United States Patent 8,969,254 (OLIGONUCLEOTIDE ARRAY FOR TISSUE TYPING) - sequence listing, part 8

SEQ ID NO: 168560 - DNA, 36 bp, Artificial Sequence
  Description of Artificial Sequence: Synthetic oligonucleotide
acaacagagtattccgaaacaccgttttcataggcc

SEQ ID NO: 168561 - DNA, 35 bp, Artificial Sequence
  Description of Artificial Sequence: Synthetic oligonucleotide
caacagagtattccgaaacaccgttttcataggcc

SEQ ID NO: 168562 - DNA, 35 bp, Artificial Sequence
  Description of Artificial Sequence: Synthetic oligonucleotide
aacagagtattccgaaacaccgttttcataggccc

SEQ ID NO: 168563 - DNA, 34 bp, Artificial Sequence
  Description of Artificial Sequence: Synthetic oligonucleotide
acagagtattccgaaacaccgttttcataggccc

SEQ ID NO: 168564 - DNA, 33 bp, Artificial Sequence
  Description of Artificial Sequence: Synthetic oligonucleotide
cagagtattccgaaacaccgttttcataggccc

SEQ ID NO: 168565 - DNA, 34 bp, Artificial Sequence
  Description of Artificial Sequence: Synthetic oligonucleotide
agagtattccgaaacaccgttttcataggccctg

SEQ ID NO: 168566 - DNA, 33 bp, Artificial Sequence
  Description of Artificial Sequence: Synthetic oligonucleotide
gagtattccgaaacaccgttttcataggccctg

SEQ ID NO: 168567 - DNA, 34 bp, Artificial Sequence
  Description of Artificial Sequence: Synthetic oligonucleotide
agtattccgaaacaccgttttcataggccctgtg

SEQ ID NO: 168568 - DNA, 33 bp, Artificial Sequence
  Description of Artificial Sequence: Synthetic oligonucleotide
gtattccgaaacaccgttttcataggccctgtg

SEQ ID NO: 168569 - DNA, 34 bp, Artificial Sequence
  Description of Artificial Sequence: Synthetic oligonucleotide
tattccgaaacaccgttttcataggccctgtgac

SEQ ID NO: 168570 - DNA, 33 bp, Artificial Sequence
  Description of Artificial Sequence: Synthetic oligonucleotide
attccgaaacaccgttttcataggccctgtgac

SEQ ID NO: 168571 - DNA, 32 bp, Artificial Sequence
  Description of Artificial Sequence: Synthetic oligonucleotide
ttccgaaacaccgttttcataggccctgtgac

SEQ ID NO: 168572 - DNA, 31 bp, Artificial Sequence
  Description of Artificial Sequence: Synthetic oligonucleotide
tccgaaacaccgttttcataggccctgtgac

SEQ ID NO: 168573 - DNA, 30 bp, Artificial Sequence
  Description of Artificial Sequence: Synthetic oligonucleotide
ccgaaacaccgttttcataggccctgtgac

SEQ ID NO: 168574 - DNA, 30 bp, Artificial Sequence
  Description of Artificial Sequence: Synthetic oligonucleotide
cgaaacaccgttttcataggccctgtgacc

SEQ ID NO: 168575 - DNA, 30 bp, Artificial Sequence
  Description of Artificial Sequence: Synthetic oligonucleotide
gaaacaccgttttcataggccctgtgaccc

SEQ ID NO: 168576 - DNA, 30 bp, Artificial Sequence
  Description of Artificial Sequence: Synthetic oligonucleotide
aaacaccgttttcataggccctgtgacccc

SEQ ID NO: 168577 - DNA, 29 bp, Artificial Sequence
  Description of Artificial Sequence: Synthetic oligonucleotide
aacaccgttttcataggccctgtgacccc

SEQ ID NO: 168578 - DNA, 28 bp, Artificial Sequence
  Description of Artificial Sequence: Synthetic oligonucleotide
acaccgttttcataggccctgtgacccc

SEQ ID NO: 168579 - DNA, 27 bp, Artificial Sequence
  Description of Artificial Sequence: Synthetic oligonucleotide
caccgttttcataggccctgtgacccc

SEQ ID NO: 168580 - DNA, 28 bp, Artificial Sequence
  Description of Artificial Sequence: Synthetic oligonucleotide
accgttttcataggccctgtgaccccag

SEQ ID NO: 168581 - DNA, 27 bp, Artificial Sequence
  Description of Artificial Sequence: Synthetic oligonucleotide
ccgttttcataggccctgtgaccccag

SEQ ID NO: 168582 - DNA, 27 bp, Artificial Sequence
  Description of Artificial Sequence: Synthetic oligonucleotide
cgttttcataggccctgtgaccccagc

SEQ ID NO: 168583 - DNA, 28 bp, Artificial Sequence
  Description of Artificial Sequence: Synthetic oligonucleotide
gttttcataggccctgtgaccccagcac

SEQ ID NO: 168584 - DNA, 30 bp, Artificial Sequence
  Description of Artificial Sequence: Synthetic oligonucleotide
ttttcataggccctgtgaccccagcacatg

SEQ ID NO: 168585 - DNA, 29 bp, Artificial Sequence
  Description of Artificial Sequence: Synthetic oligonucleotide
tttcataggccctgtgaccccagcacatg

SEQ ID NO: 168586 - DNA, 28 bp, Artificial Sequence
  Description of Artificial Sequence: Synthetic oligonucleotide
ttcataggccctgtgaccccagcacatg

SEQ ID NO: 168587 - DNA, 27 bp, Artificial Sequence
  Description of Artificial Sequence: Synthetic oligonucleotide
tcataggccctgtgaccccagcacatg

SEQ ID NO: 168588 - DNA, 26 bp, Artificial Sequence
  Description of Artificial Sequence: Synthetic oligonucleotide
cataggccctgtgaccccagcacatg

SEQ ID NO: 168589 - DNA, 27 bp, Artificial Sequence
  Description of Artificial Sequence: Synthetic oligonucleotide
ataggccctgtgaccccagcacatgca

SEQ ID NO: 168590 - DNA, 26 bp, Artificial Sequence
  Description of Artificial Sequence: Synthetic oligonucleotide
taggccctgtgaccccagcacatgca

SEQ ID NO: 168591 - DNA, 25 bp, Artificial Sequence
  Description of Artificial Sequence: Synthetic oligonucleotide
aggccctgtgaccccagcacatgca

SEQ ID NO: 168592 - DNA, 28 bp, Artificial Sequence
  Description of Artificial Sequence: Synthetic oligonucleotide
ctacagatgtcggggttcacacccacac

SEQ ID NO: 168593 - DNA, 30 bp, Artificial Sequence
  Description of Artificial Sequence: Synthetic oligonucleotide
tacagatgtcggggttcacacccacacttc

SEQ ID NO: 168594 - DNA, 29 bp, Artificial Sequence
  Description of Artificial Sequence: Synthetic oligonucleotide
acagatgtcggggttcacacccacacttc

SEQ ID NO: 168595 - DNA, 28 bp, Artificial Sequence
  Description of Artificial Sequence: Synthetic oligonucleotide
cagatgtcggggttcacacccacacttc

SEQ ID NO: 168596 - DNA, 28 bp, Artificial Sequence
  Description of Artificial Sequence: Synthetic oligonucleotide
agatgtcggggttcacacccacacttcc

SEQ ID NO: 168597 - DNA, 27 bp, Artificial Sequence
  Description of Artificial Sequence: Synthetic oligonucleotide
gatgtcggggttcacacccacacttcc

SEQ ID NO: 168598 - DNA, 28 bp, Artificial Sequence
  Description of Artificial Sequence: Synthetic oligonucleotide
atgtcggggttcacacccacacttcctc

SEQ ID NO: 168599 - DNA, 27 bp, Artificial Sequence
  Description of Artificial Sequence: Synthetic oligonucleotide
tgtcggggttcacacccacacttcctc

SEQ ID NO: 168600 - DNA, 27 bp, Artificial Sequence
  Description of Artificial Sequence: Synthetic oligonucleotide
gtcggggttcacacccacacttcctca

SEQ ID NO: 168601 - DNA, 27 bp, Artificial Sequence
  Description of Artificial Sequence: Synthetic oligonucleotide
tcggggttcacacccacacttcctcac

SEQ ID NO: 168602 - DNA, 27 bp, Artificial Sequence
  Description of Artificial Sequence: Synthetic oligonucleotide
cggggttcacacccacacttcctcact

SEQ ID NO: 168603 - DNA, 27 bp, Artificial Sequence
  Description of Artificial Sequence: Synthetic oligonucleotide
ggggttcacacccacacttcctcactg

SEQ ID NO: 168604 - DNA, 27 bp, Artificial Sequence
  Description of Artificial Sequence: Synthetic oligonucleotide
gggttcacacccacacttcctcactgg

SEQ ID NO: 168605 - DNA, 27 bp, Artificial Sequence
  Description of Artificial Sequence: Synthetic oligonucleotide
ggttcacacccacacttcctcactggg

SEQ ID NO: 168606 - DNA, 28 bp, Artificial Sequence
  Description of Artificial Sequence: Synthetic oligonucleotide
gttcacacccacacttcctcactgggtg

SEQ ID NO: 168607 - DNA, 28 bp, Artificial Sequence
  Description of Artificial Sequence: Synthetic oligonucleotide
ttcacacccacacttcctcactgggtgg

SEQ ID NO: 168608 - DNA, 27 bp, Artificial Sequence
  Description of Artificial Sequence: Synthetic oligonucleotide
tcacacccacacttcctcactgggtgg

SEQ ID NO: 168609 - DNA, 27 bp, Artificial Sequence
  Description of Artificial Sequence: Synthetic oligonucleotide
cacacccacacttcctcactgggtggt

SEQ ID NO: 168610 - DNA, 27 bp, Artificial Sequence
  Description of Artificial Sequence: Synthetic oligonucleotide
acacccacacttcctcactgggtggtc

SEQ ID NO: 168611 - DNA, 27 bp, Artificial Sequence
  Description of Artificial Sequence: Synthetic oligonucleotide
cacccacacttcctcactgggtggtca

SEQ ID NO: 168612 - DNA, 27 bp, Artificial Sequence
  Description of Artificial Sequence: Synthetic oligonucleotide
acccacacttcctcactgggtggtcag

SEQ ID NO: 168613 - DNA, 26 bp, Artificial Sequence
  Description of Artificial Sequence: Synthetic oligonucleotide
cccacacttcctcactgggtggtcag

SEQ ID NO: 168614 - DNA, 27 bp, Artificial Sequence
  Description of Artificial Sequence: Synthetic oligonucleotide
ccacacttcctcactgggtggtcagca

SEQ ID NO: 168615 - DNA, 27 bp, Artificial Sequence
  Description of Artificial Sequence: Synthetic oligonucleotide
cacacttcctcactgggtggtcagcac

SEQ ID NO: 168616 - DNA, 27 bp, Artificial Sequence
  Description of Artificial Sequence: Synthetic oligonucleotide
acacttcctcactgggtggtcagcacc

SEQ ID NO: 168617 - DNA, 26 bp, Artificial Sequence
  Description of Artificial Sequence: Synthetic oligonucleotide
cacttcctcactgggtggtcagcacc

SEQ ID NO: 168618 - DNA, 27 bp, Artificial Sequence
  Description of Artificial Sequence: Synthetic oligonucleotide
acttcctcactgggtggtcagcaccca

SEQ ID NO: 168619 - DNA, 26 bp, Artificial Sequence
  Description of Artificial Sequence: Synthetic oligonucleotide
cttcctcactgggtggtcagcaccca

SEQ ID NO: 168620 - DNA, 26 bp, Artificial Sequence
  Description of Artificial Sequence: Synthetic oligonucleotide
ttcctcactgggtggtcagcacccag

SEQ ID NO: 168621 - DNA, 25 bp, Artificial Sequence
  Description of Artificial Sequence: Synthetic oligonucleotide
tcctcactgggtggtcagcacccag

SEQ ID NO: 168622 - DNA, 24 bp, Artificial Sequence
  Description of Artificial Sequence: Synthetic oligonucleotide
cctcactgggtggtcagcacccag

SEQ ID NO: 168623 - DNA, 26 bp, Artificial Sequence
  Description of Artificial Sequence: Synthetic oligonucleotide
ctcactgggtggtcagcacccagcaa

SEQ ID NO: 168624 - DNA, 26 bp, Artificial Sequence
  Description of Artificial Sequence: Synthetic oligonucleotide
tcactgggtggtcagcacccagcaac

SEQ ID NO: 168625 - DNA, 28 bp, Artificial Sequence
  Description of Artificial Sequence: Synthetic oligonucleotide
aaccccctggtgatcatggtcacaggag

SEQ ID NO: 168626 - DNA, 27 bp, Artificial Sequence
  Description of Artificial Sequence: Synthetic oligonucleotide
accccctggtgatcatggtcacaggag

SEQ ID NO: 168627 - DNA, 27 bp, Artificial Sequence
  Description of Artificial Sequence: Synthetic oligonucleotide
ccccctggtgatcatggtcacaggagt

SEQ ID NO: 168628 - DNA, 27 bp, Artificial Sequence
  Description of Artificial Sequence: Synthetic oligonucleotide
cccctggtgatcatggtcacaggagtc

SEQ ID NO: 168629 - DNA, 27 bp, Artificial Sequence
  Description of Artificial Sequence: Synthetic oligonucleotide
ccctggtgatcatggtcacaggagtcc

SEQ ID NO: 168630 - DNA, 28 bp, Artificial Sequence
  Description of Artificial Sequence: Synthetic oligonucleotide
cctggtgatcatggtcacaggagtccac

SEQ ID NO: 168631 - DNA, 29 bp, Artificial Sequence
  Description of Artificial Sequence: Synthetic oligonucleotide
ctggtgatcatggtcacaggagtccacag

SEQ ID NO: 168632 - DNA, 34 bp, Artificial Sequence
  Description of Artificial Sequence: Synthetic oligonucleotide
cacttccttctgcacagagaggggaagtttaatg

SEQ ID NO: 168633 - DNA, 35 bp, Artificial Sequence
  Description of Artificial Sequence: Synthetic oligonucleotide
acttccttctgcacagagaggggaagtttaatgac

SEQ ID NO: 168634 - DNA, 34 bp, Artificial Sequence
  Description of Artificial Sequence: Synthetic oligonucleotide
cttccttctgcacagagaggggaagtttaatgac

SEQ ID NO: 168635 - DNA, 35 bp, Artificial Sequence
  Description of Artificial Sequence: Synthetic oligonucleotide
ttccttctgcacagagaggggaagtttaatgacac

SEQ ID NO: 168636 - DNA, 34 bp, Artificial Sequence
  Description of Artificial Sequence: Synthetic oligonucleotide
tccttctgcacagagaggggaagtttaatgacac

SEQ ID NO: 168637 - DNA, 33 bp, Artificial Sequence
  Description of Artificial Sequence: Synthetic oligonucleotide
ccttctgcacagagaggggaagtttaatgacac

SEQ ID NO: 168638 - DNA, 36 bp, Artificial Sequence
  Description of Artificial Sequence: Synthetic oligonucleotide
cttctgcacagagaggggaagtttaatgacactttg

SEQ ID NO: 168639 - DNA, 36 bp, Artificial Sequence
  Description of Artificial Sequence: Synthetic oligonucleotide
ttctgcacagagaggggaagtttaatgacactttgc

SEQ ID NO: 168640 - DNA, 35 bp, Artificial Sequence
  Description of Artificial Sequence: Synthetic oligonucleotide
tctgcacagagaggggaagtttaatgacactttgc

SEQ ID NO: 168641 - DNA, 34 bp, Artificial Sequence
  Description of Artificial Sequence: Synthetic oligonucleotide
ctgcacagagaggggaagtttaatgacactttgc

SEQ ID NO: 168642 - DNA, 34 bp, Artificial Sequence
  Description of Artificial Sequence: Synthetic oligonucleotide
tgcacagagaggggaagtttaatgacactttgcg

SEQ ID NO: 168643 - DNA, 33 bp, Artificial Sequence
  Description of Artificial Sequence: Synthetic oligonucleotide
gcacagagaggggaagtttaatgacactttgcg

SEQ ID NO: 168644 - DNA, 33 bp, Artificial Sequence
  Description of Artificial Sequence: Synthetic oligonucleotide
cacagagaggggaagtttaatgacactttgcgc

SEQ ID NO: 168645 - DNA, 33 bp, Artificial Sequence
  Description of Artificial Sequence: Synthetic oligonucleotide
acagagaggggaagtttaatgacactttgcgcc

SEQ ID NO: 168646 - DNA, 32 bp, Artificial Sequence
  Description of Artificial Sequence: Synthetic oligonucleotide
cagagaggggaagtttaatgacactttgcgcc

SEQ ID NO: 168647 - DNA, 33 bp, Artificial Sequence
  Description of Artificial Sequence: Synthetic oligonucleotide
agagaggggaagtttaatgacactttgcgcctc

SEQ ID NO: 168648 - DNA, 32 bp, Artificial Sequence
  Description of Artificial Sequence: Synthetic oligonucleotide
gagaggggaagtttaatgacactttgcgcctc

SEQ ID NO: 168649 - DNA, 33 bp, Artificial Sequence
  Description of Artificial Sequence: Synthetic oligonucleotide
agaggggaagtttaatgacactttgcgcctcac

SEQ ID NO: 168650 - DNA, 32 bp, Artificial Sequence
  Description of Artificial Sequence: Synthetic oligonucleotide
gaggggaagtttaatgacactttgcgcctcac

SEQ ID NO: 168651 - DNA, 33 bp, Artificial Sequence
  Description of Artificial Sequence: Synthetic oligonucleotide
aggggaagtttaatgacactttgcgcctcactg

SEQ ID NO: 168652 - DNA, 32 bp, Artificial Sequence
  Description of Artificial Sequence: Synthetic oligonucleotide
ggggaagtttaatgacactttgcgcctcactg

SEQ ID NO: 168653 - DNA, 32 bp, Artificial Sequence
  Description of Artificial Sequence: Synthetic oligonucleotide
gggaagtttaatgacactttgcgcctcactgg

SEQ ID NO: 168654 - DNA, 33 bp, Artificial Sequence
  Description of Artificial Sequence: Synthetic oligonucleotide
ggaagtttaatgacactttgcgcctcactggag

SEQ ID NO: 168655 - DNA, 34 bp, Artificial Sequence
  Description of Artificial Sequence: Synthetic oligonucleotide
gaagtttaatgacactttgcgcctcactggagag

SEQ ID NO: 168656 - DNA, 34 bp, Artificial Sequence
  Description of Artificial Sequence: Synthetic oligonucleotide
aagtttaatgacactttgcgcctcactggagagc

SEQ ID NO: 168657 - DNA, 33 bp, Artificial Sequence
  Description of Artificial Sequence: Synthetic oligonucleotide
agtttaatgacactttgcgcctcactggagagc

SEQ ID NO: 168658 - DNA, 32 bp, Artificial Sequence
  Description of Artificial Sequence: Synthetic oligonucleotide
gtttaatgacactttgcgcctcactggagagc

SEQ ID NO: 168659 - DNA, 33 bp, Artificial Sequence
  Description of Artificial Sequence: Synthetic oligonucleotide
tttaatgacactttgcgcctcactggagagctc

SEQ ID NO: 168660 - DNA, 32 bp, Artificial Sequence
  Description of Artificial Sequence: Synthetic oligonucleotide
ttaatgacactttgcgcctcactggagagctc

SEQ ID NO: 168661 - DNA, 31 bp, Artificial Sequence
  Description of Artificial Sequence: Synthetic oligonucleotide
taatgacactttgcgcctcactggagagctc

SEQ ID NO: 168662 - DNA, 30 bp, Artificial Sequence
  Description of Artificial Sequence: Synthetic oligonucleotide
aatgacactttgcgcctcactggagagctc

SEQ ID NO: 168663 - DNA, 29 bp, Artificial Sequence
  Description of Artificial Sequence: Synthetic oligonucleotide
atgacactttgcgcctcactggagagctc

SEQ ID NO: 168664 - DNA, 28 bp, Artificial Sequence
  Description of Artificial Sequence: Synthetic oligonucleotide
tgacactttgcgcctcactggagagctc

SEQ ID NO: 168665 - DNA, 27 bp, Artificial Sequence
  Description of Artificial Sequence: Synthetic oligonucleotide
gacactttgcgcctcactggagagctc

SEQ ID NO: 168666 - DNA, 27 bp, Artificial Sequence
  Description of Artificial Sequence: Synthetic oligonucleotide
acactttgcgcctcactggagagctcc

SEQ ID NO: 168667 - DNA, 27 bp, Artificial Sequence
  Description of Artificial Sequence: Synthetic oligonucleotide
cactttgcgcctcactggagagctcca

SEQ ID NO: 168668 - DNA, 28 bp, Artificial Sequence
  Description of Artificial Sequence: Synthetic oligonucleotide
actttgcgcctcactggagagctccatg

SEQ ID NO: 168669 - DNA, 27 bp, Artificial Sequence
  Description of Artificial Sequence: Synthetic oligonucleotide
ctttgcgcctcactggagagctccatg

SEQ ID NO: 168670 - DNA, 29 bp, Artificial Sequence
  Description of Artificial Sequence: Synthetic oligonucleotide
tttgcgcctcactggagagctccatgatg

SEQ ID NO: 168671 - DNA, 28 bp, Artificial Sequence
  Description of Artificial Sequence: Synthetic oligonucleotide
ttgcgcctcactggagagctccatgatg

SEQ ID NO: 168672 - DNA, 27 bp, Artificial Sequence
  Description of Artificial Sequence: Synthetic oligonucleotide
tgcgcctcactggagagctccatgatg

SEQ ID NO: 168673 - DNA, 26 bp, Artificial Sequence
  Description of Artificial Sequence: Synthetic oligonucleotide
gcgcctcactggagagctccatgatg

SEQ ID NO: 168674 - DNA, 26 bp, Artificial Sequence
  Description of Artificial Sequence: Synthetic oligonucleotide
cgcctcactggagagctccatgatgg

SEQ ID NO: 168675 - DNA, 26 bp, Artificial Sequence
  Description of Artificial Sequence: Synthetic oligonucleotide
gcctcactggagagctccatgatggg

SEQ ID NO: 168676 - DNA, 27 bp, Artificial Sequence
  Description of Artificial Sequence: Synthetic oligonucleotide
cctcactggagagctccatgatggggt

SEQ ID NO: 168677 - DNA, 27 bp, Artificial Sequence
  Description of Artificial Sequence: Synthetic oligonucleotide
ctcactggagagctccatgatggggtc

SEQ ID NO: 168678 - DNA, 28 bp, Artificial Sequence
  Description of Artificial Sequence: Synthetic oligonucleotide
tcactggagagctccatgatggggtctc

SEQ ID NO: 168679 - DNA, 27 bp, Artificial Sequence
  Description of Artificial Sequence: Synthetic oligonucleotide
cactggagagctccatgatggggtctc

SEQ ID NO: 168680 - DNA, 27 bp, Artificial Sequence
  Description of Artificial Sequence: Synthetic oligonucleotide
actggagagctccatgatggggtctcc

SEQ ID NO: 168681 - DNA, 27 bp, Artificial Sequence
  Description of Artificial Sequence: Synthetic oligonucleotide
ctggagagctccatgatggggtctcca

SEQ ID NO: 168682 - DNA, 28 bp, Artificial Sequence
  Description of Artificial Sequence: Synthetic oligonucleotide
tggagagctccatgatggggtctccaag

SEQ ID NO: 168683 - DNA, 27 bp, Artificial Sequence
  Description of Artificial Sequence: Synthetic oligonucleotide
ggagagctccatgatggggtctccaag

SEQ ID NO: 168684 - DNA, 27 bp, Artificial Sequence
  Description of Artificial Sequence: Synthetic oligonucleotide
gagagctccatgatggggtctccaagg

SEQ ID NO: 168685 - DNA, 27 bp, Artificial Sequence
  Description of Artificial Sequence: Synthetic oligonucleotide
agagctccatgatggggtctccaaggc

SEQ ID NO: 168686 - DNA, 26 bp, Artificial Sequence
  Description of Artificial Sequence: Synthetic oligonucleotide
gagctccatgatggggtctccaaggc

SEQ ID NO: 168687 - DNA, 27 bp, Artificial Sequence
  Description of Artificial Sequence: Synthetic oligonucleotide
agctccatgatggggtctccaaggcca

SEQ ID NO: 168688 - DNA, 27 bp, Artificial Sequence
  Description of Artificial Sequence: Synthetic oligonucleotide
gctccatgatggggtctccaaggccaa

SEQ ID NO: 168689 - DNA, 27 bp, Artificial Sequence
  Description of Artificial Sequence: Synthetic oligonucleotide
ctccatgatggggtctccaaggccaac

SEQ ID NO: 168690 - DNA, 29 bp, Artificial Sequence
  Description of Artificial Sequence: Synthetic oligonucleotide
aaggccaacttctccatcggtcgcatgac

SEQ ID NO: 168691 - DNA, 28 bp, Artificial Sequence
  Description of Artificial Sequence: Synthetic oligonucleotide
aggccaacttctccatcggtcgcatgac

SEQ ID NO: 168692 - DNA, 27 bp, Artificial Sequence
  Description of Artificial Sequence: Synthetic oligonucleotide
ggccaacttctccatcggtcgcatgac

SEQ ID NO: 168693 - DNA, 27 bp, Artificial Sequence
  Description of Artificial Sequence: Synthetic oligonucleotide
gccaacttctccatcggtcgcatgacg

SEQ ID NO: 168694 - DNA, 27 bp, Artificial Sequence
  Description of Artificial Sequence: Synthetic oligonucleotide
ccaacttctccatcggtcgcatgacgc

SEQ ID NO: 168695 - DNA, 29 bp, Artificial Sequence
  Description of Artificial Sequence: Synthetic oligonucleotide
caacttctccatcggtcgcatgacgcaag

SEQ ID NO: 168696 - DNA, 30 bp, Artificial Sequence
  Description of Artificial Sequence: Synthetic oligonucleotide
aacttctccatcggtcgcatgacgcaagac

SEQ ID NO: 168697 - DNA, 29 bp, Artificial Sequence
  Description of Artificial Sequence: Synthetic oligonucleotide
acttctccatcggtcgcatgacgcaagac

SEQ ID NO: 168698 - DNA, 28 bp, Artificial Sequence
  Description of Artificial Sequence: Synthetic oligonucleotide
cttctccatcggtcgcatgacgcaagac

SEQ ID NO: 168699 - DNA, 28 bp, Artificial Sequence
  Description of Artificial Sequence: Synthetic oligonucleotide
ttctccatcggtcgcatgacgcaagacc

SEQ ID NO: 168700 - DNA, 27 bp, Artificial Sequence
  Description of Artificial Sequence: Synthetic oligonucleotide
tctccatcggtcgcatgacgcaagacc

SEQ ID NO: 168701 - DNA, 27 bp, Artificial Sequence
  Description of Artificial Sequence: Synthetic oligonucleotide
ctccatcggtcgcatgacgcaagacct

SEQ ID NO: 168702 - DNA, 28 bp, Artificial Sequence
  Description of Artificial Sequence: Synthetic oligonucleotide
tccatcggtcgcatgacgcaagaccttg

SEQ ID NO: 168703 - DNA, 27 bp, Artificial Sequence
  Description of Artificial Sequence: Synthetic oligonucleotide
ccatcggtcgcatgacgcaagaccttg

SEQ ID NO: 168704 - DNA, 27 bp, Artificial Sequence
  Description of Artificial Sequence: Synthetic oligonucleotide
catcggtcgcatgacgcaagaccttgc

SEQ ID NO: 168705 - DNA, 28 bp, Artificial Sequence
  Description of Artificial Sequence: Synthetic oligonucleotide
atcggtcgcatgacgcaagaccttgcag

SEQ ID NO: 168706 - DNA, 27 bp, Artificial Sequence
  Description of Artificial Sequence: Synthetic oligonucleotide
tcggtcgcatgacgcaagaccttgcag

SEQ ID NO: 168707 - DNA, 26 bp, Artificial Sequence
  Description of Artificial Sequence: Synthetic oligonucleotide
cggtcgcatgacgcaagaccttgcag

SEQ ID NO: 168708 - DNA, 26 bp, Artificial Sequence
  Description of Artificial Sequence: Synthetic oligonucleotide
ggtcgcatgacgcaagaccttgcagg

SEQ ID NO: 168709 - DNA, 27 bp, Artificial Sequence
  Description of Artificial Sequence: Synthetic oligonucleotide
gtcgcatgacgcaagaccttgcaggga

SEQ ID NO: 168710 - DNA, 27 bp, Artificial Sequence
  Description of Artificial Sequence: Synthetic oligonucleotide
tcgcatgacgcaagaccttgcagggac

SEQ ID NO: 168711 - DNA, 26 bp, Artificial Sequence
  Description of Artificial Sequence: Synthetic oligonucleotide
cgcatgacgcaagaccttgcagggac

SEQ ID NO: 168712 - DNA, 27 bp, Artificial Sequence
  Description of Artificial Sequence: Synthetic oligonucleotide
gcatgacgcaagaccttgcagggacct

SEQ ID NO: 168713 - DNA, 28 bp, Artificial Sequence
  Description of Artificial Sequence: Synthetic oligonucleotide
catgacgcaagaccttgcagggacctac

SEQ ID NO: 168714 - DNA, 29 bp, Artificial Sequence
  Description of Artificial Sequence: Synthetic oligonucleotide
atgacgcaagaccttgcagggacctacag

SEQ ID NO: 168715 - DNA, 28 bp, Artificial Sequence
  Description of Artificial Sequence: Synthetic oligonucleotide
tgacgcaagaccttgcagggacctacag

SEQ ID NO: 168716 - DNA, 27 bp, Artificial Sequence
  Description of Artificial Sequence: Synthetic oligonucleotide
gacgcaagaccttgcagggacctacag

SEQ ID NO: 168717 - DNA, 29 bp, Artificial Sequence
  Description of Artificial Sequence: Synthetic oligonucleotide
acgcaagaccttgcagggacctacagatg

SEQ ID NO: 168718 - DNA, 28 bp, Artificial Sequence
  Description of Artificial Sequence: Synthetic oligonucleotide
cgcaagaccttgcagggacctacagatg

SEQ ID NO: 168719 - DNA, 33 bp, Artificial Sequence
  Description of Artificial Sequence: Synthetic oligonucleotide
gacctacagatgctacggttctgttcctcattc

SEQ ID NO: 168720 - DNA, 33 bp, Artificial Sequence
  Description of Artificial Sequence: Synthetic oligonucleotide
acctacagatgctacggttctgttcctcattcc

SEQ ID NO: 168721 - DNA, 32 bp, Artificial Sequence
  Description of Artificial Sequence: Synthetic oligonucleotide
cctacagatgctacggttctgttcctcattcc

SEQ ID NO: 168722 - DNA, 32 bp, Artificial Sequence
  Description of Artificial Sequence: Synthetic oligonucleotide
ctacagatgctacggttctgttcctcattccc

SEQ ID NO: 168723 - DNA, 32 bp, Artificial Sequence
  Description of Artificial Sequence: Synthetic oligonucleotide
tacagatgctacggttctgttcctcattcccc

SEQ ID NO: 168724 - DNA, 31 bp, Artificial Sequence
  Description of Artificial Sequence: Synthetic oligonucleotide
acagatgctacggttctgttcctcattcccc

SEQ ID NO: 168725 - DNA, 30 bp, Artificial Sequence
  Description of Artificial Sequence: Synthetic oligonucleotide
cagatgctacggttctgttcctcattcccc

SEQ ID NO: 168726 - DNA, 30 bp, Artificial Sequence
  Description of Artificial Sequence: Synthetic oligonucleotide
agatgctacggttctgttcctcattccccc

SEQ ID NO: 168727 - DNA, 29 bp, Artificial Sequence
  Description of Artificial Sequence: Synthetic oligonucleotide
gatgctacggttctgttcctcattccccc

SEQ ID NO: 168728 - DNA, 32 bp, Artificial Sequence
  Description of Artificial Sequence: Synthetic oligonucleotide
atgctacggttctgttcctcattccccctatc

SEQ ID NO: 168729 - DNA, 31 bp, Artificial Sequence
  Description of Artificial Sequence: Synthetic oligonucleotide
tgctacggttctgttcctcattccccctatc

SEQ ID NO: 168730 - DNA, 30 bp, Artificial Sequence
  Description of Artificial Sequence: Synthetic oligonucleotide
gctacggttctgttcctcattccccctatc

SEQ ID NO: 168731 - DNA, 31 bp, Artificial Sequence
  Description of Artificial Sequence: Synthetic oligonucleotide
ctacggttctgttcctcattccccctatcag

SEQ ID NO: 168732 - DNA, 33 bp, Artificial Sequence
  Description of Artificial Sequence: Synthetic oligonucleotide
tacggttctgttcctcattccccctatcagttg

SEQ ID NO: 168733 - DNA, 32 bp, Artificial Sequence
  Description of Artificial Sequence: Synthetic oligonucleotide
acggttctgttcctcattccccctatcagttg

SEQ ID NO: 168734 - DNA, 31 bp, Artificial Sequence
  Description of Artificial Sequence: Synthetic oligonucleotide
cggttctgttcctcattccccctatcagttg

SEQ ID NO: 168735 - DNA, 32 bp, Artificial Sequence
  Description of Artificial Sequence: Synthetic oligonucleotide
ggttctgttcctcattccccctatcagttgtc

SEQ ID NO: 168736 - DNA, 33 bp, Artificial Sequence
  Description of Artificial Sequence: Synthetic oligonucleotide
gttctgttcctcattccccctatcagttgtcag

SEQ ID NO: 168737 - DNA, 33 bp, Artificial Sequence
  Description of Artificial Sequence: Synthetic oligonucleotide
ttctgttcctcattccccctatcagttgtcagc

SEQ ID NO: 168738 - DNA, 32 bp, Artificial Sequence
  Description of Artificial Sequence: Synthetic oligonucleotide
tctgttcctcattccccctatcagttgtcagc

SEQ ID NO: 168739 - DNA, 31 bp, Artificial Sequence
  Description of Artificial Sequence: Synthetic oligonucleotide
ctgttcctcattccccctatcagttgtcagc

SEQ ID NO: 168740 - DNA, 32 bp, Artificial Sequence
  Description of Artificial Sequence: Synthetic oligonucleotide
tgttcctcattccccctatcagttgtcagctc

SEQ ID NO: 168741 - DNA, 31 bp, Artificial Sequence
  Description of Artificial Sequence: Synthetic oligonucleotide
gttcctcattccccctatcagttgtcagctc

SEQ ID NO: 168742 - DNA, 31 bp, Artificial Sequence
  Description of Artificial Sequence: Synthetic oligonucleotide
ttcctcattccccctatcagttgtcagctcc

SEQ ID NO: 168743 - DNA, 30 bp, Artificial Sequence
  Description of Artificial Sequence: Synthetic oligonucleotide
tcctcattccccctatcagttgtcagctcc

SEQ ID NO: 168744 - DNA, 29 bp, Artificial Sequence
  Description of Artificial Sequence: Synthetic oligonucleotide
cctcattccccctatcagttgtcagctcc

SEQ ID NO: 168745 - DNA, 29 bp, Artificial Sequence
  Description of Artificial Sequence: Synthetic oligonucleotide
ctcattccccctatcagttgtcagctccc

SEQ ID NO: 168746 - DNA, 30 bp, Artificial Sequence
  Description of Artificial Sequence: Synthetic oligonucleotide
tcattccccctatcagttgtcagctcccag

SEQ ID NO: 168747 - DNA, 29 bp, Artificial Sequence
  Description of Artificial Sequence: Synthetic oligonucleotide
cattccccctatcagttgtcagctcccag

SEQ ID NO: 168748 - DNA, 30 bp, Artificial Sequence
  Description of Artificial Sequence: Synthetic oligonucleotide
attccccctatcagttgtcagctcccagtg

SEQ ID NO: 168749 - DNA, 29 bp, Artificial Sequence
  Description of Artificial Sequence: Synthetic oligonucleotide
ttccccctatcagttgtcagctcccagtg

SEQ ID NO: 168750 - DNA, 30 bp, Artificial Sequence
  Description of Artificial Sequence: Synthetic oligonucleotide
tcccagtgaccctctggacatcgtgattac

SEQ ID NO: 168751 - DNA, 29 bp, Artificial Sequence
  Description of Artificial Sequence: Synthetic oligonucleotide
cccagtgaccctctggacatcgtgattac

SEQ ID NO: 168752 - DNA, 30 bp, Artificial Sequence
  Description of Artificial Sequence: Synthetic oligonucleotide
ccagtgaccctctggacatcgtgattacag

SEQ ID NO: 168753 - DNA, 30 bp, Artificial Sequence
  Description of Artificial Sequence: Synthetic oligonucleotide
cagtgaccctctggacatcgtgattacagg

SEQ ID NO: 168754 - DNA, 31 bp, Artificial Sequence
  Description of Artificial Sequence: Synthetic oligonucleotide
agtgaccctctggacatcgtgattacaggtc

SEQ ID NO: 168755 - DNA, 30 bp, Artificial Sequence
  Description of Artificial Sequence: Synthetic oligonucleotide
gtgaccctctggacatcgtgattacaggtc

SEQ ID NO: 168756 - DNA, 33 bp, Artificial Sequence
  Description of Artificial Sequence: Synthetic oligonucleotide
tgaccctctggacatcgtgattacaggtctatg

SEQ ID NO: 168757 - DNA, 32 bp, Artificial Sequence
  Description of Artificial Sequence: Synthetic oligonucleotide
gaccctctggacatcgtgattacaggtctatg

SEQ ID NO: 168758 - DNA, 33 bp, Artificial Sequence
  Description of Artificial Sequence: Synthetic oligonucleotide
accctctggacatcgtgattacaggtctatgtg

SEQ ID NO: 168759 - DNA, 32 bp, Artificial Sequence
  Description of Artificial Sequence: Synthetic oligonucleotide
ccctctggacatcgtgattacaggtctatgtg

SEQ ID NO: 168760 - DNA, 32 bp, Artificial Sequence
  Description of Artificial Sequence: Synthetic oligonucleotide
cctctggacatcgtgattacaggtctatgtgg

SEQ ID NO: 168761 - DNA, 32 bp, Artificial Sequence
  Description of Artificial Sequence: Synthetic oligonucleotide
ctctggacatcgtgattacaggtctatgtggg

SEQ ID NO: 168762 - DNA, 35 bp, Artificial Sequence
  Description of Artificial Sequence: Synthetic oligonucleotide
tctggacatcgtgattacaggtctatgtgggaaac

SEQ ID NO: 168763 - DNA, 34 bp, Artificial Sequence
  Description of Artificial Sequence: Synthetic oligonucleotide
ctggacatcgtgattacaggtctatgtgggaaac

SEQ ID NO: 168764 - DNA, 34 bp, Artificial Sequence
  Description of Artificial Sequence: Synthetic oligonucleotide
tggacatcgtgattacaggtctatgtgggaaacc

SEQ ID NO: 168765 - DNA, 33 bp, Artificial Sequence
  Description of Artificial Sequence: Synthetic oligonucleotide
ggacatcgtgattacaggtctatgtgggaaacc

SEQ ID NO: 168766 - DNA, 35 bp, Artificial Sequence
  Description of Artificial Sequence: Synthetic oligonucleotide
gacatcgtgattacaggtctatgtgggaaaccttc

SEQ ID NO: 168767 - DNA, 36 bp, Artificial Sequence
  Description of Artificial Sequence: Synthetic oligonucleotide
acatcgtgattacaggtctatgtgggaaaccttctc

SEQ ID NO: 168768 - DNA, 35 bp, Artificial Sequence
  Description of Artificial Sequence: Synthetic oligonucleotide
catcgtgattacaggtctatgtgggaaaccttctc

SEQ ID NO: 168769 - DNA, 36 bp, Artificial Sequence
  Description of Artificial Sequence: Synthetic oligonucleotide
atcgtgattacaggtctatgtgggaaaccttctctc

SEQ ID NO: 168770 - DNA, 35 bp, Artificial Sequence
  Description of Artificial Sequence: Synthetic oligonucleotide
tcgtgattacaggtctatgtgggaaaccttctctc

SEQ ID NO: 168771 - DNA, 34 bp, Artificial Sequence
  Description of Artificial Sequence: Synthetic oligonucleotide
cgtgattacaggtctatgtgggaaaccttctctc

SEQ ID NO: 168772 - DNA, 35 bp, Artificial Sequence
  Description of Artificial Sequence: Synthetic oligonucleotide
gtgattacaggtctatgtgggaaaccttctctctc

SEQ ID NO: 168773 - DNA, 36 bp, Artificial Sequence
  Description of Artificial Sequence: Synthetic oligonucleotide
tgattacaggtctatgtgggaaaccttctctctcag

SEQ ID NO: 168774 - DNA, 35 bp, Artificial Sequence
  Description of Artificial Sequence: Synthetic oligonucleotide
gattacaggtctatgtgggaaaccttctctctcag

SEQ ID NO: 168775 - DNA, 35 bp, Artificial Sequence
  Description of Artificial Sequence: Synthetic oligonucleotide
attacaggtctatgtgggaaaccttctctctcagc

SEQ ID NO: 168776 - DNA, 34 bp, Artificial Sequence
  Description of Artificial Sequence: Synthetic oligonucleotide
ttacaggtctatgtgggaaaccttctctctcagc

SEQ ID NO: 168777 - DNA, 33 bp, Artificial Sequence
  Description of Artificial Sequence: Synthetic oligonucleotide
tacaggtctatgtgggaaaccttctctctcagc

SEQ ID NO: 168778 - DNA, 32 bp, Artificial Sequence
  Description of Artificial Sequence: Synthetic oligonucleotide
acaggtctatgtgggaaaccttctctctcagc

SEQ ID NO: 168779 - DNA, 31 bp, Artificial Sequence
  Description of Artificial Sequence: Synthetic oligonucleotide
caggtctatgtgggaaaccttctctctcagc

SEQ ID NO: 168780 - DNA, 31 bp, Artificial Sequence
  Description of Artificial Sequence: Synthetic oligonucleotide
aggtctatgtgggaaaccttctctctcagcc

SEQ ID NO: 168781 - DNA, 30 bp, Artificial Sequence
  Description of Artificial Sequence: Synthetic oligonucleotide
ggtctatgtgggaaaccttctctctcagcc

SEQ ID NO: 168782 - DNA, 30 bp, Artificial Sequence
  Description of Artificial Sequence: Synthetic oligonucleotide
gtctatgtgggaaaccttctctctcagccc

SEQ ID NO: 168783 - DNA, 31 bp, Artificial Sequence
  Description of Artificial Sequence: Synthetic oligonucleotide
tctatgtgggaaaccttctctctcagcccag

SEQ ID NO: 168784 - DNA, 30 bp, Artificial Sequence
  Description of Artificial Sequence: Synthetic oligonucleotide
ctatgtgggaaaccttctctctcagcccag

SEQ ID NO: 168785 - DNA, 30 bp, Artificial Sequence
  Description of Artificial Sequence: Synthetic oligonucleotide
tatgtgggaaaccttctctctcagcccagc

SEQ ID NO: 168786 - DNA, 29 bp, Artificial Sequence
  Description of Artificial Sequence: Synthetic oligonucleotide
atgtgggaaaccttctctctcagcccagc

SEQ ID NO: 168787 - DNA, 28 bp, Artificial Sequence
  Description of Artificial Sequence: Synthetic oligonucleotide
tgtgggaaaccttctctctcagcccagc

SEQ ID NO: 168788 - DNA, 27 bp, Artificial Sequence
  Description of Artificial Sequence: Synthetic oligonucleotide
gtgggaaaccttctctctcagcccagc

SEQ ID NO: 168789 - DNA, 26 bp, Artificial Sequence
  Description of Artificial Sequence: Synthetic oligonucleotide
gaaaccttctctctcagcccagccgc

SEQ ID NO: 168790 - DNA, 26 bp, Artificial Sequence
  Description of Artificial Sequence: Synthetic oligonucleotide
aaaccttctctctcagcccagccgcg

SEQ ID NO: 168791 - DNA, 25 bp, Artificial Sequence
  Description of Artificial Sequence: Synthetic oligonucleotide
aaccttctctctcagcccagccgcg

SEQ ID NO: 168792 - DNA, 24 bp, Artificial Sequence
  Description of Artificial Sequence: Synthetic oligonucleotide
accttctctctcagcccagccgcg

SEQ ID NO: 168793 - DNA, 23 bp, Artificial Sequence
  Description of Artificial Sequence: Synthetic oligonucleotide
ccttctctctcagcccagccgcg

SEQ ID NO: 168794 - DNA, 23 bp, Artificial Sequence
  Description of Artificial Sequence: Synthetic oligonucleotide
cttctctctcagcccagccgcgc

SEQ ID NO: 168795 - DNA, 23 bp, Artificial Sequence
  Description of Artificial Sequence: Synthetic oligonucleotide
ttctctctcagcccagccgcgcc

SEQ ID NO: 168796 - DNA, 22 bp, Artificial Sequence
  Description of Artificial Sequence: Synthetic oligonucleotide
tctctctcagcccagccgcgcc

SEQ ID NO: 168797 - DNA, 21 bp, Artificial Sequence
  Description of Artificial Sequence: Synthetic oligonucleotide
ctctctcagcccagccgcgcc

SEQ ID NO: 168798 - DNA, 21 bp, Artificial Sequence
  Description of Artificial Sequence: Synthetic oligonucleotide
tctctcagcccagccgcgccc

SEQ ID NO: 168799 - DNA, 20 bp, Artificial Sequence
  Description of Artificial Sequence: Synthetic oligonucleotide
ctctcagcccagccgcgccc

SEQ ID NO: 168800 - DNA, 22 bp, Artificial Sequence
  Description of Artificial Sequence: Synthetic oligonucleotide
tctcagcccagccgcgccccat

SEQ ID NO: 168801 - DNA, 21 bp, Artificial Sequence
  Description of Artificial Sequence: Synthetic oligonucleotide
ctcagcccagccgcgccccat

SEQ ID NO: 168802 - DNA, 21 bp, Artificial Sequence
  Description of Artificial Sequence: Synthetic oligonucleotide
tcagcccagccgcgccccatg

SEQ ID NO: 168803 - DNA, 20 bp, Artificial Sequence
  Description of Artificial Sequence: Synthetic oligonucleotide
cagcccagccgcgccccatg

SEQ ID NO: 168804 - DNA, 24 bp, Artificial Sequence
  Description of Artificial Sequence: Synthetic oligonucleotide
agcccagccgcgccccatggttaa

SEQ ID NO: 168805 - DNA, 23 bp, Artificial Sequence
  Description of Artificial Sequence: Synthetic oligonucleotide
gcccagccgcgccccatggttaa

SEQ ID NO: 168806 - DNA, 23 bp, Artificial Sequence
  Description of Artificial Sequence: Synthetic oligonucleotide
cccagccgcgccccatggttaag

SEQ ID NO: 168807 - DNA, 23 bp, Artificial Sequence
  Description of Artificial Sequence: Synthetic oligonucleotide
ccagccgcgccccatggttaagg

SEQ ID NO: 168808 - DNA, 24 bp, Artificial Sequence
  Description of Artificial Sequence: Synthetic oligonucleotide
cagccgcgccccatggttaaggca

SEQ ID NO: 168809 - DNA, 24 bp, Artificial Sequence
  Description of Artificial Sequence: Synthetic oligonucleotide
agccgcgccccatggttaaggcag

SEQ ID NO: 168810 - DNA, 23 bp, Artificial Sequence
  Description of Artificial Sequence: Synthetic oligonucleotide
gccgcgccccatggttaaggcag

SEQ ID NO: 168811 - DNA, 24 bp, Artificial Sequence
  Description of Artificial Sequence: Synthetic oligonucleotide
ccgcgccccatggttaaggcagga

SEQ ID NO: 168812 - DNA, 25 bp, Artificial Sequence
  Description of Artificial Sequence: Synthetic oligonucleotide
cgcgccccatggttaaggcaggaga

SEQ ID NO: 168813 - DNA, 26 bp, Artificial Sequence
  Description of Artificial Sequence: Synthetic oligonucleotide
gcgccccatggttaaggcaggagaga

SEQ ID NO: 168814 - DNA, 26 bp, Artificial Sequence
  Description of Artificial Sequence: Synthetic oligonucleotide
cgccccatggttaaggcaggagagag

SEQ ID NO: 168815 - DNA, 26 bp, Artificial Sequence
  Description of Artificial Sequence: Synthetic oligonucleotide
gccccatggttaaggcaggagagagc

SEQ ID NO: 168816 - DNA, 27 bp, Artificial Sequence
  Description of Artificial Sequence: Synthetic oligonucleotide
ccccatggttaaggcaggagagagcgt

SEQ ID NO: 168817 - DNA, 27 bp, Artificial Sequence
  Description of Artificial Sequence: Synthetic oligonucleotide
cccatggttaaggcaggagagagcgtg

SEQ ID NO: 168818 - DNA, 28 bp, Artificial Sequence
  Description of Artificial Sequence: Synthetic oligonucleotide
ccatggttaaggcaggagagagcgtgac

SEQ ID NO: 168819 - DNA, 28 bp, Artificial Sequence
  Description of Artificial Sequence: Synthetic oligonucleotide
catggttaaggcaggagagagcgtgacc

SEQ ID NO: 168820 - DNA, 30 bp, Artificial Sequence
  Description of Artificial Sequence: Synthetic oligonucleotide
atggttaaggcaggagagagcgtgaccttg

SEQ ID NO: 168821 - DNA, 29 bp, Artificial Sequence
  Description of Artificial Sequence: Synthetic oligonucleotide
tggttaaggcaggagagagcgtgaccttg

SEQ ID NO: 168822 - DNA, 28 bp, Artificial Sequence
  Description of Artificial Sequence: Synthetic oligonucleotide
ggttaaggcaggagagagcgtgaccttg

SEQ ID NO: 168823 - DNA, 29 bp, Artificial Sequence
  Description of Artificial Sequence: Synthetic oligonucleotide
gttaaggcaggagagagcgtgaccttgtc

SEQ ID NO: 168824 - DNA, 29 bp, Artificial Sequence
  Description of Artificial Sequence: Synthetic oligonucleotide
ttaaggcaggagagagcgtgaccttgtcc

SEQ ID NO: 168825 - DNA, 28 bp, Artificial Sequence
  Description of Artificial Sequence: Synthetic oligonucleotide
taaggcaggagagagcgtgaccttgtcc

SEQ ID NO: 168826 - DNA, 27 bp, Artificial Sequence
  Description of Artificial Sequence: Synthetic oligonucleotide
aaggcaggagagagcgtgaccttgtcc

SEQ ID NO: 168827 - DNA, 27 bp, Artificial Sequence
  Description of Artificial Sequence: Synthetic oligonucleotide
tgcagctcccggagctcctatgacatc

SEQ ID NO: 168828 - DNA, 27 bp, Artificial Sequence
  Description of Artificial Sequence: Synthetic oligonucleotide
gcagctcccggagctcctatgacatct

SEQ ID NO: 168829 - DNA, 28 bp, Artificial Sequence
  Description of Artificial Sequence: Synthetic oligonucleotide
cagctcccggagctcctatgacatctac

SEQ ID NO: 168830 - DNA, 28 bp, Artificial Sequence
  Description of Artificial Sequence: Synthetic oligonucleotide
agctcccggagctcctatgacatctacc

SEQ ID NO: 168831 - DNA, 27 bp, Artificial Sequence
  Description of Artificial Sequence: Synthetic oligonucleotide
gctcccggagctcctatgacatctacc

SEQ ID NO: 168832 - DNA, 29 bp, Artificial Sequence
  Description of Artificial Sequence: Synthetic oligonucleotide
ctcccggagctcctatgacatctaccatc

SEQ ID NO: 168833 - DNA, 32 bp, Artificial Sequence
  Description of Artificial Sequence: Synthetic oligonucleotide
tcccggagctcctatgacatctaccatctatc

SEQ ID NO: 168834 - DNA, 31 bp, Artificial Sequence
  Description of Artificial Sequence: Synthetic oligonucleotide
cccggagctcctatgacatctaccatctatc

SEQ ID NO: 168835 - DNA, 33 bp, Artificial Sequence
  Description of Artificial Sequence: Synthetic oligonucleotide
ccggagctcctatgacatctaccatctatcaag

SEQ ID NO: 168836 - DNA, 33 bp, Artificial Sequence
  Description of Artificial Sequence: Synthetic oligonucleotide
cggagctcctatgacatctaccatctatcaagg

SEQ ID NO: 168837 - DNA, 33 bp, Artificial Sequence
  Description of Artificial Sequence: Synthetic oligonucleotide
ggagctcctatgacatctaccatctatcaaggg

SEQ ID NO: 168838 - DNA, 34 bp, Artificial Sequence
  Description of Artificial Sequence: Synthetic oligonucleotide
gagctcctatgacatctaccatctatcaagggag

SEQ ID NO: 168839 - DNA, 34 bp, Artificial Sequence
  Description of Artificial Sequence: Synthetic oligonucleotide
agctcctatgacatctaccatctatcaagggagg

SEQ ID NO: 168840 - DNA, 33 bp, Artificial Sequence
  Description of Artificial Sequence: Synthetic oligonucleotide
gctcctatgacatctaccatctatcaagggagg

SEQ ID NO: 168841 - DNA, 33 bp, Artificial Sequence
  Description of Artificial Sequence: Synthetic oligonucleotide
ctcctatgacatctaccatctatcaagggaggg

SEQ ID NO: 168842 - DNA, 33 bp, Artificial Sequence
  Description of Artificial Sequence: Synthetic oligonucleotide
tcctatgacatctaccatctatcaagggagggg

SEQ ID NO: 168843 - DNA, 32 bp, Artificial Sequence
  Description of Artificial Sequence: Synthetic oligonucleotide
cctatgacatctaccatctatcaagggagggg

SEQ ID NO: 168844 - DNA, 32 bp, Artificial Sequence
  Description of Artificial Sequence: Synthetic oligonucleotide
ctatgacatctaccatctatcaagggaggggg

SEQ ID NO: 168845 - DNA, 33 bp, Artificial Sequence
  Description of Artificial Sequence: Synthetic oligonucleotide
tatgacatctaccatctatcaagggagggggag

SEQ ID NO: 168846 - DNA, 32 bp, Artificial Sequence
  Description of Artificial Sequence: Synthetic oligonucleotide
atgacatctaccatctatcaagggagggggag

SEQ ID NO: 168847 - DNA, 31 bp, Artificial Sequence
  Description of Artificial Sequence: Synthetic oligonucleotide
tgacatctaccatctatcaagggagggggag

SEQ ID NO: 168848 - DNA, 30 bp, Artificial Sequence
  Description of Artificial Sequence: Synthetic oligonucleotide
gacatctaccatctatcaagggagggggag

SEQ ID NO: 168849 - DNA, 30 bp, Artificial Sequence
  Description of Artificial Sequence: Synthetic oligonucleotide
acatctaccatctatcaagggagggggagg

SEQ ID NO: 168850 - DNA, 29 bp, Artificial Sequence
  Description of Artificial Sequence: Synthetic oligonucleotide
catctaccatctatcaagggagggggagg

SEQ ID NO: 168851 - DNA, 29 bp, Artificial Sequence
  Description of Artificial Sequence: Synthetic oligonucleotide
atctaccatctatcaagggagggggaggc

SEQ ID NO: 168852 - DNA, 28 bp, Artificial Sequence
  Description of Artificial Sequence: Synthetic oligonucleotide
tctaccatctatcaagggagggggaggc

SEQ ID NO: 168853 - DNA, 27 bp, Artificial Sequence
  Description of Artificial Sequence: Synthetic oligonucleotide
ctaccatctatcaagggagggggaggc

SEQ ID NO: 168854 - DNA, 28 bp, Artificial Sequence
  Description of Artificial Sequence: Synthetic oligonucleotide
taccatctatcaagggagggggaggctc

SEQ ID NO: 168855 - DNA, 27 bp, Artificial Sequence
  Description of Artificial Sequence: Synthetic oligonucleotide
accatctatcaagggagggggaggctc

SEQ ID NO: 168856 - DNA, 27 bp, Artificial Sequence
  Description of Artificial Sequence: Synthetic oligonucleotide
ccatctatcaagggagggggaggctca

SEQ ID NO: 168857 - DNA, 28 bp, Artificial Sequence
  Description of Artificial Sequence: Synthetic oligonucleotide
catctatcaagggagggggaggctcatg

SEQ ID NO: 168858 - DNA, 30 bp, Artificial Sequence
  Description of Artificial Sequence: Synthetic oligonucleotide
atctatcaagggagggggaggctcatgaac

SEQ ID NO: 168859 - DNA, 29 bp, Artificial Sequence
  Description of Artificial Sequence: Synthetic oligonucleotide
tctatcaagggagggggaggctcatgaac

SEQ ID NO: 168860 - DNA, 28 bp, Artificial Sequence
  Description of Artificial Sequence: Synthetic oligonucleotide
ctatcaagggagggggaggctcatgaac

SEQ ID NO: 168861 - DNA, 31 bp, Artificial Sequence
  Description of Artificial Sequence: Synthetic oligonucleotide
tatcaagggagggggaggctcatgaacttag

SEQ ID NO: 168862 - DNA, 30 bp, Artificial Sequence
  Description of Artificial Sequence: Synthetic oligonucleotide
atcaagggagggggaggctcatgaacttag

SEQ ID NO: 168863 - DNA, 29 bp, Artificial Sequence
  Description of Artificial Sequence: Synthetic oligonucleotide
tcaagggagggggaggctcatgaacttag

SEQ ID NO: 168864 - DNA, 28 bp, Artificial Sequence
  Description of Artificial Sequence: Synthetic oligonucleotide
caagggagggggaggctcatgaacttag

SEQ ID NO: 168865 - DNA, 28 bp, Artificial Sequence
  Description of Artificial Sequence: Synthetic oligonucleotide
aagggagggggaggctcatgaacttagg

SEQ ID NO: 168866 - DNA, 27 bp, Artificial Sequence
  Description of Artificial Sequence: Synthetic oligonucleotide
agggagggggaggctcatgaacttagg

SEQ ID NO: 168867 - DNA, 27 bp, Artificial Sequence
  Description of Artificial Sequence: Synthetic oligonucleotide
gggagggggaggctcatgaacttaggt

SEQ ID NO: 168868 - DNA, 28 bp, Artificial Sequence
  Description of Artificial Sequence: Synthetic oligonucleotide
ggagggggaggctcatgaacttaggttc

SEQ ID NO: 168869 - DNA, 28 bp, Artificial Sequence
  Description of Artificial Sequence: Synthetic oligonucleotide
gagggggaggctcatgaacttaggttcc

SEQ ID NO: 168870 - DNA, 28 bp, Artificial Sequence
  Description of Artificial Sequence: Synthetic oligonucleotide
agggggaggctcatgaacttaggttccc

SEQ ID NO: 168871 - DNA, 27 bp, Artificial Sequence
  Description of Artificial Sequence: Synthetic oligonucleotide
gggggaggctcatgaacttaggttccc

SEQ ID NO: 168872 - DNA, 28 bp, Artificial Sequence
  Description of Artificial Sequence: Synthetic oligonucleotide
ggggaggctcatgaacttaggttccctg

SEQ ID NO: 168873 - DNA, 28 bp, Artificial Sequence
  Description of Artificial Sequence: Synthetic oligonucleotide
gggaggctcatgaacttaggttccctgc

SEQ ID NO: 168874 - DNA, 29 bp, Artificial Sequence
  Description of Artificial Sequence: Synthetic oligonucleotide
ggaggctcatgaacttaggttccctgcag

SEQ ID NO: 168875 - DNA, 30 bp, Artificial Sequence
  Description of Artificial Sequence: Synthetic oligonucleotide
gaggctcatgaacttaggttccctgcagtg

SEQ ID NO: 168876 - DNA, 30 bp, Artificial Sequence
  Description of Artificial Sequence: Synthetic oligonucleotide
aggctcatgaacttaggttccctgcagtgc

SEQ ID NO: 168877 - DNA, 29 bp, Artificial Sequence
  Description of Artificial Sequence: Synthetic oligonucleotide
ggctcatgaacttaggttccctgcagtgc

SEQ ID NO: 168878 - DNA, 29 bp, Artificial Sequence
  Description of Artificial Sequence: Synthetic oligonucleotide
gctcatgaacttaggttccctgcagtgcc

SEQ ID NO: 168879 - DNA, 29 bp, Artificial Sequence
  Description of Artificial Sequence: Synthetic oligonucleotide
ctcatgaacttaggttccctgcagtgccc

SEQ ID NO: 168880 - DNA, 31 bp, Artificial Sequence
  Description of Artificial Sequence: Synthetic oligonucleotide
tcatgaacttaggttccctgcagtgcccaag

SEQ ID NO: 168881 - DNA, 30 bp, Artificial Sequence
  Description of Artificial Sequence: Synthetic oligonucleotide
catgaacttaggttccctgcagtgcccaag

SEQ ID NO: 168882 - DNA, 30 bp, Artificial Sequence
  Description of Artificial Sequence: Synthetic oligonucleotide
atgaacttaggttccctgcagtgcccaagg

SEQ ID NO: 168883 - DNA, 29 bp, Artificial Sequence
  Description of Artificial Sequence: Synthetic oligonucleotide
tgaacttaggttccctgcagtgcccaagg

SEQ ID NO: 168884 - DNA, 28 bp, Artificial Sequence
  Description of Artificial Sequence: Synthetic oligonucleotide
gaacttaggttccctgcagtgcccaagg

SEQ ID NO: 168885 - DNA, 29 bp, Artificial Sequence
  Description of Artificial Sequence: Synthetic oligonucleotide
aacttaggttccctgcagtgcccaaggtc

SEQ ID NO: 168886 - DNA, 28 bp, Artificial Sequence
  Description of Artificial Sequence: Synthetic oligonucleotide
acttaggttccctgcagtgcccaaggtc

SEQ ID NO: 168887 - DNA, 27 bp, Artificial Sequence
  Description of Artificial Sequence: Synthetic oligonucleotide
cttaggttccctgcagtgcccaaggtc

SEQ ID NO: 168888 - DNA, 30 bp, Artificial Sequence
  Description of Artificial Sequence: Synthetic oligonucleotide
ttaggttccctgcagtgcccaaggtcaatg

SEQ ID NO: 168889 - DNA, 29 bp, Artificial Sequence
  Description of Artificial Sequence: Synthetic oligonucleotide
taggttccctgcagtgcccaaggtcaatg

SEQ ID NO: 168890 - DNA, 28 bp, Artificial Sequence
  Description of Artificial Sequence: Synthetic oligonucleotide
aggttccctgcagtgcccaaggtcaatg

SEQ ID NO: 168891 - DNA, 27 bp, Artificial Sequence
  Description of Artificial Sequence: Synthetic oligonucleotide
ggttccctgcagtgcccaaggtcaatg

SEQ ID NO: 168892 - DNA, 27 bp, Artificial Sequence
  Description of Artificial Sequence: Synthetic oligonucleotide
gttccctgcagtgcccaaggtcaatgg

SEQ ID NO: 168893 - DNA, 29 bp, Artificial Sequence
  Description of Artificial Sequence: Synthetic oligonucleotide
ttccctgcagtgcccaaggtcaatggaac

SEQ ID NO: 168894 - DNA, 28 bp, Artificial Sequence
  Description of Artificial Sequence: Synthetic oligonucleotide
tccctgcagtgcccaaggtcaatggaac

SEQ ID NO: 168895 - DNA, 27 bp, Artificial Sequence
  Description of Artificial Sequence: Synthetic oligonucleotide
ccctgcagtgcccaaggtcaatggaac

SEQ ID NO: 168896 - DNA, 27 bp, Artificial Sequence
  Description of Artificial Sequence: Synthetic oligonucleotide
cctgcagtgcccaaggtcaatggaacc

SEQ ID NO: 168897 - DNA, 29 bp, Artificial Sequence
  Description of Artificial Sequence: Synthetic oligonucleotide
ctgcagtgcccaaggtcaatggaaccttc

SEQ ID NO: 168898 - DNA, 29 bp, Artificial Sequence
  Description of Artificial Sequence: Synthetic oligonucleotide
tgcagtgcccaaggtcaatggaaccttcc

SEQ ID NO: 168899 - DNA, 28 bp, Artificial Sequence
  Description of Artificial Sequence: Synthetic oligonucleotide
gcagtgcccaaggtcaatggaaccttcc

SEQ ID NO: 168900 - DNA, 29 bp, Artificial Sequence
  Description of Artificial Sequence: Synthetic oligonucleotide
cagtgcccaaggtcaatggaaccttccag

SEQ ID NO: 168901 - DNA, 29 bp, Artificial Sequence
  Description of Artificial Sequence: Synthetic oligonucleotide
agtgcccaaggtcaatggaaccttccagg

SEQ ID NO: 168902 - DNA, 28 bp, Artificial Sequence
  Description of Artificial Sequence: Synthetic oligonucleotide
gtgcccaaggtcaatggaaccttccagg

SEQ ID NO: 168903 - DNA, 28 bp, Artificial Sequence
  Description of Artificial Sequence: Synthetic oligonucleotide
tgcccaaggtcaatggaaccttccaggc

SEQ ID NO: 168904 - DNA, 27 bp, Artificial Sequence
  Description of Artificial Sequence: Synthetic oligonucleotide
gcccaaggtcaatggaaccttccaggc

SEQ ID NO: 168905 - DNA, 27 bp, Artificial Sequence
  Description of Artificial Sequence: Synthetic oligonucleotide
cccaaggtcaatggaaccttccaggcc

SEQ ID NO: 168906 - DNA, 29 bp, Artificial Sequence
  Description of Artificial Sequence: Synthetic oligonucleotide
ccaaggtcaatggaaccttccaggccaac

SEQ ID NO: 168907 - DNA, 32 bp, Artificial Sequence
  Description of Artificial Sequence: Synthetic oligonucleotide
caaggtcaatggaaccttccaggccaactttc

SEQ ID NO: 168908 - DNA, 32 bp, Artificial Sequence
  Description of Artificial Sequence: Synthetic oligonucleotide
aaggtcaatggaaccttccaggccaactttcc

SEQ ID NO: 168909 - DNA, 31 bp, Artificial Sequence
  Description of Artificial Sequence: Synthetic oligonucleotide
aggtcaatggaaccttccaggccaactttcc

SEQ ID NO: 168910 - DNA, 30 bp, Artificial Sequence
  Description of Artificial Sequence: Synthetic oligonucleotide
ggtcaatggaaccttccaggccaactttcc

SEQ ID NO: 168911 - DNA, 31 bp, Artificial Sequence
  Description of Artificial Sequence: Synthetic oligonucleotide
gtcaatggaaccttccaggccaactttcctc

SEQ ID NO: 168912 - DNA, 32 bp, Artificial Sequence
  Description of Artificial Sequence: Synthetic oligonucleotide
tcaatggaaccttccaggccaactttcctctg

SEQ ID NO: 168913 - DNA, 31 bp, Artificial Sequence
  Description of Artificial Sequence: Synthetic oligonucleotide
caatggaaccttccaggccaactttcctctg

SEQ ID NO: 168914 - DNA, 31 bp, Artificial Sequence
  Description of Artificial Sequence: Synthetic oligonucleotide
aatggaaccttccaggccaactttcctctgg

SEQ ID NO: 168915 - DNA, 30 bp, Artificial Sequence
  Description of Artificial Sequence: Synthetic oligonucleotide
atggaaccttccaggccaactttcctctgg

SEQ ID NO: 168916 - DNA, 29 bp, Artificial Sequence
  Description of Artificial Sequence: Synthetic oligonucleotide
tggaaccttccaggccaactttcctctgg

SEQ ID NO: 168917 - DNA, 28 bp, Artificial Sequence
  Description of Artificial Sequence: Synthetic oligonucleotide
ggaaccttccaggccaactttcctctgg

SEQ ID NO: 168918 - DNA, 28 bp, Artificial Sequence
  Description of Artificial Sequence: Synthetic oligonucleotide
gaaccttccaggccaactttcctctggg

SEQ ID NO: 168919 - DNA, 28 bp, Artificial Sequence
  Description of Artificial Sequence: Synthetic oligonucleotide
aaccttccaggccaactttcctctgggc

SEQ ID NO: 168920 - DNA, 27 bp, Artificial Sequence
  Description of Artificial Sequence: Synthetic oligonucleotide
accttccaggccaactttcctctgggc

SEQ ID NO: 168921 - DNA, 26 bp, Artificial Sequence
  Description of Artificial Sequence: Synthetic oligonucleotide
ccttccaggccaactttcctctgggc

SEQ ID NO: 168922 - DNA, 26 bp, Artificial Sequence
  Description of Artificial Sequence: Synthetic oligonucleotide
cttccaggccaactttcctctgggcc

SEQ ID NO: 168923 - DNA, 29 bp, Artificial Sequence
  Description of Artificial Sequence: Synthetic oligonucleotide
tttccgtgactctccctacgagtggtcag

SEQ ID NO: 168924 - DNA, 28 bp, Artificial Sequence
  Description of Artificial Sequence: Synthetic oligonucleotide
ttccgtgactctccctacgagtggtcag

SEQ ID NO: 168925 - DNA, 27 bp, Artificial Sequence
  Description of Artificial Sequence: Synthetic oligonucleotide
tccgtgactctccctacgagtggtcag

SEQ ID NO: 168926 - DNA, 27 bp, Artificial Sequence
  Description of Artificial Sequence: Synthetic oligonucleotide
ccgtgactctccctacgagtggtcaga

SEQ ID NO: 168927 - DNA, 27 bp, Artificial Sequence
  Description of Artificial Sequence: Synthetic oligonucleotide
cgtgactctccctacgagtggtcagac

SEQ ID NO: 168928 - DNA, 27 bp, Artificial Sequence
  Description of Artificial Sequence: Synthetic oligonucleotide
gtgactctccctacgagtggtcagacc

SEQ ID NO: 168929 - DNA, 30 bp, Artificial Sequence
  Description of Artificial Sequence: Synthetic oligonucleotide
tgactctccctacgagtggtcagaccttag

SEQ ID NO: 168930 - DNA, 29 bp, Artificial Sequence
  Description of Artificial Sequence: Synthetic oligonucleotide
gactctccctacgagtggtcagaccttag

SEQ ID NO: 168931 - DNA, 30 bp, Artificial Sequence
  Description of Artificial Sequence: Synthetic oligonucleotide
actctccctacgagtggtcagaccttagtg

SEQ ID NO: 168932 - DNA, 29 bp, Artificial Sequence
  Description of Artificial Sequence: Synthetic oligonucleotide
ctctccctacgagtggtcagaccttagtg

SEQ ID NO: 168933 - DNA, 30 bp, Artificial Sequence
  Description of Artificial Sequence: Synthetic oligonucleotide
tctccctacgagtggtcagaccttagtgac

SEQ ID NO: 168934 - DNA, 29 bp, Artificial Sequence
  Description of Artificial Sequence: Synthetic oligonucleotide
ctccctacgagtggtcagaccttagtgac

SEQ ID NO: 168935 - DNA, 29 bp, Artificial Sequence
  Description of Artificial Sequence: Synthetic oligonucleotide
tccctacgagtggtcagaccttagtgacc

SEQ ID NO: 168936 - DNA, 28 bp, Artificial Sequence
  Description of Artificial Sequence: Synthetic oligonucleotide
ccctacgagtggtcagaccttagtgacc

SEQ ID NO: 168937 - DNA, 28 bp, Artificial Sequence
  Description of Artificial Sequence: Synthetic oligonucleotide
cctacgagtggtcagaccttagtgaccc

SEQ ID NO: 168938 - DNA, 29 bp, Artificial Sequence
  Description of Artificial Sequence: Synthetic oligonucleotide
ctacgagtggtcagaccttagtgacccac

SEQ ID NO: 168939 - DNA, 30 bp, Artificial Sequence
  Description of Artificial Sequence: Synthetic oligonucleotide
tacgagtggtcagaccttagtgacccactg

SEQ ID NO: 168940 - DNA, 29 bp, Artificial Sequence
  Description of Artificial Sequence: Synthetic oligonucleotide
acgagtggtcagaccttagtgacccactg

SEQ ID NO: 168941 - DNA, 28 bp, Artificial Sequence
  Description of Artificial Sequence: Synthetic oligonucleotide
cgagtggtcagaccttagtgacccactg

SEQ ID NO: 168942 - DNA, 28 bp, Artificial Sequence
  Description of Artificial Sequence: Synthetic oligonucleotide
gagtggtcagaccttagtgacccactgc

SEQ ID NO: 168943 - DNA, 30 bp, Artificial Sequence
  Description of Artificial Sequence: Synthetic oligonucleotide
agtggtcagaccttagtgacccactgcttg

SEQ ID NO: 168944 - DNA, 29 bp, Artificial Sequence
  Description of Artificial Sequence: Synthetic oligonucleotide
gtggtcagaccttagtgacccactgcttg

SEQ ID NO: 168945 - DNA, 32 bp, Artificial Sequence
  Description of Artificial Sequence: Synthetic oligonucleotide
tggtcagaccttagtgacccactgcttgtttc

SEQ ID NO: 168946 - DNA, 31 bp, Artificial Sequence
  Description of Artificial Sequence: Synthetic oligonucleotide
ggtcagaccttagtgacccactgcttgtttc

SEQ ID NO: 168947 - DNA, 32 bp, Artificial Sequence
  Description of Artificial Sequence: Synthetic oligonucleotide
gtcagaccttagtgacccactgcttgtttctg

SEQ ID NO: 168948 - DNA, 33 bp, Artificial Sequence
  Description of Artificial Sequence: Synthetic oligonucleotide
tcagaccttagtgacccactgcttgtttctgtc

SEQ ID NO: 168949 - DNA, 32 bp, Artificial Sequence
  Description of Artificial Sequence: Synthetic oligonucleotide
cagaccttagtgacccactgcttgtttctgtc

SEQ ID NO: 168950 - DNA, 33 bp, Artificial Sequence
  Description of Artificial Sequence: Synthetic oligonucleotide
agaccttagtgacccactgcttgtttctgtcac

SEQ ID NO: 168951 - DNA, 32 bp, Artificial Sequence
  Description of Artificial Sequence: Synthetic oligonucleotide
gaccttagtgacccactgcttgtttctgtcac

SEQ ID NO: 168952 - DNA, 33 bp, Artificial Sequence
  Description of Artificial Sequence: Synthetic oligonucleotide
accttagtgacccactgcttgtttctgtcacag

SEQ ID NO: 168953 - DNA, 34 bp, Artificial Sequence
  Description of Artificial Sequence: Synthetic oligonucleotide
gagctcctatgacatctaccatctatcaagggac

SEQ ID NO: 168954 - DNA, 34 bp, Artificial Sequence
  Description of Artificial Sequence: Synthetic oligonucleotide
agctcctatgacatctaccatctatcaagggacg

SEQ ID NO: 168955 - DNA, 33 bp, Artificial Sequence
  Description of Artificial Sequence: Synthetic oligonucleotide
gctcctatgacatctaccatctatcaagggacg

SEQ ID NO: 168956 - DNA, 33 bp, Artificial Sequence
  Description of Artificial Sequence: Synthetic oligonucleotide
ctcctatgacatctaccatctatcaagggacgg

SEQ ID NO: 168957 - DNA, 33 bp, Artificial Sequence
  Description of Artificial Sequence: Synthetic oligonucleotide
tcctatgacatctaccatctatcaagggacggg

SEQ ID NO: 168958 - DNA, 32 bp, Artificial Sequence
  Description of Artificial Sequence: Synthetic oligonucleotide
cctatgacatctaccatctatcaagggacggg

SEQ ID NO: 168959 - DNA, 32 bp, Artificial Sequence
  Description of Artificial Sequence: Synthetic oligonucleotide
ctatgacatctaccatctatcaagggacgggg

SEQ ID NO: 168960 - DNA, 33 bp, Artificial Sequence
  Description of Artificial Sequence: Synthetic oligonucleotide
tatgacatctaccatctatcaagggacggggag

SEQ ID NO: 168961 - DNA, 32 bp, Artificial Sequence
  Description of Artificial Sequence: Synthetic oligonucleotide
atgacatctaccatctatcaagggacggggag

SEQ ID NO: 168962 - DNA, 31 bp, Artificial Sequence
  Description of Artificial Sequence: Synthetic oligonucleotide
tgacatctaccatctatcaagggacggggag

SEQ ID NO: 168963 - DNA, 30 bp, Artificial Sequence
  Description of Artificial Sequence: Synthetic oligonucleotide
gacatctaccatctatcaagggacggggag

SEQ ID NO: 168964 - DNA, 30 bp, Artificial Sequence
  Description of Artificial Sequence: Synthetic oligonucleotide
acatctaccatctatcaagggacggggagg

SEQ ID NO: 168965 - DNA, 29 bp, Artificial Sequence
  Description of Artificial Sequence: Synthetic oligonucleotide
catctaccatctatcaagggacggggagg

SEQ ID NO: 168966 - DNA, 29 bp, Artificial Sequence
  Description of Artificial Sequence: Synthetic oligonucleotide
atctaccatctatcaagggacggggaggc

SEQ ID NO: 168967 - DNA, 28 bp, Artificial Sequence
  Description of Artificial Sequence: Synthetic oligonucleotide
tctaccatctatcaagggacggggaggc

SEQ ID NO: 168968 - DNA, 27 bp, Artificial Sequence
  Description of Artificial Sequence: Synthetic oligonucleotide
ctaccatctatcaagggacggggaggc

SEQ ID NO: 168969 - DNA, 28 bp, Artificial Sequence
  Description of Artificial Sequence: Synthetic oligonucleotide
taccatctatcaagggacggggaggctc

SEQ ID NO: 168970 - DNA, 27 bp, Artificial Sequence
  Description of Artificial Sequence: Synthetic oligonucleotide
accatctatcaagggacggggaggctc

SEQ ID NO: 168971 - DNA, 27 bp, Artificial Sequence
  Description of Artificial Sequence: Synthetic oligonucleotide
ccatctatcaagggacggggaggctca

SEQ ID NO: 168972 - DNA, 28 bp, Artificial Sequence
  Description of Artificial Sequence: Synthetic oligonucleotide
catctatcaagggacggggaggctcatg

SEQ ID NO: 168973 - DNA, 30 bp, Artificial Sequence
  Description of Artificial Sequence: Synthetic oligonucleotide
atctatcaagggacggggaggctcatgaac

SEQ ID NO: 168974 - DNA, 29 bp, Artificial Sequence
  Description of Artificial Sequence: Synthetic oligonucleotide
tctatcaagggacggggaggctcatgaac

SEQ ID NO: 168975 - DNA, 28 bp, Artificial Sequence
  Description of Artificial Sequence: Synthetic oligonucleotide
ctatcaagggacggggaggctcatgaac

SEQ ID NO: 168976 - DNA, 31 bp, Artificial Sequence
  Description of Artificial Sequence: Synthetic oligonucleotide
tatcaagggacggggaggctcatgaacttag

SEQ ID NO: 168977 - DNA, 30 bp, Artificial Sequence
  Description of Artificial Sequence: Synthetic oligonucleotide
atcaagggacggggaggctcatgaacttag

SEQ ID NO: 168978 - DNA, 29 bp, Artificial Sequence
  Description of Artificial Sequence: Synthetic oligonucleotide
tcaagggacggggaggctcatgaacttag

SEQ ID NO: 168979 - DNA, 28 bp, Artificial Sequence
  Description of Artificial Sequence: Synthetic oligonucleotide
caagggacggggaggctcatgaacttag

SEQ ID NO: 168980 - DNA, 28 bp, Artificial Sequence
  Description of Artificial Sequence: Synthetic oligonucleotide
aagggacggggaggctcatgaacttagg

SEQ ID NO: 168981 - DNA, 27 bp, Artificial Sequence
  Description of Artificial Sequence: Synthetic oligonucleotide
agggacggggaggctcatgaacttagg

SEQ ID NO: 168982 - DNA, 27 bp, Artificial Sequence
  Description of Artificial Sequence: Synthetic oligonucleotide
gggacggggaggctcatgaacttaggt

SEQ ID NO: 168983 - DNA, 28 bp, Artificial Sequence
  Description of Artificial Sequence: Synthetic oligonucleotide
ggacggggaggctcatgaacttaggttc

SEQ ID NO: 168984 - DNA, 28 bp, Artificial Sequence
  Description of Artificial Sequence: Synthetic oligonucleotide
gacggggaggctcatgaacttaggttcc

SEQ ID NO: 168985 - DNA, 28 bp, Artificial Sequence
  Description of Artificial Sequence: Synthetic oligonucleotide
acggggaggctcatgaacttaggttccc

SEQ ID NO: 168986 - DNA, 27 bp, Artificial Sequence
  Description of Artificial Sequence: Synthetic oligonucleotide
cggggaggctcatgaacttaggttccc

SEQ ID NO: 168987 - DNA, 28 bp, Artificial Sequence
  Description of Artificial Sequence: Synthetic oligonucleotide
atggtcgtcagcatggcgtgtgttggtg

SEQ ID NO: 168988 - DNA, 27 bp, Artificial Sequence
  Description of Artificial Sequence: Synthetic oligonucleotide
tggtcgtcagcatggcgtgtgttggtg

SEQ ID NO: 168989 - DNA, 26 bp, Artificial Sequence
  Description of Artificial Sequence: Synthetic oligonucleotide
ggtcgtcagcatggcgtgtgttggtg

SEQ ID NO: 168990 - DNA, 27 bp, Artificial Sequence
  Description of Artificial Sequence: Synthetic oligonucleotide
gtcgtcagcatggcgtgtgttggtggt

SEQ ID NO: 168991 - DNA, 27 bp, Artificial Sequence
  Description of Artificial Sequence: Synthetic oligonucleotide
tcgtcagcatggcgtgtgttggtggtc

SEQ ID NO: 168992 - DNA, 27 bp, Artificial Sequence
  Description of Artificial Sequence: Synthetic oligonucleotide
cgtcagcatggcgtgtgttggtggtca

SEQ ID NO: 168993 - DNA, 27 bp, Artificial Sequence
  Description of Artificial Sequence: Synthetic oligonucleotide
gtcagcatggcgtgtgttggtggtcag

SEQ ID NO: 168994 - DNA, 27 bp, Artificial Sequence
  Description of Artificial Sequence: Synthetic oligonucleotide
tcagcatggcgtgtgttggtggtcagg

SEQ ID NO: 168995 - DNA, 27 bp, Artificial Sequence
  Description of Artificial Sequence: Synthetic oligonucleotide
cagcatggcgtgtgttggtggtcagga

SEQ ID NO: 168996 - DNA, 27 bp, Artificial Sequence
  Description of Artificial Sequence: Synthetic oligonucleotide
agcatggcgtgtgttggtggtcaggac

SEQ ID NO: 168997 - DNA, 27 bp, Artificial Sequence
  Description of Artificial Sequence: Synthetic oligonucleotide
gcatggcgtgtgttggtggtcaggaca

SEQ ID NO: 168998 - DNA, 28 bp, Artificial Sequence
  Description of Artificial Sequence: Synthetic oligonucleotide
catggcgtgtgttggtggtcaggacaag

SEQ ID NO: 168999 - DNA, 28 bp, Artificial Sequence
  Description of Artificial Sequence: Synthetic oligonucleotide
atggcgtgtgttggtggtcaggacaagc

SEQ ID NO: 169000 - DNA, 27 bp, Artificial Sequence
  Description of Artificial Sequence: Synthetic oligonucleotide
tggcgtgtgttggtggtcaggacaagc

SEQ ID NO: 169001 - DNA, 26 bp, Artificial Sequence
  Description of Artificial Sequence: Synthetic oligonucleotide
ggcgtgtgttggtggtcaggacaagc

SEQ ID NO: 169002 - DNA, 26 bp, Artificial Sequence
  Description of Artificial Sequence: Synthetic oligonucleotide
gcgtgtgttggtggtcaggacaagcc

SEQ ID NO: 169003 - DNA, 27 bp, Artificial Sequence
  Description of Artificial Sequence: Synthetic oligonucleotide
cgtgtgttggtggtcaggacaagccct

SEQ ID NO: 169004 - DNA, 28 bp, Artificial Sequence
  Description of Artificial Sequence: Synthetic oligonucleotide
gtgtgttggtggtcaggacaagcccttc

SEQ ID NO: 169005 - DNA, 28 bp, Artificial Sequence
  Description of Artificial Sequence: Synthetic oligonucleotide
tgtgttggtggtcaggacaagcccttcc

SEQ ID NO: 169006 - DNA, 27 bp, Artificial Sequence
  Description of Artificial Sequence: Synthetic oligonucleotide
gtgttggtggtcaggacaagcccttcc

SEQ ID NO: 169007 - DNA, 28 bp, Artificial Sequence
  Description of Artificial Sequence: Synthetic oligonucleotide
tgttggtggtcaggacaagcccttcctc

SEQ ID NO: 169008 - DNA, 27 bp, Artificial Sequence
  Description of Artificial Sequence: Synthetic oligonucleotide
gttggtggtcaggacaagcccttcctc

SEQ ID NO: 169009 - DNA, 28 bp, Artificial Sequence
  Description of Artificial Sequence: Synthetic oligonucleotide
ttggtggtcaggacaagcccttcctctc

SEQ ID NO: 169010 - DNA, 27 bp, Artificial Sequence
  Description of Artificial Sequence: Synthetic oligonucleotide
tggtggtcaggacaagcccttcctctc

SEQ ID NO: 169011 - DNA, 23 bp, Artificial Sequence
  Description of Artificial Sequence: Synthetic oligonucleotide
ttcctctctgcctggcccagccc

SEQ ID NO: 169012 - DNA, 22 bp, Artificial Sequence
  Description of Artificial Sequence: Synthetic oligonucleotide
tcctctctgcctggcccagccc

SEQ ID NO: 169013 - DNA, 21 bp, Artificial Sequence
  Description of Artificial Sequence: Synthetic oligonucleotide
cctctctgcctggcccagccc

SEQ ID NO: 169014 - DNA, 21 bp, Artificial Sequence
  Description of Artificial Sequence: Synthetic oligonucleotide
ctctctgcctggcccagcccc

SEQ ID NO: 169015 - DNA, 22 bp, Artificial Sequence
  Description of Artificial Sequence: Synthetic oligonucleotide
tctctgcctggcccagccccgt

SEQ ID NO: 169016 - DNA, 21 bp, Artificial Sequence
  Description of Artificial Sequence: Synthetic oligonucleotide
ctctgcctggcccagccccgt

SEQ ID NO: 169017 - DNA, 21 bp, Artificial Sequence
  Description of Artificial Sequence: Synthetic oligonucleotide
tctgcctggcccagccccgtg

SEQ ID NO: 169018 - DNA, 20 bp, Artificial Sequence
  Description of Artificial Sequence: Synthetic oligonucleotide
ctgcctggcccagccccgtg

SEQ ID NO: 169019 - DNA, 21 bp, Artificial Sequence
  Description of Artificial Sequence: Synthetic oligonucleotide
tgcctggcccagccccgtggt

SEQ ID NO: 169020 - DNA, 20 bp, Artificial Sequence
  Description of Artificial Sequence: Synthetic oligonucleotide
gcctggcccagccccgtggt

SEQ ID NO: 169021 - DNA, 21 bp, Artificial Sequence
  Description of Artificial Sequence: Synthetic oligonucleotide
cctggcccagccccgtggtgt

SEQ ID NO: 169022 - DNA, 22 bp, Artificial Sequence
  Description of Artificial Sequence: Synthetic oligonucleotide
ctggcccagccccgtggtgtct

SEQ ID NO: 169023 - DNA, 24 bp, Artificial Sequence
  Description of Artificial Sequence: Synthetic oligonucleotide
tggcccagccccgtggtgtctgaa

SEQ ID NO: 169024 - DNA, 23 bp, Artificial Sequence
  Description of Artificial Sequence: Synthetic oligonucleotide
ggcccagccccgtggtgtctgaa

SEQ ID NO: 169025 - DNA, 23 bp, Artificial Sequence
  Description of Artificial Sequence: Synthetic oligonucleotide
gcccagccccgtggtgtctgaag

SEQ ID NO: 169026 - DNA, 24 bp, Artificial Sequence
  Description of Artificial Sequence: Synthetic oligonucleotide
cccagccccgtggtgtctgaagga

SEQ ID NO: 169027 - DNA, 26 bp, Artificial Sequence
  Description of Artificial Sequence: Synthetic oligonucleotide
ccagccccgtggtgtctgaaggagaa

SEQ ID NO: 169028 - DNA, 27 bp, Artificial Sequence
  Description of Artificial Sequence: Synthetic oligonucleotide
cagccccgtggtgtctgaaggagaaca

SEQ ID NO: 169029 - DNA, 28 bp, Artificial Sequence
  Description of Artificial Sequence: Synthetic oligonucleotide
agccccgtggtgtctgaaggagaacatg

SEQ ID NO: 169030 - DNA, 27 bp, Artificial Sequence
  Description of Artificial Sequence: Synthetic oligonucleotide
gccccgtggtgtctgaaggagaacatg

SEQ ID NO: 169031 - DNA, 28 bp, Artificial Sequence
  Description of Artificial Sequence: Synthetic oligonucleotide
ccccgtggtgtctgaaggagaacatgtg

SEQ ID NO: 169032 - DNA, 28 bp, Artificial Sequence
  Description of Artificial Sequence: Synthetic oligonucleotide
cccgtggtgtctgaaggagaacatgtgg

SEQ ID NO: 169033 - DNA, 28 bp, Artificial Sequence
  Description of Artificial Sequence: Synthetic oligonucleotide
ccgtggtgtctgaaggagaacatgtggc

SEQ ID NO: 169034 - DNA, 29 bp, Artificial Sequence
  Description of Artificial Sequence: Synthetic oligonucleotide
cgtggtgtctgaaggagaacatgtggctc

SEQ ID NO: 169035 - DNA, 27 bp, Artificial Sequence
  Description of Artificial Sequence: Synthetic oligonucleotide
cgcctcactggagagctccatgatgga

SEQ ID NO: 169036 - DNA, 27 bp, Artificial Sequence
  Description of Artificial Sequence: Synthetic oligonucleotide
gcctcactggagagctccatgatggag

SEQ ID NO: 169037 - DNA, 28 bp, Artificial Sequence
  Description of Artificial Sequence: Synthetic oligonucleotide
cctcactggagagctccatgatggagtc

SEQ ID NO: 169038 - DNA, 29 bp, Artificial Sequence
  Description of Artificial Sequence: Synthetic oligonucleotide
ctcactggagagctccatgatggagtctc

SEQ ID NO: 169039 - DNA, 29 bp, Artificial Sequence
  Description of Artificial Sequence: Synthetic oligonucleotide
tcactggagagctccatgatggagtctcc

SEQ ID NO: 169040 - DNA, 28 bp, Artificial Sequence
  Description of Artificial Sequence: Synthetic oligonucleotide
cactggagagctccatgatggagtctcc

SEQ ID NO: 169041 - DNA, 30 bp, Artificial Sequence
  Description of Artificial Sequence: Synthetic oligonucleotide
actggagagctccatgatggagtctccaag

SEQ ID NO: 169042 - DNA, 29 bp, Artificial Sequence
  Description of Artificial Sequence: Synthetic oligonucleotide
ctggagagctccatgatggagtctccaag

SEQ ID NO: 169043 - DNA, 29 bp, Artificial Sequence
  Description of Artificial Sequence: Synthetic oligonucleotide
tggagagctccatgatggagtctccaagg

SEQ ID NO: 169044 - DNA, 28 bp, Artificial Sequence
  Description of Artificial Sequence: Synthetic oligonucleotide
ggagagctccatgatggagtctccaagg

SEQ ID NO: 169045 - DNA, 28 bp, Artificial Sequence
  Description of Artificial Sequence: Synthetic oligonucleotide
gagagctccatgatggagtctccaaggc

SEQ ID NO: 169046 - DNA, 28 bp, Artificial Sequence
  Description of Artificial Sequence: Synthetic oligonucleotide
agagctccatgatggagtctccaaggcc

SEQ ID NO: 169047 - DNA, 27 bp, Artificial Sequence
  Description of Artificial Sequence: Synthetic oligonucleotide
gagctccatgatggagtctccaaggcc

SEQ ID NO: 169048 - DNA, 29 bp, Artificial Sequence
  Description of Artificial Sequence: Synthetic oligonucleotide
agctccatgatggagtctccaaggccaac

SEQ ID NO: 169049 - DNA, 28 bp, Artificial Sequence
  Description of Artificial Sequence: Synthetic oligonucleotide
gctccatgatggagtctccaaggccaac

SEQ ID NO: 169050 - DNA, 30 bp, Artificial Sequence
  Description of Artificial Sequence: Synthetic oligonucleotide
ctccatgatggagtctccaaggccaacttc

SEQ ID NO: 169051 - DNA, 31 bp, Artificial Sequence
  Description of Artificial Sequence: Synthetic oligonucleotide
tccatgatggagtctccaaggccaacttctc

SEQ ID NO: 169052 - DNA, 30 bp, Artificial Sequence
  Description of Artificial Sequence: Synthetic oligonucleotide
ccatgatggagtctccaaggccaacttctc

SEQ ID NO: 169053 - DNA, 30 bp, Artificial Sequence
  Description of Artificial Sequence: Synthetic oligonucleotide
catgatggagtctccaaggccaacttctcc

SEQ ID NO: 169054 - DNA, 32 bp, Artificial Sequence
  Description of Artificial Sequence: Synthetic oligonucleotide
atgatggagtctccaaggccaacttctccatc

SEQ ID NO: 169055 - DNA, 31 bp, Artificial Sequence
  Description of Artificial Sequence: Synthetic oligonucleotide
tgatggagtctccaaggccaacttctccatc

SEQ ID NO: 169056 - DNA, 30 bp, Artificial Sequence
  Description of Artificial Sequence: Synthetic oligonucleotide
gatggagtctccaaggccaacttctccatc

SEQ ID NO: 169057 - DNA, 30 bp, Artificial Sequence
  Description of Artificial Sequence: Synthetic oligonucleotide
atggagtctccaaggccaacttctccatcg

SEQ ID NO: 169058 - DNA, 29 bp, Artificial Sequence
  Description of Artificial Sequence: Synthetic oligonucleotide
tggagtctccaaggccaacttctccatcg

SEQ ID NO: 169059 - DNA, 28 bp, Artificial Sequence
  Description of Artificial Sequence: Synthetic oligonucleotide
ggagtctccaaggccaacttctccatcg

SEQ ID NO: 169060 - DNA, 28 bp, Artificial Sequence
  Description of Artificial Sequence: Synthetic oligonucleotide
gagtctccaaggccaacttctccatcgg

SEQ ID NO: 169061 - DNA, 29 bp, Artificial Sequence
  Description of Artificial Sequence: Synthetic oligonucleotide
agtctccaaggccaacttctccatcggtc

SEQ ID NO: 169062 - DNA, 30 bp, Artificial Sequence
  Description of Artificial Sequence: Synthetic oligonucleotide
tggtcagaccttagtgacccactgcttgtg

SEQ ID NO: 169063 - DNA, 29 bp, Artificial Sequence
  Description of Artificial Sequence: Synthetic oligonucleotide
ggtcagaccttagtgacccactgcttgtg

SEQ ID NO: 169064 - DNA, 30 bp, Artificial Sequence
  Description of Artificial Sequence: Synthetic oligonucleotide
gtcagaccttagtgacccactgcttgtgtc

SEQ ID NO: 169065 - DNA, 31 bp, Artificial Sequence
  Description of Artificial Sequence: Synthetic oligonucleotide
tcagaccttagtgacccactgcttgtgtctg

SEQ ID NO: 169066 - DNA, 30 bp, Artificial Sequence
  Description of Artificial Sequence: Synthetic oligonucleotide
cagaccttagtgacccactgcttgtgtctg

SEQ ID NO: 169067 - DNA, 31 bp, Artificial Sequence
  Description of Artificial Sequence: Synthetic oligonucleotide
agaccttagtgacccactgcttgtgtctgtc

SEQ ID NO: 169068 - DNA, 30 bp, Artificial Sequence
  Description of Artificial Sequence: Synthetic oligonucleotide
gaccttagtgacccactgcttgtgtctgtc

SEQ ID NO: 169069 - DNA, 31 bp, Artificial Sequence
  Description of Artificial Sequence: Synthetic oligonucleotide
accttagtgacccactgcttgtgtctgtcac

SEQ ID NO: 169070 - DNA, 30 bp, Artificial Sequence
  Description of Artificial Sequence: Synthetic oligonucleotide
ccttagtgacccactgcttgtgtctgtcac

SEQ ID NO: 169071 - DNA, 31 bp, Artificial Sequence
  Description of Artificial Sequence: Synthetic oligonucleotide
cttagtgacccactgcttgtgtctgtcacag

SEQ ID NO: 169072 - DNA, 33 bp, Artificial Sequence
  Description of Artificial Sequence: Synthetic oligonucleotide
acttccttctgcacagagaggggacgtttaatg

SEQ ID NO: 169073 - DNA, 32 bp, Artificial Sequence
  Description of Artificial Sequence: Synthetic oligonucleotide
cttccttctgcacagagaggggacgtttaatg

SEQ ID NO: 169074 - DNA, 33 bp, Artificial Sequence
  Description of Artificial Sequence: Synthetic oligonucleotide
ttccttctgcacagagaggggacgtttaatgac

SEQ ID NO: 169075 - DNA, 32 bp, Artificial Sequence
  Description of Artificial Sequence: Synthetic oligonucleotide
tccttctgcacagagaggggacgtttaatgac

SEQ ID NO: 169076 - DNA, 31 bp, Artificial Sequence
  Description of Artificial Sequence: Synthetic oligonucleotide
ccttctgcacagagaggggacgtttaatgac

SEQ ID NO: 169077 - DNA, 32 bp, Artificial Sequence
  Description of Artificial Sequence: Synthetic oligonucleotide
cttctgcacagagaggggacgtttaatgacac

SEQ ID NO: 169078 - DNA, 35 bp, Artificial Sequence
  Description of Artificial Sequence: Synthetic oligonucleotide
ttctgcacagagaggggacgtttaatgacactttg

SEQ ID NO: 169079 - DNA, 34 bp, Artificial Sequence
  Description of Artificial Sequence: Synthetic oligonucleotide
tctgcacagagaggggacgtttaatgacactttg

SEQ ID NO: 169080 - DNA, 33 bp, Artificial Sequence
  Description of Artificial Sequence: Synthetic oligonucleotide
ctgcacagagaggggacgtttaatgacactttg

SEQ ID NO: 169081 - DNA, 33 bp, Artificial Sequence
  Description of Artificial Sequence: Synthetic oligonucleotide
tgcacagagaggggacgtttaatgacactttgc

SEQ ID NO: 169082 - DNA, 32 bp, Artificial Sequence
  Description of Artificial Sequence: Synthetic oligonucleotide
gcacagagaggggacgtttaatgacactttgc

SEQ ID NO: 169083 - DNA, 32 bp, Artificial Sequence
  Description of Artificial Sequence: Synthetic oligonucleotide
cacagagaggggacgtttaatgacactttgcg

SEQ ID NO: 169084 - DNA, 32 bp, Artificial Sequence
  Description of Artificial Sequence: Synthetic oligonucleotide
acagagaggggacgtttaatgacactttgcgc

SEQ ID NO: 169085 - DNA, 31 bp, Artificial Sequence
  Description of Artificial Sequence: Synthetic oligonucleotide
cagagaggggacgtttaatgacactttgcgc

SEQ ID NO: 169086 - DNA, 31 bp, Artificial Sequence
  Description of Artificial Sequence: Synthetic oligonucleotide
agagaggggacgtttaatgacactttgcgcc

SEQ ID NO: 169087 - DNA, 30 bp, Artificial Sequence
  Description of Artificial Sequence: Synthetic oligonucleotide
gagaggggacgtttaatgacactttgcgcc

SEQ ID NO: 169088 - DNA, 31 bp, Artificial Sequence
  Description of Artificial Sequence: Synthetic oligonucleotide
agaggggacgtttaatgacactttgcgcctc

SEQ ID NO: 169089 - DNA, 30 bp, Artificial Sequence
  Description of Artificial Sequence: Synthetic oligonucleotide
gaggggacgtttaatgacactttgcgcctc

SEQ ID NO: 169090 - DNA, 31 bp, Artificial Sequence
  Description of Artificial Sequence: Synthetic oligonucleotide
aggggacgtttaatgacactttgcgcctcac

SEQ ID NO: 169091 - DNA, 30 bp, Artificial Sequence
  Description of Artificial Sequence: Synthetic oligonucleotide
ggggacgtttaatgacactttgcgcctcac

SEQ ID NO: 169092 - DNA, 31 bp, Artificial Sequence
  Description of Artificial Sequence: Synthetic oligonucleotide
gggacgtttaatgacactttgcgcctcactg

SEQ ID NO: 169093 - DNA, 31 bp, Artificial Sequence
  Description of Artificial Sequence: Synthetic oligonucleotide
ggacgtttaatgacactttgcgcctcactgg

SEQ ID NO: 169094 - DNA, 32 bp, Artificial Sequence
  Description of Artificial Sequence: Synthetic oligonucleotide
gacgtttaatgacactttgcgcctcactggag

SEQ ID NO: 169095 - DNA, 33 bp, Artificial Sequence
  Description of Artificial Sequence: Synthetic oligonucleotide
acgtttaatgacactttgcgcctcactggagag

SEQ ID NO: 169096 - DNA, 32 bp, Artificial Sequence
  Description of Artificial Sequence: Synthetic oligonucleotide
cgtttaatgacactttgcgcctcactggagag

SEQ ID NO: 169097 - DNA, 27 bp, Artificial Sequence
  Description of Artificial Sequence: Synthetic oligonucleotide
ggaaaccttctctctcagcccagccgt

SEQ ID NO: 169098 - DNA, 27 bp, Artificial Sequence
  Description of Artificial Sequence: Synthetic oligonucleotide
gaaaccttctctctcagcccagccgtg

SEQ ID NO: 169099 - DNA, 27 bp, Artificial Sequence
  Description of Artificial Sequence: Synthetic oligonucleotide
aaaccttctctctcagcccagccgtgc

SEQ ID NO: 169100 - DNA, 26 bp, Artificial Sequence
  Description of Artificial Sequence: Synthetic oligonucleotide
aaccttctctctcagcccagccgtgc

SEQ ID NO: 169101 - DNA, 25 bp, Artificial Sequence
  Description of Artificial Sequence: Synthetic oligonucleotide
accttctctctcagcccagccgtgc

SEQ ID NO: 169102 - DNA, 24 bp, Artificial Sequence
  Description of Artificial Sequence: Synthetic oligonucleotide
ccttctctctcagcccagccgtgc

SEQ ID NO: 169103 - DNA, 24 bp, Artificial Sequence
  Description of Artificial Sequence: Synthetic oligonucleotide
cttctctctcagcccagccgtgcc

SEQ ID NO: 169104 - DNA, 24 bp, Artificial Sequence
  Description of Artificial Sequence: Synthetic oligonucleotide
ttctctctcagcccagccgtgccc

SEQ ID NO: 169105 - DNA, 23 bp, Artificial Sequence
  Description of Artificial Sequence: Synthetic oligonucleotide
tctctctcagcccagccgtgccc

SEQ ID NO: 169106 - DNA, 22 bp, Artificial Sequence
  Description of Artificial Sequence: Synthetic oligonucleotide
ctctctcagcccagccgtgccc

SEQ ID NO: 169107 - DNA, 24 bp, Artificial Sequence
  Description of Artificial Sequence: Synthetic oligonucleotide
tctctcagcccagccgtgccccat

SEQ ID NO: 169108 - DNA, 23 bp, Artificial Sequence
  Description of Artificial Sequence: Synthetic oligonucleotide
ctctcagcccagccgtgccccat

SEQ ID NO: 169109 - DNA, 23 bp, Artificial Sequence
  Description of Artificial Sequence: Synthetic oligonucleotide
tctcagcccagccgtgccccatg

SEQ ID NO: 169110 - DNA, 22 bp, Artificial Sequence
  Description of Artificial Sequence: Synthetic oligonucleotide
ctcagcccagccgtgccccatg

SEQ ID NO: 169111 - DNA, 26 bp, Artificial Sequence
  Description of Artificial Sequence: Synthetic oligonucleotide
tcagcccagccgtgccccatggttaa

SEQ ID NO: 169112 - DNA, 25 bp, Artificial Sequence
  Description of Artificial Sequence: Synthetic oligonucleotide
cagcccagccgtgccccatggttaa

SEQ ID NO: 169113 - DNA, 25 bp, Artificial Sequence
  Description of Artificial Sequence: Synthetic oligonucleotide
agcccagccgtgccccatggttaag

SEQ ID NO: 169114 - DNA, 24 bp, Artificial Sequence
  Description of Artificial Sequence: Synthetic oligonucleotide
gcccagccgtgccccatggttaag

SEQ ID NO: 169115 - DNA, 24 bp, Artificial Sequence
  Description of Artificial Sequence: Synthetic oligonucleotide
cccagccgtgccccatggttaagg

SEQ ID NO: 169116 - DNA, 25 bp, Artificial Sequence
  Description of Artificial Sequence: Synthetic oligonucleotide
ccagccgtgccccatggttaaggca

SEQ ID NO: 169117 - DNA, 25 bp, Artificial Sequence
  Description of Artificial Sequence: Synthetic oligonucleotide
cagccgtgccccatggttaaggcag

SEQ ID NO: 169118 - DNA, 26 bp, Artificial Sequence
  Description of Artificial Sequence: Synthetic oligonucleotide
agccgtgccccatggttaaggcagga

SEQ ID NO: 169119 - DNA, 25 bp, Artificial Sequence
  Description of Artificial Sequence: Synthetic oligonucleotide
gccgtgccccatggttaaggcagga

SEQ ID NO: 169120 - DNA, 26 bp, Artificial Sequence
  Description of Artificial Sequence: Synthetic oligonucleotide
ccgtgccccatggttaaggcaggaga

SEQ ID NO: 169121 - DNA, 27 bp, Artificial Sequence
  Description of Artificial Sequence: Synthetic oligonucleotide
cgtgccccatggttaaggcaggagaga

SEQ ID NO: 169122 - DNA, 27 bp, Artificial Sequence
  Description of Artificial Sequence: Synthetic oligonucleotide
gtgccccatggttaaggcaggagagag

SEQ ID NO: 169123 - DNA, 27 bp, Artificial Sequence
  Description of Artificial Sequence: Synthetic oligonucleotide
tgccccatggttaaggcaggagagagc

SEQ ID NO: 169124 - DNA, 26 bp, Artificial Sequence
  Description of Artificial Sequence: Synthetic oligonucleotide
gggacggggaggctcatgaacttagg

SEQ ID NO: 169125 - DNA, 27 bp, Artificial Sequence
  Description of Artificial Sequence: Synthetic oligonucleotide
ggacggggaggctcatgaacttaggct

SEQ ID NO: 169126 - DNA, 27 bp, Artificial Sequence
  Description of Artificial Sequence: Synthetic oligonucleotide
gacggggaggctcatgaacttaggctc

SEQ ID NO: 169127 - DNA, 27 bp, Artificial Sequence
  Description of Artificial Sequence: Synthetic oligonucleotide
acggggaggctcatgaacttaggctcc

SEQ ID NO: 169128 - DNA, 26 bp, Artificial Sequence
  Description of Artificial Sequence: Synthetic oligonucleotide
cggggaggctcatgaacttaggctcc

SEQ ID NO: 169129 - DNA, 27 bp, Artificial Sequence
  Description of Artificial Sequence: Synthetic oligonucleotide
ggggaggctcatgaacttaggctccct

SEQ ID NO: 169130 - DNA, 27 bp, Artificial Sequence
  Description of Artificial Sequence: Synthetic oligonucleotide
gggaggctcatgaacttaggctccctg

SEQ ID NO: 169131 - DNA, 27 bp, Artificial Sequence
  Description of Artificial Sequence: Synthetic oligonucleotide
ggaggctcatgaacttaggctccctgc

SEQ ID NO: 169132 - DNA, 28 bp, Artificial Sequence
  Description of Artificial Sequence: Synthetic oligonucleotide
gaggctcatgaacttaggctccctgcag

SEQ ID NO: 169133 - DNA, 29 bp, Artificial Sequence
  Description of Artificial Sequence: Synthetic oligonucleotide
aggctcatgaacttaggctccctgcagtg

SEQ ID NO: 169134 - DNA, 28 bp, Artificial Sequence
  Description of Artificial Sequence: Synthetic oligonucleotide
ggctcatgaacttaggctccctgcagtg

SEQ ID NO: 169135 - DNA, 28 bp, Artificial Sequence
  Description of Artificial Sequence: Synthetic oligonucleotide
gctcatgaacttaggctccctgcagtgc

SEQ ID NO: 169136 - DNA, 28 bp, Artificial Sequence
  Description of Artificial Sequence: Synthetic oligonucleotide
ctcatgaacttaggctccctgcagtgcc

SEQ ID NO: 169137 - DNA, 28 bp, Artificial Sequence
  Description of Artificial Sequence: Synthetic oligonucleotide
tcatgaacttaggctccctgcagtgccc

SEQ ID NO: 169138 - DNA, 29 bp, Artificial Sequence
  Description of Artificial Sequence: Synthetic oligonucleotide
atgaacttaggctccctgcagtgcccaag

SEQ ID NO: 169139 - DNA, 28 bp, Artificial Sequence
  Description of Artificial Sequence: Synthetic oligonucleotide
tgaacttaggctccctgcagtgcccaag

SEQ ID NO: 169140 - DNA, 27 bp, Artificial Sequence
  Description of Artificial Sequence: Synthetic oligonucleotide
gaacttaggctccctgcagtgcccaag

SEQ ID NO: 169141 - DNA, 27 bp, Artificial Sequence
  Description of Artificial Sequence: Synthetic oligonucleotide
aacttaggctccctgcagtgcccaagg

SEQ ID NO: 169142 - DNA, 27 bp, Artificial Sequence
  Description of Artificial Sequence: Synthetic oligonucleotide
acttaggctccctgcagtgcccaaggt

SEQ ID NO: 169143 - DNA, 26 bp, Artificial Sequence
  Description of Artificial Sequence: Synthetic oligonucleotide
cttaggctccctgcagtgcccaaggt

SEQ ID NO: 169144 - DNA, 27 bp, Artificial Sequence
  Description of Artificial Sequence: Synthetic oligonucleotide
ttaggctccctgcagtgcccaaggtca

SEQ ID NO: 169145 - DNA, 27 bp, Artificial Sequence
  Description of Artificial Sequence: Synthetic oligonucleotide
taggctccctgcagtgcccaaggtcaa

SEQ ID NO: 169146 - DNA, 27 bp, Artificial Sequence
  Description of Artificial Sequence: Synthetic oligonucleotide
aggctccctgcagtgcccaaggtcaat

SEQ ID NO: 169147 - DNA, 26 bp, Artificial Sequence
  Description of Artificial Sequence: Synthetic oligonucleotide
ggctccctgcagtgcccaaggtcaat

SEQ ID NO: 169148 - DNA, 26 bp, Artificial Sequence
  Description of Artificial Sequence: Synthetic oligonucleotide
gctccctgcagtgcccaaggtcaatg

SEQ ID NO: 169149 - DNA, 27 bp, Artificial Sequence
  Description of Artificial Sequence: Synthetic oligonucleotide
ctccctgcagtgcccaaggtcaatgga

SEQ ID NO: 169150 - DNA, 35 bp, Artificial Sequence
  Description of Artificial Sequence: Synthetic oligonucleotide
gtttaacgaattcagtctgtccaaagaagacgggg

SEQ ID NO: 169151 - DNA, 36 bp, Artificial Sequence
  Description of Artificial Sequence: Synthetic oligonucleotide
tttaacgaattcagtctgtccaaagaagacggggtg

SEQ ID NO: 169152 - DNA, 35 bp, Artificial Sequence
  Description of Artificial Sequence: Synthetic oligonucleotide
ttaacgaattcagtctgtccaaagaagacggggtg

SEQ ID NO: 169153 - DNA, 34 bp, Artificial Sequence
  Description of Artificial Sequence: Synthetic oligonucleotide
taacgaattcagtctgtccaaagaagacggggtg

SEQ ID NO: 169154 - DNA, 33 bp, Artificial Sequence
  Description of Artificial Sequence: Synthetic oligonucleotide
aacgaattcagtctgtccaaagaagacggggtg

SEQ ID NO: 169155 - DNA, 32 bp, Artificial Sequence
  Description of Artificial Sequence: Synthetic oligonucleotide
acgaattcagtctgtccaaagaagacggggtg

SEQ ID NO: 169156 - DNA, 31 bp, Artificial Sequence
  Description of Artificial Sequence: Synthetic oligonucleotide
cgaattcagtctgtccaaagaagacggggtg

SEQ ID NO: 169157 - DNA, 31 bp, Artificial Sequence
  Description of Artificial Sequence: Synthetic oligonucleotide
gaattcagtctgtccaaagaagacggggtgc

SEQ ID NO: 169158 - DNA, 31 bp, Artificial Sequence
  Description of Artificial Sequence: Synthetic oligonucleotide
aattcagtctgtccaaagaagacggggtgcc

SEQ ID NO: 169159 - DNA, 30 bp, Artificial Sequence
  Description of Artificial Sequence: Synthetic oligonucleotide
attcagtctgtccaaagaagacggggtgcc

SEQ ID NO: 169160 - DNA, 29 bp, Artificial Sequence
  Description of Artificial Sequence: Synthetic oligonucleotide
ttcagtctgtccaaagaagacggggtgcc

SEQ ID NO: 169161 - DNA, 28 bp, Artificial Sequence
  Description of Artificial Sequence: Synthetic oligonucleotide
tcagtctgtccaaagaagacggggtgcc

SEQ ID NO: 169162 - DNA, 27 bp, Artificial Sequence
  Description of Artificial Sequence: Synthetic oligonucleotide
cagtctgtccaaagaagacggggtgcc

SEQ ID NO: 169163 - DNA, 28 bp, Artificial Sequence
  Description of Artificial Sequence: Synthetic oligonucleotide
agtctgtccaaagaagacggggtgcctg

SEQ ID NO: 169164 - DNA, 27 bp, Artificial Sequence
  Description of Artificial Sequence: Synthetic oligonucleotide
gtctgtccaaagaagacggggtgcctg

SEQ ID NO: 169165 - DNA, 28 bp, Artificial Sequence
  Description of Artificial Sequence: Synthetic oligonucleotide
tctgtccaaagaagacggggtgcctgtc

SEQ ID NO: 169166 - DNA, 27 bp, Artificial Sequence
  Description of Artificial Sequence: Synthetic oligonucleotide
ctgtccaaagaagacggggtgcctgtc

SEQ ID NO: 169167 - DNA, 27 bp, Artificial Sequence
  Description of Artificial Sequence: Synthetic oligonucleotide
tgtccaaagaagacggggtgcctgtcc

SEQ ID NO: 169168 - DNA, 26 bp, Artificial Sequence
  Description of Artificial Sequence: Synthetic oligonucleotide
gtccaaagaagacggggtgcctgtcc

SEQ ID NO: 169169 - DNA, 27 bp, Artificial Sequence
  Description of Artificial Sequence: Synthetic oligonucleotide
tccaaagaagacggggtgcctgtccct

SEQ ID NO: 169170 - DNA, 26 bp, Artificial Sequence
  Description of Artificial Sequence: Synthetic oligonucleotide
ccaaagaagacggggtgcctgtccct

SEQ ID NO: 169171 - DNA, 27 bp, Artificial Sequence
  Description of Artificial Sequence: Synthetic oligonucleotide
caaagaagacggggtgcctgtccctga

SEQ ID NO: 169172 - DNA, 27 bp, Artificial Sequence
  Description of Artificial Sequence: Synthetic oligonucleotide
aaagaagacggggtgcctgtccctgag

SEQ ID NO: 169173 - DNA, 26 bp, Artificial Sequence
  Description of Artificial Sequence: Synthetic oligonucleotide
aagaagacggggtgcctgtccctgag

SEQ ID NO: 169174 - DNA, 25 bp, Artificial Sequence
  Description of Artificial Sequence: Synthetic oligonucleotide
agaagacggggtgcctgtccctgag

SEQ ID NO: 169175 - DNA, 24 bp, Artificial Sequence
  Description of Artificial Sequence: Synthetic oligonucleotide
gaagacggggtgcctgtccctgag

SEQ ID NO: 169176 - DNA, 25 bp, Artificial Sequence
  Description of Artificial Sequence: Synthetic oligonucleotide
aagacggggtgcctgtccctgagct

SEQ ID NO: 169177 - DNA, 24 bp, Artificial Sequence
  Description of Artificial Sequence: Synthetic oligonucleotide
agacggggtgcctgtccctgagct

SEQ ID NO: 169178 - DNA, 23 bp, Artificial Sequence
  Description of Artificial Sequence: Synthetic oligonucleotide
gacggggtgcctgtccctgagct

SEQ ID NO: 169179 - DNA, 25 bp, Artificial Sequence
  Description of Artificial Sequence: Synthetic oligonucleotide
acggggtgcctgtccctgagctcta

SEQ ID NO: 169180 - DNA, 24 bp, Artificial Sequence
  Description of Artificial Sequence: Synthetic oligonucleotide
cggggtgcctgtccctgagctcta

SEQ ID NO: 169181 - DNA, 27 bp, Artificial Sequence
  Description of Artificial Sequence: Synthetic oligonucleotide
ggtgcctgtccctgagctctacaacag

SEQ ID NO: 169182 - DNA, 28 bp, Artificial Sequence
  Description of Artificial Sequence: Synthetic oligonucleotide
gtgcctgtccctgagctctacaacagag

SEQ ID NO: 169183 - DNA, 27 bp, Artificial Sequence
  Description of Artificial Sequence: Synthetic oligonucleotide
cctcactggagagctccatgatgggct

SEQ ID NO: 169184 - DNA, 27 bp, Artificial Sequence
  Description of Artificial Sequence: Synthetic oligonucleotide
ctcactggagagctccatgatgggctc

SEQ ID NO: 169185 - DNA, 28 bp, Artificial Sequence
  Description of Artificial Sequence: Synthetic oligonucleotide
tcactggagagctccatgatgggctctc

SEQ ID NO: 169186 - DNA, 27 bp, Artificial Sequence
  Description of Artificial Sequence: Synthetic oligonucleotide
cactggagagctccatgatgggctctc

SEQ ID NO: 169187 - DNA, 27 bp, Artificial Sequence
  Description of Artificial Sequence: Synthetic oligonucleotide
actggagagctccatgatgggctctcc

SEQ ID NO: 169188 - DNA, 27 bp, Artificial Sequence
  Description of Artificial Sequence: Synthetic oligonucleotide
ctggagagctccatgatgggctctcca

SEQ ID NO: 169189 - DNA, 28 bp, Artificial Sequence
  Description of Artificial Sequence: Synthetic oligonucleotide
tggagagctccatgatgggctctccaag

SEQ ID NO: 169190 - DNA, 27 bp, Artificial Sequence
  Description of Artificial Sequence: Synthetic oligonucleotide
ggagagctccatgatgggctctccaag

SEQ ID NO: 169191 - DNA, 27 bp, Artificial Sequence
  Description of Artificial Sequence: Synthetic oligonucleotide
gagagctccatgatgggctctccaagg

SEQ ID NO: 169192 - DNA, 27 bp, Artificial Sequence
  Description of Artificial Sequence: Synthetic oligonucleotide
agagctccatgatgggctctccaaggc

SEQ ID NO: 169193 - DNA, 26 bp, Artificial Sequence
  Description of Artificial Sequence: Synthetic oligonucleotide
gagctccatgatgggctctccaaggc

SEQ ID NO: 169194 - DNA, 27 bp, Artificial Sequence
  Description of Artificial Sequence: Synthetic oligonucleotide
agctccatgatgggctctccaaggcca

SEQ ID NO: 169195 - DNA, 27 bp, Artificial Sequence
  Description of Artificial Sequence: Synthetic oligonucleotide
gctccatgatgggctctccaaggccaa

SEQ ID NO: 169196 - DNA, 27 bp, Artificial Sequence
  Description of Artificial Sequence: Synthetic oligonucleotide
ctccatgatgggctctccaaggccaac

SEQ ID NO: 169197 - DNA, 29 bp, Artificial Sequence
  Description of Artificial Sequence: Synthetic oligonucleotide
tccatgatgggctctccaaggccaacttc

SEQ ID NO: 169198 - DNA, 28 bp, Artificial Sequence
  Description of Artificial Sequence: Synthetic oligonucleotide
ccatgatgggctctccaaggccaacttc

SEQ ID NO: 169199 - DNA, 29 bp, Artificial Sequence
  Description of Artificial Sequence: Synthetic oligonucleotide
catgatgggctctccaaggccaacttctc

SEQ ID NO: 169200 - DNA, 29 bp, Artificial Sequence
  Description of Artificial Sequence: Synthetic oligonucleotide
atgatgggctctccaaggccaacttctcc

SEQ ID NO: 169201 - DNA, 28 bp, Artificial Sequence
  Description of Artificial Sequence: Synthetic oligonucleotide
tgatgggctctccaaggccaacttctcc

SEQ ID NO: 169202 - DNA, 27 bp, Artificial Sequence
  Description of Artificial Sequence: Synthetic oligonucleotide
gatgggctctccaaggccaacttctcc

SEQ ID NO: 169203 - DNA, 29 bp, Artificial Sequence
  Description of Artificial Sequence: Synthetic oligonucleotide
atgggctctccaaggccaacttctccatc

SEQ ID NO: 169204 - DNA, 28 bp, Artificial Sequence
  Description of Artificial Sequence: Synthetic oligonucleotide
tgggctctccaaggccaacttctccatc

SEQ ID NO: 169205 - DNA, 27 bp, Artificial Sequence
  Description of Artificial Sequence: Synthetic oligonucleotide
gggctctccaaggccaacttctccatc

SEQ ID NO: 169206 - DNA, 27 bp, Artificial Sequence
  Description of Artificial Sequence: Synthetic oligonucleotide
ggctctccaaggccaacttctccatcg

SEQ ID NO: 169207 - DNA, 27 bp, Artificial Sequence
  Description of Artificial Sequence: Synthetic oligonucleotide
gctctccaaggccaacttctccatcgg

SEQ ID NO: 169208 - DNA, 28 bp, Artificial Sequence
  Description of Artificial Sequence: Synthetic oligonucleotide
ctctccaaggccaacttctccatcggtc

SEQ ID NO: 169209 - DNA, 27 bp, Artificial Sequence
  Description of Artificial Sequence: Synthetic oligonucleotide
cacccaggtcccctggtgaaatcagag

SEQ ID NO: 169210 - DNA, 27 bp, Artificial Sequence
  Description of Artificial Sequence: Synthetic oligonucleotide
acccaggtcccctggtgaaatcagagg

SEQ ID NO: 169211 - DNA, 27 bp, Artificial Sequence
  Description of Artificial Sequence: Synthetic oligonucleotide
cccaggtcccctggtgaaatcagagga

SEQ ID NO: 169212 - DNA, 27 bp, Artificial Sequence
  Description of Artificial Sequence: Synthetic oligonucleotide
ccaggtcccctggtgaaatcagaggag

SEQ ID NO: 169213 - DNA, 28 bp, Artificial Sequence
  Description of Artificial Sequence: Synthetic oligonucleotide
caggtcccctggtgaaatcagaggagac

SEQ ID NO: 169214 - DNA, 29 bp, Artificial Sequence
  Description of Artificial Sequence: Synthetic oligonucleotide
aggtcccctggtgaaatcagaggagacag

SEQ ID NO: 169215 - DNA, 28 bp, Artificial Sequence
  Description of Artificial Sequence: Synthetic oligonucleotide
ggtcccctggtgaaatcagaggagacag

SEQ ID NO: 169216 - DNA, 29 bp, Artificial Sequence
  Description of Artificial Sequence: Synthetic oligonucleotide
gtcccctggtgaaatcagaggagacagtc

SEQ ID NO: 169217 - DNA, 31 bp, Artificial Sequence
  Description of Artificial Sequence: Synthetic oligonucleotide
tcccctggtgaaatcagaggagacagtcatc

SEQ ID NO: 169218 - DNA, 30 bp, Artificial Sequence
  Description of Artificial Sequence: Synthetic oligonucleotide
cccctggtgaaatcagaggagacagtcatc

SEQ ID NO: 169219 - DNA, 30 bp, Artificial Sequence
  Description of Artificial Sequence: Synthetic oligonucleotide
ccctggtgaaatcagaggagacagtcatcc

SEQ ID NO: 169220 - DNA, 31 bp, Artificial Sequence
  Description of Artificial Sequence: Synthetic oligonucleotide
cctggtgaaatcagaggagacagtcatcctg

SEQ ID NO: 169221 - DNA, 31 bp, Artificial Sequence
  Description of Artificial Sequence: Synthetic oligonucleotide
ctggtgaaatcagaggagacagtcatcctgc

SEQ ID NO: 169222 - DNA, 34 bp, Artificial Sequence
  Description of Artificial Sequence: Synthetic oligonucleotide
tggtgaaatcagaggagacagtcatcctgcaatg

SEQ ID NO: 169223 - DNA, 33 bp, Artificial Sequence
  Description of Artificial Sequence: Synthetic oligonucleotide
ggtgaaatcagaggagacagtcatcctgcaatg

SEQ ID NO: 169224 - DNA, 35 bp, Artificial Sequence
  Description of Artificial Sequence: Synthetic oligonucleotide
gtgaaatcagaggagacagtcatcctgcaatgttg

SEQ ID NO: 169225 - DNA, 35 bp, Artificial Sequence
  Description of Artificial Sequence: Synthetic oligonucleotide
tgaaatcagaggagacagtcatcctgcaatgttgg

SEQ ID NO: 169226 - DNA, 34 bp, Artificial Sequence
  Description of Artificial Sequence: Synthetic oligonucleotide
gaaatcagaggagacagtcatcctgcaatgttgg

SEQ ID NO: 169227 - DNA, 35 bp, Artificial Sequence
  Description of Artificial Sequence: Synthetic oligonucleotide
aaatcagaggagacagtcatcctgcaatgttggtc

SEQ ID NO: 169228 - DNA, 34 bp, Artificial Sequence
  Description of Artificial Sequence: Synthetic oligonucleotide
aatcagaggagacagtcatcctgcaatgttggtc

SEQ ID NO: 169229 - DNA, 33 bp, Artificial Sequence
  Description of Artificial Sequence: Synthetic oligonucleotide
atcagaggagacagtcatcctgcaatgttggtc

SEQ ID NO: 169230 - DNA, 32 bp, Artificial Sequence
  Description of Artificial Sequence: Synthetic oligonucleotide
tcagaggagacagtcatcctgcaatgttggtc

SEQ ID NO: 169231 - DNA, 31 bp, Artificial Sequence
  Description of Artificial Sequence: Synthetic oligonucleotide
cagaggagacagtcatcctgcaatgttggtc

SEQ ID NO: 169232 - DNA, 32 bp, Artificial Sequence
  Description of Artificial Sequence: Synthetic oligonucleotide
agaggagacagtcatcctgcaatgttggtcag

SEQ ID NO: 169233 - DNA, 31 bp, Artificial Sequence
  Description of Artificial Sequence: Synthetic oligonucleotide
gaggagacagtcatcctgcaatgttggtcag

SEQ ID NO: 169234 - DNA, 33 bp, Artificial Sequence
  Description of Artificial Sequence: Synthetic oligonucleotide
aggagacagtcatcctgcaatgttggtcagatg

SEQ ID NO: 169235 - DNA, 32 bp, Artificial Sequence
  Description of Artificial Sequence: Synthetic oligonucleotide
ggagacagtcatcctgcaatgttggtcagatg

SEQ ID NO: 169236 - DNA, 32 bp, Artificial Sequence
  Description of Artificial Sequence: Synthetic oligonucleotide
ccacagaaccaagctccaaatctggtaacctc

SEQ ID NO: 169237 - DNA, 33 bp, Artificial Sequence
  Description of Artificial Sequence: Synthetic oligonucleotide
cacagaaccaagctccaaatctggtaacctcag

SEQ ID NO: 169238 - DNA, 34 bp, Artificial Sequence
  Description of Artificial Sequence: Synthetic oligonucleotide
acagaaccaagctccaaatctggtaacctcagac

SEQ ID NO: 169239 - DNA, 33 bp, Artificial Sequence
  Description of Artificial Sequence: Synthetic oligonucleotide
cagaaccaagctccaaatctggtaacctcagac

SEQ ID NO: 169240 - DNA, 34 bp, Artificial Sequence
  Description of Artificial Sequence: Synthetic oligonucleotide
agaaccaagctccaaatctggtaacctcagacac

SEQ ID NO: 169241 - DNA, 33 bp, Artificial Sequence
  Description of Artificial Sequence: Synthetic oligonucleotide
gaaccaagctccaaatctggtaacctcagacac

SEQ ID NO: 169242 - DNA, 33 bp, Artificial Sequence
  Description of Artificial Sequence: Synthetic oligonucleotide
aaccaagctccaaatctggtaacctcagacacc

SEQ ID NO: 169243 - DNA, 32 bp, Artificial Sequence
  Description of Artificial Sequence: Synthetic oligonucleotide
accaagctccaaatctggtaacctcagacacc

SEQ ID NO: 169244 - DNA, 31 bp, Artificial Sequence
  Description of Artificial Sequence: Synthetic oligonucleotide
ccaagctccaaatctggtaacctcagacacc

SEQ ID NO: 169245 - DNA, 32 bp, Artificial Sequence
  Description of Artificial Sequence: Synthetic oligonucleotide
caagctccaaatctggtaacctcagacacctg

SEQ ID NO: 169246 - DNA, 32 bp, Artificial Sequence
  Description of Artificial Sequence: Synthetic oligonucleotide
aagctccaaatctggtaacctcagacacctgc

SEQ ID NO: 169247 - DNA, 31 bp, Artificial Sequence
  Description of Artificial Sequence: Synthetic oligonucleotide
agctccaaatctggtaacctcagacacctgc

SEQ ID NO: 169248 - DNA, 30 bp, Artificial Sequence
  Description of Artificial Sequence: Synthetic oligonucleotide
gctccaaatctggtaacctcagacacctgc

SEQ ID NO: 169249 - DNA, 31 bp, Artificial Sequence
  Description of Artificial Sequence: Synthetic oligonucleotide
ctccaaatctggtaacctcagacacctgcac

SEQ ID NO: 169250 - DNA, 34 bp, Artificial Sequence
  Description of Artificial Sequence: Synthetic oligonucleotide
tccaaatctggtaacctcagacacctgcacattc

SEQ ID NO: 169251 - DNA, 33 bp, Artificial Sequence
  Description of Artificial Sequence: Synthetic oligonucleotide
ccaaatctggtaacctcagacacctgcacattc

SEQ ID NO: 169252 - DNA, 34 bp, Artificial Sequence
  Description of Artificial Sequence: Synthetic oligonucleotide
caaatctggtaacctcagacacctgcacattctg

SEQ ID NO: 169253 - DNA, 37 bp, Artificial Sequence
  Description of Artificial Sequence: Synthetic oligonucleotide
aaatctggtaacctcagacacctgcacattctgattg

SEQ ID NO: 169254 - DNA, 36 bp, Artificial Sequence
  Description of Artificial Sequence: Synthetic oligonucleotide
aatctggtaacctcagacacctgcacattctgattg

SEQ ID NO: 169255 - DNA, 35 bp, Artificial Sequence
  Description of Artificial Sequence: Synthetic oligonucleotide
atctggtaacctcagacacctgcacattctgattg

SEQ ID NO: 169256 - DNA, 34 bp, Artificial Sequence
  Description of Artificial Sequence: Synthetic oligonucleotide
tctggtaacctcagacacctgcacattctgattg

SEQ ID NO: 169257 - DNA, 33 bp, Artificial Sequence
  Description of Artificial Sequence: Synthetic oligonucleotide
ctggtaacctcagacacctgcacattctgattg

SEQ ID NO: 169258 - DNA, 33 bp, Artificial Sequence
  Description of Artificial Sequence: Synthetic oligonucleotide
tggtaacctcagacacctgcacattctgattgg

SEQ ID NO: 169259 - DNA, 32 bp, Artificial Sequence
  Description of Artificial Sequence: Synthetic oligonucleotide
ggtaacctcagacacctgcacattctgattgg

SEQ ID NO: 169260 - DNA, 32 bp, Artificial Sequence
  Description of Artificial Sequence: Synthetic oligonucleotide
gtaacctcagacacctgcacattctgattggg

SEQ ID NO: 169261 - DNA, 33 bp, Artificial Sequence
  Description of Artificial Sequence: Synthetic oligonucleotide
taacctcagacacctgcacattctgattgggac

SEQ ID NO: 169262 - DNA, 32 bp, Artificial Sequence
  Description of Artificial Sequence: Synthetic oligonucleotide
aacctcagacacctgcacattctgattgggac

SEQ ID NO: 169263 - DNA, 31 bp, Artificial Sequence
  Description of Artificial Sequence: Synthetic oligonucleotide
acctcagacacctgcacattctgattgggac

SEQ ID NO: 169264 - DNA, 35 bp, Artificial Sequence
  Description of Artificial Sequence: Synthetic oligonucleotide
tgcacattctgattgggacctcagtggtcaaaatc

SEQ ID NO: 169265 - DNA, 34 bp, Artificial Sequence
  Description of Artificial Sequence: Synthetic oligonucleotide
gcacattctgattgggacctcagtggtcaaaatc

SEQ ID NO: 169266 - DNA, 34 bp, Artificial Sequence
  Description of Artificial Sequence: Synthetic oligonucleotide
cacattctgattgggacctcagtggtcaaaatcc

SEQ ID NO: 169267 - DNA, 34 bp, Artificial Sequence
  Description of Artificial Sequence: Synthetic oligonucleotide
acattctgattgggacctcagtggtcaaaatccc

SEQ ID NO: 169268 - DNA, 33 bp, Artificial Sequence
  Description of Artificial Sequence: Synthetic oligonucleotide
cattctgattgggacctcagtggtcaaaatccc

SEQ ID NO: 169269 - DNA, 31 bp, Artificial Sequence
  Description of Artificial Sequence: Synthetic oligonucleotide
taatggaccaagagcctgcagggaacagaag

SEQ ID NO: 169270 - DNA, 30 bp, Artificial Sequence
  Description of Artificial Sequence: Synthetic oligonucleotide
aatggaccaagagcctgcagggaacagaag

SEQ ID NO: 169271 - DNA, 29 bp, Artificial Sequence
  Description of Artificial Sequence: Synthetic oligonucleotide
atggaccaagagcctgcagggaacagaag

SEQ ID NO: 169272 - DNA, 28 bp, Artificial Sequence
  Description of Artificial Sequence: Synthetic oligonucleotide
tggaccaagagcctgcagggaacagaag

SEQ ID NO: 169273 - DNA, 27 bp, Artificial Sequence
  Description of Artificial Sequence: Synthetic oligonucleotide
ggaccaagagcctgcagggaacagaag

SEQ ID NO: 169274 - DNA, 28 bp, Artificial Sequence
  Description of Artificial Sequence: Synthetic oligonucleotide
gaccaagagcctgcagggaacagaagtg

SEQ ID NO: 169275 - DNA, 30 bp, Artificial Sequence
  Description of Artificial Sequence: Synthetic oligonucleotide
accaagagcctgcagggaacagaagtgaac

SEQ ID NO: 169276 - DNA, 29 bp, Artificial Sequence
  Description of Artificial Sequence: Synthetic oligonucleotide
ccaagagcctgcagggaacagaagtgaac

SEQ ID NO: 169277 - DNA, 30 bp, Artificial Sequence
  Description of Artificial Sequence: Synthetic oligonucleotide
caagagcctgcagggaacagaagtgaacag

SEQ ID NO: 169278 - DNA, 30 bp, Artificial Sequence
  Description of Artificial Sequence: Synthetic oligonucleotide
aagagcctgcagggaacagaagtgaacagc

SEQ ID NO: 169279 - DNA, 29 bp, Artificial Sequence
  Description of Artificial Sequence: Synthetic oligonucleotide
agagcctgcagggaacagaagtgaacagc

SEQ ID NO: 169280 - DNA, 28 bp, Artificial Sequence
  Description of Artificial Sequence: Synthetic oligonucleotide
gagcctgcagggaacagaagtgaacagc

SEQ ID NO: 169281 - DNA, 28 bp, Artificial Sequence
  Description of Artificial Sequence: Synthetic oligonucleotide
agcctgcagggaacagaagtgaacagcg

SEQ ID NO: 169282 - DNA, 27 bp, Artificial Sequence
  Description of Artificial Sequence: Synthetic oligonucleotide
gcctgcagggaacagaagtgaacagcg

SEQ ID NO: 169283 - DNA, 28 bp, Artificial Sequence
  Description of Artificial Sequence: Synthetic oligonucleotide
cctgcagggaacagaagtgaacagcgag

SEQ ID NO: 169284 - DNA, 28 bp, Artificial Sequence
  Description of Artificial Sequence: Synthetic oligonucleotide
ctgcagggaacagaagtgaacagcgagg

SEQ ID NO: 169285 - DNA, 31 bp, Artificial Sequence
  Description of Artificial Sequence: Synthetic oligonucleotide
tgcagggaacagaagtgaacagcgaggattc

SEQ ID NO: 169286 - DNA, 30 bp, Artificial Sequence
  Description of Artificial Sequence: Synthetic oligonucleotide
gcagggaacagaagtgaacagcgaggattc

SEQ ID NO: 169287 - DNA, 31 bp, Artificial Sequence
  Description of Artificial Sequence: Synthetic oligonucleotide
cagggaacagaagtgaacagcgaggattctg

SEQ ID NO: 169288 - DNA, 36 bp, Artificial Sequence
  Description of Artificial Sequence: Synthetic oligonucleotide
tggtcacaggtctatatgagaaaccttctctctcac

SEQ ID NO: 169289 - DNA, 35 bp, Artificial Sequence
  Description of Artificial Sequence: Synthetic oligonucleotide
ggtcacaggtctatatgagaaaccttctctctcac

SEQ ID NO: 169290 - DNA, 35 bp, Artificial Sequence
  Description of Artificial Sequence: Synthetic oligonucleotide
gtcacaggtctatatgagaaaccttctctctcacc

SEQ ID NO: 169291 - DNA, 22 bp, Artificial Sequence
  Description of Artificial Sequence: Synthetic oligonucleotide
tctcaccgcagccgggccccaa

SEQ ID NO: 169292 - DNA, 21 bp, Artificial Sequence
  Description of Artificial Sequence: Synthetic oligonucleotide
ctcaccgcagccgggccccaa

SEQ ID NO: 169293 - DNA, 21 bp, Artificial Sequence
  Description of Artificial Sequence: Synthetic oligonucleotide
tcaccgcagccgggccccaag

SEQ ID NO: 169294 - DNA, 20 bp, Artificial Sequence
  Description of Artificial Sequence: Synthetic oligonucleotide
caccgcagccgggccccaag

SEQ ID NO: 169295 - DNA, 22 bp, Artificial Sequence
  Description of Artificial Sequence: Synthetic oligonucleotide
accgcagccgggccccaaggtt

SEQ ID NO: 169296 - DNA, 21 bp, Artificial Sequence
  Description of Artificial Sequence: Synthetic oligonucleotide
ccgcagccgggccccaaggtt

SEQ ID NO: 169297 - DNA, 22 bp, Artificial Sequence
  Description of Artificial Sequence: Synthetic oligonucleotide
cgcagccgggccccaaggttca

SEQ ID NO: 169298 - DNA, 22 bp, Artificial Sequence
  Description of Artificial Sequence: Synthetic oligonucleotide
gcagccgggccccaaggttcag

SEQ ID NO: 169299 - DNA, 41 bp, Artificial Sequence
  Description of Artificial Sequence: Synthetic oligonucleotide
ttctttctccttcatcgctggtgctccaacaaaaaaaaatg

SEQ ID NO: 169300 - DNA, 40 bp, Artificial Sequence
  Description of Artificial Sequence: Synthetic oligonucleotide
tctttctccttcatcgctggtgctccaacaaaaaaaaatg

SEQ ID NO: 169301 - DNA, 39 bp, Artificial Sequence
  Description of Artificial Sequence: Synthetic oligonucleotide
ctttctccttcatcgctggtgctccaacaaaaaaaaatg

SEQ ID NO: 169302 - DNA, 39 bp, Artificial Sequence
  Description of Artificial Sequence: Synthetic oligonucleotide
tttctccttcatcgctggtgctccaacaaaaaaaaatgc

SEQ ID NO: 169303 - DNA, 38 bp, Artificial Sequence
  Description of Artificial Sequence: Synthetic oligonucleotide
ttctccttcatcgctggtgctccaacaaaaaaaaatgc

SEQ ID NO: 169304 - DNA, 37 bp, Artificial Sequence
  Description of Artificial Sequence: Synthetic oligonucleotide
tctccttcatcgctggtgctccaacaaaaaaaaatgc

SEQ ID NO: 169305 - DNA, 36 bp, Artificial Sequence
  Description of Artificial Sequence: Synthetic oligonucleotide
ctccttcatcgctggtgctccaacaaaaaaaaatgc

SEQ ID NO: 169306 - DNA, 37 bp, Artificial Sequence
  Description of Artificial Sequence: Synthetic oligonucleotide
tccttcatcgctggtgctccaacaaaaaaaaatgctg

SEQ ID NO: 169307 - DNA, 36 bp, Artificial Sequence
  Description of Artificial Sequence: Synthetic oligonucleotide
ccttcatcgctggtgctccaacaaaaaaaaatgctg

SEQ ID NO: 169308 - DNA, 36 bp, Artificial Sequence
  Description of Artificial Sequence: Synthetic oligonucleotide
cttcatcgctggtgctccaacaaaaaaaaatgctgc

SEQ ID NO: 169309 - DNA, 37 bp, Artificial Sequence
  Description of Artificial Sequence: Synthetic oligonucleotide
ttcatcgctggtgctccaacaaaaaaaaatgctgctg

SEQ ID NO: 169310 - DNA, 36 bp, Artificial Sequence
  Description of Artificial Sequence: Synthetic oligonucleotide
tcatcgctggtgctccaacaaaaaaaaatgctgctg

SEQ ID NO: 169311 - DNA, 35 bp, Artificial Sequence
  Description of Artificial Sequence: Synthetic oligonucleotide
catcgctggtgctccaacaaaaaaaaatgctgctg

SEQ ID NO: 169312 - DNA, 39 bp, Artificial Sequence
  Description of Artificial Sequence: Synthetic oligonucleotide
atcgctggtgctccaacaaaaaaaaatgctgctgtaatg

SEQ ID NO: 169313 - DNA, 38 bp, Artificial Sequence
  Description of Artificial Sequence: Synthetic oligonucleotide
tcgctggtgctccaacaaaaaaaaatgctgctgtaatg

SEQ ID NO: 169314 - DNA, 37 bp, Artificial Sequence
  Description of Artificial Sequence: Synthetic oligonucleotide
cgctggtgctccaacaaaaaaaaatgctgctgtaatg

SEQ ID NO: 169315 - DNA, 37 bp, Artificial Sequence
  Description of Artificial Sequence: Synthetic oligonucleotide
gctggtgctccaacaaaaaaaaatgctgctgtaatgg

SEQ ID NO: 169316 - DNA, 38 bp, Artificial Sequence
  Description of Artificial Sequence: Synthetic oligonucleotide
ctggtgctccaacaaaaaaaaatgctgctgtaatggac

SEQ ID NO: 169317 - DNA, 38 bp, Artificial Sequence
  Description of Artificial Sequence: Synthetic oligonucleotide
tggtgctccaacaaaaaaaaatgctgctgtaatggacc

SEQ ID NO: 169318 - DNA, 37 bp, Artificial Sequence
  Description of Artificial Sequence: Synthetic oligonucleotide
ggtgctccaacaaaaaaaaatgctgctgtaatggacc

SEQ ID NO: 169319 - DNA, 39 bp, Artificial Sequence
  Description of Artificial Sequence: Synthetic oligonucleotide
gtgctccaacaaaaaaaaatgctgctgtaatggaccaag

SEQ ID NO: 169320 - DNA, 40 bp, Artificial Sequence
  Description of Artificial Sequence: Synthetic oligonucleotide
tgctccaacaaaaaaaaatgctgctgtaatggaccaagag

SEQ ID NO: 169321 - DNA, 39 bp, Artificial Sequence
  Description of Artificial Sequence: Synthetic oligonucleotide
gctccaacaaaaaaaaatgctgctgtaatggaccaagag

SEQ ID NO: 169322 - DNA, 39 bp, Artificial Sequence
  Description of Artificial Sequence: Synthetic oligonucleotide
ctccaacaaaaaaaaatgctgctgtaatggaccaagagc

SEQ ID NO: 169323 - DNA, 39 bp, Artificial Sequence
  Description of Artificial Sequence: Synthetic oligonucleotide
tccaacaaaaaaaaatgctgctgtaatggaccaagagcc

SEQ ID NO: 169324 - DNA, 38 bp, Artificial Sequence
  Description of Artificial Sequence: Synthetic oligonucleotide
ccaacaaaaaaaaatgctgctgtaatggaccaagagcc

SEQ ID NO: 169325 - DNA, 39 bp, Artificial Sequence
  Description of Artificial Sequence: Synthetic oligonucleotide
caacaaaaaaaaatgctgctgtaatggaccaagagcctg

SEQ ID NO: 169326 - DNA, 39 bp, Artificial Sequence
  Description of Artificial Sequence: Synthetic oligonucleotide
aacaaaaaaaaatgctgctgtaatggaccaagagcctgc

SEQ ID NO: 169327 - DNA, 38 bp, Artificial Sequence
  Description of Artificial Sequence: Synthetic oligonucleotide
acaaaaaaaaatgctgctgtaatggaccaagagcctgc

SEQ ID NO: 169328 - DNA, 37 bp, Artificial Sequence
  Description of Artificial Sequence: Synthetic oligonucleotide
caaaaaaaaatgctgctgtaatggaccaagagcctgc

SEQ ID NO: 169329 - DNA, 38 bp, Artificial Sequence
  Description of Artificial Sequence: Synthetic oligonucleotide
aaaaaaaaatgctgctgtaatggaccaagagcctgcag

SEQ ID NO: 169330 - DNA, 32 bp, Artificial Sequence
  Description of Artificial Sequence: Synthetic oligonucleotide
acaaagagtggatctctaaggacccctcacac

SEQ ID NO: 169331 - DNA, 31 bp, Artificial Sequence
  Description of Artificial Sequence: Synthetic oligonucleotide
caaagagtggatctctaaggacccctcacac

SEQ ID NO: 169332 - DNA, 31 bp, Artificial Sequence
  Description of Artificial Sequence: Synthetic oligonucleotide
aaagagtggatctctaaggacccctcacacc

SEQ ID NO: 169333 - DNA, 30 bp, Artificial Sequence
  Description of Artificial Sequence: Synthetic oligonucleotide
aagagtggatctctaaggacccctcacacc

SEQ ID NO: 169334 - DNA, 29 bp, Artificial Sequence
  Description of Artificial Sequence: Synthetic oligonucleotide
agagtggatctctaaggacccctcacacc

SEQ ID NO: 169335 - DNA, 28 bp, Artificial Sequence
  Description of Artificial Sequence: Synthetic oligonucleotide
gagtggatctctaaggacccctcacacc

SEQ ID NO: 169336 - DNA, 29 bp, Artificial Sequence
  Description of Artificial Sequence: Synthetic oligonucleotide
agtggatctctaaggacccctcacacctc

SEQ ID NO: 169337 - DNA, 28 bp, Artificial Sequence
  Description of Artificial Sequence: Synthetic oligonucleotide
gtggatctctaaggacccctcacacctc

SEQ ID NO: 169338 - DNA, 28 bp, Artificial Sequence
  Description of Artificial Sequence: Synthetic oligonucleotide
tggatctctaaggacccctcacacctcg

SEQ ID NO: 169339 - DNA, 27 bp, Artificial Sequence
  Description of Artificial Sequence: Synthetic oligonucleotide
ggatctctaaggacccctcacacctcg

SEQ ID NO: 169340 - DNA, 29 bp, Artificial Sequence
  Description of Artificial Sequence: Synthetic oligonucleotide
gatctctaaggacccctcacacctcgttg

SEQ ID NO: 169341 - DNA, 29 bp, Artificial Sequence
  Description of Artificial Sequence: Synthetic oligonucleotide
atctctaaggacccctcacacctcgttgg

SEQ ID NO: 169342 - DNA, 28 bp, Artificial Sequence
  Description of Artificial Sequence: Synthetic oligonucleotide
tctctaaggacccctcacacctcgttgg

SEQ ID NO: 169343 - DNA, 27 bp, Artificial Sequence
  Description of Artificial Sequence: Synthetic oligonucleotide
ctctaaggacccctcacacctcgttgg

SEQ ID NO: 169344 - DNA, 28 bp, Artificial Sequence
  Description of Artificial Sequence: Synthetic oligonucleotide
tctaaggacccctcacacctcgttggac

SEQ ID NO: 169345 - DNA, 27 bp, Artificial Sequence
  Description of Artificial Sequence: Synthetic oligonucleotide
ctaaggacccctcacacctcgttggac

SEQ ID NO: 169346 - DNA, 28 bp, Artificial Sequence
  Description of Artificial Sequence: Synthetic oligonucleotide
taaggacccctcacacctcgttggacag

SEQ ID NO: 169347 - DNA, 27 bp, Artificial Sequence
  Description of Artificial Sequence: Synthetic oligonucleotide
aaggacccctcacacctcgttggacag

SEQ ID NO: 169348 - DNA, 29 bp, Artificial Sequence
  Description of Artificial Sequence: Synthetic oligonucleotide
ggctctttccgtcactctccctacgaatg

SEQ ID NO: 169349 - DNA, 29 bp, Artificial Sequence
  Description of Artificial Sequence: Synthetic oligonucleotide
gctctttccgtcactctccctacgaatgg

SEQ ID NO: 169350 - DNA, 30 bp, Artificial Sequence
  Description of Artificial Sequence: Synthetic oligonucleotide
ctctttccgtcactctccctacgaatggtc

SEQ ID NO: 169351 - DNA, 31 bp, Artificial Sequence
  Description of Artificial Sequence: Synthetic oligonucleotide
tctttccgtcactctccctacgaatggtcag

SEQ ID NO: 169352 - DNA, 30 bp, Artificial Sequence
  Description of Artificial Sequence: Synthetic oligonucleotide
ctttccgtcactctccctacgaatggtcag

SEQ ID NO: 169353 - DNA, 31 bp, Artificial Sequence
  Description of Artificial Sequence: Synthetic oligonucleotide
tttccgtcactctccctacgaatggtcagac

SEQ ID NO: 169354 - DNA, 30 bp, Artificial Sequence
  Description of Artificial Sequence: Synthetic oligonucleotide
ttccgtcactctccctacgaatggtcagac

SEQ ID NO: 169355 - DNA, 29 bp, Artificial Sequence
  Description of Artificial Sequence: Synthetic oligonucleotide
tccgtcactctccctacgaatggtcagac

SEQ ID NO: 169356 - DNA, 28 bp, Artificial Sequence
  Description of Artificial Sequence: Synthetic oligonucleotide
ccgtcactctccctacgaatggtcagac

SEQ ID NO: 169357 - DNA, 28 bp, Artificial Sequence
  Description of Artificial Sequence: Synthetic oligonucleotide
cgtcactctccctacgaatggtcagacc

SEQ ID NO: 169358 - DNA, 28 bp, Artificial Sequence
  Description of Artificial Sequence: Synthetic oligonucleotide
gtcactctccctacgaatggtcagaccc

SEQ ID NO: 169359 - DNA, 28 bp, Artificial Sequence
  Description of Artificial Sequence: Synthetic oligonucleotide
tcactctccctacgaatggtcagacccg

SEQ ID NO: 169360 - DNA, 27 bp, Artificial Sequence
  Description of Artificial Sequence: Synthetic oligonucleotide
cactctccctacgaatggtcagacccg

SEQ ID NO: 169361 - DNA, 28 bp, Artificial Sequence
  Description of Artificial Sequence: Synthetic oligonucleotide
actctccctacgaatggtcagacccgag

SEQ ID NO: 169362 - DNA, 27 bp, Artificial Sequence
  Description of Artificial Sequence: Synthetic oligonucleotide
ctctccctacgaatggtcagacccgag

SEQ ID NO: 169363 - DNA, 28 bp, Artificial Sequence
  Description of Artificial Sequence: Synthetic oligonucleotide
tctccctacgaatggtcagacccgagtg

SEQ ID NO: 169364 - DNA, 27 bp, Artificial Sequence
  Description of Artificial Sequence: Synthetic oligonucleotide
ctccctacgaatggtcagacccgagtg

SEQ ID NO: 169365 - DNA, 28 bp, Artificial Sequence
  Description of Artificial Sequence: Synthetic oligonucleotide
tccctacgaatggtcagacccgagtgac

SEQ ID NO: 169366 - DNA, 27 bp, Artificial Sequence
  Description of Artificial Sequence: Synthetic oligonucleotide
ccctacgaatggtcagacccgagtgac

SEQ ID NO: 169367 - DNA, 27 bp, Artificial Sequence
  Description of Artificial Sequence: Synthetic oligonucleotide
cctacgaatggtcagacccgagtgacc

SEQ ID NO: 169368 - DNA, 27 bp, Artificial Sequence
  Description of Artificial Sequence: Synthetic oligonucleotide
ctacgaatggtcagacccgagtgaccc

SEQ ID NO: 169369 - DNA, 28 bp, Artificial Sequence
  Description of Artificial Sequence: Synthetic oligonucleotide
tacgaatggtcagacccgagtgacccac

SEQ ID NO: 169370 - DNA, 27 bp, Artificial Sequence
  Description of Artificial Sequence: Synthetic oligonucleotide
acgaatggtcagacccgagtgacccac

SEQ ID NO: 169371 - DNA, 27 bp, Artificial Sequence
  Description of Artificial Sequence: Synthetic oligonucleotide
cgaatggtcagacccgagtgacccact

SEQ ID NO: 169372 - DNA, 27 bp, Artificial Sequence
  Description of Artificial Sequence: Synthetic oligonucleotide
gaatggtcagacccgagtgacccactg

SEQ ID NO: 169373 - DNA, 27 bp, Artificial Sequence
  Description of Artificial Sequence: Synthetic oligonucleotide
aatggtcagacccgagtgacccactgc

SEQ ID NO: 169374 - DNA, 27 bp, Artificial Sequence
  Description of Artificial Sequence: Synthetic oligonucleotide
atggtcagacccgagtgacccactgct

SEQ ID NO: 169375 - DNA, 25 bp, Artificial Sequence
  Description of Artificial Sequence: Synthetic oligonucleotide
gagtggtcagacccgagtgacccac

SEQ ID NO: 169376 - DNA, 25 bp, Artificial Sequence
  Description of Artificial Sequence: Synthetic oligonucleotide
agtggtcagacccgagtgacccacc

SEQ ID NO: 169377 - DNA, 24 bp, Artificial Sequence
  Description of Artificial Sequence: Synthetic oligonucleotide
gtggtcagacccgagtgacccacc

SEQ ID NO: 169378 - DNA, 24 bp, Artificial Sequence
  Description of Artificial Sequence: Synthetic oligonucleotide
tggtcagacccgagtgacccaccg

SEQ ID NO: 169379 - DNA, 23 bp, Artificial Sequence
  Description of Artificial Sequence: Synthetic oligonucleotide
ggtcagacccgagtgacccaccg

SEQ ID NO: 169380 - DNA, 25 bp, Artificial Sequence
  Description of Artificial Sequence: Synthetic oligonucleotide
gtcagacccgagtgacccaccgctt

SEQ ID NO: 169381 - DNA, 27 bp, Artificial Sequence
  Description of Artificial Sequence: Synthetic oligonucleotide
tcagacccgagtgacccaccgcttgtt

SEQ ID NO: 169382 - DNA, 27 bp, Artificial Sequence
  Description of Artificial Sequence: Synthetic oligonucleotide
cagacccgagtgacccaccgcttgttt

SEQ ID NO: 169383 - DNA, 27 bp, Artificial Sequence
  Description of Artificial Sequence: Synthetic oligonucleotide
agacccgagtgacccaccgcttgtttc

SEQ ID NO: 169384 - DNA, 27 bp, Artificial Sequence
  Description of Artificial Sequence: Synthetic oligonucleotide
gacccgagtgacccaccgcttgtttct

SEQ ID NO: 169385 - DNA, 27 bp, Artificial Sequence
  Description of Artificial Sequence: Synthetic oligonucleotide
acccgagtgacccaccgcttgtttctg

SEQ ID NO: 169386 - DNA, 27 bp, Artificial Sequence
  Description of Artificial Sequence: Synthetic oligonucleotide
cccgagtgacccaccgcttgtttctgt

SEQ ID NO: 169387 - DNA, 27 bp, Artificial Sequence
  Description of Artificial Sequence: Synthetic oligonucleotide
ccgagtgacccaccgcttgtttctgtc

SEQ ID NO: 169388 - DNA, 28 bp, Artificial Sequence
  Description of Artificial Sequence: Synthetic oligonucleotide
cgagtgacccaccgcttgtttctgtcac

SEQ ID NO: 169389 - DNA, 29 bp, Artificial Sequence
  Description of Artificial Sequence: Synthetic oligonucleotide
gagtgacccaccgcttgtttctgtcacag

SEQ ID NO: 169390 - DNA, 29 bp, Artificial Sequence
  Description of Artificial Sequence: Synthetic oligonucleotide
agtgacccaccgcttgtttctgtcacagg

SEQ ID NO: 169391 - DNA, 28 bp, Artificial Sequence
  Description of Artificial Sequence: Synthetic oligonucleotide
gtgacccaccgcttgtttctgtcacagg

SEQ ID NO: 169392 - DNA, 31 bp, Artificial Sequence
  Description of Artificial Sequence: Synthetic oligonucleotide
tgacccaccgcttgtttctgtcacaggaaac

SEQ ID NO: 169393 - DNA, 30 bp, Artificial Sequence
  Description of Artificial Sequence: Synthetic oligonucleotide
gacccaccgcttgtttctgtcacaggaaac

SEQ ID NO: 169394 - DNA, 30 bp, Artificial Sequence
  Description of Artificial Sequence: Synthetic oligonucleotide
acccaccgcttgtttctgtcacaggaaacc

SEQ ID NO: 169395 - DNA, 29 bp, Artificial Sequence
  Description of Artificial Sequence: Synthetic oligonucleotide
cccaccgcttgtttctgtcacaggaaacc

SEQ ID NO: 169396 - DNA, 29 bp, Artificial Sequence
  Description of Artificial Sequence: Synthetic oligonucleotide
ccaccgcttgtttctgtcacaggaaaccc

SEQ ID NO: 169397 - DNA, 31 bp, Artificial Sequence
  Description of Artificial Sequence: Synthetic oligonucleotide
caccgcttgtttctgtcacaggaaacccttc

SEQ ID NO: 169398 - DNA, 33 bp, Artificial Sequence
  Description of Artificial Sequence: Synthetic oligonucleotide
accgcttgtttctgtcacaggaaacccttcaag

SEQ ID NO: 169399 - DNA, 32 bp, Artificial Sequence
  Description of Artificial Sequence: Synthetic oligonucleotide
ccgcttgtttctgtcacaggaaacccttcaag

SEQ ID NO: 169400 - DNA, 34 bp, Artificial Sequence
  Description of Artificial Sequence: Synthetic oligonucleotide
cgcttgtttctgtcacaggaaacccttcaagtag

SEQ ID NO: 169401 - DNA, 28 bp, Artificial Sequence
  Description of Artificial Sequence: Synthetic oligonucleotide
agatccatgatggggtctccaaggccag

SEQ ID NO: 169402 - DNA, 27 bp, Artificial Sequence
  Description of Artificial Sequence: Synthetic oligonucleotide
gatccatgatggggtctccaaggccag

SEQ ID NO: 169403 - DNA, 30 bp, Artificial Sequence
  Description of Artificial Sequence: Synthetic oligonucleotide
atccatgatggggtctccaaggccagtttc

SEQ ID NO: 169404 - DNA, 29 bp, Artificial Sequence
  Description of Artificial Sequence: Synthetic oligonucleotide
tccatgatggggtctccaaggccagtttc

SEQ ID NO: 169405 - DNA, 28 bp, Artificial Sequence
  Description of Artificial Sequence: Synthetic oligonucleotide
ccatgatggggtctccaaggccagtttc

SEQ ID NO: 169406 - DNA, 29 bp, Artificial Sequence
  Description of Artificial Sequence: Synthetic oligonucleotide
catgatggggtctccaaggccagtttctc

SEQ ID NO: 169407 - DNA, 29 bp, Artificial Sequence
  Description of Artificial Sequence: Synthetic oligonucleotide
atgatggggtctccaaggccagtttctcc

SEQ ID NO: 169408 - DNA, 28 bp, Artificial Sequence
  Description of Artificial Sequence: Synthetic oligonucleotide
tgatggggtctccaaggccagtttctcc

SEQ ID NO: 169409 - DNA, 27 bp, Artificial Sequence
  Description of Artificial Sequence: Synthetic oligonucleotide
gatggggtctccaaggccagtttctcc

SEQ ID NO: 169410 - DNA, 29 bp, Artificial Sequence
  Description of Artificial Sequence: Synthetic oligonucleotide
atggggtctccaaggccagtttctccatc

SEQ ID NO: 169411 - DNA, 28 bp, Artificial Sequence
  Description of Artificial Sequence: Synthetic oligonucleotide
tggggtctccaaggccagtttctccatc

SEQ ID NO: 169412 - DNA, 27 bp, Artificial Sequence
  Description of Artificial Sequence: Synthetic oligonucleotide
ggggtctccaaggccagtttctccatc

SEQ ID NO: 169413 - DNA, 27 bp, Artificial Sequence
  Description of Artificial Sequence: Synthetic oligonucleotide
gggtctccaaggccagtttctccatcg

SEQ ID NO: 169414 - DNA, 27 bp, Artificial Sequence
  Description of Artificial Sequence: Synthetic oligonucleotide
ggtctccaaggccagtttctccatcgg

SEQ ID NO: 169415 - DNA, 29 bp, Artificial Sequence
  Description of Artificial Sequence: Synthetic oligonucleotide
gtctccaaggccagtttctccatcggttc

SEQ ID NO: 169416 - DNA, 29 bp, Artificial Sequence
  Description of Artificial Sequence: Synthetic oligonucleotide
tctccaaggccagtttctccatcggttcc

SEQ ID NO: 169417 - DNA, 28 bp, Artificial Sequence
  Description of Artificial Sequence: Synthetic oligonucleotide
ctccaaggccagtttctccatcggttcc

SEQ ID NO: 169418 - DNA, 30 bp, Artificial Sequence
  Description of Artificial Sequence: Synthetic oligonucleotide
tccaaggccagtttctccatcggttccatg

SEQ ID NO: 169419 - DNA, 29 bp, Artificial Sequence
  Description of Artificial Sequence: Synthetic oligonucleotide
ccaaggccagtttctccatcggttccatg

SEQ ID NO: 169420 - DNA, 31 bp, Artificial Sequence
  Description of Artificial Sequence: Synthetic oligonucleotide
caaggccagtttctccatcggttccatgatg

SEQ ID NO: 169421 - DNA, 31 bp, Artificial Sequence
  Description of Artificial Sequence: Synthetic oligonucleotide
aaggccagtttctccatcggttccatgatgc

SEQ ID NO: 169422 - DNA, 30 bp, Artificial Sequence
  Description of Artificial Sequence: Synthetic oligonucleotide
aggccagtttctccatcggttccatgatgc

SEQ ID NO: 169423 - DNA, 29 bp, Artificial Sequence
  Description of Artificial Sequence: Synthetic oligonucleotide
ggccagtttctccatcggttccatgatgc

SEQ ID NO: 169424 - DNA, 29 bp, Artificial Sequence
  Description of Artificial Sequence: Synthetic oligonucleotide
gccagtttctccatcggttccatgatgcg

SEQ ID NO: 169425 - DNA, 30 bp, Artificial Sequence
  Description of Artificial Sequence: Synthetic oligonucleotide
ccagtttctccatcggttccatgatgcgtg

SEQ ID NO: 169426 - DNA, 30 bp, Artificial Sequence
  Description of Artificial Sequence: Synthetic oligonucleotide
cagtttctccatcggttccatgatgcgtgc

SEQ ID NO: 169427 - DNA, 30 bp, Artificial Sequence
  Description of Artificial Sequence: Synthetic oligonucleotide
agtttctccatcggttccatgatgcgtgcc

SEQ ID NO: 169428 - DNA, 29 bp, Artificial Sequence
  Description of Artificial Sequence: Synthetic oligonucleotide
gtttctccatcggttccatgatgcgtgcc

SEQ ID NO: 169429 - DNA, 31 bp, Artificial Sequence
  Description of Artificial Sequence: Synthetic oligonucleotide
atggggtctccaaggccaatttctccatcag

SEQ ID NO: 169430 - DNA, 30 bp, Artificial Sequence
  Description of Artificial Sequence: Synthetic oligonucleotide
tggggtctccaaggccaatttctccatcag

SEQ ID NO: 169431 - DNA, 29 bp, Artificial Sequence
  Description of Artificial Sequence: Synthetic oligonucleotide
ggggtctccaaggccaatttctccatcag

SEQ ID NO: 169432 - DNA, 31 bp, Artificial Sequence
  Description of Artificial Sequence: Synthetic oligonucleotide
gggtctccaaggccaatttctccatcagttc

SEQ ID NO: 169433 - DNA, 31 bp, Artificial Sequence
  Description of Artificial Sequence: Synthetic oligonucleotide
ggtctccaaggccaatttctccatcagttcc

SEQ ID NO: 169434 - DNA, 33 bp, Artificial Sequence
  Description of Artificial Sequence: Synthetic oligonucleotide
gtctccaaggccaatttctccatcagttccatg

SEQ ID NO: 169435 - DNA, 35 bp, Artificial Sequence
  Description of Artificial Sequence: Synthetic oligonucleotide
tctccaaggccaatttctccatcagttccatgatg

SEQ ID NO: 169436 - DNA, 34 bp, Artificial Sequence
  Description of Artificial Sequence: Synthetic oligonucleotide
ctccaaggccaatttctccatcagttccatgatg

SEQ ID NO: 169437 - DNA, 34 bp, Artificial Sequence
  Description of Artificial Sequence: Synthetic oligonucleotide
tccaaggccaatttctccatcagttccatgatgc

SEQ ID NO: 169438 - DNA, 33 bp, Artificial Sequence
  Description of Artificial Sequence: Synthetic oligonucleotide
ccaaggccaatttctccatcagttccatgatgc

SEQ ID NO: 169439 - DNA, 33 bp, Artificial Sequence
  Description of Artificial Sequence: Synthetic oligonucleotide
caaggccaatttctccatcagttccatgatgcg

SEQ ID NO: 169440 - DNA, 34 bp, Artificial Sequence
  Description of Artificial Sequence: Synthetic oligonucleotide
aaggccaatttctccatcagttccatgatgcgtg

SEQ ID NO: 169441 - DNA, 33 bp, Artificial Sequence
  Description of Artificial Sequence: Synthetic oligonucleotide
aggccaatttctccatcagttccatgatgcgtg

SEQ ID NO: 169442 - DNA, 32 bp, Artificial Sequence
  Description of Artificial Sequence: Synthetic oligonucleotide
ggccaatttctccatcagttccatgatgcgtg

SEQ ID NO: 169443 - DNA, 32 bp, Artificial Sequence
  Description of Artificial Sequence: Synthetic oligonucleotide
gccaatttctccatcagttccatgatgcgtgc

SEQ ID NO: 169444 - DNA, 32 bp, Artificial Sequence
  Description of Artificial Sequence: Synthetic oligonucleotide
ccaatttctccatcagttccatgatgcgtgcc

SEQ ID NO: 169445 - DNA, 32 bp, Artificial Sequence
  Description of Artificial Sequence: Synthetic oligonucleotide
caatttctccatcagttccatgatgcgtgccc

SEQ ID NO: 169446 - DNA, 34 bp, Artificial Sequence
  Description of Artificial Sequence: Synthetic oligonucleotide
aatttctccatcagttccatgatgcgtgcccttg

SEQ ID NO: 169447 - DNA, 33 bp, Artificial Sequence
  Description of Artificial Sequence: Synthetic oligonucleotide
atttctccatcagttccatgatgcgtgcccttg

SEQ ID NO: 169448 - DNA, 32 bp, Artificial Sequence
  Description of Artificial Sequence: Synthetic oligonucleotide
tttctccatcagttccatgatgcgtgcccttg

SEQ ID NO: 169449 - DNA, 31 bp, Artificial Sequence
  Description of Artificial Sequence: Synthetic oligonucleotide
ttctccatcagttccatgatgcgtgcccttg

SEQ ID NO: 169450 - DNA, 30 bp, Artificial Sequence
  Description of Artificial Sequence: Synthetic oligonucleotide
tctccatcagttccatgatgcgtgcccttg

SEQ ID NO: 169451 - DNA, 29 bp, Artificial Sequence
  Description of Artificial Sequence: Synthetic oligonucleotide
ctccatcagttccatgatgcgtgcccttg

SEQ ID NO: 169452 - DNA, 29 bp, Artificial Sequence
  Description of Artificial Sequence: Synthetic oligonucleotide
tccatcagttccatgatgcgtgcccttgc

SEQ ID NO: 169453 - DNA, 28 bp, Artificial Sequence
  Description of Artificial Sequence: Synthetic oligonucleotide
ccatcagttccatgatgcgtgcccttgc

SEQ ID NO: 169454 - DNA, 29 bp, Artificial Sequence
  Description of Artificial Sequence: Synthetic oligonucleotide
catcagttccatgatgcgtgcccttgcag

SEQ ID NO: 169455 - DNA, 29 bp, Artificial Sequence
  Description of Artificial Sequence: Synthetic oligonucleotide
atcagttccatgatgcgtgcccttgcagg

SEQ ID NO: 169456 - DNA, 28 bp, Artificial Sequence
  Description of Artificial Sequence: Synthetic oligonucleotide
tcagttccatgatgcgtgcccttgcagg

SEQ ID NO: 169457 - DNA, 27 bp, Artificial Sequence
  Description of Artificial Sequence: Synthetic oligonucleotide
cagttccatgatgcgtgcccttgcagg

SEQ ID NO: 169458 - DNA, 27 bp, Artificial Sequence
  Description of Artificial Sequence: Synthetic oligonucleotide
agttccatgatgcgtgcccttgcaggg

SEQ ID NO: 169459 - DNA, 30 bp, Artificial Sequence
  Description of Artificial Sequence: Synthetic oligonucleotide
ggacctacagatgcttcggctctttccatc

SEQ ID NO: 169460 - DNA, 31 bp, Artificial Sequence
  Description of Artificial Sequence: Synthetic oligonucleotide
gacctacagatgcttcggctctttccatcac

SEQ ID NO: 169461 - DNA, 32 bp, Artificial Sequence
  Description of Artificial Sequence: Synthetic oligonucleotide
acctacagatgcttcggctctttccatcactc

SEQ ID NO: 169462 - DNA, 31 bp, Artificial Sequence
  Description of Artificial Sequence: Synthetic oligonucleotide
cctacagatgcttcggctctttccatcactc

SEQ ID NO: 169463 - DNA, 32 bp, Artificial Sequence
  Description of Artificial Sequence: Synthetic oligonucleotide
ctacagatgcttcggctctttccatcactctc

SEQ ID NO: 169464 - DNA, 32 bp, Artificial Sequence
  Description of Artificial Sequence: Synthetic oligonucleotide
tacagatgcttcggctctttccatcactctcc

SEQ ID NO: 169465 - DNA, 31 bp, Artificial Sequence
  Description of Artificial Sequence: Synthetic oligonucleotide
acagatgcttcggctctttccatcactctcc

SEQ ID NO: 169466 - DNA, 30 bp, Artificial Sequence
  Description of Artificial Sequence: Synthetic oligonucleotide
cagatgcttcggctctttccatcactctcc

SEQ ID NO: 169467 - DNA, 30 bp, Artificial Sequence
  Description of Artificial Sequence: Synthetic oligonucleotide
agatgcttcggctctttccatcactctccc

SEQ ID NO: 169468 - DNA, 29 bp, Artificial Sequence
  Description of Artificial Sequence: Synthetic oligonucleotide
gatgcttcggctctttccatcactctccc

SEQ ID NO: 169469 - DNA, 31 bp, Artificial Sequence
  Description of Artificial Sequence: Synthetic oligonucleotide
atgcttcggctctttccatcactctccctac

SEQ ID NO: 169470 - DNA, 30 bp, Artificial Sequence
  Description of Artificial Sequence: Synthetic oligonucleotide
tgcttcggctctttccatcactctccctac

SEQ ID NO: 169471 - DNA, 29 bp, Artificial Sequence
  Description of Artificial Sequence: Synthetic oligonucleotide
gcttcggctctttccatcactctccctac

SEQ ID NO: 169472 - DNA, 29 bp, Artificial Sequence
  Description of Artificial Sequence: Synthetic oligonucleotide
cttcggctctttccatcactctccctacg

SEQ ID NO: 169473 - DNA, 30 bp, Artificial Sequence
  Description of Artificial Sequence: Synthetic oligonucleotide
ttcggctctttccatcactctccctacgag

SEQ ID NO: 169474 - DNA, 29 bp, Artificial Sequence
  Description of Artificial Sequence: Synthetic oligonucleotide
tcggctctttccatcactctccctacgag

SEQ ID NO: 169475 - DNA, 28 bp, Artificial Sequence
  Description of Artificial Sequence: Synthetic oligonucleotide
cggctctttccatcactctccctacgag

SEQ ID NO: 169476 - DNA, 29 bp, Artificial Sequence
  Description of Artificial Sequence: Synthetic oligonucleotide
ggctctttccatcactctccctacgagtg

SEQ ID NO: 169477 - DNA, 29 bp, Artificial Sequence
  Description of Artificial Sequence: Synthetic oligonucleotide
gctctttccatcactctccctacgagtgg

SEQ ID NO: 169478 - DNA, 30 bp, Artificial Sequence
  Description of Artificial Sequence: Synthetic oligonucleotide
ctctttccatcactctccctacgagtggtc

SEQ ID NO: 169479 - DNA, 31 bp, Artificial Sequence
  Description of Artificial Sequence: Synthetic oligonucleotide
tctttccatcactctccctacgagtggtcag

SEQ ID NO: 169480 - DNA, 30 bp, Artificial Sequence
  Description of Artificial Sequence: Synthetic oligonucleotide
ctttccatcactctccctacgagtggtcag

SEQ ID NO: 169481 - DNA, 31 bp, Artificial Sequence
  Description of Artificial Sequence: Synthetic oligonucleotide
tttccatcactctccctacgagtggtcagac

SEQ ID NO: 169482 - DNA, 30 bp, Artificial Sequence
  Description of Artificial Sequence: Synthetic oligonucleotide
ttccatcactctccctacgagtggtcagac

SEQ ID NO: 169483 - DNA, 29 bp, Artificial Sequence
  Description of Artificial Sequence: Synthetic oligonucleotide
tccatcactctccctacgagtggtcagac

SEQ ID NO: 169484 - DNA, 28 bp, Artificial Sequence
  Description of Artificial Sequence: Synthetic oligonucleotide
ccatcactctccctacgagtggtcagac

SEQ ID NO: 169485 - DNA, 28 bp, Artificial Sequence
  Description of Artificial Sequence: Synthetic oligonucleotide
catcactctccctacgagtggtcagacc

SEQ ID NO: 169486 - DNA, 28 bp, Artificial Sequence
  Description of Artificial Sequence: Synthetic oligonucleotide
atcactctccctacgagtggtcagaccc

SEQ ID NO: 169487 - DNA, 41 bp, Artificial Sequence
  Description of Artificial Sequence: Synthetic oligonucleotide
tttgagcacttctttctgcacaaagagtggatctctaaaac

SEQ ID NO: 169488 - DNA, 40 bp, Artificial Sequence
  Description of Artificial Sequence: Synthetic oligonucleotide
ttgagcacttctttctgcacaaagagtggatctctaaaac

SEQ ID NO: 169489 - DNA, 39 bp, Artificial Sequence
  Description of Artificial Sequence: Synthetic oligonucleotide
tgagcacttctttctgcacaaagagtggatctctaaaac

SEQ ID NO: 169490 - DNA, 38 bp, Artificial Sequence
  Description of Artificial Sequence: Synthetic oligonucleotide
gagcacttctttctgcacaaagagtggatctctaaaac

SEQ ID NO: 169491 - DNA, 38 bp, Artificial Sequence
  Description of Artificial Sequence: Synthetic oligonucleotide
agcacttctttctgcacaaagagtggatctctaaaacc

SEQ ID NO: 169492 - DNA, 37 bp, Artificial Sequence
  Description of Artificial Sequence: Synthetic oligonucleotide
gcacttctttctgcacaaagagtggatctctaaaacc

SEQ ID NO: 169493 - DNA, 37 bp, Artificial Sequence
  Description of Artificial Sequence: Synthetic oligonucleotide
cacttctttctgcacaaagagtggatctctaaaaccc

SEQ ID NO: 169494 - DNA, 37 bp, Artificial Sequence
  Description of Artificial Sequence: Synthetic oligonucleotide
acttctttctgcacaaagagtggatctctaaaacccc

SEQ ID NO: 169495 - DNA, 36 bp, Artificial Sequence
  Description of Artificial Sequence: Synthetic oligonucleotide
cttctttctgcacaaagagtggatctctaaaacccc

SEQ ID NO: 169496 - DNA, 37 bp, Artificial Sequence
  Description of Artificial Sequence: Synthetic oligonucleotide
ttctttctgcacaaagagtggatctctaaaacccctc

SEQ ID NO: 169497 - DNA, 36 bp, Artificial Sequence
  Description of Artificial Sequence: Synthetic oligonucleotide
tctttctgcacaaagagtggatctctaaaacccctc

SEQ ID NO: 169498 - DNA, 35 bp, Artificial Sequence
  Description of Artificial Sequence: Synthetic oligonucleotide
ctttctgcacaaagagtggatctctaaaacccctc

SEQ ID NO: 169499 - DNA, 36 bp, Artificial Sequence
  Description of Artificial Sequence: Synthetic oligonucleotide
tttctgcacaaagagtggatctctaaaacccctcac

SEQ ID NO: 169500 - DNA, 35 bp, Artificial Sequence
  Description of Artificial Sequence: Synthetic oligonucleotide
ttctgcacaaagagtggatctctaaaacccctcac

SEQ ID NO: 169501 - DNA, 34 bp, Artificial Sequence
  Description of Artificial Sequence: Synthetic oligonucleotide
tctgcacaaagagtggatctctaaaacccctcac

SEQ ID NO: 169502 - DNA, 33 bp, Artificial Sequence
  Description of Artificial Sequence: Synthetic oligonucleotide
ctgcacaaagagtggatctctaaaacccctcac

SEQ ID NO: 169503 - DNA, 33 bp, Artificial Sequence
  Description of Artificial Sequence: Synthetic oligonucleotide
tgcacaaagagtggatctctaaaacccctcacg

SEQ ID NO: 169504 - DNA, 32 bp, Artificial Sequence
  Description of Artificial Sequence: Synthetic oligonucleotide
gcacaaagagtggatctctaaaacccctcacg

SEQ ID NO: 169505 - DNA, 32 bp, Artificial Sequence
  Description of Artificial Sequence: Synthetic oligonucleotide
cacaaagagtggatctctaaaacccctcacgc

SEQ ID NO: 169506 - DNA, 32 bp, Artificial Sequence
  Description of Artificial Sequence: Synthetic oligonucleotide
acaaagagtggatctctaaaacccctcacgcc

SEQ ID NO: 169507 - DNA, 31 bp, Artificial Sequence
  Description of Artificial Sequence: Synthetic oligonucleotide
caaagagtggatctctaaaacccctcacgcc

SEQ ID NO: 169508 - DNA, 32 bp, Artificial Sequence
  Description of Artificial Sequence: Synthetic oligonucleotide
aaagagtggatctctaaaacccctcacgcctc

SEQ ID NO: 169509 - DNA, 31 bp, Artificial Sequence
  Description of Artificial Sequence: Synthetic oligonucleotide
aagagtggatctctaaaacccctcacgcctc

SEQ ID NO: 169510 - DNA, 30 bp, Artificial Sequence
  Description of Artificial Sequence: Synthetic oligonucleotide
agagtggatctctaaaacccctcacgcctc

SEQ ID NO: 169511 - DNA, 29 bp, Artificial Sequence
  Description of Artificial Sequence: Synthetic oligonucleotide
gagtggatctctaaaacccctcacgcctc

SEQ ID NO: 169512 - DNA, 29 bp, Artificial Sequence
  Description of Artificial Sequence: Synthetic oligonucleotide
agtggatctctaaaacccctcacgcctcg

SEQ ID NO: 169513 - DNA, 28 bp, Artificial Sequence
  Description of Artificial Sequence: Synthetic oligonucleotide
gtggatctctaaaacccctcacgcctcg

SEQ ID NO: 169514 - DNA, 30 bp, Artificial Sequence
  Description of Artificial Sequence: Synthetic oligonucleotide
tggatctctaaaacccctcacgcctcgttg

SEQ ID NO: 169515 - DNA, 29 bp, Artificial Sequence
  Description of Artificial Sequence: Synthetic oligonucleotide
ggatctctaaaacccctcacgcctcgttg

SEQ ID NO: 169516 - DNA, 29 bp, Artificial Sequence
  Description of Artificial Sequence: Synthetic oligonucleotide
gatctctaaaacccctcacgcctcgttgg

SEQ ID NO: 169517 - DNA, 30 bp, Artificial Sequence
  Description of Artificial Sequence: Synthetic oligonucleotide
atctctaaaacccctcacgcctcgttggac

SEQ ID NO: 169518 - DNA, 29 bp, Artificial Sequence
  Description of Artificial Sequence: Synthetic oligonucleotide
tctctaaaacccctcacgcctcgttggac

SEQ ID NO: 169519 - DNA, 28 bp, Artificial Sequence
  Description of Artificial Sequence: Synthetic oligonucleotide
ctctaaaacccctcacgcctcgttggac

SEQ ID NO: 169520 - DNA, 29 bp, Artificial Sequence
  Description of Artificial Sequence: Synthetic oligonucleotide
tctaaaacccctcacgcctcgttggacag

SEQ ID NO: 169521 - DNA, 28 bp, Artificial Sequence
  Description of Artificial Sequence: Synthetic oligonucleotide
ctaaaacccctcacgcctcgttggacag

SEQ ID NO: 169522 - DNA, 30 bp, Artificial Sequence
  Description of Artificial Sequence: Synthetic oligonucleotide
taaaacccctcacgcctcgttggacagatc

SEQ ID NO: 169523 - DNA, 29 bp, Artificial Sequence
  Description of Artificial Sequence: Synthetic oligonucleotide
aaaacccctcacgcctcgttggacagatc

SEQ ID NO: 169524 - DNA, 28 bp, Artificial Sequence
  Description of Artificial Sequence: Synthetic oligonucleotide
aaacccctcacgcctcgttggacagatc

SEQ ID NO: 169525 - DNA, 27 bp, Artificial Sequence
  Description of Artificial Sequence: Synthetic oligonucleotide
aacccctcacgcctcgttggacagatc

SEQ ID NO: 169526 - DNA, 39 bp, Artificial Sequence
  Description of Artificial Sequence: Synthetic oligonucleotide
agatatcatgtttgagcacttctttctgcacagagagtg

SEQ ID NO: 169527 - DNA, 38 bp, Artificial Sequence
  Description of Artificial Sequence: Synthetic oligonucleotide
gatatcatgtttgagcacttctttctgcacagagagtg

SEQ ID NO: 169528 - DNA, 38 bp, Artificial Sequence
  Description of Artificial Sequence: Synthetic oligonucleotide
atatcatgtttgagcacttctttctgcacagagagtgg

SEQ ID NO: 169529 - DNA, 37 bp, Artificial Sequence
  Description of Artificial Sequence: Synthetic oligonucleotide
tatcatgtttgagcacttctttctgcacagagagtgg

SEQ ID NO: 169530 - DNA, 36 bp, Artificial Sequence
  Description of Artificial Sequence: Synthetic oligonucleotide
atcatgtttgagcacttctttctgcacagagagtgg

SEQ ID NO: 169531 - DNA, 35 bp, Artificial Sequence
  Description of Artificial Sequence: Synthetic oligonucleotide
tcatgtttgagcacttctttctgcacagagagtgg

SEQ ID NO: 169532 - DNA, 34 bp, Artificial Sequence
  Description of Artificial Sequence: Synthetic oligonucleotide
catgtttgagcacttctttctgcacagagagtgg

SEQ ID NO: 169533 - DNA, 36 bp, Artificial Sequence
  Description of Artificial Sequence: Synthetic oligonucleotide
atgtttgagcacttctttctgcacagagagtggatc

SEQ ID NO: 169534 - DNA, 35 bp, Artificial Sequence
  Description of Artificial Sequence: Synthetic oligonucleotide
tgtttgagcacttctttctgcacagagagtggatc

SEQ ID NO: 169535 - DNA, 34 bp, Artificial Sequence
  Description of Artificial Sequence: Synthetic oligonucleotide
gtttgagcacttctttctgcacagagagtggatc

SEQ ID NO: 169536 - DNA, 35 bp, Artificial Sequence
  Description of Artificial Sequence: Synthetic oligonucleotide
tttgagcacttctttctgcacagagagtggatctc

SEQ ID NO: 169537 - DNA, 34 bp, Artificial Sequence
  Description of Artificial Sequence: Synthetic oligonucleotide
ttgagcacttctttctgcacagagagtggatctc

SEQ ID NO: 169538 - DNA, 33 bp, Artificial Sequence
  Description of Artificial Sequence: Synthetic oligonucleotide
tgagcacttctttctgcacagagagtggatctc

SEQ ID NO: 169539 - DNA, 32 bp, Artificial Sequence
  Description of Artificial Sequence: Synthetic oligonucleotide
gagcacttctttctgcacagagagtggatctc

SEQ ID NO: 169540 - DNA, 35 bp, Artificial Sequence
  Description of Artificial Sequence: Synthetic oligonucleotide
agcacttctttctgcacagagagtggatctctaag

SEQ ID NO: 169541 - DNA, 34 bp, Artificial Sequence
  Description of Artificial Sequence: Synthetic oligonucleotide
gcacttctttctgcacagagagtggatctctaag

SEQ ID NO: 169542 - DNA, 34 bp, Artificial Sequence
  Description of Artificial Sequence: Synthetic oligonucleotide
cacttctttctgcacagagagtggatctctaagg

SEQ ID NO: 169543 - DNA, 35 bp, Artificial Sequence
  Description of Artificial Sequence: Synthetic oligonucleotide
acttctttctgcacagagagtggatctctaaggac

SEQ ID NO: 169544 - DNA, 34 bp, Artificial Sequence
  Description of Artificial Sequence: Synthetic oligonucleotide
cttctttctgcacagagagtggatctctaaggac

SEQ ID NO: 169545 - DNA, 34 bp, Artificial Sequence
  Description of Artificial Sequence: Synthetic oligonucleotide
ttctttctgcacagagagtggatctctaaggacc

SEQ ID NO: 169546 - DNA, 33 bp, Artificial Sequence
  Description of Artificial Sequence: Synthetic oligonucleotide
tctttctgcacagagagtggatctctaaggacc

SEQ ID NO: 169547 - DNA, 32 bp, Artificial Sequence
  Description of Artificial Sequence: Synthetic oligonucleotide
ctttctgcacagagagtggatctctaaggacc

SEQ ID NO: 169548 - DNA, 32 bp, Artificial Sequence
  Description of Artificial Sequence: Synthetic oligonucleotide
tttctgcacagagagtggatctctaaggaccc

SEQ ID NO: 169549 - DNA, 31 bp, Artificial Sequence
  Description of Artificial Sequence: Synthetic oligonucleotide
ttctgcacagagagtggatctctaaggaccc

SEQ ID NO: 169550 - DNA, 30 bp, Artificial Sequence
  Description of Artificial Sequence: Synthetic oligonucleotide
tctgcacagagagtggatctctaaggaccc

SEQ ID NO: 169551 - DNA, 29 bp, Artificial Sequence
  Description of Artificial Sequence: Synthetic oligonucleotide
ctgcacagagagtggatctctaaggaccc

SEQ ID NO: 169552 - DNA, 29 bp, Artificial Sequence
  Description of Artificial Sequence: Synthetic oligonucleotide
tgcacagagagtggatctctaaggacccc

SEQ ID NO: 169553 - DNA, 28 bp, Artificial Sequence
  Description of Artificial Sequence: Synthetic oligonucleotide
gcacagagagtggatctctaaggacccc

SEQ ID NO: 169554 - DNA, 29 bp, Artificial Sequence
  Description of Artificial Sequence: Synthetic oligonucleotide
cacagagagtggatctctaaggacccctc

SEQ ID NO: 169555 - DNA, 30 bp, Artificial Sequence
  Description of Artificial Sequence: Synthetic oligonucleotide
acagagagtggatctctaaggacccctcac

SEQ ID NO: 169556 - DNA, 29 bp, Artificial Sequence
  Description of Artificial Sequence: Synthetic oligonucleotide
cagagagtggatctctaaggacccctcac

SEQ ID NO: 169557 - DNA, 29 bp, Artificial Sequence
  Description of Artificial Sequence: Synthetic oligonucleotide
agagagtggatctctaaggacccctcacg

SEQ ID NO: 169558 - DNA, 28 bp, Artificial Sequence
  Description of Artificial Sequence: Synthetic oligonucleotide
gagagtggatctctaaggacccctcacg

SEQ ID NO: 169559 - DNA, 28 bp, Artificial Sequence
  Description of Artificial Sequence: Synthetic oligonucleotide
ggtccacacatgggtggtcaggacaatc

SEQ ID NO: 169560 - DNA, 28 bp, Artificial Sequence
  Description of Artificial Sequence: Synthetic oligonucleotide
gtccacacatgggtggtcaggacaatcc

SEQ ID NO: 169561 - DNA, 28 bp, Artificial Sequence
  Description of Artificial Sequence: Synthetic oligonucleotide
tccacacatgggtggtcaggacaatccc

SEQ ID NO: 169562 - DNA, 27 bp, Artificial Sequence
  Description of Artificial Sequence: Synthetic oligonucleotide
ccacacatgggtggtcaggacaatccc

SEQ ID NO: 169563 - DNA, 29 bp, Artificial Sequence
  Description of Artificial Sequence: Synthetic oligonucleotide
cacacatgggtggtcaggacaatcccttc

SEQ ID NO: 169564 - DNA, 29 bp, Artificial Sequence
  Description of Artificial Sequence: Synthetic oligonucleotide
acacatgggtggtcaggacaatcccttcc

SEQ ID NO: 169565 - DNA, 28 bp, Artificial Sequence
  Description of Artificial Sequence: Synthetic oligonucleotide
cacatgggtggtcaggacaatcccttcc

SEQ ID NO: 169566 - DNA, 29 bp, Artificial Sequence
  Description of Artificial Sequence: Synthetic oligonucleotide
acatgggtggtcaggacaatcccttcctg

SEQ ID NO: 169567 - DNA, 28 bp, Artificial Sequence
  Description of Artificial Sequence: Synthetic oligonucleotide
catgggtggtcaggacaatcccttcctg

SEQ ID NO: 169568 - DNA, 29 bp, Artificial Sequence
  Description of Artificial Sequence: Synthetic oligonucleotide
atgggtggtcaggacaatcccttcctgtc

SEQ ID NO: 169569 - DNA, 28 bp, Artificial Sequence
  Description of Artificial Sequence: Synthetic oligonucleotide
tgggtggtcaggacaatcccttcctgtc

SEQ ID NO: 169570 - DNA, 27 bp, Artificial Sequence
  Description of Artificial Sequence: Synthetic oligonucleotide
gggtggtcaggacaatcccttcctgtc

SEQ ID NO: 169571 - DNA, 28 bp, Artificial Sequence
  Description of Artificial Sequence: Synthetic oligonucleotide
ggtggtcaggacaatcccttcctgtctg

SEQ ID NO: 169572 - DNA, 28 bp, Artificial Sequence
  Description of Artificial Sequence: Synthetic oligonucleotide
gtggtcaggacaatcccttcctgtctgc

SEQ ID NO: 169573 - DNA, 28 bp, Artificial Sequence
  Description of Artificial Sequence: Synthetic oligonucleotide
tggtcaggacaatcccttcctgtctgcc

SEQ ID NO: 169574 - DNA, 27 bp, Artificial Sequence
  Description of Artificial Sequence: Synthetic oligonucleotide
ggtcaggacaatcccttcctgtctgcc

SEQ ID NO: 169575 - DNA, 28 bp, Artificial Sequence
  Description of Artificial Sequence: Synthetic oligonucleotide
gtcaggacaatcccttcctgtctgcctg

SEQ ID NO: 169576 - DNA, 28 bp, Artificial Sequence
  Description of Artificial Sequence: Synthetic oligonucleotide
tcaggacaatcccttcctgtctgcctgg

SEQ ID NO: 169577 - DNA, 27 bp, Artificial Sequence
  Description of Artificial Sequence: Synthetic oligonucleotide
caggacaatcccttcctgtctgcctgg

SEQ ID NO: 169578 - DNA, 27 bp, Artificial Sequence
  Description of Artificial Sequence: Synthetic oligonucleotide
aggacaatcccttcctgtctgcctggc

SEQ ID NO: 169579 - DNA, 26 bp, Artificial Sequence
  Description of Artificial Sequence: Synthetic oligonucleotide
ggacaatcccttcctgtctgcctggc

SEQ ID NO: 169580 - DNA, 26 bp, Artificial Sequence
  Description of Artificial Sequence: Synthetic oligonucleotide
gacaatcccttcctgtctgcctggcc

SEQ ID NO: 169581 - DNA, 27 bp, Artificial Sequence
  Description of Artificial Sequence: Synthetic oligonucleotide
acaatcccttcctgtctgcctggccca

SEQ ID NO: 169582 - DNA, 26 bp, Artificial Sequence
  Description of Artificial Sequence: Synthetic oligonucleotide
caatcccttcctgtctgcctggccca

SEQ ID NO: 169583 - DNA, 26 bp, Artificial Sequence
  Description of Artificial Sequence: Synthetic oligonucleotide
aatcccttcctgtctgcctggcccag

SEQ ID NO: 169584 - DNA, 25 bp, Artificial Sequence
  Description of Artificial Sequence: Synthetic oligonucleotide
atcccttcctgtctgcctggcccag

SEQ ID NO: 169585 - DNA, 24 bp, Artificial Sequence
  Description of Artificial Sequence: Synthetic oligonucleotide
tcccttcctgtctgcctggcccag

SEQ ID NO: 169586 - DNA, 24 bp, Artificial Sequence
  Description of Artificial Sequence: Synthetic oligonucleotide
atggccgaggtgttgcggacgctg

SEQ ID NO: 169587 - DNA, 23 bp, Artificial Sequence
  Description of Artificial Sequence: Synthetic oligonucleotide
tggccgaggtgttgcggacgctg

SEQ ID NO: 169588 - DNA, 22 bp, Artificial Sequence
  Description of Artificial Sequence: Synthetic oligonucleotide
ggccgaggtgttgcggacgctg

SEQ ID NO: 169589 - DNA, 22 bp, Artificial Sequence
  Description of Artificial Sequence: Synthetic oligonucleotide
gccgaggtgttgcggacgctgg

SEQ ID NO: 169590 - DNA, 22 bp, Artificial Sequence
  Description of Artificial Sequence: Synthetic oligonucleotide
ccgaggtgttgcggacgctggc

SEQ ID NO: 169591 - DNA, 22 bp, Artificial Sequence
  Description of Artificial Sequence: Synthetic oligonucleotide
cgaggtgttgcggacgctggcc

SEQ ID NO: 169592 - DNA, 22 bp, Artificial Sequence
  Description of Artificial Sequence: Synthetic oligonucleotide
gaggtgttgcggacgctggccg

SEQ ID NO: 169593 - DNA, 26 bp, Artificial Sequence
  Description of Artificial Sequence: Synthetic oligonucleotide
aggtgttgcggacgctggccggaaaa

SEQ ID NO: 169594 - DNA, 25 bp, Artificial Sequence
  Description of Artificial Sequence: Synthetic oligonucleotide
ggtgttgcggacgctggccggaaaa

SEQ ID NO: 169595 - DNA, 25 bp, Artificial Sequence
  Description of Artificial Sequence: Synthetic oligonucleotide
gtgttgcggacgctggccggaaaac

SEQ ID NO: 169596 - DNA, 27 bp, Artificial Sequence
  Description of Artificial Sequence: Synthetic oligonucleotide
tgttgcggacgctggccggaaaaccaa

SEQ ID NO: 169597 - DNA, 27 bp, Artificial Sequence
  Description of Artificial Sequence: Synthetic oligonucleotide
gttgcggacgctggccggaaaaccaaa

SEQ ID NO: 169598 - DNA, 29 bp, Artificial Sequence
  Description of Artificial Sequence: Synthetic oligonucleotide
ttgcggacgctggccggaaaaccaaaatg

SEQ ID NO: 169599 - DNA, 28 bp, Artificial Sequence
  Description of Artificial Sequence: Synthetic oligonucleotide
tgcggacgctggccggaaaaccaaaatg

SEQ ID NO: 169600 - DNA, 27 bp, Artificial Sequence
  Description of Artificial Sequence: Synthetic oligonucleotide
gcggacgctggccggaaaaccaaaatg

SEQ ID NO: 169601 - DNA, 27 bp, Artificial Sequence
  Description of Artificial Sequence: Synthetic oligonucleotide
cggacgctggccggaaaaccaaaatgc

SEQ ID NO: 169602 - DNA, 27 bp, Artificial Sequence
  Description of Artificial Sequence: Synthetic oligonucleotide
ggacgctggccggaaaaccaaaatgcc

SEQ ID NO: 169603 - DNA, 28 bp, Artificial Sequence
  Description of Artificial Sequence: Synthetic oligonucleotide
gacgctggccggaaaaccaaaatgccac

SEQ ID NO: 169604 - DNA, 28 bp, Artificial Sequence
  Description of Artificial Sequence: Synthetic oligonucleotide
acgctggccggaaaaccaaaatgccacg

SEQ ID NO: 169605 - DNA, 27 bp, Artificial Sequence
  Description of Artificial Sequence: Synthetic oligonucleotide
cgctggccggaaaaccaaaatgccacg

SEQ ID NO: 169606 - DNA, 27 bp, Artificial Sequence
  Description of Artificial Sequence: Synthetic oligonucleotide
gctggccggaaaaccaaaatgccacgc

SEQ ID NO: 169607 - DNA, 28 bp, Artificial Sequence
  Description of Artificial Sequence: Synthetic oligonucleotide
ctggccggaaaaccaaaatgccacgcac

SEQ ID NO: 169608 - DNA, 30 bp, Artificial Sequence
  Description of Artificial Sequence: Synthetic oligonucleotide
tggccggaaaaccaaaatgccacgcacttc

SEQ ID NO: 169609 - DNA, 29 bp, Artificial Sequence
  Description of Artificial Sequence: Synthetic oligonucleotide
ggccggaaaaccaaaatgccacgcacttc

SEQ ID NO: 169610 - DNA, 29 bp, Artificial Sequence
  Description of Artificial Sequence: Synthetic oligonucleotide
gccggaaaaccaaaatgccacgcacttcg

SEQ ID NO: 169611 - DNA, 30 bp, Artificial Sequence
  Description of Artificial Sequence: Synthetic oligonucleotide
ccggaaaaccaaaatgccacgcacttcgac

SEQ ID NO: 169612 - DNA, 30 bp, Artificial Sequence
  Description of Artificial Sequence: Synthetic oligonucleotide
cggaaaaccaaaatgccacgcacttcgacc

SEQ ID NO: 169613 - DNA, 33 bp, Artificial Sequence
  Description of Artificial Sequence: Synthetic oligonucleotide
ggaaaaccaaaatgccacgcacttcgacctatg

SEQ ID NO: 169614 - DNA, 35 bp, Artificial Sequence
  Description of Artificial Sequence: Synthetic oligonucleotide
gaaaaccaaaatgccacgcacttcgacctatgatc

SEQ ID NO: 169615 - DNA, 35 bp, Artificial Sequence
  Description of Artificial Sequence: Synthetic oligonucleotide
aaaaccaaaatgccacgcacttcgacctatgatcc

SEQ ID NO: 169616 - DNA, 34 bp, Artificial Sequence
  Description of Artificial Sequence: Synthetic oligonucleotide
aaaccaaaatgccacgcacttcgacctatgatcc

SEQ ID NO: 169617 - DNA, 33 bp, Artificial Sequence
  Description of Artificial Sequence: Synthetic oligonucleotide
aaccaaaatgccacgcacttcgacctatgatcc

SEQ ID NO: 169618 - DNA, 32 bp, Artificial Sequence
  Description of Artificial Sequence: Synthetic oligonucleotide
accaaaatgccacgcacttcgacctatgatcc

SEQ ID NO: 169619 - DNA, 31 bp, Artificial Sequence
  Description of Artificial Sequence: Synthetic oligonucleotide
ccaaaatgccacgcacttcgacctatgatcc

SEQ ID NO: 169620 - DNA, 35 bp, Artificial Sequence
  Description of Artificial Sequence: Synthetic oligonucleotide
caaaatgccacgcacttcgacctatgatccttttc

SEQ ID NO: 169621 - DNA, 35 bp, Artificial Sequence
  Description of Artificial Sequence: Synthetic oligonucleotide
aaaatgccacgcacttcgacctatgatccttttcc

SEQ ID NO: 169622 - DNA, 34 bp, Artificial Sequence
  Description of Artificial Sequence: Synthetic oligonucleotide
aaatgccacgcacttcgacctatgatccttttcc

SEQ ID NO: 169623 - DNA, 33 bp, Artificial Sequence
  Description of Artificial Sequence: Synthetic oligonucleotide
aatgccacgcacttcgacctatgatccttttcc

SEQ ID NO: 169624 - DNA, 32 bp, Artificial Sequence
  Description of Artificial Sequence: Synthetic oligonucleotide
atgccacgcacttcgacctatgatccttttcc

SEQ ID NO: 169625 - DNA, 31 bp, Artificial Sequence
  Description of Artificial Sequence: Synthetic oligonucleotide
tgccacgcacttcgacctatgatccttttcc

SEQ ID NO: 169626 - DNA, 30 bp, Artificial Sequence
  Description of Artificial Sequence: Synthetic oligonucleotide
gccacgcacttcgacctatgatccttttcc

SEQ ID NO: 169627 - DNA, 37 bp, Artificial Sequence
  Description of Artificial Sequence: Synthetic oligonucleotide
ccacgcacttcgacctatgatccttttcctaataatg

SEQ ID NO: 169628 - DNA, 37 bp, Artificial Sequence
  Description of Artificial Sequence: Synthetic oligonucleotide
cacgcacttcgacctatgatccttttcctaataatgc

SEQ ID NO: 169629 - DNA, 39 bp, Artificial Sequence
  Description of Artificial Sequence: Synthetic oligonucleotide
acgcacttcgacctatgatccttttcctaataatgcttg

SEQ ID NO: 169630 - DNA, 38 bp, Artificial Sequence
  Description of Artificial Sequence: Synthetic oligonucleotide
cgcacttcgacctatgatccttttcctaataatgcttg

SEQ ID NO: 169631 - DNA, 39 bp, Artificial Sequence
  Description of Artificial Sequence: Synthetic oligonucleotide
gcacttcgacctatgatccttttcctaataatgcttgtc

SEQ ID NO: 169632 - DNA, 41 bp, Artificial Sequence
  Description of Artificial Sequence: Synthetic oligonucleotide
cacttcgacctatgatccttttcctaataatgcttgtcttg

SEQ ID NO: 169633 - DNA, 41 bp, Artificial Sequence
  Description of Artificial Sequence: Synthetic oligonucleotide
acttcgacctatgatccttttcctaataatgcttgtcttgg

SEQ ID NO: 169634 - DNA, 40 bp, Artificial Sequence
  Description of Artificial Sequence: Synthetic oligonucleotide
cttcgacctatgatccttttcctaataatgcttgtcttgg

SEQ ID NO: 169635 - DNA, 41 bp, Artificial Sequence
  Description of Artificial Sequence: Synthetic oligonucleotide
ttcgacctatgatccttttcctaataatgcttgtcttggtc

SEQ ID NO: 169636 - DNA, 40 bp, Artificial Sequence
  Description of Artificial Sequence: Synthetic oligonucleotide
tcgacctatgatccttttcctaataatgcttgtcttggtc

SEQ ID NO: 169637 - DNA, 39 bp, Artificial Sequence
  Description of Artificial Sequence: Synthetic oligonucleotide
cgacctatgatccttttcctaataatgcttgtcttggtc

SEQ ID NO: 169638 - DNA, 41 bp, Artificial Sequence
  Description of Artificial Sequence: Synthetic oligonucleotide
gacctatgatccttttcctaataatgcttgtcttggtcttg

SEQ ID NO: 169639 - DNA, 44 bp, Artificial Sequence
  Description of Artificial Sequence: Synthetic oligonucleotide
acctatgatccttttcctaataatgcttgtcttggtcttgtttg

SEQ ID NO: 169640 - DNA, 43 bp, Artificial Sequence
  Description of Artificial Sequence: Synthetic oligonucleotide
cctatgatccttttcctaataatgcttgtcttggtcttgtttg

SEQ ID NO: 169641 - DNA, 43 bp, Artificial Sequence
  Description of Artificial Sequence: Synthetic oligonucleotide
ctatgatccttttcctaataatgcttgtcttggtcttgtttgg

SEQ ID NO: 169642 - DNA, 46 bp, Artificial Sequence
  Description of Artificial Sequence: Synthetic oligonucleotide
tatgatccttttcctaataatgcttgtcttggtcttgtttggttac

SEQ ID NO: 169643 - DNA, 45 bp, Artificial Sequence
  Description of Artificial Sequence: Synthetic oligonucleotide
atgatccttttcctaataatgcttgtcttggtcttgtttggttac

SEQ ID NO: 169644 - DNA, 44 bp, Artificial Sequence
  Description of Artificial Sequence: Synthetic oligonucleotide
tgatccttttcctaataatgcttgtcttggtcttgtttggttac

SEQ ID NO: 169645 - DNA, 43 bp, Artificial Sequence
  Description of Artificial Sequence: Synthetic oligonucleotide
gatccttttcctaataatgcttgtcttggtcttgtttggttac

SEQ ID NO: 169646 - DNA, 43 bp, Artificial Sequence
  Description of Artificial Sequence: Synthetic oligonucleotide
atccttttcctaataatgcttgtcttggtcttgtttggttacg

SEQ ID NO: 169647 - DNA, 42 bp, Artificial Sequence
  Description of Artificial Sequence: Synthetic oligonucleotide
tccttttcctaataatgcttgtcttggtcttgtttggttacg

SEQ ID NO: 169648 - DNA, 41 bp, Artificial Sequence
  Description of Artificial Sequence: Synthetic oligonucleotide
ccttttcctaataatgcttgtcttggtcttgtttggttacg

SEQ ID NO: 169649 - DNA, 41 bp, Artificial Sequence
  Description of Artificial Sequence: Synthetic oligonucleotide
cttttcctaataatgcttgtcttggtcttgtttggttacgg

SEQ ID NO: 169650 - DNA, 41 bp, Artificial Sequence
  Description of Artificial Sequence: Synthetic oligonucleotide
ttttcctaataatgcttgtcttggtcttgtttggttacggg

SEQ ID NO: 169651 - DNA, 40 bp, Artificial Sequence
  Description of Artificial Sequence: Synthetic oligonucleotide
tttcctaataatgcttgtcttggtcttgtttggttacggg

SEQ ID NO: 169652 - DNA, 39 bp, Artificial Sequence
  Description of Artificial Sequence: Synthetic oligonucleotide
ttcctaataatgcttgtcttggtcttgtttggttacggg

SEQ ID NO: 169653 - DNA, 38 bp, Artificial Sequence
  Description of Artificial Sequence: Synthetic oligonucleotide
tcctaataatgcttgtcttggtcttgtttggttacggg

SEQ ID NO: 169654 - DNA, 37 bp, Artificial Sequence
  Description of Artificial Sequence: Synthetic oligonucleotide
cctaataatgcttgtcttggtcttgtttggttacggg

SEQ ID NO: 169655 - DNA, 37 bp, Artificial Sequence
  Description of Artificial Sequence: Synthetic oligonucleotide
ctaataatgcttgtcttggtcttgtttggttacgggg

SEQ ID NO: 169656 - DNA, 38 bp, Artificial Sequence
  Description of Artificial Sequence: Synthetic oligonucleotide
taataatgcttgtcttggtcttgtttggttacggggtc

SEQ ID NO: 169657 - DNA, 37 bp, Artificial Sequence
  Description of Artificial Sequence: Synthetic oligonucleotide
aataatgcttgtcttggtcttgtttggttacggggtc

SEQ ID NO: 169658 - DNA, 36 bp, Artificial Sequence
  Description of Artificial Sequence: Synthetic oligonucleotide
ataatgcttgtcttggtcttgtttggttacggggtc

SEQ ID NO: 169659 - DNA, 35 bp, Artificial Sequence
  Description of Artificial Sequence: Synthetic oligonucleotide
taatgcttgtcttggtcttgtttggttacggggtc

SEQ ID NO: 169660 - DNA, 34 bp, Artificial Sequence
  Description of Artificial Sequence: Synthetic oligonucleotide
aatgcttgtcttggtcttgtttggttacggggtc

SEQ ID NO: 169661 - DNA, 33 bp, Artificial Sequence
  Description of Artificial Sequence: Synthetic oligonucleotide
atgcttgtcttggtcttgtttggttacggggtc

SEQ ID NO: 169662 - DNA, 32 bp, Artificial Sequence
  Description of Artificial Sequence: Synthetic oligonucleotide
tgcttgtcttggtcttgtttggttacggggtc

SEQ ID NO: 169663 - DNA, 31 bp, Artificial Sequence
  Description of Artificial Sequence: Synthetic oligonucleotide
gcttgtcttggtcttgtttggttacggggtc

SEQ ID NO: 169664 - DNA, 31 bp, Artificial Sequence
  Description of Artificial Sequence: Synthetic oligonucleotide
cttgtcttggtcttgtttggttacggggtcc

SEQ ID NO: 169665 - DNA, 34 bp, Artificial Sequence
  Description of Artificial Sequence: Synthetic oligonucleotide
ttgtcttggtcttgtttggttacggggtcctaag

SEQ ID NO: 169666 - DNA, 33 bp, Artificial Sequence
  Description of Artificial Sequence: Synthetic oligonucleotide
tgtcttggtcttgtttggttacggggtcctaag

SEQ ID NO: 169667 - DNA, 32 bp, Artificial Sequence
  Description of Artificial Sequence: Synthetic oligonucleotide
gtcttggtcttgtttggttacggggtcctaag

SEQ ID NO: 169668 - DNA, 32 bp, Artificial Sequence
  Description of Artificial Sequence: Synthetic oligonucleotide
tcttggtcttgtttggttacggggtcctaagc

SEQ ID NO: 169669 - DNA, 31 bp, Artificial Sequence
  Description of Artificial Sequence: Synthetic oligonucleotide
cttggtcttgtttggttacggggtcctaagc

SEQ ID NO: 169670 - DNA, 31 bp, Artificial Sequence
  Description of Artificial Sequence: Synthetic oligonucleotide
ttggtcttgtttggttacggggtcctaagcc

SEQ ID NO: 169671 - DNA, 30 bp, Artificial Sequence
  Description of Artificial Sequence: Synthetic oligonucleotide
tggtcttgtttggttacggggtcctaagcc

SEQ ID NO: 169672 - DNA, 29 bp, Artificial Sequence
  Description of Artificial Sequence: Synthetic oligonucleotide
ggtcttgtttggttacggggtcctaagcc

SEQ ID NO: 169673 - DNA, 29 bp, Artificial Sequence
  Description of Artificial Sequence: Synthetic oligonucleotide
gtcttgtttggttacggggtcctaagccc

SEQ ID NO: 169674 - DNA, 29 bp, Artificial Sequence
  Description of Artificial Sequence: Synthetic oligonucleotide
tcttgtttggttacggggtcctaagcccc

SEQ ID NO: 169675 - DNA, 28 bp, Artificial Sequence
  Description of Artificial Sequence: Synthetic oligonucleotide
cttgtttggttacggggtcctaagcccc

SEQ ID NO: 169676 - DNA, 29 bp, Artificial Sequence
  Description of Artificial Sequence: Synthetic oligonucleotide
ttgtttggttacggggtcctaagccccag

SEQ ID NO: 169677 - DNA, 28 bp, Artificial Sequence
  Description of Artificial Sequence: Synthetic oligonucleotide
tgtttggttacggggtcctaagccccag

SEQ ID NO: 169678 - DNA, 27 bp, Artificial Sequence
  Description of Artificial Sequence: Synthetic oligonucleotide
gtttggttacggggtcctaagccccag

SEQ ID NO: 169679 - DNA, 29 bp, Artificial Sequence
  Description of Artificial Sequence: Synthetic oligonucleotide
tttggttacggggtcctaagccccagaag

SEQ ID NO: 169680 - DNA, 28 bp, Artificial Sequence
  Description of Artificial Sequence: Synthetic oligonucleotide
ttggttacggggtcctaagccccagaag

SEQ ID NO: 169681 - DNA, 27 bp, Artificial Sequence
  Description of Artificial Sequence: Synthetic oligonucleotide
tggttacggggtcctaagccccagaag

SEQ ID NO: 169682 - DNA, 27 bp, Artificial Sequence
  Description of Artificial Sequence: Synthetic oligonucleotide
ggttacggggtcctaagccccagaagt

SEQ ID NO: 169683 - DNA, 27 bp, Artificial Sequence
  Description of Artificial Sequence: Synthetic oligonucleotide
gttacggggtcctaagccccagaagtc

SEQ ID NO: 169684 - DNA, 31 bp, Artificial Sequence
  Description of Artificial Sequence: Synthetic oligonucleotide
ttacggggtcctaagccccagaagtctaatg

SEQ ID NO: 169685 - DNA, 30 bp, Artificial Sequence
  Description of Artificial Sequence: Synthetic oligonucleotide
tacggggtcctaagccccagaagtctaatg

SEQ ID NO: 169686 - DNA, 29 bp, Artificial Sequence
  Description of Artificial Sequence: Synthetic oligonucleotide
acggggtcctaagccccagaagtctaatg

SEQ ID NO: 169687 - DNA, 28 bp, Artificial Sequence
  Description of Artificial Sequence: Synthetic oligonucleotide
cggggtcctaagccccagaagtctaatg

SEQ ID NO: 169688 - DNA, 28 bp, Artificial Sequence
  Description of Artificial Sequence: Synthetic oligonucleotide
ggggtcctaagccccagaagtctaatgc

SEQ ID NO: 169689 - DNA, 28 bp, Artificial Sequence
  Description of Artificial Sequence: Synthetic oligonucleotide
gggtcctaagccccagaagtctaatgcc

SEQ ID NO: 169690 - DNA, 29 bp, Artificial Sequence
  Description of Artificial Sequence: Synthetic oligonucleotide
ggtcctaagccccagaagtctaatgccag

SEQ ID NO: 169691 - DNA, 29 bp, Artificial Sequence
  Description of Artificial Sequence: Synthetic oligonucleotide
gtcctaagccccagaagtctaatgccagg

SEQ ID NO: 169692 - DNA, 31 bp, Artificial Sequence
  Description of Artificial Sequence: Synthetic oligonucleotide
tcctaagccccagaagtctaatgccaggaag

SEQ ID NO: 169693 - DNA, 30 bp, Artificial Sequence
  Description of Artificial Sequence: Synthetic oligonucleotide
cctaagccccagaagtctaatgccaggaag

SEQ ID NO: 169694 - DNA, 30 bp, Artificial Sequence
  Description of Artificial Sequence: Synthetic oligonucleotide
ctaagccccagaagtctaatgccaggaagc

SEQ ID NO: 169695 - DNA, 30 bp, Artificial Sequence
  Description of Artificial Sequence: Synthetic oligonucleotide
taagccccagaagtctaatgccaggaagcc

SEQ ID NO: 169696 - DNA, 29 bp, Artificial Sequence
  Description of Artificial Sequence: Synthetic oligonucleotide
aagccccagaagtctaatgccaggaagcc

SEQ ID NO: 169697 - DNA, 28 bp, Artificial Sequence
  Description of Artificial Sequence: Synthetic oligonucleotide
agccccagaagtctaatgccaggaagcc

SEQ ID NO: 169698 - DNA, 27 bp, Artificial Sequence
  Description of Artificial Sequence: Synthetic oligonucleotide
gccccagaagtctaatgccaggaagcc

SEQ ID NO: 169699 - DNA, 28 bp, Artificial Sequence
  Description of Artificial Sequence: Synthetic oligonucleotide
ccccagaagtctaatgccaggaagcctg

SEQ ID NO: 169700 - DNA, 28 bp, Artificial Sequence
  Description of Artificial Sequence: Synthetic oligonucleotide
cccagaagtctaatgccaggaagcctgg

SEQ ID NO: 169701 - DNA, 30 bp, Artificial Sequence
  Description of Artificial Sequence: Synthetic oligonucleotide
ccagaagtctaatgccaggaagcctggaac

SEQ ID NO: 169702 - DNA, 30 bp, Artificial Sequence
  Description of Artificial Sequence: Synthetic oligonucleotide
cagaagtctaatgccaggaagcctggaacg

SEQ ID NO: 169703 - DNA, 30 bp, Artificial Sequence
  Description of Artificial Sequence: Synthetic oligonucleotide
agaagtctaatgccaggaagcctggaacgg

SEQ ID NO: 169704 - DNA, 29 bp, Artificial Sequence
  Description of Artificial Sequence: Synthetic oligonucleotide
gaagtctaatgccaggaagcctggaacgg

SEQ ID NO: 169705 - DNA, 29 bp, Artificial Sequence
  Description of Artificial Sequence: Synthetic oligonucleotide
aagtctaatgccaggaagcctggaacggg

SEQ ID NO: 169706 - DNA, 28 bp, Artificial Sequence
  Description of Artificial Sequence: Synthetic oligonucleotide
agtctaatgccaggaagcctggaacggg

SEQ ID NO: 169707 - DNA, 27 bp, Artificial Sequence
  Description of Artificial Sequence: Synthetic oligonucleotide
gtctaatgccaggaagcctggaacggg

SEQ ID NO: 169708 - DNA, 27 bp, Artificial Sequence
  Description of Artificial Sequence: Synthetic oligonucleotide
tctaatgccaggaagcctggaacgggg

SEQ ID NO: 169709 - DNA, 26 bp, Artificial Sequence
  Description of Artificial Sequence: Synthetic oligonucleotide
ctaatgccaggaagcctggaacgggg

SEQ ID NO: 169710 - DNA, 27 bp, Artificial Sequence
  Description of Artificial Sequence: Synthetic oligonucleotide
taatgccaggaagcctggaacgggggt

SEQ ID NO: 169711 - DNA, 27 bp, Artificial Sequence
  Description of Artificial Sequence: Synthetic oligonucleotide
aatgccaggaagcctggaacgggggtt

SEQ ID NO: 169712 - DNA, 26 bp, Artificial Sequence
  Description of Artificial Sequence: Synthetic oligonucleotide
atgccaggaagcctggaacgggggtt

SEQ ID NO: 169713 - DNA, 25 bp, Artificial Sequence
  Description of Artificial Sequence: Synthetic oligonucleotide
tgccaggaagcctggaacgggggtt

SEQ ID NO: 169714 - DNA, 24 bp, Artificial Sequence
  Description of Artificial Sequence: Synthetic oligonucleotide
gccaggaagcctggaacgggggtt

SEQ ID NO: 169715 - DNA, 25 bp, Artificial Sequence
  Description of Artificial Sequence: Synthetic oligonucleotide
ccaggaagcctggaacgggggttct

SEQ ID NO: 169716 - DNA, 25 bp, Artificial Sequence
  Description of Artificial Sequence: Synthetic oligonucleotide
caggaagcctggaacgggggttctg

SEQ ID NO: 169717 - DNA, 27 bp, Artificial Sequence
  Description of Artificial Sequence: Synthetic oligonucleotide
aggaagcctggaacgggggttctgcat

SEQ ID NO: 169718 - DNA, 26 bp, Artificial Sequence
  Description of Artificial Sequence: Synthetic oligonucleotide
ggaagcctggaacgggggttctgcat

SEQ ID NO: 169719 - DNA, 26 bp, Artificial Sequence
  Description of Artificial Sequence: Synthetic oligonucleotide
gaagcctggaacgggggttctgcatg

SEQ ID NO: 169720 - DNA, 26 bp, Artificial Sequence
  Description of Artificial Sequence: Synthetic oligonucleotide
aagcctggaacgggggttctgcatgg

SEQ ID NO: 169721 - DNA, 25 bp, Artificial Sequence
  Description of Artificial Sequence: Synthetic oligonucleotide
agcctggaacgggggttctgcatgg

SEQ ID NO: 169722 - DNA, 24 bp, Artificial Sequence
  Description of Artificial Sequence: Synthetic oligonucleotide
gcctggaacgggggttctgcatgg

SEQ ID NO: 169723 - DNA, 25 bp, Artificial Sequence
  Description of Artificial Sequence: Synthetic oligonucleotide
cctggaacgggggttctgcatggct

SEQ ID NO: 169724 - DNA, 27 bp, Artificial Sequence
  Description of Artificial Sequence: Synthetic oligonucleotide
ctggaacgggggttctgcatggctgtt

SEQ ID NO: 169725 - DNA, 28 bp, Artificial Sequence
  Description of Artificial Sequence: Synthetic oligonucleotide
tggaacgggggttctgcatggctgttag

SEQ ID NO: 169726 - DNA, 27 bp, Artificial Sequence
  Description of Artificial Sequence: Synthetic oligonucleotide
ggaacgggggttctgcatggctgttag

SEQ ID NO: 169727 - DNA, 27 bp, Artificial Sequence
  Description of Artificial Sequence: Synthetic oligonucleotide
gaacgggggttctgcatggctgttagg

SEQ ID NO: 169728 - DNA, 27 bp, Artificial Sequence
  Description of Artificial Sequence: Synthetic oligonucleotide
aacgggggttctgcatggctgttaggg

SEQ ID NO: 169729 - DNA, 27 bp, Artificial Sequence
  Description of Artificial Sequence: Synthetic oligonucleotide
acgggggttctgcatggctgttaggga

SEQ ID NO: 169730 - DNA, 27 bp, Artificial Sequence
  Description of Artificial Sequence: Synthetic oligonucleotide
cgggggttctgcatggctgttagggaa

SEQ ID NO: 169731 - DNA, 27 bp, Artificial Sequence
  Description of Artificial Sequence: Synthetic oligonucleotide
gggggttctgcatggctgttagggaac

SEQ ID NO: 169732 - DNA, 27 bp, Artificial Sequence
  Description of Artificial Sequence: Synthetic oligonucleotide
ggggttctgcatggctgttagggaacc

SEQ ID NO: 169733 - DNA, 28 bp, Artificial Sequence
  Description of Artificial Sequence: Synthetic oligonucleotide
gggttctgcatggctgttagggaacctg

SEQ ID NO: 169734 - DNA, 29 bp, Artificial Sequence
  Description of Artificial Sequence: Synthetic oligonucleotide
ggttctgcatggctgttagggaacctgac

SEQ ID NO: 169735 - DNA, 29 bp, Artificial Sequence
  Description of Artificial Sequence: Synthetic oligonucleotide
gttctgcatggctgttagggaacctgacc

SEQ ID NO: 169736 - DNA, 31 bp, Artificial Sequence
  Description of Artificial Sequence: Synthetic oligonucleotide
ttctgcatggctgttagggaacctgaccatc

SEQ ID NO: 169737 - DNA, 30 bp, Artificial Sequence
  Description of Artificial Sequence: Synthetic oligonucleotide
tctgcatggctgttagggaacctgaccatc

SEQ ID NO: 169738 - DNA, 29 bp, Artificial Sequence
  Description of Artificial Sequence: Synthetic oligonucleotide
ctgcatggctgttagggaacctgaccatc

SEQ ID NO: 169739 - DNA, 30 bp, Artificial Sequence
  Description of Artificial Sequence: Synthetic oligonucleotide
tgcatggctgttagggaacctgaccatctg

SEQ ID NO: 169740 - DNA, 29 bp, Artificial Sequence
  Description of Artificial Sequence: Synthetic oligonucleotide
gcatggctgttagggaacctgaccatctg

SEQ ID NO: 169741 - DNA, 29 bp, Artificial Sequence
  Description of Artificial Sequence: Synthetic oligonucleotide
catggctgttagggaacctgaccatctgc

SEQ ID NO: 169742 - DNA, 30 bp, Artificial Sequence
  Description of Artificial Sequence: Synthetic oligonucleotide
atggctgttagggaacctgaccatctgcag

SEQ ID NO: 169743 - DNA, 29 bp, Artificial Sequence
  Description of Artificial Sequence: Synthetic oligonucleotide
tggctgttagggaacctgaccatctgcag

SEQ ID NO: 169744 - DNA, 28 bp, Artificial Sequence
  Description of Artificial Sequence: Synthetic oligonucleotide
ggctgttagggaacctgaccatctgcag

SEQ ID NO: 169745 - DNA, 28 bp, Artificial Sequence
  Description of Artificial Sequence: Synthetic oligonucleotide
gctgttagggaacctgaccatctgcagc

SEQ ID NO: 169746 - DNA, 28 bp, Artificial Sequence
  Description of Artificial Sequence: Synthetic oligonucleotide
ctgttagggaacctgaccatctgcagcg

SEQ ID NO: 169747 - DNA, 28 bp, Artificial Sequence
  Description of Artificial Sequence: Synthetic oligonucleotide
tgttagggaacctgaccatctgcagcgc

SEQ ID NO: 169748 - DNA, 27 bp, Artificial Sequence
  Description of Artificial Sequence: Synthetic oligonucleotide
gttagggaacctgaccatctgcagcgc

SEQ ID NO: 169749 - DNA, 27 bp, Artificial Sequence
  Description of Artificial Sequence: Synthetic oligonucleotide
ttagggaacctgaccatctgcagcgcg

SEQ ID NO: 169750 - DNA, 27 bp, Artificial Sequence
  Description of Artificial Sequence: Synthetic oligonucleotide
tagggaacctgaccatctgcagcgcgt

SEQ ID NO: 169751 - DNA, 26 bp, Artificial Sequence
  Description of Artificial Sequence: Synthetic oligonucleotide
agggaacctgaccatctgcagcgcgt

SEQ ID NO: 169752 - DNA, 25 bp, Artificial Sequence
  Description of Artificial Sequence: Synthetic oligonucleotide
gggaacctgaccatctgcagcgcgt

SEQ ID NO: 169753 - DNA, 26 bp, Artificial Sequence
  Description of Artificial Sequence: Synthetic oligonucleotide
ggaacctgaccatctgcagcgcgtct

SEQ ID NO: 169754 - DNA, 26 bp, Artificial Sequence
  Description of Artificial Sequence: Synthetic oligonucleotide
gaacctgaccatctgcagcgcgtctc

SEQ ID NO: 169755 - DNA, 27 bp, Artificial Sequence
  Description of Artificial Sequence: Synthetic oligonucleotide
aacctgaccatctgcagcgcgtctcgt

SEQ ID NO: 169756 - DNA, 27 bp, Artificial Sequence
  Description of Artificial Sequence: Synthetic oligonucleotide
acctgaccatctgcagcgcgtctcgtt

SEQ ID NO: 169757 - DNA, 26 bp, Artificial Sequence
  Description of Artificial Sequence: Synthetic oligonucleotide
cctgaccatctgcagcgcgtctcgtt

SEQ ID NO: 169758 - DNA, 26 bp, Artificial Sequence
  Description of Artificial Sequence: Synthetic oligonucleotide
ctgaccatctgcagcgcgtctcgttg

SEQ ID NO: 169759 - DNA, 26 bp, Artificial Sequence
  Description of Artificial Sequence: Synthetic oligonucleotide
tgaccatctgcagcgcgtctcgttgc

SEQ ID NO: 169760 - DNA, 25 bp, Artificial Sequence
  Description of Artificial Sequence: Synthetic oligonucleotide
gaccatctgcagcgcgtctcgttgc

SEQ ID NO: 169761 - DNA, 27 bp, Artificial Sequence
  Description of Artificial Sequence: Synthetic oligonucleotide
accatctgcagcgcgtctcgttgccaa

SEQ ID NO: 169762 - DNA, 26 bp, Artificial Sequence
  Description of Artificial Sequence: Synthetic oligonucleotide
ccatctgcagcgcgtctcgttgccaa

SEQ ID NO: 169763 - DNA, 26 bp, Artificial Sequence
  Description of Artificial Sequence: Synthetic oligonucleotide
catctgcagcgcgtctcgttgccaag

SEQ ID NO: 169764 - DNA, 27 bp, Artificial Sequence
  Description of Artificial Sequence: Synthetic oligonucleotide
atctgcagcgcgtctcgttgccaagga

SEQ ID NO: 169765 - DNA, 27 bp, Artificial Sequence
  Description of Artificial Sequence: Synthetic oligonucleotide
tctgcagcgcgtctcgttgccaaggat

SEQ ID NO: 169766 - DNA, 26 bp, Artificial Sequence
  Description of Artificial Sequence: Synthetic oligonucleotide
ctgcagcgcgtctcgttgccaaggat

SEQ ID NO: 169767 - DNA, 26 bp, Artificial Sequence
  Description of Artificial Sequence: Synthetic oligonucleotide
tgcagcgcgtctcgttgccaaggatg

SEQ ID NO: 169768 - DNA, 25 bp, Artificial Sequence
  Description of Artificial Sequence: Synthetic oligonucleotide
gcagcgcgtctcgttgccaaggatg

SEQ ID NO: 169769 - DNA, 26 bp, Artificial Sequence
  Description of Artificial Sequence: Synthetic oligonucleotide
cagcgcgtctcgttgccaaggatggt

SEQ ID NO: 169770 - DNA, 27 bp, Artificial Sequence
  Description of Artificial Sequence: Synthetic oligonucleotide
agcgcgtctcgttgccaaggatggtct

SEQ ID NO: 169771 - DNA, 27 bp, Artificial Sequence
  Description of Artificial Sequence: Synthetic oligonucleotide
gcgcgtctcgttgccaaggatggtcta

SEQ ID NO: 169772 - DNA, 27 bp, Artificial Sequence
  Description of Artificial Sequence: Synthetic oligonucleotide
cgcgtctcgttgccaaggatggtctac

SEQ ID NO: 169773 - DNA, 27 bp, Artificial Sequence
  Description of Artificial Sequence: Synthetic oligonucleotide
gcgtctcgttgccaaggatggtctacc

SEQ ID NO: 169774 - DNA, 27 bp, Artificial Sequence
  Description of Artificial Sequence: Synthetic oligonucleotide
cgtctcgttgccaaggatggtctaccc

SEQ ID NO: 169775 - DNA, 27 bp, Artificial Sequence
  Description of Artificial Sequence: Synthetic oligonucleotide
gtctcgttgccaaggatggtctacccc

SEQ ID NO: 169776 - DNA, 27 bp, Artificial Sequence
  Description of Artificial Sequence: Synthetic oligonucleotide
tctcgttgccaaggatggtctaccccc

SEQ ID NO: 169777 - DNA, 27 bp, Artificial Sequence
  Description of Artificial Sequence: Synthetic oligonucleotide
ctcgttgccaaggatggtctaccccca

SEQ ID NO: 169778 - DNA, 27 bp, Artificial Sequence
  Description of Artificial Sequence: Synthetic oligonucleotide
tcgttgccaaggatggtctacccccag

SEQ ID NO: 169779 - DNA, 26 bp, Artificial Sequence
  Description of Artificial Sequence: Synthetic oligonucleotide
cgttgccaaggatggtctacccccag

SEQ ID NO: 169780 - DNA, 26 bp, Artificial Sequence
  Description of Artificial Sequence: Synthetic oligonucleotide
gttgccaaggatggtctacccccagc

SEQ ID NO: 169781 - DNA, 27 bp, Artificial Sequence
  Description of Artificial Sequence: Synthetic oligonucleotide
ttgccaaggatggtctacccccagcca

SEQ ID NO: 169782 - DNA, 27 bp, Artificial Sequence
  Description of Artificial Sequence: Synthetic oligonucleotide
tgccaaggatggtctacccccagccaa

SEQ ID NO: 169783 - DNA, 27 bp, Artificial Sequence
  Description of Artificial Sequence: Synthetic oligonucleotide
gccaaggatggtctacccccagccaaa

SEQ ID NO: 169784 - DNA, 27 bp, Artificial Sequence
  Description of Artificial Sequence: Synthetic oligonucleotide
ccaaggatggtctacccccagccaaag

SEQ ID NO: 169785 - DNA, 27 bp, Artificial Sequence
  Description of Artificial Sequence: Synthetic oligonucleotide
caaggatggtctacccccagccaaagg

SEQ ID NO: 169786 - DNA, 28 bp, Artificial Sequence
  Description of Artificial Sequence: Synthetic oligonucleotide
aaggatggtctacccccagccaaaggtg

SEQ ID NO: 169787 - DNA, 27 bp, Artificial Sequence
  Description of Artificial Sequence: Synthetic oligonucleotide
aggatggtctacccccagccaaaggtg

SEQ ID NO: 169788 - DNA, 26 bp, Artificial Sequence
  Description of Artificial Sequence: Synthetic oligonucleotide
ggatggtctacccccagccaaaggtg

SEQ ID NO: 169789 - DNA, 27 bp, Artificial Sequence
  Description of Artificial Sequence: Synthetic oligonucleotide
gatggtctacccccagccaaaggtgct

SEQ ID NO: 169790 - DNA, 27 bp, Artificial Sequence
  Description of Artificial Sequence: Synthetic oligonucleotide
atggtctacccccagccaaaggtgctg

SEQ ID NO: 169791 - DNA, 27 bp, Artificial Sequence
  Description of Artificial Sequence: Synthetic oligonucleotide
tggtctacccccagccaaaggtgctga

SEQ ID NO: 169792 - DNA, 26 bp, Artificial Sequence
  Description of Artificial Sequence: Synthetic oligonucleotide
ggtctacccccagccaaaggtgctga

SEQ ID NO: 169793 - DNA, 27 bp, Artificial Sequence
  Description of Artificial Sequence: Synthetic oligonucleotide
gtctacccccagccaaaggtgctgaca

SEQ ID NO: 169794 - DNA, 27 bp, Artificial Sequence
  Description of Artificial Sequence: Synthetic oligonucleotide
tctacccccagccaaaggtgctgacac

SEQ ID NO: 169795 - DNA, 26 bp, Artificial Sequence
  Description of Artificial Sequence: Synthetic oligonucleotide
ctacccccagccaaaggtgctgacac

SEQ ID NO: 169796 - DNA, 26 bp, Artificial Sequence
  Description of Artificial Sequence: Synthetic oligonucleotide
tacccccagccaaaggtgctgacacc

SEQ ID NO: 169797 - DNA, 25 bp, Artificial Sequence
  Description of Artificial Sequence: Synthetic oligonucleotide
acccccagccaaaggtgctgacacc

SEQ ID NO: 169798 - DNA, 24 bp, Artificial Sequence
  Description of Artificial Sequence: Synthetic oligonucleotide
cccccagccaaaggtgctgacacc

SEQ ID NO: 169799 - DNA, 25 bp, Artificial Sequence
  Description of Artificial Sequence: Synthetic oligonucleotide
ccccagccaaaggtgctgacaccgt

SEQ ID NO: 169800 - DNA, 27 bp, Artificial Sequence
  Description of Artificial Sequence: Synthetic oligonucleotide
cccagccaaaggtgctgacaccgtgta

SEQ ID NO: 169801 - DNA, 27 bp, Artificial Sequence
  Description of Artificial Sequence: Synthetic oligonucleotide
ccagccaaaggtgctgacaccgtgtag

SEQ ID NO: 169802 - DNA, 27 bp, Artificial Sequence
  Description of Artificial Sequence: Synthetic oligonucleotide
cagccaaaggtgctgacaccgtgtagg

SEQ ID NO: 169803 - DNA, 29 bp, Artificial Sequence
  Description of Artificial Sequence: Synthetic oligonucleotide
agccaaaggtgctgacaccgtgtaggaag

SEQ ID NO: 169804 - DNA, 28 bp, Artificial Sequence
  Description of Artificial Sequence: Synthetic oligonucleotide
gccaaaggtgctgacaccgtgtaggaag

SEQ ID NO: 169805 - DNA, 28 bp, Artificial Sequence
  Description of Artificial Sequence: Synthetic oligonucleotide
ccaaaggtgctgacaccgtgtaggaagg

SEQ ID NO: 169806 - DNA, 30 bp, Artificial Sequence
  Description of Artificial Sequence: Synthetic oligonucleotide
caaaggtgctgacaccgtgtaggaaggatg

SEQ ID NO: 169807 - DNA, 31 bp, Artificial Sequence
  Description of Artificial Sequence: Synthetic oligonucleotide
aaaggtgctgacaccgtgtaggaaggatgtc

SEQ ID NO: 169808 - DNA, 30 bp, Artificial Sequence
  Description of Artificial Sequence: Synthetic oligonucleotide
aaggtgctgacaccgtgtaggaaggatgtc

SEQ ID NO: 169809 - DNA, 29 bp, Artificial Sequence
  Description of Artificial Sequence: Synthetic oligonucleotide
aggtgctgacaccgtgtaggaaggatgtc

SEQ ID NO: 169810 - DNA, 28 bp, Artificial Sequence
  Description of Artificial Sequence: Synthetic oligonucleotide
ggtgctgacaccgtgtaggaaggatgtc

SEQ ID NO: 169811 - DNA, 28 bp, Artificial Sequence
  Description of Artificial Sequence: Synthetic oligonucleotide
gtgctgacaccgtgtaggaaggatgtcc

SEQ ID NO: 169812 - DNA, 29 bp, Artificial Sequence
  Description of Artificial Sequence: Synthetic oligonucleotide
tgctgacaccgtgtaggaaggatgtcctc

SEQ ID NO: 169813 - DNA, 28 bp, Artificial Sequence
  Description of Artificial Sequence: Synthetic oligonucleotide
gctgacaccgtgtaggaaggatgtcctc

SEQ ID NO: 169814 - DNA, 28 bp, Artificial Sequence
  Description of Artificial Sequence: Synthetic oligonucleotide
ctgacaccgtgtaggaaggatgtcctcg

SEQ ID NO: 169815 - DNA, 29 bp, Artificial Sequence
  Description of Artificial Sequence: Synthetic oligonucleotide
tgacaccgtgtaggaaggatgtcctcgtg

SEQ ID NO: 169816 - DNA, 28 bp, Artificial Sequence
  Description of Artificial Sequence: Synthetic oligonucleotide
gacaccgtgtaggaaggatgtcctcgtg

SEQ ID NO: 169817 - DNA, 28 bp, Artificial Sequence
  Description of Artificial Sequence: Synthetic oligonucleotide
acaccgtgtaggaaggatgtcctcgtgg

SEQ ID NO: 169818 - DNA, 27 bp, Artificial Sequence
  Description of Artificial Sequence: Synthetic oligonucleotide
caccgtgtaggaaggatgtcctcgtgg

SEQ ID NO: 169819 - DNA, 28 bp, Artificial Sequence
  Description of Artificial Sequence: Synthetic oligonucleotide
accgtgtaggaaggatgtcctcgtggtg

SEQ ID NO: 169820 - DNA, 27 bp, Artificial Sequence
  Description of Artificial Sequence: Synthetic oligonucleotide
ccgtgtaggaaggatgtcctcgtggtg

SEQ ID NO: 169821 - DNA, 28 bp, Artificial Sequence
  Description of Artificial Sequence: Synthetic oligonucleotide
cgtgtaggaaggatgtcctcgtggtgac

SEQ ID NO: 169822 - DNA, 28 bp, Artificial Sequence
  Description of Artificial Sequence: Synthetic oligonucleotide
gtgtaggaaggatgtcctcgtggtgacc

SEQ ID NO: 169823 - DNA, 28 bp, Artificial Sequence
  Description of Artificial Sequence: Synthetic oligonucleotide
tgtaggaaggatgtcctcgtggtgaccc

SEQ ID NO: 169824 - DNA, 27 bp, Artificial Sequence
  Description of Artificial Sequence: Synthetic oligonucleotide
gtaggaaggatgtcctcgtggtgaccc

SEQ ID NO: 169825 - DNA, 27 bp, Artificial Sequence
  Description of Artificial Sequence: Synthetic oligonucleotide
taggaaggatgtcctcgtggtgacccc

SEQ ID NO: 169826 - DNA, 27 bp, Artificial Sequence
  Description of Artificial Sequence: Synthetic oligonucleotide
aggaaggatgtcctcgtggtgacccct

SEQ ID NO: 169827 - DNA, 27 bp, Artificial Sequence
  Description of Artificial Sequence: Synthetic oligonucleotide
ggaaggatgtcctcgtggtgacccctt

SEQ ID NO: 169828 - DNA, 27 bp, Artificial Sequence
  Description of Artificial Sequence: Synthetic oligonucleotide
gaaggatgtcctcgtggtgaccccttg

SEQ ID NO: 169829 - DNA, 27 bp, Artificial Sequence
  Description of Artificial Sequence: Synthetic oligonucleotide
aaggatgtcctcgtggtgaccccttgg

SEQ ID NO: 169830 - DNA, 26 bp, Artificial Sequence
  Description of Artificial Sequence: Synthetic oligonucleotide
aggatgtcctcgtggtgaccccttgg

SEQ ID NO: 169831 - DNA, 25 bp, Artificial Sequence
  Description of Artificial Sequence: Synthetic oligonucleotide
ggatgtcctcgtggtgaccccttgg

SEQ ID NO: 169832 - DNA, 26 bp, Artificial Sequence
  Description of Artificial Sequence: Synthetic oligonucleotide
gatgtcctcgtggtgaccccttggct

SEQ ID NO: 169833 - DNA, 26 bp, Artificial Sequence
  Description of Artificial Sequence: Synthetic oligonucleotide
atgtcctcgtggtgaccccttggctg

SEQ ID NO: 169834 - DNA, 25 bp, Artificial Sequence
  Description of Artificial Sequence: Synthetic oligonucleotide
tgtcctcgtggtgaccccttggctg

SEQ ID NO: 169835 - DNA, 24 bp, Artificial Sequence
  Description of Artificial Sequence: Synthetic oligonucleotide
gtcctcgtggtgaccccttggctg

SEQ ID NO: 169836 - DNA, 24 bp, Artificial Sequence
  Description of Artificial Sequence: Synthetic oligonucleotide
tcctcgtggtgaccccttggctgg

SEQ ID NO: 169837 - DNA, 23 bp, Artificial Sequence
  Description of Artificial Sequence: Synthetic oligonucleotide
cctcgtggtgaccccttggctgg

SEQ ID NO: 169838 - DNA, 24 bp, Artificial Sequence
  Description of Artificial Sequence: Synthetic oligonucleotide
ctcgtggtgaccccttggctggct

SEQ ID NO: 169839 - DNA, 24 bp, Artificial Sequence
  Description of Artificial Sequence: Synthetic oligonucleotide
tcgtggtgaccccttggctggctc

SEQ ID NO: 169840 - DNA, 23 bp, Artificial Sequence
  Description of Artificial Sequence: Synthetic oligonucleotide
cgtggtgaccccttggctggctc

SEQ ID NO: 169841 - DNA, 23 bp, Artificial Sequence
  Description of Artificial Sequence: Synthetic oligonucleotide
gtggtgaccccttggctggctcc

SEQ ID NO: 169842 - DNA, 26 bp, Artificial Sequence
  Description of Artificial Sequence: Synthetic oligonucleotide
tggtgaccccttggctggctcccatt

SEQ ID NO: 169843 - DNA, 25 bp, Artificial Sequence
  Description of Artificial Sequence: Synthetic oligonucleotide
ggtgaccccttggctggctcccatt

SEQ ID NO: 169844 - DNA, 26 bp, Artificial Sequence
  Description of Artificial Sequence: Synthetic oligonucleotide
gtgaccccttggctggctcccattgt

SEQ ID NO: 169845 - DNA, 27 bp, Artificial Sequence
  Description of Artificial Sequence: Synthetic oligonucleotide
tgaccccttggctggctcccattgtct

SEQ ID NO: 169846 - DNA, 26 bp, Artificial Sequence
  Description of Artificial Sequence: Synthetic oligonucleotide
gaccccttggctggctcccattgtct

SEQ ID NO: 169847 - DNA, 26 bp, Artificial Sequence
  Description of Artificial Sequence: Synthetic oligonucleotide
accccttggctggctcccattgtctg

SEQ ID NO: 169848 - DNA, 25 bp, Artificial Sequence
  Description of Artificial Sequence: Synthetic oligonucleotide
ccccttggctggctcccattgtctg

SEQ ID NO: 169849 - DNA, 25 bp, Artificial Sequence
  Description of Artificial Sequence: Synthetic oligonucleotide
cccttggctggctcccattgtctgg

SEQ ID NO: 169850 - DNA, 26 bp, Artificial Sequence
  Description of Artificial Sequence: Synthetic oligonucleotide
ccttggctggctcccattgtctggga

SEQ ID NO: 169851 - DNA, 26 bp, Artificial Sequence
  Description of Artificial Sequence: Synthetic oligonucleotide
cttggctggctcccattgtctgggag

SEQ ID NO: 169852 - DNA, 26 bp, Artificial Sequence
  Description of Artificial Sequence: Synthetic oligonucleotide
ttggctggctcccattgtctgggagg

SEQ ID NO: 169853 - DNA, 25 bp, Artificial Sequence
  Description of Artificial Sequence: Synthetic oligonucleotide
tggctggctcccattgtctgggagg

SEQ ID NO: 169854 - DNA, 24 bp, Artificial Sequence
  Description of Artificial Sequence: Synthetic oligonucleotide
ggctggctcccattgtctgggagg

SEQ ID NO: 169855 - DNA, 24 bp, Artificial Sequence
  Description of Artificial Sequence: Synthetic oligonucleotide
gctggctcccattgtctgggaggg

SEQ ID NO: 169856 - DNA, 25 bp, Artificial Sequence
  Description of Artificial Sequence: Synthetic oligonucleotide
ctggctcccattgtctgggagggca

SEQ ID NO: 169857 - DNA, 27 bp, Artificial Sequence
  Description of Artificial Sequence: Synthetic oligonucleotide
tggctcccattgtctgggagggcacat

SEQ ID NO: 169858 - DNA, 27 bp, Artificial Sequence
  Description of Artificial Sequence: Synthetic oligonucleotide
ggctcccattgtctgggagggcacatt

SEQ ID NO: 169859 - DNA, 27 bp, Artificial Sequence
  Description of Artificial Sequence: Synthetic oligonucleotide
gctcccattgtctgggagggcacattc

SEQ ID NO: 169860 - DNA, 29 bp, Artificial Sequence
  Description of Artificial Sequence: Synthetic oligonucleotide
ctcccattgtctgggagggcacattcaac

SEQ ID NO: 169861 - DNA, 31 bp, Artificial Sequence
  Description of Artificial Sequence: Synthetic oligonucleotide
tcccattgtctgggagggcacattcaacatc

SEQ ID NO: 169862 - DNA, 30 bp, Artificial Sequence
  Description of Artificial Sequence: Synthetic oligonucleotide
cccattgtctgggagggcacattcaacatc

SEQ ID NO: 169863 - DNA, 30 bp, Artificial Sequence
  Description of Artificial Sequence: Synthetic oligonucleotide
ccattgtctgggagggcacattcaacatcg

SEQ ID NO: 169864 - DNA, 31 bp, Artificial Sequence
  Description of Artificial Sequence: Synthetic oligonucleotide
cattgtctgggagggcacattcaacatcgac

SEQ ID NO: 169865 - DNA, 33 bp, Artificial Sequence
  Description of Artificial Sequence: Synthetic oligonucleotide
attgtctgggagggcacattcaacatcgacatc

SEQ ID NO: 169866 - DNA, 32 bp, Artificial Sequence
  Description of Artificial Sequence: Synthetic oligonucleotide
ttgtctgggagggcacattcaacatcgacatc

SEQ ID NO: 169867 - DNA, 31 bp, Artificial Sequence
  Description of Artificial Sequence: Synthetic oligonucleotide
tgtctgggagggcacattcaacatcgacatc

SEQ ID NO: 169868 - DNA, 30 bp, Artificial Sequence
  Description of Artificial Sequence: Synthetic oligonucleotide
gtctgggagggcacattcaacatcgacatc

SEQ ID NO: 169869 - DNA, 30 bp, Artificial Sequence
  Description of Artificial Sequence: Synthetic oligonucleotide
tctgggagggcacattcaacatcgacatcc

SEQ ID NO: 169870 - DNA, 29 bp, Artificial Sequence
  Description of Artificial Sequence: Synthetic oligonucleotide
ctgggagggcacattcaacatcgacatcc

SEQ ID NO: 169871 - DNA, 30 bp, Artificial Sequence
  Description of Artificial Sequence: Synthetic oligonucleotide
tgggagggcacattcaacatcgacatcctc

SEQ ID NO: 169872 - DNA, 29 bp, Artificial Sequence
  Description of Artificial Sequence: Synthetic oligonucleotide
gggagggcacattcaacatcgacatcctc

SEQ ID NO: 169873 - DNA, 31 bp, Artificial Sequence
  Description of Artificial Sequence: Synthetic oligonucleotide
ggagggcacattcaacatcgacatcctcaac

SEQ ID NO: 169874 - DNA, 31 bp, Artificial Sequence
  Description of Artificial Sequence: Synthetic oligonucleotide
gagggcacattcaacatcgacatcctcaacg

SEQ ID NO: 169875 - DNA, 32 bp, Artificial Sequence
  Description of Artificial Sequence: Synthetic oligonucleotide
agggcacattcaacatcgacatcctcaacgag

SEQ ID NO: 169876 - DNA, 31 bp, Artificial Sequence
  Description of Artificial Sequence: Synthetic oligonucleotide
gggcacattcaacatcgacatcctcaacgag

SEQ ID NO: 169877 - DNA, 31 bp, Artificial Sequence
  Description of Artificial Sequence: Synthetic oligonucleotide
ggcacattcaacatcgacatcctcaacgagc

SEQ ID NO: 169878 - DNA, 32 bp, Artificial Sequence
  Description of Artificial Sequence: Synthetic oligonucleotide
gcacattcaacatcgacatcctcaacgagcag

SEQ ID NO: 169879 - DNA, 34 bp, Artificial Sequence
  Description of Artificial Sequence: Synthetic oligonucleotide
cacattcaacatcgacatcctcaacgagcagttc

SEQ ID NO: 169880 - DNA, 35 bp, Artificial Sequence
  Description of Artificial Sequence: Synthetic oligonucleotide
acattcaacatcgacatcctcaacgagcagttcag

SEQ ID NO: 169881 - DNA, 34 bp, Artificial Sequence
  Description of Artificial Sequence: Synthetic oligonucleotide
cattcaacatcgacatcctcaacgagcagttcag

SEQ ID NO: 169882 - DNA, 34 bp, Artificial Sequence
  Description of Artificial Sequence: Synthetic oligonucleotide
attcaacatcgacatcctcaacgagcagttcagg

SEQ ID NO: 169883 - DNA, 33 bp, Artificial Sequence
  Description of Artificial Sequence: Synthetic oligonucleotide
ttcaacatcgacatcctcaacgagcagttcagg

SEQ ID NO: 169884 - DNA, 32 bp, Artificial Sequence
  Description of Artificial Sequence: Synthetic oligonucleotide
tcaacatcgacatcctcaacgagcagttcagg

SEQ ID NO: 169885 - DNA, 31 bp, Artificial Sequence
  Description of Artificial Sequence: Synthetic oligonucleotide
caacatcgacatcctcaacgagcagttcagg

SEQ ID NO: 169886 - DNA, 31 bp, Artificial Sequence
  Description of Artificial Sequence: Synthetic oligonucleotide
aacatcgacatcctcaacgagcagttcaggc

SEQ ID NO: 169887 - DNA, 30 bp, Artificial Sequence
  Description of Artificial Sequence: Synthetic oligonucleotide
acatcgacatcctcaacgagcagttcaggc

SEQ ID NO: 169888 - DNA, 29 bp, Artificial Sequence
  Description of Artificial Sequence: Synthetic oligonucleotide
catcgacatcctcaacgagcagttcaggc

SEQ ID NO: 169889 - DNA, 30 bp, Artificial Sequence
  Description of Artificial Sequence: Synthetic oligonucleotide
atcgacatcctcaacgagcagttcaggctc

SEQ ID NO: 169890 - DNA, 29 bp, Artificial Sequence
  Description of Artificial Sequence: Synthetic oligonucleotide
tcgacatcctcaacgagcagttcaggctc

SEQ ID NO: 169891 - DNA, 28 bp, Artificial Sequence
  Description of Artificial Sequence: Synthetic oligonucleotide
cgacatcctcaacgagcagttcaggctc

SEQ ID NO: 169892 - DNA, 28 bp, Artificial Sequence
  Description of Artificial Sequence: Synthetic oligonucleotide
gacatcctcaacgagcagttcaggctcc

SEQ ID NO: 169893 - DNA, 29 bp, Artificial Sequence
  Description of Artificial Sequence: Synthetic oligonucleotide
acatcctcaacgagcagttcaggctccag

SEQ ID NO: 169894 - DNA, 28 bp, Artificial Sequence
  Description of Artificial Sequence: Synthetic oligonucleotide
catcctcaacgagcagttcaggctccag

SEQ ID NO: 169895 - DNA, 30 bp, Artificial Sequence
  Description of Artificial Sequence: Synthetic oligonucleotide
atcctcaacgagcagttcaggctccagaac

SEQ ID NO: 169896 - DNA, 29 bp, Artificial Sequence
  Description of Artificial Sequence: Synthetic oligonucleotide
tcctcaacgagcagttcaggctccagaac

SEQ ID NO: 169897 - DNA, 28 bp, Artificial Sequence
  Description of Artificial Sequence: Synthetic oligonucleotide
cctcaacgagcagttcaggctccagaac

SEQ ID NO: 169898 - DNA, 29 bp, Artificial Sequence
  Description of Artificial Sequence: Synthetic oligonucleotide
ctcaacgagcagttcaggctccagaacac

SEQ ID NO: 169899 - DNA, 29 bp, Artificial Sequence
  Description of Artificial Sequence: Synthetic oligonucleotide
tcaacgagcagttcaggctccagaacacc

SEQ ID NO: 169900 - DNA, 28 bp, Artificial Sequence
  Description of Artificial Sequence: Synthetic oligonucleotide
caacgagcagttcaggctccagaacacc

SEQ ID NO: 169901 - DNA, 29 bp, Artificial Sequence
  Description of Artificial Sequence: Synthetic oligonucleotide
aacgagcagttcaggctccagaacaccac

SEQ ID NO: 169902 - DNA, 28 bp, Artificial Sequence
  Description of Artificial Sequence: Synthetic oligonucleotide
acgagcagttcaggctccagaacaccac

SEQ ID NO: 169903 - DNA, 27 bp, Artificial Sequence
  Description of Artificial Sequence: Synthetic oligonucleotide
cgagcagttcaggctccagaacaccac

SEQ ID NO: 169904 - DNA, 27 bp, Artificial Sequence
  Description of Artificial Sequence: Synthetic oligonucleotide
gagcagttcaggctccagaacaccacc

SEQ ID NO: 169905 - DNA, 30 bp, Artificial Sequence
  Description of Artificial Sequence: Synthetic oligonucleotide
agcagttcaggctccagaacaccaccattg

SEQ ID NO: 169906 - DNA, 29 bp, Artificial Sequence
  Description of Artificial Sequence: Synthetic oligonucleotide
gcagttcaggctccagaacaccaccattg

SEQ ID NO: 169907 - DNA, 29 bp, Artificial Sequence
  Description of Artificial Sequence: Synthetic oligonucleotide
cagttcaggctccagaacaccaccattgg

SEQ ID NO: 169908 - DNA, 29 bp, Artificial Sequence
  Description of Artificial Sequence: Synthetic oligonucleotide
agttcaggctccagaacaccaccattggg

SEQ ID NO: 169909 - DNA, 28 bp, Artificial Sequence
  Description of Artificial Sequence: Synthetic oligonucleotide
gttcaggctccagaacaccaccattggg

SEQ ID NO: 169910 - DNA, 32 bp, Artificial Sequence
  Description of Artificial Sequence: Synthetic oligonucleotide
ttcaggctccagaacaccaccattgggttaac

SEQ ID NO: 169911 - DNA, 31 bp, Artificial Sequence
  Description of Artificial Sequence: Synthetic oligonucleotide
tcaggctccagaacaccaccattgggttaac

SEQ ID NO: 169912 - DNA, 30 bp, Artificial Sequence
  Description of Artificial Sequence: Synthetic oligonucleotide
caggctccagaacaccaccattgggttaac

SEQ ID NO: 169913 - DNA, 31 bp, Artificial Sequence
  Description of Artificial Sequence: Synthetic oligonucleotide
aggctccagaacaccaccattgggttaactg

SEQ ID NO: 169914 - DNA, 30 bp, Artificial Sequence
  Description of Artificial Sequence: Synthetic oligonucleotide
ggctccagaacaccaccattgggttaactg

SEQ ID NO: 169915 - DNA, 31 bp, Artificial Sequence
  Description of Artificial Sequence: Synthetic oligonucleotide
gctccagaacaccaccattgggttaactgtg

SEQ ID NO: 169916 - DNA, 34 bp, Artificial Sequence
  Description of Artificial Sequence: Synthetic oligonucleotide
ctccagaacaccaccattgggttaactgtgtttg

SEQ ID NO: 169917 - DNA, 34 bp, Artificial Sequence
  Description of Artificial Sequence: Synthetic oligonucleotide
tccagaacaccaccattgggttaactgtgtttgc

SEQ ID NO: 169918 - DNA, 33 bp, Artificial Sequence
  Description of Artificial Sequence: Synthetic oligonucleotide
ccagaacaccaccattgggttaactgtgtttgc

SEQ ID NO: 169919 - DNA, 33 bp, Artificial Sequence
  Description of Artificial Sequence: Synthetic oligonucleotide
cagaacaccaccattgggttaactgtgtttgcc

SEQ ID NO: 169920 - DNA, 35 bp, Artificial Sequence
  Description of Artificial Sequence: Synthetic oligonucleotide
agaacaccaccattgggttaactgtgtttgccatc

SEQ ID NO: 169921 - DNA, 34 bp, Artificial Sequence
  Description of Artificial Sequence: Synthetic oligonucleotide
gaacaccaccattgggttaactgtgtttgccatc

SEQ ID NO: 169922 - DNA, 36 bp, Artificial Sequence
  Description of Artificial Sequence: Synthetic oligonucleotide
aacaccaccattgggttaactgtgtttgccatcaag

SEQ ID NO: 169923 - DNA, 35 bp, Artificial Sequence
  Description of Artificial Sequence: Synthetic oligonucleotide
acaccaccattgggttaactgtgtttgccatcaag

SEQ ID NO: 169924 - DNA, 34 bp, Artificial Sequence
  Description of Artificial Sequence: Synthetic oligonucleotide
caccaccattgggttaactgtgtttgccatcaag

SEQ ID NO: 169925 - DNA, 39 bp, Artificial Sequence
  Description of Artificial Sequence: Synthetic oligonucleotide
accaccattgggttaactgtgtttgccatcaagaaatac

SEQ ID NO: 169926 - DNA, 38 bp, Artificial Sequence
  Description of Artificial Sequence: Synthetic oligonucleotide
ccaccattgggttaactgtgtttgccatcaagaaatac

SEQ ID NO: 169927 - DNA, 38 bp, Artificial Sequence
  Description of Artificial Sequence: Synthetic oligonucleotide
caccattgggttaactgtgtttgccatcaagaaatacg

SEQ ID NO: 169928 - DNA, 39 bp, Artificial Sequence
  Description of Artificial Sequence: Synthetic oligonucleotide
accattgggttaactgtgtttgccatcaagaaatacgtg

SEQ ID NO: 169929 - DNA, 38 bp, Artificial Sequence
  Description of Artificial Sequence: Synthetic oligonucleotide
ccattgggttaactgtgtttgccatcaagaaatacgtg

SEQ ID NO: 169930 - DNA, 38 bp, Artificial Sequence
  Description of Artificial Sequence: Synthetic oligonucleotide
cattgggttaactgtgtttgccatcaagaaatacgtgg

SEQ ID NO: 169931 - DNA, 38 bp, Artificial Sequence
  Description of Artificial Sequence: Synthetic oligonucleotide
attgggttaactgtgtttgccatcaagaaatacgtggc

SEQ ID NO: 169932 - DNA, 37 bp, Artificial Sequence
  Description of Artificial Sequence: Synthetic oligonucleotide
ttgggttaactgtgtttgccatcaagaaatacgtggc

SEQ ID NO: 169933 - DNA, 36 bp, Artificial Sequence
  Description of Artificial Sequence: Synthetic oligonucleotide
tgggttaactgtgtttgccatcaagaaatacgtggc

SEQ ID NO: 169934 - DNA, 35 bp, Artificial Sequence
  Description of Artificial Sequence: Synthetic oligonucleotide
gggttaactgtgtttgccatcaagaaatacgtggc

SEQ ID NO: 169935 - DNA, 38 bp, Artificial Sequence
  Description of Artificial Sequence: Synthetic oligonucleotide
ggttaactgtgtttgccatcaagaaatacgtggctttc

SEQ ID NO: 169936 - DNA, 38 bp, Artificial Sequence
  Description of Artificial Sequence: Synthetic oligonucleotide
gttaactgtgtttgccatcaagaaatacgtggctttcc

SEQ ID NO: 169937 - DNA, 39 bp, Artificial Sequence
  Description of Artificial Sequence: Synthetic oligonucleotide
ttaactgtgtttgccatcaagaaatacgtggctttcctg

SEQ ID NO: 169938 - DNA, 38 bp, Artificial Sequence
  Description of Artificial Sequence: Synthetic oligonucleotide
taactgtgtttgccatcaagaaatacgtggctttcctg

SEQ ID NO: 169939 - DNA, 37 bp, Artificial Sequence
  Description of Artificial Sequence: Synthetic oligonucleotide
aactgtgtttgccatcaagaaatacgtggctttcctg

SEQ ID NO: 169940 - DNA, 36 bp, Artificial Sequence
  Description of Artificial Sequence: Synthetic oligonucleotide
actgtgtttgccatcaagaaatacgtggctttcctg

SEQ ID NO: 169941 - DNA, 35 bp, Artificial Sequence
  Description of Artificial Sequence: Synthetic oligonucleotide
ctgtgtttgccatcaagaaatacgtggctttcctg

SEQ ID NO: 169942 - DNA, 37 bp, Artificial Sequence
  Description of Artificial Sequence: Synthetic oligonucleotide
tgtgtttgccatcaagaaatacgtggctttcctgaag

SEQ ID NO: 169943 - DNA, 36 bp, Artificial Sequence
  Description of Artificial Sequence: Synthetic oligonucleotide
gtgtttgccatcaagaaatacgtggctttcctgaag

SEQ ID NO: 169944 - DNA, 36 bp, Artificial Sequence
  Description of Artificial Sequence: Synthetic oligonucleotide
tgtttgccatcaagaaatacgtggctttcctgaagc

SEQ ID NO: 169945 - DNA, 35 bp, Artificial Sequence
  Description of Artificial Sequence: Synthetic oligonucleotide
gtttgccatcaagaaatacgtggctttcctgaagc

SEQ ID NO: 169946 - DNA, 36 bp, Artificial Sequence
  Description of Artificial Sequence: Synthetic oligonucleotide
tttgccatcaagaaatacgtggctttcctgaagctg

SEQ ID NO: 169947 - DNA, 35 bp, Artificial Sequence
  Description of Artificial Sequence: Synthetic oligonucleotide
ttgccatcaagaaatacgtggctttcctgaagctg

SEQ ID NO: 169948 - DNA, 34 bp, Artificial Sequence
  Description of Artificial Sequence: Synthetic oligonucleotide
tgccatcaagaaatacgtggctttcctgaagctg

SEQ ID NO: 169949 - DNA, 33 bp, Artificial Sequence
  Description of Artificial Sequence: Synthetic oligonucleotide
gccatcaagaaatacgtggctttcctgaagctg

SEQ ID NO: 169950 - DNA, 35 bp, Artificial Sequence
  Description of Artificial Sequence: Synthetic oligonucleotide
ccatcaagaaatacgtggctttcctgaagctgttc

SEQ ID NO: 169951 - DNA, 35 bp, Artificial Sequence
  Description of Artificial Sequence: Synthetic oligonucleotide
catcaagaaatacgtggctttcctgaagctgttcc

SEQ ID NO: 169952 - DNA, 36 bp, Artificial Sequence
  Description of Artificial Sequence: Synthetic oligonucleotide
atcaagaaatacgtggctttcctgaagctgttcctg

SEQ ID NO: 169953 - DNA, 35 bp, Artificial Sequence
  Description of Artificial Sequence: Synthetic oligonucleotide
tcaagaaatacgtggctttcctgaagctgttcctg

SEQ ID NO: 169954 - DNA, 34 bp, Artificial Sequence
  Description of Artificial Sequence: Synthetic oligonucleotide
caagaaatacgtggctttcctgaagctgttcctg

SEQ ID NO: 169955 - DNA, 34 bp, Artificial Sequence
  Description of Artificial Sequence: Synthetic oligonucleotide
aagaaatacgtggctttcctgaagctgttcctgg

SEQ ID NO: 169956 - DNA, 33 bp, Artificial Sequence
  Description of Artificial Sequence: Synthetic oligonucleotide
agaaatacgtggctttcctgaagctgttcctgg

SEQ ID NO: 169957 - DNA, 32 bp, Artificial Sequence
  Description of Artificial Sequence: Synthetic oligonucleotide
gaaatacgtggctttcctgaagctgttcctgg

SEQ ID NO: 169958 - DNA, 33 bp, Artificial Sequence
  Description of Artificial Sequence: Synthetic oligonucleotide
aaatacgtggctttcctgaagctgttcctggag

SEQ ID NO: 169959 - DNA, 32 bp, Artificial Sequence
  Description of Artificial Sequence: Synthetic oligonucleotide
aatacgtggctttcctgaagctgttcctggag

SEQ ID NO: 169960 - DNA, 31 bp, Artificial Sequence
  Description of Artificial Sequence: Synthetic oligonucleotide
atacgtggctttcctgaagctgttcctggag

SEQ ID NO: 169961 - DNA, 30 bp, Artificial Sequence
  Description of Artificial Sequence: Synthetic oligonucleotide
tacgtggctttcctgaagctgttcctggag

SEQ ID NO: 169962 - DNA, 29 bp, Artificial Sequence
  Description of Artificial Sequence: Synthetic oligonucleotide
acgtggctttcctgaagctgttcctggag

SEQ ID NO: 169963 - DNA, 28 bp, Artificial Sequence
  Description of Artificial Sequence: Synthetic oligonucleotide
cgtggctttcctgaagctgttcctggag

SEQ ID NO: 169964 - DNA, 29 bp, Artificial Sequence
  Description of Artificial Sequence: Synthetic oligonucleotide
gtggctttcctgaagctgttcctggagac

SEQ ID NO: 169965 - DNA, 29 bp, Artificial Sequence
  Description of Artificial Sequence: Synthetic oligonucleotide
tggctttcctgaagctgttcctggagacg

SEQ ID NO: 169966 - DNA, 28 bp, Artificial Sequence
  Description of Artificial Sequence: Synthetic oligonucleotide
ggctttcctgaagctgttcctggagacg

SEQ ID NO: 169967 - DNA, 28 bp, Artificial Sequence
  Description of Artificial Sequence: Synthetic oligonucleotide
gctttcctgaagctgttcctggagacgg

SEQ ID NO: 169968 - DNA, 28 bp, Artificial Sequence
  Description of Artificial Sequence: Synthetic oligonucleotide
ctttcctgaagctgttcctggagacggc

SEQ ID NO: 169969 - DNA, 28 bp, Artificial Sequence
  Description of Artificial Sequence: Synthetic oligonucleotide
tttcctgaagctgttcctggagacggcg

SEQ ID NO: 169970 - DNA, 27 bp, Artificial Sequence
  Description of Artificial Sequence: Synthetic oligonucleotide
ttcctgaagctgttcctggagacggcg

SEQ ID NO: 169971 - DNA, 26 bp, Artificial Sequence
  Description of Artificial Sequence: Synthetic oligonucleotide
tcctgaagctgttcctggagacggcg

SEQ ID NO: 169972 - DNA, 25 bp, Artificial Sequence
  Description of Artificial Sequence: Synthetic oligonucleotide
cctgaagctgttcctggagacggcg

SEQ ID NO: 169973 - DNA, 26 bp, Artificial Sequence
  Description of Artificial Sequence: Synthetic oligonucleotide
ctgaagctgttcctggagacggcgga

SEQ ID NO: 169974 - DNA, 27 bp, Artificial Sequence
  Description of Artificial Sequence: Synthetic oligonucleotide
tgaagctgttcctggagacggcggaga

SEQ ID NO: 169975 - DNA, 27 bp, Artificial Sequence
  Description of Artificial Sequence: Synthetic oligonucleotide
gaagctgttcctggagacggcggagaa

SEQ ID NO: 169976 - DNA, 27 bp, Artificial Sequence
  Description of Artificial Sequence: Synthetic oligonucleotide
aagctgttcctggagacggcggagaag

SEQ ID NO: 169977 - DNA, 26 bp, Artificial Sequence
  Description of Artificial Sequence: Synthetic oligonucleotide
agctgttcctggagacggcggagaag

SEQ ID NO: 169978 - DNA, 25 bp, Artificial Sequence
  Description of Artificial Sequence: Synthetic oligonucleotide
gctgttcctggagacggcggagaag

SEQ ID NO: 169979 - DNA, 26 bp, Artificial Sequence
  Description of Artificial Sequence: Synthetic oligonucleotide
ctgttcctggagacggcggagaagca

SEQ ID NO: 169980 - DNA, 27 bp, Artificial Sequence
  Description of Artificial Sequence: Synthetic oligonucleotide
tgttcctggagacggcggagaagcact

SEQ ID NO: 169981 - DNA, 27 bp, Artificial Sequence
  Description of Artificial Sequence: Synthetic oligonucleotide
gttcctggagacggcggagaagcactt

SEQ ID NO: 169982 - DNA, 27 bp, Artificial Sequence
  Description of Artificial Sequence: Synthetic oligonucleotide
ttcctggagacggcggagaagcacttc

SEQ ID NO: 169983 - DNA, 27 bp, Artificial Sequence
  Description of Artificial Sequence: Synthetic oligonucleotide
tcctggagacggcggagaagcacttca

SEQ ID NO: 169984 - DNA, 27 bp, Artificial Sequence
  Description of Artificial Sequence: Synthetic oligonucleotide
cctggagacggcggagaagcacttcat

SEQ ID NO: 169985 - DNA, 27 bp, Artificial Sequence
  Description of Artificial Sequence: Synthetic oligonucleotide
ctggagacggcggagaagcacttcatg

SEQ ID NO: 169986 - DNA, 27 bp, Artificial Sequence
  Description of Artificial Sequence: Synthetic oligonucleotide
tggagacggcggagaagcacttcatgg

SEQ ID NO: 169987 - DNA, 27 bp, Artificial Sequence
  Description of Artificial Sequence: Synthetic oligonucleotide
ggagacggcggagaagcacttcatggt

SEQ ID NO: 169988 - DNA, 27 bp, Artificial Sequence
  Description of Artificial Sequence: Synthetic oligonucleotide
gagacggcggagaagcacttcatggtg

SEQ ID NO: 169989 - DNA, 27 bp, Artificial Sequence
  Description of Artificial Sequence: Synthetic oligonucleotide
agacggcggagaagcacttcatggtgg

SEQ ID NO: 169990 - DNA, 26 bp, Artificial Sequence
  Description of Artificial Sequence: Synthetic oligonucleotide
gacggcggagaagcacttcatggtgg

SEQ ID NO: 169991 - DNA, 26 bp, Artificial Sequence
  Description of Artificial Sequence: Synthetic oligonucleotide
acggcggagaagcacttcatggtggg

SEQ ID NO: 169992 - DNA, 25 bp, Artificial Sequence
  Description of Artificial Sequence: Synthetic oligonucleotide
cggcggagaagcacttcatggtggg

SEQ ID NO: 169993 - DNA, 25 bp, Artificial Sequence
  Description of Artificial Sequence: Synthetic oligonucleotide
ggcggagaagcacttcatggtgggc

SEQ ID NO: 169994 - DNA, 26 bp, Artificial Sequence
  Description of Artificial Sequence: Synthetic oligonucleotide
gcggagaagcacttcatggtgggcca

SEQ ID NO: 169995 - DNA, 26 bp, Artificial Sequence
  Description of Artificial Sequence: Synthetic oligonucleotide
cggagaagcacttcatggtgggccac

SEQ ID NO: 169996 - DNA, 26 bp, Artificial Sequence
  Description of Artificial Sequence: Synthetic oligonucleotide
ggagaagcacttcatggtgggccacc

SEQ ID NO: 169997 - DNA, 27 bp, Artificial Sequence
  Description of Artificial Sequence: Synthetic oligonucleotide
gagaagcacttcatggtgggccaccgt

SEQ ID NO: 169998 - DNA, 27 bp, Artificial Sequence
  Description of Artificial Sequence: Synthetic oligonucleotide
agaagcacttcatggtgggccaccgtg

SEQ ID NO: 169999 - DNA, 27 bp, Artificial Sequence
  Description of Artificial Sequence: Synthetic oligonucleotide
gaagcacttcatggtgggccaccgtgt

SEQ ID NO: 170000 - DNA, 27 bp, Artificial Sequence
  Description of Artificial Sequence: Synthetic oligonucleotide
aagcacttcatggtgggccaccgtgtc

SEQ ID NO: 170001 - DNA, 26 bp, Artificial Sequence
  Description of Artificial Sequence: Synthetic oligonucleotide
agcacttcatggtgggccaccgtgtc

SEQ ID NO: 170002 - DNA, 25 bp, Artificial Sequence
  Description of Artificial Sequence: Synthetic oligonucleotide
gcacttcatggtgggccaccgtgtc

SEQ ID NO: 170003 - DNA, 26 bp, Artificial Sequence
  Description of Artificial Sequence: Synthetic oligonucleotide
cacttcatggtgggccaccgtgtcca

SEQ ID NO: 170004 - DNA, 27 bp, Artificial Sequence
  Description of Artificial Sequence: Synthetic oligonucleotide
acttcatggtgggccaccgtgtccact

SEQ ID NO: 170005 - DNA, 27 bp, Artificial Sequence
  Description of Artificial Sequence: Synthetic oligonucleotide
cttcatggtgggccaccgtgtccacta

SEQ ID NO: 170006 - DNA, 27 bp, Artificial Sequence
  Description of Artificial Sequence: Synthetic oligonucleotide
ttcatggtgggccaccgtgtccactac

SEQ ID NO: 170007 - DNA, 27 bp, Artificial Sequence
  Description of Artificial Sequence: Synthetic oligonucleotide
tcatggtgggccaccgtgtccactact

SEQ ID NO: 170008 - DNA, 27 bp, Artificial Sequence
  Description of Artificial Sequence: Synthetic oligonucleotide
catggtgggccaccgtgtccactacta

SEQ ID NO: 170009 - DNA, 28 bp, Artificial Sequence
  Description of Artificial Sequence: Synthetic oligonucleotide
atggtgggccaccgtgtccactactatg

SEQ ID NO: 170010 - DNA, 27 bp, Artificial Sequence
  Description of Artificial Sequence: Synthetic oligonucleotide
tggtgggccaccgtgtccactactatg

SEQ ID NO: 170011 - DNA, 27 bp, Artificial Sequence
  Description of Artificial Sequence: Synthetic oligonucleotide
ggtgggccaccgtgtccactactatgt

SEQ ID NO: 170012 - DNA, 27 bp, Artificial Sequence
  Description of Artificial Sequence: Synthetic oligonucleotide
gtgggccaccgtgtccactactatgtc

SEQ ID NO: 170013 - DNA, 29 bp, Artificial Sequence
  Description of Artificial Sequence: Synthetic oligonucleotide
tgggccaccgtgtccactactatgtcttc

SEQ ID NO: 170014 - DNA, 28 bp, Artificial Sequence
  Description of Artificial Sequence: Synthetic oligonucleotide
gggccaccgtgtccactactatgtcttc

SEQ ID NO: 170015 - DNA, 29 bp, Artificial Sequence
  Description of Artificial Sequence: Synthetic oligonucleotide
ggccaccgtgtccactactatgtcttcac

SEQ ID NO: 170016 - DNA, 29 bp, Artificial Sequence
  Description of Artificial Sequence: Synthetic oligonucleotide
gccaccgtgtccactactatgtcttcacc

SEQ ID NO: 170017 - DNA, 29 bp, Artificial Sequence
  Description of Artificial Sequence: Synthetic oligonucleotide
ccaccgtgtccactactatgtcttcaccg

SEQ ID NO: 170018 - DNA, 30 bp, Artificial Sequence
  Description of Artificial Sequence: Synthetic oligonucleotide
caccgtgtccactactatgtcttcaccgac

SEQ ID NO: 170019 - DNA, 30 bp, Artificial Sequence
  Description of Artificial Sequence: Synthetic oligonucleotide
accgtgtccactactatgtcttcaccgacc

SEQ ID NO: 170020 - DNA, 29 bp, Artificial Sequence
  Description of Artificial Sequence: Synthetic oligonucleotide
ccgtgtccactactatgtcttcaccgacc

SEQ ID NO: 170021 - DNA, 30 bp, Artificial Sequence
  Description of Artificial Sequence: Synthetic oligonucleotide
cgtgtccactactatgtcttcaccgaccag

SEQ ID NO: 170022 - DNA, 30 bp, Artificial Sequence
  Description of Artificial Sequence: Synthetic oligonucleotide
gtgtccactactatgtcttcaccgaccagc

SEQ ID NO: 170023 - DNA, 30 bp, Artificial Sequence
  Description of Artificial Sequence: Synthetic oligonucleotide
tgtccactactatgtcttcaccgaccagcc

SEQ ID NO: 170024 - DNA, 29 bp, Artificial Sequence
  Description of Artificial Sequence: Synthetic oligonucleotide
gtccactactatgtcttcaccgaccagcc

SEQ ID NO: 170025 - DNA, 29 bp, Artificial Sequence
  Description of Artificial Sequence: Synthetic oligonucleotide
tccactactatgtcttcaccgaccagccg

SEQ ID NO: 170026 - DNA, 28 bp, Artificial Sequence
  Description of Artificial Sequence: Synthetic oligonucleotide
ccactactatgtcttcaccgaccagccg

SEQ ID NO: 170027 - DNA, 28 bp, Artificial Sequence
  Description of Artificial Sequence: Synthetic oligonucleotide
cactactatgtcttcaccgaccagccgg

SEQ ID NO: 170028 - DNA, 28 bp, Artificial Sequence
  Description of Artificial Sequence: Synthetic oligonucleotide
actactatgtcttcaccgaccagccggc

SEQ ID NO: 170029 - DNA, 27 bp, Artificial Sequence
  Description of Artificial Sequence: Synthetic oligonucleotide
ctactatgtcttcaccgaccagccggc

SEQ ID NO: 170030 - DNA, 27 bp, Artificial Sequence
  Description of Artificial Sequence: Synthetic oligonucleotide
tactatgtcttcaccgaccagccggcc

SEQ ID NO: 170031 - DNA, 26 bp, Artificial Sequence
  Description of Artificial Sequence: Synthetic oligonucleotide
actatgtcttcaccgaccagccggcc

SEQ ID NO: 170032 - DNA, 25 bp, Artificial Sequence
  Description of Artificial Sequence: Synthetic oligonucleotide
ctatgtcttcaccgaccagccggcc

SEQ ID NO: 170033 - DNA, 25 bp, Artificial Sequence
  Description of Artificial Sequence: Synthetic oligonucleotide
tatgtcttcaccgaccagccggccg

SEQ ID NO: 170034 - DNA, 24 bp, Artificial Sequence
  Description of Artificial Sequence: Synthetic oligonucleotide
atgtcttcaccgaccagccggccg

SEQ ID NO: 170035 - DNA, 23 bp, Artificial Sequence
  Description of Artificial Sequence: Synthetic oligonucleotide
tgtcttcaccgaccagccggccg

SEQ ID NO: 170036 - DNA, 22 bp, Artificial Sequence
  Description of Artificial Sequence: Synthetic oligonucleotide
gtcttcaccgaccagccggccg

SEQ ID NO: 170037 - DNA, 22 bp, Artificial Sequence
  Description of Artificial Sequence: Synthetic oligonucleotide
tcttcaccgaccagccggccgc

SEQ ID NO: 170038 - DNA, 21 bp, Artificial Sequence
  Description of Artificial Sequence: Synthetic oligonucleotide
cttcaccgaccagccggccgc

SEQ ID NO: 170039 - DNA, 21 bp, Artificial Sequence
  Description of Artificial Sequence: Synthetic oligonucleotide
ttcaccgaccagccggccgcg

SEQ ID NO: 170040 - DNA, 20 bp, Artificial Sequence
  Description of Artificial Sequence: Synthetic oligonucleotide
tcaccgaccagccggccgcg

SEQ ID NO: 170041 - DNA, 20 bp, Artificial Sequence
  Description of Artificial Sequence: Synthetic oligonucleotide
caccgaccagccggccgcgt

SEQ ID NO: 170042 - DNA, 20 bp, Artificial Sequence
  Description of Artificial Sequence: Synthetic oligonucleotide
accgaccagccggccgcggt

SEQ ID NO: 170043 - DNA, 20 bp, Artificial Sequence
  Description of Artificial Sequence: Synthetic oligonucleotide
ccgaccagccggccgcggtt

SEQ ID NO: 170044 - DNA, 20 bp, Artificial Sequence
  Description of Artificial Sequence: Synthetic oligonucleotide
cgaccagccggccgcggtgt

SEQ ID NO: 170045 - DNA, 20 bp, Artificial Sequence
  Description of Artificial Sequence: Synthetic oligonucleotide
gaccagccggccgcggtgct

SEQ ID NO: 170046 - DNA, 20 bp, Artificial Sequence
  Description of Artificial Sequence: Synthetic oligonucleotide
accagccggccgcggtgcct

SEQ ID NO: 170047 - DNA, 20 bp, Artificial Sequence
  Description of Artificial Sequence: Synthetic oligonucleotide
ccagccggccgcggtgcctt

SEQ ID NO: 170048 - DNA, 20 bp, Artificial Sequence
  Description of Artificial Sequence: Synthetic oligonucleotide
cagccggccgcggtgccctt

SEQ ID NO: 170049 - DNA, 20 bp, Artificial Sequence
  Description of Artificial Sequence: Synthetic oligonucleotide
agccggccgcggtgcccctt

SEQ ID NO: 170050 - DNA, 20 bp, Artificial Sequence
  Description of Artificial Sequence: Synthetic oligonucleotide
gccggccgcggtgccccttt

SEQ ID NO: 170051 - DNA, 20 bp, Artificial Sequence
  Description of Artificial Sequence: Synthetic oligonucleotide
ccggccgcggtgccccgttt

SEQ ID NO: 170052 - DNA, 20 bp, Artificial Sequence
  Description of Artificial Sequence: Synthetic oligonucleotide
cggccgcggtgccccgcttt

SEQ ID NO: 170053 - DNA, 20 bp, Artificial Sequence
  Description of Artificial Sequence: Synthetic oligonucleotide
ggccgcggtgccccgcgttt

SEQ ID NO: 170054 - DNA, 20 bp, Artificial Sequence
  Description of Artificial Sequence: Synthetic oligonucleotide
gccgcggtgccccgcgtgat

SEQ ID NO: 170055 - DNA, 20 bp, Artificial Sequence
  Description of Artificial Sequence: Synthetic oligonucleotide
ccgcggtgccccgcgtgact

SEQ ID NO: 170056 - DNA, 20 bp, Artificial Sequence
  Description of Artificial Sequence: Synthetic oligonucleotide
cgcggtgccccgcgtgacgt

SEQ ID NO: 170057 - DNA, 20 bp, Artificial Sequence
  Description of Artificial Sequence: Synthetic oligonucleotide
gcggtgccccgcgtgacgct

SEQ ID NO: 170058 - DNA, 20 bp, Artificial Sequence
  Description of Artificial Sequence: Synthetic oligonucleotide
cggtgccccgcgtgacgctg

SEQ ID NO: 170059 - DNA, 20 bp, Artificial Sequence
  Description of Artificial Sequence: Synthetic oligonucleotide
ggtgccccgcgtgacgctgg

SEQ ID NO: 170060 - DNA, 20 bp, Artificial Sequence
  Description of Artificial Sequence: Synthetic oligonucleotide
gtgccccgcgtgacgctggg

SEQ ID NO: 170061 - DNA, 21 bp, Artificial Sequence
  Description of Artificial Sequence: Synthetic oligonucleotide
tgccccgcgtgacgctgggga

SEQ ID NO: 170062 - DNA, 20 bp, Artificial Sequence
  Description of Artificial Sequence: Synthetic oligonucleotide
gccccgcgtgacgctgggga

SEQ ID NO: 170063 - DNA, 20 bp, Artificial Sequence
  Description of Artificial Sequence: Synthetic oligonucleotide
ccccgcgtgacgctggggac

SEQ ID NO: 170064 - DNA, 20 bp, Artificial Sequence
  Description of Artificial Sequence: Synthetic oligonucleotide
cccgcgtgacgctggggacc

SEQ ID NO: 170065 - DNA, 20 bp, Artificial Sequence
  Description of Artificial Sequence: Synthetic oligonucleotide
ccgcgtgacgctggggaccg

SEQ ID NO: 170066 - DNA, 21 bp, Artificial Sequence
  Description of Artificial Sequence: Synthetic oligonucleotide
cgcgtgacgctggggaccggt

SEQ ID NO: 170067 - DNA, 21 bp, Artificial Sequence
  Description of Artificial Sequence: Synthetic oligonucleotide
gcgtgacgctggggaccggtc

SEQ ID NO: 170068 - DNA, 21 bp, Artificial Sequence
  Description of Artificial Sequence: Synthetic oligonucleotide
cgtgacgctggggaccggtcg

SEQ ID NO: 170069 - DNA, 21 bp, Artificial Sequence
  Description of Artificial Sequence: Synthetic oligonucleotide
gtgacgctggggaccggtcgg

SEQ ID NO: 170070 - DNA, 22 bp, Artificial Sequence
  Description of Artificial Sequence: Synthetic oligonucleotide
tgacgctggggaccggtcggca

SEQ ID NO: 170071 - DNA, 21 bp, Artificial Sequence
  Description of Artificial Sequence: Synthetic oligonucleotide
gacgctggggaccggtcggca

SEQ ID NO: 170072 - DNA, 21 bp, Artificial Sequence
  Description of Artificial Sequence: Synthetic oligonucleotide
acgctggggaccggtcggcag

SEQ ID NO: 170073 - DNA, 20 bp, Artificial Sequence
  Description of Artificial Sequence: Synthetic oligonucleotide
cgctggggaccggtcggcag

SEQ ID NO: 170074 - DNA, 21 bp, Artificial Sequence
  Description of Artificial Sequence: Synthetic oligonucleotide
gctggggaccggtcggcagct

SEQ ID NO: 170075 - DNA, 22 bp, Artificial Sequence
  Description of Artificial Sequence: Synthetic oligonucleotide
ctggggaccggtcggcagctgt

SEQ ID NO: 170076 - DNA, 23 bp, Artificial Sequence
  Description of Artificial Sequence: Synthetic oligonucleotide
tggggaccggtcggcagctgtca

SEQ ID NO: 170077 - DNA, 22 bp, Artificial Sequence
  Description of Artificial Sequence: Synthetic oligonucleotide
ggggaccggtcggcagctgtca

SEQ ID NO: 170078 - DNA, 23 bp, Artificial Sequence
  Description of Artificial Sequence: Synthetic oligonucleotide
gggaccggtcggcagctgtcagt

SEQ ID NO: 170079 - DNA, 23 bp, Artificial Sequence
  Description of Artificial Sequence: Synthetic oligonucleotide
ggaccggtcggcagctgtcagtg

SEQ ID NO: 170080 - DNA, 24 bp, Artificial Sequence
  Description of Artificial Sequence: Synthetic oligonucleotide
gaccggtcggcagctgtcagtgct

SEQ ID NO: 170081 - DNA, 24 bp, Artificial Sequence
  Description of Artificial Sequence: Synthetic oligonucleotide
accggtcggcagctgtcagtgctg

SEQ ID NO: 170082 - DNA, 23 bp, Artificial Sequence
  Description of Artificial Sequence: Synthetic oligonucleotide
ccggtcggcagctgtcagtgctg

SEQ ID NO: 170083 - DNA, 24 bp, Artificial Sequence
  Description of Artificial Sequence: Synthetic oligonucleotide
cggtcggcagctgtcagtgctgga

SEQ ID NO: 170084 - DNA, 24 bp, Artificial Sequence
  Description of Artificial Sequence: Synthetic oligonucleotide
ggtcggcagctgtcagtgctggag

SEQ ID NO: 170085 - DNA, 25 bp, Artificial Sequence
  Description of Artificial Sequence: Synthetic oligonucleotide
gtcggcagctgtcagtgctggaggt

SEQ ID NO: 170086 - DNA, 25 bp, Artificial Sequence
  Description of Artificial Sequence: Synthetic oligonucleotide
tcggcagctgtcagtgctggaggtg

SEQ ID NO: 170087 - DNA, 24 bp, Artificial Sequence
  Description of Artificial Sequence: Synthetic oligonucleotide
cggcagctgtcagtgctggaggtg

SEQ ID NO: 170088 - DNA, 24 bp, Artificial Sequence
  Description of Artificial Sequence: Synthetic oligonucleotide
ggcagctgtcagtgctggaggtgc

SEQ ID NO: 170089 - DNA, 24 bp, Artificial Sequence
  Description of Artificial Sequence: Synthetic oligonucleotide
gcagctgtcagtgctggaggtgcg

SEQ ID NO: 170090 - DNA, 24 bp, Artificial Sequence
  Description of Artificial Sequence: Synthetic oligonucleotide
cagctgtcagtgctggaggtgcgc

SEQ ID NO: 170091 - DNA, 24 bp, Artificial Sequence
  Description of Artificial Sequence: Synthetic oligonucleotide
agctgtcagtgctggaggtgcgcg

SEQ ID NO: 170092 - DNA, 23 bp, Artificial Sequence
  Description of Artificial Sequence: Synthetic oligonucleotide
gctgtcagtgctggaggtgcgcg

SEQ ID NO: 170093 - DNA, 23 bp, Artificial Sequence
  Description of Artificial Sequence: Synthetic oligonucleotide
ctgtcagtgctggaggtgcgcgc

SEQ ID NO: 170094 - DNA, 25 bp, Artificial Sequence
  Description of Artificial Sequence: Synthetic oligonucleotide
tgtcagtgctggaggtgcgcgccta

SEQ ID NO: 170095 - DNA, 24 bp, Artificial Sequence
  Description of Artificial Sequence: Synthetic oligonucleotide
gtcagtgctggaggtgcgcgccta

SEQ ID NO: 170096 - DNA, 26 bp, Artificial Sequence
  Description of Artificial Sequence: Synthetic oligonucleotide
tcagtgctggaggtgcgcgcctacaa

SEQ ID NO: 170097 - DNA, 25 bp, Artificial Sequence
  Description of Artificial Sequence: Synthetic oligonucleotide
cagtgctggaggtgcgcgcctacaa

SEQ ID NO: 170098 - DNA, 25 bp, Artificial Sequence
  Description of Artificial Sequence: Synthetic oligonucleotide
agtgctggaggtgcgcgcctacaag

SEQ ID NO: 170099 - DNA, 24 bp, Artificial Sequence
  Description of Artificial Sequence: Synthetic oligonucleotide
gtgctggaggtgcgcgcctacaag

SEQ ID NO: 170100 - DNA, 24 bp, Artificial Sequence
  Description of Artificial Sequence: Synthetic oligonucleotide
tgctggaggtgcgcgcctacaagc

SEQ ID NO: 170101 - DNA, 23 bp, Artificial Sequence
  Description of Artificial Sequence: Synthetic oligonucleotide
gctggaggtgcgcgcctacaagc

SEQ ID NO: 170102 - DNA, 23 bp, Artificial Sequence
  Description of Artificial Sequence: Synthetic oligonucleotide
ctggaggtgcgcgcctacaagcg

SEQ ID NO: 170103 - DNA, 24 bp, Artificial Sequence
  Description of Artificial Sequence: Synthetic oligonucleotide
tggaggtgcgcgcctacaagcgct

SEQ ID NO: 170104 - DNA, 23 bp, Artificial Sequence
  Description of Artificial Sequence: Synthetic oligonucleotide
ggaggtgcgcgcctacaagcgct

SEQ ID NO: 170105 - DNA, 23 bp, Artificial Sequence
  Description of Artificial Sequence: Synthetic oligonucleotide
gaggtgcgcgcctacaagcgctg

SEQ ID NO: 170106 - DNA, 23 bp, Artificial Sequence
  Description of Artificial Sequence: Synthetic oligonucleotide
aggtgcgcgcctacaagcgctgg

SEQ ID NO: 170107 - DNA, 22 bp, Artificial Sequence
  Description of Artificial Sequence: Synthetic oligonucleotide
ggtgcgcgcctacaagcgctgg

SEQ ID NO: 170108 - DNA, 23 bp, Artificial Sequence
  Description of Artificial Sequence: Synthetic oligonucleotide
gtgcgcgcctacaagcgctggca

SEQ ID NO: 170109 - DNA, 23 bp, Artificial Sequence
  Description of Artificial Sequence: Synthetic oligonucleotide
tgcgcgcctacaagcgctggcag

SEQ ID NO: 170110 - DNA, 22 bp, Artificial Sequence
  Description of Artificial Sequence: Synthetic oligonucleotide
gcgcgcctacaagcgctggcag

SEQ ID NO: 170111 - DNA, 23 bp, Artificial Sequence
  Description of Artificial Sequence: Synthetic oligonucleotide
cgcgcctacaagcgctggcagga

SEQ ID NO: 170112 - DNA, 23 bp, Artificial Sequence
  Description of Artificial Sequence: Synthetic oligonucleotide
gcgcctacaagcgctggcaggac

SEQ ID NO: 170113 - DNA, 24 bp, Artificial Sequence
  Description of Artificial Sequence: Synthetic oligonucleotide
cgcctacaagcgctggcaggacgt

SEQ ID NO: 170114 - DNA, 25 bp, Artificial Sequence
  Description of Artificial Sequence: Synthetic oligonucleotide
gcctacaagcgctggcaggacgtgt

SEQ ID NO: 170115 - DNA, 25 bp, Artificial Sequence
  Description of Artificial Sequence: Synthetic oligonucleotide
cctacaagcgctggcaggacgtgtc

SEQ ID NO: 170116 - DNA, 27 bp, Artificial Sequence
  Description of Artificial Sequence: Synthetic oligonucleotide
ctacaagcgctggcaggacgtgtccat

SEQ ID NO: 170117 - DNA, 27 bp, Artificial Sequence
  Description of Artificial Sequence: Synthetic oligonucleotide
tacaagcgctggcaggacgtgtccatg

SEQ ID NO: 170118 - DNA, 26 bp, Artificial Sequence
  Description of Artificial Sequence: Synthetic oligonucleotide
acaagcgctggcaggacgtgtccatg

SEQ ID NO: 170119 - DNA, 25 bp, Artificial Sequence
  Description of Artificial Sequence: Synthetic oligonucleotide
caagcgctggcaggacgtgtccatg

SEQ ID NO: 170120 - DNA, 25 bp, Artificial Sequence
  Description of Artificial Sequence: Synthetic oligonucleotide
aagcgctggcaggacgtgtccatgc

SEQ ID NO: 170121 - DNA, 24 bp, Artificial Sequence
  Description of Artificial Sequence: Synthetic oligonucleotide
agcgctggcaggacgtgtccatgc

SEQ ID NO: 170122 - DNA, 23 bp, Artificial Sequence
  Description of Artificial Sequence: Synthetic oligonucleotide
gcgctggcaggacgtgtccatgc

SEQ ID NO: 170123 - DNA, 23 bp, Artificial Sequence
  Description of Artificial Sequence: Synthetic oligonucleotide
cgctggcaggacgtgtccatgcg

SEQ ID NO: 170124 - DNA, 23 bp, Artificial Sequence
  Description of Artificial Sequence: Synthetic oligonucleotide
gctggcaggacgtgtccatgcgc

SEQ ID NO: 170125 - DNA, 23 bp, Artificial Sequence
  Description of Artificial Sequence: Synthetic oligonucleotide
ctggcaggacgtgtccatgcgcc

SEQ ID NO: 170126 - DNA, 23 bp, Artificial Sequence
  Description of Artificial Sequence: Synthetic oligonucleotide
tggcaggacgtgtccatgcgccg

SEQ ID NO: 170127 - DNA, 22 bp, Artificial Sequence
  Description of Artificial Sequence: Synthetic oligonucleotide
ggcaggacgtgtccatgcgccg

SEQ ID NO: 170128 - DNA, 24 bp, Artificial Sequence
  Description of Artificial Sequence: Synthetic oligonucleotide
gcaggacgtgtccatgcgccgcat

SEQ ID NO: 170129 - DNA, 24 bp, Artificial Sequence
  Description of Artificial Sequence: Synthetic oligonucleotide
caggacgtgtccatgcgccgcatg

SEQ ID NO: 170130 - DNA, 25 bp, Artificial Sequence
  Description of Artificial Sequence: Synthetic oligonucleotide
aggacgtgtccatgcgccgcatgga

SEQ ID NO: 170131 - DNA, 24 bp, Artificial Sequence
  Description of Artificial Sequence: Synthetic oligonucleotide
ggacgtgtccatgcgccgcatgga

SEQ ID NO: 170132 - DNA, 26 bp, Artificial Sequence
  Description of Artificial Sequence: Synthetic oligonucleotide
gacgtgtccatgcgccgcatggagat

SEQ ID NO: 170133 - DNA, 27 bp, Artificial Sequence
  Description of Artificial Sequence: Synthetic oligonucleotide
acgtgtccatgcgccgcatggagatga

SEQ ID NO: 170134 - DNA, 27 bp, Artificial Sequence
  Description of Artificial Sequence: Synthetic oligonucleotide
cgtgtccatgcgccgcatggagatgat

SEQ ID NO: 170135 - DNA, 27 bp, Artificial Sequence
  Description of Artificial Sequence: Synthetic oligonucleotide
gtgtccatgcgccgcatggagatgatc

SEQ ID NO: 170136 - DNA, 28 bp, Artificial Sequence
  Description of Artificial Sequence: Synthetic oligonucleotide
tgtccatgcgccgcatggagatgatcag

SEQ ID NO: 170137 - DNA, 27 bp, Artificial Sequence
  Description of Artificial Sequence: Synthetic oligonucleotide
gtccatgcgccgcatggagatgatcag

SEQ ID NO: 170138 - DNA, 28 bp, Artificial Sequence
  Description of Artificial Sequence: Synthetic oligonucleotide
tccatgcgccgcatggagatgatcagtg

SEQ ID NO: 170139 - DNA, 27 bp, Artificial Sequence
  Description of Artificial Sequence: Synthetic oligonucleotide
ccatgcgccgcatggagatgatcagtg

SEQ ID NO: 170140 - DNA, 28 bp, Artificial Sequence
  Description of Artificial Sequence: Synthetic oligonucleotide
catgcgccgcatggagatgatcagtgac

SEQ ID NO: 170141 - DNA, 30 bp, Artificial Sequence
  Description of Artificial Sequence: Synthetic oligonucleotide
atgcgccgcatggagatgatcagtgacttc

SEQ ID NO: 170142 - DNA, 29 bp, Artificial Sequence
  Description of Artificial Sequence: Synthetic oligonucleotide
tgcgccgcatggagatgatcagtgacttc

SEQ ID NO: 170143 - DNA, 28 bp, Artificial Sequence
  Description of Artificial Sequence: Synthetic oligonucleotide
gcgccgcatggagatgatcagtgacttc

SEQ ID NO: 170144 - DNA, 29 bp, Artificial Sequence
  Description of Artificial Sequence: Synthetic oligonucleotide
cgccgcatggagatgatcagtgacttctg

SEQ ID NO: 170145 - DNA, 29 bp, Artificial Sequence
  Description of Artificial Sequence: Synthetic oligonucleotide
gccgcatggagatgatcagtgacttctgc

SEQ ID NO: 170146 - DNA, 29 bp, Artificial Sequence
  Description of Artificial Sequence: Synthetic oligonucleotide
ccgcatggagatgatcagtgacttctgcg

SEQ ID NO: 170147 - DNA, 30 bp, Artificial Sequence
  Description of Artificial Sequence: Synthetic oligonucleotide
cgcatggagatgatcagtgacttctgcgag

SEQ ID NO: 170148 - DNA, 30 bp, Artificial Sequence
  Description of Artificial Sequence: Synthetic oligonucleotide
gcatggagatgatcagtgacttctgcgagc

SEQ ID NO: 170149 - DNA, 30 bp, Artificial Sequence
  Description of Artificial Sequence: Synthetic oligonucleotide
catggagatgatcagtgacttctgcgagcg

SEQ ID NO: 170150 - DNA, 30 bp, Artificial Sequence
  Description of Artificial Sequence: Synthetic oligonucleotide
atggagatgatcagtgacttctgcgagcgg

SEQ ID NO: 170151 - DNA, 29 bp, Artificial Sequence
  Description of Artificial Sequence: Synthetic oligonucleotide
tggagatgatcagtgacttctgcgagcgg

SEQ ID NO: 170152 - DNA, 28 bp, Artificial Sequence
  Description of Artificial Sequence: Synthetic oligonucleotide
ggagatgatcagtgacttctgcgagcgg

SEQ ID NO: 170153 - DNA, 28 bp, Artificial Sequence
  Description of Artificial Sequence: Synthetic oligonucleotide
gagatgatcagtgacttctgcgagcggc

SEQ ID NO: 170154 - DNA, 28 bp, Artificial Sequence
  Description of Artificial Sequence: Synthetic oligonucleotide
agatgatcagtgacttctgcgagcggcg

SEQ ID NO: 170155 - DNA, 27 bp, Artificial Sequence
  Description of Artificial Sequence: Synthetic oligonucleotide
gatgatcagtgacttctgcgagcggcg

SEQ ID NO: 170156 - DNA, 27 bp, Artificial Sequence
  Description of Artificial Sequence: Synthetic oligonucleotide
atgatcagtgacttctgcgagcggcgc

SEQ ID NO: 170157 - DNA, 27 bp, Artificial Sequence
  Description of Artificial Sequence: Synthetic oligonucleotide
tgatcagtgacttctgcgagcggcgct

SEQ ID NO: 170158 - DNA, 27 bp, Artificial Sequence
  Description of Artificial Sequence: Synthetic oligonucleotide
gatcagtgacttctgcgagcggcgctt

SEQ ID NO: 170159 - DNA, 27 bp, Artificial Sequence
  Description of Artificial Sequence: Synthetic oligonucleotide
atcagtgacttctgcgagcggcgcttc

SEQ ID NO: 170160 - DNA, 26 bp, Artificial Sequence
  Description of Artificial Sequence: Synthetic oligonucleotide
tcagtgacttctgcgagcggcgcttc

SEQ ID NO: 170161 - DNA, 25 bp, Artificial Sequence
  Description of Artificial Sequence: Synthetic oligonucleotide
cagtgacttctgcgagcggcgcttc

SEQ ID NO: 170162 - DNA, 26 bp, Artificial Sequence
  Description of Artificial Sequence: Synthetic oligonucleotide
agtgacttctgcgagcggcgcttcct

SEQ ID NO: 170163 - DNA, 25 bp, Artificial Sequence
  Description of Artificial Sequence: Synthetic oligonucleotide
gtgacttctgcgagcggcgcttcct

SEQ ID NO: 170164 - DNA, 26 bp, Artificial Sequence
  Description of Artificial Sequence: Synthetic oligonucleotide
tgacttctgcgagcggcgcttcctca

SEQ ID NO: 170165 - DNA, 25 bp, Artificial Sequence
  Description of Artificial Sequence: Synthetic oligonucleotide
gacttctgcgagcggcgcttcctca

SEQ ID NO: 170166 - DNA, 25 bp, Artificial Sequence
  Description of Artificial Sequence: Synthetic oligonucleotide
acttctgcgagcggcgcttcctcag

SEQ ID NO: 170167 - DNA, 24 bp, Artificial Sequence
  Description of Artificial Sequence: Synthetic oligonucleotide
cttctgcgagcggcgcttcctcag

SEQ ID NO: 170168 - DNA, 24 bp, Artificial Sequence
  Description of Artificial Sequence: Synthetic oligonucleotide
ttctgcgagcggcgcttcctcagc

SEQ ID NO: 170169 - DNA, 23 bp, Artificial Sequence
  Description of Artificial Sequence: Synthetic oligonucleotide
tctgcgagcggcgcttcctcagc

SEQ ID NO: 170170 - DNA, 22 bp, Artificial Sequence
  Description of Artificial Sequence: Synthetic oligonucleotide
ctgcgagcggcgcttcctcagc

SEQ ID NO: 170171 - DNA, 23 bp, Artificial Sequence
  Description of Artificial Sequence: Synthetic oligonucleotide
tgcgagcggcgcttcctcagcga

SEQ ID NO: 170172 - DNA, 22 bp, Artificial Sequence
  Description of Artificial Sequence: Synthetic oligonucleotide
gcgagcggcgcttcctcagcga

SEQ ID NO: 170173 - DNA, 22 bp, Artificial Sequence
  Description of Artificial Sequence: Synthetic oligonucleotide
cgagcggcgcttcctcagcgag

SEQ ID NO: 170174 - DNA, 23 bp, Artificial Sequence
  Description of Artificial Sequence: Synthetic oligonucleotide
gagcggcgcttcctcagcgaggt

SEQ ID NO: 170175 - DNA, 23 bp, Artificial Sequence
  Description of Artificial Sequence: Synthetic oligonucleotide
agcggcgcttcctcagcgaggtg

SEQ ID NO: 170176 - DNA, 22 bp, Artificial Sequence
  Description of Artificial Sequence: Synthetic oligonucleotide
gcggcgcttcctcagcgaggtg

SEQ ID NO: 170177 - DNA, 26 bp, Artificial Sequence
  Description of Artificial Sequence: Synthetic oligonucleotide
cggcgcttcctcagcgaggtggatta

SEQ ID NO: 170178 - DNA, 26 bp, Artificial Sequence
  Description of Artificial Sequence: Synthetic oligonucleotide
ggcgcttcctcagcgaggtggattac

SEQ ID NO: 170179 - DNA, 27 bp, Artificial Sequence
  Description of Artificial Sequence: Synthetic oligonucleotide
gcgcttcctcagcgaggtggattacct

SEQ ID NO: 170180 - DNA, 27 bp, Artificial Sequence
  Description of Artificial Sequence: Synthetic oligonucleotide
cgcttcctcagcgaggtggattacctg

SEQ ID NO: 170181 - DNA, 27 bp, Artificial Sequence
  Description of Artificial Sequence: Synthetic oligonucleotide
gcttcctcagcgaggtggattacctgg

SEQ ID NO: 170182 - DNA, 28 bp, Artificial Sequence
  Description of Artificial Sequence: Synthetic oligonucleotide
cttcctcagcgaggtggattacctggtg

SEQ ID NO: 170183 - DNA, 29 bp, Artificial Sequence
  Description of Artificial Sequence: Synthetic oligonucleotide
ttcctcagcgaggtggattacctggtgtg

SEQ ID NO: 170184 - DNA, 28 bp, Artificial Sequence
  Description of Artificial Sequence: Synthetic oligonucleotide
tcctcagcgaggtggattacctggtgtg

SEQ ID NO: 170185 - DNA, 27 bp, Artificial Sequence
  Description of Artificial Sequence: Synthetic oligonucleotide
cctcagcgaggtggattacctggtgtg

SEQ ID NO: 170186 - DNA, 27 bp, Artificial Sequence
  Description of Artificial Sequence: Synthetic oligonucleotide
ctcagcgaggtggattacctggtgtgc

SEQ ID NO: 170187 - DNA, 27 bp, Artificial Sequence
  Description of Artificial Sequence: Synthetic oligonucleotide
tcagcgaggtggattacctggtgtgcg

SEQ ID NO: 170188 - DNA, 27 bp, Artificial Sequence
  Description of Artificial Sequence: Synthetic oligonucleotide
cagcgaggtggattacctggtgtgcgt

SEQ ID NO: 170189 - DNA, 27 bp, Artificial Sequence
  Description of Artificial Sequence: Synthetic oligonucleotide
agcgaggtggattacctggtgtgcgtg

SEQ ID NO: 170190 - DNA, 26 bp, Artificial Sequence
  Description of Artificial Sequence: Synthetic oligonucleotide
gcgaggtggattacctggtgtgcgtg

SEQ ID NO: 170191 - DNA, 27 bp, Artificial Sequence
  Description of Artificial Sequence: Synthetic oligonucleotide
cgaggtggattacctggtgtgcgtgga

SEQ ID NO: 170192 - DNA, 27 bp, Artificial Sequence
  Description of Artificial Sequence: Synthetic oligonucleotide
gaggtggattacctggtgtgcgtggac

SEQ ID NO: 170193 - DNA, 27 bp, Artificial Sequence
  Description of Artificial Sequence: Synthetic oligonucleotide
aggtggattacctggtgtgcgtggacg

SEQ ID NO: 170194 - DNA, 27 bp, Artificial Sequence
  Description of Artificial Sequence: Synthetic oligonucleotide
ggtggattacctggtgtgcgtggacgt

SEQ ID NO: 170195 - DNA, 27 bp, Artificial Sequence
  Description of Artificial Sequence: Synthetic oligonucleotide
gtggattacctggtgtgcgtggacgtg

SEQ ID NO: 170196 - DNA, 27 bp, Artificial Sequence
  Description of Artificial Sequence: Synthetic oligonucleotide
tggattacctggtgtgcgtggacgtgg

SEQ ID NO: 170197 - DNA, 27 bp, Artificial Sequence
  Description of Artificial Sequence: Synthetic oligonucleotide
ggattacctggtgtgcgtggacgtgga

SEQ ID NO: 170198 - DNA, 27 bp, Artificial Sequence
  Description of Artificial Sequence: Synthetic oligonucleotide
gattacctggtgtgcgtggacgtggac

SEQ ID NO: 170199 - DNA, 29 bp, Artificial Sequence
  Description of Artificial Sequence: Synthetic oligonucleotide
attacctggtgtgcgtggacgtggacatg

SEQ ID NO: 170200 - DNA, 28 bp, Artificial Sequence
  Description of Artificial Sequence: Synthetic oligonucleotide
ttacctggtgtgcgtggacgtggacatg

SEQ ID NO: 170201 - DNA, 27 bp, Artificial Sequence
  Description of Artificial Sequence: Synthetic oligonucleotide
tacctggtgtgcgtggacgtggacatg

SEQ ID NO: 170202 - DNA, 26 bp, Artificial Sequence
  Description of Artificial Sequence: Synthetic oligonucleotide
acctggtgtgcgtggacgtggacatg

SEQ ID NO: 170203 - DNA, 25 bp, Artificial Sequence
  Description of Artificial Sequence: Synthetic oligonucleotide
cctggtgtgcgtggacgtggacatg

SEQ ID NO: 170204 - DNA, 26 bp, Artificial Sequence
  Description of Artificial Sequence: Synthetic oligonucleotide
ctggtgtgcgtggacgtggacatgga

SEQ ID NO: 170205 - DNA, 27 bp, Artificial Sequence
  Description of Artificial Sequence: Synthetic oligonucleotide
tggtgtgcgtggacgtggacatggagt

SEQ ID NO: 170206 - DNA, 27 bp, Artificial Sequence
  Description of Artificial Sequence: Synthetic oligonucleotide
ggtgtgcgtggacgtggacatggagtt

SEQ ID NO: 170207 - DNA, 27 bp, Artificial Sequence
  Description of Artificial Sequence: Synthetic oligonucleotide
gtgtgcgtggacgtggacatggagttc

SEQ ID NO: 170208 - DNA, 27 bp, Artificial Sequence
  Description of Artificial Sequence: Synthetic oligonucleotide
tgtgcgtggacgtggacatggagttcc

SEQ ID NO: 170209 - DNA, 26 bp, Artificial Sequence
  Description of Artificial Sequence: Synthetic oligonucleotide
gtgcgtggacgtggacatggagttcc

SEQ ID NO: 170210 - DNA, 26 bp, Artificial Sequence
  Description of Artificial Sequence: Synthetic oligonucleotide
tgcgtggacgtggacatggagttccg

SEQ ID NO: 170211 - DNA, 25 bp, Artificial Sequence
  Description of Artificial Sequence: Synthetic oligonucleotide
gcgtggacgtggacatggagttccg

SEQ ID NO: 170212 - DNA, 25 bp, Artificial Sequence
  Description of Artificial Sequence: Synthetic oligonucleotide
cgtggacgtggacatggagttccgc

SEQ ID NO: 170213 - DNA, 26 bp, Artificial Sequence
  Description of Artificial Sequence: Synthetic oligonucleotide
gtggacgtggacatggagttccgcga

SEQ ID NO: 170214 - DNA, 26 bp, Artificial Sequence
  Description of Artificial Sequence: Synthetic oligonucleotide
tggacgtggacatggagttccgcgac

SEQ ID NO: 170215 - DNA, 25 bp, Artificial Sequence
  Description of Artificial Sequence: Synthetic oligonucleotide
ggacgtggacatggagttccgcgac

SEQ ID NO: 170216 - DNA, 26 bp, Artificial Sequence
  Description of Artificial Sequence: Synthetic oligonucleotide
gacgtggacatggagttccgcgacca

SEQ ID NO: 170217 - DNA, 26 bp, Artificial Sequence
  Description of Artificial Sequence: Synthetic oligonucleotide
acgtggacatggagttccgcgaccac

SEQ ID NO: 170218 - DNA, 25 bp, Artificial Sequence
  Description of Artificial Sequence: Synthetic oligonucleotide
cgtggacatggagttccgcgaccac

SEQ ID NO: 170219 - DNA, 26 bp, Artificial Sequence
  Description of Artificial Sequence: Synthetic oligonucleotide
gtggacatggagttccgcgaccacgt

SEQ ID NO: 170220 - DNA, 26 bp, Artificial Sequence
  Description of Artificial Sequence: Synthetic oligonucleotide
tggacatggagttccgcgaccacgtg

SEQ ID NO: 170221 - DNA, 25 bp, Artificial Sequence
  Description of Artificial Sequence: Synthetic oligonucleotide
ggacatggagttccgcgaccacgtg

SEQ ID NO: 170222 - DNA, 25 bp, Artificial Sequence
  Description of Artificial Sequence: Synthetic oligonucleotide
gacatggagttccgcgaccacgtgg

SEQ ID NO: 170223 - DNA, 25 bp, Artificial Sequence
  Description of Artificial Sequence: Synthetic oligonucleotide
acatggagttccgcgaccacgtggg

SEQ ID NO: 170224 - DNA, 24 bp, Artificial Sequence
  Description of Artificial Sequence: Synthetic oligonucleotide
catggagttccgcgaccacgtggg

SEQ ID NO: 170225 - DNA, 24 bp, Artificial Sequence
  Description of Artificial Sequence: Synthetic oligonucleotide
atggagttccgcgaccacgtgggc

SEQ ID NO: 170226 - DNA, 23 bp, Artificial Sequence
  Description of Artificial Sequence: Synthetic oligonucleotide
tggagttccgcgaccacgtgggc

SEQ ID NO: 170227 - DNA, 22 bp, Artificial Sequence
  Description of Artificial Sequence: Synthetic oligonucleotide
ggagttccgcgaccacgtgggc

SEQ ID NO: 170228 - DNA, 23 bp, Artificial Sequence
  Description of Artificial Sequence: Synthetic oligonucleotide
gagttccgcgaccacgtgggcgt

SEQ ID NO: 170229 - DNA, 23 bp, Artificial Sequence
  Description of Artificial Sequence: Synthetic oligonucleotide
agttccgcgaccacgtgggcgtg

SEQ ID NO: 170230 - DNA, 22 bp, Artificial Sequence
  Description of Artificial Sequence: Synthetic oligonucleotide
gttccgcgaccacgtgggcgtg

SEQ ID NO: 170231 - DNA, 23 bp, Artificial Sequence
  Description of Artificial Sequence: Synthetic oligonucleotide
ttccgcgaccacgtgggcgtgga

SEQ ID NO: 170232 - DNA, 22 bp, Artificial Sequence
  Description of Artificial Sequence: Synthetic oligonucleotide
tccgcgaccacgtgggcgtgga

SEQ ID NO: 170233 - DNA, 21 bp, Artificial Sequence
  Description of Artificial Sequence: Synthetic oligonucleotide
ccgcgaccacgtgggcgtgga

SEQ ID NO: 170234 - DNA, 23 bp, Artificial Sequence
  Description of Artificial Sequence: Synthetic oligonucleotide
cgcgaccacgtgggcgtggagat

SEQ ID NO: 170235 - DNA, 23 bp, Artificial Sequence
  Description of Artificial Sequence: Synthetic oligonucleotide
gcgaccacgtgggcgtggagatc

SEQ ID NO: 170236 - DNA, 24 bp, Artificial Sequence
  Description of Artificial Sequence: Synthetic oligonucleotide
cgaccacgtgggcgtggagatcct

SEQ ID NO: 170237 - DNA, 25 bp, Artificial Sequence
  Description of Artificial Sequence: Synthetic oligonucleotide
gaccacgtgggcgtggagatcctga

SEQ ID NO: 170238 - DNA, 26 bp, Artificial Sequence
  Description of Artificial Sequence: Synthetic oligonucleotide
accacgtgggcgtggagatcctgact

SEQ ID NO: 170239 - DNA, 25 bp, Artificial Sequence
  Description of Artificial Sequence: Synthetic oligonucleotide
ccacgtgggcgtggagatcctgact

SEQ ID NO: 170240 - DNA, 25 bp, Artificial Sequence
  Description of Artificial Sequence: Synthetic oligonucleotide
cacgtgggcgtggagatcctgactc

SEQ ID NO: 170241 - DNA, 25 bp, Artificial Sequence
  Description of Artificial Sequence: Synthetic oligonucleotide
acgtgggcgtggagatcctgactcc

SEQ ID NO: 170242 - DNA, 24 bp, Artificial Sequence
  Description of Artificial Sequence: Synthetic oligonucleotide
cgtgggcgtggagatcctgactcc

SEQ ID NO: 170243 - DNA, 24 bp, Artificial Sequence
  Description of Artificial Sequence: Synthetic oligonucleotide
gtgggcgtggagatcctgactccg

SEQ ID NO: 170244 - DNA, 25 bp, Artificial Sequence
  Description of Artificial Sequence: Synthetic oligonucleotide
tgggcgtggagatcctgactccgct

SEQ ID NO: 170245 - DNA, 24 bp, Artificial Sequence
  Description of Artificial Sequence: Synthetic oligonucleotide
gggcgtggagatcctgactccgct

SEQ ID NO: 170246 - DNA, 26 bp, Artificial Sequence
  Description of Artificial Sequence: Synthetic oligonucleotide
ggcgtggagatcctgactccgctgtt

SEQ ID NO: 170247 - DNA, 26 bp, Artificial Sequence
  Description of Artificial Sequence: Synthetic oligonucleotide
gcgtggagatcctgactccgctgttc

SEQ ID NO: 170248 - DNA, 26 bp, Artificial Sequence
  Description of Artificial Sequence: Synthetic oligonucleotide
cgtggagatcctgactccgctgttcg

SEQ ID NO: 170249 - DNA, 26 bp, Artificial Sequence
  Description of Artificial Sequence: Synthetic oligonucleotide
gtggagatcctgactccgctgttcgg

SEQ ID NO: 170250 - DNA, 27 bp, Artificial Sequence
  Description of Artificial Sequence: Synthetic oligonucleotide
tggagatcctgactccgctgttcggca

SEQ ID NO: 170251 - DNA, 26 bp, Artificial Sequence
  Description of Artificial Sequence: Synthetic oligonucleotide
ggagatcctgactccgctgttcggca

SEQ ID NO: 170252 - DNA, 26 bp, Artificial Sequence
  Description of Artificial Sequence: Synthetic oligonucleotide
gagatcctgactccgctgttcggcac

SEQ ID NO: 170253 - DNA, 26 bp, Artificial Sequence
  Description of Artificial Sequence: Synthetic oligonucleotide
agatcctgactccgctgttcggcacc

SEQ ID NO: 170254 - DNA, 25 bp, Artificial Sequence
  Description of Artificial Sequence: Synthetic oligonucleotide
gatcctgactccgctgttcggcacc

SEQ ID NO: 170255 - DNA, 26 bp, Artificial Sequence
  Description of Artificial Sequence: Synthetic oligonucleotide
atcctgactccgctgttcggcaccct

SEQ ID NO: 170256 - DNA, 25 bp, Artificial Sequence
  Description of Artificial Sequence: Synthetic oligonucleotide
tcctgactccgctgttcggcaccct

SEQ ID NO: 170257 - DNA, 24 bp, Artificial Sequence
  Description of Artificial Sequence: Synthetic oligonucleotide
cctgactccgctgttcggcaccct

SEQ ID NO: 170258 - DNA, 24 bp, Artificial Sequence
  Description of Artificial Sequence: Synthetic oligonucleotide
ctgactccgctgttcggcaccctg

SEQ ID NO: 170259 - DNA, 25 bp, Artificial Sequence
  Description of Artificial Sequence: Synthetic oligonucleotide
tgactccgctgttcggcaccctgca

SEQ ID NO: 170260 - DNA, 24 bp, Artificial Sequence
  Description of Artificial Sequence: Synthetic oligonucleotide
gactccgctgttcggcaccctgca

SEQ ID NO: 170261 - DNA, 24 bp, Artificial Sequence
  Description of Artificial Sequence: Synthetic oligonucleotide
actccgctgttcggcaccctgcac

SEQ ID NO: 170262 - DNA, 23 bp, Artificial Sequence
  Description of Artificial Sequence: Synthetic oligonucleotide
ctccgctgttcggcaccctgcac

SEQ ID NO: 170263 - DNA, 23 bp, Artificial Sequence
  Description of Artificial Sequence: Synthetic oligonucleotide
tccgctgttcggcaccctgcacc

SEQ ID NO: 170264 - DNA, 22 bp, Artificial Sequence
  Description of Artificial Sequence: Synthetic oligonucleotide
ccgctgttcggcaccctgcacc

SEQ ID NO: 170265 - DNA, 22 bp, Artificial Sequence
  Description of Artificial Sequence: Synthetic oligonucleotide
cgctgttcggcaccctgcaccc

SEQ ID NO: 170266 - DNA, 22 bp, Artificial Sequence
  Description of Artificial Sequence: Synthetic oligonucleotide
gctgttcggcaccctgcacccc

SEQ ID NO: 170267 - DNA, 22 bp, Artificial Sequence
  Description of Artificial Sequence: Synthetic oligonucleotide
ctgttcggcaccctgcaccccg

SEQ ID NO: 170268 - DNA, 22 bp, Artificial Sequence
  Description of Artificial Sequence: Synthetic oligonucleotide
tgttcggcaccctgcaccccgg

SEQ ID NO: 170269 - DNA, 21 bp, Artificial Sequence
  Description of Artificial Sequence: Synthetic oligonucleotide
gttcggcaccctgcaccccgg

SEQ ID NO: 170270 - DNA, 23 bp, Artificial Sequence
  Description of Artificial Sequence: Synthetic oligonucleotide
ttcggcaccctgcaccccggctt

SEQ ID NO: 170271 - DNA, 22 bp, Artificial Sequence
  Description of Artificial Sequence: Synthetic oligonucleotide
tcggcaccctgcaccccggctt

SEQ ID NO: 170272 - DNA, 21 bp, Artificial Sequence
  Description of Artificial Sequence: Synthetic oligonucleotide
cggcaccctgcaccccggctt

SEQ ID NO: 170273 - DNA, 23 bp, Artificial Sequence
  Description of Artificial Sequence: Synthetic oligonucleotide
ggcaccctgcaccccggcttcta

SEQ ID NO: 170274 - DNA, 23 bp, Artificial Sequence
  Description of Artificial Sequence: Synthetic oligonucleotide
gcaccctgcaccccggcttctac

SEQ ID NO: 170275 - DNA, 23 bp, Artificial Sequence
  Description of Artificial Sequence: Synthetic oligonucleotide
caccctgcaccccggcttctacg

SEQ ID NO: 170276 - DNA, 25 bp, Artificial Sequence
  Description of Artificial Sequence: Synthetic oligonucleotide
accctgcaccccggcttctacggaa

SEQ ID NO: 170277 - DNA, 24 bp, Artificial Sequence
  Description of Artificial Sequence: Synthetic oligonucleotide
ccctgcaccccggcttctacggaa

SEQ ID NO: 170278 - DNA, 24 bp, Artificial Sequence
  Description of Artificial Sequence: Synthetic oligonucleotide
cctgcaccccggcttctacggaag

SEQ ID NO: 170279 - DNA, 25 bp, Artificial Sequence
  Description of Artificial Sequence: Synthetic oligonucleotide
ctgcaccccggcttctacggaagca

SEQ ID NO: 170280 - DNA, 25 bp, Artificial Sequence
  Description of Artificial Sequence: Synthetic oligonucleotide
tgcaccccggcttctacggaagcag

SEQ ID NO: 170281 - DNA, 24 bp, Artificial Sequence
  Description of Artificial Sequence: Synthetic oligonucleotide
gcaccccggcttctacggaagcag

SEQ ID NO: 170282 - DNA, 24 bp, Artificial Sequence
  Description of Artificial Sequence: Synthetic oligonucleotide
caccccggcttctacggaagcagc

SEQ ID NO: 170283 - DNA, 24 bp, Artificial Sequence
  Description of Artificial Sequence: Synthetic oligonucleotide
accccggcttctacggaagcagcc

SEQ ID NO: 170284 - DNA, 23 bp, Artificial Sequence
  Description of Artificial Sequence: Synthetic oligonucleotide
ccccggcttctacggaagcagcc

SEQ ID NO: 170285 - DNA, 23 bp, Artificial Sequence
  Description of Artificial Sequence: Synthetic oligonucleotide
cccggcttctacggaagcagccg

SEQ ID NO: 170286 - DNA, 23 bp, Artificial Sequence
  Description of Artificial Sequence: Synthetic oligonucleotide
ccggcttctacggaagcagccgg

SEQ ID NO: 170287 - DNA, 24 bp, Artificial Sequence
  Description of Artificial Sequence: Synthetic oligonucleotide
cggcttctacggaagcagccggga

SEQ ID NO: 170288 - DNA, 24 bp, Artificial Sequence
  Description of Artificial Sequence: Synthetic oligonucleotide
ggcttctacggaagcagccgggag

SEQ ID NO: 170289 - DNA, 24 bp, Artificial Sequence
  Description of Artificial Sequence: Synthetic oligonucleotide
gcttctacggaagcagccgggagg

SEQ ID NO: 170290 - DNA, 24 bp, Artificial Sequence
  Description of Artificial Sequence: Synthetic oligonucleotide
cttctacggaagcagccgggaggc

SEQ ID NO: 170291 - DNA, 26 bp, Artificial Sequence
  Description of Artificial Sequence: Synthetic oligonucleotide
ttctacggaagcagccgggaggcctt

SEQ ID NO: 170292 - DNA, 25 bp, Artificial Sequence
  Description of Artificial Sequence: Synthetic oligonucleotide
tctacggaagcagccgggaggcctt

SEQ ID NO: 170293 - DNA, 24 bp, Artificial Sequence
  Description of Artificial Sequence: Synthetic oligonucleotide
ctacggaagcagccgggaggcctt

SEQ ID NO: 170294 - DNA, 25 bp, Artificial Sequence
  Description of Artificial Sequence: Synthetic oligonucleotide
tacggaagcagccgggaggccttca

SEQ ID NO: 170295 - DNA, 24 bp, Artificial Sequence
  Description of Artificial Sequence: Synthetic oligonucleotide
acggaagcagccgggaggccttca

SEQ ID NO: 170296 - DNA, 23 bp, Artificial Sequence
  Description of Artificial Sequence: Synthetic oligonucleotide
cggaagcagccgggaggccttca

SEQ ID NO: 170297 - DNA, 23 bp, Artificial Sequence
  Description of Artificial Sequence: Synthetic oligonucleotide
ggaagcagccgggaggccttcac

SEQ ID NO: 170298 - DNA, 25 bp, Artificial Sequence
  Description of Artificial Sequence: Synthetic oligonucleotide
gaagcagccgggaggccttcaccta

SEQ ID NO: 170299 - DNA, 25 bp, Artificial Sequence
  Description of Artificial Sequence: Synthetic oligonucleotide
aagcagccgggaggccttcacctac

SEQ ID NO: 170300 - DNA, 24 bp, Artificial Sequence
  Description of Artificial Sequence: Synthetic oligonucleotide
agcagccgggaggccttcacctac

SEQ ID NO: 170301 - DNA, 23 bp, Artificial Sequence
  Description of Artificial Sequence: Synthetic oligonucleotide
gcagccgggaggccttcacctac

SEQ ID NO: 170302 - DNA, 24 bp, Artificial Sequence
  Description of Artificial Sequence: Synthetic oligonucleotide
cagccgggaggccttcacctacga

SEQ ID NO: 170303 - DNA, 24 bp, Artificial Sequence
  Description of Artificial Sequence: Synthetic oligonucleotide
agccgggaggccttcacctacgag

SEQ ID NO: 170304 - DNA, 23 bp, Artificial Sequence
  Description of Artificial Sequence: Synthetic oligonucleotide
gccgggaggccttcacctacgag

SEQ ID NO: 170305 - DNA, 23 bp, Artificial Sequence
  Description of Artificial Sequence: Synthetic oligonucleotide
ccgggaggccttcacctacgagc

SEQ ID NO: 170306 - DNA, 23 bp, Artificial Sequence
  Description of Artificial Sequence: Synthetic oligonucleotide
cgggaggccttcacctacgagcg

SEQ ID NO: 170307 - DNA, 23 bp, Artificial Sequence
  Description of Artificial Sequence: Synthetic oligonucleotide
gggaggccttcacctacgagcgc

SEQ ID NO: 170308 - DNA, 23 bp, Artificial Sequence
  Description of Artificial Sequence: Synthetic oligonucleotide
ggaggccttcacctacgagcgcc

SEQ ID NO: 170309 - DNA, 23 bp, Artificial Sequence
  Description of Artificial Sequence: Synthetic oligonucleotide
gaggccttcacctacgagcgccg

SEQ ID NO: 170310 - DNA, 23 bp, Artificial Sequence
  Description of Artificial Sequence: Synthetic oligonucleotide
aggccttcacctacgagcgccgg

SEQ ID NO: 170311 - DNA, 22 bp, Artificial Sequence
  Description of Artificial Sequence: Synthetic oligonucleotide
ggccttcacctacgagcgccgg

SEQ ID NO: 170312 - DNA, 22 bp, Artificial Sequence
  Description of Artificial Sequence: Synthetic oligonucleotide
gccttcacctacgagcgccggc

SEQ ID NO: 170313 - DNA, 22 bp, Artificial Sequence
  Description of Artificial Sequence: Synthetic oligonucleotide
ccttcacctacgagcgccggcc

SEQ ID NO: 170314 - DNA, 22 bp, Artificial Sequence
  Description of Artificial Sequence: Synthetic oligonucleotide
cttcacctacgagcgccggccc

SEQ ID NO: 170315 - DNA, 23 bp, Artificial Sequence
  Description of Artificial Sequence: Synthetic oligonucleotide
ttcacctacgagcgccggcccca

SEQ ID NO: 170316 - DNA, 22 bp, Artificial Sequence
  Description of Artificial Sequence: Synthetic oligonucleotide
tcacctacgagcgccggcccca

SEQ ID NO: 170317 - DNA, 21 bp, Artificial Sequence
  Description of Artificial Sequence: Synthetic oligonucleotide
cacctacgagcgccggcccca

SEQ ID NO: 170318 - DNA, 22 bp, Artificial Sequence
  Description of Artificial Sequence: Synthetic oligonucleotide
acctacgagcgccggccccagt

SEQ ID NO: 170319 - DNA, 21 bp, Artificial Sequence
  Description of Artificial Sequence: Synthetic oligonucleotide
cctacgagcgccggccccagt

SEQ ID NO: 170320 - DNA, 21 bp, Artificial Sequence
  Description of Artificial Sequence: Synthetic oligonucleotide
ctacgagcgccggccccagtc

SEQ ID NO: 170321 - DNA, 21 bp, Artificial Sequence
  Description of Artificial Sequence: Synthetic oligonucleotide
tacgagcgccggccccagtcc

SEQ ID NO: 170322 - DNA, 20 bp, Artificial Sequence
  Description of Artificial Sequence: Synthetic oligonucleotide
acgagcgccggccccagtcc

SEQ ID NO: 170323 - DNA, 20 bp, Artificial Sequence
  Description of Artificial Sequence: Synthetic oligonucleotide
cgagcgccggccccagtcct

SEQ ID NO: 170324 - DNA, 20 bp, Artificial Sequence
  Description of Artificial Sequence: Synthetic oligonucleotide
gagcgccggccccagtccca

SEQ ID NO: 170325 - DNA, 20 bp, Artificial Sequence
  Description of Artificial Sequence: Synthetic oligonucleotide
agcgccggccccagtcccag

SEQ ID NO: 170326 - DNA, 20 bp, Artificial Sequence
  Description of Artificial Sequence: Synthetic oligonucleotide
gcgccggccccagtcccagt

SEQ ID NO: 170327 - DNA, 20 bp, Artificial Sequence
  Description of Artificial Sequence: Synthetic oligonucleotide
cgccggccccagtcccaggt

SEQ ID NO: 170328 - DNA, 20 bp, Artificial Sequence
  Description of Artificial Sequence: Synthetic oligonucleotide
gccggccccagtcccaggct

SEQ ID NO: 170329 - DNA, 21 bp, Artificial Sequence
  Description of Artificial Sequence: Synthetic oligonucleotide
ccggccccagtcccaggccta

SEQ ID NO: 170330 - DNA, 23 bp, Artificial Sequence
  Description of Artificial Sequence: Synthetic oligonucleotide
cggccccagtcccaggcctacat

SEQ ID NO: 170331 - DNA, 23 bp, Artificial Sequence
  Description of Artificial Sequence: Synthetic oligonucleotide
ggccccagtcccaggcctacatc

SEQ ID NO: 170332 - DNA, 23 bp, Artificial Sequence
  Description of Artificial Sequence: Synthetic oligonucleotide
gccccagtcccaggcctacatcc

SEQ ID NO: 170333 - DNA, 23 bp, Artificial Sequence
  Description of Artificial Sequence: Synthetic oligonucleotide
ccccagtcccaggcctacatccc

SEQ ID NO: 170334 - DNA, 25 bp, Artificial Sequence
  Description of Artificial Sequence: Synthetic oligonucleotide
cccagtcccaggcctacatccccaa

SEQ ID NO: 170335 - DNA, 25 bp, Artificial Sequence
  Description of Artificial Sequence: Synthetic oligonucleotide
ccagtcccaggcctacatccccaag

SEQ ID NO: 170336 - DNA, 26 bp, Artificial Sequence
  Description of Artificial Sequence: Synthetic oligonucleotide
cagtcccaggcctacatccccaagga

SEQ ID NO: 170337 - DNA, 26 bp, Artificial Sequence
  Description of Artificial Sequence: Synthetic oligonucleotide
agtcccaggcctacatccccaaggac

SEQ ID NO: 170338 - DNA, 25 bp, Artificial Sequence
  Description of Artificial Sequence: Synthetic oligonucleotide
gtcccaggcctacatccccaaggac

SEQ ID NO: 170339 - DNA, 26 bp, Artificial Sequence
  Description of Artificial Sequence: Synthetic oligonucleotide
tcccaggcctacatccccaaggacga

SEQ ID NO: 170340 - DNA, 25 bp, Artificial Sequence
  Description of Artificial Sequence: Synthetic oligonucleotide
cccaggcctacatccccaaggacga

SEQ ID NO: 170341 - DNA, 25 bp, Artificial Sequence
  Description of Artificial Sequence: Synthetic oligonucleotide
ccaggcctacatccccaaggacgag

SEQ ID NO: 170342 - DNA, 25 bp, Artificial Sequence
  Description of Artificial Sequence: Synthetic oligonucleotide
caggcctacatccccaaggacgagg

SEQ ID NO: 170343 - DNA, 25 bp, Artificial Sequence
  Description of Artificial Sequence: Synthetic oligonucleotide
aggcctacatccccaaggacgaggg

SEQ ID NO: 170344 - DNA, 24 bp, Artificial Sequence
  Description of Artificial Sequence: Synthetic oligonucleotide
ggcctacatccccaaggacgaggg

SEQ ID NO: 170345 - DNA, 24 bp, Artificial Sequence
  Description of Artificial Sequence: Synthetic oligonucleotide
gcctacatccccaaggacgagggc

SEQ ID NO: 170346 - DNA, 27 bp, Artificial Sequence
  Description of Artificial Sequence: Synthetic oligonucleotide
cctacatccccaaggacgagggcgatt

SEQ ID NO: 170347 - DNA, 28 bp, Artificial Sequence
  Description of Artificial Sequence: Synthetic oligonucleotide
ctacatccccaaggacgagggcgatttc

SEQ ID NO: 170348 - DNA, 30 bp, Artificial Sequence
  Description of Artificial Sequence: Synthetic oligonucleotide
tacatccccaaggacgagggcgatttctac

SEQ ID NO: 170349 - DNA, 29 bp, Artificial Sequence
  Description of Artificial Sequence: Synthetic oligonucleotide
acatccccaaggacgagggcgatttctac

SEQ ID NO: 170350 - DNA, 28 bp, Artificial Sequence
  Description of Artificial Sequence: Synthetic oligonucleotide
catccccaaggacgagggcgatttctac

SEQ ID NO: 170351 - DNA, 30 bp, Artificial Sequence
  Description of Artificial Sequence: Synthetic oligonucleotide
atccccaaggacgagggcgatttctactac

SEQ ID NO: 170352 - DNA, 29 bp, Artificial Sequence
  Description of Artificial Sequence: Synthetic oligonucleotide
tccccaaggacgagggcgatttctactac

SEQ ID NO: 170353 - DNA, 28 bp, Artificial Sequence
  Description of Artificial Sequence: Synthetic oligonucleotide
ccccaaggacgagggcgatttctactac

SEQ ID NO: 170354 - DNA, 28 bp, Artificial Sequence
  Description of Artificial Sequence: Synthetic oligonucleotide
cccaaggacgagggcgatttctactacc

SEQ ID NO: 170355 - DNA, 29 bp, Artificial Sequence
  Description of Artificial Sequence: Synthetic oligonucleotide
ccaaggacgagggcgatttctactacctg

SEQ ID NO: 170356 - DNA, 29 bp, Artificial Sequence
  Description of Artificial Sequence: Synthetic oligonucleotide
caaggacgagggcgatttctactacctgg

SEQ ID NO: 170357 - DNA, 29 bp, Artificial Sequence
  Description of Artificial Sequence: Synthetic oligonucleotide
aaggacgagggcgatttctactacctggg

SEQ ID NO: 170358 - DNA, 28 bp, Artificial Sequence
  Description of Artificial Sequence: Synthetic oligonucleotide
aggacgagggcgatttctactacctggg

SEQ ID NO: 170359 - DNA, 27 bp, Artificial Sequence
  Description of Artificial Sequence: Synthetic oligonucleotide
ggacgagggcgatttctactacctggg

SEQ ID NO: 170360 - DNA, 27 bp, Artificial Sequence
  Description of Artificial Sequence: Synthetic oligonucleotide
gacgagggcgatttctactacctgggg

SEQ ID NO: 170361 - DNA, 27 bp, Artificial Sequence
  Description of Artificial Sequence: Synthetic oligonucleotide
acgagggcgatttctactacctggggg

SEQ ID NO: 170362 - DNA, 26 bp, Artificial Sequence
  Description of Artificial Sequence: Synthetic oligonucleotide
cgagggcgatttctactacctggggg

SEQ ID NO: 170363 - DNA, 26 bp, Artificial Sequence
  Description of Artificial Sequence: Synthetic oligonucleotide
gagggcgatttctactacctgggggg

SEQ ID NO: 170364 - DNA, 27 bp, Artificial Sequence
  Description of Artificial Sequence: Synthetic oligonucleotide
agggcgatttctactacctgggggggt

SEQ ID NO: 170365 - DNA, 27 bp, Artificial Sequence
  Description of Artificial Sequence: Synthetic oligonucleotide
gggcgatttctactacctgggggggtt

SEQ ID NO: 170366 - DNA, 27 bp, Artificial Sequence
  Description of Artificial Sequence: Synthetic oligonucleotide
ggcgatttctactacctgggggggttc

SEQ ID NO: 170367 - DNA, 29 bp, Artificial Sequence
  Description of Artificial Sequence: Synthetic oligonucleotide
gcgatttctactacctgggggggttcttc

SEQ ID NO: 170368 - DNA, 29 bp, Artificial Sequence
  Description of Artificial Sequence: Synthetic oligonucleotide
cgatttctactacctgggggggttcttcg

SEQ ID NO: 170369 - DNA, 29 bp, Artificial Sequence
  Description of Artificial Sequence: Synthetic oligonucleotide
gatttctactacctgggggggttcttcgg

SEQ ID NO: 170370 - DNA, 29 bp, Artificial Sequence
  Description of Artificial Sequence: Synthetic oligonucleotide
atttctactacctgggggggttcttcggg

SEQ ID NO: 170371 - DNA, 28 bp, Artificial Sequence
  Description of Artificial Sequence: Synthetic oligonucleotide
tttctactacctgggggggttcttcggg

SEQ ID NO: 170372 - DNA, 27 bp, Artificial Sequence
  Description of Artificial Sequence: Synthetic oligonucleotide
ttctactacctgggggggttcttcggg

SEQ ID NO: 170373 - DNA, 26 bp, Artificial Sequence
  Description of Artificial Sequence: Synthetic oligonucleotide
tctactacctgggggggttcttcggg

SEQ ID NO: 170374 - DNA, 25 bp, Artificial Sequence
  Description of Artificial Sequence: Synthetic oligonucleotide
ctactacctgggggggttcttcggg

SEQ ID NO: 170375 - DNA, 25 bp, Artificial Sequence
  Description of Artificial Sequence: Synthetic oligonucleotide
tactacctgggggggttcttcgggg

SEQ ID NO: 170376 - DNA, 24 bp, Artificial Sequence
  Description of Artificial Sequence: Synthetic oligonucleotide
actacctgggggggttcttcgggg

SEQ ID NO: 170377 - DNA, 23 bp, Artificial Sequence
  Description of Artificial Sequence: Synthetic oligonucleotide
ctacctgggggggttcttcgggg

SEQ ID NO: 170378 - DNA, 23 bp, Artificial Sequence
  Description of Artificial Sequence: Synthetic oligonucleotide
tacctgggggggttcttcggggg

SEQ ID NO: 170379 - DNA, 22 bp, Artificial Sequence
  Description of Artificial Sequence: Synthetic oligonucleotide
acctgggggggttcttcggggg

SEQ ID NO: 170380 - DNA, 21 bp, Artificial Sequence
  Description of Artificial Sequence: Synthetic oligonucleotide
cctgggggggttcttcggggg

SEQ ID NO: 170381 - DNA, 22 bp, Artificial Sequence
  Description of Artificial Sequence: Synthetic oligonucleotide
ctgggggggttcttcggggggt

SEQ ID NO: 170382 - DNA, 22 bp, Artificial Sequence
  Description of Artificial Sequence: Synthetic oligonucleotide
tgggggggttcttcggggggtc

SEQ ID NO: 170383 - DNA, 21 bp, Artificial Sequence
  Description of Artificial Sequence: Synthetic oligonucleotide
gggggggttcttcggggggtc

SEQ ID NO: 170384 - DNA, 21 bp, Artificial Sequence
  Description of Artificial Sequence: Synthetic oligonucleotide
ggggggttcttcggggggtcg

SEQ ID NO: 170385 - DNA, 22 bp, Artificial Sequence
  Description of Artificial Sequence: Synthetic oligonucleotide
gggggttcttcggggggtcggt

SEQ ID NO: 170386 - DNA, 22 bp, Artificial Sequence
  Description of Artificial Sequence: Synthetic oligonucleotide
ggggttcttcggggggtcggtg

SEQ ID NO: 170387 - DNA, 24 bp, Artificial Sequence
  Description of Artificial Sequence: Synthetic oligonucleotide
gggttcttcggggggtcggtgcaa

SEQ ID NO: 170388 - DNA, 25 bp, Artificial Sequence
  Description of Artificial Sequence: Synthetic oligonucleotide
ggttcttcggggggtcggtgcaaga

SEQ ID NO: 170389 - DNA, 25 bp, Artificial Sequence
  Description of Artificial Sequence: Synthetic oligonucleotide
gttcttcggggggtcggtgcaagag

SEQ ID NO: 170390 - DNA, 26 bp, Artificial Sequence
  Description of Artificial Sequence: Synthetic oligonucleotide
ttcttcggggggtcggtgcaagaggt

SEQ ID NO: 170391 - DNA, 25 bp, Artificial Sequence
  Description of Artificial Sequence: Synthetic oligonucleotide
tcttcggggggtcggtgcaagaggt

SEQ ID NO: 170392 - DNA, 24 bp, Artificial Sequence
  Description of Artificial Sequence: Synthetic oligonucleotide
cttcggggggtcggtgcaagaggt

SEQ ID NO: 170393 - DNA, 24 bp, Artificial Sequence
  Description of Artificial Sequence: Synthetic oligonucleotide
ttcggggggtcggtgcaagaggtg

SEQ ID NO: 170394 - DNA, 23 bp, Artificial Sequence
  Description of Artificial Sequence: Synthetic oligonucleotide
tcggggggtcggtgcaagaggtg

SEQ ID NO: 170395 - DNA, 22 bp, Artificial Sequence
  Description of Artificial Sequence: Synthetic oligonucleotide
cggggggtcggtgcaagaggtg

SEQ ID NO: 170396 - DNA, 23 bp, Artificial Sequence
  Description of Artificial Sequence: Synthetic oligonucleotide
ggggggtcggtgcaagaggtgca

SEQ ID NO: 170397 - DNA, 23 bp, Artificial Sequence
  Description of Artificial Sequence: Synthetic oligonucleotide
gggggtcggtgcaagaggtgcag

SEQ ID NO: 170398 - DNA, 23 bp, Artificial Sequence
  Description of Artificial Sequence: Synthetic oligonucleotide
ggggtcggtgcaagaggtgcagc

SEQ ID NO: 170399 - DNA, 23 bp, Artificial Sequence
  Description of Artificial Sequence: Synthetic oligonucleotide
gggtcggtgcaagaggtgcagcg

SEQ ID NO: 170400 - DNA, 23 bp, Artificial Sequence
  Description of Artificial Sequence: Synthetic oligonucleotide
ggtcggtgcaagaggtgcagcgg

SEQ ID NO: 170401 - DNA, 24 bp, Artificial Sequence
  Description of Artificial Sequence: Synthetic oligonucleotide
gtcggtgcaagaggtgcagcggct

SEQ ID NO: 170402 - DNA, 25 bp, Artificial Sequence
  Description of Artificial Sequence: Synthetic oligonucleotide
tcggtgcaagaggtgcagcggctca

SEQ ID NO: 170403 - DNA, 24 bp, Artificial Sequence
  Description of Artificial Sequence: Synthetic oligonucleotide
cggtgcaagaggtgcagcggctca

SEQ ID NO: 170404 - DNA, 24 bp, Artificial Sequence
  Description of Artificial Sequence: Synthetic oligonucleotide
ggtgcaagaggtgcagcggctcac

SEQ ID NO: 170405 - DNA, 25 bp, Artificial Sequence
  Description of Artificial Sequence: Synthetic oligonucleotide
gtgcaagaggtgcagcggctcacca

SEQ ID NO: 170406 - DNA, 25 bp, Artificial Sequence
  Description of Artificial Sequence: Synthetic oligonucleotide
tgcaagaggtgcagcggctcaccag

SEQ ID NO: 170407 - DNA, 24 bp, Artificial Sequence
  Description of Artificial Sequence: Synthetic oligonucleotide
gcaagaggtgcagcggctcaccag

SEQ ID NO: 170408 - DNA, 24 bp, Artificial Sequence
  Description of Artificial Sequence: Synthetic oligonucleotide
caagaggtgcagcggctcaccagg

SEQ ID NO: 170409 - DNA, 24 bp, Artificial Sequence
  Description of Artificial Sequence: Synthetic oligonucleotide
aagaggtgcagcggctcaccaggg

SEQ ID NO: 170410 - DNA, 23 bp, Artificial Sequence
  Description of Artificial Sequence: Synthetic oligonucleotide
agaggtgcagcggctcaccaggg

SEQ ID NO: 170411 - DNA, 22 bp, Artificial Sequence
  Description of Artificial Sequence: Synthetic oligonucleotide
gaggtgcagcggctcaccaggg

SEQ ID NO: 170412 - DNA, 22 bp, Artificial Sequence
  Description of Artificial Sequence: Synthetic oligonucleotide
aggtgcagcggctcaccagggc

SEQ ID NO: 170413 - DNA, 21 bp, Artificial Sequence
  Description of Artificial Sequence: Synthetic oligonucleotide
ggtgcagcggctcaccagggc

SEQ ID NO: 170414 - DNA, 22 bp, Artificial Sequence
  Description of Artificial Sequence: Synthetic oligonucleotide
gtgcagcggctcaccagggcct

SEQ ID NO: 170415 - DNA, 22 bp, Artificial Sequence
  Description of Artificial Sequence: Synthetic oligonucleotide
tgcagcggctcaccagggcctg

SEQ ID NO: 170416 - DNA, 21 bp, Artificial Sequence
  Description of Artificial Sequence: Synthetic oligonucleotide
gcagcggctcaccagggcctg

SEQ ID NO: 170417 - DNA, 21 bp, Artificial Sequence
  Description of Artificial Sequence: Synthetic oligonucleotide
cagcggctcaccagggcctgc

SEQ ID NO: 170418 - DNA, 22 bp, Artificial Sequence
  Description of Artificial Sequence: Synthetic oligonucleotide
agcggctcaccagggcctgcca

SEQ ID NO: 170419 - DNA, 21 bp, Artificial Sequence
  Description of Artificial Sequence: Synthetic oligonucleotide
gcggctcaccagggcctgcca

SEQ ID NO: 170420 - DNA, 21 bp, Artificial Sequence
  Description of Artificial Sequence: Synthetic oligonucleotide
cggctcaccagggcctgccac

SEQ ID NO: 170421 - DNA, 22 bp, Artificial Sequence
  Description of Artificial Sequence: Synthetic oligonucleotide
ggctcaccagggcctgccacca

SEQ ID NO: 170422 - DNA, 22 bp, Artificial Sequence
  Description of Artificial Sequence: Synthetic oligonucleotide
gctcaccagggcctgccaccag

SEQ ID NO: 170423 - DNA, 22 bp, Artificial Sequence
  Description of Artificial Sequence: Synthetic oligonucleotide
ctcaccagggcctgccaccagg

SEQ ID NO: 170424 - DNA, 22 bp, Artificial Sequence
  Description of Artificial Sequence: Synthetic oligonucleotide
tcaccagggcctgccaccaggc

SEQ ID NO: 170425 - DNA, 21 bp, Artificial Sequence
  Description of Artificial Sequence: Synthetic oligonucleotide
caccagggcctgccaccaggc

SEQ ID NO: 170426 - DNA, 23 bp, Artificial Sequence
  Description of Artificial Sequence: Synthetic oligonucleotide
accagggcctgccaccaggccat

SEQ ID NO: 170427 - DNA, 22 bp, Artificial Sequence
  Description of Artificial Sequence: Synthetic oligonucleotide
ccagggcctgccaccaggccat

SEQ ID NO: 170428 - DNA, 24 bp, Artificial Sequence
  Description of Artificial Sequence: Synthetic oligonucleotide
cagggcctgccaccaggccatgat

SEQ ID NO: 170429 - DNA, 24 bp, Artificial Sequence
  Description of Artificial Sequence: Synthetic oligonucleotide
agggcctgccaccaggccatgatg

SEQ ID NO: 170430 - DNA, 23 bp, Artificial Sequence
  Description of Artificial Sequence: Synthetic oligonucleotide
gggcctgccaccaggccatgatg

SEQ ID NO: 170431 - DNA, 24 bp, Artificial Sequence
  Description of Artificial Sequence: Synthetic oligonucleotide
ggcctgccaccaggccatgatggt

SEQ ID NO: 170432 - DNA, 24 bp, Artificial Sequence
  Description of Artificial Sequence: Synthetic oligonucleotide
gcctgccaccaggccatgatggtc

SEQ ID NO: 170433 - DNA, 25 bp, Artificial Sequence
  Description of Artificial Sequence: Synthetic oligonucleotide
cctgccaccaggccatgatggtcga

SEQ ID NO: 170434 - DNA, 25 bp, Artificial Sequence
  Description of Artificial Sequence: Synthetic oligonucleotide
ctgccaccaggccatgatggtcgac

SEQ ID NO: 170435 - DNA, 26 bp, Artificial Sequence
  Description of Artificial Sequence: Synthetic oligonucleotide
tgccaccaggccatgatggtcgacca

SEQ ID NO: 170436 - DNA, 25 bp, Artificial Sequence
  Description of Artificial Sequence: Synthetic oligonucleotide
gccaccaggccatgatggtcgacca

SEQ ID NO: 170437 - DNA, 25 bp, Artificial Sequence
  Description of Artificial Sequence: Synthetic oligonucleotide
ccaccaggccatgatggtcgaccag

SEQ ID NO: 170438 - DNA, 25 bp, Artificial Sequence
  Description of Artificial Sequence: Synthetic oligonucleotide
caccaggccatgatggtcgaccagg

SEQ ID NO: 170439 - DNA, 25 bp, Artificial Sequence
  Description of Artificial Sequence: Synthetic oligonucleotide
accaggccatgatggtcgaccaggc

SEQ ID NO: 170440 - DNA, 24 bp, Artificial Sequence
  Description of Artificial Sequence: Synthetic oligonucleotide
ccaggccatgatggtcgaccaggc

SEQ ID NO: 170441 - DNA, 26 bp, Artificial Sequence
  Description of Artificial Sequence: Synthetic oligonucleotide
caggccatgatggtcgaccaggccaa

SEQ ID NO: 170442 - DNA, 26 bp, Artificial Sequence
  Description of Artificial Sequence: Synthetic oligonucleotide
aggccatgatggtcgaccaggccaac

SEQ ID NO: 170443 - DNA, 25 bp, Artificial Sequence
  Description of Artificial Sequence: Synthetic oligonucleotide
ggccatgatggtcgaccaggccaac

SEQ ID NO: 170444 - DNA, 25 bp, Artificial Sequence
  Description of Artificial Sequence: Synthetic oligonucleotide
gccatgatggtcgaccaggccaacg

SEQ ID NO: 170445 - DNA, 25 bp, Artificial Sequence
  Description of Artificial Sequence: Synthetic oligonucleotide
ccatgatggtcgaccaggccaacgg

SEQ ID NO: 170446 - DNA, 27 bp, Artificial Sequence
  Description of Artificial Sequence: Synthetic oligonucleotide
catgatggtcgaccaggccaacggcat

SEQ ID NO: 170447 - DNA, 27 bp, Artificial Sequence
  Description of Artificial Sequence: Synthetic oligonucleotide
atgatggtcgaccaggccaacggcatc

SEQ ID NO: 170448 - DNA, 26 bp, Artificial Sequence
  Description of Artificial Sequence: Synthetic oligonucleotide
tgatggtcgaccaggccaacggcatc

SEQ ID NO: 170449 - DNA, 25 bp, Artificial Sequence
  Description of Artificial Sequence: Synthetic oligonucleotide
gatggtcgaccaggccaacggcatc

SEQ ID NO: 170450 - DNA, 26 bp, Artificial Sequence
  Description of Artificial Sequence: Synthetic oligonucleotide
atggtcgaccaggccaacggcatcga

SEQ ID NO: 170451 - DNA, 25 bp, Artificial Sequence
  Description of Artificial Sequence: Synthetic oligonucleotide
tggtcgaccaggccaacggcatcga

SEQ ID NO: 170452 - DNA, 24 bp, Artificial Sequence
  Description of Artificial Sequence: Synthetic oligonucleotide
ggtcgaccaggccaacggcatcga

SEQ ID NO: 170453 - DNA, 24 bp, Artificial Sequence
  Description of Artificial Sequence: Synthetic oligonucleotide
gtcgaccaggccaacggcatcgag

SEQ ID NO: 170454 - DNA, 24 bp, Artificial Sequence
  Description of Artificial Sequence: Synthetic oligonucleotide
tcgaccaggccaacggcatcgagg

SEQ ID NO: 170455 - DNA, 23 bp, Artificial Sequence
  Description of Artificial Sequence: Synthetic oligonucleotide
cgaccaggccaacggcatcgagg

SEQ ID NO: 170456 - DNA, 23 bp, Artificial Sequence
  Description of Artificial Sequence: Synthetic oligonucleotide
gaccaggccaacggcatcgaggc

SEQ ID NO: 170457 - DNA, 23 bp, Artificial Sequence
  Description of Artificial Sequence: Synthetic oligonucleotide
accaggccaacggcatcgaggcc

SEQ ID NO: 170458 - DNA, 22 bp, Artificial Sequence
  Description of Artificial Sequence: Synthetic oligonucleotide
ccaggccaacggcatcgaggcc

SEQ ID NO: 170459 - DNA, 23 bp, Artificial Sequence
  Description of Artificial Sequence: Synthetic oligonucleotide
caggccaacggcatcgaggccgt

SEQ ID NO: 170460 - DNA, 24 bp, Artificial Sequence
  Description of Artificial Sequence: Synthetic oligonucleotide
aggccaacggcatcgaggccgtgt

SEQ ID NO: 170461 - DNA, 23 bp, Artificial Sequence
  Description of Artificial Sequence: Synthetic oligonucleotide
ggccaacggcatcgaggccgtgt

SEQ ID NO: 170462 - DNA, 23 bp, Artificial Sequence
  Description of Artificial Sequence: Synthetic oligonucleotide
gccaacggcatcgaggccgtgtg

SEQ ID NO: 170463 - DNA, 23 bp, Artificial Sequence
  Description of Artificial Sequence: Synthetic oligonucleotide
ccaacggcatcgaggccgtgtgg

SEQ ID NO: 170464 - DNA, 24 bp, Artificial Sequence
  Description of Artificial Sequence: Synthetic oligonucleotide
caacggcatcgaggccgtgtggca

SEQ ID NO: 170465 - DNA, 24 bp, Artificial Sequence
  Description of Artificial Sequence: Synthetic oligonucleotide
aacggcatcgaggccgtgtggcac

SEQ ID NO: 170466 - DNA, 23 bp, Artificial Sequence
  Description of Artificial Sequence: Synthetic oligonucleotide
acggcatcgaggccgtgtggcac

SEQ ID NO: 170467 - DNA, 22 bp, Artificial Sequence
  Description of Artificial Sequence: Synthetic oligonucleotide
cggcatcgaggccgtgtggcac

SEQ ID NO: 170468 - DNA, 23 bp, Artificial Sequence
  Description of Artificial Sequence: Synthetic oligonucleotide
ggcatcgaggccgtgtggcacga

SEQ ID NO: 170469 - DNA, 23 bp, Artificial Sequence
  Description of Artificial Sequence: Synthetic oligonucleotide
gcatcgaggccgtgtggcacgac

SEQ ID NO: 170470 - DNA, 24 bp, Artificial Sequence
  Description of Artificial Sequence: Synthetic oligonucleotide
catcgaggccgtgtggcacgacga

SEQ ID NO: 170471 - DNA, 25 bp, Artificial Sequence
  Description of Artificial Sequence: Synthetic oligonucleotide
atcgaggccgtgtggcacgacgaga

SEQ ID NO: 170472 - DNA, 24 bp, Artificial Sequence
  Description of Artificial Sequence: Synthetic oligonucleotide
tcgaggccgtgtggcacgacgaga

SEQ ID NO: 170473 - DNA, 23 bp, Artificial Sequence
  Description of Artificial Sequence: Synthetic oligonucleotide
cgaggccgtgtggcacgacgaga

SEQ ID NO: 170474 - DNA, 23 bp, Artificial Sequence
  Description of Artificial Sequence: Synthetic oligonucleotide
gaggccgtgtggcacgacgagag

SEQ ID NO: 170475 - DNA, 23 bp, Artificial Sequence
  Description of Artificial Sequence: Synthetic oligonucleotide
aggccgtgtggcacgacgagagc

SEQ ID NO: 170476 - DNA, 22 bp, Artificial Sequence
  Description of Artificial Sequence: Synthetic oligonucleotide
ggccgtgtggcacgacgagagc

SEQ ID NO: 170477 - DNA, 23 bp, Artificial Sequence
  Description of Artificial Sequence: Synthetic oligonucleotide
gccgtgtggcacgacgagagcca

SEQ ID NO: 170478 - DNA, 23 bp, Artificial Sequence
  Description of Artificial Sequence: Synthetic oligonucleotide
ccgtgtggcacgacgagagccac

SEQ ID NO: 170479 - DNA, 24 bp, Artificial Sequence
  Description of Artificial Sequence: Synthetic oligonucleotide
cgtgtggcacgacgagagccacct

SEQ ID NO: 170480 - DNA, 26 bp, Artificial Sequence
  Description of Artificial Sequence: Synthetic oligonucleotide
gtgtggcacgacgagagccacctgaa

SEQ ID NO: 170481 - DNA, 27 bp, Artificial Sequence
  Description of Artificial Sequence: Synthetic oligonucleotide
tgtggcacgacgagagccacctgaaca

SEQ ID NO: 170482 - DNA, 27 bp, Artificial Sequence
  Description of Artificial Sequence: Synthetic oligonucleotide
gtggcacgacgagagccacctgaacaa

SEQ ID NO: 170483 - DNA, 27 bp, Artificial Sequence
  Description of Artificial Sequence: Synthetic oligonucleotide
tggcacgacgagagccacctgaacaag

SEQ ID NO: 170484 - DNA, 27 bp, Artificial Sequence
  Description of Artificial Sequence: Synthetic oligonucleotide
ggcacgacgagagccacctgaacaagt

SEQ ID NO: 170485 - DNA, 28 bp, Artificial Sequence
  Description of Artificial Sequence: Synthetic oligonucleotide
gcacgacgagagccacctgaacaagtac

SEQ ID NO: 170486 - DNA, 28 bp, Artificial Sequence
  Description of Artificial Sequence: Synthetic oligonucleotide
cacgacgagagccacctgaacaagtacc

SEQ ID NO: 170487 - DNA, 29 bp, Artificial Sequence
  Description of Artificial Sequence: Synthetic oligonucleotide
acgacgagagccacctgaacaagtacctg

SEQ ID NO: 170488 - DNA, 28 bp, Artificial Sequence
  Description of Artificial Sequence: Synthetic oligonucleotide
cgacgagagccacctgaacaagtacctg

SEQ ID NO: 170489 - DNA, 28 bp, Artificial Sequence
  Description of Artificial Sequence: Synthetic oligonucleotide
gacgagagccacctgaacaagtacctgc

SEQ ID NO: 170490 - DNA, 29 bp, Artificial Sequence
  Description of Artificial Sequence: Synthetic oligonucleotide
acgagagccacctgaacaagtacctgctg

SEQ ID NO: 170491 - DNA, 28 bp, Artificial Sequence
  Description of Artificial Sequence: Synthetic oligonucleotide
cgagagccacctgaacaagtacctgctg

SEQ ID NO: 170492 - DNA, 28 bp, Artificial Sequence
  Description of Artificial Sequence: Synthetic oligonucleotide
gagagccacctgaacaagtacctgctgc

SEQ ID NO: 170493 - DNA, 28 bp, Artificial Sequence
  Description of Artificial Sequence: Synthetic oligonucleotide
agagccacctgaacaagtacctgctgcg

SEQ ID NO: 170494 - DNA, 27 bp, Artificial Sequence
  Description of Artificial Sequence: Synthetic oligonucleotide
gagccacctgaacaagtacctgctgcg

SEQ ID NO: 170495 - DNA, 27 bp, Artificial Sequence
  Description of Artificial Sequence: Synthetic oligonucleotide
agccacctgaacaagtacctgctgcgc

SEQ ID NO: 170496 - DNA, 26 bp, Artificial Sequence
  Description of Artificial Sequence: Synthetic oligonucleotide
gccacctgaacaagtacctgctgcgc

SEQ ID NO: 170497 - DNA, 27 bp, Artificial Sequence
  Description of Artificial Sequence: Synthetic oligonucleotide
ccacctgaacaagtacctgctgcgcca

SEQ ID NO: 170498 - DNA, 27 bp, Artificial Sequence
  Description of Artificial Sequence: Synthetic oligonucleotide
cacctgaacaagtacctgctgcgccac

SEQ ID NO: 170499 - DNA, 30 bp, Artificial Sequence
  Description of Artificial Sequence: Synthetic oligonucleotide
acctgaacaagtacctgctgcgccacaaac

SEQ ID NO: 170500 - DNA, 29 bp, Artificial Sequence
  Description of Artificial Sequence: Synthetic oligonucleotide
cctgaacaagtacctgctgcgccacaaac

SEQ ID NO: 170501 - DNA, 29 bp, Artificial Sequence
  Description of Artificial Sequence: Synthetic oligonucleotide
ctgaacaagtacctgctgcgccacaaacc

SEQ ID NO: 170502 - DNA, 29 bp, Artificial Sequence
  Description of Artificial Sequence: Synthetic oligonucleotide
tgaacaagtacctgctgcgccacaaaccc

SEQ ID NO: 170503 - DNA, 28 bp, Artificial Sequence
  Description of Artificial Sequence: Synthetic oligonucleotide
gaacaagtacctgctgcgccacaaaccc

SEQ ID NO: 170504 - DNA, 29 bp, Artificial Sequence
  Description of Artificial Sequence: Synthetic oligonucleotide
aacaagtacctgctgcgccacaaacccac

SEQ ID NO: 170505 - DNA, 28 bp, Artificial Sequence
  Description of Artificial Sequence: Synthetic oligonucleotide
acaagtacctgctgcgccacaaacccac

SEQ ID NO: 170506 - DNA, 27 bp, Artificial Sequence
  Description of Artificial Sequence: Synthetic oligonucleotide
caagtacctgctgcgccacaaacccac

SEQ ID NO: 170507 - DNA, 27 bp, Artificial Sequence
  Description of Artificial Sequence: Synthetic oligonucleotide
aagtacctgctgcgccacaaacccacc

SEQ ID NO: 170508 - DNA, 27 bp, Artificial Sequence
  Description of Artificial Sequence: Synthetic oligonucleotide
agtacctgctgcgccacaaacccacca

SEQ ID NO: 170509 - DNA, 27 bp, Artificial Sequence
  Description of Artificial Sequence: Synthetic oligonucleotide
gtacctgctgcgccacaaacccaccaa

SEQ ID NO: 170510 - DNA, 27 bp, Artificial Sequence
  Description of Artificial Sequence: Synthetic oligonucleotide
tacctgctgcgccacaaacccaccaag

SEQ ID NO: 170511 - DNA, 26 bp, Artificial Sequence
  Description of Artificial Sequence: Synthetic oligonucleotide
acctgctgcgccacaaacccaccaag

SEQ ID NO: 170512 - DNA, 25 bp, Artificial Sequence
  Description of Artificial Sequence: Synthetic oligonucleotide
cctgctgcgccacaaacccaccaag

SEQ ID NO: 170513 - DNA, 26 bp, Artificial Sequence
  Description of Artificial Sequence: Synthetic oligonucleotide
ctgctgcgccacaaacccaccaaggt

SEQ ID NO: 170514 - DNA, 26 bp, Artificial Sequence
  Description of Artificial Sequence: Synthetic oligonucleotide
tgctgcgccacaaacccaccaaggtg

SEQ ID NO: 170515 - DNA, 25 bp, Artificial Sequence
  Description of Artificial Sequence: Synthetic oligonucleotide
gctgcgccacaaacccaccaaggtg

SEQ ID NO: 170516 - DNA, 26 bp, Artificial Sequence
  Description of Artificial Sequence: Synthetic oligonucleotide
ctgcgccacaaacccaccaaggtgct

SEQ ID NO: 170517 - DNA, 27 bp, Artificial Sequence
  Description of Artificial Sequence: Synthetic oligonucleotide
tgcgccacaaacccaccaaggtgctct

SEQ ID NO: 170518 - DNA, 26 bp, Artificial Sequence
  Description of Artificial Sequence: Synthetic oligonucleotide
gcgccacaaacccaccaaggtgctct

SEQ ID NO: 170519 - DNA, 26 bp, Artificial Sequence
  Description of Artificial Sequence: Synthetic oligonucleotide
cgccacaaacccaccaaggtgctctc

SEQ ID NO: 170520 - DNA, 26 bp, Artificial Sequence
  Description of Artificial Sequence: Synthetic oligonucleotide
gccacaaacccaccaaggtgctctcc

SEQ ID NO: 170521 - DNA, 26 bp, Artificial Sequence
  Description of Artificial Sequence: Synthetic oligonucleotide
ccacaaacccaccaaggtgctctccc

SEQ ID NO: 170522 - DNA, 26 bp, Artificial Sequence
  Description of Artificial Sequence: Synthetic oligonucleotide
cacaaacccaccaaggtgctctcccc

SEQ ID NO: 170523 - DNA, 26 bp, Artificial Sequence
  Description of Artificial Sequence: Synthetic oligonucleotide
acaaacccaccaaggtgctctccccc

SEQ ID NO: 170524 - DNA, 25 bp, Artificial Sequence
  Description of Artificial Sequence: Synthetic oligonucleotide
caaacccaccaaggtgctctccccc

SEQ ID NO: 170525 - DNA, 26 bp, Artificial Sequence
  Description of Artificial Sequence: Synthetic oligonucleotide
aaacccaccaaggtgctctcccccga

SEQ ID NO: 170526 - DNA, 25 bp, Artificial Sequence
  Description of Artificial Sequence: Synthetic oligonucleotide
aacccaccaaggtgctctcccccga

SEQ ID NO: 170527 - DNA, 24 bp, Artificial Sequence
  Description of Artificial Sequence: Synthetic oligonucleotide
acccaccaaggtgctctcccccga

SEQ ID NO: 170528 - DNA, 23 bp, Artificial Sequence
  Description of Artificial Sequence: Synthetic oligonucleotide
cccaccaaggtgctctcccccga

SEQ ID NO: 170529 - DNA, 25 bp, Artificial Sequence
  Description of Artificial Sequence: Synthetic oligonucleotide
ccaccaaggtgctctcccccgagta

SEQ ID NO: 170530 - DNA, 27 bp, Artificial Sequence
  Description of Artificial Sequence: Synthetic oligonucleotide
caccaaggtgctctcccccgagtactt

SEQ ID NO: 170531 - DNA, 27 bp, Artificial Sequence
  Description of Artificial Sequence: Synthetic oligonucleotide
accaaggtgctctcccccgagtacttg

SEQ ID NO: 170532 - DNA, 27 bp, Artificial Sequence
  Description of Artificial Sequence: Synthetic oligonucleotide
ccaaggtgctctcccccgagtacttgt

SEQ ID NO: 170533 - DNA, 27 bp, Artificial Sequence
  Description of Artificial Sequence: Synthetic oligonucleotide
caaggtgctctcccccgagtacttgtg

SEQ ID NO: 170534 - DNA, 27 bp, Artificial Sequence
  Description of Artificial Sequence: Synthetic oligonucleotide
aaggtgctctcccccgagtacttgtgg

SEQ ID NO: 170535 - DNA, 26 bp, Artificial Sequence
  Description of Artificial Sequence: Synthetic oligonucleotide
aggtgctctcccccgagtacttgtgg

SEQ ID NO: 170536 - DNA, 25 bp, Artificial Sequence
  Description of Artificial Sequence: Synthetic oligonucleotide
ggtgctctcccccgagtacttgtgg

SEQ ID NO: 170537 - DNA, 26 bp, Artificial Sequence
  Description of Artificial Sequence: Synthetic oligonucleotide
gtgctctcccccgagtacttgtggga

SEQ ID NO: 170538 - DNA, 26 bp, Artificial Sequence
  Description of Artificial Sequence: Synthetic oligonucleotide
tgctctcccccgagtacttgtgggac

SEQ ID NO: 170539 - DNA, 25 bp, Artificial Sequence
  Description of Artificial Sequence: Synthetic oligonucleotide
gctctcccccgagtacttgtgggac

SEQ ID NO: 170540 - DNA, 26 bp, Artificial Sequence
  Description of Artificial Sequence: Synthetic oligonucleotide
ctctcccccgagtacttgtgggacca

SEQ ID NO: 170541 - DNA, 26 bp, Artificial Sequence
  Description of Artificial Sequence: Synthetic oligonucleotide
tctcccccgagtacttgtgggaccag

SEQ ID NO: 170542 - DNA, 25 bp, Artificial Sequence
  Description of Artificial Sequence: Synthetic oligonucleotide
ctcccccgagtacttgtgggaccag

SEQ ID NO: 170543 - DNA, 26 bp, Artificial Sequence
  Description of Artificial Sequence: Synthetic oligonucleotide
tcccccgagtacttgtgggaccagca

SEQ ID NO: 170544 - DNA, 25 bp, Artificial Sequence
  Description of Artificial Sequence: Synthetic oligonucleotide
cccccgagtacttgtgggaccagca

SEQ ID NO: 170545 - DNA, 25 bp, Artificial Sequence
  Description of Artificial Sequence: Synthetic oligonucleotide
ccccgagtacttgtgggaccagcag

SEQ ID NO: 170546 - DNA, 26 bp, Artificial Sequence
  Description of Artificial Sequence: Synthetic oligonucleotide
cccgagtacttgtgggaccagcagct

SEQ ID NO: 170547 - DNA, 26 bp, Artificial Sequence
  Description of Artificial Sequence: Synthetic oligonucleotide
ccgagtacttgtgggaccagcagctg

SEQ ID NO: 170548 - DNA, 27 bp, Artificial Sequence
  Description of Artificial Sequence: Synthetic oligonucleotide
cgagtacttgtgggaccagcagctgct

SEQ ID NO: 170549 - DNA, 27 bp, Artificial Sequence
  Description of Artificial Sequence: Synthetic oligonucleotide
gagtacttgtgggaccagcagctgctg

SEQ ID NO: 170550 - DNA, 27 bp, Artificial Sequence
  Description of Artificial Sequence: Synthetic oligonucleotide
agtacttgtgggaccagcagctgctgg

SEQ ID NO: 170551 - DNA, 26 bp, Artificial Sequence
  Description of Artificial Sequence: Synthetic oligonucleotide
gtacttgtgggaccagcagctgctgg

SEQ ID NO: 170552 - DNA, 26 bp, Artificial Sequence
  Description of Artificial Sequence: Synthetic oligonucleotide
tacttgtgggaccagcagctgctggg

SEQ ID NO: 170553 - DNA, 25 bp, Artificial Sequence
  Description of Artificial Sequence: Synthetic oligonucleotide
acttgtgggaccagcagctgctggg

SEQ ID NO: 170554 - DNA, 24 bp, Artificial Sequence
  Description of Artificial Sequence: Synthetic oligonucleotide
cttgtgggaccagcagctgctggg

SEQ ID NO: 170555 - DNA, 25 bp, Artificial Sequence
  Description of Artificial Sequence: Synthetic oligonucleotide
ttgtgggaccagcagctgctgggct

SEQ ID NO: 170556 - DNA, 24 bp, Artificial Sequence
  Description of Artificial Sequence: Synthetic oligonucleotide
tgtgggaccagcagctgctgggct

SEQ ID NO: 170557 - DNA, 23 bp, Artificial Sequence
  Description of Artificial Sequence: Synthetic oligonucleotide
gtgggaccagcagctgctgggct

SEQ ID NO: 170558 - DNA, 23 bp, Artificial Sequence
  Description of Artificial Sequence: Synthetic oligonucleotide
tgggaccagcagctgctgggctg

SEQ ID NO: 170559 - DNA, 22 bp, Artificial Sequence
  Description of Artificial Sequence: Synthetic oligonucleotide
gggaccagcagctgctgggctg

SEQ ID NO: 170560 - DNA, 22 bp, Artificial Sequence
  Description of Artificial Sequence: Synthetic oligonucleotide
ggaccagcagctgctgggctgg

SEQ ID NO: 170561 - DNA, 22 bp, Artificial Sequence
  Description of Artificial Sequence: Synthetic oligonucleotide
gaccagcagctgctgggctggc

SEQ ID NO: 170562 - DNA, 22 bp, Artificial Sequence
  Description of Artificial Sequence: Synthetic oligonucleotide
accagcagctgctgggctggcc

SEQ ID NO: 170563 - DNA, 21 bp, Artificial Sequence
  Description of Artificial Sequence: Synthetic oligonucleotide
ccagcagctgctgggctggcc

SEQ ID NO: 170564 - DNA, 21 bp, Artificial Sequence
  Description of Artificial Sequence: Synthetic oligonucleotide
cagcagctgctgggctggccc

SEQ ID NO: 170565 - DNA, 21 bp, Artificial Sequence
  Description of Artificial Sequence: Synthetic oligonucleotide
agcagctgctgggctggcccg

SEQ ID NO: 170566 - DNA, 20 bp, Artificial Sequence
  Description of Artificial Sequence: Synthetic oligonucleotide
gcagctgctgggctggcccg

SEQ ID NO: 170567 - DNA, 20 bp, Artificial Sequence
  Description of Artificial Sequence: Synthetic oligonucleotide
cagctgctgggctggcccgc

SEQ ID NO: 170568 - DNA, 20 bp, Artificial Sequence
  Description of Artificial Sequence: Synthetic oligonucleotide
agctgctgggctggcccgcc

SEQ ID NO: 170569 - DNA, 20 bp, Artificial Sequence
  Description of Artificial Sequence: Synthetic oligonucleotide
gctgctgggctggcccgcct

SEQ ID NO: 170570 - DNA, 20 bp, Artificial Sequence
  Description of Artificial Sequence: Synthetic oligonucleotide
ctgctgggctggcccgccgt

SEQ ID NO: 170571 - DNA, 20 bp, Artificial Sequence
  Description of Artificial Sequence: Synthetic oligonucleotide
tgctgggctggcccgccgtc

SEQ ID NO: 170572 - DNA, 20 bp, Artificial Sequence
  Description of Artificial Sequence: Synthetic oligonucleotide
gctgggctggcccgccgtct

SEQ ID NO: 170573 - DNA, 20 bp, Artificial Sequence
  Description of Artificial Sequence: Synthetic oligonucleotide
ctgggctggcccgccgtcct

SEQ ID NO: 170574 - DNA, 21 bp, Artificial Sequence
  Description of Artificial Sequence: Synthetic oligonucleotide
tgggctggcccgccgtcctga

SEQ ID NO: 170575 - DNA, 20 bp, Artificial Sequence
  Description of Artificial Sequence: Synthetic oligonucleotide
gggctggcccgccgtcctga

SEQ ID NO: 170576 - DNA, 20 bp, Artificial Sequence
  Description of Artificial Sequence: Synthetic oligonucleotide
ggctggcccgccgtcctgag

SEQ ID NO: 170577 - DNA, 22 bp, Artificial Sequence
  Description of Artificial Sequence: Synthetic oligonucleotide
gctggcccgccgtcctgaggaa

SEQ ID NO: 170578 - DNA, 22 bp, Artificial Sequence
  Description of Artificial Sequence: Synthetic oligonucleotide
ctggcccgccgtcctgaggaag

SEQ ID NO: 170579 - DNA, 23 bp, Artificial Sequence
  Description of Artificial Sequence: Synthetic oligonucleotide
tggcccgccgtcctgaggaagct

SEQ ID NO: 170580 - DNA, 22 bp, Artificial Sequence
  Description of Artificial Sequence: Synthetic oligonucleotide
ggcccgccgtcctgaggaagct

SEQ ID NO: 170581 - DNA, 23 bp, Artificial Sequence
  Description of Artificial Sequence: Synthetic oligonucleotide
gcccgccgtcctgaggaagctga

SEQ ID NO: 170582 - DNA, 23 bp, Artificial Sequence
  Description of Artificial Sequence: Synthetic oligonucleotide
cccgccgtcctgaggaagctgag

SEQ ID NO: 170583 - DNA, 25 bp, Artificial Sequence
  Description of Artificial Sequence: Synthetic oligonucleotide
ccgccgtcctgaggaagctgaggtt

SEQ ID NO: 170584 - DNA, 26 bp, Artificial Sequence
  Description of Artificial Sequence: Synthetic oligonucleotide
cgccgtcctgaggaagctgaggttca

SEQ ID NO: 170585 - DNA, 27 bp, Artificial Sequence
  Description of Artificial Sequence: Synthetic oligonucleotide
gccgtcctgaggaagctgaggttcact

SEQ ID NO: 170586 - DNA, 27 bp, Artificial Sequence
  Description of Artificial Sequence: Synthetic oligonucleotide
ccgtcctgaggaagctgaggttcactg

SEQ ID NO: 170587 - DNA, 27 bp, Artificial Sequence
  Description of Artificial Sequence: Synthetic oligonucleotide
cgtcctgaggaagctgaggttcactgc

SEQ ID NO: 170588 - DNA, 27 bp, Artificial Sequence
  Description of Artificial Sequence: Synthetic oligonucleotide
gtcctgaggaagctgaggttcactgcg

SEQ ID NO: 170589 - DNA, 27 bp, Artificial Sequence
  Description of Artificial Sequence: Synthetic oligonucleotide
tcctgaggaagctgaggttcactgcgg

SEQ ID NO: 170590 - DNA, 27 bp, Artificial Sequence
  Description of Artificial Sequence: Synthetic oligonucleotide
cctgaggaagctgaggttcactgcggt

SEQ ID NO: 170591 - DNA, 27 bp, Artificial Sequence
  Description of Artificial Sequence: Synthetic oligonucleotide
ctgaggaagctgaggttcactgcggtg

SEQ ID NO: 170592 - DNA, 27 bp, Artificial Sequence
  Description of Artificial Sequence: Synthetic oligonucleotide
tgaggaagctgaggttcactgcggtgc

SEQ ID NO: 170593 - DNA, 26 bp, Artificial Sequence
  Description of Artificial Sequence: Synthetic oligonucleotide
gaggaagctgaggttcactgcggtgc

SEQ ID NO: 170594 - DNA, 26 bp, Artificial Sequence
  Description of Artificial Sequence: Synthetic oligonucleotide
aggaagctgaggttcactgcggtgcc

SEQ ID NO: 170595 - DNA, 25 bp, Artificial Sequence
  Description of Artificial Sequence: Synthetic oligonucleotide
ggaagctgaggttcactgcggtgcc

SEQ ID NO: 170596 - DNA, 27 bp, Artificial Sequence
  Description of Artificial Sequence: Synthetic oligonucleotide
gaagctgaggttcactgcggtgcccaa

SEQ ID NO: 170597 - DNA, 27 bp, Artificial Sequence
  Description of Artificial Sequence: Synthetic oligonucleotide
aagctgaggttcactgcggtgcccaag

SEQ ID NO: 170598 - DNA, 27 bp, Artificial Sequence
  Description of Artificial Sequence: Synthetic oligonucleotide
agctgaggttcactgcggtgcccaaga

SEQ ID NO: 170599 - DNA, 27 bp, Artificial Sequence
  Description of Artificial Sequence: Synthetic oligonucleotide
gctgaggttcactgcggtgcccaagaa

SEQ ID NO: 170600 - DNA, 27 bp, Artificial Sequence
  Description of Artificial Sequence: Synthetic oligonucleotide
ctgaggttcactgcggtgcccaagaac

SEQ ID NO: 170601 - DNA, 27 bp, Artificial Sequence
  Description of Artificial Sequence: Synthetic oligonucleotide
tgaggttcactgcggtgcccaagaacc

SEQ ID NO: 170602 - DNA, 27 bp, Artificial Sequence
  Description of Artificial Sequence: Synthetic oligonucleotide
gaggttcactgcggtgcccaagaacca

SEQ ID NO: 170603 - DNA, 27 bp, Artificial Sequence
  Description of Artificial Sequence: Synthetic oligonucleotide
aggttcactgcggtgcccaagaaccac

SEQ ID NO: 170604 - DNA, 26 bp, Artificial Sequence
  Description of Artificial Sequence: Synthetic oligonucleotide
ggttcactgcggtgcccaagaaccac

SEQ ID NO: 170605 - DNA, 27 bp, Artificial Sequence
  Description of Artificial Sequence: Synthetic oligonucleotide
gttcactgcggtgcccaagaaccacca

SEQ ID NO: 170606 - DNA, 27 bp, Artificial Sequence
  Description of Artificial Sequence: Synthetic oligonucleotide
ttcactgcggtgcccaagaaccaccag

SEQ ID NO: 170607 - DNA, 26 bp, Artificial Sequence
  Description of Artificial Sequence: Synthetic oligonucleotide
tcactgcggtgcccaagaaccaccag

SEQ ID NO: 170608 - DNA, 25 bp, Artificial Sequence
  Description of Artificial Sequence: Synthetic oligonucleotide
cactgcggtgcccaagaaccaccag

SEQ ID NO: 170609 - DNA, 25 bp, Artificial Sequence
  Description of Artificial Sequence: Synthetic oligonucleotide
actgcggtgcccaagaaccaccagg

SEQ ID NO: 170610 - DNA, 24 bp, Artificial Sequence
  Description of Artificial Sequence: Synthetic oligonucleotide
ctgcggtgcccaagaaccaccagg

SEQ ID NO: 170611 - DNA, 24 bp, Artificial Sequence
  Description of Artificial Sequence: Synthetic oligonucleotide
tgcggtgcccaagaaccaccaggc

SEQ ID NO: 170612 - DNA, 23 bp, Artificial Sequence
  Description of Artificial Sequence: Synthetic oligonucleotide
gcggtgcccaagaaccaccaggc

SEQ ID NO: 170613 - DNA, 23 bp, Artificial Sequence
  Description of Artificial Sequence: Synthetic oligonucleotide
cggtgcccaagaaccaccaggcg

SEQ ID NO: 170614 - DNA, 24 bp, Artificial Sequence
  Description of Artificial Sequence: Synthetic oligonucleotide
ggtgcccaagaaccaccaggcggt

SEQ ID NO: 170615 - DNA, 24 bp, Artificial Sequence
  Description of Artificial Sequence: Synthetic oligonucleotide
gtgcccaagaaccaccaggcggtc

SEQ ID NO: 170616 - DNA, 24 bp, Artificial Sequence
  Description of Artificial Sequence: Synthetic oligonucleotide
tgcccaagaaccaccaggcggtcc

SEQ ID NO: 170617 - DNA, 23 bp, Artificial Sequence
  Description of Artificial Sequence: Synthetic oligonucleotide
gcccaagaaccaccaggcggtcc

SEQ ID NO: 170618 - DNA, 23 bp, Artificial Sequence
  Description of Artificial Sequence: Synthetic oligonucleotide
cccaagaaccaccaggcggtccg

SEQ ID NO: 170619 - DNA, 25 bp, Artificial Sequence
  Description of Artificial Sequence: Synthetic oligonucleotide
ccaagaaccaccaggcggtccggaa

SEQ ID NO: 170620 - DNA, 25 bp, Artificial Sequence
  Description of Artificial Sequence: Synthetic oligonucleotide
caagaaccaccaggcggtccggaac

SEQ ID NO: 170621 - DNA, 25 bp, Artificial Sequence
  Description of Artificial Sequence: Synthetic oligonucleotide
aagaaccaccaggcggtccggaacc

SEQ ID NO: 170622 - DNA, 24 bp, Artificial Sequence
  Description of Artificial Sequence: Synthetic oligonucleotide
agaaccaccaggcggtccggaacc

SEQ ID NO: 170623 - DNA, 23 bp, Artificial Sequence
  Description of Artificial Sequence: Synthetic oligonucleotide
gaaccaccaggcggtccggaacc

SEQ ID NO: 170624 - DNA, 23 bp, Artificial Sequence
  Description of Artificial Sequence: Synthetic oligonucleotide
aaccaccaggcggtccggaaccc

SEQ ID NO: 170625 - DNA, 22 bp, Artificial Sequence
  Description of Artificial Sequence: Synthetic oligonucleotide
accaccaggcggtccggaaccc

SEQ ID NO: 170626 - DNA, 21 bp, Artificial Sequence
  Description of Artificial Sequence: Synthetic oligonucleotide
ccaccaggcggtccggaaccc

SEQ ID NO: 170627 - DNA, 22 bp, Artificial Sequence
  Description of Artificial Sequence: Synthetic oligonucleotide
caccaggcggtccggaacccgt

SEQ ID NO: 170628 - DNA, 23 bp, Artificial Sequence
  Description of Artificial Sequence: Synthetic oligonucleotide
accaggcggtccggaacccgtga

SEQ ID NO: 170629 - DNA, 31 bp, Artificial Sequence
  Description of Artificial Sequence: Synthetic oligonucleotide
tgtccactactatgtcttcaccgaccagctg

SEQ ID NO: 170630 - DNA, 30 bp, Artificial Sequence
  Description of Artificial Sequence: Synthetic oligonucleotide
gtccactactatgtcttcaccgaccagctg

SEQ ID NO: 170631 - DNA, 30 bp, Artificial Sequence
  Description of Artificial Sequence: Synthetic oligonucleotide
tccactactatgtcttcaccgaccagctgg

SEQ ID NO: 170632 - DNA, 29 bp, Artificial Sequence
  Description of Artificial Sequence: Synthetic oligonucleotide
ccactactatgtcttcaccgaccagctgg

SEQ ID NO: 170633 - DNA, 29 bp, Artificial Sequence
  Description of Artificial Sequence: Synthetic oligonucleotide
cactactatgtcttcaccgaccagctggc

SEQ ID NO: 170634 - DNA, 29 bp, Artificial Sequence
  Description of Artificial Sequence: Synthetic oligonucleotide
actactatgtcttcaccgaccagctggcc

SEQ ID NO: 170635 - DNA, 28 bp, Artificial Sequence
  Description of Artificial Sequence: Synthetic oligonucleotide
ctactatgtcttcaccgaccagctggcc

SEQ ID NO: 170636 - DNA, 28 bp, Artificial Sequence
  Description of Artificial Sequence: Synthetic oligonucleotide
tactatgtcttcaccgaccagctggccg

SEQ ID NO: 170637 - DNA, 27 bp, Artificial Sequence
  Description of Artificial Sequence: Synthetic oligonucleotide
actatgtcttcaccgaccagctggccg

SEQ ID NO: 170638 - DNA, 26 bp, Artificial Sequence
  Description of Artificial Sequence: Synthetic oligonucleotide
ctatgtcttcaccgaccagctggccg

SEQ ID NO: 170639 - DNA, 26 bp, Artificial Sequence
  Description of Artificial Sequence: Synthetic oligonucleotide
tatgtcttcaccgaccagctggccgc

SEQ ID NO: 170640 - DNA, 25 bp, Artificial Sequence
  Description of Artificial Sequence: Synthetic oligonucleotide
atgtcttcaccgaccagctggccgc

SEQ ID NO: 170641 - DNA, 24 bp, Artificial Sequence
  Description of Artificial Sequence: Synthetic oligonucleotide
tgtcttcaccgaccagctggccgc

SEQ ID NO: 170642 - DNA, 23 bp, Artificial Sequence
  Description of Artificial Sequence: Synthetic oligonucleotide
gtcttcaccgaccagctggccgc

SEQ ID NO: 170643 - DNA, 23 bp, Artificial Sequence
  Description of Artificial Sequence: Synthetic oligonucleotide
tcttcaccgaccagctggccgcg

SEQ ID NO: 170644 - DNA, 22 bp, Artificial Sequence
  Description of Artificial Sequence: Synthetic oligonucleotide
cttcaccgaccagctggccgcg

SEQ ID NO: 170645 - DNA, 23 bp, Artificial Sequence
  Description of Artificial Sequence: Synthetic oligonucleotide
ttcaccgaccagctggccgcggt

SEQ ID NO: 170646 - DNA, 22 bp, Artificial Sequence
  Description of Artificial Sequence: Synthetic oligonucleotide
tcaccgaccagctggccgcggt

SEQ ID NO: 170647 - DNA, 21 bp, Artificial Sequence
  Description of Artificial Sequence: Synthetic oligonucleotide
caccgaccagctggccgcggt

SEQ ID NO: 170648 - DNA, 21 bp, Artificial Sequence
  Description of Artificial Sequence: Synthetic oligonucleotide
accgaccagctggccgcggtg

SEQ ID NO: 170649 - DNA, 20 bp, Artificial Sequence
  Description of Artificial Sequence: Synthetic oligonucleotide
ccgaccagctggccgcggtg

SEQ ID NO: 170650 - DNA, 20 bp, Artificial Sequence
  Description of Artificial Sequence: Synthetic oligonucleotide
cgaccagctggccgcggtgc

SEQ ID NO: 170651 - DNA, 20 bp, Artificial Sequence
  Description of Artificial Sequence: Synthetic oligonucleotide
gaccagctggccgcggtgcc

SEQ ID NO: 170652 - DNA, 20 bp, Artificial Sequence
  Description of Artificial Sequence: Synthetic oligonucleotide
accagctggccgcggtgccc

SEQ ID NO: 170653 - DNA, 20 bp, Artificial Sequence
  Description of Artificial Sequence: Synthetic oligonucleotide
ccagctggccgcggtgccct

SEQ ID NO: 170654 - DNA, 20 bp, Artificial Sequence
  Description of Artificial Sequence: Synthetic oligonucleotide
cagctggccgcggtgcccct

SEQ ID NO: 170655 - DNA, 20 bp, Artificial Sequence
  Description of Artificial Sequence: Synthetic oligonucleotide
agctggccgcggtgccccgt

SEQ ID NO: 170656 - DNA, 20 bp, Artificial Sequence
  Description of Artificial Sequence: Synthetic oligonucleotide
gctggccgcggtgccccgtt

SEQ ID NO: 170657 - DNA, 20 bp, Artificial Sequence
  Description of Artificial Sequence: Synthetic oligonucleotide
ctggccgcggtgccccgctt

SEQ ID NO: 170658 - DNA, 20 bp, Artificial Sequence
  Description of Artificial Sequence: Synthetic oligonucleotide
tggccgcggtgccccgcgtt

SEQ ID NO: 170659 - DNA, 26 bp, Artificial Sequence
  Description of Artificial Sequence: Synthetic oligonucleotide
tggcaggacgtgtccatgcgccgtat

SEQ ID NO: 170660 - DNA, 25 bp, Artificial Sequence
  Description of Artificial Sequence: Synthetic oligonucleotide
ggcaggacgtgtccatgcgccgtat

SEQ ID NO: 170661 - DNA, 25 bp, Artificial Sequence
  Description of Artificial Sequence: Synthetic oligonucleotide
gcaggacgtgtccatgcgccgtatg

SEQ ID NO: 170662 - DNA, 26 bp, Artificial Sequence
  Description of Artificial Sequence: Synthetic oligonucleotide
caggacgtgtccatgcgccgtatgga

SEQ ID NO: 170663 - DNA, 27 bp, Artificial Sequence
  Description of Artificial Sequence: Synthetic oligonucleotide
aggacgtgtccatgcgccgtatggaga

SEQ ID NO: 170664 - DNA, 27 bp, Artificial Sequence
  Description of Artificial Sequence: Synthetic oligonucleotide
ggacgtgtccatgcgccgtatggagat

SEQ ID NO: 170665 - DNA, 27 bp, Artificial Sequence
  Description of Artificial Sequence: Synthetic oligonucleotide
gacgtgtccatgcgccgtatggagatg

SEQ ID NO: 170666 - DNA, 29 bp, Artificial Sequence
  Description of Artificial Sequence: Synthetic oligonucleotide
acgtgtccatgcgccgtatggagatgatc

SEQ ID NO: 170667 - DNA, 28 bp, Artificial Sequence
  Description of Artificial Sequence: Synthetic oligonucleotide
cgtgtccatgcgccgtatggagatgatc

SEQ ID NO: 170668 - DNA, 29 bp, Artificial Sequence
  Description of Artificial Sequence: Synthetic oligonucleotide
gtgtccatgcgccgtatggagatgatcag

SEQ ID NO: 170669 - DNA, 30 bp, Artificial Sequence
  Description of Artificial Sequence: Synthetic oligonucleotide
tgtccatgcgccgtatggagatgatcagtg

SEQ ID NO: 170670 - DNA, 29 bp, Artificial Sequence
  Description of Artificial Sequence: Synthetic oligonucleotide
gtccatgcgccgtatggagatgatcagtg

SEQ ID NO: 170671 - DNA, 30 bp, Artificial Sequence
  Description of Artificial Sequence: Synthetic oligonucleotide
tccatgcgccgtatggagatgatcagtgac

SEQ ID NO: 170672 - DNA, 29 bp, Artificial Sequence
  Description of Artificial Sequence: Synthetic oligonucleotide
ccatgcgccgtatggagatgatcagtgac

SEQ ID NO: 170673 - DNA, 31 bp, Artificial Sequence
  Description of Artificial Sequence: Synthetic oligonucleotide
catgcgccgtatggagatgatcagtgacttc

SEQ ID NO: 170674 - DNA, 32 bp, Artificial Sequence
  Description of Artificial Sequence: Synthetic oligonucleotide
atgcgccgtatggagatgatcagtgacttctg

SEQ ID NO: 170675 - DNA, 31 bp, Artificial Sequence
  Description of Artificial Sequence: Synthetic oligonucleotide
tgcgccgtatggagatgatcagtgacttctg

SEQ ID NO: 170676 - DNA, 30 bp, Artificial Sequence
  Description of Artificial Sequence: Synthetic oligonucleotide
gcgccgtatggagatgatcagtgacttctg

SEQ ID NO: 170677 - DNA, 30 bp, Artificial Sequence
  Description of Artificial Sequence: Synthetic oligonucleotide
cgccgtatggagatgatcagtgacttctgc

SEQ ID NO: 170678 - DNA, 30 bp, Artificial Sequence
  Description of Artificial Sequence: Synthetic oligonucleotide
gccgtatggagatgatcagtgacttctgcg

SEQ ID NO: 170679 - DNA, 31 bp, Artificial Sequence
  Description of Artificial Sequence: Synthetic oligonucleotide
ccgtatggagatgatcagtgacttctgcgag

SEQ ID NO: 170680 - DNA, 31 bp, Artificial Sequence
  Description of Artificial Sequence: Synthetic oligonucleotide
cgtatggagatgatcagtgacttctgcgagc

SEQ ID NO: 170681 - DNA, 31 bp, Artificial Sequence
  Description of Artificial Sequence: Synthetic oligonucleotide
gtatggagatgatcagtgacttctgcgagcg

SEQ ID NO: 170682 - DNA, 31 bp, Artificial Sequence
  Description of Artificial Sequence: Synthetic oligonucleotide
tatggagatgatcagtgacttctgcgagcgg

SEQ ID NO: 170683 - DNA, 25 bp, Artificial Sequence
  Description of Artificial Sequence: Synthetic oligonucleotide
tggctcccattgtctgggagggcac

SEQ ID NO: 170684 - DNA, 24 bp, Artificial Sequence
  Description of Artificial Sequence: Synthetic oligonucleotide
ggctcccattgtctgggagggcac

SEQ ID NO: 170685 - DNA, 26 bp, Artificial Sequence
  Description of Artificial Sequence: Synthetic oligonucleotide
gctcccattgtctgggagggcacgtt

SEQ ID NO: 170686 - DNA, 27 bp, Artificial Sequence
  Description of Artificial Sequence: Synthetic oligonucleotide
ctcccattgtctgggagggcacgttca

SEQ ID NO: 170687 - DNA, 28 bp, Artificial Sequence
  Description of Artificial Sequence: Synthetic oligonucleotide
tcccattgtctgggagggcacgttcaac

SEQ ID NO: 170688 - DNA, 27 bp, Artificial Sequence
  Description of Artificial Sequence: Synthetic oligonucleotide
cccattgtctgggagggcacgttcaac

SEQ ID NO: 170689 - DNA, 29 bp, Artificial Sequence
  Description of Artificial Sequence: Synthetic oligonucleotide
ccattgtctgggagggcacgttcaacatc

SEQ ID NO: 170690 - DNA, 29 bp, Artificial Sequence
  Description of Artificial Sequence: Synthetic oligonucleotide
cattgtctgggagggcacgttcaacatcg

SEQ ID NO: 170691 - DNA, 30 bp, Artificial Sequence
  Description of Artificial Sequence: Synthetic oligonucleotide
attgtctgggagggcacgttcaacatcgac

SEQ ID NO: 170692 - DNA, 29 bp, Artificial Sequence
  Description of Artificial Sequence: Synthetic oligonucleotide
ttgtctgggagggcacgttcaacatcgac

SEQ ID NO: 170693 - DNA, 28 bp, Artificial Sequence
  Description of Artificial Sequence: Synthetic oligonucleotide
tgtctgggagggcacgttcaacatcgac

SEQ ID NO: 170694 - DNA, 27 bp, Artificial Sequence
  Description of Artificial Sequence: Synthetic oligonucleotide
gtctgggagggcacgttcaacatcgac

SEQ ID NO: 170695 - DNA, 29 bp, Artificial Sequence
  Description of Artificial Sequence: Synthetic oligonucleotide
tctgggagggcacgttcaacatcgacatc

SEQ ID NO: 170696 - DNA, 28 bp, Artificial Sequence
  Description of Artificial Sequence: Synthetic oligonucleotide
ctgggagggcacgttcaacatcgacatc

SEQ ID NO: 170697 - DNA, 28 bp, Artificial Sequence
  Description of Artificial Sequence: Synthetic oligonucleotide
tgggagggcacgttcaacatcgacatcc

SEQ ID NO: 170698 - DNA, 27 bp, Artificial Sequence
  Description of Artificial Sequence: Synthetic oligonucleotide
gggagggcacgttcaacatcgacatcc

SEQ ID NO: 170699 - DNA, 28 bp, Artificial Sequence
  Description of Artificial Sequence: Synthetic oligonucleotide
ggagggcacgttcaacatcgacatcctc

SEQ ID NO: 170700 - DNA, 30 bp, Artificial Sequence
  Description of Artificial Sequence: Synthetic oligonucleotide
gagggcacgttcaacatcgacatcctcaac

SEQ ID NO: 170701 - DNA, 30 bp, Artificial Sequence
  Description of Artificial Sequence: Synthetic oligonucleotide
agggcacgttcaacatcgacatcctcaacg

SEQ ID NO: 170702 - DNA, 29 bp, Artificial Sequence
  Description of Artificial Sequence: Synthetic oligonucleotide
gggcacgttcaacatcgacatcctcaacg

SEQ ID NO: 170703 - DNA, 30 bp, Artificial Sequence
  Description of Artificial Sequence: Synthetic oligonucleotide
ggcacgttcaacatcgacatcctcaacgag

SEQ ID NO: 170704 - DNA, 30 bp, Artificial Sequence
  Description of Artificial Sequence: Synthetic oligonucleotide
gcacgttcaacatcgacatcctcaacgagc

SEQ ID NO: 170705 - DNA, 31 bp, Artificial Sequence
  Description of Artificial Sequence: Synthetic oligonucleotide
cacgttcaacatcgacatcctcaacgagcag

SEQ ID NO: 170706 - DNA, 33 bp, Artificial Sequence
  Description of Artificial Sequence: Synthetic oligonucleotide
acgttcaacatcgacatcctcaacgagcagttc

SEQ ID NO: 170707 - DNA, 32 bp, Artificial Sequence
  Description of Artificial Sequence: Synthetic oligonucleotide
cgttcaacatcgacatcctcaacgagcagttc

SEQ ID NO: 170708 - DNA, 33 bp, Artificial Sequence
  Description of Artificial Sequence: Synthetic oligonucleotide
gttcaacatcgacatcctcaacgagcagttcag

SEQ ID NO: 170709 - DNA, 27 bp, Artificial Sequence
  Description of Artificial Sequence: Synthetic oligonucleotide
gcctacatccccaaggacgagggcaat

SEQ ID NO: 170710 - DNA, 29 bp, Artificial Sequence
  Description of Artificial Sequence: Synthetic oligonucleotide
cctacatccccaaggacgagggcaatttc

SEQ ID NO: 170711 - DNA, 31 bp, Artificial Sequence
  Description of Artificial Sequence: Synthetic oligonucleotide
ctacatccccaaggacgagggcaatttctac

SEQ ID NO: 170712 - DNA, 33 bp, Artificial Sequence
  Description of Artificial Sequence: Synthetic oligonucleotide
tacatccccaaggacgagggcaatttctactac

SEQ ID NO: 170713 - DNA, 32 bp, Artificial Sequence
  Description of Artificial Sequence: Synthetic oligonucleotide
acatccccaaggacgagggcaatttctactac

SEQ ID NO: 170714 - DNA, 31 bp, Artificial Sequence
  Description of Artificial Sequence: Synthetic oligonucleotide
catccccaaggacgagggcaatttctactac

SEQ ID NO: 170715 - DNA, 31 bp, Artificial Sequence
  Description of Artificial Sequence: Synthetic oligonucleotide
atccccaaggacgagggcaatttctactacc

SEQ ID NO: 170716 - DNA, 30 bp, Artificial Sequence
  Description of Artificial Sequence: Synthetic oligonucleotide
tccccaaggacgagggcaatttctactacc

SEQ ID NO: 170717 - DNA, 29 bp, Artificial Sequence
  Description of Artificial Sequence: Synthetic oligonucleotide
ccccaaggacgagggcaatttctactacc

SEQ ID NO: 170718 - DNA, 30 bp, Artificial Sequence
  Description of Artificial Sequence: Synthetic oligonucleotide
cccaaggacgagggcaatttctactacctg

SEQ ID NO: 170719 - DNA, 30 bp, Artificial Sequence
  Description of Artificial Sequence: Synthetic oligonucleotide
ccaaggacgagggcaatttctactacctgg

SEQ ID NO: 170720 - DNA, 30 bp, Artificial Sequence
  Description of Artificial Sequence: Synthetic oligonucleotide
caaggacgagggcaatttctactacctggg

SEQ ID NO: 170721 - DNA, 30 bp, Artificial Sequence
  Description of Artificial Sequence: Synthetic oligonucleotide
aaggacgagggcaatttctactacctgggg

SEQ ID NO: 170722 - DNA, 29 bp, Artificial Sequence
  Description of Artificial Sequence: Synthetic oligonucleotide
aggacgagggcaatttctactacctgggg

SEQ ID NO: 170723 - DNA, 28 bp, Artificial Sequence
  Description of Artificial Sequence: Synthetic oligonucleotide
ggacgagggcaatttctactacctgggg

SEQ ID NO: 170724 - DNA, 28 bp, Artificial Sequence
  Description of Artificial Sequence: Synthetic oligonucleotide
gacgagggcaatttctactacctggggg

SEQ ID NO: 170725 - DNA, 28 bp, Artificial Sequence
  Description of Artificial Sequence: Synthetic oligonucleotide
acgagggcaatttctactacctgggggg

SEQ ID NO: 170726 - DNA, 27 bp, Artificial Sequence
  Description of Artificial Sequence: Synthetic oligonucleotide
cgagggcaatttctactacctgggggg

SEQ ID NO: 170727 - DNA, 27 bp, Artificial Sequence
  Description of Artificial Sequence: Synthetic oligonucleotide
gagggcaatttctactacctggggggg

SEQ ID NO: 170728 - DNA, 29 bp, Artificial Sequence
  Description of Artificial Sequence: Synthetic oligonucleotide
agggcaatttctactacctgggggggttc

SEQ ID NO: 170729 - DNA, 28 bp, Artificial Sequence
  Description of Artificial Sequence: Synthetic oligonucleotide
gggcaatttctactacctgggggggttc

SEQ ID NO: 170730 - DNA, 30 bp, Artificial Sequence
  Description of Artificial Sequence: Synthetic oligonucleotide
ggcaatttctactacctgggggggttcttc

SEQ ID NO: 170731 - DNA, 30 bp, Artificial Sequence
  Description of Artificial Sequence: Synthetic oligonucleotide
gcaatttctactacctgggggggttcttcg

SEQ ID NO: 170732 - DNA, 30 bp, Artificial Sequence
  Description of Artificial Sequence: Synthetic oligonucleotide
caatttctactacctgggggggttcttcgg

SEQ ID NO: 170733 - DNA, 30 bp, Artificial Sequence
  Description of Artificial Sequence: Synthetic oligonucleotide
aatttctactacctgggggggttcttcggg

SEQ ID NO: 170734 - DNA, 27 bp, Artificial Sequence
  Description of Artificial Sequence: Synthetic oligonucleotide
agtcccaggcctacatccccaaggaca

SEQ ID NO: 170735 - DNA, 27 bp, Artificial Sequence
  Description of Artificial Sequence: Synthetic oligonucleotide
gtcccaggcctacatccccaaggacaa

SEQ ID NO: 170736 - DNA, 27 bp, Artificial Sequence
  Description of Artificial Sequence: Synthetic oligonucleotide
tcccaggcctacatccccaaggacaag

SEQ ID NO: 170737 - DNA, 26 bp, Artificial Sequence
  Description of Artificial Sequence: Synthetic oligonucleotide
cccaggcctacatccccaaggacaag

SEQ ID NO: 170738 - DNA, 26 bp, Artificial Sequence
  Description of Artificial Sequence: Synthetic oligonucleotide
ccaggcctacatccccaaggacaagg

SEQ ID NO: 170739 - DNA, 26 bp, Artificial Sequence
  Description of Artificial Sequence: Synthetic oligonucleotide
caggcctacatccccaaggacaaggg

SEQ ID NO: 170740 - DNA, 26 bp, Artificial Sequence
  Description of Artificial Sequence: Synthetic oligonucleotide
aggcctacatccccaaggacaagggc

SEQ ID NO: 170741 - DNA, 25 bp, Artificial Sequence
  Description of Artificial Sequence: Synthetic oligonucleotide
ggcctacatccccaaggacaagggc

SEQ ID NO: 170742 - DNA, 27 bp, Artificial Sequence
  Description of Artificial Sequence: Synthetic oligonucleotide
gcctacatccccaaggacaagggcgat

SEQ ID NO: 170743 - DNA, 29 bp, Artificial Sequence
  Description of Artificial Sequence: Synthetic oligonucleotide
cctacatccccaaggacaagggcgatttc

SEQ ID NO: 170744 - DNA, 31 bp, Artificial Sequence
  Description of Artificial Sequence: Synthetic oligonucleotide
ctacatccccaaggacaagggcgatttctac

SEQ ID NO: 170745 - DNA, 33 bp, Artificial Sequence
  Description of Artificial Sequence: Synthetic oligonucleotide
tacatccccaaggacaagggcgatttctactac

SEQ ID NO: 170746 - DNA, 32 bp, Artificial Sequence
  Description of Artificial Sequence: Synthetic oligonucleotide
acatccccaaggacaagggcgatttctactac

SEQ ID NO: 170747 - DNA, 31 bp, Artificial Sequence
  Description of Artificial Sequence: Synthetic oligonucleotide
catccccaaggacaagggcgatttctactac

SEQ ID NO: 170748 - DNA, 31 bp, Artificial Sequence
  Description of Artificial Sequence: Synthetic oligonucleotide
atccccaaggacaagggcgatttctactacc

SEQ ID NO: 170749 - DNA, 30 bp, Artificial Sequence
  Description of Artificial Sequence: Synthetic oligonucleotide
tccccaaggacaagggcgatttctactacc

SEQ ID NO: 170750 - DNA, 29 bp, Artificial Sequence
  Description of Artificial Sequence: Synthetic oligonucleotide
ccccaaggacaagggcgatttctactacc

SEQ ID NO: 170751 - DNA, 30 bp, Artificial Sequence
  Description of Artificial Sequence: Synthetic oligonucleotide
cccaaggacaagggcgatttctactacctg

SEQ ID NO: 170752 - DNA, 30 bp, Artificial Sequence
  Description of Artificial Sequence: Synthetic oligonucleotide
ccaaggacaagggcgatttctactacctgg

SEQ ID NO: 170753 - DNA, 30 bp, Artificial Sequence
  Description of Artificial Sequence: Synthetic oligonucleotide
caaggacaagggcgatttctactacctggg

SEQ ID NO: 170754 - DNA, 30 bp, Artificial Sequence
  Description of Artificial Sequence: Synthetic oligonucleotide
aaggacaagggcgatttctactacctgggg

SEQ ID NO: 170755 - DNA, 29 bp, Artificial Sequence
  Description of Artificial Sequence: Synthetic oligonucleotide
aggacaagggcgatttctactacctgggg

SEQ ID NO: 170756 - DNA, 28 bp, Artificial Sequence
  Description of Artificial Sequence: Synthetic oligonucleotide
ggacaagggcgatttctactacctgggg

SEQ ID NO: 170757 - DNA, 28 bp, Artificial Sequence
  Description of Artificial Sequence: Synthetic oligonucleotide
gacaagggcgatttctactacctggggg

SEQ ID NO: 170758 - DNA, 28 bp, Artificial Sequence
  Description of Artificial Sequence: Synthetic oligonucleotide
acaagggcgatttctactacctgggggg

SEQ ID NO: 170759 - DNA, 27 bp, Artificial Sequence
  Description of Artificial Sequence: Synthetic oligonucleotide
caagggcgatttctactacctgggggg

SEQ ID NO: 170760 - DNA, 27 bp, Artificial Sequence
  Description of Artificial Sequence: Synthetic oligonucleotide
aagggcgatttctactacctggggggg

SEQ ID NO: 170761 - DNA, 27 bp, Artificial Sequence
  Description of Artificial Sequence: Synthetic oligonucleotide
tggtgtgcgtggacgtggacatggaga

SEQ ID NO: 170762 - DNA, 27 bp, Artificial Sequence
  Description of Artificial Sequence: Synthetic oligonucleotide
ggtgtgcgtggacgtggacatggagat

SEQ ID NO: 170763 - DNA, 27 bp, Artificial Sequence
  Description of Artificial Sequence: Synthetic oligonucleotide
gtgtgcgtggacgtggacatggagatc

SEQ ID NO: 170764 - DNA, 27 bp, Artificial Sequence
  Description of Artificial Sequence: Synthetic oligonucleotide
tgtgcgtggacgtggacatggagatcc

SEQ ID NO: 170765 - DNA, 26 bp, Artificial Sequence
  Description of Artificial Sequence: Synthetic oligonucleotide
gtgcgtggacgtggacatggagatcc

SEQ ID NO: 170766 - DNA, 26 bp, Artificial Sequence
  Description of Artificial Sequence: Synthetic oligonucleotide
tgcgtggacgtggacatggagatccg

SEQ ID NO: 170767 - DNA, 25 bp, Artificial Sequence
  Description of Artificial Sequence: Synthetic oligonucleotide
gcgtggacgtggacatggagatccg

SEQ ID NO: 170768 - DNA, 25 bp, Artificial Sequence
  Description of Artificial Sequence: Synthetic oligonucleotide
cgtggacgtggacatggagatccgc

SEQ ID NO: 170769 - DNA, 26 bp, Artificial Sequence
  Description of Artificial Sequence: Synthetic oligonucleotide
gtggacgtggacatggagatccgcga

SEQ ID NO: 170770 - DNA, 26 bp, Artificial Sequence
  Description of Artificial Sequence: Synthetic oligonucleotide
tggacgtggacatggagatccgcgac

SEQ ID NO: 170771 - DNA, 25 bp, Artificial Sequence
  Description of Artificial Sequence: Synthetic oligonucleotide
ggacgtggacatggagatccgcgac

SEQ ID NO: 170772 - DNA, 26 bp, Artificial Sequence
  Description of Artificial Sequence: Synthetic oligonucleotide
gacgtggacatggagatccgcgacca

SEQ ID NO: 170773 - DNA, 26 bp, Artificial Sequence
  Description of Artificial Sequence: Synthetic oligonucleotide
acgtggacatggagatccgcgaccac

SEQ ID NO: 170774 - DNA, 25 bp, Artificial Sequence
  Description of Artificial Sequence: Synthetic oligonucleotide
cgtggacatggagatccgcgaccac

SEQ ID NO: 170775 - DNA, 26 bp, Artificial Sequence
  Description of Artificial Sequence: Synthetic oligonucleotide
gtggacatggagatccgcgaccacgt

SEQ ID NO: 170776 - DNA, 26 bp, Artificial Sequence
  Description of Artificial Sequence: Synthetic oligonucleotide
tggacatggagatccgcgaccacgtg

SEQ ID NO: 170777 - DNA, 25 bp, Artificial Sequence
  Description of Artificial Sequence: Synthetic oligonucleotide
ggacatggagatccgcgaccacgtg

SEQ ID NO: 170778 - DNA, 25 bp, Artificial Sequence
  Description of Artificial Sequence: Synthetic oligonucleotide
gacatggagatccgcgaccacgtgg

SEQ ID NO: 170779 - DNA, 25 bp, Artificial Sequence
  Description of Artificial Sequence: Synthetic oligonucleotide
acatggagatccgcgaccacgtggg

SEQ ID NO: 170780 - DNA, 24 bp, Artificial Sequence
  Description of Artificial Sequence: Synthetic oligonucleotide
catggagatccgcgaccacgtggg

SEQ ID NO: 170781 - DNA, 24 bp, Artificial Sequence
  Description of Artificial Sequence: Synthetic oligonucleotide
atggagatccgcgaccacgtgggc

SEQ ID NO: 170782 - DNA, 23 bp, Artificial Sequence
  Description of Artificial Sequence: Synthetic oligonucleotide
tggagatccgcgaccacgtgggc

SEQ ID NO: 170783 - DNA, 22 bp, Artificial Sequence
  Description of Artificial Sequence: Synthetic oligonucleotide
ggagatccgcgaccacgtgggc

SEQ ID NO: 170784 - DNA, 23 bp, Artificial Sequence
  Description of Artificial Sequence: Synthetic oligonucleotide
gagatccgcgaccacgtgggcgt

SEQ ID NO: 170785 - DNA, 23 bp, Artificial Sequence
  Description of Artificial Sequence: Synthetic oligonucleotide
agatccgcgaccacgtgggcgtg

SEQ ID NO: 170786 - DNA, 22 bp, Artificial Sequence
  Description of Artificial Sequence: Synthetic oligonucleotide
gatccgcgaccacgtgggcgtg

SEQ ID NO: 170787 - DNA, 23 bp, Artificial Sequence
  Description of Artificial Sequence: Synthetic oligonucleotide
atccgcgaccacgtgggcgtgga

SEQ ID NO: 170788 - DNA, 26 bp, Artificial Sequence
  Description of Artificial Sequence: Synthetic oligonucleotide
acgtgggcgtggagatcctgactcca

SEQ ID NO: 170789 - DNA, 25 bp, Artificial Sequence
  Description of Artificial Sequence: Synthetic oligonucleotide
cgtgggcgtggagatcctgactcca

SEQ ID NO: 170790 - DNA, 26 bp, Artificial Sequence
  Description of Artificial Sequence: Synthetic oligonucleotide
gtgggcgtggagatcctgactccact

SEQ ID NO: 170791 - DNA, 27 bp, Artificial Sequence
  Description of Artificial Sequence: Synthetic oligonucleotide
tgggcgtggagatcctgactccactgt

SEQ ID NO: 170792 - DNA, 27 bp, Artificial Sequence
  Description of Artificial Sequence: Synthetic oligonucleotide
gggcgtggagatcctgactccactgtt

SEQ ID NO: 170793 - DNA, 27 bp, Artificial Sequence
  Description of Artificial Sequence: Synthetic oligonucleotide
ggcgtggagatcctgactccactgttc

SEQ ID NO: 170794 - DNA, 27 bp, Artificial Sequence
  Description of Artificial Sequence: Synthetic oligonucleotide
gcgtggagatcctgactccactgttcg

SEQ ID NO: 170795 - DNA, 27 bp, Artificial Sequence
  Description of Artificial Sequence: Synthetic oligonucleotide
cgtggagatcctgactccactgttcgg

SEQ ID NO: 170796 - DNA, 27 bp, Artificial Sequence
  Description of Artificial Sequence: Synthetic oligonucleotide
gtggagatcctgactccactgttcggc

SEQ ID NO: 170797 - DNA, 28 bp, Artificial Sequence
  Description of Artificial Sequence: Synthetic oligonucleotide
tggagatcctgactccactgttcggcac

SEQ ID NO: 170798 - DNA, 27 bp, Artificial Sequence
  Description of Artificial Sequence: Synthetic oligonucleotide
ggagatcctgactccactgttcggcac

SEQ ID NO: 170799 - DNA, 27 bp, Artificial Sequence
  Description of Artificial Sequence: Synthetic oligonucleotide
gagatcctgactccactgttcggcacc

SEQ ID NO: 170800 - DNA, 27 bp, Artificial Sequence
  Description of Artificial Sequence: Synthetic oligonucleotide
agatcctgactccactgttcggcaccc

SEQ ID NO: 170801 - DNA, 27 bp, Artificial Sequence
  Description of Artificial Sequence: Synthetic oligonucleotide
gatcctgactccactgttcggcaccct

SEQ ID NO: 170802 - DNA, 27 bp, Artificial Sequence
  Description of Artificial Sequence: Synthetic oligonucleotide
atcctgactccactgttcggcaccctg

SEQ ID NO: 170803 - DNA, 26 bp, Artificial Sequence
  Description of Artificial Sequence: Synthetic oligonucleotide
tcctgactccactgttcggcaccctg

SEQ ID NO: 170804 - DNA, 25 bp, Artificial Sequence
  Description of Artificial Sequence: Synthetic oligonucleotide
cctgactccactgttcggcaccctg

SEQ ID NO: 170805 - DNA, 26 bp, Artificial Sequence
  Description of Artificial Sequence: Synthetic oligonucleotide
ctgactccactgttcggcaccctgca

SEQ ID NO: 170806 - DNA, 26 bp, Artificial Sequence
  Description of Artificial Sequence: Synthetic oligonucleotide
tgactccactgttcggcaccctgcac

SEQ ID NO: 170807 - DNA, 25 bp, Artificial Sequence
  Description of Artificial Sequence: Synthetic oligonucleotide
gactccactgttcggcaccctgcac

SEQ ID NO: 170808 - DNA, 25 bp, Artificial Sequence
  Description of Artificial Sequence: Synthetic oligonucleotide
actccactgttcggcaccctgcacc

SEQ ID NO: 170809 - DNA, 24 bp, Artificial Sequence
  Description of Artificial Sequence: Synthetic oligonucleotide
ctccactgttcggcaccctgcacc

SEQ ID NO: 170810 - DNA, 24 bp, Artificial Sequence
  Description of Artificial Sequence: Synthetic oligonucleotide
tccactgttcggcaccctgcaccc

SEQ ID NO: 170811 - DNA, 23 bp, Artificial Sequence
  Description of Artificial Sequence: Synthetic oligonucleotide
ccactgttcggcaccctgcaccc

SEQ ID NO: 170812 - DNA, 23 bp, Artificial Sequence
  Description of Artificial Sequence: Synthetic oligonucleotide
cactgttcggcaccctgcacccc

SEQ ID NO: 170813 - DNA, 23 bp, Artificial Sequence
  Description of Artificial Sequence: Synthetic oligonucleotide
actgttcggcaccctgcaccccg

SEQ ID NO: 170814 - DNA, 24 bp, Artificial Sequence
  Description of Artificial Sequence: Synthetic oligonucleotide
aaccaccaggcggtccggaaccgt

SEQ ID NO: 170815 - DNA, 23 bp, Artificial Sequence
  Description of Artificial Sequence: Synthetic oligonucleotide
accaccaggcggtccggaaccgt

SEQ ID NO: 170816 - DNA, 22 bp, Artificial Sequence
  Description of Artificial Sequence: Synthetic oligonucleotide
ccaccaggcggtccggaaccgt

SEQ ID NO: 170817 - DNA, 23 bp, Artificial Sequence
  Description of Artificial Sequence: Synthetic oligonucleotide
caccaggcggtccggaaccgtga

SEQ ID NO: 170818 - DNA, 25 bp, Artificial Sequence
  Description of Artificial Sequence: Synthetic oligonucleotide
gtgcccaagaaccaccaggcggtct

SEQ ID NO: 170819 - DNA, 25 bp, Artificial Sequence
  Description of Artificial Sequence: Synthetic oligonucleotide
tgcccaagaaccaccaggcggtctg

SEQ ID NO: 170820 - DNA, 24 bp, Artificial Sequence
  Description of Artificial Sequence: Synthetic oligonucleotide
gcccaagaaccaccaggcggtctg

SEQ ID NO: 170821 - DNA, 26 bp, Artificial Sequence
  Description of Artificial Sequence: Synthetic oligonucleotide
cccaagaaccaccaggcggtctggaa

SEQ ID NO: 170822 - DNA, 26 bp, Artificial Sequence
  Description of Artificial Sequence: Synthetic oligonucleotide
ccaagaaccaccaggcggtctggaac

SEQ ID NO: 170823 - DNA, 26 bp, Artificial Sequence
  Description of Artificial Sequence: Synthetic oligonucleotide
caagaaccaccaggcggtctggaacc

SEQ ID NO: 170824 - DNA, 26 bp, Artificial Sequence
  Description of Artificial Sequence: Synthetic oligonucleotide
aagaaccaccaggcggtctggaaccc

SEQ ID NO: 170825 - DNA, 25 bp, Artificial Sequence
  Description of Artificial Sequence: Synthetic oligonucleotide
agaaccaccaggcggtctggaaccc

SEQ ID NO: 170826 - DNA, 24 bp, Artificial Sequence
  Description of Artificial Sequence: Synthetic oligonucleotide
gaaccaccaggcggtctggaaccc

SEQ ID NO: 170827 - DNA, 25 bp, Artificial Sequence
  Description of Artificial Sequence: Synthetic oligonucleotide
aaccaccaggcggtctggaacccgt

SEQ ID NO: 170828 - DNA, 24 bp, Artificial Sequence
  Description of Artificial Sequence: Synthetic oligonucleotide
accaccaggcggtctggaacccgt

SEQ ID NO: 170829 - DNA, 23 bp, Artificial Sequence
  Description of Artificial Sequence: Synthetic oligonucleotide
ccaccaggcggtctggaacccgt

SEQ ID NO: 170830 - DNA, 24 bp, Artificial Sequence
  Description of Artificial Sequence: Synthetic oligonucleotide
caccaggcggtctggaacccgtga

SEQ ID NO: 170831 - DNA, 24 bp, Artificial Sequence
  Description of Artificial Sequence: Synthetic oligonucleotide
tgcccaagaaccaccaggcggtcg

SEQ ID NO: 170832 - DNA, 23 bp, Artificial Sequence
  Description of Artificial Sequence: Synthetic oligonucleotide
gcccaagaaccaccaggcggtcg

SEQ ID NO: 170833 - DNA, 23 bp, Artificial Sequence
  Description of Artificial Sequence: Synthetic oligonucleotide
cccaagaaccaccaggcggtcgg

SEQ ID NO: 170834 - DNA, 25 bp, Artificial Sequence
  Description of Artificial Sequence: Synthetic oligonucleotide
ccaagaaccaccaggcggtcgggaa

SEQ ID NO: 170835 - DNA, 25 bp, Artificial Sequence
  Description of Artificial Sequence: Synthetic oligonucleotide
caagaaccaccaggcggtcgggaac

SEQ ID NO: 170836 - DNA, 25 bp, Artificial Sequence
  Description of Artificial Sequence: Synthetic oligonucleotide
aagaaccaccaggcggtcgggaacc

SEQ ID NO: 170837 - DNA, 24 bp, Artificial Sequence
  Description of Artificial Sequence: Synthetic oligonucleotide
agaaccaccaggcggtcgggaacc

SEQ ID NO: 170838 - DNA, 23 bp, Artificial Sequence
  Description of Artificial Sequence: Synthetic oligonucleotide
gaaccaccaggcggtcgggaacc

SEQ ID NO: 170839 - DNA, 23 bp, Artificial Sequence
  Description of Artificial Sequence: Synthetic oligonucleotide
aaccaccaggcggtcgggaaccc

SEQ ID NO: 170840 - DNA, 22 bp, Artificial Sequence
  Description of Artificial Sequence: Synthetic oligonucleotide
accaccaggcggtcgggaaccc

SEQ ID NO: 170841 - DNA, 21 bp, Artificial Sequence
  Description of Artificial Sequence: Synthetic oligonucleotide
ccaccaggcggtcgggaaccc

SEQ ID NO: 170842 - DNA, 22 bp, Artificial Sequence
  Description of Artificial Sequence: Synthetic oligonucleotide
caccaggcggtcgggaacccgt

SEQ ID NO: 170843 - DNA, 23 bp, Artificial Sequence
  Description of Artificial Sequence: Synthetic oligonucleotide
accaggcggtcgggaacccgtga

SEQ ID NO: 170844 - DNA, 24 bp, Artificial Sequence
  Description of Artificial Sequence: Synthetic oligonucleotide
ggcagctgtcagtgctggaggtgg

SEQ ID NO: 170845 - DNA, 24 bp, Artificial Sequence
  Description of Artificial Sequence: Synthetic oligonucleotide
gcagctgtcagtgctggaggtggg

SEQ ID NO: 170846 - DNA, 24 bp, Artificial Sequence
  Description of Artificial Sequence: Synthetic oligonucleotide
cagctgtcagtgctggaggtgggc

SEQ ID NO: 170847 - DNA, 24 bp, Artificial Sequence
  Description of Artificial Sequence: Synthetic oligonucleotide
agctgtcagtgctggaggtgggcg

SEQ ID NO: 170848 - DNA, 23 bp, Artificial Sequence
  Description of Artificial Sequence: Synthetic oligonucleotide
gctgtcagtgctggaggtgggcg

SEQ ID NO: 170849 - DNA, 23 bp, Artificial Sequence
  Description of Artificial Sequence: Synthetic oligonucleotide
ctgtcagtgctggaggtgggcgc

SEQ ID NO: 170850 - DNA, 25 bp, Artificial Sequence
  Description of Artificial Sequence: Synthetic oligonucleotide
tgtcagtgctggaggtgggcgccta

SEQ ID NO: 170851 - DNA, 24 bp, Artificial Sequence
  Description of Artificial Sequence: Synthetic oligonucleotide
gtcagtgctggaggtgggcgccta

SEQ ID NO: 170852 - DNA, 26 bp, Artificial Sequence
  Description of Artificial Sequence: Synthetic oligonucleotide
tcagtgctggaggtgggcgcctacaa

SEQ ID NO: 170853 - DNA, 25 bp, Artificial Sequence
  Description of Artificial Sequence: Synthetic oligonucleotide
cagtgctggaggtgggcgcctacaa

SEQ ID NO: 170854 - DNA, 25 bp, Artificial Sequence
  Description of Artificial Sequence: Synthetic oligonucleotide
agtgctggaggtgggcgcctacaag

SEQ ID NO: 170855 - DNA, 24 bp, Artificial Sequence
  Description of Artificial Sequence: Synthetic oligonucleotide
gtgctggaggtgggcgcctacaag

SEQ ID NO: 170856 - DNA, 24 bp, Artificial Sequence
  Description of Artificial Sequence: Synthetic oligonucleotide
tgctggaggtgggcgcctacaagc

SEQ ID NO: 170857 - DNA, 23 bp, Artificial Sequence
  Description of Artificial Sequence: Synthetic oligonucleotide
gctggaggtgggcgcctacaagc

SEQ ID NO: 170858 - DNA, 23 bp, Artificial Sequence
  Description of Artificial Sequence: Synthetic oligonucleotide
ctggaggtgggcgcctacaagcg

SEQ ID NO: 170859 - DNA, 24 bp, Artificial Sequence
  Description of Artificial Sequence: Synthetic oligonucleotide
tggaggtgggcgcctacaagcgct

SEQ ID NO: 170860 - DNA, 23 bp, Artificial Sequence
  Description of Artificial Sequence: Synthetic oligonucleotide
ggaggtgggcgcctacaagcgct

SEQ ID NO: 170861 - DNA, 23 bp, Artificial Sequence
  Description of Artificial Sequence: Synthetic oligonucleotide
gaggtgggcgcctacaagcgctg

SEQ ID NO: 170862 - DNA, 23 bp, Artificial Sequence
  Description of Artificial Sequence: Synthetic oligonucleotide
aggtgggcgcctacaagcgctgg

SEQ ID NO: 170863 - DNA, 22 bp, Artificial Sequence
  Description of Artificial Sequence: Synthetic oligonucleotide
ggtgggcgcctacaagcgctgg

SEQ ID NO: 170864 - DNA, 23 bp, Artificial Sequence
  Description of Artificial Sequence: Synthetic oligonucleotide
gtgggcgcctacaagcgctggca

SEQ ID NO: 170865 - DNA, 23 bp, Artificial Sequence
  Description of Artificial Sequence: Synthetic oligonucleotide
tgggcgcctacaagcgctggcag

SEQ ID NO: 170866 - DNA, 22 bp, Artificial Sequence
  Description of Artificial Sequence: Synthetic oligonucleotide
gggcgcctacaagcgctggcag

SEQ ID NO: 170867 - DNA, 23 bp, Artificial Sequence
  Description of Artificial Sequence: Synthetic oligonucleotide
ggcgcctacaagcgctggcagga

SEQ ID NO: 170868 - DNA, 27 bp, Artificial Sequence
  Description of Artificial Sequence: Synthetic oligonucleotide
gacgtggacatggagttccgcgaccat

SEQ ID NO: 170869 - DNA, 27 bp, Artificial Sequence
  Description of Artificial Sequence: Synthetic oligonucleotide
acgtggacatggagttccgcgaccatg

SEQ ID NO: 170870 - DNA, 27 bp, Artificial Sequence
  Description of Artificial Sequence: Synthetic oligonucleotide
cgtggacatggagttccgcgaccatgt

SEQ ID NO: 170871 - DNA, 27 bp, Artificial Sequence
  Description of Artificial Sequence: Synthetic oligonucleotide
gtggacatggagttccgcgaccatgtg

SEQ ID NO: 170872 - DNA, 27 bp, Artificial Sequence
  Description of Artificial Sequence: Synthetic oligonucleotide
tggacatggagttccgcgaccatgtgg

SEQ ID NO: 170873 - DNA, 26 bp, Artificial Sequence
  Description of Artificial Sequence: Synthetic oligonucleotide
ggacatggagttccgcgaccatgtgg

SEQ ID NO: 170874 - DNA, 26 bp, Artificial Sequence
  Description of Artificial Sequence: Synthetic oligonucleotide
gacatggagttccgcgaccatgtggg

SEQ ID NO: 170875 - DNA, 26 bp, Artificial Sequence
  Description of Artificial Sequence: Synthetic oligonucleotide
acatggagttccgcgaccatgtgggc

SEQ ID NO: 170876 - DNA, 25 bp, Artificial Sequence
  Description of Artificial Sequence: Synthetic oligonucleotide
catggagttccgcgaccatgtgggc

SEQ ID NO: 170877 - DNA, 26 bp, Artificial Sequence
  Description of Artificial Sequence: Synthetic oligonucleotide
atggagttccgcgaccatgtgggcgt

SEQ ID NO: 170878 - DNA, 25 bp, Artificial Sequence
  Description of Artificial Sequence: Synthetic oligonucleotide
tggagttccgcgaccatgtgggcgt

SEQ ID NO: 170879 - DNA, 24 bp, Artificial Sequence
  Description of Artificial Sequence: Synthetic oligonucleotide
ggagttccgcgaccatgtgggcgt

SEQ ID NO: 170880 - DNA, 24 bp, Artificial Sequence
  Description of Artificial Sequence: Synthetic oligonucleotide
gagttccgcgaccatgtgggcgtg

SEQ ID NO: 170881 - DNA, 25 bp, Artificial Sequence
  Description of Artificial Sequence: Synthetic oligonucleotide
agttccgcgaccatgtgggcgtgga

SEQ ID NO: 170882 - DNA, 24 bp, Artificial Sequence
  Description of Artificial Sequence: Synthetic oligonucleotide
gttccgcgaccatgtgggcgtgga

SEQ ID NO: 170883 - DNA, 26 bp, Artificial Sequence
  Description of Artificial Sequence: Synthetic oligonucleotide
ttccgcgaccatgtgggcgtggagat

SEQ ID NO: 170884 - DNA, 25 bp, Artificial Sequence
  Description of Artificial Sequence: Synthetic oligonucleotide
tccgcgaccatgtgggcgtggagat

SEQ ID NO: 170885 - DNA, 24 bp, Artificial Sequence
  Description of Artificial Sequence: Synthetic oligonucleotide
ccgcgaccatgtgggcgtggagat

SEQ ID NO: 170886 - DNA, 24 bp, Artificial Sequence
  Description of Artificial Sequence: Synthetic oligonucleotide
cgcgaccatgtgggcgtggagatc

SEQ ID NO: 170887 - DNA, 25 bp, Artificial Sequence
  Description of Artificial Sequence: Synthetic oligonucleotide
gcgaccatgtgggcgtggagatcct

SEQ ID NO: 170888 - DNA, 26 bp, Artificial Sequence
  Description of Artificial Sequence: Synthetic oligonucleotide
cgaccatgtgggcgtggagatcctga

SEQ ID NO: 170889 - DNA, 27 bp, Artificial Sequence
  Description of Artificial Sequence: Synthetic oligonucleotide
gaccatgtgggcgtggagatcctgact

SEQ ID NO: 170890 - DNA, 27 bp, Artificial Sequence
  Description of Artificial Sequence: Synthetic oligonucleotide
accatgtgggcgtggagatcctgactc

SEQ ID NO: 170891 - DNA, 26 bp, Artificial Sequence
  Description of Artificial Sequence: Synthetic oligonucleotide
ccatgtgggcgtggagatcctgactc

SEQ ID NO: 170892 - DNA, 26 bp, Artificial Sequence
  Description of Artificial Sequence: Synthetic oligonucleotide
catgtgggcgtggagatcctgactcc

SEQ ID NO: 170893 - DNA, 26 bp, Artificial Sequence
  Description of Artificial Sequence: Synthetic oligonucleotide
atgtgggcgtggagatcctgactccg

SEQ ID NO: 170894 - DNA, 25 bp, Artificial Sequence
  Description of Artificial Sequence: Synthetic oligonucleotide
tgtgggcgtggagatcctgactccg

SEQ ID NO: 170895 - DNA, 23 bp, Artificial Sequence
  Description of Artificial Sequence: Synthetic oligonucleotide
gctgttcggcaccctgcacccca

SEQ ID NO: 170896 - DNA, 23 bp, Artificial Sequence
  Description of Artificial Sequence: Synthetic oligonucleotide
ctgttcggcaccctgcaccccag

SEQ ID NO: 170897 - DNA, 25 bp, Artificial Sequence
  Description of Artificial Sequence: Synthetic oligonucleotide
tgttcggcaccctgcaccccagctt

SEQ ID NO: 170898 - DNA, 24 bp, Artificial Sequence
  Description of Artificial Sequence: Synthetic oligonucleotide
gttcggcaccctgcaccccagctt

SEQ ID NO: 170899 - DNA, 26 bp, Artificial Sequence
  Description of Artificial Sequence: Synthetic oligonucleotide
ttcggcaccctgcaccccagcttcta

SEQ ID NO: 170900 - DNA, 25 bp, Artificial Sequence
  Description of Artificial Sequence: Synthetic oligonucleotide
tcggcaccctgcaccccagcttcta

SEQ ID NO: 170901 - DNA, 24 bp, Artificial Sequence
  Description of Artificial Sequence: Synthetic oligonucleotide
cggcaccctgcaccccagcttcta

SEQ ID NO: 170902 - DNA, 24 bp, Artificial Sequence
  Description of Artificial Sequence: Synthetic oligonucleotide
ggcaccctgcaccccagcttctac

SEQ ID NO: 170903 - DNA, 24 bp, Artificial Sequence
  Description of Artificial Sequence: Synthetic oligonucleotide
gcaccctgcaccccagcttctacg

SEQ ID NO: 170904 - DNA, 26 bp, Artificial Sequence
  Description of Artificial Sequence: Synthetic oligonucleotide
caccctgcaccccagcttctacggaa

SEQ ID NO: 170905 - DNA, 26 bp, Artificial Sequence
  Description of Artificial Sequence: Synthetic oligonucleotide
accctgcaccccagcttctacggaag

SEQ ID NO: 170906 - DNA, 25 bp, Artificial Sequence
  Description of Artificial Sequence: Synthetic oligonucleotide
ccctgcaccccagcttctacggaag

SEQ ID NO: 170907 - DNA, 26 bp, Artificial Sequence
  Description of Artificial Sequence: Synthetic oligonucleotide
cctgcaccccagcttctacggaagca

SEQ ID NO: 170908 - DNA, 26 bp, Artificial Sequence
  Description of Artificial Sequence: Synthetic oligonucleotide
ctgcaccccagcttctacggaagcag

SEQ ID NO: 170909 - DNA, 26 bp, Artificial Sequence
  Description of Artificial Sequence: Synthetic oligonucleotide
tgcaccccagcttctacggaagcagc

SEQ ID NO: 170910 - DNA, 25 bp, Artificial Sequence
  Description of Artificial Sequence: Synthetic oligonucleotide
gcaccccagcttctacggaagcagc

SEQ ID NO: 170911 - DNA, 25 bp, Artificial Sequence
  Description of Artificial Sequence: Synthetic oligonucleotide
caccccagcttctacggaagcagcc

SEQ ID NO: 170912 - DNA, 25 bp, Artificial Sequence
  Description of Artificial Sequence: Synthetic oligonucleotide
accccagcttctacggaagcagccg

SEQ ID NO: 170913 - DNA, 24 bp, Artificial Sequence
  Description of Artificial Sequence: Synthetic oligonucleotide
ccccagcttctacggaagcagccg

SEQ ID NO: 170914 - DNA, 24 bp, Artificial Sequence
  Description of Artificial Sequence: Synthetic oligonucleotide
cccagcttctacggaagcagccgg

SEQ ID NO: 170915 - DNA, 25 bp, Artificial Sequence
  Description of Artificial Sequence: Synthetic oligonucleotide
ccagcttctacggaagcagccggga

SEQ ID NO: 170916 - DNA, 25 bp, Artificial Sequence
  Description of Artificial Sequence: Synthetic oligonucleotide
cagcttctacggaagcagccgggag

SEQ ID NO: 170917 - DNA, 25 bp, Artificial Sequence
  Description of Artificial Sequence: Synthetic oligonucleotide
agcttctacggaagcagccgggagg

SEQ ID NO: 170918 - DNA, 26 bp, Artificial Sequence
  Description of Artificial Sequence: Synthetic oligonucleotide
ccccagtcccaggcctacatccctaa

SEQ ID NO: 170919 - DNA, 26 bp, Artificial Sequence
  Description of Artificial Sequence: Synthetic oligonucleotide
cccagtcccaggcctacatccctaag

SEQ ID NO: 170920 - DNA, 27 bp, Artificial Sequence
  Description of Artificial Sequence: Synthetic oligonucleotide
ccagtcccaggcctacatccctaagga

SEQ ID NO: 170921 - DNA, 27 bp, Artificial Sequence
  Description of Artificial Sequence: Synthetic oligonucleotide
cagtcccaggcctacatccctaaggac

SEQ ID NO: 170922 - DNA, 27 bp, Artificial Sequence
  Description of Artificial Sequence: Synthetic oligonucleotide
agtcccaggcctacatccctaaggacg

SEQ ID NO: 170923 - DNA, 27 bp, Artificial Sequence
  Description of Artificial Sequence: Synthetic oligonucleotide
gtcccaggcctacatccctaaggacga

SEQ ID NO: 170924 - DNA, 27 bp, Artificial Sequence
  Description of Artificial Sequence: Synthetic oligonucleotide
tcccaggcctacatccctaaggacgag

SEQ ID NO: 170925 - DNA, 26 bp, Artificial Sequence
  Description of Artificial Sequence: Synthetic oligonucleotide
cccaggcctacatccctaaggacgag

SEQ ID NO: 170926 - DNA, 26 bp, Artificial Sequence
  Description of Artificial Sequence: Synthetic oligonucleotide
ccaggcctacatccctaaggacgagg

SEQ ID NO: 170927 - DNA, 26 bp, Artificial Sequence
  Description of Artificial Sequence: Synthetic oligonucleotide
caggcctacatccctaaggacgaggg

SEQ ID NO: 170928 - DNA, 26 bp, Artificial Sequence
  Description of Artificial Sequence: Synthetic oligonucleotide
aggcctacatccctaaggacgagggc

SEQ ID NO: 170929 - DNA, 25 bp, Artificial Sequence
  Description of Artificial Sequence: Synthetic oligonucleotide
ggcctacatccctaaggacgagggc

SEQ ID NO: 170930 - DNA, 27 bp, Artificial Sequence
  Description of Artificial Sequence: Synthetic oligonucleotide
gcctacatccctaaggacgagggcgat

SEQ ID NO: 170931 - DNA, 29 bp, Artificial Sequence
  Description of Artificial Sequence: Synthetic oligonucleotide
cctacatccctaaggacgagggcgatttc

SEQ ID NO: 170932 - DNA, 31 bp, Artificial Sequence
  Description of Artificial Sequence: Synthetic oligonucleotide
ctacatccctaaggacgagggcgatttctac

SEQ ID NO: 170933 - DNA, 33 bp, Artificial Sequence
  Description of Artificial Sequence: Synthetic oligonucleotide
tacatccctaaggacgagggcgatttctactac

SEQ ID NO: 170934 - DNA, 32 bp, Artificial Sequence
  Description of Artificial Sequence: Synthetic oligonucleotide
acatccctaaggacgagggcgatttctactac

SEQ ID NO: 170935 - DNA, 31 bp, Artificial Sequence
  Description of Artificial Sequence: Synthetic oligonucleotide
catccctaaggacgagggcgatttctactac

SEQ ID NO: 170936 - DNA, 31 bp, Artificial Sequence
  Description of Artificial Sequence: Synthetic oligonucleotide
atccctaaggacgagggcgatttctactacc

SEQ ID NO: 170937 - DNA, 30 bp, Artificial Sequence
  Description of Artificial Sequence: Synthetic oligonucleotide
tccctaaggacgagggcgatttctactacc

SEQ ID NO: 170938 - DNA, 29 bp, Artificial Sequence
  Description of Artificial Sequence: Synthetic oligonucleotide
ccctaaggacgagggcgatttctactacc

SEQ ID NO: 170939 - DNA, 30 bp, Artificial Sequence
  Description of Artificial Sequence: Synthetic oligonucleotide
cctaaggacgagggcgatttctactacctg

SEQ ID NO: 170940 - DNA, 30 bp, Artificial Sequence
  Description of Artificial Sequence: Synthetic oligonucleotide
ctaaggacgagggcgatttctactacctgg

SEQ ID NO: 170941 - DNA, 30 bp, Artificial Sequence
  Description of Artificial Sequence: Synthetic oligonucleotide
taaggacgagggcgatttctactacctggg

SEQ ID NO: 170942 - DNA, 27 bp, Artificial Sequence
  Description of Artificial Sequence: Synthetic oligonucleotide
gttcttcggggggtcggtgcaagagat

SEQ ID NO: 170943 - DNA, 27 bp, Artificial Sequence
  Description of Artificial Sequence: Synthetic oligonucleotide
ttcttcggggggtcggtgcaagagatg

SEQ ID NO: 170944 - DNA, 26 bp, Artificial Sequence
  Description of Artificial Sequence: Synthetic oligonucleotide
tcttcggggggtcggtgcaagagatg

SEQ ID NO: 170945 - DNA, 25 bp, Artificial Sequence
  Description of Artificial Sequence: Synthetic oligonucleotide
cttcggggggtcggtgcaagagatg

SEQ ID NO: 170946 - DNA, 26 bp, Artificial Sequence
  Description of Artificial Sequence: Synthetic oligonucleotide
ttcggggggtcggtgcaagagatgca

SEQ ID NO: 170947 - DNA, 25 bp, Artificial Sequence
  Description of Artificial Sequence: Synthetic oligonucleotide
tcggggggtcggtgcaagagatgca

SEQ ID NO: 170948 - DNA, 24 bp, Artificial Sequence
  Description of Artificial Sequence: Synthetic oligonucleotide
cggggggtcggtgcaagagatgca

SEQ ID NO: 170949 - DNA, 24 bp, Artificial Sequence
  Description of Artificial Sequence: Synthetic oligonucleotide
ggggggtcggtgcaagagatgcag

SEQ ID NO: 170950 - DNA, 24 bp, Artificial Sequence
  Description of Artificial Sequence: Synthetic oligonucleotide
gggggtcggtgcaagagatgcagc

SEQ ID NO: 170951 - DNA, 24 bp, Artificial Sequence
  Description of Artificial Sequence: Synthetic oligonucleotide
ggggtcggtgcaagagatgcagcg

SEQ ID NO: 170952 - DNA, 24 bp, Artificial Sequence
  Description of Artificial Sequence: Synthetic oligonucleotide
gggtcggtgcaagagatgcagcgg

SEQ ID NO: 170953 - DNA, 25 bp, Artificial Sequence
  Description of Artificial Sequence: Synthetic oligonucleotide
ggtcggtgcaagagatgcagcggct

SEQ ID NO: 170954 - DNA, 26 bp, Artificial Sequence
  Description of Artificial Sequence: Synthetic oligonucleotide
gtcggtgcaagagatgcagcggctca

SEQ ID NO: 170955 - DNA, 26 bp, Artificial Sequence
  Description of Artificial Sequence: Synthetic oligonucleotide
tcggtgcaagagatgcagcggctcac

SEQ ID NO: 170956 - DNA, 25 bp, Artificial Sequence
  Description of Artificial Sequence: Synthetic oligonucleotide
cggtgcaagagatgcagcggctcac

SEQ ID NO: 170957 - DNA, 26 bp, Artificial Sequence
  Description of Artificial Sequence: Synthetic oligonucleotide
ggtgcaagagatgcagcggctcacca

SEQ ID NO: 170958 - DNA, 26 bp, Artificial Sequence
  Description of Artificial Sequence: Synthetic oligonucleotide
gtgcaagagatgcagcggctcaccag

SEQ ID NO: 170959 - DNA, 26 bp, Artificial Sequence
  Description of Artificial Sequence: Synthetic oligonucleotide
tgcaagagatgcagcggctcaccagg

SEQ ID NO: 170960 - DNA, 25 bp, Artificial Sequence
  Description of Artificial Sequence: Synthetic oligonucleotide
gcaagagatgcagcggctcaccagg

SEQ ID NO: 170961 - DNA, 25 bp, Artificial Sequence
  Description of Artificial Sequence: Synthetic oligonucleotide
caagagatgcagcggctcaccaggg

SEQ ID NO: 170962 - DNA, 25 bp, Artificial Sequence
  Description of Artificial Sequence: Synthetic oligonucleotide
aagagatgcagcggctcaccagggc

SEQ ID NO: 170963 - DNA, 24 bp, Artificial Sequence
  Description of Artificial Sequence: Synthetic oligonucleotide
agagatgcagcggctcaccagggc

SEQ ID NO: 170964 - DNA, 23 bp, Artificial Sequence
  Description of Artificial Sequence: Synthetic oligonucleotide
gagatgcagcggctcaccagggc

SEQ ID NO: 170965 - DNA, 24 bp, Artificial Sequence
  Description of Artificial Sequence: Synthetic oligonucleotide
agatgcagcggctcaccagggcct

SEQ ID NO: 170966 - DNA, 23 bp, Artificial Sequence
  Description of Artificial Sequence: Synthetic oligonucleotide
gatgcagcggctcaccagggcct

SEQ ID NO: 170967 - DNA, 23 bp, Artificial Sequence
  Description of Artificial Sequence: Synthetic oligonucleotide
atgcagcggctcaccagggcctg

SEQ ID NO: 170968 - DNA, 22 bp, Artificial Sequence
  Description of Artificial Sequence: Synthetic oligonucleotide
caggccaacggcatcgaggccg

SEQ ID NO: 170969 - DNA, 20 bp, Artificial Sequence
  Description of Artificial Sequence: Synthetic oligonucleotide
tgggctggcccgccgtcctg

SEQ ID NO: 170970 - DNA, 20 bp, Artificial Sequence
  Description of Artificial Sequence: Synthetic oligonucleotide
gggctggcccgccgtcctgt

SEQ ID NO: 170971 - DNA, 20 bp, Artificial Sequence
  Description of Artificial Sequence: Synthetic oligonucleotide
ggctggcccgccgtcctggt

SEQ ID NO: 170972 - DNA, 20 bp, Artificial Sequence
  Description of Artificial Sequence: Synthetic oligonucleotide
gctggcccgccgtcctgggt

SEQ ID NO: 170973 - DNA, 21 bp, Artificial Sequence
  Description of Artificial Sequence: Synthetic oligonucleotide
ctggcccgccgtcctggggaa

SEQ ID NO: 170974 - DNA, 21 bp, Artificial Sequence
  Description of Artificial Sequence: Synthetic oligonucleotide
tggcccgccgtcctggggaag

SEQ ID NO: 170975 - DNA, 20 bp, Artificial Sequence
  Description of Artificial Sequence: Synthetic oligonucleotide
ggcccgccgtcctggggaag

SEQ ID NO: 170976 - DNA, 21 bp, Artificial Sequence
  Description of Artificial Sequence: Synthetic oligonucleotide
gcccgccgtcctggggaagct

SEQ ID NO: 170977 - DNA, 22 bp, Artificial Sequence
  Description of Artificial Sequence: Synthetic oligonucleotide
cccgccgtcctggggaagctga

SEQ ID NO: 170978 - DNA, 22 bp, Artificial Sequence
  Description of Artificial Sequence: Synthetic oligonucleotide
ccgccgtcctggggaagctgag

SEQ ID NO: 170979 - DNA, 24 bp, Artificial Sequence
  Description of Artificial Sequence: Synthetic oligonucleotide
cgccgtcctggggaagctgaggtt

SEQ ID NO: 170980 - DNA, 25 bp, Artificial Sequence
  Description of Artificial Sequence: Synthetic oligonucleotide
gccgtcctggggaagctgaggttca

SEQ ID NO: 170981 - DNA, 26 bp, Artificial Sequence
  Description of Artificial Sequence: Synthetic oligonucleotide
ccgtcctggggaagctgaggttcact

SEQ ID NO: 170982 - DNA, 26 bp, Artificial Sequence
  Description of Artificial Sequence: Synthetic oligonucleotide
cgtcctggggaagctgaggttcactg

SEQ ID NO: 170983 - DNA, 26 bp, Artificial Sequence
  Description of Artificial Sequence: Synthetic oligonucleotide
gtcctggggaagctgaggttcactgc

SEQ ID NO: 170984 - DNA, 26 bp, Artificial Sequence
  Description of Artificial Sequence: Synthetic oligonucleotide
tcctggggaagctgaggttcactgcg

SEQ ID NO: 170985 - DNA, 25 bp, Artificial Sequence
  Description of Artificial Sequence: Synthetic oligonucleotide
cctggggaagctgaggttcactgcg

SEQ ID NO: 170986 - DNA, 26 bp, Artificial Sequence
  Description of Artificial Sequence: Synthetic oligonucleotide
ctggggaagctgaggttcactgcggt

SEQ ID NO: 170987 - DNA, 26 bp, Artificial Sequence
  Description of Artificial Sequence: Synthetic oligonucleotide
tggggaagctgaggttcactgcggtg

SEQ ID NO: 170988 - DNA, 25 bp, Artificial Sequence
  Description of Artificial Sequence: Synthetic oligonucleotide
ggggaagctgaggttcactgcggtg

SEQ ID NO: 170989 - DNA, 25 bp, Artificial Sequence
  Description of Artificial Sequence: Synthetic oligonucleotide
gggaagctgaggttcactgcggtgc

SEQ ID NO: 170990 - DNA, 23 bp, Artificial Sequence
  Description of Artificial Sequence: Synthetic oligonucleotide
ctggaggtgcgcgcctacaagcc

SEQ ID NO: 170991 - DNA, 24 bp, Artificial Sequence
  Description of Artificial Sequence: Synthetic oligonucleotide
tggaggtgcgcgcctacaagccct

SEQ ID NO: 170992 - DNA, 23 bp, Artificial Sequence
  Description of Artificial Sequence: Synthetic oligonucleotide
ggaggtgcgcgcctacaagccct

SEQ ID NO: 170993 - DNA, 23 bp, Artificial Sequence
  Description of Artificial Sequence: Synthetic oligonucleotide
gaggtgcgcgcctacaagccctg

SEQ ID NO: 170994 - DNA, 23 bp, Artificial Sequence
  Description of Artificial Sequence: Synthetic oligonucleotide
aggtgcgcgcctacaagccctgg

SEQ ID NO: 170995 - DNA, 22 bp, Artificial Sequence
  Description of Artificial Sequence: Synthetic oligonucleotide
ggtgcgcgcctacaagccctgg

SEQ ID NO: 170996 - DNA, 23 bp, Artificial Sequence
  Description of Artificial Sequence: Synthetic oligonucleotide
gtgcgcgcctacaagccctggca

SEQ ID NO: 170997 - DNA, 23 bp, Artificial Sequence
  Description of Artificial Sequence: Synthetic oligonucleotide
tgcgcgcctacaagccctggcag

SEQ ID NO: 170998 - DNA, 22 bp, Artificial Sequence
  Description of Artificial Sequence: Synthetic oligonucleotide
gcgcgcctacaagccctggcag

SEQ ID NO: 170999 - DNA, 23 bp, Artificial Sequence
  Description of Artificial Sequence: Synthetic oligonucleotide
cgcgcctacaagccctggcagga

SEQ ID NO: 171000 - DNA, 23 bp, Artificial Sequence
  Description of Artificial Sequence: Synthetic oligonucleotide
gcgcctacaagccctggcaggac

SEQ ID NO: 171001 - DNA, 24 bp, Artificial Sequence
  Description of Artificial Sequence: Synthetic oligonucleotide
cgcctacaagccctggcaggacgt

SEQ ID NO: 171002 - DNA, 25 bp, Artificial Sequence
  Description of Artificial Sequence: Synthetic oligonucleotide
gcctacaagccctggcaggacgtgt

SEQ ID NO: 171003 - DNA, 25 bp, Artificial Sequence
  Description of Artificial Sequence: Synthetic oligonucleotide
cctacaagccctggcaggacgtgtc

SEQ ID NO: 171004 - DNA, 27 bp, Artificial Sequence
  Description of Artificial Sequence: Synthetic oligonucleotide
ctacaagccctggcaggacgtgtccat

SEQ ID NO: 171005 - DNA, 27 bp, Artificial Sequence
  Description of Artificial Sequence: Synthetic oligonucleotide
tacaagccctggcaggacgtgtccatg

SEQ ID NO: 171006 - DNA, 26 bp, Artificial Sequence
  Description of Artificial Sequence: Synthetic oligonucleotide
acaagccctggcaggacgtgtccatg

SEQ ID NO: 171007 - DNA, 25 bp, Artificial Sequence
  Description of Artificial Sequence: Synthetic oligonucleotide
caagccctggcaggacgtgtccatg

SEQ ID NO: 171008 - DNA, 25 bp, Artificial Sequence
  Description of Artificial Sequence: Synthetic oligonucleotide
aagccctggcaggacgtgtccatgc

SEQ ID NO: 171009 - DNA, 24 bp, Artificial Sequence
  Description of Artificial Sequence: Synthetic oligonucleotide
agccctggcaggacgtgtccatgc

SEQ ID NO: 171010 - DNA, 23 bp, Artificial Sequence
  Description of Artificial Sequence: Synthetic oligonucleotide
gccctggcaggacgtgtccatgc

SEQ ID NO: 171011 - DNA, 23 bp, Artificial Sequence
  Description of Artificial Sequence: Synthetic oligonucleotide
ccctggcaggacgtgtccatgcg

SEQ ID NO: 171012 - DNA, 23 bp, Artificial Sequence
  Description of Artificial Sequence: Synthetic oligonucleotide
cctggcaggacgtgtccatgcgc

SEQ ID NO: 171013 - DNA, 22 bp, Artificial Sequence
  Description of Artificial Sequence: Synthetic oligonucleotide
ttcacctacgagcgccggcccc

SEQ ID NO: 171014 - DNA, 21 bp, Artificial Sequence
  Description of Artificial Sequence: Synthetic oligonucleotide
tcacctacgagcgccggcccc

SEQ ID NO: 171015 - DNA, 20 bp, Artificial Sequence
  Description of Artificial Sequence: Synthetic oligonucleotide
cacctacgagcgccggcccc

SEQ ID NO: 171016 - DNA, 21 bp, Artificial Sequence
  Description of Artificial Sequence: Synthetic oligonucleotide
acctacgagcgccggccccca

SEQ ID NO: 171017 - DNA, 20 bp, Artificial Sequence
  Description of Artificial Sequence: Synthetic oligonucleotide
cctacgagcgccggccccca

SEQ ID NO: 171018 - DNA, 20 bp, Artificial Sequence
  Description of Artificial Sequence: Synthetic oligonucleotide
ctacgagcgccggcccccag

SEQ ID NO: 171019 - DNA, 20 bp, Artificial Sequence
  Description of Artificial Sequence: Synthetic oligonucleotide
tacgagcgccggcccccagc

SEQ ID NO: 171020 - DNA, 20 bp, Artificial Sequence
  Description of Artificial Sequence: Synthetic oligonucleotide
acgagcgccggcccccagct

SEQ ID NO: 171021 - DNA, 20 bp, Artificial Sequence
  Description of Artificial Sequence: Synthetic oligonucleotide
cgagcgccggcccccagctt

SEQ ID NO: 171022 - DNA, 20 bp, Artificial Sequence
  Description of Artificial Sequence: Synthetic oligonucleotide
gagcgccggcccccagcctt

SEQ ID NO: 171023 - DNA, 20 bp, Artificial Sequence
  Description of Artificial Sequence: Synthetic oligonucleotide
agcgccggcccccagcccat

SEQ ID NO: 171024 - DNA, 20 bp, Artificial Sequence
  Description of Artificial Sequence: Synthetic oligonucleotide
gcgccggcccccagcccatt

SEQ ID NO: 171025 - DNA, 20 bp, Artificial Sequence
  Description of Artificial Sequence: Synthetic oligonucleotide
cgccggcccccagcccagtt

SEQ ID NO: 171026 - DNA, 20 bp, Artificial Sequence
  Description of Artificial Sequence: Synthetic oligonucleotide
gccggcccccagcccaggtt

SEQ ID NO: 171027 - DNA, 20 bp, Artificial Sequence
  Description of Artificial Sequence: Synthetic oligonucleotide
ccggcccccagcccaggctt

SEQ ID NO: 171028 - DNA, 20 bp, Artificial Sequence
  Description of Artificial Sequence: Synthetic oligonucleotide
cggcccccagcccaggccta

SEQ ID NO: 171029 - DNA, 22 bp, Artificial Sequence
  Description of Artificial Sequence: Synthetic oligonucleotide
ggcccccagcccaggcctacat

SEQ ID NO: 171030 - DNA, 22 bp, Artificial Sequence
  Description of Artificial Sequence: Synthetic oligonucleotide
gcccccagcccaggcctacatc

SEQ ID NO: 171031 - DNA, 22 bp, Artificial Sequence
  Description of Artificial Sequence: Synthetic oligonucleotide
cccccagcccaggcctacatcc

SEQ ID NO: 171032 - DNA, 22 bp, Artificial Sequence
  Description of Artificial Sequence: Synthetic oligonucleotide
ccccagcccaggcctacatccc

SEQ ID NO: 171033 - DNA, 24 bp, Artificial Sequence
  Description of Artificial Sequence: Synthetic oligonucleotide
cccagcccaggcctacatccccaa

SEQ ID NO: 171034 - DNA, 24 bp, Artificial Sequence
  Description of Artificial Sequence: Synthetic oligonucleotide
ccagcccaggcctacatccccaag

SEQ ID NO: 171035 - DNA, 25 bp, Artificial Sequence
  Description of Artificial Sequence: Synthetic oligonucleotide
cagcccaggcctacatccccaagga

SEQ ID NO: 171036 - DNA, 25 bp, Artificial Sequence
  Description of Artificial Sequence: Synthetic oligonucleotide
agcccaggcctacatccccaaggac

SEQ ID NO: 171037 - DNA, 24 bp, Artificial Sequence
  Description of Artificial Sequence: Synthetic oligonucleotide
gcccaggcctacatccccaaggac

SEQ ID NO: 171038 - DNA, 25 bp, Artificial Sequence
  Description of Artificial Sequence: Synthetic oligonucleotide
ggcagctgtcagtgctggaggtgca

SEQ ID NO: 171039 - DNA, 25 bp, Artificial Sequence
  Description of Artificial Sequence: Synthetic oligonucleotide
gcagctgtcagtgctggaggtgcac

SEQ ID NO: 171040 - DNA, 25 bp, Artificial Sequence
  Description of Artificial Sequence: Synthetic oligonucleotide
cagctgtcagtgctggaggtgcacg

SEQ ID NO: 171041 - DNA, 25 bp, Artificial Sequence
  Description of Artificial Sequence: Synthetic oligonucleotide
agctgtcagtgctggaggtgcacgc

SEQ ID NO: 171042 - DNA, 24 bp, Artificial Sequence
  Description of Artificial Sequence: Synthetic oligonucleotide
gctgtcagtgctggaggtgcacgc

SEQ ID NO: 171043 - DNA, 26 bp, Artificial Sequence
  Description of Artificial Sequence: Synthetic oligonucleotide
ctgtcagtgctggaggtgcacgccta

SEQ ID NO: 171044 - DNA, 27 bp, Artificial Sequence
  Description of Artificial Sequence: Synthetic oligonucleotide
tgtcagtgctggaggtgcacgcctaca

SEQ ID NO: 171045 - DNA, 27 bp, Artificial Sequence
  Description of Artificial Sequence: Synthetic oligonucleotide
gtcagtgctggaggtgcacgcctacaa

SEQ ID NO: 171046 - DNA, 27 bp, Artificial Sequence
  Description of Artificial Sequence: Synthetic oligonucleotide
tcagtgctggaggtgcacgcctacaag

SEQ ID NO: 171047 - DNA, 26 bp, Artificial Sequence
  Description of Artificial Sequence: Synthetic oligonucleotide
cagtgctggaggtgcacgcctacaag

SEQ ID NO: 171048 - DNA, 26 bp, Artificial Sequence
  Description of Artificial Sequence: Synthetic oligonucleotide
agtgctggaggtgcacgcctacaagc

SEQ ID NO: 171049 - DNA, 25 bp, Artificial Sequence
  Description of Artificial Sequence: Synthetic oligonucleotide
gtgctggaggtgcacgcctacaagc

SEQ ID NO: 171050 - DNA, 25 bp, Artificial Sequence
  Description of Artificial Sequence: Synthetic oligonucleotide
tgctggaggtgcacgcctacaagcg

SEQ ID NO: 171051 - DNA, 24 bp, Artificial Sequence
  Description of Artificial Sequence: Synthetic oligonucleotide
gctggaggtgcacgcctacaagcg

SEQ ID NO: 171052 - DNA, 25 bp, Artificial Sequence
  Description of Artificial Sequence: Synthetic oligonucleotide
ctggaggtgcacgcctacaagcgct

SEQ ID NO: 171053 - DNA, 25 bp, Artificial Sequence
  Description of Artificial Sequence: Synthetic oligonucleotide
tggaggtgcacgcctacaagcgctg

SEQ ID NO: 171054 - DNA, 24 bp, Artificial Sequence
  Description of Artificial Sequence: Synthetic oligonucleotide
ggaggtgcacgcctacaagcgctg

SEQ ID NO: 171055 - DNA, 24 bp, Artificial Sequence
  Description of Artificial Sequence: Synthetic oligonucleotide
gaggtgcacgcctacaagcgctgg

SEQ ID NO: 171056 - DNA, 25 bp, Artificial Sequence
  Description of Artificial Sequence: Synthetic oligonucleotide
aggtgcacgcctacaagcgctggca

SEQ ID NO: 171057 - DNA, 24 bp, Artificial Sequence
  Description of Artificial Sequence: Synthetic oligonucleotide
ggtgcacgcctacaagcgctggca

SEQ ID NO: 171058 - DNA, 24 bp, Artificial Sequence
  Description of Artificial Sequence: Synthetic oligonucleotide
gtgcacgcctacaagcgctggcag

SEQ ID NO: 171059 - DNA, 25 bp, Artificial Sequence
  Description of Artificial Sequence: Synthetic oligonucleotide
tgcacgcctacaagcgctggcagga

SEQ ID NO: 171060 - DNA, 24 bp, Artificial Sequence
  Description of Artificial Sequence: Synthetic oligonucleotide
gcacgcctacaagcgctggcagga

SEQ ID NO: 171061 - DNA, 24 bp, Artificial Sequence
  Description of Artificial Sequence: Synthetic oligonucleotide
cacgcctacaagcgctggcaggac

SEQ ID NO: 171062 - DNA, 25 bp, Artificial Sequence
  Description of Artificial Sequence: Synthetic oligonucleotide
acgcctacaagcgctggcaggacgt

SEQ ID NO: 171063 - DNA, 26 bp, Artificial Sequence
  Description of Artificial Sequence: Synthetic oligonucleotide
gcctgccaccaggccatgatggtcaa

SEQ ID NO: 171064 - DNA, 26 bp, Artificial Sequence
  Description of Artificial Sequence: Synthetic oligonucleotide
cctgccaccaggccatgatggtcaac

SEQ ID NO: 171065 - DNA, 27 bp, Artificial Sequence
  Description of Artificial Sequence: Synthetic oligonucleotide
ctgccaccaggccatgatggtcaacca

SEQ ID NO: 171066 - DNA, 27 bp, Artificial Sequence
  Description of Artificial Sequence: Synthetic oligonucleotide
tgccaccaggccatgatggtcaaccag

SEQ ID NO: 171067 - DNA, 26 bp, Artificial Sequence
  Description of Artificial Sequence: Synthetic oligonucleotide
gccaccaggccatgatggtcaaccag

SEQ ID NO: 171068 - DNA, 26 bp, Artificial Sequence
  Description of Artificial Sequence: Synthetic oligonucleotide
ccaccaggccatgatggtcaaccagg

SEQ ID NO: 171069 - DNA, 26 bp, Artificial Sequence
  Description of Artificial Sequence: Synthetic oligonucleotide
caccaggccatgatggtcaaccaggc

SEQ ID NO: 171070 - DNA, 27 bp, Artificial Sequence
  Description of Artificial Sequence: Synthetic oligonucleotide
accaggccatgatggtcaaccaggcca

SEQ ID NO: 171071 - DNA, 27 bp, Artificial Sequence
  Description of Artificial Sequence: Synthetic oligonucleotide
ccaggccatgatggtcaaccaggccaa

SEQ ID NO: 171072 - DNA, 27 bp, Artificial Sequence
  Description of Artificial Sequence: Synthetic oligonucleotide
caggccatgatggtcaaccaggccaac

SEQ ID NO: 171073 - DNA, 27 bp, Artificial Sequence
  Description of Artificial Sequence: Synthetic oligonucleotide
aggccatgatggtcaaccaggccaacg

SEQ ID NO: 171074 - DNA, 26 bp, Artificial Sequence
  Description of Artificial Sequence: Synthetic oligonucleotide
ggccatgatggtcaaccaggccaacg

SEQ ID NO: 171075 - DNA, 26 bp, Artificial Sequence
  Description of Artificial Sequence: Synthetic oligonucleotide
gccatgatggtcaaccaggccaacgg

SEQ ID NO: 171076 - DNA, 27 bp, Artificial Sequence
  Description of Artificial Sequence: Synthetic oligonucleotide
ccatgatggtcaaccaggccaacggca

SEQ ID NO: 171077 - DNA, 28 bp, Artificial Sequence
  Description of Artificial Sequence: Synthetic oligonucleotide
catgatggtcaaccaggccaacggcatc

SEQ ID NO: 171078 - DNA, 28 bp, Artificial Sequence
  Description of Artificial Sequence: Synthetic oligonucleotide
atgatggtcaaccaggccaacggcatcg

SEQ ID NO: 171079 - DNA, 27 bp, Artificial Sequence
  Description of Artificial Sequence: Synthetic oligonucleotide
tgatggtcaaccaggccaacggcatcg

SEQ ID NO: 171080 - DNA, 27 bp, Artificial Sequence
  Description of Artificial Sequence: Synthetic oligonucleotide
gatggtcaaccaggccaacggcatcga

SEQ ID NO: 171081 - DNA, 27 bp, Artificial Sequence
  Description of Artificial Sequence: Synthetic oligonucleotide
atggtcaaccaggccaacggcatcgag

SEQ ID NO: 171082 - DNA, 26 bp, Artificial Sequence
  Description of Artificial Sequence: Synthetic oligonucleotide
tggtcaaccaggccaacggcatcgag

SEQ ID NO: 171083 - DNA, 25 bp, Artificial Sequence
  Description of Artificial Sequence: Synthetic oligonucleotide
ggtcaaccaggccaacggcatcgag

SEQ ID NO: 171084 - DNA, 25 bp, Artificial Sequence
  Description of Artificial Sequence: Synthetic oligonucleotide
gtcaaccaggccaacggcatcgagg

SEQ ID NO: 171085 - DNA, 25 bp, Artificial Sequence
  Description of Artificial Sequence: Synthetic oligonucleotide
tcaaccaggccaacggcatcgaggc

SEQ ID NO: 171086 - DNA, 24 bp, Artificial Sequence
  Description of Artificial Sequence: Synthetic oligonucleotide
caaccaggccaacggcatcgaggc

SEQ ID NO: 171087 - DNA, 24 bp, Artificial Sequence
  Description of Artificial Sequence: Synthetic oligonucleotide
aaccaggccaacggcatcgaggcc

SEQ ID NO: 171088 - DNA, 25 bp, Artificial Sequence
  Description of Artificial Sequence: Synthetic oligonucleotide
ggtcggtgcaagaggtgcagcggtt

SEQ ID NO: 171089 - DNA, 26 bp, Artificial Sequence
  Description of Artificial Sequence: Synthetic oligonucleotide
gtcggtgcaagaggtgcagcggttca

SEQ ID NO: 171090 - DNA, 26 bp, Artificial Sequence
  Description of Artificial Sequence: Synthetic oligonucleotide
tcggtgcaagaggtgcagcggttcac

SEQ ID NO: 171091 - DNA, 25 bp, Artificial Sequence
  Description of Artificial Sequence: Synthetic oligonucleotide
cggtgcaagaggtgcagcggttcac

SEQ ID NO: 171092 - DNA, 26 bp, Artificial Sequence
  Description of Artificial Sequence: Synthetic oligonucleotide
ggtgcaagaggtgcagcggttcacca

SEQ ID NO: 171093 - DNA, 26 bp, Artificial Sequence
  Description of Artificial Sequence: Synthetic oligonucleotide
gtgcaagaggtgcagcggttcaccag

SEQ ID NO: 171094 - DNA, 26 bp, Artificial Sequence
  Description of Artificial Sequence: Synthetic oligonucleotide
tgcaagaggtgcagcggttcaccagg

SEQ ID NO: 171095 - DNA, 25 bp, Artificial Sequence
  Description of Artificial Sequence: Synthetic oligonucleotide
gcaagaggtgcagcggttcaccagg

SEQ ID NO: 171096 - DNA, 25 bp, Artificial Sequence
  Description of Artificial Sequence: Synthetic oligonucleotide
caagaggtgcagcggttcaccaggg

SEQ ID NO: 171097 - DNA, 25 bp, Artificial Sequence
  Description of Artificial Sequence: Synthetic oligonucleotide
aagaggtgcagcggttcaccagggc

SEQ ID NO: 171098 - DNA, 24 bp, Artificial Sequence
  Description of Artificial Sequence: Synthetic oligonucleotide
agaggtgcagcggttcaccagggc

SEQ ID NO: 171099 - DNA, 23 bp, Artificial Sequence
  Description of Artificial Sequence: Synthetic oligonucleotide
gaggtgcagcggttcaccagggc

SEQ ID NO: 171100 - DNA, 24 bp, Artificial Sequence
  Description of Artificial Sequence: Synthetic oligonucleotide
aggtgcagcggttcaccagggcct

SEQ ID NO: 171101 - DNA, 23 bp, Artificial Sequence
  Description of Artificial Sequence: Synthetic oligonucleotide
ggtgcagcggttcaccagggcct

SEQ ID NO: 171102 - DNA, 23 bp, Artificial Sequence
  Description of Artificial Sequence: Synthetic oligonucleotide
gtgcagcggttcaccagggcctg

SEQ ID NO: 171103 - DNA, 23 bp, Artificial Sequence
  Description of Artificial Sequence: Synthetic oligonucleotide
tgcagcggttcaccagggcctgc

SEQ ID NO: 171104 - DNA, 22 bp, Artificial Sequence
  Description of Artificial Sequence: Synthetic oligonucleotide
gcagcggttcaccagggcctgc

SEQ ID NO: 171105 - DNA, 23 bp, Artificial Sequence
  Description of Artificial Sequence: Synthetic oligonucleotide
cagcggttcaccagggcctgcca

SEQ ID NO: 171106 - DNA, 23 bp, Artificial Sequence
  Description of Artificial Sequence: Synthetic oligonucleotide
agcggttcaccagggcctgccac

SEQ ID NO: 171107 - DNA, 22 bp, Artificial Sequence
  Description of Artificial Sequence: Synthetic oligonucleotide
gcggttcaccagggcctgccac

SEQ ID NO: 171108 - DNA, 23 bp, Artificial Sequence
  Description of Artificial Sequence: Synthetic oligonucleotide
cggttcaccagggcctgccacca

SEQ ID NO: 171109 - DNA, 23 bp, Artificial Sequence
  Description of Artificial Sequence: Synthetic oligonucleotide
ggttcaccagggcctgccaccag

SEQ ID NO: 171110 - DNA, 23 bp, Artificial Sequence
  Description of Artificial Sequence: Synthetic oligonucleotide
gttcaccagggcctgccaccagg

SEQ ID NO: 171111 - DNA, 23 bp, Artificial Sequence
  Description of Artificial Sequence: Synthetic oligonucleotide
ttcaccagggcctgccaccaggc

SEQ ID NO: 171112 - DNA, 24 bp, Artificial Sequence
  Description of Artificial Sequence: Synthetic oligonucleotide
tgggaccagcagctgctgggctga

SEQ ID NO: 171113 - DNA, 23 bp, Artificial Sequence
  Description of Artificial Sequence: Synthetic oligonucleotide
gggaccagcagctgctgggctga

SEQ ID NO: 171114 - DNA, 23 bp, Artificial Sequence
  Description of Artificial Sequence: Synthetic oligonucleotide
ggaccagcagctgctgggctgac

SEQ ID NO: 171115 - DNA, 23 bp, Artificial Sequence
  Description of Artificial Sequence: Synthetic oligonucleotide
gaccagcagctgctgggctgacc

SEQ ID NO: 171116 - DNA, 23 bp, Artificial Sequence
  Description of Artificial Sequence: Synthetic oligonucleotide
accagcagctgctgggctgaccc

SEQ ID NO: 171117 - DNA, 22 bp, Artificial Sequence
  Description of Artificial Sequence: Synthetic oligonucleotide
ccagcagctgctgggctgaccc

SEQ ID NO: 171118 - DNA, 22 bp, Artificial Sequence
  Description of Artificial Sequence: Synthetic oligonucleotide
cagcagctgctgggctgacccg

SEQ ID NO: 171119 - DNA, 22 bp, Artificial Sequence
  Description of Artificial Sequence: Synthetic oligonucleotide
agcagctgctgggctgacccgc

SEQ ID NO: 171120 - DNA, 21 bp, Artificial Sequence
  Description of Artificial Sequence: Synthetic oligonucleotide
gcagctgctgggctgacccgc

SEQ ID NO: 171121 - DNA, 21 bp, Artificial Sequence
  Description of Artificial Sequence: Synthetic oligonucleotide
cagctgctgggctgacccgcc

SEQ ID NO: 171122 - DNA, 22 bp, Artificial Sequence
  Description of Artificial Sequence: Synthetic oligonucleotide
agctgctgggctgacccgccgt

SEQ ID NO: 171123 - DNA, 21 bp, Artificial Sequence
  Description of Artificial Sequence: Synthetic oligonucleotide
gctgctgggctgacccgccgt

SEQ ID NO: 171124 - DNA, 21 bp, Artificial Sequence
  Description of Artificial Sequence: Synthetic oligonucleotide
ctgctgggctgacccgccgtc

SEQ ID NO: 171125 - DNA, 22 bp, Artificial Sequence
  Description of Artificial Sequence: Synthetic oligonucleotide
tgctgggctgacccgccgtcct

SEQ ID NO: 171126 - DNA, 21 bp, Artificial Sequence
  Description of Artificial Sequence: Synthetic oligonucleotide
gctgggctgacccgccgtcct

SEQ ID NO: 171127 - DNA, 22 bp, Artificial Sequence
  Description of Artificial Sequence: Synthetic oligonucleotide
ctgggctgacccgccgtcctga

SEQ ID NO: 171128 - DNA, 22 bp, Artificial Sequence
  Description of Artificial Sequence: Synthetic oligonucleotide
tgggctgacccgccgtcctgag

SEQ ID NO: 171129 - DNA, 21 bp, Artificial Sequence
  Description of Artificial Sequence: Synthetic oligonucleotide
gggctgacccgccgtcctgag

SEQ ID NO: 171130 - DNA, 23 bp, Artificial Sequence
  Description of Artificial Sequence: Synthetic oligonucleotide
ggctgacccgccgtcctgaggaa

SEQ ID NO: 171131 - DNA, 23 bp, Artificial Sequence
  Description of Artificial Sequence: Synthetic oligonucleotide
gctgacccgccgtcctgaggaag

SEQ ID NO: 171132 - DNA, 24 bp, Artificial Sequence
  Description of Artificial Sequence: Synthetic oligonucleotide
ctgacccgccgtcctgaggaagct

SEQ ID NO: 171133 - DNA, 25 bp, Artificial Sequence
  Description of Artificial Sequence: Synthetic oligonucleotide
tgacccgccgtcctgaggaagctga

SEQ ID NO: 171134 - DNA, 24 bp, Artificial Sequence
  Description of Artificial Sequence: Synthetic oligonucleotide
gacccgccgtcctgaggaagctga

SEQ ID NO: 171135 - DNA, 24 bp, Artificial Sequence
  Description of Artificial Sequence: Synthetic oligonucleotide
acccgccgtcctgaggaagctgag

SEQ ID NO: 171136 - DNA, 26 bp, Artificial Sequence
  Description of Artificial Sequence: Synthetic oligonucleotide
agggcgatttctactacctggggggg

SEQ ID NO: 171137 - DNA, 25 bp, Artificial Sequence
  Description of Artificial Sequence: Synthetic oligonucleotide
gggcgatttctactacctggggggg

SEQ ID NO: 171138 - DNA, 27 bp, Artificial Sequence
  Description of Artificial Sequence: Synthetic oligonucleotide
ggcgatttctactacctggggggggtt

SEQ ID NO: 171139 - DNA, 27 bp, Artificial Sequence
  Description of Artificial Sequence: Synthetic oligonucleotide
gcgatttctactacctggggggggttc

SEQ ID NO: 171140 - DNA, 29 bp, Artificial Sequence
  Description of Artificial Sequence: Synthetic oligonucleotide
cgatttctactacctggggggggttcttc

SEQ ID NO: 171141 - DNA, 29 bp, Artificial Sequence
  Description of Artificial Sequence: Synthetic oligonucleotide
gatttctactacctggggggggttcttcg

SEQ ID NO: 171142 - DNA, 29 bp, Artificial Sequence
  Description of Artificial Sequence: Synthetic oligonucleotide
atttctactacctggggggggttcttcgg

SEQ ID NO: 171143 - DNA, 28 bp, Artificial Sequence
  Description of Artificial Sequence: Synthetic oligonucleotide
tttctactacctggggggggttcttcgg

SEQ ID NO: 171144 - DNA, 27 bp, Artificial Sequence
  Description of Artificial Sequence: Synthetic oligonucleotide
ttctactacctggggggggttcttcgg

SEQ ID NO: 171145 - DNA, 26 bp, Artificial Sequence
  Description of Artificial Sequence: Synthetic oligonucleotide
tctactacctggggggggttcttcgg

SEQ ID NO: 171146 - DNA, 25 bp, Artificial Sequence
  Description of Artificial Sequence: Synthetic oligonucleotide
ctactacctggggggggttcttcgg

SEQ ID NO: 171147 - DNA, 25 bp, Artificial Sequence
  Description of Artificial Sequence: Synthetic oligonucleotide
tactacctggggggggttcttcggg

SEQ ID NO: 171148 - DNA, 24 bp, Artificial Sequence
  Description of Artificial Sequence: Synthetic oligonucleotide
actacctggggggggttcttcggg

SEQ ID NO: 171149 - DNA, 23 bp, Artificial Sequence
  Description of Artificial Sequence: Synthetic oligonucleotide
ctacctggggggggttcttcggg

SEQ ID NO: 171150 - DNA, 23 bp, Artificial Sequence
  Description of Artificial Sequence: Synthetic oligonucleotide
tacctggggggggttcttcgggg

SEQ ID NO: 171151 - DNA, 22 bp, Artificial Sequence
  Description of Artificial Sequence: Synthetic oligonucleotide
acctggggggggttcttcgggg

SEQ ID NO: 171152 - DNA, 21 bp, Artificial Sequence
  Description of Artificial Sequence: Synthetic oligonucleotide
cctggggggggttcttcgggg

SEQ ID NO: 171153 - DNA, 21 bp, Artificial Sequence
  Description of Artificial Sequence: Synthetic oligonucleotide
ctggggggggttcttcggggg

SEQ ID NO: 171154 - DNA, 22 bp, Artificial Sequence
  Description of Artificial Sequence: Synthetic oligonucleotide
tggggggggttcttcggggggt

SEQ ID NO: 171155 - DNA, 21 bp, Artificial Sequence
  Description of Artificial Sequence: Synthetic oligonucleotide
ggggggggttcttcggggggt

SEQ ID NO: 171156 - DNA, 25 bp, Artificial Sequence
  Description of Artificial Sequence: Synthetic oligonucleotide
cagtcccaggcctacatccccaagg

SEQ ID NO: 171157 - DNA, 25 bp, Artificial Sequence
  Description of Artificial Sequence: Synthetic oligonucleotide
agtcccaggcctacatccccaaggg

SEQ ID NO: 171158 - DNA, 24 bp, Artificial Sequence
  Description of Artificial Sequence: Synthetic oligonucleotide
gtcccaggcctacatccccaaggg

SEQ ID NO: 171159 - DNA, 24 bp, Artificial Sequence
  Description of Artificial Sequence: Synthetic oligonucleotide
tcccaggcctacatccccaagggc

SEQ ID NO: 171160 - DNA, 23 bp, Artificial Sequence
  Description of Artificial Sequence: Synthetic oligonucleotide
cccaggcctacatccccaagggc

SEQ ID NO: 171161 - DNA, 24 bp, Artificial Sequence
  Description of Artificial Sequence: Synthetic oligonucleotide
ccaggcctacatccccaagggcga

SEQ ID NO: 171162 - DNA, 24 bp, Artificial Sequence
  Description of Artificial Sequence: Synthetic oligonucleotide
caggcctacatccccaagggcgag

SEQ ID NO: 171163 - DNA, 24 bp, Artificial Sequence
  Description of Artificial Sequence: Synthetic oligonucleotide
aggcctacatccccaagggcgagg

SEQ ID NO: 171164 - DNA, 23 bp, Artificial Sequence
  Description of Artificial Sequence: Synthetic oligonucleotide
ggcctacatccccaagggcgagg

SEQ ID NO: 171165 - DNA, 23 bp, Artificial Sequence
  Description of Artificial Sequence: Synthetic oligonucleotide
gcctacatccccaagggcgaggg

SEQ ID NO: 171166 - DNA, 23 bp, Artificial Sequence
  Description of Artificial Sequence: Synthetic oligonucleotide
cctacatccccaagggcgagggc

SEQ ID NO: 171167 - DNA, 27 bp, Artificial Sequence
  Description of Artificial Sequence: Synthetic oligonucleotide
ctacatccccaagggcgagggcgattt

SEQ ID NO: 171168 - DNA, 27 bp, Artificial Sequence
  Description of Artificial Sequence: Synthetic oligonucleotide
tacatccccaagggcgagggcgatttc

SEQ ID NO: 171169 - DNA, 27 bp, Artificial Sequence
  Description of Artificial Sequence: Synthetic oligonucleotide
acatccccaagggcgagggcgatttct

SEQ ID NO: 171170 - DNA, 27 bp, Artificial Sequence
  Description of Artificial Sequence: Synthetic oligonucleotide
catccccaagggcgagggcgatttcta

SEQ ID NO: 171171 - DNA, 27 bp, Artificial Sequence
  Description of Artificial Sequence: Synthetic oligonucleotide
atccccaagggcgagggcgatttctac

SEQ ID NO: 171172 - DNA, 27 bp, Artificial Sequence
  Description of Artificial Sequence: Synthetic oligonucleotide
tccccaagggcgagggcgatttctact

SEQ ID NO: 171173 - DNA, 27 bp, Artificial Sequence
  Description of Artificial Sequence: Synthetic oligonucleotide
ccccaagggcgagggcgatttctacta

SEQ ID NO: 171174 - DNA, 27 bp, Artificial Sequence
  Description of Artificial Sequence: Synthetic oligonucleotide
cccaagggcgagggcgatttctactac

SEQ ID NO: 171175 - DNA, 27 bp, Artificial Sequence
  Description of Artificial Sequence: Synthetic oligonucleotide
ccaagggcgagggcgatttctactacc

SEQ ID NO: 171176 - DNA, 28 bp, Artificial Sequence
  Description of Artificial Sequence: Synthetic oligonucleotide
caagggcgagggcgatttctactacctg

SEQ ID NO: 171177 - DNA, 28 bp, Artificial Sequence
  Description of Artificial Sequence: Synthetic oligonucleotide
aagggcgagggcgatttctactacctgg

SEQ ID NO: 171178 - DNA, 27 bp, Artificial Sequence
  Description of Artificial Sequence: Synthetic oligonucleotide
agggcgagggcgatttctactacctgg

SEQ ID NO: 171179 - DNA, 26 bp, Artificial Sequence
  Description of Artificial Sequence: Synthetic oligonucleotide
gggcgagggcgatttctactacctgg

SEQ ID NO: 171180 - DNA, 26 bp, Artificial Sequence
  Description of Artificial Sequence: Synthetic oligonucleotide
ggcgagggcgatttctactacctggg

SEQ ID NO: 171181 - DNA, 26 bp, Artificial Sequence
  Description of Artificial Sequence: Synthetic oligonucleotide
gcgagggcgatttctactacctgggg

SEQ ID NO: 171182 - DNA, 27 bp, Artificial Sequence
  Description of Artificial Sequence: Synthetic oligonucleotide
gagggcgatttctactacctggggggt

SEQ ID NO: 171183 - DNA, 28 bp, Artificial Sequence
  Description of Artificial Sequence: Synthetic oligonucleotide
agggcgatttctactacctggggggttc

SEQ ID NO: 171184 - DNA, 27 bp, Artificial Sequence
  Description of Artificial Sequence: Synthetic oligonucleotide
gggcgatttctactacctggggggttc

SEQ ID NO: 171185 - DNA, 29 bp, Artificial Sequence
  Description of Artificial Sequence: Synthetic oligonucleotide
ggcgatttctactacctggggggttcttc

SEQ ID NO: 171186 - DNA, 29 bp, Artificial Sequence
  Description of Artificial Sequence: Synthetic oligonucleotide
gcgatttctactacctggggggttcttcg

SEQ ID NO: 171187 - DNA, 29 bp, Artificial Sequence
  Description of Artificial Sequence: Synthetic oligonucleotide
cgatttctactacctggggggttcttcgg

SEQ ID NO: 171188 - DNA, 29 bp, Artificial Sequence
  Description of Artificial Sequence: Synthetic oligonucleotide
gatttctactacctggggggttcttcggg

SEQ ID NO: 171189 - DNA, 29 bp, Artificial Sequence
  Description of Artificial Sequence: Synthetic oligonucleotide
atttctactacctggggggttcttcgggg

SEQ ID NO: 171190 - DNA, 28 bp, Artificial Sequence
  Description of Artificial Sequence: Synthetic oligonucleotide
tttctactacctggggggttcttcgggg

SEQ ID NO: 171191 - DNA, 27 bp, Artificial Sequence
  Description of Artificial Sequence: Synthetic oligonucleotide
ttctactacctggggggttcttcgggg

SEQ ID NO: 171192 - DNA, 26 bp, Artificial Sequence
  Description of Artificial Sequence: Synthetic oligonucleotide
tctactacctggggggttcttcgggg

SEQ ID NO: 171193 - DNA, 25 bp, Artificial Sequence
  Description of Artificial Sequence: Synthetic oligonucleotide
ctactacctggggggttcttcgggg

SEQ ID NO: 171194 - DNA, 25 bp, Artificial Sequence
  Description of Artificial Sequence: Synthetic oligonucleotide
tactacctggggggttcttcggggg

SEQ ID NO: 171195 - DNA, 24 bp, Artificial Sequence
  Description of Artificial Sequence: Synthetic oligonucleotide
actacctggggggttcttcggggg

SEQ ID NO: 171196 - DNA, 23 bp, Artificial Sequence
  Description of Artificial Sequence: Synthetic oligonucleotide
ctacctggggggttcttcggggg

SEQ ID NO: 171197 - DNA, 24 bp, Artificial Sequence
  Description of Artificial Sequence: Synthetic oligonucleotide
tacctggggggttcttcggggggt

SEQ ID NO: 171198 - DNA, 23 bp, Artificial Sequence
  Description of Artificial Sequence: Synthetic oligonucleotide
acctggggggttcttcggggggt

SEQ ID NO: 171199 - DNA, 22 bp, Artificial Sequence
  Description of Artificial Sequence: Synthetic oligonucleotide
cctggggggttcttcggggggt

SEQ ID NO: 171200 - DNA, 22 bp, Artificial Sequence
  Description of Artificial Sequence: Synthetic oligonucleotide
ctggggggttcttcggggggtc

SEQ ID NO: 171201 - DNA, 22 bp, Artificial Sequence
  Description of Artificial Sequence: Synthetic oligonucleotide
tggggggttcttcggggggtcg

SEQ ID NO: 171202 - DNA, 22 bp, Artificial Sequence
  Description of Artificial Sequence: Synthetic oligonucleotide
cggccccagtcccaggcctaca

SEQ ID NO: 171203 - DNA, 22 bp, Artificial Sequence
  Description of Artificial Sequence: Synthetic oligonucleotide
ggccccagtcccaggcctacac

SEQ ID NO: 171204 - DNA, 22 bp, Artificial Sequence
  Description of Artificial Sequence: Synthetic oligonucleotide
gccccagtcccaggcctacacc

SEQ ID NO: 171205 - DNA, 22 bp, Artificial Sequence
  Description of Artificial Sequence: Synthetic oligonucleotide
ccccagtcccaggcctacaccc

SEQ ID NO: 171206 - DNA, 22 bp, Artificial Sequence
  Description of Artificial Sequence: Synthetic oligonucleotide
cccagtcccaggcctacacccc

SEQ ID NO: 171207 - DNA, 24 bp, Artificial Sequence
  Description of Artificial Sequence: Synthetic oligonucleotide
ccagtcccaggcctacacccccaa

SEQ ID NO: 171208 - DNA, 24 bp, Artificial Sequence
  Description of Artificial Sequence: Synthetic oligonucleotide
cagtcccaggcctacacccccaag

SEQ ID NO: 171209 - DNA, 25 bp, Artificial Sequence
  Description of Artificial Sequence: Synthetic oligonucleotide
agtcccaggcctacacccccaagga

SEQ ID NO: 171210 - DNA, 24 bp, Artificial Sequence
  Description of Artificial Sequence: Synthetic oligonucleotide
gtcccaggcctacacccccaagga

SEQ ID NO: 171211 - DNA, 24 bp, Artificial Sequence
  Description of Artificial Sequence: Synthetic oligonucleotide
tcccaggcctacacccccaaggac

SEQ ID NO: 171212 - DNA, 23 bp, Artificial Sequence
  Description of Artificial Sequence: Synthetic oligonucleotide
cccaggcctacacccccaaggac

SEQ ID NO: 171213 - DNA, 24 bp, Artificial Sequence
  Description of Artificial Sequence: Synthetic oligonucleotide
ccaggcctacacccccaaggacga

SEQ ID NO: 171214 - DNA, 24 bp, Artificial Sequence
  Description of Artificial Sequence: Synthetic oligonucleotide
caggcctacacccccaaggacgag

SEQ ID NO: 171215 - DNA, 24 bp, Artificial Sequence
  Description of Artificial Sequence: Synthetic oligonucleotide
aggcctacacccccaaggacgagg

SEQ ID NO: 171216 - DNA, 23 bp, Artificial Sequence
  Description of Artificial Sequence: Synthetic oligonucleotide
ggcctacacccccaaggacgagg

SEQ ID NO: 171217 - DNA, 23 bp, Artificial Sequence
  Description of Artificial Sequence: Synthetic oligonucleotide
gcctacacccccaaggacgaggg

SEQ ID NO: 171218 - DNA, 23 bp, Artificial Sequence
  Description of Artificial Sequence: Synthetic oligonucleotide
cctacacccccaaggacgagggc

SEQ ID NO: 171219 - DNA, 27 bp, Artificial Sequence
  Description of Artificial Sequence: Synthetic oligonucleotide
ctacacccccaaggacgagggcgattt

SEQ ID NO: 171220 - DNA, 27 bp, Artificial Sequence
  Description of Artificial Sequence: Synthetic oligonucleotide
tacacccccaaggacgagggcgatttc

SEQ ID NO: 171221 - DNA, 27 bp, Artificial Sequence
  Description of Artificial Sequence: Synthetic oligonucleotide
acacccccaaggacgagggcgatttct

SEQ ID NO: 171222 - DNA, 27 bp, Artificial Sequence
  Description of Artificial Sequence: Synthetic oligonucleotide
cacccccaaggacgagggcgatttcta

SEQ ID NO: 171223 - DNA, 27 bp, Artificial Sequence
  Description of Artificial Sequence: Synthetic oligonucleotide
acccccaaggacgagggcgatttctac

SEQ ID NO: 171224 - DNA, 27 bp, Artificial Sequence
  Description of Artificial Sequence: Synthetic oligonucleotide
cccccaaggacgagggcgatttctact

SEQ ID NO: 171225 - DNA, 22 bp, Artificial Sequence
  Description of Artificial Sequence: Synthetic oligonucleotide
gccggccccagtcccaggtcta

SEQ ID NO: 171226 - DNA, 24 bp, Artificial Sequence
  Description of Artificial Sequence: Synthetic oligonucleotide
ccggccccagtcccaggtctacat

SEQ ID NO: 171227 - DNA, 24 bp, Artificial Sequence
  Description of Artificial Sequence: Synthetic oligonucleotide
cggccccagtcccaggtctacatc

SEQ ID NO: 171228 - DNA, 24 bp, Artificial Sequence
  Description of Artificial Sequence: Synthetic oligonucleotide
ggccccagtcccaggtctacatcc

SEQ ID NO: 171229 - DNA, 24 bp, Artificial Sequence
  Description of Artificial Sequence: Synthetic oligonucleotide
gccccagtcccaggtctacatccc

SEQ ID NO: 171230 - DNA, 26 bp, Artificial Sequence
  Description of Artificial Sequence: Synthetic oligonucleotide
ccccagtcccaggtctacatccccaa

SEQ ID NO: 171231 - DNA, 26 bp, Artificial Sequence
  Description of Artificial Sequence: Synthetic oligonucleotide
cccagtcccaggtctacatccccaag

SEQ ID NO: 171232 - DNA, 27 bp, Artificial Sequence
  Description of Artificial Sequence: Synthetic oligonucleotide
ccagtcccaggtctacatccccaagga

SEQ ID NO: 171233 - DNA, 27 bp, Artificial Sequence
  Description of Artificial Sequence: Synthetic oligonucleotide
cagtcccaggtctacatccccaaggac

SEQ ID NO: 171234 - DNA, 27 bp, Artificial Sequence
  Description of Artificial Sequence: Synthetic oligonucleotide
agtcccaggtctacatccccaaggacg

SEQ ID NO: 171235 - DNA, 27 bp, Artificial Sequence
  Description of Artificial Sequence: Synthetic oligonucleotide
gtcccaggtctacatccccaaggacga

SEQ ID NO: 171236 - DNA, 27 bp, Artificial Sequence
  Description of Artificial Sequence: Synthetic oligonucleotide
tcccaggtctacatccccaaggacgag

SEQ ID NO: 171237 - DNA, 26 bp, Artificial Sequence
  Description of Artificial Sequence: Synthetic oligonucleotide
cccaggtctacatccccaaggacgag

SEQ ID NO: 171238 - DNA, 26 bp, Artificial Sequence
  Description of Artificial Sequence: Synthetic oligonucleotide
ccaggtctacatccccaaggacgagg

SEQ ID NO: 171239 - DNA, 26 bp, Artificial Sequence
  Description of Artificial Sequence: Synthetic oligonucleotide
caggtctacatccccaaggacgaggg

SEQ ID NO: 171240 - DNA, 26 bp, Artificial Sequence
  Description of Artificial Sequence: Synthetic oligonucleotide
aggtctacatccccaaggacgagggc

SEQ ID NO: 171241 - DNA, 25 bp, Artificial Sequence
  Description of Artificial Sequence: Synthetic oligonucleotide
ggtctacatccccaaggacgagggc

SEQ ID NO: 171242 - DNA, 27 bp, Artificial Sequence
  Description of Artificial Sequence: Synthetic oligonucleotide
gtctacatccccaaggacgagggcgat

SEQ ID NO: 171243 - DNA, 29 bp, Artificial Sequence
  Description of Artificial Sequence: Synthetic oligonucleotide
tctacatccccaaggacgagggcgatttc

SEQ ID NO: 171244 - DNA, 26 bp, Artificial Sequence
  Description of Artificial Sequence: Synthetic oligonucleotide
atggagttccgcgaccacgtgggcat

SEQ ID NO: 171245 - DNA, 25 bp, Artificial Sequence
  Description of Artificial Sequence: Synthetic oligonucleotide
tggagttccgcgaccacgtgggcat

SEQ ID NO: 171246 - DNA, 24 bp, Artificial Sequence
  Description of Artificial Sequence: Synthetic oligonucleotide
ggagttccgcgaccacgtgggcat

SEQ ID NO: 171247 - DNA, 24 bp, Artificial Sequence
  Description of Artificial Sequence: Synthetic oligonucleotide
gagttccgcgaccacgtgggcatg

SEQ ID NO: 171248 - DNA, 25 bp, Artificial Sequence
  Description of Artificial Sequence: Synthetic oligonucleotide
agttccgcgaccacgtgggcatgga

SEQ ID NO: 171249 - DNA, 24 bp, Artificial Sequence
  Description of Artificial Sequence: Synthetic oligonucleotide
gttccgcgaccacgtgggcatgga

SEQ ID NO: 171250 - DNA, 26 bp, Artificial Sequence
  Description of Artificial Sequence: Synthetic oligonucleotide
ttccgcgaccacgtgggcatggagat

SEQ ID NO: 171251 - DNA, 25 bp, Artificial Sequence
  Description of Artificial Sequence: Synthetic oligonucleotide
tccgcgaccacgtgggcatggagat

SEQ ID NO: 171252 - DNA, 24 bp, Artificial Sequence
  Description of Artificial Sequence: Synthetic oligonucleotide
ccgcgaccacgtgggcatggagat

SEQ ID NO: 171253 - DNA, 24 bp, Artificial Sequence
  Description of Artificial Sequence: Synthetic oligonucleotide
cgcgaccacgtgggcatggagatc

SEQ ID NO: 171254 - DNA, 25 bp, Artificial Sequence
  Description of Artificial Sequence: Synthetic oligonucleotide
gcgaccacgtgggcatggagatcct

SEQ ID NO: 171255 - DNA, 26 bp, Artificial Sequence
  Description of Artificial Sequence: Synthetic oligonucleotide
cgaccacgtgggcatggagatcctga

SEQ ID NO: 171256 - DNA, 27 bp, Artificial Sequence
  Description of Artificial Sequence: Synthetic oligonucleotide
gaccacgtgggcatggagatcctgact

SEQ ID NO: 171257 - DNA, 27 bp, Artificial Sequence
  Description of Artificial Sequence: Synthetic oligonucleotide
accacgtgggcatggagatcctgactc

SEQ ID NO: 171258 - DNA, 26 bp, Artificial Sequence
  Description of Artificial Sequence: Synthetic oligonucleotide
ccacgtgggcatggagatcctgactc

SEQ ID NO: 171259 - DNA, 26 bp, Artificial Sequence
  Description of Artificial Sequence: Synthetic oligonucleotide
cacgtgggcatggagatcctgactcc

SEQ ID NO: 171260 - DNA, 26 bp, Artificial Sequence
  Description of Artificial Sequence: Synthetic oligonucleotide
acgtgggcatggagatcctgactccg

SEQ ID NO: 171261 - DNA, 25 bp, Artificial Sequence
  Description of Artificial Sequence: Synthetic oligonucleotide
cgtgggcatggagatcctgactccg

SEQ ID NO: 171262 - DNA, 26 bp, Artificial Sequence
  Description of Artificial Sequence: Synthetic oligonucleotide
gtgggcatggagatcctgactccgct

SEQ ID NO: 171263 - DNA, 27 bp, Artificial Sequence
  Description of Artificial Sequence: Synthetic oligonucleotide
tgggcatggagatcctgactccgctgt

SEQ ID NO: 171264 - DNA, 27 bp, Artificial Sequence
  Description of Artificial Sequence: Synthetic oligonucleotide
gggcatggagatcctgactccgctgtt

SEQ ID NO: 171265 - DNA, 27 bp, Artificial Sequence
  Description of Artificial Sequence: Synthetic oligonucleotide
ggcatggagatcctgactccgctgttc

SEQ ID NO: 171266 - DNA, 27 bp, Artificial Sequence
  Description of Artificial Sequence: Synthetic oligonucleotide
gcatggagatcctgactccgctgttcg

SEQ ID NO: 171267 - DNA, 27 bp, Artificial Sequence
  Description of Artificial Sequence: Synthetic oligonucleotide
catggagatcctgactccgctgttcgg

SEQ ID NO: 171268 - DNA, 27 bp, Artificial Sequence
  Description of Artificial Sequence: Synthetic oligonucleotide
atggagatcctgactccgctgttcggc

SEQ ID NO: 171269 - DNA, 30 bp, Artificial Sequence
  Description of Artificial Sequence: Synthetic oligonucleotide
gtggctttcctgaagctgttcctggagatg

SEQ ID NO: 171270 - DNA, 30 bp, Artificial Sequence
  Description of Artificial Sequence: Synthetic oligonucleotide
tggctttcctgaagctgttcctggagatgg

SEQ ID NO: 171271 - DNA, 29 bp, Artificial Sequence
  Description of Artificial Sequence: Synthetic oligonucleotide
ggctttcctgaagctgttcctggagatgg

SEQ ID NO: 171272 - DNA, 29 bp, Artificial Sequence
  Description of Artificial Sequence: Synthetic oligonucleotide
gctttcctgaagctgttcctggagatggc

SEQ ID NO: 171273 - DNA, 29 bp, Artificial Sequence
  Description of Artificial Sequence: Synthetic oligonucleotide
ctttcctgaagctgttcctggagatggcg

SEQ ID NO: 171274 - DNA, 29 bp, Artificial Sequence
  Description of Artificial Sequence: Synthetic oligonucleotide
tttcctgaagctgttcctggagatggcgg

SEQ ID NO: 171275 - DNA, 28 bp, Artificial Sequence
  Description of Artificial Sequence: Synthetic oligonucleotide
ttcctgaagctgttcctggagatggcgg

SEQ ID NO: 171276 - DNA, 27 bp, Artificial Sequence
  Description of Artificial Sequence: Synthetic oligonucleotide
tcctgaagctgttcctggagatggcgg

SEQ ID NO: 171277 - DNA, 27 bp, Artificial Sequence
  Description of Artificial Sequence: Synthetic oligonucleotide
cctgaagctgttcctggagatggcgga

SEQ ID NO: 171278 - DNA, 27 bp, Artificial Sequence
  Description of Artificial Sequence: Synthetic oligonucleotide
ctgaagctgttcctggagatggcggag

SEQ ID NO: 171279 - DNA, 29 bp, Artificial Sequence
  Description of Artificial Sequence: Synthetic oligonucleotide
tgaagctgttcctggagatggcggagaag

SEQ ID NO: 171280 - DNA, 28 bp, Artificial Sequence
  Description of Artificial Sequence: Synthetic oligonucleotide
gaagctgttcctggagatggcggagaag

SEQ ID NO: 171281 - DNA, 28 bp, Artificial Sequence
  Description of Artificial Sequence: Synthetic oligonucleotide
aagctgttcctggagatggcggagaagc

SEQ ID NO: 171282 - DNA, 27 bp, Artificial Sequence
  Description of Artificial Sequence: Synthetic oligonucleotide
agctgttcctggagatggcggagaagc

SEQ ID NO: 171283 - DNA, 27 bp, Artificial Sequence
  Description of Artificial Sequence: Synthetic oligonucleotide
gctgttcctggagatggcggagaagca

SEQ ID NO: 171284 - DNA, 27 bp, Artificial Sequence
  Description of Artificial Sequence: Synthetic oligonucleotide
ctgttcctggagatggcggagaagcac

SEQ ID NO: 171285 - DNA, 29 bp, Artificial Sequence
  Description of Artificial Sequence: Synthetic oligonucleotide
tgttcctggagatggcggagaagcacttc

SEQ ID NO: 171286 - DNA, 28 bp, Artificial Sequence
  Description of Artificial Sequence: Synthetic oligonucleotide
gttcctggagatggcggagaagcacttc

SEQ ID NO: 171287 - DNA, 30 bp, Artificial Sequence
  Description of Artificial Sequence: Synthetic oligonucleotide
ttcctggagatggcggagaagcacttcatg

SEQ ID NO: 171288 - DNA, 29 bp, Artificial Sequence
  Description of Artificial Sequence: Synthetic oligonucleotide
tcctggagatggcggagaagcacttcatg

SEQ ID NO: 171289 - DNA, 28 bp, Artificial Sequence
  Description of Artificial Sequence: Synthetic oligonucleotide
cctggagatggcggagaagcacttcatg

SEQ ID NO: 171290 - DNA, 28 bp, Artificial Sequence
  Description of Artificial Sequence: Synthetic oligonucleotide
ctggagatggcggagaagcacttcatgg

SEQ ID NO: 171291 - DNA, 29 bp, Artificial Sequence
  Description of Artificial Sequence: Synthetic oligonucleotide
tggagatggcggagaagcacttcatggtg

SEQ ID NO: 171292 - DNA, 28 bp, Artificial Sequence
  Description of Artificial Sequence: Synthetic oligonucleotide
ggagatggcggagaagcacttcatggtg

SEQ ID NO: 171293 - DNA, 28 bp, Artificial Sequence
  Description of Artificial Sequence: Synthetic oligonucleotide
gagatggcggagaagcacttcatggtgg

SEQ ID NO: 171294 - DNA, 28 bp, Artificial Sequence
  Description of Artificial Sequence: Synthetic oligonucleotide
agatggcggagaagcacttcatggtggg

SEQ ID NO: 171295 - DNA, 27 bp, Artificial Sequence
  Description of Artificial Sequence: Synthetic oligonucleotide
gatggcggagaagcacttcatggtggg

SEQ ID NO: 171296 - DNA, 27 bp, Artificial Sequence
  Description of Artificial Sequence: Synthetic oligonucleotide
atggcggagaagcacttcatggtgggc

SEQ ID NO: 171297 - DNA, 26 bp, Artificial Sequence
  Description of Artificial Sequence: Synthetic oligonucleotide
tggcggagaagcacttcatggtgggc

SEQ ID NO: 171298 - DNA, 29 bp, Artificial Sequence
  Description of Artificial Sequence: Synthetic oligonucleotide
cagttcaggctccagaacaccaccattgc

SEQ ID NO: 171299 - DNA, 29 bp, Artificial Sequence
  Description of Artificial Sequence: Synthetic oligonucleotide
agttcaggctccagaacaccaccattgcg

SEQ ID NO: 171300 - DNA, 28 bp, Artificial Sequence
  Description of Artificial Sequence: Synthetic oligonucleotide
gttcaggctccagaacaccaccattgcg

SEQ ID NO: 171301 - DNA, 32 bp, Artificial Sequence
  Description of Artificial Sequence: Synthetic oligonucleotide
ttcaggctccagaacaccaccattgcgttaac

SEQ ID NO: 171302 - DNA, 31 bp, Artificial Sequence
  Description of Artificial Sequence: Synthetic oligonucleotide
tcaggctccagaacaccaccattgcgttaac

SEQ ID NO: 171303 - DNA, 30 bp, Artificial Sequence
  Description of Artificial Sequence: Synthetic oligonucleotide
caggctccagaacaccaccattgcgttaac

SEQ ID NO: 171304 - DNA, 31 bp, Artificial Sequence
  Description of Artificial Sequence: Synthetic oligonucleotide
aggctccagaacaccaccattgcgttaactg

SEQ ID NO: 171305 - DNA, 30 bp, Artificial Sequence
  Description of Artificial Sequence: Synthetic oligonucleotide
ggctccagaacaccaccattgcgttaactg

SEQ ID NO: 171306 - DNA, 31 bp, Artificial Sequence
  Description of Artificial Sequence: Synthetic oligonucleotide
gctccagaacaccaccattgcgttaactgtg

SEQ ID NO: 171307 - DNA, 34 bp, Artificial Sequence
  Description of Artificial Sequence: Synthetic oligonucleotide
ctccagaacaccaccattgcgttaactgtgtttg

SEQ ID NO: 171308 - DNA, 34 bp, Artificial Sequence
  Description of Artificial Sequence: Synthetic oligonucleotide
tccagaacaccaccattgcgttaactgtgtttgc

SEQ ID NO: 171309 - DNA, 33 bp, Artificial Sequence
  Description of Artificial Sequence: Synthetic oligonucleotide
ccagaacaccaccattgcgttaactgtgtttgc

SEQ ID NO: 171310 - DNA, 33 bp, Artificial Sequence
  Description of Artificial Sequence: Synthetic oligonucleotide
cagaacaccaccattgcgttaactgtgtttgcc

SEQ ID NO: 171311 - DNA, 35 bp, Artificial Sequence
  Description of Artificial Sequence: Synthetic oligonucleotide
agaacaccaccattgcgttaactgtgtttgccatc

SEQ ID NO: 171312 - DNA, 34 bp, Artificial Sequence
  Description of Artificial Sequence: Synthetic oligonucleotide
gaacaccaccattgcgttaactgtgtttgccatc

SEQ ID NO: 171313 - DNA, 36 bp, Artificial Sequence
  Description of Artificial Sequence: Synthetic oligonucleotide
aacaccaccattgcgttaactgtgtttgccatcaag

SEQ ID NO: 171314 - DNA, 35 bp, Artificial Sequence
  Description of Artificial Sequence: Synthetic oligonucleotide
acaccaccattgcgttaactgtgtttgccatcaag

SEQ ID NO: 171315 - DNA, 34 bp, Artificial Sequence
  Description of Artificial Sequence: Synthetic oligonucleotide
caccaccattgcgttaactgtgtttgccatcaag

SEQ ID NO: 171316 - DNA, 39 bp, Artificial Sequence
  Description of Artificial Sequence: Synthetic oligonucleotide
accaccattgcgttaactgtgtttgccatcaagaaatac

SEQ ID NO: 171317 - DNA, 38 bp, Artificial Sequence
  Description of Artificial Sequence: Synthetic oligonucleotide
ccaccattgcgttaactgtgtttgccatcaagaaatac

SEQ ID NO: 171318 - DNA, 38 bp, Artificial Sequence
  Description of Artificial Sequence: Synthetic oligonucleotide
caccattgcgttaactgtgtttgccatcaagaaatacg

SEQ ID NO: 171319 - DNA, 39 bp, Artificial Sequence
  Description of Artificial Sequence: Synthetic oligonucleotide
accattgcgttaactgtgtttgccatcaagaaatacgtg

SEQ ID NO: 171320 - DNA, 38 bp, Artificial Sequence
  Description of Artificial Sequence: Synthetic oligonucleotide
ccattgcgttaactgtgtttgccatcaagaaatacgtg

SEQ ID NO: 171321 - DNA, 38 bp, Artificial Sequence
  Description of Artificial Sequence: Synthetic oligonucleotide
cattgcgttaactgtgtttgccatcaagaaatacgtgg

SEQ ID NO: 171322 - DNA, 38 bp, Artificial Sequence
  Description of Artificial Sequence: Synthetic oligonucleotide
attgcgttaactgtgtttgccatcaagaaatacgtggc

SEQ ID NO: 171323 - DNA, 37 bp, Artificial Sequence
  Description of Artificial Sequence: Synthetic oligonucleotide
ttgcgttaactgtgtttgccatcaagaaatacgtggc

SEQ ID NO: 171324 - DNA, 36 bp, Artificial Sequence
  Description of Artificial Sequence: Synthetic oligonucleotide
tgcgttaactgtgtttgccatcaagaaatacgtggc

SEQ ID NO: 171325 - DNA, 35 bp, Artificial Sequence
  Description of Artificial Sequence: Synthetic oligonucleotide
gcgttaactgtgtttgccatcaagaaatacgtggc

SEQ ID NO: 171326 - DNA, 38 bp, Artificial Sequence
  Description of Artificial Sequence: Synthetic oligonucleotide
cgttaactgtgtttgccatcaagaaatacgtggctttc

SEQ ID NO: 171327 - DNA, 27 bp, Artificial Sequence
  Description of Artificial Sequence: Synthetic oligonucleotide
catctgcagcgcgtctcgttgccaaca

SEQ ID NO: 171328 - DNA, 29 bp, Artificial Sequence
  Description of Artificial Sequence: Synthetic oligonucleotide
atctgcagcgcgtctcgttgccaacatac

SEQ ID NO: 171329 - DNA, 28 bp, Artificial Sequence
  Description of Artificial Sequence: Synthetic oligonucleotide
tctgcagcgcgtctcgttgccaacatac

SEQ ID NO: 171330 - DNA, 27 bp, Artificial Sequence
  Description of Artificial Sequence: Synthetic oligonucleotide
ctgcagcgcgtctcgttgccaacatac

SEQ ID NO: 171331 - DNA, 27 bp, Artificial Sequence
  Description of Artificial Sequence: Synthetic oligonucleotide
tgcagcgcgtctcgttgccaacatacg

SEQ ID NO: 171332 - DNA, 27 bp, Artificial Sequence
  Description of Artificial Sequence: Synthetic oligonucleotide
gcagcgcgtctcgttgccaacatacgt

SEQ ID NO: 171333 - DNA, 27 bp, Artificial Sequence
  Description of Artificial Sequence: Synthetic oligonucleotide
cagcgcgtctcgttgccaacatacgtg

SEQ ID NO: 171334 - DNA, 27 bp, Artificial Sequence
  Description of Artificial Sequence: Synthetic oligonucleotide
agcgcgtctcgttgccaacatacgtgg

SEQ ID NO: 171335 - DNA, 26 bp, Artificial Sequence
  Description of Artificial Sequence: Synthetic oligonucleotide
gcgcgtctcgttgccaacatacgtgg

SEQ ID NO: 171336 - DNA, 27 bp, Artificial Sequence
  Description of Artificial Sequence: Synthetic oligonucleotide
cgcgtctcgttgccaacatacgtggct

SEQ ID NO: 171337 - DNA, 29 bp, Artificial Sequence
  Description of Artificial Sequence: Synthetic oligonucleotide
gcgtctcgttgccaacatacgtggctttc

SEQ ID NO: 171338 - DNA, 29 bp, Artificial Sequence
  Description of Artificial Sequence: Synthetic oligonucleotide
cgtctcgttgccaacatacgtggctttcc

SEQ ID NO: 171339 - DNA, 30 bp, Artificial Sequence
  Description of Artificial Sequence: Synthetic oligonucleotide
gtctcgttgccaacatacgtggctttcctg

SEQ ID NO: 171340 - DNA, 32 bp, Artificial Sequence
  Description of Artificial Sequence: Synthetic oligonucleotide
tctcgttgccaacatacgtggctttcctgaag

SEQ ID NO: 171341 - DNA, 31 bp, Artificial Sequence
  Description of Artificial Sequence: Synthetic oligonucleotide
ctcgttgccaacatacgtggctttcctgaag

SEQ ID NO: 171342 - DNA, 31 bp, Artificial Sequence
  Description of Artificial Sequence: Synthetic oligonucleotide
tcgttgccaacatacgtggctttcctgaagc

SEQ ID NO: 171343 - DNA, 30 bp, Artificial Sequence
  Description of Artificial Sequence: Synthetic oligonucleotide
cgttgccaacatacgtggctttcctgaagc

SEQ ID NO: 171344 - DNA, 31 bp, Artificial Sequence
  Description of Artificial Sequence: Synthetic oligonucleotide
gttgccaacatacgtggctttcctgaagctg

SEQ ID NO: 171345 - DNA, 33 bp, Artificial Sequence
  Description of Artificial Sequence: Synthetic oligonucleotide
ttgccaacatacgtggctttcctgaagctgttc

SEQ ID NO: 171346 - DNA, 32 bp, Artificial Sequence
  Description of Artificial Sequence: Synthetic oligonucleotide
tgccaacatacgtggctttcctgaagctgttc

SEQ ID NO: 171347 - DNA, 31 bp, Artificial Sequence
  Description of Artificial Sequence: Synthetic oligonucleotide
gccaacatacgtggctttcctgaagctgttc

SEQ ID NO: 171348 - DNA, 31 bp, Artificial Sequence
  Description of Artificial Sequence: Synthetic oligonucleotide
ccaacatacgtggctttcctgaagctgttcc

SEQ ID NO: 171349 - DNA, 32 bp, Artificial Sequence
  Description of Artificial Sequence: Synthetic oligonucleotide
caacatacgtggctttcctgaagctgttcctg

SEQ ID NO: 171350 - DNA, 32 bp, Artificial Sequence
  Description of Artificial Sequence: Synthetic oligonucleotide
aacatacgtggctttcctgaagctgttcctgg

SEQ ID NO: 171351 - DNA, 31 bp, Artificial Sequence
  Description of Artificial Sequence: Synthetic oligonucleotide
acatacgtggctttcctgaagctgttcctgg

SEQ ID NO: 171352 - DNA, 30 bp, Artificial Sequence
  Description of Artificial Sequence: Synthetic oligonucleotide
catacgtggctttcctgaagctgttcctgg

SEQ ID NO: 171353 - DNA, 25 bp, Artificial Sequence
  Description of Artificial Sequence: Synthetic oligonucleotide
caccccggcttctacggaagcagct

SEQ ID NO: 171354 - DNA, 25 bp, Artificial Sequence
  Description of Artificial Sequence: Synthetic oligonucleotide
accccggcttctacggaagcagctg

SEQ ID NO: 171355 - DNA, 24 bp, Artificial Sequence
  Description of Artificial Sequence: Synthetic oligonucleotide
ccccggcttctacggaagcagctg

SEQ ID NO: 171356 - DNA, 24 bp, Artificial Sequence
  Description of Artificial Sequence: Synthetic oligonucleotide
cccggcttctacggaagcagctgg

SEQ ID NO: 171357 - DNA, 25 bp, Artificial Sequence
  Description of Artificial Sequence: Synthetic oligonucleotide
ccggcttctacggaagcagctggga

SEQ ID NO: 171358 - DNA, 25 bp, Artificial Sequence
  Description of Artificial Sequence: Synthetic oligonucleotide
cggcttctacggaagcagctgggag

SEQ ID NO: 171359 - DNA, 25 bp, Artificial Sequence
  Description of Artificial Sequence: Synthetic oligonucleotide
ggcttctacggaagcagctgggagg

SEQ ID NO: 171360 - DNA, 25 bp, Artificial Sequence
  Description of Artificial Sequence: Synthetic oligonucleotide
gcttctacggaagcagctgggaggc

SEQ ID NO: 171361 - DNA, 27 bp, Artificial Sequence
  Description of Artificial Sequence: Synthetic oligonucleotide
cttctacggaagcagctgggaggcctt

SEQ ID NO: 171362 - DNA, 27 bp, Artificial Sequence
  Description of Artificial Sequence: Synthetic oligonucleotide
ttctacggaagcagctgggaggccttc

SEQ ID NO: 171363 - DNA, 27 bp, Artificial Sequence
  Description of Artificial Sequence: Synthetic oligonucleotide
tctacggaagcagctgggaggccttca

SEQ ID NO: 171364 - DNA, 26 bp, Artificial Sequence
  Description of Artificial Sequence: Synthetic oligonucleotide
ctacggaagcagctgggaggccttca

SEQ ID NO: 171365 - DNA, 26 bp, Artificial Sequence
  Description of Artificial Sequence: Synthetic oligonucleotide
tacggaagcagctgggaggccttcac

SEQ ID NO: 171366 - DNA, 25 bp, Artificial Sequence
  Description of Artificial Sequence: Synthetic oligonucleotide
acggaagcagctgggaggccttcac

SEQ ID NO: 171367 - DNA, 24 bp, Artificial Sequence
  Description of Artificial Sequence: Synthetic oligonucleotide
cggaagcagctgggaggccttcac

SEQ ID NO: 171368 - DNA, 26 bp, Artificial Sequence
  Description of Artificial Sequence: Synthetic oligonucleotide
ggaagcagctgggaggccttcaccta

SEQ ID NO: 171369 - DNA, 26 bp, Artificial Sequence
  Description of Artificial Sequence: Synthetic oligonucleotide
gaagcagctgggaggccttcacctac

SEQ ID NO: 171370 - DNA, 27 bp, Artificial Sequence
  Description of Artificial Sequence: Synthetic oligonucleotide
aagcagctgggaggccttcacctacga

SEQ ID NO: 171371 - DNA, 26 bp, Artificial Sequence
  Description of Artificial Sequence: Synthetic oligonucleotide
agcagctgggaggccttcacctacga

SEQ ID NO: 171372 - DNA, 25 bp, Artificial Sequence
  Description of Artificial Sequence: Synthetic oligonucleotide
gcagctgggaggccttcacctacga

SEQ ID NO: 171373 - DNA, 25 bp, Artificial Sequence
  Description of Artificial Sequence: Synthetic oligonucleotide
cagctgggaggccttcacctacgag

SEQ ID NO: 171374 - DNA, 25 bp, Artificial Sequence
  Description of Artificial Sequence: Synthetic oligonucleotide
agctgggaggccttcacctacgagc

SEQ ID NO: 171375 - DNA, 24 bp, Artificial Sequence
  Description of Artificial Sequence: Synthetic oligonucleotide
gctgggaggccttcacctacgagc

SEQ ID NO: 171376 - DNA, 24 bp, Artificial Sequence
  Description of Artificial Sequence: Synthetic oligonucleotide
ctgggaggccttcacctacgagcg

SEQ ID NO: 171377 - DNA, 24 bp, Artificial Sequence
  Description of Artificial Sequence: Synthetic oligonucleotide
tgggaggccttcacctacgagcgc

SEQ ID NO: 171378 - DNA, 25 bp, Artificial Sequence
  Description of Artificial Sequence: Synthetic oligonucleotide
aaacccaccaaggtgctctcccccg

SEQ ID NO: 171379 - DNA, 24 bp, Artificial Sequence
  Description of Artificial Sequence: Synthetic oligonucleotide
aacccaccaaggtgctctcccccg

SEQ ID NO: 171380 - DNA, 23 bp, Artificial Sequence
  Description of Artificial Sequence: Synthetic oligonucleotide
acccaccaaggtgctctcccccg

SEQ ID NO: 171381 - DNA, 22 bp, Artificial Sequence
  Description of Artificial Sequence: Synthetic oligonucleotide
cccaccaaggtgctctcccccg

SEQ ID NO: 171382 - DNA, 22 bp, Artificial Sequence
  Description of Artificial Sequence: Synthetic oligonucleotide
ccaccaaggtgctctcccccgg

SEQ ID NO: 171383 - DNA, 24 bp, Artificial Sequence
  Description of Artificial Sequence: Synthetic oligonucleotide
caccaaggtgctctcccccgggta

SEQ ID NO: 171384 - DNA, 26 bp, Artificial Sequence
  Description of Artificial Sequence: Synthetic oligonucleotide
accaaggtgctctcccccgggtactt

SEQ ID NO: 171385 - DNA, 25 bp, Artificial Sequence
  Description of Artificial Sequence: Synthetic oligonucleotide
ccaaggtgctctcccccgggtactt

SEQ ID NO: 171386 - DNA, 26 bp, Artificial Sequence
  Description of Artificial Sequence: Synthetic oligonucleotide
caaggtgctctcccccgggtacttgt

SEQ ID NO: 171387 - DNA, 26 bp, Artificial Sequence
  Description of Artificial Sequence: Synthetic oligonucleotide
aaggtgctctcccccgggtacttgtg

SEQ ID NO: 171388 - DNA, 25 bp, Artificial Sequence
  Description of Artificial Sequence: Synthetic oligonucleotide
aggtgctctcccccgggtacttgtg

SEQ ID NO: 171389 - DNA, 24 bp, Artificial Sequence
  Description of Artificial Sequence: Synthetic oligonucleotide
ggtgctctcccccgggtacttgtg

SEQ ID NO: 171390 - DNA, 24 bp, Artificial Sequence
  Description of Artificial Sequence: Synthetic oligonucleotide
gtgctctcccccgggtacttgtgg

SEQ ID NO: 171391 - DNA, 25 bp, Artificial Sequence
  Description of Artificial Sequence: Synthetic oligonucleotide
tgctctcccccgggtacttgtggga

SEQ ID NO: 171392 - DNA, 24 bp, Artificial Sequence
  Description of Artificial Sequence: Synthetic oligonucleotide
gctctcccccgggtacttgtggga

SEQ ID NO: 171393 - DNA, 24 bp, Artificial Sequence
  Description of Artificial Sequence: Synthetic oligonucleotide
ctctcccccgggtacttgtgggac

SEQ ID NO: 171394 - DNA, 25 bp, Artificial Sequence
  Description of Artificial Sequence: Synthetic oligonucleotide
tctcccccgggtacttgtgggacca

SEQ ID NO: 171395 - DNA, 24 bp, Artificial Sequence
  Description of Artificial Sequence: Synthetic oligonucleotide
ctcccccgggtacttgtgggacca

SEQ ID NO: 171396 - DNA, 24 bp, Artificial Sequence
  Description of Artificial Sequence: Synthetic oligonucleotide
tcccccgggtacttgtgggaccag

SEQ ID NO: 171397 - DNA, 23 bp, Artificial Sequence
  Description of Artificial Sequence: Synthetic oligonucleotide
cccccgggtacttgtgggaccag

SEQ ID NO: 171398 - DNA, 24 bp, Artificial Sequence
  Description of Artificial Sequence: Synthetic oligonucleotide
ccccgggtacttgtgggaccagca

SEQ ID NO: 171399 - DNA, 24 bp, Artificial Sequence
  Description of Artificial Sequence: Synthetic oligonucleotide
cccgggtacttgtgggaccagcag

SEQ ID NO: 171400 - DNA, 25 bp, Artificial Sequence
  Description of Artificial Sequence: Synthetic oligonucleotide
ccgggtacttgtgggaccagcagct

SEQ ID NO: 171401 - DNA, 25 bp, Artificial Sequence
  Description of Artificial Sequence: Synthetic oligonucleotide
cgggtacttgtgggaccagcagctg

SEQ ID NO: 171402 - DNA, 26 bp, Artificial Sequence
  Description of Artificial Sequence: Synthetic oligonucleotide
gggtacttgtgggaccagcagctgct

SEQ ID NO: 171403 - DNA, 26 bp, Artificial Sequence
  Description of Artificial Sequence: Synthetic oligonucleotide
ggtacttgtgggaccagcagctgctg

SEQ ID NO: 171404 - DNA, 21 bp, Artificial Sequence
  Description of Artificial Sequence: Synthetic oligonucleotide
gcgtgacgctggggaccggtg

SEQ ID NO: 171405 - DNA, 21 bp, Artificial Sequence
  Description of Artificial Sequence: Synthetic oligonucleotide
cgtgacgctggggaccggtgg

SEQ ID NO: 171406 - DNA, 21 bp, Artificial Sequence
  Description of Artificial Sequence: Synthetic oligonucleotide
gtgacgctggggaccggtggg

SEQ ID NO: 171407 - DNA, 22 bp, Artificial Sequence
  Description of Artificial Sequence: Synthetic oligonucleotide
tgacgctggggaccggtgggca

SEQ ID NO: 171408 - DNA, 21 bp, Artificial Sequence
  Description of Artificial Sequence: Synthetic oligonucleotide
gacgctggggaccggtgggca

SEQ ID NO: 171409 - DNA, 21 bp, Artificial Sequence
  Description of Artificial Sequence: Synthetic oligonucleotide
acgctggggaccggtgggcag

SEQ ID NO: 171410 - DNA, 20 bp, Artificial Sequence
  Description of Artificial Sequence: Synthetic oligonucleotide
cgctggggaccggtgggcag

SEQ ID NO: 171411 - DNA, 21 bp, Artificial Sequence
  Description of Artificial Sequence: Synthetic oligonucleotide
gctggggaccggtgggcagct

SEQ ID NO: 171412 - DNA, 22 bp, Artificial Sequence
  Description of Artificial Sequence: Synthetic oligonucleotide
ctggggaccggtgggcagctgt

SEQ ID NO: 171413 - DNA, 23 bp, Artificial Sequence
  Description of Artificial Sequence: Synthetic oligonucleotide
tggggaccggtgggcagctgtca

SEQ ID NO: 171414 - DNA, 22 bp, Artificial Sequence
  Description of Artificial Sequence: Synthetic oligonucleotide
ggggaccggtgggcagctgtca

SEQ ID NO: 171415 - DNA, 23 bp, Artificial Sequence
  Description of Artificial Sequence: Synthetic oligonucleotide
gggaccggtgggcagctgtcagt

SEQ ID NO: 171416 - DNA, 23 bp, Artificial Sequence
  Description of Artificial Sequence: Synthetic oligonucleotide
ggaccggtgggcagctgtcagtg

SEQ ID NO: 171417 - DNA, 24 bp, Artificial Sequence
  Description of Artificial Sequence: Synthetic oligonucleotide
gaccggtgggcagctgtcagtgct

SEQ ID NO: 171418 - DNA, 24 bp, Artificial Sequence
  Description of Artificial Sequence: Synthetic oligonucleotide
accggtgggcagctgtcagtgctg

SEQ ID NO: 171419 - DNA, 23 bp, Artificial Sequence
  Description of Artificial Sequence: Synthetic oligonucleotide
ccggtgggcagctgtcagtgctg

SEQ ID NO: 171420 - DNA, 24 bp, Artificial Sequence
  Description of Artificial Sequence: Synthetic oligonucleotide
cggtgggcagctgtcagtgctgga

SEQ ID NO: 171421 - DNA, 24 bp, Artificial Sequence
  Description of Artificial Sequence: Synthetic oligonucleotide
ggtgggcagctgtcagtgctggag

SEQ ID NO: 171422 - DNA, 25 bp, Artificial Sequence
  Description of Artificial Sequence: Synthetic oligonucleotide
gtgggcagctgtcagtgctggaggt

SEQ ID NO: 171423 - DNA, 25 bp, Artificial Sequence
  Description of Artificial Sequence: Synthetic oligonucleotide
tgggcagctgtcagtgctggaggtg

SEQ ID NO: 171424 - DNA, 24 bp, Artificial Sequence
  Description of Artificial Sequence: Synthetic oligonucleotide
gggcagctgtcagtgctggaggtg

SEQ ID NO: 171425 - DNA, 31 bp, Artificial Sequence
  Description of Artificial Sequence: Synthetic oligonucleotide
gcatggagatgatcagtgacttctgcgagtg

SEQ ID NO: 171426 - DNA, 31 bp, Artificial Sequence
  Description of Artificial Sequence: Synthetic oligonucleotide
catggagatgatcagtgacttctgcgagtgg

SEQ ID NO: 171427 - DNA, 31 bp, Artificial Sequence
  Description of Artificial Sequence: Synthetic oligonucleotide
atggagatgatcagtgacttctgcgagtggc

SEQ ID NO: 171428 - DNA, 30 bp, Artificial Sequence
  Description of Artificial Sequence: Synthetic oligonucleotide
tggagatgatcagtgacttctgcgagtggc

SEQ ID NO: 171429 - DNA, 29 bp, Artificial Sequence
  Description of Artificial Sequence: Synthetic oligonucleotide
ggagatgatcagtgacttctgcgagtggc

SEQ ID NO: 171430 - DNA, 29 bp, Artificial Sequence
  Description of Artificial Sequence: Synthetic oligonucleotide
gagatgatcagtgacttctgcgagtggcg

SEQ ID NO: 171431 - DNA, 29 bp, Artificial Sequence
  Description of Artificial Sequence: Synthetic oligonucleotide
agatgatcagtgacttctgcgagtggcgc

SEQ ID NO: 171432 - DNA, 28 bp, Artificial Sequence
  Description of Artificial Sequence: Synthetic oligonucleotide
gatgatcagtgacttctgcgagtggcgc

SEQ ID NO: 171433 - DNA, 30 bp, Artificial Sequence
  Description of Artificial Sequence: Synthetic oligonucleotide
atgatcagtgacttctgcgagtggcgcttc

SEQ ID NO: 171434 - DNA, 29 bp, Artificial Sequence
  Description of Artificial Sequence: Synthetic oligonucleotide
tgatcagtgacttctgcgagtggcgcttc

SEQ ID NO: 171435 - DNA, 28 bp, Artificial Sequence
  Description of Artificial Sequence: Synthetic oligonucleotide
gatcagtgacttctgcgagtggcgcttc

SEQ ID NO: 171436 - DNA, 28 bp, Artificial Sequence
  Description of Artificial Sequence: Synthetic oligonucleotide
atcagtgacttctgcgagtggcgcttcc

SEQ ID NO: 171437 - DNA, 27 bp, Artificial Sequence
  Description of Artificial Sequence: Synthetic oligonucleotide
tcagtgacttctgcgagtggcgcttcc

SEQ ID NO: 171438 - DNA, 27 bp, Artificial Sequence
  Description of Artificial Sequence: Synthetic oligonucleotide
cagtgacttctgcgagtggcgcttcct

SEQ ID NO: 171439 - DNA, 27 bp, Artificial Sequence
  Description of Artificial Sequence: Synthetic oligonucleotide
agtgacttctgcgagtggcgcttcctc

SEQ ID NO: 171440 - DNA, 27 bp, Artificial Sequence
  Description of Artificial Sequence: Synthetic oligonucleotide
gtgacttctgcgagtggcgcttcctca

SEQ ID NO: 171441 - DNA, 27 bp, Artificial Sequence
  Description of Artificial Sequence: Synthetic oligonucleotide
tgacttctgcgagtggcgcttcctcag

SEQ ID NO: 171442 - DNA, 26 bp, Artificial Sequence
  Description of Artificial Sequence: Synthetic oligonucleotide
gacttctgcgagtggcgcttcctcag

SEQ ID NO: 171443 - DNA, 26 bp, Artificial Sequence
  Description of Artificial Sequence: Synthetic oligonucleotide
acttctgcgagtggcgcttcctcagc

SEQ ID NO: 171444 - DNA, 25 bp, Artificial Sequence
  Description of Artificial Sequence: Synthetic oligonucleotide
cttctgcgagtggcgcttcctcagc

SEQ ID NO: 171445 - DNA, 26 bp, Artificial Sequence
  Description of Artificial Sequence: Synthetic oligonucleotide
ttctgcgagtggcgcttcctcagcga

SEQ ID NO: 171446 - DNA, 25 bp, Artificial Sequence
  Description of Artificial Sequence: Synthetic oligonucleotide
tctgcgagtggcgcttcctcagcga

SEQ ID NO: 171447 - DNA, 24 bp, Artificial Sequence
  Description of Artificial Sequence: Synthetic oligonucleotide
ctgcgagtggcgcttcctcagcga

SEQ ID NO: 171448 - DNA, 24 bp, Artificial Sequence
  Description of Artificial Sequence: Synthetic oligonucleotide
tgcgagtggcgcttcctcagcgag

SEQ ID NO: 171449 - DNA, 23 bp, Artificial Sequence
  Description of Artificial Sequence: Synthetic oligonucleotide
gcgagtggcgcttcctcagcgag

SEQ ID NO: 171450 - DNA, 24 bp, Artificial Sequence
  Description of Artificial Sequence: Synthetic oligonucleotide
cgagtggcgcttcctcagcgaggt

SEQ ID NO: 171451 - DNA, 24 bp, Artificial Sequence
  Description of Artificial Sequence: Synthetic oligonucleotide
gagtggcgcttcctcagcgaggtg

SEQ ID NO: 171452 - DNA, 27 bp, Artificial Sequence
  Description of Artificial Sequence: Synthetic oligonucleotide
agtggcgcttcctcagcgaggtggatt

SEQ ID NO: 171453 - DNA, 27 bp, Artificial Sequence
  Description of Artificial Sequence: Synthetic oligonucleotide
gtggcgcttcctcagcgaggtggatta

SEQ ID NO: 171454 - DNA, 27 bp, Artificial Sequence
  Description of Artificial Sequence: Synthetic oligonucleotide
tggcgcttcctcagcgaggtggattac

SEQ ID NO: 171455 - DNA, 27 bp, Artificial Sequence
  Description of Artificial Sequence: Synthetic oligonucleotide
cgttgccaaggatggtctacccccagt

SEQ ID NO: 171456 - DNA, 27 bp, Artificial Sequence
  Description of Artificial Sequence: Synthetic oligonucleotide
gttgccaaggatggtctacccccagtc

SEQ ID NO: 171457 - DNA, 30 bp, Artificial Sequence
  Description of Artificial Sequence: Synthetic oligonucleotide
ttgccaaggatggtctacccccagtcaaag

SEQ ID NO: 171458 - DNA, 29 bp, Artificial Sequence
  Description of Artificial Sequence: Synthetic oligonucleotide
tgccaaggatggtctacccccagtcaaag

SEQ ID NO: 171459 - DNA, 28 bp, Artificial Sequence
  Description of Artificial Sequence: Synthetic oligonucleotide
gccaaggatggtctacccccagtcaaag

SEQ ID NO: 171460 - DNA, 28 bp, Artificial Sequence
  Description of Artificial Sequence: Synthetic oligonucleotide
ccaaggatggtctacccccagtcaaagg

SEQ ID NO: 171461 - DNA, 29 bp, Artificial Sequence
  Description of Artificial Sequence: Synthetic oligonucleotide
caaggatggtctacccccagtcaaaggtg

SEQ ID NO: 171462 - DNA, 29 bp, Artificial Sequence
  Description of Artificial Sequence: Synthetic oligonucleotide
aaggatggtctacccccagtcaaaggtgc

SEQ ID NO: 171463 - DNA, 28 bp, Artificial Sequence
  Description of Artificial Sequence: Synthetic oligonucleotide
aggatggtctacccccagtcaaaggtgc

SEQ ID NO: 171464 - DNA, 27 bp, Artificial Sequence
  Description of Artificial Sequence: Synthetic oligonucleotide
ggatggtctacccccagtcaaaggtgc

SEQ ID NO: 171465 - DNA, 28 bp, Artificial Sequence
  Description of Artificial Sequence: Synthetic oligonucleotide
gatggtctacccccagtcaaaggtgctg

SEQ ID NO: 171466 - DNA, 29 bp, Artificial Sequence
  Description of Artificial Sequence: Synthetic oligonucleotide
atggtctacccccagtcaaaggtgctgac

SEQ ID NO: 171467 - DNA, 28 bp, Artificial Sequence
  Description of Artificial Sequence: Synthetic oligonucleotide
tggtctacccccagtcaaaggtgctgac

SEQ ID NO: 171468 - DNA, 27 bp, Artificial Sequence
  Description of Artificial Sequence: Synthetic oligonucleotide
ggtctacccccagtcaaaggtgctgac

SEQ ID NO: 171469 - DNA, 28 bp, Artificial Sequence
  Description of Artificial Sequence: Synthetic oligonucleotide
gtctacccccagtcaaaggtgctgacac

SEQ ID NO: 171470 - DNA, 28 bp, Artificial Sequence
  Description of Artificial Sequence: Synthetic oligonucleotide
tctacccccagtcaaaggtgctgacacc

SEQ ID NO: 171471 - DNA, 27 bp, Artificial Sequence
  Description of Artificial Sequence: Synthetic oligonucleotide
ctacccccagtcaaaggtgctgacacc

SEQ ID NO: 171472 - DNA, 27 bp, Artificial Sequence
  Description of Artificial Sequence: Synthetic oligonucleotide
tacccccagtcaaaggtgctgacaccg

SEQ ID NO: 171473 - DNA, 27 bp, Artificial Sequence
  Description of Artificial Sequence: Synthetic oligonucleotide
acccccagtcaaaggtgctgacaccgt

SEQ ID NO: 171474 - DNA, 26 bp, Artificial Sequence
  Description of Artificial Sequence: Synthetic oligonucleotide
cccccagtcaaaggtgctgacaccgt

SEQ ID NO: 171475 - DNA, 27 bp, Artificial Sequence
  Description of Artificial Sequence: Synthetic oligonucleotide
ccccagtcaaaggtgctgacaccgtgt

SEQ ID NO: 171476 - DNA, 28 bp, Artificial Sequence
  Description of Artificial Sequence: Synthetic oligonucleotide
cccagtcaaaggtgctgacaccgtgtag

SEQ ID NO: 171477 - DNA, 28 bp, Artificial Sequence
  Description of Artificial Sequence: Synthetic oligonucleotide
ccagtcaaaggtgctgacaccgtgtagg

SEQ ID NO: 171478 - DNA, 30 bp, Artificial Sequence
  Description of Artificial Sequence: Synthetic oligonucleotide
cagtcaaaggtgctgacaccgtgtaggaag

SEQ ID NO: 171479 - DNA, 30 bp, Artificial Sequence
  Description of Artificial Sequence: Synthetic oligonucleotide
agtcaaaggtgctgacaccgtgtaggaagg

SEQ ID NO: 171480 - DNA, 29 bp, Artificial Sequence
  Description of Artificial Sequence: Synthetic oligonucleotide
gtcaaaggtgctgacaccgtgtaggaagg

SEQ ID NO: 171481 - DNA, 31 bp, Artificial Sequence
  Description of Artificial Sequence: Synthetic oligonucleotide
tcaaaggtgctgacaccgtgtaggaaggatg

SEQ ID NO: 171482 - DNA, 21 bp, Artificial Sequence
  Description of Artificial Sequence: Synthetic oligonucleotide
ccccgcgtgacgctggggact

SEQ ID NO: 171483 - DNA, 21 bp, Artificial Sequence
  Description of Artificial Sequence: Synthetic oligonucleotide
cccgcgtgacgctggggactg

SEQ ID NO: 171484 - DNA, 22 bp, Artificial Sequence
  Description of Artificial Sequence: Synthetic oligonucleotide
ccgcgtgacgctggggactggt

SEQ ID NO: 171485 - DNA, 22 bp, Artificial Sequence
  Description of Artificial Sequence: Synthetic oligonucleotide
cgcgtgacgctggggactggtc

SEQ ID NO: 171486 - DNA, 22 bp, Artificial Sequence
  Description of Artificial Sequence: Synthetic oligonucleotide
gcgtgacgctggggactggtcg

SEQ ID NO: 171487 - DNA, 22 bp, Artificial Sequence
  Description of Artificial Sequence: Synthetic oligonucleotide
cgtgacgctggggactggtcgg

SEQ ID NO: 171488 - DNA, 23 bp, Artificial Sequence
  Description of Artificial Sequence: Synthetic oligonucleotide
gtgacgctggggactggtcggca

SEQ ID NO: 171489 - DNA, 23 bp, Artificial Sequence
  Description of Artificial Sequence: Synthetic oligonucleotide
tgacgctggggactggtcggcag

SEQ ID NO: 171490 - DNA, 22 bp, Artificial Sequence
  Description of Artificial Sequence: Synthetic oligonucleotide
gacgctggggactggtcggcag

SEQ ID NO: 171491 - DNA, 23 bp, Artificial Sequence
  Description of Artificial Sequence: Synthetic oligonucleotide
acgctggggactggtcggcagct

SEQ ID NO: 171492 - DNA, 22 bp, Artificial Sequence
  Description of Artificial Sequence: Synthetic oligonucleotide
cgctggggactggtcggcagct

SEQ ID NO: 171493 - DNA, 23 bp, Artificial Sequence
  Description of Artificial Sequence: Synthetic oligonucleotide
gctggggactggtcggcagctgt

SEQ ID NO: 171494 - DNA, 24 bp, Artificial Sequence
  Description of Artificial Sequence: Synthetic oligonucleotide
ctggggactggtcggcagctgtca

SEQ ID NO: 171495 - DNA, 25 bp, Artificial Sequence
  Description of Artificial Sequence: Synthetic oligonucleotide
tggggactggtcggcagctgtcagt

SEQ ID NO: 171496 - DNA, 24 bp, Artificial Sequence
  Description of Artificial Sequence: Synthetic oligonucleotide
ggggactggtcggcagctgtcagt

SEQ ID NO: 171497 - DNA, 24 bp, Artificial Sequence
  Description of Artificial Sequence: Synthetic oligonucleotide
gggactggtcggcagctgtcagtg

SEQ ID NO: 171498 - DNA, 25 bp, Artificial Sequence
  Description of Artificial Sequence: Synthetic oligonucleotide
ggactggtcggcagctgtcagtgct

SEQ ID NO: 171499 - DNA, 25 bp, Artificial Sequence
  Description of Artificial Sequence: Synthetic oligonucleotide
gactggtcggcagctgtcagtgctg

SEQ ID NO: 171500 - DNA, 26 bp, Artificial Sequence
  Description of Artificial Sequence: Synthetic oligonucleotide
actggtcggcagctgtcagtgctgga

SEQ ID NO: 171501 - DNA, 25 bp, Artificial Sequence
  Description of Artificial Sequence: Synthetic oligonucleotide
ctggtcggcagctgtcagtgctgga

SEQ ID NO: 171502 - DNA, 25 bp, Artificial Sequence
  Description of Artificial Sequence: Synthetic oligonucleotide
tggtcggcagctgtcagtgctggag

SEQ ID NO: 171503 - DNA, 28 bp, Artificial Sequence
  Description of Artificial Sequence: Synthetic oligonucleotide
acgagggcgatttctactacctggggag

SEQ ID NO: 171504 - DNA, 27 bp, Artificial Sequence
  Description of Artificial Sequence: Synthetic oligonucleotide
cgagggcgatttctactacctggggag

SEQ ID NO: 171505 - DNA, 27 bp, Artificial Sequence
  Description of Artificial Sequence: Synthetic oligonucleotide
gagggcgatttctactacctggggagg

SEQ ID NO: 171506 - DNA, 29 bp, Artificial Sequence
  Description of Artificial Sequence: Synthetic oligonucleotide
agggcgatttctactacctggggaggttc

SEQ ID NO: 171507 - DNA, 28 bp, Artificial Sequence
  Description of Artificial Sequence: Synthetic oligonucleotide
gggcgatttctactacctggggaggttc

SEQ ID NO: 171508 - DNA, 30 bp, Artificial Sequence
  Description of Artificial Sequence: Synthetic oligonucleotide
ggcgatttctactacctggggaggttcttc

SEQ ID NO: 171509 - DNA, 30 bp, Artificial Sequence
  Description of Artificial Sequence: Synthetic oligonucleotide
gcgatttctactacctggggaggttcttcg

SEQ ID NO: 171510 - DNA, 30 bp, Artificial Sequence
  Description of Artificial Sequence: Synthetic oligonucleotide
cgatttctactacctggggaggttcttcgg

SEQ ID NO: 171511 - DNA, 30 bp, Artificial Sequence
  Description of Artificial Sequence: Synthetic oligonucleotide
gatttctactacctggggaggttcttcggg

SEQ ID NO: 171512 - DNA, 30 bp, Artificial Sequence
  Description of Artificial Sequence: Synthetic oligonucleotide
atttctactacctggggaggttcttcgggg

SEQ ID NO: 171513 - DNA, 29 bp, Artificial Sequence
  Description of Artificial Sequence: Synthetic oligonucleotide
tttctactacctggggaggttcttcgggg

SEQ ID NO: 171514 - DNA, 28 bp, Artificial Sequence
  Description of Artificial Sequence: Synthetic oligonucleotide
ttctactacctggggaggttcttcgggg

SEQ ID NO: 171515 - DNA, 27 bp, Artificial Sequence
  Description of Artificial Sequence: Synthetic oligonucleotide
tctactacctggggaggttcttcgggg

SEQ ID NO: 171516 - DNA, 26 bp, Artificial Sequence
  Description of Artificial Sequence: Synthetic oligonucleotide
ctactacctggggaggttcttcgggg

SEQ ID NO: 171517 - DNA, 26 bp, Artificial Sequence
  Description of Artificial Sequence: Synthetic oligonucleotide
tactacctggggaggttcttcggggg

SEQ ID NO: 171518 - DNA, 25 bp, Artificial Sequence
  Description of Artificial Sequence: Synthetic oligonucleotide
actacctggggaggttcttcggggg

SEQ ID NO: 171519 - DNA, 24 bp, Artificial Sequence
  Description of Artificial Sequence: Synthetic oligonucleotide
ctacctggggaggttcttcggggg

SEQ ID NO: 171520 - DNA, 25 bp, Artificial Sequence
  Description of Artificial Sequence: Synthetic oligonucleotide
tacctggggaggttcttcggggggt

SEQ ID NO: 171521 - DNA, 24 bp, Artificial Sequence
  Description of Artificial Sequence: Synthetic oligonucleotide
acctggggaggttcttcggggggt

SEQ ID NO: 171522 - DNA, 23 bp, Artificial Sequence
  Description of Artificial Sequence: Synthetic oligonucleotide
cctggggaggttcttcggggggt

SEQ ID NO: 171523 - DNA, 23 bp, Artificial Sequence
  Description of Artificial Sequence: Synthetic oligonucleotide
ctggggaggttcttcggggggtc

SEQ ID NO: 171524 - DNA, 23 bp, Artificial Sequence
  Description of Artificial Sequence: Synthetic oligonucleotide
tggggaggttcttcggggggtcg

SEQ ID NO: 171525 - DNA, 22 bp, Artificial Sequence
  Description of Artificial Sequence: Synthetic oligonucleotide
ggggaggttcttcggggggtcg

SEQ ID NO: 171526 - DNA, 23 bp, Artificial Sequence
  Description of Artificial Sequence: Synthetic oligonucleotide
gggaggttcttcggggggtcggt

SEQ ID NO: 171527 - DNA, 23 bp, Artificial Sequence
  Description of Artificial Sequence: Synthetic oligonucleotide
ggaggttcttcggggggtcggtg

SEQ ID NO: 171528 - DNA, 25 bp, Artificial Sequence
  Description of Artificial Sequence: Synthetic oligonucleotide
gaggttcttcggggggtcggtgcaa

SEQ ID NO: 171529 - DNA, 26 bp, Artificial Sequence
  Description of Artificial Sequence: Synthetic oligonucleotide
aggttcttcggggggtcggtgcaaga

SEQ ID NO: 171530 - DNA, 36 bp, Artificial Sequence
  Description of Artificial Sequence: Synthetic oligonucleotide
gaaaaccaaaatgccacacacttcgacctatgatcc

SEQ ID NO: 171531 - DNA, 40 bp, Artificial Sequence
  Description of Artificial Sequence: Synthetic oligonucleotide
aaaaccaaaatgccacacacttcgacctatgatccttttc

SEQ ID NO: 171532 - DNA, 39 bp, Artificial Sequence
  Description of Artificial Sequence: Synthetic oligonucleotide
aaaccaaaatgccacacacttcgacctatgatccttttc

SEQ ID NO: 171533 - DNA, 38 bp, Artificial Sequence
  Description of Artificial Sequence: Synthetic oligonucleotide
aaccaaaatgccacacacttcgacctatgatccttttc

SEQ ID NO: 171534 - DNA, 37 bp, Artificial Sequence
  Description of Artificial Sequence: Synthetic oligonucleotide
accaaaatgccacacacttcgacctatgatccttttc

SEQ ID NO: 171535 - DNA, 36 bp, Artificial Sequence
  Description of Artificial Sequence: Synthetic oligonucleotide
ccaaaatgccacacacttcgacctatgatccttttc

SEQ ID NO: 171536 - DNA, 36 bp, Artificial Sequence
  Description of Artificial Sequence: Synthetic oligonucleotide
caaaatgccacacacttcgacctatgatccttttcc

SEQ ID NO: 171537 - DNA, 43 bp, Artificial Sequence
  Description of Artificial Sequence: Synthetic oligonucleotide
aaaatgccacacacttcgacctatgatccttttcctaataatg

SEQ ID NO: 171538 - DNA, 42 bp, Artificial Sequence
  Description of Artificial Sequence: Synthetic oligonucleotide
aaatgccacacacttcgacctatgatccttttcctaataatg

SEQ ID NO: 171539 - DNA, 41 bp, Artificial Sequence
  Description of Artificial Sequence: Synthetic oligonucleotide
aatgccacacacttcgacctatgatccttttcctaataatg

SEQ ID NO: 171540 - DNA, 40 bp, Artificial Sequence
  Description of Artificial Sequence: Synthetic oligonucleotide
atgccacacacttcgacctatgatccttttcctaataatg

SEQ ID NO: 171541 - DNA, 39 bp, Artificial Sequence
  Description of Artificial Sequence: Synthetic oligonucleotide
tgccacacacttcgacctatgatccttttcctaataatg

SEQ ID NO: 171542 - DNA, 38 bp, Artificial Sequence
  Description of Artificial Sequence: Synthetic oligonucleotide
gccacacacttcgacctatgatccttttcctaataatg

SEQ ID NO: 171543 - DNA, 38 bp, Artificial Sequence
  Description of Artificial Sequence: Synthetic oligonucleotide
ccacacacttcgacctatgatccttttcctaataatgc

SEQ ID NO: 171544 - DNA, 40 bp, Artificial Sequence
  Description of Artificial Sequence: Synthetic oligonucleotide
cacacacttcgacctatgatccttttcctaataatgcttg

SEQ ID NO: 171545 - DNA, 41 bp, Artificial Sequence
  Description of Artificial Sequence: Synthetic oligonucleotide
acacacttcgacctatgatccttttcctaataatgcttgtc

SEQ ID NO: 171546 - DNA, 40 bp, Artificial Sequence
  Description of Artificial Sequence: Synthetic oligonucleotide
cacacttcgacctatgatccttttcctaataatgcttgtc

SEQ ID NO: 171547 - DNA, 42 bp, Artificial Sequence
  Description of Artificial Sequence: Synthetic oligonucleotide
acacttcgacctatgatccttttcctaataatgcttgtcttg

SEQ ID NO: 171548 - DNA, 39 bp, Artificial Sequence
  Description of Artificial Sequence: Synthetic oligonucleotide
ctaataatgcttgtcttggtcttgtttggttacgggttc

SEQ ID NO: 171549 - DNA, 39 bp, Artificial Sequence
  Description of Artificial Sequence: Synthetic oligonucleotide
taataatgcttgtcttggtcttgtttggttacgggttcc

SEQ ID NO: 171550 - DNA, 38 bp, Artificial Sequence
  Description of Artificial Sequence: Synthetic oligonucleotide
aataatgcttgtcttggtcttgtttggttacgggttcc

SEQ ID NO: 171551 - DNA, 37 bp, Artificial Sequence
  Description of Artificial Sequence: Synthetic oligonucleotide
ataatgcttgtcttggtcttgtttggttacgggttcc

SEQ ID NO: 171552 - DNA, 36 bp, Artificial Sequence
  Description of Artificial Sequence: Synthetic oligonucleotide
taatgcttgtcttggtcttgtttggttacgggttcc

SEQ ID NO: 171553 - DNA, 35 bp, Artificial Sequence
  Description of Artificial Sequence: Synthetic oligonucleotide
aatgcttgtcttggtcttgtttggttacgggttcc

SEQ ID NO: 171554 - DNA, 34 bp, Artificial Sequence
  Description of Artificial Sequence: Synthetic oligonucleotide
atgcttgtcttggtcttgtttggttacgggttcc

SEQ ID NO: 171555 - DNA, 33 bp, Artificial Sequence
  Description of Artificial Sequence: Synthetic oligonucleotide
tgcttgtcttggtcttgtttggttacgggttcc

SEQ ID NO: 171556 - DNA, 32 bp, Artificial Sequence
  Description of Artificial Sequence: Synthetic oligonucleotide
gcttgtcttggtcttgtttggttacgggttcc

SEQ ID NO: 171557 - DNA, 35 bp, Artificial Sequence
  Description of Artificial Sequence: Synthetic oligonucleotide
cttgtcttggtcttgtttggttacgggttcctaag

SEQ ID NO: 171558 - DNA, 35 bp, Artificial Sequence
  Description of Artificial Sequence: Synthetic oligonucleotide
ttgtcttggtcttgtttggttacgggttcctaagc

SEQ ID NO: 171559 - DNA, 34 bp, Artificial Sequence
  Description of Artificial Sequence: Synthetic oligonucleotide
tgtcttggtcttgtttggttacgggttcctaagc

SEQ ID NO: 171560 - DNA, 33 bp, Artificial Sequence
  Description of Artificial Sequence: Synthetic oligonucleotide
gtcttggtcttgtttggttacgggttcctaagc

SEQ ID NO: 171561 - DNA, 33 bp, Artificial Sequence
  Description of Artificial Sequence: Synthetic oligonucleotide
tcttggtcttgtttggttacgggttcctaagcc

SEQ ID NO: 171562 - DNA, 32 bp, Artificial Sequence
  Description of Artificial Sequence: Synthetic oligonucleotide
cttggtcttgtttggttacgggttcctaagcc

SEQ ID NO: 171563 - DNA, 32 bp, Artificial Sequence
  Description of Artificial Sequence: Synthetic oligonucleotide
ttggtcttgtttggttacgggttcctaagccc

SEQ ID NO: 171564 - DNA, 31 bp, Artificial Sequence
  Description of Artificial Sequence: Synthetic oligonucleotide
tggtcttgtttggttacgggttcctaagccc

SEQ ID NO: 171565 - DNA, 30 bp, Artificial Sequence
  Description of Artificial Sequence: Synthetic oligonucleotide
ggtcttgtttggttacgggttcctaagccc

SEQ ID NO: 171566 - DNA, 30 bp, Artificial Sequence
  Description of Artificial Sequence: Synthetic oligonucleotide
gtcttgtttggttacgggttcctaagcccc

SEQ ID NO: 171567 - DNA, 31 bp, Artificial Sequence
  Description of Artificial Sequence: Synthetic oligonucleotide
tcttgtttggttacgggttcctaagccccag

SEQ ID NO: 171568 - DNA, 30 bp, Artificial Sequence
  Description of Artificial Sequence: Synthetic oligonucleotide
cttgtttggttacgggttcctaagccccag

SEQ ID NO: 171569 - DNA, 32 bp, Artificial Sequence
  Description of Artificial Sequence: Synthetic oligonucleotide
ttgtttggttacgggttcctaagccccagaag

SEQ ID NO: 171570 - DNA, 31 bp, Artificial Sequence
  Description of Artificial Sequence: Synthetic oligonucleotide
tgtttggttacgggttcctaagccccagaag

SEQ ID NO: 171571 - DNA, 30 bp, Artificial Sequence
  Description of Artificial Sequence: Synthetic oligonucleotide
gtttggttacgggttcctaagccccagaag

SEQ ID NO: 171572 - DNA, 31 bp, Artificial Sequence
  Description of Artificial Sequence: Synthetic oligonucleotide
tttggttacgggttcctaagccccagaagtc

SEQ ID NO: 171573 - DNA, 30 bp, Artificial Sequence
  Description of Artificial Sequence: Synthetic oligonucleotide
ttggttacgggttcctaagccccagaagtc

SEQ ID NO: 171574 - DNA, 29 bp, Artificial Sequence
  Description of Artificial Sequence: Synthetic oligonucleotide
tggttacgggttcctaagccccagaagtc

SEQ ID NO: 171575 - DNA, 28 bp, Artificial Sequence
  Description of Artificial Sequence: Synthetic oligonucleotide
ggttacgggttcctaagccccagaagtc

SEQ ID NO: 171576 - DNA, 32 bp, Artificial Sequence
  Description of Artificial Sequence: Synthetic oligonucleotide
gttacgggttcctaagccccagaagtctaatg

SEQ ID NO: 171577 - DNA, 32 bp, Artificial Sequence
  Description of Artificial Sequence: Synthetic oligonucleotide
ttacgggttcctaagccccagaagtctaatgc

SEQ ID NO: 171578 - DNA, 31 bp, Artificial Sequence
  Description of Artificial Sequence: Synthetic oligonucleotide
tacgggttcctaagccccagaagtctaatgc

SEQ ID NO: 171579 - DNA, 30 bp, Artificial Sequence
  Description of Artificial Sequence: Synthetic oligonucleotide
acgggttcctaagccccagaagtctaatgc

SEQ ID NO: 171580 - DNA, 29 bp, Artificial Sequence
  Description of Artificial Sequence: Synthetic oligonucleotide
cgggttcctaagccccagaagtctaatgc

SEQ ID NO: 171581 - DNA, 29 bp, Artificial Sequence
  Description of Artificial Sequence: Synthetic oligonucleotide
gggttcctaagccccagaagtctaatgcc

SEQ ID NO: 171582 - DNA, 30 bp, Artificial Sequence
  Description of Artificial Sequence: Synthetic oligonucleotide
ggttcctaagccccagaagtctaatgccag

SEQ ID NO: 171583 - DNA, 30 bp, Artificial Sequence
  Description of Artificial Sequence: Synthetic oligonucleotide
gttcctaagccccagaagtctaatgccagg

SEQ ID NO: 171584 - DNA, 32 bp, Artificial Sequence
  Description of Artificial Sequence: Synthetic oligonucleotide
ttcctaagccccagaagtctaatgccaggaag

SEQ ID NO: 171585 - DNA, 29 bp, Artificial Sequence
  Description of Artificial Sequence: Synthetic oligonucleotide
ctgttagggaacctgaccatctgcagctc

SEQ ID NO: 171586 - DNA, 29 bp, Artificial Sequence
  Description of Artificial Sequence: Synthetic oligonucleotide
tgttagggaacctgaccatctgcagctcg

SEQ ID NO: 171587 - DNA, 28 bp, Artificial Sequence
  Description of Artificial Sequence: Synthetic oligonucleotide
gttagggaacctgaccatctgcagctcg

SEQ ID NO: 171588 - DNA, 29 bp, Artificial Sequence
  Description of Artificial Sequence: Synthetic oligonucleotide
ttagggaacctgaccatctgcagctcgtc

SEQ ID NO: 171589 - DNA, 28 bp, Artificial Sequence
  Description of Artificial Sequence: Synthetic oligonucleotide
tagggaacctgaccatctgcagctcgtc

SEQ ID NO: 171590 - DNA, 27 bp, Artificial Sequence
  Description of Artificial Sequence: Synthetic oligonucleotide
agggaacctgaccatctgcagctcgtc

SEQ ID NO: 171591 - DNA, 27 bp, Artificial Sequence
  Description of Artificial Sequence: Synthetic oligonucleotide
gggaacctgaccatctgcagctcgtct

SEQ ID NO: 171592 - DNA, 27 bp, Artificial Sequence
  Description of Artificial Sequence: Synthetic oligonucleotide
ggaacctgaccatctgcagctcgtctc

SEQ ID NO: 171593 - DNA, 27 bp, Artificial Sequence
  Description of Artificial Sequence: Synthetic oligonucleotide
gaacctgaccatctgcagctcgtctcg

SEQ ID NO: 171594 - DNA, 29 bp, Artificial Sequence
  Description of Artificial Sequence: Synthetic oligonucleotide
aacctgaccatctgcagctcgtctcgttg

SEQ ID NO: 171595 - DNA, 28 bp, Artificial Sequence
  Description of Artificial Sequence: Synthetic oligonucleotide
acctgaccatctgcagctcgtctcgttg

SEQ ID NO: 171596 - DNA, 27 bp, Artificial Sequence
  Description of Artificial Sequence: Synthetic oligonucleotide
cctgaccatctgcagctcgtctcgttg

SEQ ID NO: 171597 - DNA, 27 bp, Artificial Sequence
  Description of Artificial Sequence: Synthetic oligonucleotide
ctgaccatctgcagctcgtctcgttgc

SEQ ID NO: 171598 - DNA, 27 bp, Artificial Sequence
  Description of Artificial Sequence: Synthetic oligonucleotide
tgaccatctgcagctcgtctcgttgcc

SEQ ID NO: 171599 - DNA, 27 bp, Artificial Sequence
  Description of Artificial Sequence: Synthetic oligonucleotide
gaccatctgcagctcgtctcgttgcca

SEQ ID NO: 171600 - DNA, 28 bp, Artificial Sequence
  Description of Artificial Sequence: Synthetic oligonucleotide
accatctgcagctcgtctcgttgccaag

SEQ ID NO: 171601 - DNA, 27 bp, Artificial Sequence
  Description of Artificial Sequence: Synthetic oligonucleotide
ccatctgcagctcgtctcgttgccaag

SEQ ID NO: 171602 - DNA, 27 bp, Artificial Sequence
  Description of Artificial Sequence: Synthetic oligonucleotide
catctgcagctcgtctcgttgccaagg

SEQ ID NO: 171603 - DNA, 29 bp, Artificial Sequence
  Description of Artificial Sequence: Synthetic oligonucleotide
atctgcagctcgtctcgttgccaaggatg

SEQ ID NO: 171604 - DNA, 28 bp, Artificial Sequence
  Description of Artificial Sequence: Synthetic oligonucleotide
tctgcagctcgtctcgttgccaaggatg

SEQ ID NO: 171605 - DNA, 27 bp, Artificial Sequence
  Description of Artificial Sequence: Synthetic oligonucleotide
ctgcagctcgtctcgttgccaaggatg

SEQ ID NO: 171606 - DNA, 27 bp, Artificial Sequence
  Description of Artificial Sequence: Synthetic oligonucleotide
tgcagctcgtctcgttgccaaggatgg

SEQ ID NO: 171607 - DNA, 27 bp, Artificial Sequence
  Description of Artificial Sequence: Synthetic oligonucleotide
gcagctcgtctcgttgccaaggatggt

SEQ ID NO: 171608 - DNA, 27 bp, Artificial Sequence
  Description of Artificial Sequence: Synthetic oligonucleotide
cagctcgtctcgttgccaaggatggtc

SEQ ID NO: 171609 - DNA, 29 bp, Artificial Sequence
  Description of Artificial Sequence: Synthetic oligonucleotide
agctcgtctcgttgccaaggatggtctac

SEQ ID NO: 171610 - DNA, 28 bp, Artificial Sequence
  Description of Artificial Sequence: Synthetic oligonucleotide
gctcgtctcgttgccaaggatggtctac

SEQ ID NO: 171611 - DNA, 28 bp, Artificial Sequence
  Description of Artificial Sequence: Synthetic oligonucleotide
ctcgtctcgttgccaaggatggtctacc

SEQ ID NO: 171612 - DNA, 28 bp, Artificial Sequence
  Description of Artificial Sequence: Synthetic oligonucleotide
tcgtctcgttgccaaggatggtctaccc

SEQ ID NO: 171613 - DNA, 30 bp, Artificial Sequence
  Description of Artificial Sequence: Synthetic oligonucleotide
cccaaggacgagggcgatttctactacatg

SEQ ID NO: 171614 - DNA, 30 bp, Artificial Sequence
  Description of Artificial Sequence: Synthetic oligonucleotide
ccaaggacgagggcgatttctactacatgg

SEQ ID NO: 171615 - DNA, 30 bp, Artificial Sequence
  Description of Artificial Sequence: Synthetic oligonucleotide
caaggacgagggcgatttctactacatggg

SEQ ID NO: 171616 - DNA, 30 bp, Artificial Sequence
  Description of Artificial Sequence: Synthetic oligonucleotide
aaggacgagggcgatttctactacatgggg

SEQ ID NO: 171617 - DNA, 29 bp, Artificial Sequence
  Description of Artificial Sequence: Synthetic oligonucleotide
aggacgagggcgatttctactacatgggg

SEQ ID NO: 171618 - DNA, 28 bp, Artificial Sequence
  Description of Artificial Sequence: Synthetic oligonucleotide
ggacgagggcgatttctactacatgggg

SEQ ID NO: 171619 - DNA, 28 bp, Artificial Sequence
  Description of Artificial Sequence: Synthetic oligonucleotide
gacgagggcgatttctactacatggggg

SEQ ID NO: 171620 - DNA, 28 bp, Artificial Sequence
  Description of Artificial Sequence: Synthetic oligonucleotide
acgagggcgatttctactacatgggggc

SEQ ID NO: 171621 - DNA, 27 bp, Artificial Sequence
  Description of Artificial Sequence: Synthetic oligonucleotide
cgagggcgatttctactacatgggggc

SEQ ID NO: 171622 - DNA, 27 bp, Artificial Sequence
  Description of Artificial Sequence: Synthetic oligonucleotide
gagggcgatttctactacatgggggcg

SEQ ID NO: 171623 - DNA, 29 bp, Artificial Sequence
  Description of Artificial Sequence: Synthetic oligonucleotide
agggcgatttctactacatgggggcgttc

SEQ ID NO: 171624 - DNA, 28 bp, Artificial Sequence
  Description of Artificial Sequence: Synthetic oligonucleotide
gggcgatttctactacatgggggcgttc

SEQ ID NO: 171625 - DNA, 30 bp, Artificial Sequence
  Description of Artificial Sequence: Synthetic oligonucleotide
ggcgatttctactacatgggggcgttcttc

SEQ ID NO: 171626 - DNA, 30 bp, Artificial Sequence
  Description of Artificial Sequence: Synthetic oligonucleotide
gcgatttctactacatgggggcgttcttcg

SEQ ID NO: 171627 - DNA, 30 bp, Artificial Sequence
  Description of Artificial Sequence: Synthetic oligonucleotide
cgatttctactacatgggggcgttcttcgg

SEQ ID NO: 171628 - DNA, 30 bp, Artificial Sequence
  Description of Artificial Sequence: Synthetic oligonucleotide
gatttctactacatgggggcgttcttcggg

SEQ ID NO: 171629 - DNA, 30 bp, Artificial Sequence
  Description of Artificial Sequence: Synthetic oligonucleotide
atttctactacatgggggcgttcttcgggg

SEQ ID NO: 171630 - DNA, 29 bp, Artificial Sequence
  Description of Artificial Sequence: Synthetic oligonucleotide
tttctactacatgggggcgttcttcgggg

SEQ ID NO: 171631 - DNA, 28 bp, Artificial Sequence
  Description of Artificial Sequence: Synthetic oligonucleotide
ttctactacatgggggcgttcttcgggg

SEQ ID NO: 171632 - DNA, 27 bp, Artificial Sequence
  Description of Artificial Sequence: Synthetic oligonucleotide
tctactacatgggggcgttcttcgggg

SEQ ID NO: 171633 - DNA, 26 bp, Artificial Sequence
  Description of Artificial Sequence: Synthetic oligonucleotide
ctactacatgggggcgttcttcgggg

SEQ ID NO: 171634 - DNA, 26 bp, Artificial Sequence
  Description of Artificial Sequence: Synthetic oligonucleotide
tactacatgggggcgttcttcggggg

SEQ ID NO: 171635 - DNA, 25 bp, Artificial Sequence
  Description of Artificial Sequence: Synthetic oligonucleotide
actacatgggggcgttcttcggggg

SEQ ID NO: 171636 - DNA, 24 bp, Artificial Sequence
  Description of Artificial Sequence: Synthetic oligonucleotide
ctacatgggggcgttcttcggggg

SEQ ID NO: 171637 - DNA, 25 bp, Artificial Sequence
  Description of Artificial Sequence: Synthetic oligonucleotide
tacatgggggcgttcttcggggggt

SEQ ID NO: 171638 - DNA, 24 bp, Artificial Sequence
  Description of Artificial Sequence: Synthetic oligonucleotide
acatgggggcgttcttcggggggt

SEQ ID NO: 171639 - DNA, 23 bp, Artificial Sequence
  Description of Artificial Sequence: Synthetic oligonucleotide
catgggggcgttcttcggggggt

SEQ ID NO: 171640 - DNA, 23 bp, Artificial Sequence
  Description of Artificial Sequence: Synthetic oligonucleotide
atgggggcgttcttcggggggtc

SEQ ID NO: 171641 - DNA, 22 bp, Artificial Sequence
  Description of Artificial Sequence: Synthetic oligonucleotide
tgggggcgttcttcggggggtc

SEQ ID NO: 171642 - DNA, 21 bp, Artificial Sequence
  Description of Artificial Sequence: Synthetic oligonucleotide
gggggcgttcttcggggggtc

SEQ ID NO: 171643 - DNA, 21 bp, Artificial Sequence
  Description of Artificial Sequence: Synthetic oligonucleotide
ggggcgttcttcggggggtcg

SEQ ID NO: 171644 - DNA, 22 bp, Artificial Sequence
  Description of Artificial Sequence: Synthetic oligonucleotide
gggcgttcttcggggggtcggt

SEQ ID NO: 171645 - DNA, 22 bp, Artificial Sequence
  Description of Artificial Sequence: Synthetic oligonucleotide
ggcgttcttcggggggtcggtg

SEQ ID NO: 171646 - DNA, 24 bp, Artificial Sequence
  Description of Artificial Sequence: Synthetic oligonucleotide
gcgttcttcggggggtcggtgcaa

SEQ ID NO: 171647 - DNA, 25 bp, Artificial Sequence
  Description of Artificial Sequence: Synthetic oligonucleotide
cgttcttcggggggtcggtgcaaga

SEQ ID NO: 171648 - DNA, 30 bp, Artificial Sequence
  Description of Artificial Sequence: Synthetic oligonucleotide
acgacgagagccacctgaacaagtacctac

SEQ ID NO: 171649 - DNA, 29 bp, Artificial Sequence
  Description of Artificial Sequence: Synthetic oligonucleotide
cgacgagagccacctgaacaagtacctac

SEQ ID NO: 171650 - DNA, 30 bp, Artificial Sequence
  Description of Artificial Sequence: Synthetic oligonucleotide
gacgagagccacctgaacaagtacctactg

SEQ ID NO: 171651 - DNA, 30 bp, Artificial Sequence
  Description of Artificial Sequence: Synthetic oligonucleotide
acgagagccacctgaacaagtacctactgc

SEQ ID NO: 171652 - DNA, 29 bp, Artificial Sequence
  Description of Artificial Sequence: Synthetic oligonucleotide
cgagagccacctgaacaagtacctactgc

SEQ ID NO: 171653 - DNA, 29 bp, Artificial Sequence
  Description of Artificial Sequence: Synthetic oligonucleotide
gagagccacctgaacaagtacctactgcg

SEQ ID NO: 171654 - DNA, 29 bp, Artificial Sequence
  Description of Artificial Sequence: Synthetic oligonucleotide
agagccacctgaacaagtacctactgcgc

SEQ ID NO: 171655 - DNA, 28 bp, Artificial Sequence
  Description of Artificial Sequence: Synthetic oligonucleotide
gagccacctgaacaagtacctactgcgc

SEQ ID NO: 171656 - DNA, 28 bp, Artificial Sequence
  Description of Artificial Sequence: Synthetic oligonucleotide
agccacctgaacaagtacctactgcgcc

SEQ ID NO: 171657 - DNA, 27 bp, Artificial Sequence
  Description of Artificial Sequence: Synthetic oligonucleotide
gccacctgaacaagtacctactgcgcc

SEQ ID NO: 171658 - DNA, 28 bp, Artificial Sequence
  Description of Artificial Sequence: Synthetic oligonucleotide
ccacctgaacaagtacctactgcgccac

SEQ ID NO: 171659 - DNA, 31 bp, Artificial Sequence
  Description of Artificial Sequence: Synthetic oligonucleotide
cacctgaacaagtacctactgcgccacaaac

SEQ ID NO: 171660 - DNA, 31 bp, Artificial Sequence
  Description of Artificial Sequence: Synthetic oligonucleotide
acctgaacaagtacctactgcgccacaaacc

SEQ ID NO: 171661 - DNA, 30 bp, Artificial Sequence
  Description of Artificial Sequence: Synthetic oligonucleotide
cctgaacaagtacctactgcgccacaaacc

SEQ ID NO: 171662 - DNA, 30 bp, Artificial Sequence
  Description of Artificial Sequence: Synthetic oligonucleotide
ctgaacaagtacctactgcgccacaaaccc

SEQ ID NO: 171663 - DNA, 31 bp, Artificial Sequence
  Description of Artificial Sequence: Synthetic oligonucleotide
tgaacaagtacctactgcgccacaaacccac

SEQ ID NO: 171664 - DNA, 30 bp, Artificial Sequence
  Description of Artificial Sequence: Synthetic oligonucleotide
gaacaagtacctactgcgccacaaacccac

SEQ ID NO: 171665 - DNA, 30 bp, Artificial Sequence
  Description of Artificial Sequence: Synthetic oligonucleotide
aacaagtacctactgcgccacaaacccacc

SEQ ID NO: 171666 - DNA, 29 bp, Artificial Sequence
  Description of Artificial Sequence: Synthetic oligonucleotide
acaagtacctactgcgccacaaacccacc

SEQ ID NO: 171667 - DNA, 28 bp, Artificial Sequence
  Description of Artificial Sequence: Synthetic oligonucleotide
caagtacctactgcgccacaaacccacc

SEQ ID NO: 171668 - DNA, 30 bp, Artificial Sequence
  Description of Artificial Sequence: Synthetic oligonucleotide
aagtacctactgcgccacaaacccaccaag

SEQ ID NO: 171669 - DNA, 29 bp, Artificial Sequence
  Description of Artificial Sequence: Synthetic oligonucleotide
agtacctactgcgccacaaacccaccaag

SEQ ID NO: 171670 - DNA, 28 bp, Artificial Sequence
  Description of Artificial Sequence: Synthetic oligonucleotide
gtacctactgcgccacaaacccaccaag

SEQ ID NO: 171671 - DNA, 28 bp, Artificial Sequence
  Description of Artificial Sequence: Synthetic oligonucleotide
tacctactgcgccacaaacccaccaagg

SEQ ID NO: 171672 - DNA, 27 bp, Artificial Sequence
  Description of Artificial Sequence: Synthetic oligonucleotide
acctactgcgccacaaacccaccaagg

SEQ ID NO: 171673 - DNA, 27 bp, Artificial Sequence
  Description of Artificial Sequence: Synthetic oligonucleotide
cctactgcgccacaaacccaccaaggt

SEQ ID NO: 171674 - DNA, 27 bp, Artificial Sequence
  Description of Artificial Sequence: Synthetic oligonucleotide
ctactgcgccacaaacccaccaaggtg

SEQ ID NO: 171675 - DNA, 27 bp, Artificial Sequence
  Description of Artificial Sequence: Synthetic oligonucleotide
tactgcgccacaaacccaccaaggtgc

SEQ ID NO: 171676 - DNA, 27 bp, Artificial Sequence
  Description of Artificial Sequence: Synthetic oligonucleotide
actgcgccacaaacccaccaaggtgct

SEQ ID NO: 171677 - DNA, 27 bp, Artificial Sequence
  Description of Artificial Sequence: Synthetic oligonucleotide
caggaagcctggaacgggggttctgta

SEQ ID NO: 171678 - DNA, 27 bp, Artificial Sequence
  Description of Artificial Sequence: Synthetic oligonucleotide
aggaagcctggaacgggggttctgtag

SEQ ID NO: 171679 - DNA, 26 bp, Artificial Sequence
  Description of Artificial Sequence: Synthetic oligonucleotide
ggaagcctggaacgggggttctgtag

SEQ ID NO: 171680 - DNA, 27 bp, Artificial Sequence
  Description of Artificial Sequence: Synthetic oligonucleotide
gaagcctggaacgggggttctgtagga

SEQ ID NO: 171681 - DNA, 28 bp, Artificial Sequence
  Description of Artificial Sequence: Synthetic oligonucleotide
aagcctggaacgggggttctgtaggaag

SEQ ID NO: 171682 - DNA, 27 bp, Artificial Sequence
  Description of Artificial Sequence: Synthetic oligonucleotide
agcctggaacgggggttctgtaggaag

SEQ ID NO: 171683 - DNA, 26 bp, Artificial Sequence
  Description of Artificial Sequence: Synthetic oligonucleotide
gcctggaacgggggttctgtaggaag

SEQ ID NO: 171684 - DNA, 27 bp, Artificial Sequence
  Description of Artificial Sequence: Synthetic oligonucleotide
cctggaacgggggttctgtaggaagga

SEQ ID NO: 171685 - DNA, 28 bp, Artificial Sequence
  Description of Artificial Sequence: Synthetic oligonucleotide
ctggaacgggggttctgtaggaaggatg

SEQ ID NO: 171686 - DNA, 29 bp, Artificial Sequence
  Description of Artificial Sequence: Synthetic oligonucleotide
tggaacgggggttctgtaggaaggatgtc

SEQ ID NO: 171687 - DNA, 28 bp, Artificial Sequence
  Description of Artificial Sequence: Synthetic oligonucleotide
ggaacgggggttctgtaggaaggatgtc

SEQ ID NO: 171688 - DNA, 28 bp, Artificial Sequence
  Description of Artificial Sequence: Synthetic oligonucleotide
gaacgggggttctgtaggaaggatgtcc

SEQ ID NO: 171689 - DNA, 29 bp, Artificial Sequence
  Description of Artificial Sequence: Synthetic oligonucleotide
aacgggggttctgtaggaaggatgtcctc

SEQ ID NO: 171690 - DNA, 28 bp, Artificial Sequence
  Description of Artificial Sequence: Synthetic oligonucleotide
acgggggttctgtaggaaggatgtcctc

SEQ ID NO: 171691 - DNA, 27 bp, Artificial Sequence
  Description of Artificial Sequence: Synthetic oligonucleotide
cgggggttctgtaggaaggatgtcctc

SEQ ID NO: 171692 - DNA, 27 bp, Artificial Sequence
  Description of Artificial Sequence: Synthetic oligonucleotide
gggggttctgtaggaaggatgtcctcg

SEQ ID NO: 171693 - DNA, 28 bp, Artificial Sequence
  Description of Artificial Sequence: Synthetic oligonucleotide
ggggttctgtaggaaggatgtcctcgtg

SEQ ID NO: 171694 - DNA, 28 bp, Artificial Sequence
  Description of Artificial Sequence: Synthetic oligonucleotide
gggttctgtaggaaggatgtcctcgtgg

SEQ ID NO: 171695 - DNA, 29 bp, Artificial Sequence
  Description of Artificial Sequence: Synthetic oligonucleotide
ggttctgtaggaaggatgtcctcgtggtg

SEQ ID NO: 171696 - DNA, 30 bp, Artificial Sequence
  Description of Artificial Sequence: Synthetic oligonucleotide
gttctgtaggaaggatgtcctcgtggtgac

SEQ ID NO: 171697 - DNA, 30 bp, Artificial Sequence
  Description of Artificial Sequence: Synthetic oligonucleotide
ttctgtaggaaggatgtcctcgtggtgacc

SEQ ID NO: 171698 - DNA, 29 bp, Artificial Sequence
  Description of Artificial Sequence: Synthetic oligonucleotide
tctgtaggaaggatgtcctcgtggtgacc

SEQ ID NO: 171699 - DNA, 28 bp, Artificial Sequence
  Description of Artificial Sequence: Synthetic oligonucleotide
ctgtaggaaggatgtcctcgtggtgacc

SEQ ID NO: 171700 - DNA, 30 bp, Artificial Sequence
  Description of Artificial Sequence: Synthetic oligonucleotide
taggaagtatgtcctcgtggtgaccccttg

SEQ ID NO: 171701 - DNA, 29 bp, Artificial Sequence
  Description of Artificial Sequence: Synthetic oligonucleotide
aggaagtatgtcctcgtggtgaccccttg

SEQ ID NO: 171702 - DNA, 28 bp, Artificial Sequence
  Description of Artificial Sequence: Synthetic oligonucleotide
ggaagtatgtcctcgtggtgaccccttg

SEQ ID NO: 171703 - DNA, 28 bp, Artificial Sequence
  Description of Artificial Sequence: Synthetic oligonucleotide
gaagtatgtcctcgtggtgaccccttgg

SEQ ID NO: 171704 - DNA, 28 bp, Artificial Sequence
  Description of Artificial Sequence: Synthetic oligonucleotide
aagtatgtcctcgtggtgaccccttggc

SEQ ID NO: 171705 - DNA, 27 bp, Artificial Sequence
  Description of Artificial Sequence: Synthetic oligonucleotide
agtatgtcctcgtggtgaccccttggc

SEQ ID NO: 171706 - DNA, 27 bp, Artificial Sequence
  Description of Artificial Sequence: Synthetic oligonucleotide
gtatgtcctcgtggtgaccccttggct

SEQ ID NO: 171707 - DNA, 27 bp, Artificial Sequence
  Description of Artificial Sequence: Synthetic oligonucleotide
tatgtcctcgtggtgaccccttggctg

SEQ ID NO: 171708 - DNA, 23 bp, Artificial Sequence
  Description of Artificial Sequence: Synthetic oligonucleotide
tccgctgttcggcaccctgcacg

SEQ ID NO: 171709 - DNA, 22 bp, Artificial Sequence
  Description of Artificial Sequence: Synthetic oligonucleotide
ccgctgttcggcaccctgcacg

SEQ ID NO: 171710 - DNA, 22 bp, Artificial Sequence
  Description of Artificial Sequence: Synthetic oligonucleotide
cgctgttcggcaccctgcacgc

SEQ ID NO: 171711 - DNA, 23 bp, Artificial Sequence
  Description of Artificial Sequence: Synthetic oligonucleotide
gctgttcggcaccctgcacgcca

SEQ ID NO: 171712 - DNA, 23 bp, Artificial Sequence
  Description of Artificial Sequence: Synthetic oligonucleotide
ctgttcggcaccctgcacgccag

SEQ ID NO: 171713 - DNA, 25 bp, Artificial Sequence
  Description of Artificial Sequence: Synthetic oligonucleotide
tgttcggcaccctgcacgccagctt

SEQ ID NO: 171714 - DNA, 24 bp, Artificial Sequence
  Description of Artificial Sequence: Synthetic oligonucleotide
gttcggcaccctgcacgccagctt

SEQ ID NO: 171715 - DNA, 26 bp, Artificial Sequence
  Description of Artificial Sequence: Synthetic oligonucleotide
ttcggcaccctgcacgccagcttcta

SEQ ID NO: 171716 - DNA, 25 bp, Artificial Sequence
  Description of Artificial Sequence: Synthetic oligonucleotide
tcggcaccctgcacgccagcttcta

SEQ ID NO: 171717 - DNA, 24 bp, Artificial Sequence
  Description of Artificial Sequence: Synthetic oligonucleotide
cggcaccctgcacgccagcttcta

SEQ ID NO: 171718 - DNA, 24 bp, Artificial Sequence
  Description of Artificial Sequence: Synthetic oligonucleotide
ggcaccctgcacgccagcttctac

SEQ ID NO: 171719 - DNA, 24 bp, Artificial Sequence
  Description of Artificial Sequence: Synthetic oligonucleotide
gcaccctgcacgccagcttctacg

SEQ ID NO: 171720 - DNA, 26 bp, Artificial Sequence
  Description of Artificial Sequence: Synthetic oligonucleotide
caccctgcacgccagcttctacggaa

SEQ ID NO: 171721 - DNA, 26 bp, Artificial Sequence
  Description of Artificial Sequence: Synthetic oligonucleotide
accctgcacgccagcttctacggaag

SEQ ID NO: 171722 - DNA, 25 bp, Artificial Sequence
  Description of Artificial Sequence: Synthetic oligonucleotide
ccctgcacgccagcttctacggaag

SEQ ID NO: 171723 - DNA, 26 bp, Artificial Sequence
  Description of Artificial Sequence: Synthetic oligonucleotide
cctgcacgccagcttctacggaagca

SEQ ID NO: 171724 - DNA, 26 bp, Artificial Sequence
  Description of Artificial Sequence: Synthetic oligonucleotide
ctgcacgccagcttctacggaagcag

SEQ ID NO: 171725 - DNA, 26 bp, Artificial Sequence
  Description of Artificial Sequence: Synthetic oligonucleotide
tgcacgccagcttctacggaagcagc

SEQ ID NO: 171726 - DNA, 25 bp, Artificial Sequence
  Description of Artificial Sequence: Synthetic oligonucleotide
gcacgccagcttctacggaagcagc

SEQ ID NO: 171727 - DNA, 25 bp, Artificial Sequence
  Description of Artificial Sequence: Synthetic oligonucleotide
cacgccagcttctacggaagcagcc

SEQ ID NO: 171728 - DNA, 25 bp, Artificial Sequence
  Description of Artificial Sequence: Synthetic oligonucleotide
acgccagcttctacggaagcagccg

SEQ ID NO: 171729 - DNA, 24 bp, Artificial Sequence
  Description of Artificial Sequence: Synthetic oligonucleotide
cgccagcttctacggaagcagccg

SEQ ID NO: 171730 - DNA, 24 bp, Artificial Sequence
  Description of Artificial Sequence: Synthetic oligonucleotide
gccagcttctacggaagcagccgg

SEQ ID NO: 171731 - DNA, 28 bp, Artificial Sequence
  Description of Artificial Sequence: Synthetic oligonucleotide
attacctggtgtgcgtggacgtggacag

SEQ ID NO: 171732 - DNA, 27 bp, Artificial Sequence
  Description of Artificial Sequence: Synthetic oligonucleotide
ttacctggtgtgcgtggacgtggacag

SEQ ID NO: 171733 - DNA, 26 bp, Artificial Sequence
  Description of Artificial Sequence: Synthetic oligonucleotide
tacctggtgtgcgtggacgtggacag

SEQ ID NO: 171734 - DNA, 25 bp, Artificial Sequence
  Description of Artificial Sequence: Synthetic oligonucleotide
acctggtgtgcgtggacgtggacag

SEQ ID NO: 171735 - DNA, 24 bp, Artificial Sequence
  Description of Artificial Sequence: Synthetic oligonucleotide
cctggtgtgcgtggacgtggacag

SEQ ID NO: 171736 - DNA, 24 bp, Artificial Sequence
  Description of Artificial Sequence: Synthetic oligonucleotide
ctggtgtgcgtggacgtggacagg

SEQ ID NO: 171737 - DNA, 25 bp, Artificial Sequence
  Description of Artificial Sequence: Synthetic oligonucleotide
tggtgtgcgtggacgtggacaggga

SEQ ID NO: 171738 - DNA, 24 bp, Artificial Sequence
  Description of Artificial Sequence: Synthetic oligonucleotide
ggtgtgcgtggacgtggacaggga

SEQ ID NO: 171739 - DNA, 26 bp, Artificial Sequence
  Description of Artificial Sequence: Synthetic oligonucleotide
gtgtgcgtggacgtggacagggagtt

SEQ ID NO: 171740 - DNA, 26 bp, Artificial Sequence
  Description of Artificial Sequence: Synthetic oligonucleotide
tgtgcgtggacgtggacagggagttc

SEQ ID NO: 171741 - DNA, 25 bp, Artificial Sequence
  Description of Artificial Sequence: Synthetic oligonucleotide
gtgcgtggacgtggacagggagttc

SEQ ID NO: 171742 - DNA, 25 bp, Artificial Sequence
  Description of Artificial Sequence: Synthetic oligonucleotide
tgcgtggacgtggacagggagttcc

SEQ ID NO: 171743 - DNA, 24 bp, Artificial Sequence
  Description of Artificial Sequence: Synthetic oligonucleotide
gcgtggacgtggacagggagttcc

SEQ ID NO: 171744 - DNA, 24 bp, Artificial Sequence
  Description of Artificial Sequence: Synthetic oligonucleotide
cgtggacgtggacagggagttccg

SEQ ID NO: 171745 - DNA, 24 bp, Artificial Sequence
  Description of Artificial Sequence: Synthetic oligonucleotide
gtggacgtggacagggagttccgc

SEQ ID NO: 171746 - DNA, 25 bp, Artificial Sequence
  Description of Artificial Sequence: Synthetic oligonucleotide
tggacgtggacagggagttccgcga

SEQ ID NO: 171747 - DNA, 24 bp, Artificial Sequence
  Description of Artificial Sequence: Synthetic oligonucleotide
ggacgtggacagggagttccgcga

SEQ ID NO: 171748 - DNA, 24 bp, Artificial Sequence
  Description of Artificial Sequence: Synthetic oligonucleotide
gacgtggacagggagttccgcgac

SEQ ID NO: 171749 - DNA, 26 bp, Artificial Sequence
  Description of Artificial Sequence: Synthetic oligonucleotide
acgtggacagggagttccgcgaccat

SEQ ID NO: 171750 - DNA, 25 bp, Artificial Sequence
  Description of Artificial Sequence: Synthetic oligonucleotide
cgtggacagggagttccgcgaccat

SEQ ID NO: 171751 - DNA, 26 bp, Artificial Sequence
  Description of Artificial Sequence: Synthetic oligonucleotide
gtggacagggagttccgcgaccatgt

SEQ ID NO: 171752 - DNA, 26 bp, Artificial Sequence
  Description of Artificial Sequence: Synthetic oligonucleotide
tggacagggagttccgcgaccatgtg

SEQ ID NO: 171753 - DNA, 25 bp, Artificial Sequence
  Description of Artificial Sequence: Synthetic oligonucleotide
ggacagggagttccgcgaccatgtg

SEQ ID NO: 171754 - DNA, 25 bp, Artificial Sequence
  Description of Artificial Sequence: Synthetic oligonucleotide
gacagggagttccgcgaccatgtgg

SEQ ID NO: 171755 - DNA, 25 bp, Artificial Sequence
  Description of Artificial Sequence: Synthetic oligonucleotide
acagggagttccgcgaccatgtggg

SEQ ID NO: 171756 - DNA, 24 bp, Artificial Sequence
  Description of Artificial Sequence: Synthetic oligonucleotide
cagggagttccgcgaccatgtggg

SEQ ID NO: 171757 - DNA, 24 bp, Artificial Sequence
  Description of Artificial Sequence: Synthetic oligonucleotide
agggagttccgcgaccatgtgggc

SEQ ID NO: 171758 - DNA, 23 bp, Artificial Sequence
  Description of Artificial Sequence: Synthetic oligonucleotide
gggagttccgcgaccatgtgggc

SEQ ID NO: 171759 - DNA, 27 bp, Artificial Sequence
  Description of Artificial Sequence: Synthetic oligonucleotide
agttccgcgaccatgtgggcgtggata

SEQ ID NO: 171760 - DNA, 27 bp, Artificial Sequence
  Description of Artificial Sequence: Synthetic oligonucleotide
gttccgcgaccatgtgggcgtggatat

SEQ ID NO: 171761 - DNA, 27 bp, Artificial Sequence
  Description of Artificial Sequence: Synthetic oligonucleotide
ttccgcgaccatgtgggcgtggatatc

SEQ ID NO: 171762 - DNA, 26 bp, Artificial Sequence
  Description of Artificial Sequence: Synthetic oligonucleotide
tccgcgaccatgtgggcgtggatatc

SEQ ID NO: 171763 - DNA, 25 bp, Artificial Sequence
  Description of Artificial Sequence: Synthetic oligonucleotide
ccgcgaccatgtgggcgtggatatc

SEQ ID NO: 171764 - DNA, 26 bp, Artificial Sequence
  Description of Artificial Sequence: Synthetic oligonucleotide
cgcgaccatgtgggcgtggatatcct

SEQ ID NO: 171765 - DNA, 27 bp, Artificial Sequence
  Description of Artificial Sequence: Synthetic oligonucleotide
gcgaccatgtgggcgtggatatcctga

SEQ ID NO: 171766 - DNA, 27 bp, Artificial Sequence
  Description of Artificial Sequence: Synthetic oligonucleotide
cgaccatgtgggcgtggatatcctgac

SEQ ID NO: 171767 - DNA, 28 bp, Artificial Sequence
  Description of Artificial Sequence: Synthetic oligonucleotide
gaccatgtgggcgtggatatcctgactc

SEQ ID NO: 171768 - DNA, 28 bp, Artificial Sequence
  Description of Artificial Sequence: Synthetic oligonucleotide
accatgtgggcgtggatatcctgactcc

SEQ ID NO: 171769 - DNA, 27 bp, Artificial Sequence
  Description of Artificial Sequence: Synthetic oligonucleotide
ccatgtgggcgtggatatcctgactcc

SEQ ID NO: 171770 - DNA, 27 bp, Artificial Sequence
  Description of Artificial Sequence: Synthetic oligonucleotide
catgtgggcgtggatatcctgactccg

SEQ ID NO: 171771 - DNA, 27 bp, Artificial Sequence
  Description of Artificial Sequence: Synthetic oligonucleotide
atgtgggcgtggatatcctgactccgc

SEQ ID NO: 171772 - DNA, 27 bp, Artificial Sequence
  Description of Artificial Sequence: Synthetic oligonucleotide
tgtgggcgtggatatcctgactccgct

SEQ ID NO: 171773 - DNA, 26 bp, Artificial Sequence
  Description of Artificial Sequence: Synthetic oligonucleotide
gtgggcgtggatatcctgactccgct

SEQ ID NO: 171774 - DNA, 27 bp, Artificial Sequence
  Description of Artificial Sequence: Synthetic oligonucleotide
tgggcgtggatatcctgactccgctgt

SEQ ID NO: 171775 - DNA, 27 bp, Artificial Sequence
  Description of Artificial Sequence: Synthetic oligonucleotide
gggcgtggatatcctgactccgctgtt

SEQ ID NO: 171776 - DNA, 27 bp, Artificial Sequence
  Description of Artificial Sequence: Synthetic oligonucleotide
ggcgtggatatcctgactccgctgttc

SEQ ID NO: 171777 - DNA, 27 bp, Artificial Sequence
  Description of Artificial Sequence: Synthetic oligonucleotide
gcgtggatatcctgactccgctgttcg

SEQ ID NO: 171778 - DNA, 27 bp, Artificial Sequence
  Description of Artificial Sequence: Synthetic oligonucleotide
cgtggatatcctgactccgctgttcgg

SEQ ID NO: 171779 - DNA, 27 bp, Artificial Sequence
  Description of Artificial Sequence: Synthetic oligonucleotide
gtggatatcctgactccgctgttcggc

SEQ ID NO: 171780 - DNA, 28 bp, Artificial Sequence
  Description of Artificial Sequence: Synthetic oligonucleotide
tggatatcctgactccgctgttcggcac

SEQ ID NO: 171781 - DNA, 27 bp, Artificial Sequence
  Description of Artificial Sequence: Synthetic oligonucleotide
ggatatcctgactccgctgttcggcac

SEQ ID NO: 171782 - DNA, 27 bp, Artificial Sequence
  Description of Artificial Sequence: Synthetic oligonucleotide
gatatcctgactccgctgttcggcacc

SEQ ID NO: 171783 - DNA, 27 bp, Artificial Sequence
  Description of Artificial Sequence: Synthetic oligonucleotide
atatcctgactccgctgttcggcaccc

SEQ ID NO: 171784 - DNA, 27 bp, Artificial Sequence
  Description of Artificial Sequence: Synthetic oligonucleotide
tatcctgactccgctgttcggcaccct

SEQ ID NO: 171785 - DNA, 22 bp, Artificial Sequence
  Description of Artificial Sequence: Synthetic oligonucleotide
cgcgtgacgctggggaccggtt

SEQ ID NO: 171786 - DNA, 22 bp, Artificial Sequence
  Description of Artificial Sequence: Synthetic oligonucleotide
gcgtgacgctggggaccggttg

SEQ ID NO: 171787 - DNA, 22 bp, Artificial Sequence
  Description of Artificial Sequence: Synthetic oligonucleotide
cgtgacgctggggaccggttgg

SEQ ID NO: 171788 - DNA, 23 bp, Artificial Sequence
  Description of Artificial Sequence: Synthetic oligonucleotide
gtgacgctggggaccggttggca

SEQ ID NO: 171789 - DNA, 23 bp, Artificial Sequence
  Description of Artificial Sequence: Synthetic oligonucleotide
tgacgctggggaccggttggcag

SEQ ID NO: 171790 - DNA, 22 bp, Artificial Sequence
  Description of Artificial Sequence: Synthetic oligonucleotide
gacgctggggaccggttggcag

SEQ ID NO: 171791 - DNA, 23 bp, Artificial Sequence
  Description of Artificial Sequence: Synthetic oligonucleotide
acgctggggaccggttggcagct

SEQ ID NO: 171792 - DNA, 22 bp, Artificial Sequence
  Description of Artificial Sequence: Synthetic oligonucleotide
cgctggggaccggttggcagct

SEQ ID NO: 171793 - DNA, 23 bp, Artificial Sequence
  Description of Artificial Sequence: Synthetic oligonucleotide
gctggggaccggttggcagctgt

SEQ ID NO: 171794 - DNA, 24 bp, Artificial Sequence
  Description of Artificial Sequence: Synthetic oligonucleotide
ctggggaccggttggcagctgtca

SEQ ID NO: 171795 - DNA, 25 bp, Artificial Sequence
  Description of Artificial Sequence: Synthetic oligonucleotide
tggggaccggttggcagctgtcagt

SEQ ID NO: 171796 - DNA, 24 bp, Artificial Sequence
  Description of Artificial Sequence: Synthetic oligonucleotide
ggggaccggttggcagctgtcagt

SEQ ID NO: 171797 - DNA, 24 bp, Artificial Sequence
  Description of Artificial Sequence: Synthetic oligonucleotide
gggaccggttggcagctgtcagtg

SEQ ID NO: 171798 - DNA, 25 bp, Artificial Sequence
  Description of Artificial Sequence: Synthetic oligonucleotide
ggaccggttggcagctgtcagtgct

SEQ ID NO: 171799 - DNA, 25 bp, Artificial Sequence
  Description of Artificial Sequence: Synthetic oligonucleotide
gaccggttggcagctgtcagtgctg

SEQ ID NO: 171800 - DNA, 26 bp, Artificial Sequence
  Description of Artificial Sequence: Synthetic oligonucleotide
accggttggcagctgtcagtgctgga

SEQ ID NO: 171801 - DNA, 25 bp, Artificial Sequence
  Description of Artificial Sequence: Synthetic oligonucleotide
ccggttggcagctgtcagtgctgga

SEQ ID NO: 171802 - DNA, 25 bp, Artificial Sequence
  Description of Artificial Sequence: Synthetic oligonucleotide
cggttggcagctgtcagtgctggag

SEQ ID NO: 171803 - DNA, 26 bp, Artificial Sequence
  Description of Artificial Sequence: Synthetic oligonucleotide
ggttggcagctgtcagtgctggaggt

SEQ ID NO: 171804 - DNA, 26 bp, Artificial Sequence
  Description of Artificial Sequence: Synthetic oligonucleotide
gttggcagctgtcagtgctggaggtg

SEQ ID NO: 171805 - DNA, 26 bp, Artificial Sequence
  Description of Artificial Sequence: Synthetic oligonucleotide
ttggcagctgtcagtgctggaggtgg

SEQ ID NO: 171806 - DNA, 25 bp, Artificial Sequence
  Description of Artificial Sequence: Synthetic oligonucleotide
tggcagctgtcagtgctggaggtgg

SEQ ID NO: 171807 - DNA, 27 bp, Artificial Sequence
  Description of Artificial Sequence: Synthetic oligonucleotide
ggtgtgcgtggacgtggacatggagta

SEQ ID NO: 171808 - DNA, 27 bp, Artificial Sequence
  Description of Artificial Sequence: Synthetic oligonucleotide
gtgtgcgtggacgtggacatggagtac

SEQ ID NO: 171809 - DNA, 27 bp, Artificial Sequence
  Description of Artificial Sequence: Synthetic oligonucleotide
tgtgcgtggacgtggacatggagtacc

SEQ ID NO: 171810 - DNA, 26 bp, Artificial Sequence
  Description of Artificial Sequence: Synthetic oligonucleotide
gtgcgtggacgtggacatggagtacc

SEQ ID NO: 171811 - DNA, 26 bp, Artificial Sequence
  Description of Artificial Sequence: Synthetic oligonucleotide
tgcgtggacgtggacatggagtaccg

SEQ ID NO: 171812 - DNA, 25 bp, Artificial Sequence
  Description of Artificial Sequence: Synthetic oligonucleotide
gcgtggacgtggacatggagtaccg

SEQ ID NO: 171813 - DNA, 25 bp, Artificial Sequence
  Description of Artificial Sequence: Synthetic oligonucleotide
cgtggacgtggacatggagtaccgc

SEQ ID NO: 171814 - DNA, 26 bp, Artificial Sequence
  Description of Artificial Sequence: Synthetic oligonucleotide
gtggacgtggacatggagtaccgcga

SEQ ID NO: 171815 - DNA, 26 bp, Artificial Sequence
  Description of Artificial Sequence: Synthetic oligonucleotide
tggacgtggacatggagtaccgcgac

SEQ ID NO: 171816 - DNA, 25 bp, Artificial Sequence
  Description of Artificial Sequence: Synthetic oligonucleotide
ggacgtggacatggagtaccgcgac

SEQ ID NO: 171817 - DNA, 26 bp, Artificial Sequence
  Description of Artificial Sequence: Synthetic oligonucleotide
gacgtggacatggagtaccgcgacca

SEQ ID NO: 171818 - DNA, 26 bp, Artificial Sequence
  Description of Artificial Sequence: Synthetic oligonucleotide
acgtggacatggagtaccgcgaccac

SEQ ID NO: 171819 - DNA, 25 bp, Artificial Sequence
  Description of Artificial Sequence: Synthetic oligonucleotide
cgtggacatggagtaccgcgaccac

SEQ ID NO: 171820 - DNA, 26 bp, Artificial Sequence
  Description of Artificial Sequence: Synthetic oligonucleotide
gtggacatggagtaccgcgaccacgt

SEQ ID NO: 171821 - DNA, 26 bp, Artificial Sequence
  Description of Artificial Sequence: Synthetic oligonucleotide
tggacatggagtaccgcgaccacgtg

SEQ ID NO: 171822 - DNA, 25 bp, Artificial Sequence
  Description of Artificial Sequence: Synthetic oligonucleotide
ggacatggagtaccgcgaccacgtg

SEQ ID NO: 171823 - DNA, 25 bp, Artificial Sequence
  Description of Artificial Sequence: Synthetic oligonucleotide
gacatggagtaccgcgaccacgtgg

SEQ ID NO: 171824 - DNA, 25 bp, Artificial Sequence
  Description of Artificial Sequence: Synthetic oligonucleotide
acatggagtaccgcgaccacgtggg

SEQ ID NO: 171825 - DNA, 24 bp, Artificial Sequence
  Description of Artificial Sequence: Synthetic oligonucleotide
catggagtaccgcgaccacgtggg

SEQ ID NO: 171826 - DNA, 24 bp, Artificial Sequence
  Description of Artificial Sequence: Synthetic oligonucleotide
atggagtaccgcgaccacgtgggc

SEQ ID NO: 171827 - DNA, 23 bp, Artificial Sequence
  Description of Artificial Sequence: Synthetic oligonucleotide
tggagtaccgcgaccacgtgggc

SEQ ID NO: 171828 - DNA, 22 bp, Artificial Sequence
  Description of Artificial Sequence: Synthetic oligonucleotide
ggagtaccgcgaccacgtgggc

SEQ ID NO: 171829 - DNA, 23 bp, Artificial Sequence
  Description of Artificial Sequence: Synthetic oligonucleotide
gagtaccgcgaccacgtgggcgt

SEQ ID NO: 171830 - DNA, 23 bp, Artificial Sequence
  Description of Artificial Sequence: Synthetic oligonucleotide
agtaccgcgaccacgtgggcgtg

SEQ ID NO: 171831 - DNA, 22 bp, Artificial Sequence
  Description of Artificial Sequence: Synthetic oligonucleotide
gtaccgcgaccacgtgggcgtg

SEQ ID NO: 171832 - DNA, 23 bp, Artificial Sequence
  Description of Artificial Sequence: Synthetic oligonucleotide
taccgcgaccacgtgggcgtgga

SEQ ID NO: 171833 - DNA, 22 bp, Artificial Sequence
  Description of Artificial Sequence: Synthetic oligonucleotide
accgcgaccacgtgggcgtgga

SEQ ID NO: 171834 - DNA, 33 bp, Artificial Sequence
  Description of Artificial Sequence: Synthetic oligonucleotide
atccctaaggacgagggcgatttctactacatg

SEQ ID NO: 171835 - DNA, 32 bp, Artificial Sequence
  Description of Artificial Sequence: Synthetic oligonucleotide
tccctaaggacgagggcgatttctactacatg

SEQ ID NO: 171836 - DNA, 31 bp, Artificial Sequence
  Description of Artificial Sequence: Synthetic oligonucleotide
ccctaaggacgagggcgatttctactacatg

SEQ ID NO: 171837 - DNA, 31 bp, Artificial Sequence
  Description of Artificial Sequence: Synthetic oligonucleotide
cctaaggacgagggcgatttctactacatgg

SEQ ID NO: 171838 - DNA, 31 bp, Artificial Sequence
  Description of Artificial Sequence: Synthetic oligonucleotide
ctaaggacgagggcgatttctactacatggg

SEQ ID NO: 171839 - DNA, 31 bp, Artificial Sequence
  Description of Artificial Sequence: Synthetic oligonucleotide
taaggacgagggcgatttctactacatgggg

SEQ ID NO: 171840 - DNA, 25 bp, Artificial Sequence
  Description of Artificial Sequence: Synthetic oligonucleotide
ctgccaccaggccatgatggtcgag

SEQ ID NO: 171841 - DNA, 26 bp, Artificial Sequence
  Description of Artificial Sequence: Synthetic oligonucleotide
tgccaccaggccatgatggtcgagca

SEQ ID NO: 171842 - DNA, 25 bp, Artificial Sequence
  Description of Artificial Sequence: Synthetic oligonucleotide
gccaccaggccatgatggtcgagca

SEQ ID NO: 171843 - DNA, 25 bp, Artificial Sequence
  Description of Artificial Sequence: Synthetic oligonucleotide
ccaccaggccatgatggtcgagcag

SEQ ID NO: 171844 - DNA, 25 bp, Artificial Sequence
  Description of Artificial Sequence: Synthetic oligonucleotide
caccaggccatgatggtcgagcagg

SEQ ID NO: 171845 - DNA, 25 bp, Artificial Sequence
  Description of Artificial Sequence: Synthetic oligonucleotide
accaggccatgatggtcgagcaggc

SEQ ID NO: 171846 - DNA, 24 bp, Artificial Sequence
  Description of Artificial Sequence: Synthetic oligonucleotide
ccaggccatgatggtcgagcaggc

SEQ ID NO: 171847 - DNA, 26 bp, Artificial Sequence
  Description of Artificial Sequence: Synthetic oligonucleotide
caggccatgatggtcgagcaggccaa

SEQ ID NO: 171848 - DNA, 26 bp, Artificial Sequence
  Description of Artificial Sequence: Synthetic oligonucleotide
aggccatgatggtcgagcaggccaac

SEQ ID NO: 171849 - DNA, 25 bp, Artificial Sequence
  Description of Artificial Sequence: Synthetic oligonucleotide
ggccatgatggtcgagcaggccaac

SEQ ID NO: 171850 - DNA, 25 bp, Artificial Sequence
  Description of Artificial Sequence: Synthetic oligonucleotide
gccatgatggtcgagcaggccaacg

SEQ ID NO: 171851 - DNA, 25 bp, Artificial Sequence
  Description of Artificial Sequence: Synthetic oligonucleotide
ccatgatggtcgagcaggccaacgg

SEQ ID NO: 171852 - DNA, 27 bp, Artificial Sequence
  Description of Artificial Sequence: Synthetic oligonucleotide
catgatggtcgagcaggccaacggcat

SEQ ID NO: 171853 - DNA, 27 bp, Artificial Sequence
  Description of Artificial Sequence: Synthetic oligonucleotide
atgatggtcgagcaggccaacggcatc

SEQ ID NO: 171854 - DNA, 26 bp, Artificial Sequence
  Description of Artificial Sequence: Synthetic oligonucleotide
tgatggtcgagcaggccaacggcatc

SEQ ID NO: 171855 - DNA, 25 bp, Artificial Sequence
  Description of Artificial Sequence: Synthetic oligonucleotide
gatggtcgagcaggccaacggcatc

SEQ ID NO: 171856 - DNA, 26 bp, Artificial Sequence
  Description of Artificial Sequence: Synthetic oligonucleotide
atggtcgagcaggccaacggcatcga

SEQ ID NO: 171857 - DNA, 25 bp, Artificial Sequence
  Description of Artificial Sequence: Synthetic oligonucleotide
tggtcgagcaggccaacggcatcga

SEQ ID NO: 171858 - DNA, 24 bp, Artificial Sequence
  Description of Artificial Sequence: Synthetic oligonucleotide
ggtcgagcaggccaacggcatcga

SEQ ID NO: 171859 - DNA, 24 bp, Artificial Sequence
  Description of Artificial Sequence: Synthetic oligonucleotide
gtcgagcaggccaacggcatcgag

SEQ ID NO: 171860 - DNA, 24 bp, Artificial Sequence
  Description of Artificial Sequence: Synthetic oligonucleotide
tcgagcaggccaacggcatcgagg

SEQ ID NO: 171861 - DNA, 23 bp, Artificial Sequence
  Description of Artificial Sequence: Synthetic oligonucleotide
cgagcaggccaacggcatcgagg

SEQ ID NO: 171862 - DNA, 23 bp, Artificial Sequence
  Description of Artificial Sequence: Synthetic oligonucleotide
gagcaggccaacggcatcgaggc

SEQ ID NO: 171863 - DNA, 23 bp, Artificial Sequence
  Description of Artificial Sequence: Synthetic oligonucleotide
agcaggccaacggcatcgaggcc

SEQ ID NO: 171864 - DNA, 22 bp, Artificial Sequence
  Description of Artificial Sequence: Synthetic oligonucleotide
gcaggccaacggcatcgaggcc

SEQ ID NO: 171865 - DNA, 27 bp, Artificial Sequence
  Description of Artificial Sequence: Synthetic oligonucleotide
tgcaccccagcttctacggaagcagct

SEQ ID NO: 171866 - DNA, 26 bp, Artificial Sequence
  Description of Artificial Sequence: Synthetic oligonucleotide
gcaccccagcttctacggaagcagct

SEQ ID NO: 171867 - DNA, 26 bp, Artificial Sequence
  Description of Artificial Sequence: Synthetic oligonucleotide
caccccagcttctacggaagcagctg

SEQ ID NO: 171868 - DNA, 26 bp, Artificial Sequence
  Description of Artificial Sequence: Synthetic oligonucleotide
accccagcttctacggaagcagctgg

SEQ ID NO: 171869 - DNA, 25 bp, Artificial Sequence
  Description of Artificial Sequence: Synthetic oligonucleotide
ccccagcttctacggaagcagctgg

SEQ ID NO: 171870 - DNA, 26 bp, Artificial Sequence
  Description of Artificial Sequence: Synthetic oligonucleotide
cccagcttctacggaagcagctggga

SEQ ID NO: 171871 - DNA, 26 bp, Artificial Sequence
  Description of Artificial Sequence: Synthetic oligonucleotide
ccagcttctacggaagcagctgggag

SEQ ID NO: 171872 - DNA, 26 bp, Artificial Sequence
  Description of Artificial Sequence: Synthetic oligonucleotide
cagcttctacggaagcagctgggagg

SEQ ID NO: 171873 - DNA, 26 bp, Artificial Sequence
  Description of Artificial Sequence: Synthetic oligonucleotide
agcttctacggaagcagctgggaggc

SEQ ID NO: 171874 - DNA, 22 bp, Artificial Sequence
  Description of Artificial Sequence: Synthetic oligonucleotide
ggcgcctacaagcgctggcagg

SEQ ID NO: 171875 - DNA, 22 bp, Artificial Sequence
  Description of Artificial Sequence: Synthetic oligonucleotide
gcgcctacaagcgctggcaggg

SEQ ID NO: 171876 - DNA, 22 bp, Artificial Sequence
  Description of Artificial Sequence: Synthetic oligonucleotide
cgcctacaagcgctggcagggc

SEQ ID NO: 171877 - DNA, 23 bp, Artificial Sequence
  Description of Artificial Sequence: Synthetic oligonucleotide
gcctacaagcgctggcagggcgt

SEQ ID NO: 171878 - DNA, 24 bp, Artificial Sequence
  Description of Artificial Sequence: Synthetic oligonucleotide
cctacaagcgctggcagggcgtgt

SEQ ID NO: 171879 - DNA, 24 bp, Artificial Sequence
  Description of Artificial Sequence: Synthetic oligonucleotide
ctacaagcgctggcagggcgtgtc

SEQ ID NO: 171880 - DNA, 26 bp, Artificial Sequence
  Description of Artificial Sequence: Synthetic oligonucleotide
tacaagcgctggcagggcgtgtccat

SEQ ID NO: 171881 - DNA, 25 bp, Artificial Sequence
  Description of Artificial Sequence: Synthetic oligonucleotide
acaagcgctggcagggcgtgtccat

SEQ ID NO: 171882 - DNA, 24 bp, Artificial Sequence
  Description of Artificial Sequence: Synthetic oligonucleotide
caagcgctggcagggcgtgtccat

SEQ ID NO: 171883 - DNA, 24 bp, Artificial Sequence
  Description of Artificial Sequence: Synthetic oligonucleotide
aagcgctggcagggcgtgtccatg

SEQ ID NO: 171884 - DNA, 23 bp, Artificial Sequence
  Description of Artificial Sequence: Synthetic oligonucleotide
agcgctggcagggcgtgtccatg

SEQ ID NO: 171885 - DNA, 22 bp, Artificial Sequence
  Description of Artificial Sequence: Synthetic oligonucleotide
gcgctggcagggcgtgtccatg

SEQ ID NO: 171886 - DNA, 22 bp, Artificial Sequence
  Description of Artificial Sequence: Synthetic oligonucleotide
cgctggcagggcgtgtccatgc

SEQ ID NO: 171887 - DNA, 22 bp, Artificial Sequence
  Description of Artificial Sequence: Synthetic oligonucleotide
gctggcagggcgtgtccatgcg

SEQ ID NO: 171888 - DNA, 22 bp, Artificial Sequence
  Description of Artificial Sequence: Synthetic oligonucleotide
ctggcagggcgtgtccatgcgc

SEQ ID NO: 171889 - DNA, 22 bp, Artificial Sequence
  Description of Artificial Sequence: Synthetic oligonucleotide
tggcagggcgtgtccatgcgcc

SEQ ID NO: 171890 - DNA, 21 bp, Artificial Sequence
  Description of Artificial Sequence: Synthetic oligonucleotide
ggcagggcgtgtccatgcgcc

SEQ ID NO: 171891 - DNA, 21 bp, Artificial Sequence
  Description of Artificial Sequence: Synthetic oligonucleotide
gcagggcgtgtccatgcgccg

SEQ ID NO: 171892 - DNA, 23 bp, Artificial Sequence
  Description of Artificial Sequence: Synthetic oligonucleotide
cagggcgtgtccatgcgccgcat

SEQ ID NO: 171893 - DNA, 23 bp, Artificial Sequence
  Description of Artificial Sequence: Synthetic oligonucleotide
agggcgtgtccatgcgccgcatg

SEQ ID NO: 171894 - DNA, 22 bp, Artificial Sequence
  Description of Artificial Sequence: Synthetic oligonucleotide
gggcgtgtccatgcgccgcatg

SEQ ID NO: 171895 - DNA, 23 bp, Artificial Sequence
  Description of Artificial Sequence: Synthetic oligonucleotide
ggcgtgtccatgcgccgcatgga

SEQ ID NO: 171896 - DNA, 25 bp, Artificial Sequence
  Description of Artificial Sequence: Synthetic oligonucleotide
gcgtgtccatgcgccgcatggagat

SEQ ID NO: 171897 - DNA, 25 bp, Artificial Sequence
  Description of Artificial Sequence: Synthetic oligonucleotide
tgctggaggtgggcgcctacaagca

SEQ ID NO: 171898 - DNA, 24 bp, Artificial Sequence
  Description of Artificial Sequence: Synthetic oligonucleotide
gctggaggtgggcgcctacaagca

SEQ ID NO: 171899 - DNA, 25 bp, Artificial Sequence
  Description of Artificial Sequence: Synthetic oligonucleotide
ctggaggtgggcgcctacaagcact

SEQ ID NO: 171900 - DNA, 25 bp, Artificial Sequence
  Description of Artificial Sequence: Synthetic oligonucleotide
tggaggtgggcgcctacaagcactg

SEQ ID NO: 171901 - DNA, 24 bp, Artificial Sequence
  Description of Artificial Sequence: Synthetic oligonucleotide
ggaggtgggcgcctacaagcactg

SEQ ID NO: 171902 - DNA, 24 bp, Artificial Sequence
  Description of Artificial Sequence: Synthetic oligonucleotide
gaggtgggcgcctacaagcactgg

SEQ ID NO: 171903 - DNA, 25 bp, Artificial Sequence
  Description of Artificial Sequence: Synthetic oligonucleotide
aggtgggcgcctacaagcactggca

SEQ ID NO: 171904 - DNA, 24 bp, Artificial Sequence
  Description of Artificial Sequence: Synthetic oligonucleotide
ggtgggcgcctacaagcactggca

SEQ ID NO: 171905 - DNA, 24 bp, Artificial Sequence
  Description of Artificial Sequence: Synthetic oligonucleotide
gtgggcgcctacaagcactggcag

SEQ ID NO: 171906 - DNA, 25 bp, Artificial Sequence
  Description of Artificial Sequence: Synthetic oligonucleotide
tgggcgcctacaagcactggcagga

SEQ ID NO: 171907 - DNA, 24 bp, Artificial Sequence
  Description of Artificial Sequence: Synthetic oligonucleotide
gggcgcctacaagcactggcagga

SEQ ID NO: 171908 - DNA, 24 bp, Artificial Sequence
  Description of Artificial Sequence: Synthetic oligonucleotide
ggcgcctacaagcactggcaggac

SEQ ID NO: 171909 - DNA, 25 bp, Artificial Sequence
  Description of Artificial Sequence: Synthetic oligonucleotide
gcgcctacaagcactggcaggacgt

SEQ ID NO: 171910 - DNA, 26 bp, Artificial Sequence
  Description of Artificial Sequence: Synthetic oligonucleotide
cgcctacaagcactggcaggacgtgt

SEQ ID NO: 171911 - DNA, 26 bp, Artificial Sequence
  Description of Artificial Sequence: Synthetic oligonucleotide
gcctacaagcactggcaggacgtgtc

SEQ ID NO: 171912 - DNA, 27 bp, Artificial Sequence
  Description of Artificial Sequence: Synthetic oligonucleotide
cctacaagcactggcaggacgtgtcca

SEQ ID NO: 171913 - DNA, 28 bp, Artificial Sequence
  Description of Artificial Sequence: Synthetic oligonucleotide
ctacaagcactggcaggacgtgtccatg

SEQ ID NO: 171914 - DNA, 28 bp, Artificial Sequence
  Description of Artificial Sequence: Synthetic oligonucleotide
tacaagcactggcaggacgtgtccatgc

SEQ ID NO: 171915 - DNA, 27 bp, Artificial Sequence
  Description of Artificial Sequence: Synthetic oligonucleotide
acaagcactggcaggacgtgtccatgc

SEQ ID NO: 171916 - DNA, 26 bp, Artificial Sequence
  Description of Artificial Sequence: Synthetic oligonucleotide
caagcactggcaggacgtgtccatgc

SEQ ID NO: 171917 - DNA, 26 bp, Artificial Sequence
  Description of Artificial Sequence: Synthetic oligonucleotide
aagcactggcaggacgtgtccatgcg

SEQ ID NO: 171918 - DNA, 25 bp, Artificial Sequence
  Description of Artificial Sequence: Synthetic oligonucleotide
agcactggcaggacgtgtccatgcg

SEQ ID NO: 171919 - DNA, 24 bp, Artificial Sequence
  Description of Artificial Sequence: Synthetic oligonucleotide
gcactggcaggacgtgtccatgcg

SEQ ID NO: 171920 - DNA, 24 bp, Artificial Sequence
  Description of Artificial Sequence: Synthetic oligonucleotide
cactggcaggacgtgtccatgcgc

SEQ ID NO: 171921 - DNA, 24 bp, Artificial Sequence
  Description of Artificial Sequence: Synthetic oligonucleotide
actggcaggacgtgtccatgcgcc

SEQ ID NO: 171922 - DNA, 25 bp, Artificial Sequence
  Description of Artificial Sequence: Synthetic oligonucleotide
gaagctgaggttcactgcggtgccc

SEQ ID NO: 171923 - DNA, 26 bp, Artificial Sequence
  Description of Artificial Sequence: Synthetic oligonucleotide
aagctgaggttcactgcggtgcccga

SEQ ID NO: 171924 - DNA, 25 bp, Artificial Sequence
  Description of Artificial Sequence: Synthetic oligonucleotide
agctgaggttcactgcggtgcccga

SEQ ID NO: 171925 - DNA, 24 bp, Artificial Sequence
  Description of Artificial Sequence: Synthetic oligonucleotide
gctgaggttcactgcggtgcccga

SEQ ID NO: 171926 - DNA, 26 bp, Artificial Sequence
  Description of Artificial Sequence: Synthetic oligonucleotide
ctgaggttcactgcggtgcccgagaa

SEQ ID NO: 171927 - DNA, 26 bp, Artificial Sequence
  Description of Artificial Sequence: Synthetic oligonucleotide
tgaggttcactgcggtgcccgagaac

SEQ ID NO: 171928 - DNA, 25 bp, Artificial Sequence
  Description of Artificial Sequence: Synthetic oligonucleotide
gaggttcactgcggtgcccgagaac

SEQ ID NO: 171929 - DNA, 26 bp, Artificial Sequence
  Description of Artificial Sequence: Synthetic oligonucleotide
aggttcactgcggtgcccgagaacca

SEQ ID NO: 171930 - DNA, 25 bp, Artificial Sequence
  Description of Artificial Sequence: Synthetic oligonucleotide
ggttcactgcggtgcccgagaacca

SEQ ID NO: 171931 - DNA, 25 bp, Artificial Sequence
  Description of Artificial Sequence: Synthetic oligonucleotide
gttcactgcggtgcccgagaaccac

SEQ ID NO: 171932 - DNA, 26 bp, Artificial Sequence
  Description of Artificial Sequence: Synthetic oligonucleotide
ttcactgcggtgcccgagaaccacca

SEQ ID NO: 171933 - DNA, 25 bp, Artificial Sequence
  Description of Artificial Sequence: Synthetic oligonucleotide
tcactgcggtgcccgagaaccacca

SEQ ID NO: 171934 - DNA, 24 bp, Artificial Sequence
  Description of Artificial Sequence: Synthetic oligonucleotide
cactgcggtgcccgagaaccacca

SEQ ID NO: 171935 - DNA, 24 bp, Artificial Sequence
  Description of Artificial Sequence: Synthetic oligonucleotide
actgcggtgcccgagaaccaccag

SEQ ID NO: 171936 - DNA, 23 bp, Artificial Sequence
  Description of Artificial Sequence: Synthetic oligonucleotide
ctgcggtgcccgagaaccaccag

SEQ ID NO: 171937 - DNA, 23 bp, Artificial Sequence
  Description of Artificial Sequence: Synthetic oligonucleotide
tgcggtgcccgagaaccaccagg

SEQ ID NO: 171938 - DNA, 22 bp, Artificial Sequence
  Description of Artificial Sequence: Synthetic oligonucleotide
gcggtgcccgagaaccaccagg

SEQ ID NO: 171939 - DNA, 22 bp, Artificial Sequence
  Description of Artificial Sequence: Synthetic oligonucleotide
cggtgcccgagaaccaccaggc

SEQ ID NO: 171940 - DNA, 22 bp, Artificial Sequence
  Description of Artificial Sequence: Synthetic oligonucleotide
ggtgcccgagaaccaccaggcg

SEQ ID NO: 171941 - DNA, 23 bp, Artificial Sequence
  Description of Artificial Sequence: Synthetic oligonucleotide
gtgcccgagaaccaccaggcggt

SEQ ID NO: 171942 - DNA, 23 bp, Artificial Sequence
  Description of Artificial Sequence: Synthetic oligonucleotide
tgcccgagaaccaccaggcggtc

SEQ ID NO: 171943 - DNA, 22 bp, Artificial Sequence
  Description of Artificial Sequence: Synthetic oligonucleotide
gcccgagaaccaccaggcggtc

SEQ ID NO: 171944 - DNA, 22 bp, Artificial Sequence
  Description of Artificial Sequence: Synthetic oligonucleotide
cccgagaaccaccaggcggtcc

SEQ ID NO: 171945 - DNA, 22 bp, Artificial Sequence
  Description of Artificial Sequence: Synthetic oligonucleotide
ccgagaaccaccaggcggtccg

SEQ ID NO: 171946 - DNA, 24 bp, Artificial Sequence
  Description of Artificial Sequence: Synthetic oligonucleotide
cgagaaccaccaggcggtccggaa

SEQ ID NO: 171947 - DNA, 24 bp, Artificial Sequence
  Description of Artificial Sequence: Synthetic oligonucleotide
gagaaccaccaggcggtccggaac

SEQ ID NO: 171948 - DNA, 25 bp, Artificial Sequence
  Description of Artificial Sequence: Synthetic oligonucleotide
tgcccaagaaccaccaggcggtcca

SEQ ID NO: 171949 - DNA, 24 bp, Artificial Sequence
  Description of Artificial Sequence: Synthetic oligonucleotide
gcccaagaaccaccaggcggtcca

SEQ ID NO: 171950 - DNA, 26 bp, Artificial Sequence
  Description of Artificial Sequence: Synthetic oligonucleotide
cccaagaaccaccaggcggtccagaa

SEQ ID NO: 171951 - DNA, 26 bp, Artificial Sequence
  Description of Artificial Sequence: Synthetic oligonucleotide
ccaagaaccaccaggcggtccagaac

SEQ ID NO: 171952 - DNA, 26 bp, Artificial Sequence
  Description of Artificial Sequence: Synthetic oligonucleotide
caagaaccaccaggcggtccagaacc

SEQ ID NO: 171953 - DNA, 26 bp, Artificial Sequence
  Description of Artificial Sequence: Synthetic oligonucleotide
aagaaccaccaggcggtccagaaccc

SEQ ID NO: 171954 - DNA, 25 bp, Artificial Sequence
  Description of Artificial Sequence: Synthetic oligonucleotide
agaaccaccaggcggtccagaaccc

SEQ ID NO: 171955 - DNA, 24 bp, Artificial Sequence
  Description of Artificial Sequence: Synthetic oligonucleotide
gaaccaccaggcggtccagaaccc

SEQ ID NO: 171956 - DNA, 25 bp, Artificial Sequence
  Description of Artificial Sequence: Synthetic oligonucleotide
aaccaccaggcggtccagaacccgt

SEQ ID NO: 171957 - DNA, 24 bp, Artificial Sequence
  Description of Artificial Sequence: Synthetic oligonucleotide
accaccaggcggtccagaacccgt

SEQ ID NO: 171958 - DNA, 23 bp, Artificial Sequence
  Description of Artificial Sequence: Synthetic oligonucleotide
ccaccaggcggtccagaacccgt

SEQ ID NO: 171959 - DNA, 24 bp, Artificial Sequence
  Description of Artificial Sequence: Synthetic oligonucleotide
caccaggcggtccagaacccgtga

SEQ ID NO: 171960 - DNA, 22 bp, Artificial Sequence
  Description of Artificial Sequence: Synthetic oligonucleotide
accagggcctgccaccaggcca

SEQ ID NO: 171961 - DNA, 21 bp, Artificial Sequence
  Description of Artificial Sequence: Synthetic oligonucleotide
ccagggcctgccaccaggcca

SEQ ID NO: 171962 - DNA, 21 bp, Artificial Sequence
  Description of Artificial Sequence: Synthetic oligonucleotide
cagggcctgccaccaggccag

SEQ ID NO: 171963 - DNA, 23 bp, Artificial Sequence
  Description of Artificial Sequence: Synthetic oligonucleotide
agggcctgccaccaggccaggat

SEQ ID NO: 171964 - DNA, 22 bp, Artificial Sequence
  Description of Artificial Sequence: Synthetic oligonucleotide
gggcctgccaccaggccaggat

SEQ ID NO: 171965 - DNA, 22 bp, Artificial Sequence
  Description of Artificial Sequence: Synthetic oligonucleotide
ggcctgccaccaggccaggatg

SEQ ID NO: 171966 - DNA, 23 bp, Artificial Sequence
  Description of Artificial Sequence: Synthetic oligonucleotide
gcctgccaccaggccaggatggt

SEQ ID NO: 171967 - DNA, 23 bp, Artificial Sequence
  Description of Artificial Sequence: Synthetic oligonucleotide
cctgccaccaggccaggatggtc

SEQ ID NO: 171968 - DNA, 24 bp, Artificial Sequence
  Description of Artificial Sequence: Synthetic oligonucleotide
ctgccaccaggccaggatggtcga

SEQ ID NO: 171969 - DNA, 24 bp, Artificial Sequence
  Description of Artificial Sequence: Synthetic oligonucleotide
tgccaccaggccaggatggtcgac

SEQ ID NO: 171970 - DNA, 23 bp, Artificial Sequence
  Description of Artificial Sequence: Synthetic oligonucleotide
gccaccaggccaggatggtcgac

SEQ ID NO: 171971 - DNA, 24 bp, Artificial Sequence
  Description of Artificial Sequence: Synthetic oligonucleotide
ccaccaggccaggatggtcgacca

SEQ ID NO: 171972 - DNA, 24 bp, Artificial Sequence
  Description of Artificial Sequence: Synthetic oligonucleotide
caccaggccaggatggtcgaccag

SEQ ID NO: 171973 - DNA, 24 bp, Artificial Sequence
  Description of Artificial Sequence: Synthetic oligonucleotide
accaggccaggatggtcgaccagg

SEQ ID NO: 171974 - DNA, 23 bp, Artificial Sequence
  Description of Artificial Sequence: Synthetic oligonucleotide
ccaggccaggatggtcgaccagg

SEQ ID NO: 171975 - DNA, 23 bp, Artificial Sequence
  Description of Artificial Sequence: Synthetic oligonucleotide
caggccaggatggtcgaccaggc

SEQ ID NO: 171976 - DNA, 25 bp, Artificial Sequence
  Description of Artificial Sequence: Synthetic oligonucleotide
aggccaggatggtcgaccaggccaa

SEQ ID NO: 171977 - DNA, 24 bp, Artificial Sequence
  Description of Artificial Sequence: Synthetic oligonucleotide
ggccaggatggtcgaccaggccaa

SEQ ID NO: 171978 - DNA, 24 bp, Artificial Sequence
  Description of Artificial Sequence: Synthetic oligonucleotide
gccaggatggtcgaccaggccaac

SEQ ID NO: 171979 - DNA, 24 bp, Artificial Sequence
  Description of Artificial Sequence: Synthetic oligonucleotide
ccaggatggtcgaccaggccaacg

SEQ ID NO: 171980 - DNA, 24 bp, Artificial Sequence
  Description of Artificial Sequence: Synthetic oligonucleotide
caggatggtcgaccaggccaacgg

SEQ ID NO: 171981 - DNA, 26 bp, Artificial Sequence
  Description of Artificial Sequence: Synthetic oligonucleotide
aggatggtcgaccaggccaacggcat

SEQ ID NO: 171982 - DNA, 25 bp, Artificial Sequence
  Description of Artificial Sequence: Synthetic oligonucleotide
ggatggtcgaccaggccaacggcat

SEQ ID NO: 171983 - DNA, 27 bp, Artificial Sequence
  Description of Artificial Sequence: Synthetic oligonucleotide
gaagctgaggttcactgcggtgcccat

SEQ ID NO: 171984 - DNA, 27 bp, Artificial Sequence
  Description of Artificial Sequence: Synthetic oligonucleotide
aagctgaggttcactgcggtgcccatg

SEQ ID NO: 171985 - DNA, 27 bp, Artificial Sequence
  Description of Artificial Sequence: Synthetic oligonucleotide
agctgaggttcactgcggtgcccatga

SEQ ID NO: 171986 - DNA, 27 bp, Artificial Sequence
  Description of Artificial Sequence: Synthetic oligonucleotide
gctgaggttcactgcggtgcccatgaa

SEQ ID NO: 171987 - DNA, 27 bp, Artificial Sequence
  Description of Artificial Sequence: Synthetic oligonucleotide
ctgaggttcactgcggtgcccatgaac

SEQ ID NO: 171988 - DNA, 27 bp, Artificial Sequence
  Description of Artificial Sequence: Synthetic oligonucleotide
tgaggttcactgcggtgcccatgaacc

SEQ ID NO: 171989 - DNA, 27 bp, Artificial Sequence
  Description of Artificial Sequence: Synthetic oligonucleotide
gaggttcactgcggtgcccatgaacca

SEQ ID NO: 171990 - DNA, 27 bp, Artificial Sequence
  Description of Artificial Sequence: Synthetic oligonucleotide
aggttcactgcggtgcccatgaaccac

SEQ ID NO: 171991 - DNA, 26 bp, Artificial Sequence
  Description of Artificial Sequence: Synthetic oligonucleotide
ggttcactgcggtgcccatgaaccac

SEQ ID NO: 171992 - DNA, 27 bp, Artificial Sequence
  Description of Artificial Sequence: Synthetic oligonucleotide
gttcactgcggtgcccatgaaccacca

SEQ ID NO: 171993 - DNA, 27 bp, Artificial Sequence
  Description of Artificial Sequence: Synthetic oligonucleotide
ttcactgcggtgcccatgaaccaccag

SEQ ID NO: 171994 - DNA, 26 bp, Artificial Sequence
  Description of Artificial Sequence: Synthetic oligonucleotide
tcactgcggtgcccatgaaccaccag

SEQ ID NO: 171995 - DNA, 25 bp, Artificial Sequence
  Description of Artificial Sequence: Synthetic oligonucleotide
cactgcggtgcccatgaaccaccag

SEQ ID NO: 171996 - DNA, 25 bp, Artificial Sequence
  Description of Artificial Sequence: Synthetic oligonucleotide
actgcggtgcccatgaaccaccagg

SEQ ID NO: 171997 - DNA, 24 bp, Artificial Sequence
  Description of Artificial Sequence: Synthetic oligonucleotide
ctgcggtgcccatgaaccaccagg

SEQ ID NO: 171998 - DNA, 24 bp, Artificial Sequence
  Description of Artificial Sequence: Synthetic oligonucleotide
tgcggtgcccatgaaccaccaggc

SEQ ID NO: 171999 - DNA, 23 bp, Artificial Sequence
  Description of Artificial Sequence: Synthetic oligonucleotide
gcggtgcccatgaaccaccaggc

SEQ ID NO: 172000 - DNA, 23 bp, Artificial Sequence
  Description of Artificial Sequence: Synthetic oligonucleotide
cggtgcccatgaaccaccaggcg

SEQ ID NO: 172001 - DNA, 24 bp, Artificial Sequence
  Description of Artificial Sequence: Synthetic oligonucleotide
ggtgcccatgaaccaccaggcggt

SEQ ID NO: 172002 - DNA, 24 bp, Artificial Sequence
  Description of Artificial Sequence: Synthetic oligonucleotide
gtgcccatgaaccaccaggcggtc

SEQ ID NO: 172003 - DNA, 24 bp, Artificial Sequence
  Description of Artificial Sequence: Synthetic oligonucleotide
tgcccatgaaccaccaggcggtcc

SEQ ID NO: 172004 - DNA, 23 bp, Artificial Sequence
  Description of Artificial Sequence: Synthetic oligonucleotide
gcccatgaaccaccaggcggtcc

SEQ ID NO: 172005 - DNA, 23 bp, Artificial Sequence
  Description of Artificial Sequence: Synthetic oligonucleotide
cccatgaaccaccaggcggtccg

SEQ ID NO: 172006 - DNA, 25 bp, Artificial Sequence
  Description of Artificial Sequence: Synthetic oligonucleotide
ccatgaaccaccaggcggtccggaa

SEQ ID NO: 172007 - DNA, 25 bp, Artificial Sequence
  Description of Artificial Sequence: Synthetic oligonucleotide
catgaaccaccaggcggtccggaac

SEQ ID NO: 172008 - DNA, 25 bp, Artificial Sequence
  Description of Artificial Sequence: Synthetic oligonucleotide
atgaaccaccaggcggtccggaacc

SEQ ID NO: 172009 - DNA, 24 bp, Artificial Sequence
  Description of Artificial Sequence: Synthetic oligonucleotide
tgaaccaccaggcggtccggaacc

SEQ ID NO: 172010 - DNA, 25 bp, Artificial Sequence
  Description of Artificial Sequence: Synthetic oligonucleotide
ctacaagcgctggcaggacgtgtcc

SEQ ID NO: 172011 - DNA, 26 bp, Artificial Sequence
  Description of Artificial Sequence: Synthetic oligonucleotide
tacaagcgctggcaggacgtgtccgt

SEQ ID NO: 172012 - DNA, 25 bp, Artificial Sequence
  Description of Artificial Sequence: Synthetic oligonucleotide
acaagcgctggcaggacgtgtccgt

SEQ ID NO: 172013 - DNA, 24 bp, Artificial Sequence
  Description of Artificial Sequence: Synthetic oligonucleotide
caagcgctggcaggacgtgtccgt

SEQ ID NO: 172014 - DNA, 24 bp, Artificial Sequence
  Description of Artificial Sequence: Synthetic oligonucleotide
aagcgctggcaggacgtgtccgtg

SEQ ID NO: 172015 - DNA, 23 bp, Artificial Sequence
  Description of Artificial Sequence: Synthetic oligonucleotide
agcgctggcaggacgtgtccgtg

SEQ ID NO: 172016 - DNA, 22 bp, Artificial Sequence
  Description of Artificial Sequence: Synthetic oligonucleotide
gcgctggcaggacgtgtccgtg

SEQ ID NO: 172017 - DNA, 22 bp, Artificial Sequence
  Description of Artificial Sequence: Synthetic oligonucleotide
cgctggcaggacgtgtccgtgc

SEQ ID NO: 172018 - DNA, 22 bp, Artificial Sequence
  Description of Artificial Sequence: Synthetic oligonucleotide
gctggcaggacgtgtccgtgcg

SEQ ID NO: 172019 - DNA, 22 bp, Artificial Sequence
  Description of Artificial Sequence: Synthetic oligonucleotide
ctggcaggacgtgtccgtgcgc

SEQ ID NO: 172020 - DNA, 22 bp, Artificial Sequence
  Description of Artificial Sequence: Synthetic oligonucleotide
tggcaggacgtgtccgtgcgcc

SEQ ID NO: 172021 - DNA, 21 bp, Artificial Sequence
  Description of Artificial Sequence: Synthetic oligonucleotide
ggcaggacgtgtccgtgcgcc

SEQ ID NO: 172022 - DNA, 21 bp, Artificial Sequence
  Description of Artificial Sequence: Synthetic oligonucleotide
gcaggacgtgtccgtgcgccg

SEQ ID NO: 172023 - DNA, 23 bp, Artificial Sequence
  Description of Artificial Sequence: Synthetic oligonucleotide
caggacgtgtccgtgcgccgcat

SEQ ID NO: 172024 - DNA, 23 bp, Artificial Sequence
  Description of Artificial Sequence: Synthetic oligonucleotide
aggacgtgtccgtgcgccgcatg

SEQ ID NO: 172025 - DNA, 22 bp, Artificial Sequence
  Description of Artificial Sequence: Synthetic oligonucleotide
ggacgtgtccgtgcgccgcatg

SEQ ID NO: 172026 - DNA, 23 bp, Artificial Sequence
  Description of Artificial Sequence: Synthetic oligonucleotide
gacgtgtccgtgcgccgcatgga

SEQ ID NO: 172027 - DNA, 25 bp, Artificial Sequence
  Description of Artificial Sequence: Synthetic oligonucleotide
acgtgtccgtgcgccgcatggagat

SEQ ID NO: 172028 - DNA, 24 bp, Artificial Sequence
  Description of Artificial Sequence: Synthetic oligonucleotide
cgtgtccgtgcgccgcatggagat

SEQ ID NO: 172029 - DNA, 26 bp, Artificial Sequence
  Description of Artificial Sequence: Synthetic oligonucleotide
gtgtccgtgcgccgcatggagatgat

SEQ ID NO: 172030 - DNA, 27 bp, Artificial Sequence
  Description of Artificial Sequence: Synthetic oligonucleotide
tgtccgtgcgccgcatggagatgatca

SEQ ID NO: 172031 - DNA, 26 bp, Artificial Sequence
  Description of Artificial Sequence: Synthetic oligonucleotide
gtccgtgcgccgcatggagatgatca

SEQ ID NO: 172032 - DNA, 27 bp, Artificial Sequence
  Description of Artificial Sequence: Synthetic oligonucleotide
tccgtgcgccgcatggagatgatcagt

SEQ ID NO: 172033 - DNA, 26 bp, Artificial Sequence
  Description of Artificial Sequence: Synthetic oligonucleotide
ccgtgcgccgcatggagatgatcagt

SEQ ID NO: 172034 - DNA, 27 bp, Artificial Sequence
  Description of Artificial Sequence: Synthetic oligonucleotide
cgtgcgccgcatggagatgatcagtga

SEQ ID NO: 172035 - DNA, 27 bp, Artificial Sequence
  Description of Artificial Sequence: Synthetic oligonucleotide
gtgcgccgcatggagatgatcagtgac

SEQ ID NO: 172036 - DNA, 29 bp, Artificial Sequence
  Description of Artificial Sequence: Synthetic oligonucleotide
accgtgtaggaaggatgtcctcgtggtac

SEQ ID NO: 172037 - DNA, 28 bp, Artificial Sequence
  Description of Artificial Sequence: Synthetic oligonucleotide
ccgtgtaggaaggatgtcctcgtggtac

SEQ ID NO: 172038 - DNA, 28 bp, Artificial Sequence
  Description of Artificial Sequence: Synthetic oligonucleotide
cgtgtaggaaggatgtcctcgtggtacc

SEQ ID NO: 172039 - DNA, 28 bp, Artificial Sequence
  Description of Artificial Sequence: Synthetic oligonucleotide
gtgtaggaaggatgtcctcgtggtaccc

SEQ ID NO: 172040 - DNA, 28 bp, Artificial Sequence
  Description of Artificial Sequence: Synthetic oligonucleotide
tgtaggaaggatgtcctcgtggtacccc

SEQ ID NO: 172041 - DNA, 27 bp, Artificial Sequence
  Description of Artificial Sequence: Synthetic oligonucleotide
gtaggaaggatgtcctcgtggtacccc

SEQ ID NO: 172042 - DNA, 29 bp, Artificial Sequence
  Description of Artificial Sequence: Synthetic oligonucleotide
taggaaggatgtcctcgtggtaccccttg

SEQ ID NO: 172043 - DNA, 28 bp, Artificial Sequence
  Description of Artificial Sequence: Synthetic oligonucleotide
aggaaggatgtcctcgtggtaccccttg

SEQ ID NO: 172044 - DNA, 27 bp, Artificial Sequence
  Description of Artificial Sequence: Synthetic oligonucleotide
ggaaggatgtcctcgtggtaccccttg

SEQ ID NO: 172045 - DNA, 27 bp, Artificial Sequence
  Description of Artificial Sequence: Synthetic oligonucleotide
gaaggatgtcctcgtggtaccccttgg

SEQ ID NO: 172046 - DNA, 27 bp, Artificial Sequence
  Description of Artificial Sequence: Synthetic oligonucleotide
aaggatgtcctcgtggtaccccttggc

SEQ ID NO: 172047 - DNA, 27 bp, Artificial Sequence
  Description of Artificial Sequence: Synthetic oligonucleotide
aggatgtcctcgtggtaccccttggct

SEQ ID NO: 172048 - DNA, 26 bp, Artificial Sequence
  Description of Artificial Sequence: Synthetic oligonucleotide
ggatgtcctcgtggtaccccttggct

SEQ ID NO: 172049 - DNA, 26 bp, Artificial Sequence
  Description of Artificial Sequence: Synthetic oligonucleotide
gatgtcctcgtggtaccccttggctg

SEQ ID NO: 172050 - DNA, 26 bp, Artificial Sequence
  Description of Artificial Sequence: Synthetic oligonucleotide
atgtcctcgtggtaccccttggctgg

SEQ ID NO: 172051 - DNA, 25 bp, Artificial Sequence
  Description of Artificial Sequence: Synthetic oligonucleotide
tgtcctcgtggtaccccttggctgg

SEQ ID NO: 172052 - DNA, 24 bp, Artificial Sequence
  Description of Artificial Sequence: Synthetic oligonucleotide
gtcctcgtggtaccccttggctgg

SEQ ID NO: 172053 - DNA, 25 bp, Artificial Sequence
  Description of Artificial Sequence: Synthetic oligonucleotide
tcctcgtggtaccccttggctggct

SEQ ID NO: 172054 - DNA, 24 bp, Artificial Sequence
  Description of Artificial Sequence: Synthetic oligonucleotide
cctcgtggtaccccttggctggct

SEQ ID NO: 172055 - DNA, 24 bp, Artificial Sequence
  Description of Artificial Sequence: Synthetic oligonucleotide
ctcgtggtaccccttggctggctc

SEQ ID NO: 172056 - DNA, 24 bp, Artificial Sequence
  Description of Artificial Sequence: Synthetic oligonucleotide
tcgtggtaccccttggctggctcc

SEQ ID NO: 172057 - DNA, 23 bp, Artificial Sequence
  Description of Artificial Sequence: Synthetic oligonucleotide
cgtggtaccccttggctggctcc

SEQ ID NO: 172058 - DNA, 26 bp, Artificial Sequence
  Description of Artificial Sequence: Synthetic oligonucleotide
gtggtaccccttggctggctcccatt

SEQ ID NO: 172059 - DNA, 27 bp, Artificial Sequence
  Description of Artificial Sequence: Synthetic oligonucleotide
tggtaccccttggctggctcccattgt

SEQ ID NO: 172060 - DNA, 26 bp, Artificial Sequence
  Description of Artificial Sequence: Synthetic oligonucleotide
ggtaccccttggctggctcccattgt

SEQ ID NO: 172061 - DNA, 27 bp, Artificial Sequence
  Description of Artificial Sequence: Synthetic oligonucleotide
gtaccccttggctggctcccattgtct

SEQ ID NO: 172062 - DNA, 27 bp, Artificial Sequence
  Description of Artificial Sequence: Synthetic oligonucleotide
taccccttggctggctcccattgtctg

SEQ ID NO: 172063 - DNA, 27 bp, Artificial Sequence
  Description of Artificial Sequence: Synthetic oligonucleotide
tccatgcgccgcatggagatgatcagc

SEQ ID NO: 172064 - DNA, 26 bp, Artificial Sequence
  Description of Artificial Sequence: Synthetic oligonucleotide
ccatgcgccgcatggagatgatcagc

SEQ ID NO: 172065 - DNA, 27 bp, Artificial Sequence
  Description of Artificial Sequence: Synthetic oligonucleotide
catgcgccgcatggagatgatcagcga

SEQ ID NO: 172066 - DNA, 27 bp, Artificial Sequence
  Description of Artificial Sequence: Synthetic oligonucleotide
atgcgccgcatggagatgatcagcgac

SEQ ID NO: 172067 - DNA, 27 bp, Artificial Sequence
  Description of Artificial Sequence: Synthetic oligonucleotide
tgcgccgcatggagatgatcagcgact

SEQ ID NO: 172068 - DNA, 27 bp, Artificial Sequence
  Description of Artificial Sequence: Synthetic oligonucleotide
gcgccgcatggagatgatcagcgactt

SEQ ID NO: 172069 - DNA, 27 bp, Artificial Sequence
  Description of Artificial Sequence: Synthetic oligonucleotide
cgccgcatggagatgatcagcgacttc

SEQ ID NO: 172070 - DNA, 28 bp, Artificial Sequence
  Description of Artificial Sequence: Synthetic oligonucleotide
gccgcatggagatgatcagcgacttctg

SEQ ID NO: 172071 - DNA, 28 bp, Artificial Sequence
  Description of Artificial Sequence: Synthetic oligonucleotide
ccgcatggagatgatcagcgacttctgc

SEQ ID NO: 172072 - DNA, 28 bp, Artificial Sequence
  Description of Artificial Sequence: Synthetic oligonucleotide
cgcatggagatgatcagcgacttctgcg

SEQ ID NO: 172073 - DNA, 29 bp, Artificial Sequence
  Description of Artificial Sequence: Synthetic oligonucleotide
gcatggagatgatcagcgacttctgcgag

SEQ ID NO: 172074 - DNA, 29 bp, Artificial Sequence
  Description of Artificial Sequence: Synthetic oligonucleotide
catggagatgatcagcgacttctgcgagc

SEQ ID NO: 172075 - DNA, 29 bp, Artificial Sequence
  Description of Artificial Sequence: Synthetic oligonucleotide
atggagatgatcagcgacttctgcgagcg

SEQ ID NO: 172076 - DNA, 28 bp, Artificial Sequence
  Description of Artificial Sequence: Synthetic oligonucleotide
tggagatgatcagcgacttctgcgagcg

SEQ ID NO: 172077 - DNA, 27 bp, Artificial Sequence
  Description of Artificial Sequence: Synthetic oligonucleotide
ggagatgatcagcgacttctgcgagcg

SEQ ID NO: 172078 - DNA, 27 bp, Artificial Sequence
  Description of Artificial Sequence: Synthetic oligonucleotide
gagatgatcagcgacttctgcgagcgg

SEQ ID NO: 172079 - DNA, 27 bp, Artificial Sequence
  Description of Artificial Sequence: Synthetic oligonucleotide
agatgatcagcgacttctgcgagcggc

SEQ ID NO: 172080 - DNA, 26 bp, Artificial Sequence
  Description of Artificial Sequence: Synthetic oligonucleotide
gatgatcagcgacttctgcgagcggc

SEQ ID NO: 172081 - DNA, 26 bp, Artificial Sequence
  Description of Artificial Sequence: Synthetic oligonucleotide
atgatcagcgacttctgcgagcggcg

SEQ ID NO: 172082 - DNA, 25 bp, Artificial Sequence
  Description of Artificial Sequence: Synthetic oligonucleotide
tgatcagcgacttctgcgagcggcg

SEQ ID NO: 172083 - DNA, 24 bp, Artificial Sequence
  Description of Artificial Sequence: Synthetic oligonucleotide
gatcagcgacttctgcgagcggcg

SEQ ID NO: 172084 - DNA, 26 bp, Artificial Sequence
  Description of Artificial Sequence: Synthetic oligonucleotide
atcagcgacttctgcgagcggcgctt

SEQ ID NO: 172085 - DNA, 25 bp, Artificial Sequence
  Description of Artificial Sequence: Synthetic oligonucleotide
tcagcgacttctgcgagcggcgctt

SEQ ID NO: 172086 - DNA, 24 bp, Artificial Sequence
  Description of Artificial Sequence: Synthetic oligonucleotide
cagcgacttctgcgagcggcgctt

SEQ ID NO: 172087 - DNA, 24 bp, Artificial Sequence
  Description of Artificial Sequence: Synthetic oligonucleotide
agcgacttctgcgagcggcgcttc

SEQ ID NO: 172088 - DNA, 23 bp, Artificial Sequence
  Description of Artificial Sequence: Synthetic oligonucleotide
gcgacttctgcgagcggcgcttc

SEQ ID NO: 172089 - DNA, 24 bp, Artificial Sequence
  Description of Artificial Sequence: Synthetic oligonucleotide
cgacttctgcgagcggcgcttcct

SEQ ID NO: 172090 - DNA, 27 bp, Artificial Sequence
  Description of Artificial Sequence: Synthetic oligonucleotide
tgggccaccgtgtccactactatgtcc

SEQ ID NO: 172091 - DNA, 27 bp, Artificial Sequence
  Description of Artificial Sequence: Synthetic oligonucleotide
gggccaccgtgtccactactatgtcct

SEQ ID NO: 172092 - DNA, 27 bp, Artificial Sequence
  Description of Artificial Sequence: Synthetic oligonucleotide
ggccaccgtgtccactactatgtcctc

SEQ ID NO: 172093 - DNA, 28 bp, Artificial Sequence
  Description of Artificial Sequence: Synthetic oligonucleotide
gccaccgtgtccactactatgtcctcac

SEQ ID NO: 172094 - DNA, 28 bp, Artificial Sequence
  Description of Artificial Sequence: Synthetic oligonucleotide
ccaccgtgtccactactatgtcctcacc

SEQ ID NO: 172095 - DNA, 28 bp, Artificial Sequence
  Description of Artificial Sequence: Synthetic oligonucleotide
caccgtgtccactactatgtcctcaccg

SEQ ID NO: 172096 - DNA, 29 bp, Artificial Sequence
  Description of Artificial Sequence: Synthetic oligonucleotide
accgtgtccactactatgtcctcaccgac

SEQ ID NO: 172097 - DNA, 28 bp, Artificial Sequence
  Description of Artificial Sequence: Synthetic oligonucleotide
ccgtgtccactactatgtcctcaccgac

SEQ ID NO: 172098 - DNA, 28 bp, Artificial Sequence
  Description of Artificial Sequence: Synthetic oligonucleotide
cgtgtccactactatgtcctcaccgacc

SEQ ID NO: 172099 - DNA, 29 bp, Artificial Sequence
  Description of Artificial Sequence: Synthetic oligonucleotide
gtgtccactactatgtcctcaccgaccag

SEQ ID NO: 172100 - DNA, 29 bp, Artificial Sequence
  Description of Artificial Sequence: Synthetic oligonucleotide
tgtccactactatgtcctcaccgaccagc

SEQ ID NO: 172101 - DNA, 28 bp, Artificial Sequence
  Description of Artificial Sequence: Synthetic oligonucleotide
gtccactactatgtcctcaccgaccagc

SEQ ID NO: 172102 - DNA, 28 bp, Artificial Sequence
  Description of Artificial Sequence: Synthetic oligonucleotide
tccactactatgtcctcaccgaccagcc

SEQ ID NO: 172103 - DNA, 27 bp, Artificial Sequence
  Description of Artificial Sequence: Synthetic oligonucleotide
ccactactatgtcctcaccgaccagcc

SEQ ID NO: 172104 - DNA, 27 bp, Artificial Sequence
  Description of Artificial Sequence: Synthetic oligonucleotide
cactactatgtcctcaccgaccagccg

SEQ ID NO: 172105 - DNA, 27 bp, Artificial Sequence
  Description of Artificial Sequence: Synthetic oligonucleotide
actactatgtcctcaccgaccagccgg

SEQ ID NO: 172106 - DNA, 26 bp, Artificial Sequence
  Description of Artificial Sequence: Synthetic oligonucleotide
ctactatgtcctcaccgaccagccgg

SEQ ID NO: 172107 - DNA, 26 bp, Artificial Sequence
  Description of Artificial Sequence: Synthetic oligonucleotide
tactatgtcctcaccgaccagccggc

SEQ ID NO: 172108 - DNA, 25 bp, Artificial Sequence
  Description of Artificial Sequence: Synthetic oligonucleotide
actatgtcctcaccgaccagccggc

SEQ ID NO: 172109 - DNA, 24 bp, Artificial Sequence
  Description of Artificial Sequence: Synthetic oligonucleotide
ctatgtcctcaccgaccagccggc

SEQ ID NO: 172110 - DNA, 24 bp, Artificial Sequence
  Description of Artificial Sequence: Synthetic oligonucleotide
tatgtcctcaccgaccagccggcc

SEQ ID NO: 172111 - DNA, 23 bp, Artificial Sequence
  Description of Artificial Sequence: Synthetic oligonucleotide
atgtcctcaccgaccagccggcc

SEQ ID NO: 172112 - DNA, 22 bp, Artificial Sequence
  Description of Artificial Sequence: Synthetic oligonucleotide
tgtcctcaccgaccagccggcc

SEQ ID NO: 172113 - DNA, 21 bp, Artificial Sequence
  Description of Artificial Sequence: Synthetic oligonucleotide
gtcctcaccgaccagccggcc

SEQ ID NO: 172114 - DNA, 21 bp, Artificial Sequence
  Description of Artificial Sequence: Synthetic oligonucleotide
tcctcaccgaccagccggccg

SEQ ID NO: 172115 - DNA, 20 bp, Artificial Sequence
  Description of Artificial Sequence: Synthetic oligonucleotide
cctcaccgaccagccggccg

SEQ ID NO: 172116 - DNA, 20 bp, Artificial Sequence
  Description of Artificial Sequence: Synthetic oligonucleotide
ctcaccgaccagccggccgc

SEQ ID NO: 172117 - DNA, 24 bp, Artificial Sequence
  Description of Artificial Sequence: Synthetic oligonucleotide
cggccccagtcccaggcctacata

SEQ ID NO: 172118 - DNA, 24 bp, Artificial Sequence
  Description of Artificial Sequence: Synthetic oligonucleotide
ggccccagtcccaggcctacatac

SEQ ID NO: 172119 - DNA, 24 bp, Artificial Sequence
  Description of Artificial Sequence: Synthetic oligonucleotide
gccccagtcccaggcctacatacc

SEQ ID NO: 172120 - DNA, 26 bp, Artificial Sequence
  Description of Artificial Sequence: Synthetic oligonucleotide
ccccagtcccaggcctacatacccaa

SEQ ID NO: 172121 - DNA, 26 bp, Artificial Sequence
  Description of Artificial Sequence: Synthetic oligonucleotide
cccagtcccaggcctacatacccaag

SEQ ID NO: 172122 - DNA, 27 bp, Artificial Sequence
  Description of Artificial Sequence: Synthetic oligonucleotide
ccagtcccaggcctacatacccaagga

SEQ ID NO: 172123 - DNA, 27 bp, Artificial Sequence
  Description of Artificial Sequence: Synthetic oligonucleotide
cagtcccaggcctacatacccaaggac

SEQ ID NO: 172124 - DNA, 27 bp, Artificial Sequence
  Description of Artificial Sequence: Synthetic oligonucleotide
agtcccaggcctacatacccaaggacg

SEQ ID NO: 172125 - DNA, 27 bp, Artificial Sequence
  Description of Artificial Sequence: Synthetic oligonucleotide
gtcccaggcctacatacccaaggacga

SEQ ID NO: 172126 - DNA, 27 bp, Artificial Sequence
  Description of Artificial Sequence: Synthetic oligonucleotide
tcccaggcctacatacccaaggacgag

SEQ ID NO: 172127 - DNA, 26 bp, Artificial Sequence
  Description of Artificial Sequence: Synthetic oligonucleotide
cccaggcctacatacccaaggacgag

SEQ ID NO: 172128 - DNA, 26 bp, Artificial Sequence
  Description of Artificial Sequence: Synthetic oligonucleotide
ccaggcctacatacccaaggacgagg

SEQ ID NO: 172129 - DNA, 26 bp, Artificial Sequence
  Description of Artificial Sequence: Synthetic oligonucleotide
caggcctacatacccaaggacgaggg

SEQ ID NO: 172130 - DNA, 26 bp, Artificial Sequence
  Description of Artificial Sequence: Synthetic oligonucleotide
aggcctacatacccaaggacgagggc

SEQ ID NO: 172131 - DNA, 25 bp, Artificial Sequence
  Description of Artificial Sequence: Synthetic oligonucleotide
ggcctacatacccaaggacgagggc

SEQ ID NO: 172132 - DNA, 27 bp, Artificial Sequence
  Description of Artificial Sequence: Synthetic oligonucleotide
gcctacatacccaaggacgagggcgat

SEQ ID NO: 172133 - DNA, 29 bp, Artificial Sequence
  Description of Artificial Sequence: Synthetic oligonucleotide
cctacatacccaaggacgagggcgatttc

SEQ ID NO: 172134 - DNA, 31 bp, Artificial Sequence
  Description of Artificial Sequence: Synthetic oligonucleotide
ctacatacccaaggacgagggcgatttctac

SEQ ID NO: 172135 - DNA, 33 bp, Artificial Sequence
  Description of Artificial Sequence: Synthetic oligonucleotide
tacatacccaaggacgagggcgatttctactac

SEQ ID NO: 172136 - DNA, 32 bp, Artificial Sequence
  Description of Artificial Sequence: Synthetic oligonucleotide
acatacccaaggacgagggcgatttctactac

SEQ ID NO: 172137 - DNA, 31 bp, Artificial Sequence
  Description of Artificial Sequence: Synthetic oligonucleotide
catacccaaggacgagggcgatttctactac

SEQ ID NO: 172138 - DNA, 31 bp, Artificial Sequence
  Description of Artificial Sequence: Synthetic oligonucleotide
atacccaaggacgagggcgatttctactacc

SEQ ID NO: 172139 - DNA, 30 bp, Artificial Sequence
  Description of Artificial Sequence: Synthetic oligonucleotide
tacccaaggacgagggcgatttctactacc

SEQ ID NO: 172140 - DNA, 29 bp, Artificial Sequence
  Description of Artificial Sequence: Synthetic oligonucleotide
acccaaggacgagggcgatttctactacc

SEQ ID NO: 172141 - DNA, 27 bp, Artificial Sequence
  Description of Artificial Sequence: Synthetic oligonucleotide
gcacgacgagagccacctgaacaagtg

SEQ ID NO: 172142 - DNA, 27 bp, Artificial Sequence
  Description of Artificial Sequence: Synthetic oligonucleotide
cacgacgagagccacctgaacaagtgc

SEQ ID NO: 172143 - DNA, 27 bp, Artificial Sequence
  Description of Artificial Sequence: Synthetic oligonucleotide
acgacgagagccacctgaacaagtgcc

SEQ ID NO: 172144 - DNA, 27 bp, Artificial Sequence
  Description of Artificial Sequence: Synthetic oligonucleotide
cgacgagagccacctgaacaagtgcct

SEQ ID NO: 172145 - DNA, 27 bp, Artificial Sequence
  Description of Artificial Sequence: Synthetic oligonucleotide
gacgagagccacctgaacaagtgcctg

SEQ ID NO: 172146 - DNA, 27 bp, Artificial Sequence
  Description of Artificial Sequence: Synthetic oligonucleotide
acgagagccacctgaacaagtgcctgc

SEQ ID NO: 172147 - DNA, 27 bp, Artificial Sequence
  Description of Artificial Sequence: Synthetic oligonucleotide
cgagagccacctgaacaagtgcctgct

SEQ ID NO: 172148 - DNA, 27 bp, Artificial Sequence
  Description of Artificial Sequence: Synthetic oligonucleotide
gagagccacctgaacaagtgcctgctg

SEQ ID NO: 172149 - DNA, 27 bp, Artificial Sequence
  Description of Artificial Sequence: Synthetic oligonucleotide
agagccacctgaacaagtgcctgctgc

SEQ ID NO: 172150 - DNA, 26 bp, Artificial Sequence
  Description of Artificial Sequence: Synthetic oligonucleotide
gagccacctgaacaagtgcctgctgc

SEQ ID NO: 172151 - DNA, 26 bp, Artificial Sequence
  Description of Artificial Sequence: Synthetic oligonucleotide
agccacctgaacaagtgcctgctgcg

SEQ ID NO: 172152 - DNA, 25 bp, Artificial Sequence
  Description of Artificial Sequence: Synthetic oligonucleotide
gccacctgaacaagtgcctgctgcg

SEQ ID NO: 172153 - DNA, 25 bp, Artificial Sequence
  Description of Artificial Sequence: Synthetic oligonucleotide
ccacctgaacaagtgcctgctgcgc

SEQ ID NO: 172154 - DNA, 26 bp, Artificial Sequence
  Description of Artificial Sequence: Synthetic oligonucleotide
cacctgaacaagtgcctgctgcgcca

SEQ ID NO: 172155 - DNA, 27 bp, Artificial Sequence
  Description of Artificial Sequence: Synthetic oligonucleotide
acctgaacaagtgcctgctgcgccaca

SEQ ID NO: 172156 - DNA, 27 bp, Artificial Sequence
  Description of Artificial Sequence: Synthetic oligonucleotide
cctgaacaagtgcctgctgcgccacaa

SEQ ID NO: 172157 - DNA, 28 bp, Artificial Sequence
  Description of Artificial Sequence: Synthetic oligonucleotide
ctgaacaagtgcctgctgcgccacaaac

SEQ ID NO: 172158 - DNA, 28 bp, Artificial Sequence
  Description of Artificial Sequence: Synthetic oligonucleotide
tgaacaagtgcctgctgcgccacaaacc

SEQ ID NO: 172159 - DNA, 27 bp, Artificial Sequence
  Description of Artificial Sequence: Synthetic oligonucleotide
gaacaagtgcctgctgcgccacaaacc

SEQ ID NO: 172160 - DNA, 27 bp, Artificial Sequence
  Description of Artificial Sequence: Synthetic oligonucleotide
aacaagtgcctgctgcgccacaaaccc

SEQ ID NO: 172161 - DNA, 27 bp, Artificial Sequence
  Description of Artificial Sequence: Synthetic oligonucleotide
acaagtgcctgctgcgccacaaaccca

SEQ ID NO: 172162 - DNA, 26 bp, Artificial Sequence
  Description of Artificial Sequence: Synthetic oligonucleotide
caagtgcctgctgcgccacaaaccca

SEQ ID NO: 172163 - DNA, 26 bp, Artificial Sequence
  Description of Artificial Sequence: Synthetic oligonucleotide
aagtgcctgctgcgccacaaacccac

SEQ ID NO: 172164 - DNA, 25 bp, Artificial Sequence
  Description of Artificial Sequence: Synthetic oligonucleotide
agtgcctgctgcgccacaaacccac

SEQ ID NO: 172165 - DNA, 24 bp, Artificial Sequence
  Description of Artificial Sequence: Synthetic oligonucleotide
gtgcctgctgcgccacaaacccac

SEQ ID NO: 172166 - DNA, 26 bp, Artificial Sequence
  Description of Artificial Sequence: Synthetic oligonucleotide
tgcctgctgcgccacaaacccaccaa

SEQ ID NO: 172167 - DNA, 25 bp, Artificial Sequence
  Description of Artificial Sequence: Synthetic oligonucleotide
gcctgctgcgccacaaacccaccaa

SEQ ID NO: 172168 - DNA, 20 bp, Artificial Sequence
  Description of Artificial Sequence: Synthetic oligonucleotide
tgccccgcgtgacgctgggg

SEQ ID NO: 172169 - DNA, 20 bp, Artificial Sequence
  Description of Artificial Sequence: Synthetic oligonucleotide
gccccgcgtgacgctggggt

SEQ ID NO: 172170 - DNA, 20 bp, Artificial Sequence
  Description of Artificial Sequence: Synthetic oligonucleotide
ccccgcgtgacgctggggct

SEQ ID NO: 172171 - DNA, 20 bp, Artificial Sequence
  Description of Artificial Sequence: Synthetic oligonucleotide
cccgcgtgacgctggggcct

SEQ ID NO: 172172 - DNA, 20 bp, Artificial Sequence
  Description of Artificial Sequence: Synthetic oligonucleotide
ccgcgtgacgctggggccgt

SEQ ID NO: 172173 - DNA, 20 bp, Artificial Sequence
  Description of Artificial Sequence: Synthetic oligonucleotide
cgcgtgacgctggggccggt

SEQ ID NO: 172174 - DNA, 20 bp, Artificial Sequence
  Description of Artificial Sequence: Synthetic oligonucleotide
gcgtgacgctggggccggtc

SEQ ID NO: 172175 - DNA, 20 bp, Artificial Sequence
  Description of Artificial Sequence: Synthetic oligonucleotide
cgtgacgctggggccggtcg

SEQ ID NO: 172176 - DNA, 20 bp, Artificial Sequence
  Description of Artificial Sequence: Synthetic oligonucleotide
gtgacgctggggccggtcgg

SEQ ID NO: 172177 - DNA, 21 bp, Artificial Sequence
  Description of Artificial Sequence: Synthetic oligonucleotide
tgacgctggggccggtcggca

SEQ ID NO: 172178 - DNA, 20 bp, Artificial Sequence
  Description of Artificial Sequence: Synthetic oligonucleotide
gacgctggggccggtcggca

SEQ ID NO: 172179 - DNA, 20 bp, Artificial Sequence
  Description of Artificial Sequence: Synthetic oligonucleotide
acgctggggccggtcggcag

SEQ ID NO: 172180 - DNA, 20 bp, Artificial Sequence
  Description of Artificial Sequence: Synthetic oligonucleotide
cgctggggccggtcggcagt

SEQ ID NO: 172181 - DNA, 20 bp, Artificial Sequence
  Description of Artificial Sequence: Synthetic oligonucleotide
gctggggccggtcggcagct

SEQ ID NO: 172182 - DNA, 21 bp, Artificial Sequence
  Description of Artificial Sequence: Synthetic oligonucleotide
ctggggccggtcggcagctgt

SEQ ID NO: 172183 - DNA, 22 bp, Artificial Sequence
  Description of Artificial Sequence: Synthetic oligonucleotide
tggggccggtcggcagctgtca

SEQ ID NO: 172184 - DNA, 21 bp, Artificial Sequence
  Description of Artificial Sequence: Synthetic oligonucleotide
ggggccggtcggcagctgtca

SEQ ID NO: 172185 - DNA, 22 bp, Artificial Sequence
  Description of Artificial Sequence: Synthetic oligonucleotide
gggccggtcggcagctgtcagt

SEQ ID NO: 172186 - DNA, 22 bp, Artificial Sequence
  Description of Artificial Sequence: Synthetic oligonucleotide
ggccggtcggcagctgtcagtg

SEQ ID NO: 172187 - DNA, 23 bp, Artificial Sequence
  Description of Artificial Sequence: Synthetic oligonucleotide
gccggtcggcagctgtcagtgct

SEQ ID NO: 172188 - DNA, 30 bp, Artificial Sequence
  Description of Artificial Sequence: Synthetic oligonucleotide
ctgttagggaacctgaccatctgcagcatg

SEQ ID NO: 172189 - DNA, 31 bp, Artificial Sequence
  Description of Artificial Sequence: Synthetic oligonucleotide
tgttagggaacctgaccatctgcagcatgtc

SEQ ID NO: 172190 - DNA, 30 bp, Artificial Sequence
  Description of Artificial Sequence: Synthetic oligonucleotide
gttagggaacctgaccatctgcagcatgtc

SEQ ID NO: 172191 - DNA, 31 bp, Artificial Sequence
  Description of Artificial Sequence: Synthetic oligonucleotide
ttagggaacctgaccatctgcagcatgtctc

SEQ ID NO: 172192 - DNA, 30 bp, Artificial Sequence
  Description of Artificial Sequence: Synthetic oligonucleotide
tagggaacctgaccatctgcagcatgtctc

SEQ ID NO: 172193 - DNA, 29 bp, Artificial Sequence
  Description of Artificial Sequence: Synthetic oligonucleotide
agggaacctgaccatctgcagcatgtctc

SEQ ID NO: 172194 - DNA, 28 bp, Artificial Sequence
  Description of Artificial Sequence: Synthetic oligonucleotide
gggaacctgaccatctgcagcatgtctc

SEQ ID NO: 172195 - DNA, 28 bp, Artificial Sequence
  Description of Artificial Sequence: Synthetic oligonucleotide
ggaacctgaccatctgcagcatgtctcg

SEQ ID NO: 172196 - DNA, 30 bp, Artificial Sequence
  Description of Artificial Sequence: Synthetic oligonucleotide
gaacctgaccatctgcagcatgtctcgttg

SEQ ID NO: 172197 - DNA, 30 bp, Artificial Sequence
  Description of Artificial Sequence: Synthetic oligonucleotide
aacctgaccatctgcagcatgtctcgttgc

SEQ ID NO: 172198 - DNA, 29 bp, Artificial Sequence
  Description of Artificial Sequence: Synthetic oligonucleotide
acctgaccatctgcagcatgtctcgttgc

SEQ ID NO: 172199 - DNA, 28 bp, Artificial Sequence
  Description of Artificial Sequence: Synthetic oligonucleotide
cctgaccatctgcagcatgtctcgttgc

SEQ ID NO: 172200 - DNA, 28 bp, Artificial Sequence
  Description of Artificial Sequence: Synthetic oligonucleotide
ctgaccatctgcagcatgtctcgttgcc

SEQ ID NO: 172201 - DNA, 30 bp, Artificial Sequence
  Description of Artificial Sequence: Synthetic oligonucleotide
tgaccatctgcagcatgtctcgttgccaag

SEQ ID NO: 172202 - DNA, 29 bp, Artificial Sequence
  Description of Artificial Sequence: Synthetic oligonucleotide
gaccatctgcagcatgtctcgttgccaag

SEQ ID NO: 172203 - DNA, 29 bp, Artificial Sequence
  Description of Artificial Sequence: Synthetic oligonucleotide
accatctgcagcatgtctcgttgccaagg

SEQ ID NO: 172204 - DNA, 28 bp, Artificial Sequence
  Description of Artificial Sequence: Synthetic oligonucleotide
ccatctgcagcatgtctcgttgccaagg

SEQ ID NO: 172205 - DNA, 30 bp, Artificial Sequence
  Description of Artificial Sequence: Synthetic oligonucleotide
catctgcagcatgtctcgttgccaaggatg

SEQ ID NO: 172206 - DNA, 30 bp, Artificial Sequence
  Description of Artificial Sequence: Synthetic oligonucleotide
atctgcagcatgtctcgttgccaaggatgg

SEQ ID NO: 172207 - DNA, 29 bp, Artificial Sequence
  Description of Artificial Sequence: Synthetic oligonucleotide
tctgcagcatgtctcgttgccaaggatgg

SEQ ID NO: 172208 - DNA, 28 bp, Artificial Sequence
  Description of Artificial Sequence: Synthetic oligonucleotide
ctgcagcatgtctcgttgccaaggatgg

SEQ ID NO: 172209 - DNA, 29 bp, Artificial Sequence
  Description of Artificial Sequence: Synthetic oligonucleotide
tgcagcatgtctcgttgccaaggatggtc

SEQ ID NO: 172210 - DNA, 28 bp, Artificial Sequence
  Description of Artificial Sequence: Synthetic oligonucleotide
gcagcatgtctcgttgccaaggatggtc

SEQ ID NO: 172211 - DNA, 30 bp, Artificial Sequence
  Description of Artificial Sequence: Synthetic oligonucleotide
cagcatgtctcgttgccaaggatggtctac

SEQ ID NO: 172212 - DNA, 30 bp, Artificial Sequence
  Description of Artificial Sequence: Synthetic oligonucleotide
agcatgtctcgttgccaaggatggtctacc

SEQ ID NO: 172213 - DNA, 29 bp, Artificial Sequence
  Description of Artificial Sequence: Synthetic oligonucleotide
gcatgtctcgttgccaaggatggtctacc

SEQ ID NO: 172214 - DNA, 29 bp, Artificial Sequence
  Description of Artificial Sequence: Synthetic oligonucleotide
catgtctcgttgccaaggatggtctaccc

SEQ ID NO: 172215 - DNA, 29 bp, Artificial Sequence
  Description of Artificial Sequence: Synthetic oligonucleotide
atgtctcgttgccaaggatggtctacccc

SEQ ID NO: 172216 - DNA, 28 bp, Artificial Sequence
  Description of Artificial Sequence: Synthetic oligonucleotide
tgtctcgttgccaaggatggtctacccc

SEQ ID NO: 172217 - DNA, 25 bp, Artificial Sequence
  Description of Artificial Sequence: Synthetic oligonucleotide
tggaggtgcgcgcctacaagcgcta

SEQ ID NO: 172218 - DNA, 24 bp, Artificial Sequence
  Description of Artificial Sequence: Synthetic oligonucleotide
ggaggtgcgcgcctacaagcgcta

SEQ ID NO: 172219 - DNA, 24 bp, Artificial Sequence
  Description of Artificial Sequence: Synthetic oligonucleotide
gaggtgcgcgcctacaagcgctag

SEQ ID NO: 172220 - DNA, 25 bp, Artificial Sequence
  Description of Artificial Sequence: Synthetic oligonucleotide
aggtgcgcgcctacaagcgctagca

SEQ ID NO: 172221 - DNA, 24 bp, Artificial Sequence
  Description of Artificial Sequence: Synthetic oligonucleotide
ggtgcgcgcctacaagcgctagca

SEQ ID NO: 172222 - DNA, 24 bp, Artificial Sequence
  Description of Artificial Sequence: Synthetic oligonucleotide
gtgcgcgcctacaagcgctagcag

SEQ ID NO: 172223 - DNA, 25 bp, Artificial Sequence
  Description of Artificial Sequence: Synthetic oligonucleotide
tgcgcgcctacaagcgctagcagga

SEQ ID NO: 172224 - DNA, 24 bp, Artificial Sequence
  Description of Artificial Sequence: Synthetic oligonucleotide
gcgcgcctacaagcgctagcagga

SEQ ID NO: 172225 - DNA, 24 bp, Artificial Sequence
  Description of Artificial Sequence: Synthetic oligonucleotide
cgcgcctacaagcgctagcaggac

SEQ ID NO: 172226 - DNA, 25 bp, Artificial Sequence
  Description of Artificial Sequence: Synthetic oligonucleotide
gcgcctacaagcgctagcaggacgt

SEQ ID NO: 172227 - DNA, 26 bp, Artificial Sequence
  Description of Artificial Sequence: Synthetic oligonucleotide
cgcctacaagcgctagcaggacgtgt

SEQ ID NO: 172228 - DNA, 26 bp, Artificial Sequence
  Description of Artificial Sequence: Synthetic oligonucleotide
gcctacaagcgctagcaggacgtgtc

SEQ ID NO: 172229 - DNA, 27 bp, Artificial Sequence
  Description of Artificial Sequence: Synthetic oligonucleotide
cctacaagcgctagcaggacgtgtcca

SEQ ID NO: 172230 - DNA, 28 bp, Artificial Sequence
  Description of Artificial Sequence: Synthetic oligonucleotide
ctacaagcgctagcaggacgtgtccatg

SEQ ID NO: 172231 - DNA, 28 bp, Artificial Sequence
  Description of Artificial Sequence: Synthetic oligonucleotide
tacaagcgctagcaggacgtgtccatgc

SEQ ID NO: 172232 - DNA, 27 bp, Artificial Sequence
  Description of Artificial Sequence: Synthetic oligonucleotide
acaagcgctagcaggacgtgtccatgc

SEQ ID NO: 172233 - DNA, 26 bp, Artificial Sequence
  Description of Artificial Sequence: Synthetic oligonucleotide
caagcgctagcaggacgtgtccatgc

SEQ ID NO: 172234 - DNA, 26 bp, Artificial Sequence
  Description of Artificial Sequence: Synthetic oligonucleotide
aagcgctagcaggacgtgtccatgcg

SEQ ID NO: 172235 - DNA, 25 bp, Artificial Sequence
  Description of Artificial Sequence: Synthetic oligonucleotide
agcgctagcaggacgtgtccatgcg

SEQ ID NO: 172236 - DNA, 24 bp, Artificial Sequence
  Description of Artificial Sequence: Synthetic oligonucleotide
gcgctagcaggacgtgtccatgcg

SEQ ID NO: 172237 - DNA, 24 bp, Artificial Sequence
  Description of Artificial Sequence: Synthetic oligonucleotide
cgctagcaggacgtgtccatgcgc

SEQ ID NO: 172238 - DNA, 24 bp, Artificial Sequence
  Description of Artificial Sequence: Synthetic oligonucleotide
gctagcaggacgtgtccatgcgcc

SEQ ID NO: 172239 - DNA, 24 bp, Artificial Sequence
  Description of Artificial Sequence: Synthetic oligonucleotide
ctagcaggacgtgtccatgcgccg

SEQ ID NO: 172240 - DNA, 26 bp, Artificial Sequence
  Description of Artificial Sequence: Synthetic oligonucleotide
tagcaggacgtgtccatgcgccgcat

SEQ ID NO: 172241 - DNA, 25 bp, Artificial Sequence
  Description of Artificial Sequence: Synthetic oligonucleotide
agcaggacgtgtccatgcgccgcat

SEQ ID NO: 172242 - DNA, 29 bp, Artificial Sequence
  Description of Artificial Sequence: Synthetic oligonucleotide
gagatgatcagtgacttctgcgagcggtg

SEQ ID NO: 172243 - DNA, 29 bp, Artificial Sequence
  Description of Artificial Sequence: Synthetic oligonucleotide
agatgatcagtgacttctgcgagcggtgc

SEQ ID NO: 172244 - DNA, 28 bp, Artificial Sequence
  Description of Artificial Sequence: Synthetic oligonucleotide
gatgatcagtgacttctgcgagcggtgc

SEQ ID NO: 172245 - DNA, 30 bp, Artificial Sequence
  Description of Artificial Sequence: Synthetic oligonucleotide
atgatcagtgacttctgcgagcggtgcttc

SEQ ID NO: 172246 - DNA, 29 bp, Artificial Sequence
  Description of Artificial Sequence: Synthetic oligonucleotide
tgatcagtgacttctgcgagcggtgcttc

SEQ ID NO: 172247 - DNA, 28 bp, Artificial Sequence
  Description of Artificial Sequence: Synthetic oligonucleotide
gatcagtgacttctgcgagcggtgcttc

SEQ ID NO: 172248 - DNA, 28 bp, Artificial Sequence
  Description of Artificial Sequence: Synthetic oligonucleotide
atcagtgacttctgcgagcggtgcttcc

SEQ ID NO: 172249 - DNA, 27 bp, Artificial Sequence
  Description of Artificial Sequence: Synthetic oligonucleotide
tcagtgacttctgcgagcggtgcttcc

SEQ ID NO: 172250 - DNA, 27 bp, Artificial Sequence
  Description of Artificial Sequence: Synthetic oligonucleotide
cagtgacttctgcgagcggtgcttcct

SEQ ID NO: 172251 - DNA, 27 bp, Artificial Sequence
  Description of Artificial Sequence: Synthetic oligonucleotide
agtgacttctgcgagcggtgcttcctc

SEQ ID NO: 172252 - DNA, 27 bp, Artificial Sequence
  Description of Artificial Sequence: Synthetic oligonucleotide
gtgacttctgcgagcggtgcttcctca

SEQ ID NO: 172253 - DNA, 27 bp, Artificial Sequence
  Description of Artificial Sequence: Synthetic oligonucleotide
tgacttctgcgagcggtgcttcctcag

SEQ ID NO: 172254 - DNA, 26 bp, Artificial Sequence
  Description of Artificial Sequence: Synthetic oligonucleotide
gacttctgcgagcggtgcttcctcag

SEQ ID NO: 172255 - DNA, 26 bp, Artificial Sequence
  Description of Artificial Sequence: Synthetic oligonucleotide
acttctgcgagcggtgcttcctcagc

SEQ ID NO: 172256 - DNA, 25 bp, Artificial Sequence
  Description of Artificial Sequence: Synthetic oligonucleotide
cttctgcgagcggtgcttcctcagc

SEQ ID NO: 172257 - DNA, 26 bp, Artificial Sequence
  Description of Artificial Sequence: Synthetic oligonucleotide
ttctgcgagcggtgcttcctcagcga

SEQ ID NO: 172258 - DNA, 25 bp, Artificial Sequence
  Description of Artificial Sequence: Synthetic oligonucleotide
tctgcgagcggtgcttcctcagcga

SEQ ID NO: 172259 - DNA, 24 bp, Artificial Sequence
  Description of Artificial Sequence: Synthetic oligonucleotide
ctgcgagcggtgcttcctcagcga

SEQ ID NO: 172260 - DNA, 24 bp, Artificial Sequence
  Description of Artificial Sequence: Synthetic oligonucleotide
tgcgagcggtgcttcctcagcgag

SEQ ID NO: 172261 - DNA, 23 bp, Artificial Sequence
  Description of Artificial Sequence: Synthetic oligonucleotide
gcgagcggtgcttcctcagcgag

SEQ ID NO: 172262 - DNA, 24 bp, Artificial Sequence
  Description of Artificial Sequence: Synthetic oligonucleotide
cgagcggtgcttcctcagcgaggt

SEQ ID NO: 172263 - DNA, 24 bp, Artificial Sequence
  Description of Artificial Sequence: Synthetic oligonucleotide
gagcggtgcttcctcagcgaggtg

SEQ ID NO: 172264 - DNA, 27 bp, Artificial Sequence
  Description of Artificial Sequence: Synthetic oligonucleotide
agcggtgcttcctcagcgaggtggatt

SEQ ID NO: 172265 - DNA, 27 bp, Artificial Sequence
  Description of Artificial Sequence: Synthetic oligonucleotide
gcggtgcttcctcagcgaggtggatta

SEQ ID NO: 172266 - DNA, 27 bp, Artificial Sequence
  Description of Artificial Sequence: Synthetic oligonucleotide
cggtgcttcctcagcgaggtggattac

SEQ ID NO: 172267 - DNA, 27 bp, Artificial Sequence
  Description of Artificial Sequence: Synthetic oligonucleotide
ggtgcttcctcagcgaggtggattacc

SEQ ID NO: 172268 - DNA, 28 bp, Artificial Sequence
  Description of Artificial Sequence: Synthetic oligonucleotide
gtgcttcctcagcgaggtggattacctg

SEQ ID NO: 172269 - DNA, 28 bp, Artificial Sequence
  Description of Artificial Sequence: Synthetic oligonucleotide
tgcttcctcagcgaggtggattacctgg

SEQ ID NO: 172270 - DNA, 31 bp, Artificial Sequence
  Description of Artificial Sequence: Synthetic oligonucleotide
caaggacgagggcgatttctactacatggag

SEQ ID NO: 172271 - DNA, 31 bp, Artificial Sequence
  Description of Artificial Sequence: Synthetic oligonucleotide
aaggacgagggcgatttctactacatggagg

SEQ ID NO: 172272 - DNA, 30 bp, Artificial Sequence
  Description of Artificial Sequence: Synthetic oligonucleotide
aggacgagggcgatttctactacatggagg

SEQ ID NO: 172273 - DNA, 29 bp, Artificial Sequence
  Description of Artificial Sequence: Synthetic oligonucleotide
ggacgagggcgatttctactacatggagg

SEQ ID NO: 172274 - DNA, 29 bp, Artificial Sequence
  Description of Artificial Sequence: Synthetic oligonucleotide
gacgagggcgatttctactacatggaggc

SEQ ID NO: 172275 - DNA, 29 bp, Artificial Sequence
  Description of Artificial Sequence: Synthetic oligonucleotide
acgagggcgatttctactacatggaggcg

SEQ ID NO: 172276 - DNA, 28 bp, Artificial Sequence
  Description of Artificial Sequence: Synthetic oligonucleotide
cgagggcgatttctactacatggaggcg

SEQ ID NO: 172277 - DNA, 30 bp, Artificial Sequence
  Description of Artificial Sequence: Synthetic oligonucleotide
gagggcgatttctactacatggaggcgttc

SEQ ID NO: 172278 - DNA, 32 bp, Artificial Sequence
  Description of Artificial Sequence: Synthetic oligonucleotide
agggcgatttctactacatggaggcgttcttc

SEQ ID NO: 172279 - DNA, 31 bp, Artificial Sequence
  Description of Artificial Sequence: Synthetic oligonucleotide
gggcgatttctactacatggaggcgttcttc

SEQ ID NO: 172280 - DNA, 31 bp, Artificial Sequence
  Description of Artificial Sequence: Synthetic oligonucleotide
ggcgatttctactacatggaggcgttcttcg

SEQ ID NO: 172281 - DNA, 31 bp, Artificial Sequence
  Description of Artificial Sequence: Synthetic oligonucleotide
gcgatttctactacatggaggcgttcttcgg

SEQ ID NO: 172282 - DNA, 31 bp, Artificial Sequence
  Description of Artificial Sequence: Synthetic oligonucleotide
cgatttctactacatggaggcgttcttcggg

SEQ ID NO: 172283 - DNA, 31 bp, Artificial Sequence
  Description of Artificial Sequence: Synthetic oligonucleotide
gatttctactacatggaggcgttcttcgggg

SEQ ID NO: 172284 - DNA, 31 bp, Artificial Sequence
  Description of Artificial Sequence: Synthetic oligonucleotide
atttctactacatggaggcgttcttcggggg

SEQ ID NO: 172285 - DNA, 30 bp, Artificial Sequence
  Description of Artificial Sequence: Synthetic oligonucleotide
tttctactacatggaggcgttcttcggggg

SEQ ID NO: 172286 - DNA, 29 bp, Artificial Sequence
  Description of Artificial Sequence: Synthetic oligonucleotide
ttctactacatggaggcgttcttcggggg

SEQ ID NO: 172287 - DNA, 28 bp, Artificial Sequence
  Description of Artificial Sequence: Synthetic oligonucleotide
tctactacatggaggcgttcttcggggg

SEQ ID NO: 172288 - DNA, 27 bp, Artificial Sequence
  Description of Artificial Sequence: Synthetic oligonucleotide
ctactacatggaggcgttcttcggggg

SEQ ID NO: 172289 - DNA, 27 bp, Artificial Sequence
  Description of Artificial Sequence: Synthetic oligonucleotide
tactacatggaggcgttcttcgggggg

SEQ ID NO: 172290 - DNA, 27 bp, Artificial Sequence
  Description of Artificial Sequence: Synthetic oligonucleotide
actacatggaggcgttcttcggggggt

SEQ ID NO: 172291 - DNA, 26 bp, Artificial Sequence
  Description of Artificial Sequence: Synthetic oligonucleotide
ctacatggaggcgttcttcggggggt

SEQ ID NO: 172292 - DNA, 26 bp, Artificial Sequence
  Description of Artificial Sequence: Synthetic oligonucleotide
tacatggaggcgttcttcggggggtc

SEQ ID NO: 172293 - DNA, 25 bp, Artificial Sequence
  Description of Artificial Sequence: Synthetic oligonucleotide
acatggaggcgttcttcggggggtc

SEQ ID NO: 172294 - DNA, 24 bp, Artificial Sequence
  Description of Artificial Sequence: Synthetic oligonucleotide
catggaggcgttcttcggggggtc

SEQ ID NO: 172295 - DNA, 24 bp, Artificial Sequence
  Description of Artificial Sequence: Synthetic oligonucleotide
atggaggcgttcttcggggggtcg

SEQ ID NO: 172296 - DNA, 23 bp, Artificial Sequence
  Description of Artificial Sequence: Synthetic oligonucleotide
tggaggcgttcttcggggggtcg

SEQ ID NO: 172297 - DNA, 22 bp, Artificial Sequence
  Description of Artificial Sequence: Synthetic oligonucleotide
ggaggcgttcttcggggggtcg

SEQ ID NO: 172298 - DNA, 23 bp, Artificial Sequence
  Description of Artificial Sequence: Synthetic oligonucleotide
gaggcgttcttcggggggtcggt

SEQ ID NO: 172299 - DNA, 23 bp, Artificial Sequence
  Description of Artificial Sequence: Synthetic oligonucleotide
aggcgttcttcggggggtcggtg

SEQ ID NO: 172300 - DNA, 25 bp, Artificial Sequence
  Description of Artificial Sequence: Synthetic oligonucleotide
cagctgtcagtgctggaggtgcgca

SEQ ID NO: 172301 - DNA, 25 bp, Artificial Sequence
  Description of Artificial Sequence: Synthetic oligonucleotide
agctgtcagtgctggaggtgcgcac

SEQ ID NO: 172302 - DNA, 24 bp, Artificial Sequence
  Description of Artificial Sequence: Synthetic oligonucleotide
gctgtcagtgctggaggtgcgcac

SEQ ID NO: 172303 - DNA, 26 bp, Artificial Sequence
  Description of Artificial Sequence: Synthetic oligonucleotide
ctgtcagtgctggaggtgcgcaccta

SEQ ID NO: 172304 - DNA, 27 bp, Artificial Sequence
  Description of Artificial Sequence: Synthetic oligonucleotide
tgtcagtgctggaggtgcgcacctaca

SEQ ID NO: 172305 - DNA, 27 bp, Artificial Sequence
  Description of Artificial Sequence: Synthetic oligonucleotide
gtcagtgctggaggtgcgcacctacaa

SEQ ID NO: 172306 - DNA, 27 bp, Artificial Sequence
  Description of Artificial Sequence: Synthetic oligonucleotide
tcagtgctggaggtgcgcacctacaag

SEQ ID NO: 172307 - DNA, 26 bp, Artificial Sequence
  Description of Artificial Sequence: Synthetic oligonucleotide
cagtgctggaggtgcgcacctacaag

SEQ ID NO: 172308 - DNA, 26 bp, Artificial Sequence
  Description of Artificial Sequence: Synthetic oligonucleotide
agtgctggaggtgcgcacctacaagc

SEQ ID NO: 172309 - DNA, 25 bp, Artificial Sequence
  Description of Artificial Sequence: Synthetic oligonucleotide
gtgctggaggtgcgcacctacaagc

SEQ ID NO: 172310 - DNA, 25 bp, Artificial Sequence
  Description of Artificial Sequence: Synthetic oligonucleotide
tgctggaggtgcgcacctacaagcg

SEQ ID NO: 172311 - DNA, 24 bp, Artificial Sequence
  Description of Artificial Sequence: Synthetic oligonucleotide
gctggaggtgcgcacctacaagcg

SEQ ID NO: 172312 - DNA, 25 bp, Artificial Sequence
  Description of Artificial Sequence: Synthetic oligonucleotide
ctggaggtgcgcacctacaagcgct

SEQ ID NO: 172313 - DNA, 25 bp, Artificial Sequence
  Description of Artificial Sequence: Synthetic oligonucleotide
tggaggtgcgcacctacaagcgctg

SEQ ID NO: 172314 - DNA, 24 bp, Artificial Sequence
  Description of Artificial Sequence: Synthetic oligonucleotide
ggaggtgcgcacctacaagcgctg

SEQ ID NO: 172315 - DNA, 24 bp, Artificial Sequence
  Description of Artificial Sequence: Synthetic oligonucleotide
gaggtgcgcacctacaagcgctgg

SEQ ID NO: 172316 - DNA, 25 bp, Artificial Sequence
  Description of Artificial Sequence: Synthetic oligonucleotide
aggtgcgcacctacaagcgctggca

SEQ ID NO: 172317 - DNA, 24 bp, Artificial Sequence
  Description of Artificial Sequence: Synthetic oligonucleotide
ggtgcgcacctacaagcgctggca

SEQ ID NO: 172318 - DNA, 24 bp, Artificial Sequence
  Description of Artificial Sequence: Synthetic oligonucleotide
gtgcgcacctacaagcgctggcag

SEQ ID NO: 172319 - DNA, 25 bp, Artificial Sequence
  Description of Artificial Sequence: Synthetic oligonucleotide
tgcgcacctacaagcgctggcagga

SEQ ID NO: 172320 - DNA, 24 bp, Artificial Sequence
  Description of Artificial Sequence: Synthetic oligonucleotide
gcgcacctacaagcgctggcagga

SEQ ID NO: 172321 - DNA, 24 bp, Artificial Sequence
  Description of Artificial Sequence: Synthetic oligonucleotide
cgcacctacaagcgctggcaggac

SEQ ID NO: 172322 - DNA, 25 bp, Artificial Sequence
  Description of Artificial Sequence: Synthetic oligonucleotide
gcacctacaagcgctggcaggacgt

SEQ ID NO: 172323 - DNA, 26 bp, Artificial Sequence
  Description of Artificial Sequence: Synthetic oligonucleotide
cacctacaagcgctggcaggacgtgt

SEQ ID NO: 172324 - DNA, 26 bp, Artificial Sequence
  Description of Artificial Sequence: Synthetic oligonucleotide
acctacaagcgctggcaggacgtgtc

SEQ ID NO: 172325 - DNA, 26 bp, Artificial Sequence
  Description of Artificial Sequence: Synthetic oligonucleotide
agtgctggaggtgcgcgcctacaagt

SEQ ID NO: 172326 - DNA, 25 bp, Artificial Sequence
  Description of Artificial Sequence: Synthetic oligonucleotide
gtgctggaggtgcgcgcctacaagt

SEQ ID NO: 172327 - DNA, 25 bp, Artificial Sequence
  Description of Artificial Sequence: Synthetic oligonucleotide
tgctggaggtgcgcgcctacaagtg

SEQ ID NO: 172328 - DNA, 24 bp, Artificial Sequence
  Description of Artificial Sequence: Synthetic oligonucleotide
gctggaggtgcgcgcctacaagtg

SEQ ID NO: 172329 - DNA, 25 bp, Artificial Sequence
  Description of Artificial Sequence: Synthetic oligonucleotide
ctggaggtgcgcgcctacaagtgct

SEQ ID NO: 172330 - DNA, 25 bp, Artificial Sequence
  Description of Artificial Sequence: Synthetic oligonucleotide
tggaggtgcgcgcctacaagtgctg

SEQ ID NO: 172331 - DNA, 24 bp, Artificial Sequence
  Description of Artificial Sequence: Synthetic oligonucleotide
ggaggtgcgcgcctacaagtgctg

SEQ ID NO: 172332 - DNA, 24 bp, Artificial Sequence
  Description of Artificial Sequence: Synthetic oligonucleotide
gaggtgcgcgcctacaagtgctgg

SEQ ID NO: 172333 - DNA, 25 bp, Artificial Sequence
  Description of Artificial Sequence: Synthetic oligonucleotide
aggtgcgcgcctacaagtgctggca

SEQ ID NO: 172334 - DNA, 24 bp, Artificial Sequence
  Description of Artificial Sequence: Synthetic oligonucleotide
ggtgcgcgcctacaagtgctggca

SEQ ID NO: 172335 - DNA, 24 bp, Artificial Sequence
  Description of Artificial Sequence: Synthetic oligonucleotide
gtgcgcgcctacaagtgctggcag

SEQ ID NO: 172336 - DNA, 25 bp, Artificial Sequence
  Description of Artificial Sequence: Synthetic oligonucleotide
tgcgcgcctacaagtgctggcagga

SEQ ID NO: 172337 - DNA, 24 bp, Artificial Sequence
  Description of Artificial Sequence: Synthetic oligonucleotide
gcgcgcctacaagtgctggcagga

SEQ ID NO: 172338 - DNA, 24 bp, Artificial Sequence
  Description of Artificial Sequence: Synthetic oligonucleotide
cgcgcctacaagtgctggcaggac

SEQ ID NO: 172339 - DNA, 25 bp, Artificial Sequence
  Description of Artificial Sequence: Synthetic oligonucleotide
gcgcctacaagtgctggcaggacgt

SEQ ID NO: 172340 - DNA, 26 bp, Artificial Sequence
  Description of Artificial Sequence: Synthetic oligonucleotide
cgcctacaagtgctggcaggacgtgt

SEQ ID NO: 172341 - DNA, 26 bp, Artificial Sequence
  Description of Artificial Sequence: Synthetic oligonucleotide
gcctacaagtgctggcaggacgtgtc

SEQ ID NO: 172342 - DNA, 27 bp, Artificial Sequence
  Description of Artificial Sequence: Synthetic oligonucleotide
cctacaagtgctggcaggacgtgtcca

SEQ ID NO: 172343 - DNA, 28 bp, Artificial Sequence
  Description of Artificial Sequence: Synthetic oligonucleotide
ctacaagtgctggcaggacgtgtccatg

SEQ ID NO: 172344 - DNA, 28 bp, Artificial Sequence
  Description of Artificial Sequence: Synthetic oligonucleotide
tacaagtgctggcaggacgtgtccatgc

SEQ ID NO: 172345 - DNA, 27 bp, Artificial Sequence
  Description of Artificial Sequence: Synthetic oligonucleotide
acaagtgctggcaggacgtgtccatgc

SEQ ID NO: 172346 - DNA, 26 bp, Artificial Sequence
  Description of Artificial Sequence: Synthetic oligonucleotide
caagtgctggcaggacgtgtccatgc

SEQ ID NO: 172347 - DNA, 26 bp, Artificial Sequence
  Description of Artificial Sequence: Synthetic oligonucleotide
aagtgctggcaggacgtgtccatgcg

SEQ ID NO: 172348 - DNA, 25 bp, Artificial Sequence
  Description of Artificial Sequence: Synthetic oligonucleotide
agtgctggcaggacgtgtccatgcg

SEQ ID NO: 172349 - DNA, 24 bp, Artificial Sequence
  Description of Artificial Sequence: Synthetic oligonucleotide
gtgctggcaggacgtgtccatgcg

SEQ ID NO: 172350 - DNA, 24 bp, Artificial Sequence
  Description of Artificial Sequence: Synthetic oligonucleotide
tgctggcaggacgtgtccatgcgc

SEQ ID NO: 172351 - DNA, 26 bp, Artificial Sequence
  Description of Artificial Sequence: Synthetic oligonucleotide
ttggcagctgtcagtgctggaggtgc

SEQ ID NO: 172352 - DNA, 25 bp, Artificial Sequence
  Description of Artificial Sequence: Synthetic oligonucleotide
tggcagctgtcagtgctggaggtgc

SEQ ID NO: 172353 - DNA, 32 bp, Artificial Sequence
  Description of Artificial Sequence: Synthetic oligonucleotide
ggagggcacattcaacatcgacatcctcaatg

SEQ ID NO: 172354 - DNA, 33 bp, Artificial Sequence
  Description of Artificial Sequence: Synthetic oligonucleotide
gagggcacattcaacatcgacatcctcaatgag

SEQ ID NO: 172355 - DNA, 33 bp, Artificial Sequence
  Description of Artificial Sequence: Synthetic oligonucleotide
agggcacattcaacatcgacatcctcaatgagc

SEQ ID NO: 172356 - DNA, 32 bp, Artificial Sequence
  Description of Artificial Sequence: Synthetic oligonucleotide
gggcacattcaacatcgacatcctcaatgagc

SEQ ID NO: 172357 - DNA, 33 bp, Artificial Sequence
  Description of Artificial Sequence: Synthetic oligonucleotide
ggcacattcaacatcgacatcctcaatgagcag

SEQ ID NO: 172358 - DNA, 35 bp, Artificial Sequence
  Description of Artificial Sequence: Synthetic oligonucleotide
gcacattcaacatcgacatcctcaatgagcagttc

SEQ ID NO: 172359 - DNA, 36 bp, Artificial Sequence
  Description of Artificial Sequence: Synthetic oligonucleotide
cacattcaacatcgacatcctcaatgagcagttcag

SEQ ID NO: 172360 - DNA, 36 bp, Artificial Sequence
  Description of Artificial Sequence: Synthetic oligonucleotide
acattcaacatcgacatcctcaatgagcagttcagg

SEQ ID NO: 172361 - DNA, 35 bp, Artificial Sequence
  Description of Artificial Sequence: Synthetic oligonucleotide
cattcaacatcgacatcctcaatgagcagttcagg

SEQ ID NO: 172362 - DNA, 35 bp, Artificial Sequence
  Description of Artificial Sequence: Synthetic oligonucleotide
attcaacatcgacatcctcaatgagcagttcaggc

SEQ ID NO: 172363 - DNA, 34 bp, Artificial Sequence
  Description of Artificial Sequence: Synthetic oligonucleotide
ttcaacatcgacatcctcaatgagcagttcaggc

SEQ ID NO: 172364 - DNA, 33 bp, Artificial Sequence
  Description of Artificial Sequence: Synthetic oligonucleotide
tcaacatcgacatcctcaatgagcagttcaggc

SEQ ID NO: 172365 - DNA, 32 bp, Artificial Sequence
  Description of Artificial Sequence: Synthetic oligonucleotide
caacatcgacatcctcaatgagcagttcaggc

SEQ ID NO: 172366 - DNA, 33 bp, Artificial Sequence
  Description of Artificial Sequence: Synthetic oligonucleotide
aacatcgacatcctcaatgagcagttcaggctc

SEQ ID NO: 172367 - DNA, 32 bp, Artificial Sequence
  Description of Artificial Sequence: Synthetic oligonucleotide
acatcgacatcctcaatgagcagttcaggctc

SEQ ID NO: 172368 - DNA, 31 bp, Artificial Sequence
  Description of Artificial Sequence: Synthetic oligonucleotide
catcgacatcctcaatgagcagttcaggctc

SEQ ID NO: 172369 - DNA, 31 bp, Artificial Sequence
  Description of Artificial Sequence: Synthetic oligonucleotide
atcgacatcctcaatgagcagttcaggctcc

SEQ ID NO: 172370 - DNA, 30 bp, Artificial Sequence
  Description of Artificial Sequence: Synthetic oligonucleotide
tcgacatcctcaatgagcagttcaggctcc

SEQ ID NO: 172371 - DNA, 29 bp, Artificial Sequence
  Description of Artificial Sequence: Synthetic oligonucleotide
cgacatcctcaatgagcagttcaggctcc

SEQ ID NO: 172372 - DNA, 30 bp, Artificial Sequence
  Description of Artificial Sequence: Synthetic oligonucleotide
gacatcctcaatgagcagttcaggctccag

SEQ ID NO: 172373 - DNA, 32 bp, Artificial Sequence
  Description of Artificial Sequence: Synthetic oligonucleotide
acatcctcaatgagcagttcaggctccagaac

SEQ ID NO: 172374 - DNA, 31 bp, Artificial Sequence
  Description of Artificial Sequence: Synthetic oligonucleotide
catcctcaatgagcagttcaggctccagaac

SEQ ID NO: 172375 - DNA, 32 bp, Artificial Sequence
  Description of Artificial Sequence: Synthetic oligonucleotide
atcctcaatgagcagttcaggctccagaacac

SEQ ID NO: 172376 - DNA, 31 bp, Artificial Sequence
  Description of Artificial Sequence: Synthetic oligonucleotide
tcctcaatgagcagttcaggctccagaacac

SEQ ID NO: 172377 - DNA, 30 bp, Artificial Sequence
  Description of Artificial Sequence: Synthetic oligonucleotide
cctcaatgagcagttcaggctccagaacac

SEQ ID NO: 172378 - DNA, 30 bp, Artificial Sequence
  Description of Artificial Sequence: Synthetic oligonucleotide
ctcaatgagcagttcaggctccagaacacc

SEQ ID NO: 172379 - DNA, 31 bp, Artificial Sequence
  Description of Artificial Sequence: Synthetic oligonucleotide
tcaatgagcagttcaggctccagaacaccac

SEQ ID NO: 172380 - DNA, 30 bp, Artificial Sequence
  Description of Artificial Sequence: Synthetic oligonucleotide
caatgagcagttcaggctccagaacaccac

SEQ ID NO: 172381 - DNA, 30 bp, Artificial Sequence
  Description of Artificial Sequence: Synthetic oligonucleotide
aatgagcagttcaggctccagaacaccacc

SEQ ID NO: 172382 - DNA, 29 bp, Artificial Sequence
  Description of Artificial Sequence: Synthetic oligonucleotide
atgagcagttcaggctccagaacaccacc

SEQ ID NO: 172383 - DNA, 28 bp, Artificial Sequence
  Description of Artificial Sequence: Synthetic oligonucleotide
tgagcagttcaggctccagaacaccacc

SEQ ID NO: 172384 - DNA, 27 bp, Artificial Sequence
  Description of Artificial Sequence: Synthetic oligonucleotide
cttctacggaagcagccgggaggcttt

SEQ ID NO: 172385 - DNA, 27 bp, Artificial Sequence
  Description of Artificial Sequence: Synthetic oligonucleotide
ttctacggaagcagccgggaggctttc

SEQ ID NO: 172386 - DNA, 27 bp, Artificial Sequence
  Description of Artificial Sequence: Synthetic oligonucleotide
tctacggaagcagccgggaggctttca

SEQ ID NO: 172387 - DNA, 26 bp, Artificial Sequence
  Description of Artificial Sequence: Synthetic oligonucleotide
ctacggaagcagccgggaggctttca

SEQ ID NO: 172388 - DNA, 26 bp, Artificial Sequence
  Description of Artificial Sequence: Synthetic oligonucleotide
tacggaagcagccgggaggctttcac

SEQ ID NO: 172389 - DNA, 25 bp, Artificial Sequence
  Description of Artificial Sequence: Synthetic oligonucleotide
acggaagcagccgggaggctttcac

SEQ ID NO: 172390 - DNA, 24 bp, Artificial Sequence
  Description of Artificial Sequence: Synthetic oligonucleotide
cggaagcagccgggaggctttcac

SEQ ID NO: 172391 - DNA, 26 bp, Artificial Sequence
  Description of Artificial Sequence: Synthetic oligonucleotide
ggaagcagccgggaggctttcaccta

SEQ ID NO: 172392 - DNA, 26 bp, Artificial Sequence
  Description of Artificial Sequence: Synthetic oligonucleotide
gaagcagccgggaggctttcacctac

SEQ ID NO: 172393 - DNA, 27 bp, Artificial Sequence
  Description of Artificial Sequence: Synthetic oligonucleotide
aagcagccgggaggctttcacctacga

SEQ ID NO: 172394 - DNA, 26 bp, Artificial Sequence
  Description of Artificial Sequence: Synthetic oligonucleotide
agcagccgggaggctttcacctacga

SEQ ID NO: 172395 - DNA, 25 bp, Artificial Sequence
  Description of Artificial Sequence: Synthetic oligonucleotide
gcagccgggaggctttcacctacga

SEQ ID NO: 172396 - DNA, 25 bp, Artificial Sequence
  Description of Artificial Sequence: Synthetic oligonucleotide
cagccgggaggctttcacctacgag

SEQ ID NO: 172397 - DNA, 25 bp, Artificial Sequence
  Description of Artificial Sequence: Synthetic oligonucleotide
agccgggaggctttcacctacgagc

SEQ ID NO: 172398 - DNA, 24 bp, Artificial Sequence
  Description of Artificial Sequence: Synthetic oligonucleotide
gccgggaggctttcacctacgagc

SEQ ID NO: 172399 - DNA, 24 bp, Artificial Sequence
  Description of Artificial Sequence: Synthetic oligonucleotide
ccgggaggctttcacctacgagcg

SEQ ID NO: 172400 - DNA, 24 bp, Artificial Sequence
  Description of Artificial Sequence: Synthetic oligonucleotide
cgggaggctttcacctacgagcgc

SEQ ID NO: 172401 - DNA, 24 bp, Artificial Sequence
  Description of Artificial Sequence: Synthetic oligonucleotide
gggaggctttcacctacgagcgcc

SEQ ID NO: 172402 - DNA, 24 bp, Artificial Sequence
  Description of Artificial Sequence: Synthetic oligonucleotide
ggaggctttcacctacgagcgccg

SEQ ID NO: 172403 - DNA, 24 bp, Artificial Sequence
  Description of Artificial Sequence: Synthetic oligonucleotide
gaggctttcacctacgagcgccgg

SEQ ID NO: 172404 - DNA, 24 bp, Artificial Sequence
  Description of Artificial Sequence: Synthetic oligonucleotide
aggctttcacctacgagcgccggc

SEQ ID NO: 172405 - DNA, 23 bp, Artificial Sequence
  Description of Artificial Sequence: Synthetic oligonucleotide
ggctttcacctacgagcgccggc

SEQ ID NO: 172406 - DNA, 23 bp, Artificial Sequence
  Description of Artificial Sequence: Synthetic oligonucleotide
gctttcacctacgagcgccggcc

SEQ ID NO: 172407 - DNA, 23 bp, Artificial Sequence
  Description of Artificial Sequence: Synthetic oligonucleotide
ctttcacctacgagcgccggccc

SEQ ID NO: 172408 - DNA, 24 bp, Artificial Sequence
  Description of Artificial Sequence: Synthetic oligonucleotide
tttcacctacgagcgccggcccca

SEQ ID NO: 172409 - DNA, 25 bp, Artificial Sequence
  Description of Artificial Sequence: Synthetic oligonucleotide
tcgaccaggccaacggcatcgaggt

SEQ ID NO: 172410 - DNA, 24 bp, Artificial Sequence
  Description of Artificial Sequence: Synthetic oligonucleotide
cgaccaggccaacggcatcgaggt

SEQ ID NO: 172411 - DNA, 24 bp, Artificial Sequence
  Description of Artificial Sequence: Synthetic oligonucleotide
gaccaggccaacggcatcgaggtc

SEQ ID NO: 172412 - DNA, 25 bp, Artificial Sequence
  Description of Artificial Sequence: Synthetic oligonucleotide
accaggccaacggcatcgaggtcgt

SEQ ID NO: 172413 - DNA, 24 bp, Artificial Sequence
  Description of Artificial Sequence: Synthetic oligonucleotide
ccaggccaacggcatcgaggtcgt

SEQ ID NO: 172414 - DNA, 25 bp, Artificial Sequence
  Description of Artificial Sequence: Synthetic oligonucleotide
caggccaacggcatcgaggtcgtgt

SEQ ID NO: 172415 - DNA, 25 bp, Artificial Sequence
  Description of Artificial Sequence: Synthetic oligonucleotide
aggccaacggcatcgaggtcgtgtg

SEQ ID NO: 172416 - DNA, 24 bp, Artificial Sequence
  Description of Artificial Sequence: Synthetic oligonucleotide
ggccaacggcatcgaggtcgtgtg

SEQ ID NO: 172417 - DNA, 24 bp, Artificial Sequence
  Description of Artificial Sequence: Synthetic oligonucleotide
gccaacggcatcgaggtcgtgtgg

SEQ ID NO: 172418 - DNA, 25 bp, Artificial Sequence
  Description of Artificial Sequence: Synthetic oligonucleotide
ccaacggcatcgaggtcgtgtggca

SEQ ID NO: 172419 - DNA, 25 bp, Artificial Sequence
  Description of Artificial Sequence: Synthetic oligonucleotide
caacggcatcgaggtcgtgtggcac

SEQ ID NO: 172420 - DNA, 26 bp, Artificial Sequence
  Description of Artificial Sequence: Synthetic oligonucleotide
aacggcatcgaggtcgtgtggcacga

SEQ ID NO: 172421 - DNA, 25 bp, Artificial Sequence
  Description of Artificial Sequence: Synthetic oligonucleotide
acggcatcgaggtcgtgtggcacga

SEQ ID NO: 172422 - DNA, 24 bp, Artificial Sequence
  Description of Artificial Sequence: Synthetic oligonucleotide
cggcatcgaggtcgtgtggcacga

SEQ ID NO: 172423 - DNA, 24 bp, Artificial Sequence
  Description of Artificial Sequence: Synthetic oligonucleotide
ggcatcgaggtcgtgtggcacgac

SEQ ID NO: 172424 - DNA, 25 bp, Artificial Sequence
  Description of Artificial Sequence: Synthetic oligonucleotide
gcatcgaggtcgtgtggcacgacga

SEQ ID NO: 172425 - DNA, 26 bp, Artificial Sequence
  Description of Artificial Sequence: Synthetic oligonucleotide
catcgaggtcgtgtggcacgacgaga

SEQ ID NO: 172426 - DNA, 26 bp, Artificial Sequence
  Description of Artificial Sequence: Synthetic oligonucleotide
atcgaggtcgtgtggcacgacgagag

SEQ ID NO: 172427 - DNA, 25 bp, Artificial Sequence
  Description of Artificial Sequence: Synthetic oligonucleotide
tcgaggtcgtgtggcacgacgagag

SEQ ID NO: 172428 - DNA, 24 bp, Artificial Sequence
  Description of Artificial Sequence: Synthetic oligonucleotide
cgaggtcgtgtggcacgacgagag

SEQ ID NO: 172429 - DNA, 24 bp, Artificial Sequence
  Description of Artificial Sequence: Synthetic oligonucleotide
gaggtcgtgtggcacgacgagagc

SEQ ID NO: 172430 - DNA, 25 bp, Artificial Sequence
  Description of Artificial Sequence: Synthetic oligonucleotide
aggtcgtgtggcacgacgagagcca

SEQ ID NO: 172431 - DNA, 24 bp, Artificial Sequence
  Description of Artificial Sequence: Synthetic oligonucleotide
ggtcgtgtggcacgacgagagcca

SEQ ID NO: 172432 - DNA, 24 bp, Artificial Sequence
  Description of Artificial Sequence: Synthetic oligonucleotide
gtcgtgtggcacgacgagagccac

SEQ ID NO: 172433 - DNA, 25 bp, Artificial Sequence
  Description of Artificial Sequence: Synthetic oligonucleotide
tcgtgtggcacgacgagagccacct

SEQ ID NO: 172434 - DNA, 29 bp, Artificial Sequence
  Description of Artificial Sequence: Synthetic oligonucleotide
gcacgacgagagccacctgaacaagtaac

SEQ ID NO: 172435 - DNA, 30 bp, Artificial Sequence
  Description of Artificial Sequence: Synthetic oligonucleotide
cacgacgagagccacctgaacaagtaactg

SEQ ID NO: 172436 - DNA, 30 bp, Artificial Sequence
  Description of Artificial Sequence: Synthetic oligonucleotide
acgacgagagccacctgaacaagtaactgc

SEQ ID NO: 172437 - DNA, 29 bp, Artificial Sequence
  Description of Artificial Sequence: Synthetic oligonucleotide
cgacgagagccacctgaacaagtaactgc

SEQ ID NO: 172438 - DNA, 30 bp, Artificial Sequence
  Description of Artificial Sequence: Synthetic oligonucleotide
gacgagagccacctgaacaagtaactgctg

SEQ ID NO: 172439 - DNA, 30 bp, Artificial Sequence
  Description of Artificial Sequence: Synthetic oligonucleotide
acgagagccacctgaacaagtaactgctgc

SEQ ID NO: 172440 - DNA, 29 bp, Artificial Sequence
  Description of Artificial Sequence: Synthetic oligonucleotide
cgagagccacctgaacaagtaactgctgc

SEQ ID NO: 172441 - DNA, 29 bp, Artificial Sequence
  Description of Artificial Sequence: Synthetic oligonucleotide
gagagccacctgaacaagtaactgctgcg

SEQ ID NO: 172442 - DNA, 29 bp, Artificial Sequence
  Description of Artificial Sequence: Synthetic oligonucleotide
agagccacctgaacaagtaactgctgcgc

SEQ ID NO: 172443 - DNA, 28 bp, Artificial Sequence
  Description of Artificial Sequence: Synthetic oligonucleotide
gagccacctgaacaagtaactgctgcgc

SEQ ID NO: 172444 - DNA, 28 bp, Artificial Sequence
  Description of Artificial Sequence: Synthetic oligonucleotide
agccacctgaacaagtaactgctgcgcc

SEQ ID NO: 172445 - DNA, 27 bp, Artificial Sequence
  Description of Artificial Sequence: Synthetic oligonucleotide
gccacctgaacaagtaactgctgcgcc

SEQ ID NO: 172446 - DNA, 28 bp, Artificial Sequence
  Description of Artificial Sequence: Synthetic oligonucleotide
ccacctgaacaagtaactgctgcgccac

SEQ ID NO: 172447 - DNA, 31 bp, Artificial Sequence
  Description of Artificial Sequence: Synthetic oligonucleotide
cacctgaacaagtaactgctgcgccacaaac

SEQ ID NO: 172448 - DNA, 31 bp, Artificial Sequence
  Description of Artificial Sequence: Synthetic oligonucleotide
acctgaacaagtaactgctgcgccacaaacc

SEQ ID NO: 172449 - DNA, 30 bp, Artificial Sequence
  Description of Artificial Sequence: Synthetic oligonucleotide
cctgaacaagtaactgctgcgccacaaacc

SEQ ID NO: 172450 - DNA, 30 bp, Artificial Sequence
  Description of Artificial Sequence: Synthetic oligonucleotide
ctgaacaagtaactgctgcgccacaaaccc

SEQ ID NO: 172451 - DNA, 31 bp, Artificial Sequence
  Description of Artificial Sequence: Synthetic oligonucleotide
tgaacaagtaactgctgcgccacaaacccac

SEQ ID NO: 172452 - DNA, 30 bp, Artificial Sequence
  Description of Artificial Sequence: Synthetic oligonucleotide
gaacaagtaactgctgcgccacaaacccac

SEQ ID NO: 172453 - DNA, 30 bp, Artificial Sequence
  Description of Artificial Sequence: Synthetic oligonucleotide
aacaagtaactgctgcgccacaaacccacc

SEQ ID NO: 172454 - DNA, 29 bp, Artificial Sequence
  Description of Artificial Sequence: Synthetic oligonucleotide
acaagtaactgctgcgccacaaacccacc

SEQ ID NO: 172455 - DNA, 28 bp, Artificial Sequence
  Description of Artificial Sequence: Synthetic oligonucleotide
caagtaactgctgcgccacaaacccacc

SEQ ID NO: 172456 - DNA, 30 bp, Artificial Sequence
  Description of Artificial Sequence: Synthetic oligonucleotide
aagtaactgctgcgccacaaacccaccaag

SEQ ID NO: 172457 - DNA, 29 bp, Artificial Sequence
  Description of Artificial Sequence: Synthetic oligonucleotide
agtaactgctgcgccacaaacccaccaag

SEQ ID NO: 172458 - DNA, 28 bp, Artificial Sequence
  Description of Artificial Sequence: Synthetic oligonucleotide
gtaactgctgcgccacaaacccaccaag

SEQ ID NO: 172459 - DNA, 28 bp, Artificial Sequence
  Description of Artificial Sequence: Synthetic oligonucleotide
taactgctgcgccacaaacccaccaagg

SEQ ID NO: 172460 - DNA, 27 bp, Artificial Sequence
  Description of Artificial Sequence: Synthetic oligonucleotide
aactgctgcgccacaaacccaccaagg

SEQ ID NO: 172461 - DNA, 27 bp, Artificial Sequence
  Description of Artificial Sequence: Synthetic oligonucleotide
actgctgcgccacaaacccaccaaggt

SEQ ID NO: 172462 - DNA, 36 bp, Artificial Sequence
  Description of Artificial Sequence: Synthetic oligonucleotide
gaaaaccaaaatgccacgcacttctacctatgatcc

SEQ ID NO: 172463 - DNA, 40 bp, Artificial Sequence
  Description of Artificial Sequence: Synthetic oligonucleotide
aaaaccaaaatgccacgcacttctacctatgatccttttc

SEQ ID NO: 172464 - DNA, 39 bp, Artificial Sequence
  Description of Artificial Sequence: Synthetic oligonucleotide
aaaccaaaatgccacgcacttctacctatgatccttttc

SEQ ID NO: 172465 - DNA, 38 bp, Artificial Sequence
  Description of Artificial Sequence: Synthetic oligonucleotide
aaccaaaatgccacgcacttctacctatgatccttttc

SEQ ID NO: 172466 - DNA, 37 bp, Artificial Sequence
  Description of Artificial Sequence: Synthetic oligonucleotide
accaaaatgccacgcacttctacctatgatccttttc

SEQ ID NO: 172467 - DNA, 36 bp, Artificial Sequence
  Description of Artificial Sequence: Synthetic oligonucleotide
ccaaaatgccacgcacttctacctatgatccttttc

SEQ ID NO: 172468 - DNA, 36 bp, Artificial Sequence
  Description of Artificial Sequence: Synthetic oligonucleotide
caaaatgccacgcacttctacctatgatccttttcc

SEQ ID NO: 172469 - DNA, 43 bp, Artificial Sequence
  Description of Artificial Sequence: Synthetic oligonucleotide
aaaatgccacgcacttctacctatgatccttttcctaataatg

SEQ ID NO: 172470 - DNA, 42 bp, Artificial Sequence
  Description of Artificial Sequence: Synthetic oligonucleotide
aaatgccacgcacttctacctatgatccttttcctaataatg

SEQ ID NO: 172471 - DNA, 41 bp, Artificial Sequence
  Description of Artificial Sequence: Synthetic oligonucleotide
aatgccacgcacttctacctatgatccttttcctaataatg

SEQ ID NO: 172472 - DNA, 40 bp, Artificial Sequence
  Description of Artificial Sequence: Synthetic oligonucleotide
atgccacgcacttctacctatgatccttttcctaataatg

SEQ ID NO: 172473 - DNA, 39 bp, Artificial Sequence
  Description of Artificial Sequence: Synthetic oligonucleotide
tgccacgcacttctacctatgatccttttcctaataatg

SEQ ID NO: 172474 - DNA, 38 bp, Artificial Sequence
  Description of Artificial Sequence: Synthetic oligonucleotide
gccacgcacttctacctatgatccttttcctaataatg

SEQ ID NO: 172475 - DNA, 38 bp, Artificial Sequence
  Description of Artificial Sequence: Synthetic oligonucleotide
ccacgcacttctacctatgatccttttcctaataatgc

SEQ ID NO: 172476 - DNA, 40 bp, Artificial Sequence
  Description of Artificial Sequence: Synthetic oligonucleotide
cacgcacttctacctatgatccttttcctaataatgcttg

SEQ ID NO: 172477 - DNA, 41 bp, Artificial Sequence
  Description of Artificial Sequence: Synthetic oligonucleotide
acgcacttctacctatgatccttttcctaataatgcttgtc

SEQ ID NO: 172478 - DNA, 40 bp, Artificial Sequence
  Description of Artificial Sequence: Synthetic oligonucleotide
cgcacttctacctatgatccttttcctaataatgcttgtc

SEQ ID NO: 172479 - DNA, 42 bp, Artificial Sequence
  Description of Artificial Sequence: Synthetic oligonucleotide
gcacttctacctatgatccttttcctaataatgcttgtcttg

SEQ ID NO: 172480 - DNA, 42 bp, Artificial Sequence
  Description of Artificial Sequence: Synthetic oligonucleotide
cacttctacctatgatccttttcctaataatgcttgtcttgg

SEQ ID NO: 172481 - DNA, 43 bp, Artificial Sequence
  Description of Artificial Sequence: Synthetic oligonucleotide
acttctacctatgatccttttcctaataatgcttgtcttggtc

SEQ ID NO: 172482 - DNA, 42 bp, Artificial Sequence
  Description of Artificial Sequence: Synthetic oligonucleotide
cttctacctatgatccttttcctaataatgcttgtcttggtc

SEQ ID NO: 172483 - DNA, 44 bp, Artificial Sequence
  Description of Artificial Sequence: Synthetic oligonucleotide
ttctacctatgatccttttcctaataatgcttgtcttggtcttg

SEQ ID NO: 172484 - DNA, 43 bp, Artificial Sequence
  Description of Artificial Sequence: Synthetic oligonucleotide
tctacctatgatccttttcctaataatgcttgtcttggtcttg

SEQ ID NO: 172485 - DNA, 42 bp, Artificial Sequence
  Description of Artificial Sequence: Synthetic oligonucleotide
ctacctatgatccttttcctaataatgcttgtcttggtcttg

SEQ ID NO: 172486 - DNA, 45 bp, Artificial Sequence
  Description of Artificial Sequence: Synthetic oligonucleotide
tacctatgatccttttcctaataatgcttgtcttggtcttgtttg

SEQ ID NO: 172487 - DNA, 28 bp, Artificial Sequence
  Description of Artificial Sequence: Synthetic oligonucleotide
tgtgcgtggacgtggacatggagttctg

SEQ ID NO: 172488 - DNA, 27 bp, Artificial Sequence
  Description of Artificial Sequence: Synthetic oligonucleotide
gtgcgtggacgtggacatggagttctg

SEQ ID NO: 172489 - DNA, 27 bp, Artificial Sequence
  Description of Artificial Sequence: Synthetic oligonucleotide
tgcgtggacgtggacatggagttctgc

SEQ ID NO: 172490 - DNA, 26 bp, Artificial Sequence
  Description of Artificial Sequence: Synthetic oligonucleotide
gcgtggacgtggacatggagttctgc

SEQ ID NO: 172491 - DNA, 27 bp, Artificial Sequence
  Description of Artificial Sequence: Synthetic oligonucleotide
cgtggacgtggacatggagttctgcga

SEQ ID NO: 172492 - DNA, 27 bp, Artificial Sequence
  Description of Artificial Sequence: Synthetic oligonucleotide
gtggacgtggacatggagttctgcgac

SEQ ID NO: 172493 - DNA, 27 bp, Artificial Sequence
  Description of Artificial Sequence: Synthetic oligonucleotide
tggacgtggacatggagttctgcgacc

SEQ ID NO: 172494 - DNA, 27 bp, Artificial Sequence
  Description of Artificial Sequence: Synthetic oligonucleotide
ggacgtggacatggagttctgcgacca

SEQ ID NO: 172495 - DNA, 27 bp, Artificial Sequence
  Description of Artificial Sequence: Synthetic oligonucleotide
gacgtggacatggagttctgcgaccac

SEQ ID NO: 172496 - DNA, 27 bp, Artificial Sequence
  Description of Artificial Sequence: Synthetic oligonucleotide
acgtggacatggagttctgcgaccacg

SEQ ID NO: 172497 - DNA, 27 bp, Artificial Sequence
  Description of Artificial Sequence: Synthetic oligonucleotide
cgtggacatggagttctgcgaccacgt

SEQ ID NO: 172498 - DNA, 27 bp, Artificial Sequence
  Description of Artificial Sequence: Synthetic oligonucleotide
gtggacatggagttctgcgaccacgtg

SEQ ID NO: 172499 - DNA, 27 bp, Artificial Sequence
  Description of Artificial Sequence: Synthetic oligonucleotide
tggacatggagttctgcgaccacgtgg

SEQ ID NO: 172500 - DNA, 26 bp, Artificial Sequence
  Description of Artificial Sequence: Synthetic oligonucleotide
ggacatggagttctgcgaccacgtgg

SEQ ID NO: 172501 - DNA, 26 bp, Artificial Sequence
  Description of Artificial Sequence: Synthetic oligonucleotide
gacatggagttctgcgaccacgtggg

SEQ ID NO: 172502 - DNA, 26 bp, Artificial Sequence
  Description of Artificial Sequence: Synthetic oligonucleotide
acatggagttctgcgaccacgtgggc

SEQ ID NO: 172503 - DNA, 25 bp, Artificial Sequence
  Description of Artificial Sequence: Synthetic oligonucleotide
catggagttctgcgaccacgtgggc

SEQ ID NO: 172504 - DNA, 26 bp, Artificial Sequence
  Description of Artificial Sequence: Synthetic oligonucleotide
atggagttctgcgaccacgtgggcgt

SEQ ID NO: 172505 - DNA, 25 bp, Artificial Sequence
  Description of Artificial Sequence: Synthetic oligonucleotide
tggagttctgcgaccacgtgggcgt

SEQ ID NO: 172506 - DNA, 24 bp, Artificial Sequence
  Description of Artificial Sequence: Synthetic oligonucleotide
ggagttctgcgaccacgtgggcgt

SEQ ID NO: 172507 - DNA, 24 bp, Artificial Sequence
  Description of Artificial Sequence: Synthetic oligonucleotide
gagttctgcgaccacgtgggcgtg

SEQ ID NO: 172508 - DNA, 25 bp, Artificial Sequence
  Description of Artificial Sequence: Synthetic oligonucleotide
agttctgcgaccacgtgggcgtgga

SEQ ID NO: 172509 - DNA, 24 bp, Artificial Sequence
  Description of Artificial Sequence: Synthetic oligonucleotide
gttctgcgaccacgtgggcgtgga

SEQ ID NO: 172510 - DNA, 26 bp, Artificial Sequence
  Description of Artificial Sequence: Synthetic oligonucleotide
ttctgcgaccacgtgggcgtggagat

SEQ ID NO: 172511 - DNA, 25 bp, Artificial Sequence
  Description of Artificial Sequence: Synthetic oligonucleotide
tctgcgaccacgtgggcgtggagat

SEQ ID NO: 172512 - DNA, 24 bp, Artificial Sequence
  Description of Artificial Sequence: Synthetic oligonucleotide
ctgcgaccacgtgggcgtggagat

SEQ ID NO: 172513 - DNA, 24 bp, Artificial Sequence
  Description of Artificial Sequence: Synthetic oligonucleotide
tgcgaccacgtgggcgtggagatc

SEQ ID NO: 172514 - DNA, 27 bp, Artificial Sequence
  Description of Artificial Sequence: Synthetic oligonucleotide
cgtggagatcctgactccgctgttcga

SEQ ID NO: 172515 - DNA, 27 bp, Artificial Sequence
  Description of Artificial Sequence: Synthetic oligonucleotide
gtggagatcctgactccgctgttcgac

SEQ ID NO: 172516 - DNA, 28 bp, Artificial Sequence
  Description of Artificial Sequence: Synthetic oligonucleotide
tggagatcctgactccgctgttcgacac

SEQ ID NO: 172517 - DNA, 27 bp, Artificial Sequence
  Description of Artificial Sequence: Synthetic oligonucleotide
ggagatcctgactccgctgttcgacac

SEQ ID NO: 172518 - DNA, 27 bp, Artificial Sequence
  Description of Artificial Sequence: Synthetic oligonucleotide
gagatcctgactccgctgttcgacacc

SEQ ID NO: 172519 - DNA, 27 bp, Artificial Sequence
  Description of Artificial Sequence: Synthetic oligonucleotide
agatcctgactccgctgttcgacaccc

SEQ ID NO: 172520 - DNA, 27 bp, Artificial Sequence
  Description of Artificial Sequence: Synthetic oligonucleotide
gatcctgactccgctgttcgacaccct

SEQ ID NO: 172521 - DNA, 27 bp, Artificial Sequence
  Description of Artificial Sequence: Synthetic oligonucleotide
atcctgactccgctgttcgacaccctg

SEQ ID NO: 172522 - DNA, 26 bp, Artificial Sequence
  Description of Artificial Sequence: Synthetic oligonucleotide
tcctgactccgctgttcgacaccctg

SEQ ID NO: 172523 - DNA, 25 bp, Artificial Sequence
  Description of Artificial Sequence: Synthetic oligonucleotide
cctgactccgctgttcgacaccctg

SEQ ID NO: 172524 - DNA, 26 bp, Artificial Sequence
  Description of Artificial Sequence: Synthetic oligonucleotide
ctgactccgctgttcgacaccctgca

SEQ ID NO: 172525 - DNA, 26 bp, Artificial Sequence
  Description of Artificial Sequence: Synthetic oligonucleotide
tgactccgctgttcgacaccctgcac

SEQ ID NO: 172526 - DNA, 25 bp, Artificial Sequence
  Description of Artificial Sequence: Synthetic oligonucleotide
gactccgctgttcgacaccctgcac

SEQ ID NO: 172527 - DNA, 25 bp, Artificial Sequence
  Description of Artificial Sequence: Synthetic oligonucleotide
actccgctgttcgacaccctgcacc

SEQ ID NO: 172528 - DNA, 24 bp, Artificial Sequence
  Description of Artificial Sequence: Synthetic oligonucleotide
ctccgctgttcgacaccctgcacc

SEQ ID NO: 172529 - DNA, 24 bp, Artificial Sequence
  Description of Artificial Sequence: Synthetic oligonucleotide
tccgctgttcgacaccctgcaccc

SEQ ID NO: 172530 - DNA, 23 bp, Artificial Sequence
  Description of Artificial Sequence: Synthetic oligonucleotide
ccgctgttcgacaccctgcaccc

SEQ ID NO: 172531 - DNA, 23 bp, Artificial Sequence
  Description of Artificial Sequence: Synthetic oligonucleotide
cgctgttcgacaccctgcacccc

SEQ ID NO: 172532 - DNA, 23 bp, Artificial Sequence
  Description of Artificial Sequence: Synthetic oligonucleotide
gctgttcgacaccctgcaccccg

SEQ ID NO: 172533 - DNA, 23 bp, Artificial Sequence
  Description of Artificial Sequence: Synthetic oligonucleotide
ctgttcgacaccctgcaccccgg

SEQ ID NO: 172534 - DNA, 25 bp, Artificial Sequence
  Description of Artificial Sequence: Synthetic oligonucleotide
tgttcgacaccctgcaccccggctt

SEQ ID NO: 172535 - DNA, 24 bp, Artificial Sequence
  Description of Artificial Sequence: Synthetic oligonucleotide
gttcgacaccctgcaccccggctt

SEQ ID NO: 172536 - DNA, 26 bp, Artificial Sequence
  Description of Artificial Sequence: Synthetic oligonucleotide
ttcgacaccctgcaccccggcttcta

SEQ ID NO: 172537 - DNA, 25 bp, Artificial Sequence
  Description of Artificial Sequence: Synthetic oligonucleotide
tcgacaccctgcaccccggcttcta

SEQ ID NO: 172538 - DNA, 24 bp, Artificial Sequence
  Description of Artificial Sequence: Synthetic oligonucleotide
cgacaccctgcaccccggcttcta

SEQ ID NO: 172539 - DNA, 24 bp, Artificial Sequence
  Description of Artificial Sequence: Synthetic oligonucleotide
gacaccctgcaccccggcttctac

SEQ ID NO: 172540 - DNA, 24 bp, Artificial Sequence
  Description of Artificial Sequence: Synthetic oligonucleotide
acaccctgcaccccggcttctacg

SEQ ID NO: 172541 - DNA, 20 bp, Artificial Sequence
  Description of Artificial Sequence: Synthetic oligonucleotide
ccgcggtgccccgcgtgatg

SEQ ID NO: 172542 - DNA, 21 bp, Artificial Sequence
  Description of Artificial Sequence: Synthetic oligonucleotide
cgcggtgccccgcgtgatgct

SEQ ID NO: 172543 - DNA, 21 bp, Artificial Sequence
  Description of Artificial Sequence: Synthetic oligonucleotide
gcggtgccccgcgtgatgctg

SEQ ID NO: 172544 - DNA, 21 bp, Artificial Sequence
  Description of Artificial Sequence: Synthetic oligonucleotide
cggtgccccgcgtgatgctgg

SEQ ID NO: 172545 - DNA, 21 bp, Artificial Sequence
  Description of Artificial Sequence: Synthetic oligonucleotide
ggtgccccgcgtgatgctggg

SEQ ID NO: 172546 - DNA, 22 bp, Artificial Sequence
  Description of Artificial Sequence: Synthetic oligonucleotide
gtgccccgcgtgatgctgggga

SEQ ID NO: 172547 - DNA, 22 bp, Artificial Sequence
  Description of Artificial Sequence: Synthetic oligonucleotide
tgccccgcgtgatgctggggac

SEQ ID NO: 172548 - DNA, 21 bp, Artificial Sequence
  Description of Artificial Sequence: Synthetic oligonucleotide
gccccgcgtgatgctggggac

SEQ ID NO: 172549 - DNA, 21 bp, Artificial Sequence
  Description of Artificial Sequence: Synthetic oligonucleotide
ccccgcgtgatgctggggacc

SEQ ID NO: 172550 - DNA, 21 bp, Artificial Sequence
  Description of Artificial Sequence: Synthetic oligonucleotide
cccgcgtgatgctggggaccg

SEQ ID NO: 172551 - DNA, 22 bp, Artificial Sequence
  Description of Artificial Sequence: Synthetic oligonucleotide
ccgcgtgatgctggggaccggt

SEQ ID NO: 172552 - DNA, 22 bp, Artificial Sequence
  Description of Artificial Sequence: Synthetic oligonucleotide
cgcgtgatgctggggaccggtc

SEQ ID NO: 172553 - DNA, 22 bp, Artificial Sequence
  Description of Artificial Sequence: Synthetic oligonucleotide
gcgtgatgctggggaccggtcg

SEQ ID NO: 172554 - DNA, 22 bp, Artificial Sequence
  Description of Artificial Sequence: Synthetic oligonucleotide
cgtgatgctggggaccggtcgg

SEQ ID NO: 172555 - DNA, 23 bp, Artificial Sequence
  Description of Artificial Sequence: Synthetic oligonucleotide
gtgatgctggggaccggtcggca

SEQ ID NO: 172556 - DNA, 23 bp, Artificial Sequence
  Description of Artificial Sequence: Synthetic oligonucleotide
tgatgctggggaccggtcggcag

SEQ ID NO: 172557 - DNA, 22 bp, Artificial Sequence
  Description of Artificial Sequence: Synthetic oligonucleotide
gatgctggggaccggtcggcag

SEQ ID NO: 172558 - DNA, 23 bp, Artificial Sequence
  Description of Artificial Sequence: Synthetic oligonucleotide
atgctggggaccggtcggcagct

SEQ ID NO: 172559 - DNA, 22 bp, Artificial Sequence
  Description of Artificial Sequence: Synthetic oligonucleotide
tgctggggaccggtcggcagct

SEQ ID NO: 172560 - DNA, 40 bp, Artificial Sequence
  Description of Artificial Sequence: Synthetic oligonucleotide
ttcgacctatgatccttttcctaataatgcttgtcttggg

SEQ ID NO: 172561 - DNA, 39 bp, Artificial Sequence
  Description of Artificial Sequence: Synthetic oligonucleotide
tcgacctatgatccttttcctaataatgcttgtcttggg

SEQ ID NO: 172562 - DNA, 38 bp, Artificial Sequence
  Description of Artificial Sequence: Synthetic oligonucleotide
cgacctatgatccttttcctaataatgcttgtcttggg

SEQ ID NO: 172563 - DNA, 39 bp, Artificial Sequence
  Description of Artificial Sequence: Synthetic oligonucleotide
gacctatgatccttttcctaataatgcttgtcttgggtc

SEQ ID NO: 172564 - DNA, 41 bp, Artificial Sequence
  Description of Artificial Sequence: Synthetic oligonucleotide
acctatgatccttttcctaataatgcttgtcttgggtcttg

SEQ ID NO: 172565 - DNA, 40 bp, Artificial Sequence
  Description of Artificial Sequence: Synthetic oligonucleotide
cctatgatccttttcctaataatgcttgtcttgggtcttg

SEQ ID NO: 172566 - DNA, 43 bp, Artificial Sequence
  Description of Artificial Sequence: Synthetic oligonucleotide
ctatgatccttttcctaataatgcttgtcttgggtcttgtttg

SEQ ID NO: 172567 - DNA, 43 bp, Artificial Sequence
  Description of Artificial Sequence: Synthetic oligonucleotide
tatgatccttttcctaataatgcttgtcttgggtcttgtttgg

SEQ ID NO: 172568 - DNA, 33 bp, Artificial Sequence
  Description of Artificial Sequence: Synthetic oligonucleotide
ggcacattcaacatcgacatcctcaacgagtag

SEQ ID NO: 172569 - DNA, 35 bp, Artificial Sequence
  Description of Artificial Sequence: Synthetic oligonucleotide
gcacattcaacatcgacatcctcaacgagtagttc

SEQ ID NO: 172570 - DNA, 36 bp, Artificial Sequence
  Description of Artificial Sequence: Synthetic oligonucleotide
cacattcaacatcgacatcctcaacgagtagttcag

SEQ ID NO: 172571 - DNA, 36 bp, Artificial Sequence
  Description of Artificial Sequence: Synthetic oligonucleotide
acattcaacatcgacatcctcaacgagtagttcagg

SEQ ID NO: 172572 - DNA, 35 bp, Artificial Sequence
  Description of Artificial Sequence: Synthetic oligonucleotide
cattcaacatcgacatcctcaacgagtagttcagg

SEQ ID NO: 172573 - DNA, 35 bp, Artificial Sequence
  Description of Artificial Sequence: Synthetic oligonucleotide
attcaacatcgacatcctcaacgagtagttcaggc

SEQ ID NO: 172574 - DNA, 34 bp, Artificial Sequence
  Description of Artificial Sequence: Synthetic oligonucleotide
ttcaacatcgacatcctcaacgagtagttcaggc

SEQ ID NO: 172575 - DNA, 33 bp, Artificial Sequence
  Description of Artificial Sequence: Synthetic oligonucleotide
tcaacatcgacatcctcaacgagtagttcaggc

SEQ ID NO: 172576 - DNA, 32 bp, Artificial Sequence
  Description of Artificial Sequence: Synthetic oligonucleotide
caacatcgacatcctcaacgagtagttcaggc

SEQ ID NO: 172577 - DNA, 33 bp, Artificial Sequence
  Description of Artificial Sequence: Synthetic oligonucleotide
aacatcgacatcctcaacgagtagttcaggctc

SEQ ID NO: 172578 - DNA, 32 bp, Artificial Sequence
  Description of Artificial Sequence: Synthetic oligonucleotide
acatcgacatcctcaacgagtagttcaggctc

SEQ ID NO: 172579 - DNA, 31 bp, Artificial Sequence
  Description of Artificial Sequence: Synthetic oligonucleotide
catcgacatcctcaacgagtagttcaggctc

SEQ ID NO: 172580 - DNA, 31 bp, Artificial Sequence
  Description of Artificial Sequence: Synthetic oligonucleotide
atcgacatcctcaacgagtagttcaggctcc

SEQ ID NO: 172581 - DNA, 30 bp, Artificial Sequence
  Description of Artificial Sequence: Synthetic oligonucleotide
tcgacatcctcaacgagtagttcaggctcc

SEQ ID NO: 172582 - DNA, 29 bp, Artificial Sequence
  Description of Artificial Sequence: Synthetic oligonucleotide
cgacatcctcaacgagtagttcaggctcc

SEQ ID NO: 172583 - DNA, 30 bp, Artificial Sequence
  Description of Artificial Sequence: Synthetic oligonucleotide
gacatcctcaacgagtagttcaggctccag

SEQ ID NO: 172584 - DNA, 32 bp, Artificial Sequence
  Description of Artificial Sequence: Synthetic oligonucleotide
acatcctcaacgagtagttcaggctccagaac

SEQ ID NO: 172585 - DNA, 31 bp, Artificial Sequence
  Description of Artificial Sequence: Synthetic oligonucleotide
catcctcaacgagtagttcaggctccagaac

SEQ ID NO: 172586 - DNA, 32 bp, Artificial Sequence
  Description of Artificial Sequence: Synthetic oligonucleotide
atcctcaacgagtagttcaggctccagaacac

SEQ ID NO: 172587 - DNA, 31 bp, Artificial Sequence
  Description of Artificial Sequence: Synthetic oligonucleotide
tcctcaacgagtagttcaggctccagaacac

SEQ ID NO: 172588 - DNA, 30 bp, Artificial Sequence
  Description of Artificial Sequence: Synthetic oligonucleotide
cctcaacgagtagttcaggctccagaacac

SEQ ID NO: 172589 - DNA, 30 bp, Artificial Sequence
  Description of Artificial Sequence: Synthetic oligonucleotide
ctcaacgagtagttcaggctccagaacacc

SEQ ID NO: 172590 - DNA, 31 bp, Artificial Sequence
  Description of Artificial Sequence: Synthetic oligonucleotide
tcaacgagtagttcaggctccagaacaccac

SEQ ID NO: 172591 - DNA, 30 bp, Artificial Sequence
  Description of Artificial Sequence: Synthetic oligonucleotide
caacgagtagttcaggctccagaacaccac

SEQ ID NO: 172592 - DNA, 30 bp, Artificial Sequence
  Description of Artificial Sequence: Synthetic oligonucleotide
aacgagtagttcaggctccagaacaccacc

SEQ ID NO: 172593 - DNA, 29 bp, Artificial Sequence
  Description of Artificial Sequence: Synthetic oligonucleotide
acgagtagttcaggctccagaacaccacc

SEQ ID NO: 172594 - DNA, 28 bp, Artificial Sequence
  Description of Artificial Sequence: Synthetic oligonucleotide
cgagtagttcaggctccagaacaccacc

SEQ ID NO: 172595 - DNA, 31 bp, Artificial Sequence
  Description of Artificial Sequence: Synthetic oligonucleotide
gagtagttcaggctccagaacaccaccattg

SEQ ID NO: 172596 - DNA, 31 bp, Artificial Sequence
  Description of Artificial Sequence: Synthetic oligonucleotide
agtagttcaggctccagaacaccaccattgg

SEQ ID NO: 172597 - DNA, 30 bp, Artificial Sequence
  Description of Artificial Sequence: Synthetic oligonucleotide
gtagttcaggctccagaacaccaccattgg

SEQ ID NO: 172598 - DNA, 30 bp, Artificial Sequence
  Description of Artificial Sequence: Synthetic oligonucleotide
tagttcaggctccagaacaccaccattggg

SEQ ID NO: 172599 - DNA, 26 bp, Artificial Sequence
  Description of Artificial Sequence: Synthetic oligonucleotide
gagggcgatttctactacctgggggc

SEQ ID NO: 172600 - DNA, 27 bp, Artificial Sequence
  Description of Artificial Sequence: Synthetic oligonucleotide
agggcgatttctactacctgggggcgt

SEQ ID NO: 172601 - DNA, 27 bp, Artificial Sequence
  Description of Artificial Sequence: Synthetic oligonucleotide
gggcgatttctactacctgggggcgtt

SEQ ID NO: 172602 - DNA, 27 bp, Artificial Sequence
  Description of Artificial Sequence: Synthetic oligonucleotide
ggcgatttctactacctgggggcgttc

SEQ ID NO: 172603 - DNA, 29 bp, Artificial Sequence
  Description of Artificial Sequence: Synthetic oligonucleotide
gcgatttctactacctgggggcgttcttc

SEQ ID NO: 172604 - DNA, 29 bp, Artificial Sequence
  Description of Artificial Sequence: Synthetic oligonucleotide
cgatttctactacctgggggcgttcttcg

SEQ ID NO: 172605 - DNA, 29 bp, Artificial Sequence
  Description of Artificial Sequence: Synthetic oligonucleotide
gatttctactacctgggggcgttcttcgg

SEQ ID NO: 172606 - DNA, 29 bp, Artificial Sequence
  Description of Artificial Sequence: Synthetic oligonucleotide
atttctactacctgggggcgttcttcggg

SEQ ID NO: 172607 - DNA, 28 bp, Artificial Sequence
  Description of Artificial Sequence: Synthetic oligonucleotide
tttctactacctgggggcgttcttcggg

SEQ ID NO: 172608 - DNA, 27 bp, Artificial Sequence
  Description of Artificial Sequence: Synthetic oligonucleotide
ttctactacctgggggcgttcttcggg

SEQ ID NO: 172609 - DNA, 26 bp, Artificial Sequence
  Description of Artificial Sequence: Synthetic oligonucleotide
tctactacctgggggcgttcttcggg

SEQ ID NO: 172610 - DNA, 25 bp, Artificial Sequence
  Description of Artificial Sequence: Synthetic oligonucleotide
ctactacctgggggcgttcttcggg

SEQ ID NO: 172611 - DNA, 25 bp, Artificial Sequence
  Description of Artificial Sequence: Synthetic oligonucleotide
tactacctgggggcgttcttcgggg

SEQ ID NO: 172612 - DNA, 24 bp, Artificial Sequence
  Description of Artificial Sequence: Synthetic oligonucleotide
actacctgggggcgttcttcgggg

SEQ ID NO: 172613 - DNA, 23 bp, Artificial Sequence
  Description of Artificial Sequence: Synthetic oligonucleotide
ctacctgggggcgttcttcgggg

SEQ ID NO: 172614 - DNA, 23 bp, Artificial Sequence
  Description of Artificial Sequence: Synthetic oligonucleotide
tacctgggggcgttcttcggggg

SEQ ID NO: 172615 - DNA, 22 bp, Artificial Sequence
  Description of Artificial Sequence: Synthetic oligonucleotide
acctgggggcgttcttcggggg

SEQ ID NO: 172616 - DNA, 21 bp, Artificial Sequence
  Description of Artificial Sequence: Synthetic oligonucleotide
cctgggggcgttcttcggggg

SEQ ID NO: 172617 - DNA, 22 bp, Artificial Sequence
  Description of Artificial Sequence: Synthetic oligonucleotide
ctgggggcgttcttcggggggt

SEQ ID NO: 172618 - DNA, 25 bp, Artificial Sequence
  Description of Artificial Sequence: Synthetic oligonucleotide
actccgctgttcggcaccctgcact

SEQ ID NO: 172619 - DNA, 24 bp, Artificial Sequence
  Description of Artificial Sequence: Synthetic oligonucleotide
ctccgctgttcggcaccctgcact

SEQ ID NO: 172620 - DNA, 24 bp, Artificial Sequence
  Description of Artificial Sequence: Synthetic oligonucleotide
tccgctgttcggcaccctgcactc

SEQ ID NO: 172621 - DNA, 23 bp, Artificial Sequence
  Description of Artificial Sequence: Synthetic oligonucleotide
ccgctgttcggcaccctgcactc

SEQ ID NO: 172622 - DNA, 24 bp, Artificial Sequence
  Description of Artificial Sequence: Synthetic oligonucleotide
cgctgttcggcaccctgcactcca

SEQ ID NO: 172623 - DNA, 24 bp, Artificial Sequence
  Description of Artificial Sequence: Synthetic oligonucleotide
gctgttcggcaccctgcactccag

SEQ ID NO: 172624 - DNA, 26 bp, Artificial Sequence
  Description of Artificial Sequence: Synthetic oligonucleotide
ctgttcggcaccctgcactccagctt

SEQ ID NO: 172625 - DNA, 27 bp, Artificial Sequence
  Description of Artificial Sequence: Synthetic oligonucleotide
tgttcggcaccctgcactccagcttct

SEQ ID NO: 172626 - DNA, 27 bp, Artificial Sequence
  Description of Artificial Sequence: Synthetic oligonucleotide
gttcggcaccctgcactccagcttcta

SEQ ID NO: 172627 - DNA, 27 bp, Artificial Sequence
  Description of Artificial Sequence: Synthetic oligonucleotide
ttcggcaccctgcactccagcttctac

SEQ ID NO: 172628 - DNA, 26 bp, Artificial Sequence
  Description of Artificial Sequence: Synthetic oligonucleotide
tcggcaccctgcactccagcttctac

SEQ ID NO: 172629 - DNA, 25 bp, Artificial Sequence
  Description of Artificial Sequence: Synthetic oligonucleotide
cggcaccctgcactccagcttctac

SEQ ID NO: 172630 - DNA, 25 bp, Artificial Sequence
  Description of Artificial Sequence: Synthetic oligonucleotide
ggcaccctgcactccagcttctacg

SEQ ID NO: 172631 - DNA, 27 bp, Artificial Sequence
  Description of Artificial Sequence: Synthetic oligonucleotide
gcaccctgcactccagcttctacggaa

SEQ ID NO: 172632 - DNA, 27 bp, Artificial Sequence
  Description of Artificial Sequence: Synthetic oligonucleotide
caccctgcactccagcttctacggaag

SEQ ID NO: 172633 - DNA, 27 bp, Artificial Sequence
  Description of Artificial Sequence: Synthetic oligonucleotide
accctgcactccagcttctacggaagc

SEQ ID NO: 172634 - DNA, 27 bp, Artificial Sequence
  Description of Artificial Sequence: Synthetic oligonucleotide
ccctgcactccagcttctacggaagca

SEQ ID NO: 172635 - DNA, 27 bp, Artificial Sequence
  Description of Artificial Sequence: Synthetic oligonucleotide
cctgcactccagcttctacggaagcag

SEQ ID NO: 172636 - DNA, 27 bp, Artificial Sequence
  Description of Artificial Sequence: Synthetic oligonucleotide
ctgcactccagcttctacggaagcagc

SEQ ID NO: 172637 - DNA, 27 bp, Artificial Sequence
  Description of Artificial Sequence: Synthetic oligonucleotide
tgcactccagcttctacggaagcagcc

SEQ ID NO: 172638 - DNA, 26 bp, Artificial Sequence
  Description of Artificial Sequence: Synthetic oligonucleotide
gcactccagcttctacggaagcagcc

SEQ ID NO: 172639 - DNA, 26 bp, Artificial Sequence
  Description of Artificial Sequence: Synthetic oligonucleotide
cactccagcttctacggaagcagccg

SEQ ID NO: 172640 - DNA, 26 bp, Artificial Sequence
  Description of Artificial Sequence: Synthetic oligonucleotide
actccagcttctacggaagcagccgg

SEQ ID NO: 172641 - DNA, 25 bp, Artificial Sequence
  Description of Artificial Sequence: Synthetic oligonucleotide
ctccagcttctacggaagcagccgg

SEQ ID NO: 172642 - DNA, 26 bp, Artificial Sequence
  Description of Artificial Sequence: Synthetic oligonucleotide
tccagcttctacggaagcagccggga

SEQ ID NO: 172643 - DNA, 28 bp, Artificial Sequence
  Description of Artificial Sequence: Synthetic oligonucleotide
acgagggcgatttctactacatgggggg

SEQ ID NO: 172644 - DNA, 27 bp, Artificial Sequence
  Description of Artificial Sequence: Synthetic oligonucleotide
cgagggcgatttctactacatgggggg

SEQ ID NO: 172645 - DNA, 27 bp, Artificial Sequence
  Description of Artificial Sequence: Synthetic oligonucleotide
gagggcgatttctactacatggggggg

SEQ ID NO: 172646 - DNA, 29 bp, Artificial Sequence
  Description of Artificial Sequence: Synthetic oligonucleotide
agggcgatttctactacatgggggggttc

SEQ ID NO: 172647 - DNA, 28 bp, Artificial Sequence
  Description of Artificial Sequence: Synthetic oligonucleotide
gggcgatttctactacatgggggggttc

SEQ ID NO: 172648 - DNA, 30 bp, Artificial Sequence
  Description of Artificial Sequence: Synthetic oligonucleotide
ggcgatttctactacatgggggggttcttc

SEQ ID NO: 172649 - DNA, 30 bp, Artificial Sequence
  Description of Artificial Sequence: Synthetic oligonucleotide
gcgatttctactacatgggggggttcttcg

SEQ ID NO: 172650 - DNA, 30 bp, Artificial Sequence
  Description of Artificial Sequence: Synthetic oligonucleotide
cgatttctactacatgggggggttcttcgg

SEQ ID NO: 172651 - DNA, 30 bp, Artificial Sequence
  Description of Artificial Sequence: Synthetic oligonucleotide
gatttctactacatgggggggttcttcggg

SEQ ID NO: 172652 - DNA, 30 bp, Artificial Sequence
  Description of Artificial Sequence: Synthetic oligonucleotide
atttctactacatgggggggttcttcgggg

SEQ ID NO: 172653 - DNA, 29 bp, Artificial Sequence
  Description of Artificial Sequence: Synthetic oligonucleotide
tttctactacatgggggggttcttcgggg

SEQ ID NO: 172654 - DNA, 28 bp, Artificial Sequence
  Description of Artificial Sequence: Synthetic oligonucleotide
ttctactacatgggggggttcttcgggg

SEQ ID NO: 172655 - DNA, 27 bp, Artificial Sequence
  Description of Artificial Sequence: Synthetic oligonucleotide
tctactacatgggggggttcttcgggg

SEQ ID NO: 172656 - DNA, 26 bp, Artificial Sequence
  Description of Artificial Sequence: Synthetic oligonucleotide
ctactacatgggggggttcttcgggg

SEQ ID NO: 172657 - DNA, 26 bp, Artificial Sequence
  Description of Artificial Sequence: Synthetic oligonucleotide
tactacatgggggggttcttcggggg

SEQ ID NO: 172658 - DNA, 25 bp, Artificial Sequence
  Description of Artificial Sequence: Synthetic oligonucleotide
actacatgggggggttcttcggggg

SEQ ID NO: 172659 - DNA, 24 bp, Artificial Sequence
  Description of Artificial Sequence: Synthetic oligonucleotide
ctacatgggggggttcttcggggg

SEQ ID NO: 172660 - DNA, 25 bp, Artificial Sequence
  Description of Artificial Sequence: Synthetic oligonucleotide
tacatgggggggttcttcggggggt

SEQ ID NO: 172661 - DNA, 24 bp, Artificial Sequence
  Description of Artificial Sequence: Synthetic oligonucleotide
acatgggggggttcttcggggggt

SEQ ID NO: 172662 - DNA, 23 bp, Artificial Sequence
  Description of Artificial Sequence: Synthetic oligonucleotide
catgggggggttcttcggggggt

SEQ ID NO: 172663 - DNA, 23 bp, Artificial Sequence
  Description of Artificial Sequence: Synthetic oligonucleotide
atgggggggttcttcggggggtc

SEQ ID NO: 172664 - DNA, 26 bp, Artificial Sequence
  Description of Artificial Sequence: Synthetic oligonucleotide
gaagctgaggttcactgcggtgccca

SEQ ID NO: 172665 - DNA, 26 bp, Artificial Sequence
  Description of Artificial Sequence: Synthetic oligonucleotide
aagctgaggttcactgcggtgcccag

SEQ ID NO: 172666 - DNA, 25 bp, Artificial Sequence
  Description of Artificial Sequence: Synthetic oligonucleotide
agctgaggttcactgcggtgcccag

SEQ ID NO: 172667 - DNA, 24 bp, Artificial Sequence
  Description of Artificial Sequence: Synthetic oligonucleotide
gctgaggttcactgcggtgcccag

SEQ ID NO: 172668 - DNA, 26 bp, Artificial Sequence
  Description of Artificial Sequence: Synthetic oligonucleotide
ctgaggttcactgcggtgcccaggaa

SEQ ID NO: 172669 - DNA, 26 bp, Artificial Sequence
  Description of Artificial Sequence: Synthetic oligonucleotide
tgaggttcactgcggtgcccaggaac

SEQ ID NO: 172670 - DNA, 25 bp, Artificial Sequence
  Description of Artificial Sequence: Synthetic oligonucleotide
gaggttcactgcggtgcccaggaac

SEQ ID NO: 172671 - DNA, 26 bp, Artificial Sequence
  Description of Artificial Sequence: Synthetic oligonucleotide
aggttcactgcggtgcccaggaacca

SEQ ID NO: 172672 - DNA, 25 bp, Artificial Sequence
  Description of Artificial Sequence: Synthetic oligonucleotide
ggttcactgcggtgcccaggaacca

SEQ ID NO: 172673 - DNA, 25 bp, Artificial Sequence
  Description of Artificial Sequence: Synthetic oligonucleotide
gttcactgcggtgcccaggaaccac

SEQ ID NO: 172674 - DNA, 26 bp, Artificial Sequence
  Description of Artificial Sequence: Synthetic oligonucleotide
ttcactgcggtgcccaggaaccacca

SEQ ID NO: 172675 - DNA, 25 bp, Artificial Sequence
  Description of Artificial Sequence: Synthetic oligonucleotide
tcactgcggtgcccaggaaccacca

SEQ ID NO: 172676 - DNA, 24 bp, Artificial Sequence
  Description of Artificial Sequence: Synthetic oligonucleotide
cactgcggtgcccaggaaccacca

SEQ ID NO: 172677 - DNA, 24 bp, Artificial Sequence
  Description of Artificial Sequence: Synthetic oligonucleotide
actgcggtgcccaggaaccaccag

SEQ ID NO: 172678 - DNA, 23 bp, Artificial Sequence
  Description of Artificial Sequence: Synthetic oligonucleotide
ctgcggtgcccaggaaccaccag

SEQ ID NO: 172679 - DNA, 23 bp, Artificial Sequence
  Description of Artificial Sequence: Synthetic oligonucleotide
tgcggtgcccaggaaccaccagg

SEQ ID NO: 172680 - DNA, 22 bp, Artificial Sequence
  Description of Artificial Sequence: Synthetic oligonucleotide
gcggtgcccaggaaccaccagg

SEQ ID NO: 172681 - DNA, 22 bp, Artificial Sequence
  Description of Artificial Sequence: Synthetic oligonucleotide
cggtgcccaggaaccaccaggc

SEQ ID NO: 172682 - DNA, 22 bp, Artificial Sequence
  Description of Artificial Sequence: Synthetic oligonucleotide
ggtgcccaggaaccaccaggcg

SEQ ID NO: 172683 - DNA, 23 bp, Artificial Sequence
  Description of Artificial Sequence: Synthetic oligonucleotide
gtgcccaggaaccaccaggcggt

SEQ ID NO: 172684 - DNA, 23 bp, Artificial Sequence
  Description of Artificial Sequence: Synthetic oligonucleotide
tgcccaggaaccaccaggcggtc

SEQ ID NO: 172685 - DNA, 22 bp, Artificial Sequence
  Description of Artificial Sequence: Synthetic oligonucleotide
gcccaggaaccaccaggcggtc

SEQ ID NO: 172686 - DNA, 22 bp, Artificial Sequence
  Description of Artificial Sequence: Synthetic oligonucleotide
cccaggaaccaccaggcggtcc

SEQ ID NO: 172687 - DNA, 22 bp, Artificial Sequence
  Description of Artificial Sequence: Synthetic oligonucleotide
ccaggaaccaccaggcggtccg

SEQ ID NO: 172688 - DNA, 24 bp, Artificial Sequence
  Description of Artificial Sequence: Synthetic oligonucleotide
caggaaccaccaggcggtccggaa

SEQ ID NO: 172689 - DNA, 24 bp, Artificial Sequence
  Description of Artificial Sequence: Synthetic oligonucleotide
aggaaccaccaggcggtccggaac

SEQ ID NO: 172690 - DNA, 23 bp, Artificial Sequence
  Description of Artificial Sequence: Synthetic oligonucleotide
ggaaccaccaggcggtccggaac

SEQ ID NO: 172691 - DNA, 26 bp, Artificial Sequence
  Description of Artificial Sequence: Synthetic oligonucleotide
tgactccgctgttcggcaccctgcaa

SEQ ID NO: 172692 - DNA, 25 bp, Artificial Sequence
  Description of Artificial Sequence: Synthetic oligonucleotide
gactccgctgttcggcaccctgcaa

SEQ ID NO: 172693 - DNA, 25 bp, Artificial Sequence
  Description of Artificial Sequence: Synthetic oligonucleotide
actccgctgttcggcaccctgcaac

SEQ ID NO: 172694 - DNA, 24 bp, Artificial Sequence
  Description of Artificial Sequence: Synthetic oligonucleotide
ctccgctgttcggcaccctgcaac

SEQ ID NO: 172695 - DNA, 24 bp, Artificial Sequence
  Description of Artificial Sequence: Synthetic oligonucleotide
tccgctgttcggcaccctgcaacc

SEQ ID NO: 172696 - DNA, 23 bp, Artificial Sequence
  Description of Artificial Sequence: Synthetic oligonucleotide
ccgctgttcggcaccctgcaacc

SEQ ID NO: 172697 - DNA, 23 bp, Artificial Sequence
  Description of Artificial Sequence: Synthetic oligonucleotide
cgctgttcggcaccctgcaaccc

SEQ ID NO: 172698 - DNA, 23 bp, Artificial Sequence
  Description of Artificial Sequence: Synthetic oligonucleotide
gctgttcggcaccctgcaacccg

SEQ ID NO: 172699 - DNA, 23 bp, Artificial Sequence
  Description of Artificial Sequence: Synthetic oligonucleotide
ctgttcggcaccctgcaacccgg

SEQ ID NO: 172700 - DNA, 25 bp, Artificial Sequence
  Description of Artificial Sequence: Synthetic oligonucleotide
tgttcggcaccctgcaacccggctt

SEQ ID NO: 172701 - DNA, 24 bp, Artificial Sequence
  Description of Artificial Sequence: Synthetic oligonucleotide
gttcggcaccctgcaacccggctt

SEQ ID NO: 172702 - DNA, 26 bp, Artificial Sequence
  Description of Artificial Sequence: Synthetic oligonucleotide
ttcggcaccctgcaacccggcttcta

SEQ ID NO: 172703 - DNA, 25 bp, Artificial Sequence
  Description of Artificial Sequence: Synthetic oligonucleotide
tcggcaccctgcaacccggcttcta

SEQ ID NO: 172704 - DNA, 24 bp, Artificial Sequence
  Description of Artificial Sequence: Synthetic oligonucleotide
cggcaccctgcaacccggcttcta

SEQ ID NO: 172705 - DNA, 24 bp, Artificial Sequence
  Description of Artificial Sequence: Synthetic oligonucleotide
ggcaccctgcaacccggcttctac

SEQ ID NO: 172706 - DNA, 24 bp, Artificial Sequence
  Description of Artificial Sequence: Synthetic oligonucleotide
gcaccctgcaacccggcttctacg

SEQ ID NO: 172707 - DNA, 26 bp, Artificial Sequence
  Description of Artificial Sequence: Synthetic oligonucleotide
caccctgcaacccggcttctacggaa

SEQ ID NO: 172708 - DNA, 26 bp, Artificial Sequence
  Description of Artificial Sequence: Synthetic oligonucleotide
accctgcaacccggcttctacggaag

SEQ ID NO: 172709 - DNA, 25 bp, Artificial Sequence
  Description of Artificial Sequence: Synthetic oligonucleotide
ccctgcaacccggcttctacggaag

SEQ ID NO: 172710 - DNA, 26 bp, Artificial Sequence
  Description of Artificial Sequence: Synthetic oligonucleotide
cctgcaacccggcttctacggaagca

SEQ ID NO: 172711 - DNA, 26 bp, Artificial Sequence
  Description of Artificial Sequence: Synthetic oligonucleotide
ctgcaacccggcttctacggaagcag

SEQ ID NO: 172712 - DNA, 26 bp, Artificial Sequence
  Description of Artificial Sequence: Synthetic oligonucleotide
tgcaacccggcttctacggaagcagc

SEQ ID NO: 172713 - DNA, 25 bp, Artificial Sequence
  Description of Artificial Sequence: Synthetic oligonucleotide
gcaacccggcttctacggaagcagc

SEQ ID NO: 172714 - DNA, 25 bp, Artificial Sequence
  Description of Artificial Sequence: Synthetic oligonucleotide
caacccggcttctacggaagcagcc

SEQ ID NO: 172715 - DNA, 25 bp, Artificial Sequence
  Description of Artificial Sequence: Synthetic oligonucleotide
aacccggcttctacggaagcagccg

SEQ ID NO: 172716 - DNA, 24 bp, Artificial Sequence
  Description of Artificial Sequence: Synthetic oligonucleotide
acccggcttctacggaagcagccg

SEQ ID NO: 172717 - DNA, 26 bp, Artificial Sequence
  Description of Artificial Sequence: Synthetic oligonucleotide
caccaaggtgctctcccccgagtact

SEQ ID NO: 172718 - DNA, 26 bp, Artificial Sequence
  Description of Artificial Sequence: Synthetic oligonucleotide
accaaggtgctctcccccgagtactg

SEQ ID NO: 172719 - DNA, 25 bp, Artificial Sequence
  Description of Artificial Sequence: Synthetic oligonucleotide
ccaaggtgctctcccccgagtactg

SEQ ID NO: 172720 - DNA, 26 bp, Artificial Sequence
  Description of Artificial Sequence: Synthetic oligonucleotide
caaggtgctctcccccgagtactggt

SEQ ID NO: 172721 - DNA, 26 bp, Artificial Sequence
  Description of Artificial Sequence: Synthetic oligonucleotide
aaggtgctctcccccgagtactggtg

SEQ ID NO: 172722 - DNA, 25 bp, Artificial Sequence
  Description of Artificial Sequence: Synthetic oligonucleotide
aggtgctctcccccgagtactggtg

SEQ ID NO: 172723 - DNA, 24 bp, Artificial Sequence
  Description of Artificial Sequence: Synthetic oligonucleotide
ggtgctctcccccgagtactggtg

SEQ ID NO: 172724 - DNA, 24 bp, Artificial Sequence
  Description of Artificial Sequence: Synthetic oligonucleotide
gtgctctcccccgagtactggtgg

SEQ ID NO: 172725 - DNA, 25 bp, Artificial Sequence
  Description of Artificial Sequence: Synthetic oligonucleotide
tgctctcccccgagtactggtggga

SEQ ID NO: 172726 - DNA, 24 bp, Artificial Sequence
  Description of Artificial Sequence: Synthetic oligonucleotide
gctctcccccgagtactggtggga

SEQ ID NO: 172727 - DNA, 24 bp, Artificial Sequence
  Description of Artificial Sequence: Synthetic oligonucleotide
ctctcccccgagtactggtgggac

SEQ ID NO: 172728 - DNA, 25 bp, Artificial Sequence
  Description of Artificial Sequence: Synthetic oligonucleotide
tctcccccgagtactggtgggacca

SEQ ID NO: 172729 - DNA, 24 bp, Artificial Sequence
  Description of Artificial Sequence: Synthetic oligonucleotide
ctcccccgagtactggtgggacca

SEQ ID NO: 172730 - DNA, 24 bp, Artificial Sequence
  Description of Artificial Sequence: Synthetic oligonucleotide
tcccccgagtactggtgggaccag

SEQ ID NO: 172731 - DNA, 23 bp, Artificial Sequence
  Description of Artificial Sequence: Synthetic oligonucleotide
cccccgagtactggtgggaccag

SEQ ID NO: 172732 - DNA, 24 bp, Artificial Sequence
  Description of Artificial Sequence: Synthetic oligonucleotide
ccccgagtactggtgggaccagca

SEQ ID NO: 172733 - DNA, 24 bp, Artificial Sequence
  Description of Artificial Sequence: Synthetic oligonucleotide
cccgagtactggtgggaccagcag

SEQ ID NO: 172734 - DNA, 25 bp, Artificial Sequence
  Description of Artificial Sequence: Synthetic oligonucleotide
ccgagtactggtgggaccagcagct

SEQ ID NO: 172735 - DNA, 25 bp, Artificial Sequence
  Description of Artificial Sequence: Synthetic oligonucleotide
cgagtactggtgggaccagcagctg

SEQ ID NO: 172736 - DNA, 26 bp, Artificial Sequence
  Description of Artificial Sequence: Synthetic oligonucleotide
gagtactggtgggaccagcagctgct

SEQ ID NO: 172737 - DNA, 26 bp, Artificial Sequence
  Description of Artificial Sequence: Synthetic oligonucleotide
agtactggtgggaccagcagctgctg

SEQ ID NO: 172738 - DNA, 25 bp, Artificial Sequence
  Description of Artificial Sequence: Synthetic oligonucleotide
gtactggtgggaccagcagctgctg

SEQ ID NO: 172739 - DNA, 25 bp, Artificial Sequence
  Description of Artificial Sequence: Synthetic oligonucleotide
tactggtgggaccagcagctgctgg

SEQ ID NO: 172740 - DNA, 24 bp, Artificial Sequence
  Description of Artificial Sequence: Synthetic oligonucleotide
actggtgggaccagcagctgctgg

SEQ ID NO: 172741 - DNA, 23 bp, Artificial Sequence
  Description of Artificial Sequence: Synthetic oligonucleotide
ctggtgggaccagcagctgctgg

SEQ ID NO: 172742 - DNA, 23 bp, Artificial Sequence
  Description of Artificial Sequence: Synthetic oligonucleotide
tggtgggaccagcagctgctggg

SEQ ID NO: 172743 - DNA, 22 bp, Artificial Sequence
  Description of Artificial Sequence: Synthetic oligonucleotide
ggtgggaccagcagctgctggg

SEQ ID NO: 172744 - DNA, 23 bp, Artificial Sequence
  Description of Artificial Sequence: Synthetic oligonucleotide
cgtgtggcacgacgagagccacc

SEQ ID NO: 172745 - DNA, 23 bp, Artificial Sequence
  Description of Artificial Sequence: Synthetic oligonucleotide
gtgtggcacgacgagagccaccg

SEQ ID NO: 172746 - DNA, 25 bp, Artificial Sequence
  Description of Artificial Sequence: Synthetic oligonucleotide
tgtggcacgacgagagccaccggaa

SEQ ID NO: 172747 - DNA, 24 bp, Artificial Sequence
  Description of Artificial Sequence: Synthetic oligonucleotide
gtggcacgacgagagccaccggaa

SEQ ID NO: 172748 - DNA, 26 bp, Artificial Sequence
  Description of Artificial Sequence: Synthetic oligonucleotide
tggcacgacgagagccaccggaacaa

SEQ ID NO: 172749 - DNA, 25 bp, Artificial Sequence
  Description of Artificial Sequence: Synthetic oligonucleotide
ggcacgacgagagccaccggaacaa

SEQ ID NO: 172750 - DNA, 27 bp, Artificial Sequence
  Description of Artificial Sequence: Synthetic oligonucleotide
gcacgacgagagccaccggaacaagta

SEQ ID NO: 172751 - DNA, 27 bp, Artificial Sequence
  Description of Artificial Sequence: Synthetic oligonucleotide
cacgacgagagccaccggaacaagtac

SEQ ID NO: 172752 - DNA, 27 bp, Artificial Sequence
  Description of Artificial Sequence: Synthetic oligonucleotide
acgacgagagccaccggaacaagtacc

SEQ ID NO: 172753 - DNA, 27 bp, Artificial Sequence
  Description of Artificial Sequence: Synthetic oligonucleotide
cgacgagagccaccggaacaagtacct

SEQ ID NO: 172754 - DNA, 27 bp, Artificial Sequence
  Description of Artificial Sequence: Synthetic oligonucleotide
gacgagagccaccggaacaagtacctg

SEQ ID NO: 172755 - DNA, 27 bp, Artificial Sequence
  Description of Artificial Sequence: Synthetic oligonucleotide
acgagagccaccggaacaagtacctgc

SEQ ID NO: 172756 - DNA, 27 bp, Artificial Sequence
  Description of Artificial Sequence: Synthetic oligonucleotide
cgagagccaccggaacaagtacctgct

SEQ ID NO: 172757 - DNA, 27 bp, Artificial Sequence
  Description of Artificial Sequence: Synthetic oligonucleotide
gagagccaccggaacaagtacctgctg

SEQ ID NO: 172758 - DNA, 27 bp, Artificial Sequence
  Description of Artificial Sequence: Synthetic oligonucleotide
agagccaccggaacaagtacctgctgc

SEQ ID NO: 172759 - DNA, 26 bp, Artificial Sequence
  Description of Artificial Sequence: Synthetic oligonucleotide
gagccaccggaacaagtacctgctgc

SEQ ID NO: 172760 - DNA, 26 bp, Artificial Sequence
  Description of Artificial Sequence: Synthetic oligonucleotide
agccaccggaacaagtacctgctgcg

SEQ ID NO: 172761 - DNA, 25 bp, Artificial Sequence
  Description of Artificial Sequence: Synthetic oligonucleotide
gccaccggaacaagtacctgctgcg

SEQ ID NO: 172762 - DNA, 25 bp, Artificial Sequence
  Description of Artificial Sequence: Synthetic oligonucleotide
ccaccggaacaagtacctgctgcgc

SEQ ID NO: 172763 - DNA, 26 bp, Artificial Sequence
  Description of Artificial Sequence: Synthetic oligonucleotide
caccggaacaagtacctgctgcgcca

SEQ ID NO: 172764 - DNA, 27 bp, Artificial Sequence
  Description of Artificial Sequence: Synthetic oligonucleotide
accggaacaagtacctgctgcgccaca

SEQ ID NO: 172765 - DNA, 27 bp, Artificial Sequence
  Description of Artificial Sequence: Synthetic oligonucleotide
ccggaacaagtacctgctgcgccacaa

SEQ ID NO: 172766 - DNA, 28 bp, Artificial Sequence
  Description of Artificial Sequence: Synthetic oligonucleotide
cggaacaagtacctgctgcgccacaaac

SEQ ID NO: 172767 - DNA, 28 bp, Artificial Sequence
  Description of Artificial Sequence: Synthetic oligonucleotide
ggaacaagtacctgctgcgccacaaacc

SEQ ID NO: 172768 - DNA, 25 bp, Artificial Sequence
  Description of Artificial Sequence: Synthetic oligonucleotide
atcctgactccgctgttcggcaccc

SEQ ID NO: 172769 - DNA, 24 bp, Artificial Sequence
  Description of Artificial Sequence: Synthetic oligonucleotide
tcctgactccgctgttcggcaccc

SEQ ID NO: 172770 - DNA, 23 bp, Artificial Sequence
  Description of Artificial Sequence: Synthetic oligonucleotide
cctgactccgctgttcggcaccc

SEQ ID NO: 172771 - DNA, 23 bp, Artificial Sequence
  Description of Artificial Sequence: Synthetic oligonucleotide
ctgactccgctgttcggcacccc

SEQ ID NO: 172772 - DNA, 23 bp, Artificial Sequence
  Description of Artificial Sequence: Synthetic oligonucleotide
tgactccgctgttcggcaccccg

SEQ ID NO: 172773 - DNA, 22 bp, Artificial Sequence
  Description of Artificial Sequence: Synthetic oligonucleotide
gactccgctgttcggcaccccg

SEQ ID NO: 172774 - DNA, 23 bp, Artificial Sequence
  Description of Artificial Sequence: Synthetic oligonucleotide
actccgctgttcggcaccccgca

SEQ ID NO: 172775 - DNA, 22 bp, Artificial Sequence
  Description of Artificial Sequence: Synthetic oligonucleotide
ctccgctgttcggcaccccgca

SEQ ID NO: 172776 - DNA, 22 bp, Artificial Sequence
  Description of Artificial Sequence: Synthetic oligonucleotide
tccgctgttcggcaccccgcac

SEQ ID NO: 172777 - DNA, 21 bp, Artificial Sequence
  Description of Artificial Sequence: Synthetic oligonucleotide
ccgctgttcggcaccccgcac

SEQ ID NO: 172778 - DNA, 21 bp, Artificial Sequence
  Description of Artificial Sequence: Synthetic oligonucleotide
cgctgttcggcaccccgcacc

SEQ ID NO: 172779 - DNA, 21 bp, Artificial Sequence
  Description of Artificial Sequence: Synthetic oligonucleotide
gctgttcggcaccccgcaccc

SEQ ID NO: 172780 - DNA, 22 bp, Artificial Sequence
  Description of Artificial Sequence: Synthetic oligonucleotide
ctgttcggcaccccgcacccca

SEQ ID NO: 172781 - DNA, 22 bp, Artificial Sequence
  Description of Artificial Sequence: Synthetic oligonucleotide
tgttcggcaccccgcaccccag

SEQ ID NO: 172782 - DNA, 21 bp, Artificial Sequence
  Description of Artificial Sequence: Synthetic oligonucleotide
gttcggcaccccgcaccccag

SEQ ID NO: 172783 - DNA, 23 bp, Artificial Sequence
  Description of Artificial Sequence: Synthetic oligonucleotide
ttcggcaccccgcaccccagctt

SEQ ID NO: 172784 - DNA, 22 bp, Artificial Sequence
  Description of Artificial Sequence: Synthetic oligonucleotide
tcggcaccccgcaccccagctt

SEQ ID NO: 172785 - DNA, 21 bp, Artificial Sequence
  Description of Artificial Sequence: Synthetic oligonucleotide
cggcaccccgcaccccagctt

SEQ ID NO: 172786 - DNA, 23 bp, Artificial Sequence
  Description of Artificial Sequence: Synthetic oligonucleotide
ggcaccccgcaccccagcttcta

SEQ ID NO: 172787 - DNA, 23 bp, Artificial Sequence
  Description of Artificial Sequence: Synthetic oligonucleotide
gcaccccgcaccccagcttctac

SEQ ID NO: 172788 - DNA, 23 bp, Artificial Sequence
  Description of Artificial Sequence: Synthetic oligonucleotide
caccccgcaccccagcttctacg

SEQ ID NO: 172789 - DNA, 25 bp, Artificial Sequence
  Description of Artificial Sequence: Synthetic oligonucleotide
accccgcaccccagcttctacggaa

SEQ ID NO: 172790 - DNA, 24 bp, Artificial Sequence
  Description of Artificial Sequence: Synthetic oligonucleotide
ccccgcaccccagcttctacggaa

SEQ ID NO: 172791 - DNA, 24 bp, Artificial Sequence
  Description of Artificial Sequence: Synthetic oligonucleotide
cccgcaccccagcttctacggaag

SEQ ID NO: 172792 - DNA, 25 bp, Artificial Sequence
  Description of Artificial Sequence: Synthetic oligonucleotide
ccgcaccccagcttctacggaagca

SEQ ID NO: 172793 - DNA, 25 bp, Artificial Sequence
  Description of Artificial Sequence: Synthetic oligonucleotide
cgcaccccagcttctacggaagcag

SEQ ID NO: 172794 - DNA, 25 bp, Artificial Sequence
  Description of Artificial Sequence: Synthetic oligonucleotide
tgggcgcctacaagcgctggcagaa

SEQ ID NO: 172795 - DNA, 24 bp, Artificial Sequence
  Description of Artificial Sequence: Synthetic oligonucleotide
gggcgcctacaagcgctggcagaa

SEQ ID NO: 172796 - DNA, 24 bp, Artificial Sequence
  Description of Artificial Sequence: Synthetic oligonucleotide
ggcgcctacaagcgctggcagaac

SEQ ID NO: 172797 - DNA, 25 bp, Artificial Sequence
  Description of Artificial Sequence: Synthetic oligonucleotide
gcgcctacaagcgctggcagaacgt

SEQ ID NO: 172798 - DNA, 26 bp, Artificial Sequence
  Description of Artificial Sequence: Synthetic oligonucleotide
cgcctacaagcgctggcagaacgtgt

SEQ ID NO: 172799 - DNA, 26 bp, Artificial Sequence
  Description of Artificial Sequence: Synthetic oligonucleotide
gcctacaagcgctggcagaacgtgtc

SEQ ID NO: 172800 - DNA, 27 bp, Artificial Sequence
  Description of Artificial Sequence: Synthetic oligonucleotide
cctacaagcgctggcagaacgtgtcca

SEQ ID NO: 172801 - DNA, 28 bp, Artificial Sequence
  Description of Artificial Sequence: Synthetic oligonucleotide
ctacaagcgctggcagaacgtgtccatg

SEQ ID NO: 172802 - DNA, 28 bp, Artificial Sequence
  Description of Artificial Sequence: Synthetic oligonucleotide
tacaagcgctggcagaacgtgtccatgc

SEQ ID NO: 172803 - DNA, 27 bp, Artificial Sequence
  Description of Artificial Sequence: Synthetic oligonucleotide
acaagcgctggcagaacgtgtccatgc

SEQ ID NO: 172804 - DNA, 26 bp, Artificial Sequence
  Description of Artificial Sequence: Synthetic oligonucleotide
caagcgctggcagaacgtgtccatgc

SEQ ID NO: 172805 - DNA, 26 bp, Artificial Sequence
  Description of Artificial Sequence: Synthetic oligonucleotide
aagcgctggcagaacgtgtccatgcg

SEQ ID NO: 172806 - DNA, 25 bp, Artificial Sequence
  Description of Artificial Sequence: Synthetic oligonucleotide
agcgctggcagaacgtgtccatgcg

SEQ ID NO: 172807 - DNA, 24 bp, Artificial Sequence
  Description of Artificial Sequence: Synthetic oligonucleotide
gcgctggcagaacgtgtccatgcg

SEQ ID NO: 172808 - DNA, 24 bp, Artificial Sequence
  Description of Artificial Sequence: Synthetic oligonucleotide
cgctggcagaacgtgtccatgcgc

SEQ ID NO: 172809 - DNA, 24 bp, Artificial Sequence
  Description of Artificial Sequence: Synthetic oligonucleotide
gctggcagaacgtgtccatgcgcc

SEQ ID NO: 172810 - DNA, 24 bp, Artificial Sequence
  Description of Artificial Sequence: Synthetic oligonucleotide
ctggcagaacgtgtccatgcgccg

SEQ ID NO: 172811 - DNA, 26 bp, Artificial Sequence
  Description of Artificial Sequence: Synthetic oligonucleotide
tggcagaacgtgtccatgcgccgcat

SEQ ID NO: 172812 - DNA, 25 bp, Artificial Sequence
  Description of Artificial Sequence: Synthetic oligonucleotide
ggcagaacgtgtccatgcgccgcat

SEQ ID NO: 172813 - DNA, 25 bp, Artificial Sequence
  Description of Artificial Sequence: Synthetic oligonucleotide
gcagaacgtgtccatgcgccgcatg

SEQ ID NO: 172814 - DNA, 26 bp, Artificial Sequence
  Description of Artificial Sequence: Synthetic oligonucleotide
cagaacgtgtccatgcgccgcatgga

SEQ ID NO: 172815 - DNA, 27 bp, Artificial Sequence
  Description of Artificial Sequence: Synthetic oligonucleotide
agaacgtgtccatgcgccgcatggaga

SEQ ID NO: 172816 - DNA, 27 bp, Artificial Sequence
  Description of Artificial Sequence: Synthetic oligonucleotide
gaacgtgtccatgcgccgcatggagat

SEQ ID NO: 172817 - DNA, 27 bp, Artificial Sequence
  Description of Artificial Sequence: Synthetic oligonucleotide
aacgtgtccatgcgccgcatggagatg

SEQ ID NO: 172818 - DNA, 27 bp, Artificial Sequence
  Description of Artificial Sequence: Synthetic oligonucleotide
acatggagttccgcgaccatgtgggca

SEQ ID NO: 172819 - DNA, 27 bp, Artificial Sequence
  Description of Artificial Sequence: Synthetic oligonucleotide
catggagttccgcgaccatgtgggcat

SEQ ID NO: 172820 - DNA, 27 bp, Artificial Sequence
  Description of Artificial Sequence: Synthetic oligonucleotide
atggagttccgcgaccatgtgggcatg

SEQ ID NO: 172821 - DNA, 26 bp, Artificial Sequence
  Description of Artificial Sequence: Synthetic oligonucleotide
tggagttccgcgaccatgtgggcatg

SEQ ID NO: 172822 - DNA, 25 bp, Artificial Sequence
  Description of Artificial Sequence: Synthetic oligonucleotide
ggagttccgcgaccatgtgggcatg

SEQ ID NO: 172823 - DNA, 26 bp, Artificial Sequence
  Description of Artificial Sequence: Synthetic oligonucleotide
gagttccgcgaccatgtgggcatgga

SEQ ID NO: 172824 - DNA, 27 bp, Artificial Sequence
  Description of Artificial Sequence: Synthetic oligonucleotide
agttccgcgaccatgtgggcatggaga

SEQ ID NO: 172825 - DNA, 27 bp, Artificial Sequence
  Description of Artificial Sequence: Synthetic oligonucleotide
gttccgcgaccatgtgggcatggagat

SEQ ID NO: 172826 - DNA, 27 bp, Artificial Sequence
  Description of Artificial Sequence: Synthetic oligonucleotide
ttccgcgaccatgtgggcatggagatc

SEQ ID NO: 172827 - DNA, 26 bp, Artificial Sequence
  Description of Artificial Sequence: Synthetic oligonucleotide
tccgcgaccatgtgggcatggagatc

SEQ ID NO: 172828 - DNA, 25 bp, Artificial Sequence
  Description of Artificial Sequence: Synthetic oligonucleotide
ccgcgaccatgtgggcatggagatc

SEQ ID NO: 172829 - DNA, 26 bp, Artificial Sequence
  Description of Artificial Sequence: Synthetic oligonucleotide
cgcgaccatgtgggcatggagatcct

SEQ ID NO: 172830 - DNA, 27 bp, Artificial Sequence
  Description of Artificial Sequence: Synthetic oligonucleotide
gcgaccatgtgggcatggagatcctga

SEQ ID NO: 172831 - DNA, 27 bp, Artificial Sequence
  Description of Artificial Sequence: Synthetic oligonucleotide
cgaccatgtgggcatggagatcctgac

SEQ ID NO: 172832 - DNA, 28 bp, Artificial Sequence
  Description of Artificial Sequence: Synthetic oligonucleotide
gaccatgtgggcatggagatcctgactc

SEQ ID NO: 172833 - DNA, 28 bp, Artificial Sequence
  Description of Artificial Sequence: Synthetic oligonucleotide
accatgtgggcatggagatcctgactcc

SEQ ID NO: 172834 - DNA, 27 bp, Artificial Sequence
  Description of Artificial Sequence: Synthetic oligonucleotide
ccatgtgggcatggagatcctgactcc

SEQ ID NO: 172835 - DNA, 27 bp, Artificial Sequence
  Description of Artificial Sequence: Synthetic oligonucleotide
catgtgggcatggagatcctgactccg

SEQ ID NO: 172836 - DNA, 27 bp, Artificial Sequence
  Description of Artificial Sequence: Synthetic oligonucleotide
atgtgggcatggagatcctgactccgc

SEQ ID NO: 172837 - DNA, 27 bp, Artificial Sequence
  Description of Artificial Sequence: Synthetic oligonucleotide
tgtgggcatggagatcctgactccgct

SEQ ID NO: 172838 - DNA, 29 bp, Artificial Sequence
  Description of Artificial Sequence: Synthetic oligonucleotide
ttagggaacctgaccatctgcagcgcatc

SEQ ID NO: 172839 - DNA, 28 bp, Artificial Sequence
  Description of Artificial Sequence: Synthetic oligonucleotide
tagggaacctgaccatctgcagcgcatc

SEQ ID NO: 172840 - DNA, 27 bp, Artificial Sequence
  Description of Artificial Sequence: Synthetic oligonucleotide
agggaacctgaccatctgcagcgcatc

SEQ ID NO: 172841 - DNA, 27 bp, Artificial Sequence
  Description of Artificial Sequence: Synthetic oligonucleotide
gggaacctgaccatctgcagcgcatct

SEQ ID NO: 172842 - DNA, 27 bp, Artificial Sequence
  Description of Artificial Sequence: Synthetic oligonucleotide
ggaacctgaccatctgcagcgcatctc

SEQ ID NO: 172843 - DNA, 27 bp, Artificial Sequence
  Description of Artificial Sequence: Synthetic oligonucleotide
gaacctgaccatctgcagcgcatctcg

SEQ ID NO: 172844 - DNA, 29 bp, Artificial Sequence
  Description of Artificial Sequence: Synthetic oligonucleotide
aacctgaccatctgcagcgcatctcgttg

SEQ ID NO: 172845 - DNA, 28 bp, Artificial Sequence
  Description of Artificial Sequence: Synthetic oligonucleotide
acctgaccatctgcagcgcatctcgttg

SEQ ID NO: 172846 - DNA, 27 bp, Artificial Sequence
  Description of Artificial Sequence: Synthetic oligonucleotide
cctgaccatctgcagcgcatctcgttg

SEQ ID NO: 172847 - DNA, 27 bp, Artificial Sequence
  Description of Artificial Sequence: Synthetic oligonucleotide
ctgaccatctgcagcgcatctcgttgc

SEQ ID NO: 172848 - DNA, 27 bp, Artificial Sequence
  Description of Artificial Sequence: Synthetic oligonucleotide
tgaccatctgcagcgcatctcgttgcc

SEQ ID NO: 172849 - DNA, 27 bp, Artificial Sequence
  Description of Artificial Sequence: Synthetic oligonucleotide
gaccatctgcagcgcatctcgttgcca

SEQ ID NO: 172850 - DNA, 28 bp, Artificial Sequence
  Description of Artificial Sequence: Synthetic oligonucleotide
accatctgcagcgcatctcgttgccaag

SEQ ID NO: 172851 - DNA, 43 bp, Artificial Sequence
  Description of Artificial Sequence: Synthetic oligonucleotide
tatgatccttttcctaataatgcttgtcttggtcttgtttggc

SEQ ID NO: 172852 - DNA, 42 bp, Artificial Sequence
  Description of Artificial Sequence: Synthetic oligonucleotide
atgatccttttcctaataatgcttgtcttggtcttgtttggc

SEQ ID NO: 172853 - DNA, 41 bp, Artificial Sequence
  Description of Artificial Sequence: Synthetic oligonucleotide
tgatccttttcctaataatgcttgtcttggtcttgtttggc

SEQ ID NO: 172854 - DNA, 40 bp, Artificial Sequence
  Description of Artificial Sequence: Synthetic oligonucleotide
gatccttttcctaataatgcttgtcttggtcttgtttggc

SEQ ID NO: 172855 - DNA, 42 bp, Artificial Sequence
  Description of Artificial Sequence: Synthetic oligonucleotide
atccttttcctaataatgcttgtcttggtcttgtttggcatg

SEQ ID NO: 172856 - DNA, 41 bp, Artificial Sequence
  Description of Artificial Sequence: Synthetic oligonucleotide
tccttttcctaataatgcttgtcttggtcttgtttggcatg

SEQ ID NO: 172857 - DNA, 40 bp, Artificial Sequence
  Description of Artificial Sequence: Synthetic oligonucleotide
ccttttcctaataatgcttgtcttggtcttgtttggcatg

SEQ ID NO: 172858 - DNA, 40 bp, Artificial Sequence
  Description of Artificial Sequence: Synthetic oligonucleotide
cttttcctaataatgcttgtcttggtcttgtttggcatgg

SEQ ID NO: 172859 - DNA, 40 bp, Artificial Sequence
  Description of Artificial Sequence: Synthetic oligonucleotide
ttttcctaataatgcttgtcttggtcttgtttggcatggc

SEQ ID NO: 172860 - DNA, 39 bp, Artificial Sequence
  Description of Artificial Sequence: Synthetic oligonucleotide
tttcctaataatgcttgtcttggtcttgtttggcatggc

SEQ ID NO: 172861 - DNA, 38 bp, Artificial Sequence
  Description of Artificial Sequence: Synthetic oligonucleotide
ttcctaataatgcttgtcttggtcttgtttggcatggc

SEQ ID NO: 172862 - DNA, 37 bp, Artificial Sequence
  Description of Artificial Sequence: Synthetic oligonucleotide
tcctaataatgcttgtcttggtcttgtttggcatggc

SEQ ID NO: 172863 - DNA, 36 bp, Artificial Sequence
  Description of Artificial Sequence: Synthetic oligonucleotide
cctaataatgcttgtcttggtcttgtttggcatggc

SEQ ID NO: 172864 - DNA, 37 bp, Artificial Sequence
  Description of Artificial Sequence: Synthetic oligonucleotide
ctaataatgcttgtcttggtcttgtttggcatggctg

SEQ ID NO: 172865 - DNA, 40 bp, Artificial Sequence
  Description of Artificial Sequence: Synthetic oligonucleotide
taataatgcttgtcttggtcttgtttggcatggctgttag

SEQ ID NO: 172866 - DNA, 39 bp, Artificial Sequence
  Description of Artificial Sequence: Synthetic oligonucleotide
aataatgcttgtcttggtcttgtttggcatggctgttag

SEQ ID NO: 172867 - DNA, 38 bp, Artificial Sequence
  Description of Artificial Sequence: Synthetic oligonucleotide
ataatgcttgtcttggtcttgtttggcatggctgttag

SEQ ID NO: 172868 - DNA, 37 bp, Artificial Sequence
  Description of Artificial Sequence: Synthetic oligonucleotide
taatgcttgtcttggtcttgtttggcatggctgttag

SEQ ID NO: 172869 - DNA, 36 bp, Artificial Sequence
  Description of Artificial Sequence: Synthetic oligonucleotide
aatgcttgtcttggtcttgtttggcatggctgttag

SEQ ID NO: 172870 - DNA, 35 bp, Artificial Sequence
  Description of Artificial Sequence: Synthetic oligonucleotide
atgcttgtcttggtcttgtttggcatggctgttag

SEQ ID NO: 172871 - DNA, 34 bp, Artificial Sequence
  Description of Artificial Sequence: Synthetic oligonucleotide
tgcttgtcttggtcttgtttggcatggctgttag

SEQ ID NO: 172872 - DNA, 33 bp, Artificial Sequence
  Description of Artificial Sequence: Synthetic oligonucleotide
gcttgtcttggtcttgtttggcatggctgttag

SEQ ID NO: 172873 - DNA, 33 bp, Artificial Sequence
  Description of Artificial Sequence: Synthetic oligonucleotide
cttgtcttggtcttgtttggcatggctgttagg

SEQ ID NO: 172874 - DNA, 33 bp, Artificial Sequence
  Description of Artificial Sequence: Synthetic oligonucleotide
ttgtcttggtcttgtttggcatggctgttaggg

SEQ ID NO: 172875 - DNA, 32 bp, Artificial Sequence
  Description of Artificial Sequence: Synthetic oligonucleotide
tgtcttggtcttgtttggcatggctgttaggg

SEQ ID NO: 172876 - DNA, 31 bp, Artificial Sequence
  Description of Artificial Sequence: Synthetic oligonucleotide
gtcttggtcttgtttggcatggctgttaggg

SEQ ID NO: 172877 - DNA, 33 bp, Artificial Sequence
  Description of Artificial Sequence: Synthetic oligonucleotide
tcttggtcttgtttggcatggctgttagggaac

SEQ ID NO: 172878 - DNA, 32 bp, Artificial Sequence
  Description of Artificial Sequence: Synthetic oligonucleotide
cttggtcttgtttggcatggctgttagggaac

SEQ ID NO: 172879 - DNA, 32 bp, Artificial Sequence
  Description of Artificial Sequence: Synthetic oligonucleotide
ttggtcttgtttggcatggctgttagggaacc

SEQ ID NO: 172880 - DNA, 31 bp, Artificial Sequence
  Description of Artificial Sequence: Synthetic oligonucleotide
tggtcttgtttggcatggctgttagggaacc

SEQ ID NO: 172881 - DNA, 30 bp, Artificial Sequence
  Description of Artificial Sequence: Synthetic oligonucleotide
ggtcttgtttggcatggctgttagggaacc

SEQ ID NO: 172882 - DNA, 31 bp, Artificial Sequence
  Description of Artificial Sequence: Synthetic oligonucleotide
gtcttgtttggcatggctgttagggaacctg

SEQ ID NO: 172883 - DNA, 32 bp, Artificial Sequence
  Description of Artificial Sequence: Synthetic oligonucleotide
tcttgtttggcatggctgttagggaacctgac

SEQ ID NO: 172884 - DNA, 31 bp, Artificial Sequence
  Description of Artificial Sequence: Synthetic oligonucleotide
cttgtttggcatggctgttagggaacctgac

SEQ ID NO: 172885 - DNA, 31 bp, Artificial Sequence
  Description of Artificial Sequence: Synthetic oligonucleotide
ttgtttggcatggctgttagggaacctgacc

SEQ ID NO: 172886 - DNA, 30 bp, Artificial Sequence
  Description of Artificial Sequence: Synthetic oligonucleotide
tgtttggcatggctgttagggaacctgacc

SEQ ID NO: 172887 - DNA, 29 bp, Artificial Sequence
  Description of Artificial Sequence: Synthetic oligonucleotide
gtttggcatggctgttagggaacctgacc

SEQ ID NO: 172888 - DNA, 31 bp, Artificial Sequence
  Description of Artificial Sequence: Synthetic oligonucleotide
tttggcatggctgttagggaacctgaccatc

SEQ ID NO: 172889 - DNA, 30 bp, Artificial Sequence
  Description of Artificial Sequence: Synthetic oligonucleotide
ttggcatggctgttagggaacctgaccatc

SEQ ID NO: 172890 - DNA, 29 bp, Artificial Sequence
  Description of Artificial Sequence: Synthetic oligonucleotide
tggcatggctgttagggaacctgaccatc

SEQ ID NO: 172891 - DNA, 28 bp, Artificial Sequence
  Description of Artificial Sequence: Synthetic oligonucleotide
ggcatggctgttagggaacctgaccatc

SEQ ID NO: 172892 - DNA, 29 bp, Artificial Sequence
  Description of Artificial Sequence: Synthetic oligonucleotide
ctgttagggaacctgaccatctgcagcac

SEQ ID NO: 172893 - DNA, 29 bp, Artificial Sequence
  Description of Artificial Sequence: Synthetic oligonucleotide
tgttagggaacctgaccatctgcagcacg

SEQ ID NO: 172894 - DNA, 28 bp, Artificial Sequence
  Description of Artificial Sequence: Synthetic oligonucleotide
gttagggaacctgaccatctgcagcacg

SEQ ID NO: 172895 - DNA, 29 bp, Artificial Sequence
  Description of Artificial Sequence: Synthetic oligonucleotide
ttagggaacctgaccatctgcagcacgtc

SEQ ID NO: 172896 - DNA, 28 bp, Artificial Sequence
  Description of Artificial Sequence: Synthetic oligonucleotide
tagggaacctgaccatctgcagcacgtc

SEQ ID NO: 172897 - DNA, 27 bp, Artificial Sequence
  Description of Artificial Sequence: Synthetic oligonucleotide
agggaacctgaccatctgcagcacgtc

SEQ ID NO: 172898 - DNA, 27 bp, Artificial Sequence
  Description of Artificial Sequence: Synthetic oligonucleotide
gggaacctgaccatctgcagcacgtct

SEQ ID NO: 172899 - DNA, 27 bp, Artificial Sequence
  Description of Artificial Sequence: Synthetic oligonucleotide
ggaacctgaccatctgcagcacgtctc

SEQ ID NO: 172900 - DNA, 27 bp, Artificial Sequence
  Description of Artificial Sequence: Synthetic oligonucleotide
gaacctgaccatctgcagcacgtctcg

SEQ ID NO: 172901 - DNA, 29 bp, Artificial Sequence
  Description of Artificial Sequence: Synthetic oligonucleotide
aacctgaccatctgcagcacgtctcgttg

SEQ ID NO: 172902 - DNA, 28 bp, Artificial Sequence
  Description of Artificial Sequence: Synthetic oligonucleotide
acctgaccatctgcagcacgtctcgttg

SEQ ID NO: 172903 - DNA, 27 bp, Artificial Sequence
  Description of Artificial Sequence: Synthetic oligonucleotide
cctgaccatctgcagcacgtctcgttg

SEQ ID NO: 172904 - DNA, 27 bp, Artificial Sequence
  Description of Artificial Sequence: Synthetic oligonucleotide
ctgaccatctgcagcacgtctcgttgc

SEQ ID NO: 172905 - DNA, 27 bp, Artificial Sequence
  Description of Artificial Sequence: Synthetic oligonucleotide
tgaccatctgcagcacgtctcgttgcc

SEQ ID NO: 172906 - DNA, 27 bp, Artificial Sequence
  Description of Artificial Sequence: Synthetic oligonucleotide
gaccatctgcagcacgtctcgttgcca

SEQ ID NO: 172907 - DNA, 28 bp, Artificial Sequence
  Description of Artificial Sequence: Synthetic oligonucleotide
accatctgcagcacgtctcgttgccaag

SEQ ID NO: 172908 - DNA, 27 bp, Artificial Sequence
  Description of Artificial Sequence: Synthetic oligonucleotide
ggcgtggagatcctgactccgctgttt

SEQ ID NO: 172909 - DNA, 27 bp, Artificial Sequence
  Description of Artificial Sequence: Synthetic oligonucleotide
gcgtggagatcctgactccgctgtttg

SEQ ID NO: 172910 - DNA, 27 bp, Artificial Sequence
  Description of Artificial Sequence: Synthetic oligonucleotide
cgtggagatcctgactccgctgtttgg

SEQ ID NO: 172911 - DNA, 27 bp, Artificial Sequence
  Description of Artificial Sequence: Synthetic oligonucleotide
gtggagatcctgactccgctgtttggc

SEQ ID NO: 172912 - DNA, 28 bp, Artificial Sequence
  Description of Artificial Sequence: Synthetic oligonucleotide
tggagatcctgactccgctgtttggcac

SEQ ID NO: 172913 - DNA, 27 bp, Artificial Sequence
  Description of Artificial Sequence: Synthetic oligonucleotide
ggagatcctgactccgctgtttggcac

SEQ ID NO: 172914 - DNA, 27 bp, Artificial Sequence
  Description of Artificial Sequence: Synthetic oligonucleotide
gagatcctgactccgctgtttggcacc

SEQ ID NO: 172915 - DNA, 27 bp, Artificial Sequence
  Description of Artificial Sequence: Synthetic oligonucleotide
agatcctgactccgctgtttggcaccc

SEQ ID NO: 172916 - DNA, 27 bp, Artificial Sequence
  Description of Artificial Sequence: Synthetic oligonucleotide
gatcctgactccgctgtttggcaccct

SEQ ID NO: 172917 - DNA, 27 bp, Artificial Sequence
  Description of Artificial Sequence: Synthetic oligonucleotide
atcctgactccgctgtttggcaccctg

SEQ ID NO: 172918 - DNA, 26 bp, Artificial Sequence
  Description of Artificial Sequence: Synthetic oligonucleotide
tcctgactccgctgtttggcaccctg

SEQ ID NO: 172919 - DNA, 25 bp, Artificial Sequence
  Description of Artificial Sequence: Synthetic oligonucleotide
cctgactccgctgtttggcaccctg

SEQ ID NO: 172920 - DNA, 26 bp, Artificial Sequence
  Description of Artificial Sequence: Synthetic oligonucleotide
ctgactccgctgtttggcaccctgca

SEQ ID NO: 172921 - DNA, 26 bp, Artificial Sequence
  Description of Artificial Sequence: Synthetic oligonucleotide
tgactccgctgtttggcaccctgcac

SEQ ID NO: 172922 - DNA, 25 bp, Artificial Sequence
  Description of Artificial Sequence: Synthetic oligonucleotide
gactccgctgtttggcaccctgcac

SEQ ID NO: 172923 - DNA, 25 bp, Artificial Sequence
  Description of Artificial Sequence: Synthetic oligonucleotide
actccgctgtttggcaccctgcacc

SEQ ID NO: 172924 - DNA, 24 bp, Artificial Sequence
  Description of Artificial Sequence: Synthetic oligonucleotide
ctccgctgtttggcaccctgcacc

SEQ ID NO: 172925 - DNA, 24 bp, Artificial Sequence
  Description of Artificial Sequence: Synthetic oligonucleotide
tccgctgtttggcaccctgcaccc

SEQ ID NO: 172926 - DNA, 23 bp, Artificial Sequence
  Description of Artificial Sequence: Synthetic oligonucleotide
ccgctgtttggcaccctgcaccc

SEQ ID NO: 172927 - DNA, 23 bp, Artificial Sequence
  Description of Artificial Sequence: Synthetic oligonucleotide
cgctgtttggcaccctgcacccc

SEQ ID NO: 172928 - DNA, 23 bp, Artificial Sequence
  Description of Artificial Sequence: Synthetic oligonucleotide
gctgtttggcaccctgcaccccg

SEQ ID NO: 172929 - DNA, 23 bp, Artificial Sequence
  Description of Artificial Sequence: Synthetic oligonucleotide
ctgtttggcaccctgcaccccgg

SEQ ID NO: 172930 - DNA, 25 bp, Artificial Sequence
  Description of Artificial Sequence: Synthetic oligonucleotide
tgtttggcaccctgcaccccggctt

SEQ ID NO: 172931 - DNA, 24 bp, Artificial Sequence
  Description of Artificial Sequence: Synthetic oligonucleotide
gtttggcaccctgcaccccggctt

SEQ ID NO: 172932 - DNA, 26 bp, Artificial Sequence
  Description of Artificial Sequence: Synthetic oligonucleotide
tttggcaccctgcaccccggcttcta

SEQ ID NO: 172933 - DNA, 25 bp, Artificial Sequence
  Description of Artificial Sequence: Synthetic oligonucleotide
ttggcaccctgcaccccggcttcta

SEQ ID NO: 172934 - DNA, 24 bp, Artificial Sequence
  Description of Artificial Sequence: Synthetic oligonucleotide
tggcaccctgcaccccggcttcta

SEQ ID NO: 172935 - DNA, 28 bp, Artificial Sequence
  Description of Artificial Sequence: Synthetic oligonucleotide
gacgagggcgatttctactacctgggtg

SEQ ID NO: 172936 - DNA, 28 bp, Artificial Sequence
  Description of Artificial Sequence: Synthetic oligonucleotide
acgagggcgatttctactacctgggtgg

SEQ ID NO: 172937 - DNA, 27 bp, Artificial Sequence
  Description of Artificial Sequence: Synthetic oligonucleotide
cgagggcgatttctactacctgggtgg

SEQ ID NO: 172938 - DNA, 27 bp, Artificial Sequence
  Description of Artificial Sequence: Synthetic oligonucleotide
gagggcgatttctactacctgggtggg

SEQ ID NO: 172939 - DNA, 29 bp, Artificial Sequence
  Description of Artificial Sequence: Synthetic oligonucleotide
agggcgatttctactacctgggtgggttc

SEQ ID NO: 172940 - DNA, 28 bp, Artificial Sequence
  Description of Artificial Sequence: Synthetic oligonucleotide
gggcgatttctactacctgggtgggttc

SEQ ID NO: 172941 - DNA, 30 bp, Artificial Sequence
  Description of Artificial Sequence: Synthetic oligonucleotide
ggcgatttctactacctgggtgggttcttc

SEQ ID NO: 172942 - DNA, 30 bp, Artificial Sequence
  Description of Artificial Sequence: Synthetic oligonucleotide
gcgatttctactacctgggtgggttcttcg

SEQ ID NO: 172943 - DNA, 30 bp, Artificial Sequence
  Description of Artificial Sequence: Synthetic oligonucleotide
cgatttctactacctgggtgggttcttcgg

SEQ ID NO: 172944 - DNA, 30 bp, Artificial Sequence
  Description of Artificial Sequence: Synthetic oligonucleotide
gatttctactacctgggtgggttcttcggg

SEQ ID NO: 172945 - DNA, 30 bp, Artificial Sequence
  Description of Artificial Sequence: Synthetic oligonucleotide
atttctactacctgggtgggttcttcgggg

SEQ ID NO: 172946 - DNA, 29 bp, Artificial Sequence
  Description of Artificial Sequence: Synthetic oligonucleotide
tttctactacctgggtgggttcttcgggg

SEQ ID NO: 172947 - DNA, 28 bp, Artificial Sequence
  Description of Artificial Sequence: Synthetic oligonucleotide
ttctactacctgggtgggttcttcgggg

SEQ ID NO: 172948 - DNA, 27 bp, Artificial Sequence
  Description of Artificial Sequence: Synthetic oligonucleotide
tctactacctgggtgggttcttcgggg

SEQ ID NO: 172949 - DNA, 26 bp, Artificial Sequence
  Description of Artificial Sequence: Synthetic oligonucleotide
ctactacctgggtgggttcttcgggg

SEQ ID NO: 172950 - DNA, 26 bp, Artificial Sequence
  Description of Artificial Sequence: Synthetic oligonucleotide
tactacctgggtgggttcttcggggg

SEQ ID NO: 172951 - DNA, 25 bp, Artificial Sequence
  Description of Artificial Sequence: Synthetic oligonucleotide
actacctgggtgggttcttcggggg

SEQ ID NO: 172952 - DNA, 24 bp, Artificial Sequence
  Description of Artificial Sequence: Synthetic oligonucleotide
ctacctgggtgggttcttcggggg

SEQ ID NO: 172953 - DNA, 25 bp, Artificial Sequence
  Description of Artificial Sequence: Synthetic oligonucleotide
tacctgggtgggttcttcggggggt

SEQ ID NO: 172954 - DNA, 24 bp, Artificial Sequence
  Description of Artificial Sequence: Synthetic oligonucleotide
acctgggtgggttcttcggggggt

SEQ ID NO: 172955 - DNA, 23 bp, Artificial Sequence
  Description of Artificial Sequence: Synthetic oligonucleotide
cctgggtgggttcttcggggggt

SEQ ID NO: 172956 - DNA, 23 bp, Artificial Sequence
  Description of Artificial Sequence: Synthetic oligonucleotide
ctgggtgggttcttcggggggtc

SEQ ID NO: 172957 - DNA, 23 bp, Artificial Sequence
  Description of Artificial Sequence: Synthetic oligonucleotide
tgggtgggttcttcggggggtcg

SEQ ID NO: 172958 - DNA, 22 bp, Artificial Sequence
  Description of Artificial Sequence: Synthetic oligonucleotide
gggtgggttcttcggggggtcg

SEQ ID NO: 172959 - DNA, 23 bp, Artificial Sequence
  Description of Artificial Sequence: Synthetic oligonucleotide
ggtgggttcttcggggggtcggt

SEQ ID NO: 172960 - DNA, 23 bp, Artificial Sequence
  Description of Artificial Sequence: Synthetic oligonucleotide
gtgggttcttcggggggtcggtg

SEQ ID NO: 172961 - DNA, 25 bp, Artificial Sequence
  Description of Artificial Sequence: Synthetic oligonucleotide
tgggttcttcggggggtcggtgcaa

SEQ ID NO: 172962 - DNA, 27 bp, Artificial Sequence
  Description of Artificial Sequence: Synthetic oligonucleotide
ctctcccccgagtacttgtgggaccaa

SEQ ID NO: 172963 - DNA, 27 bp, Artificial Sequence
  Description of Artificial Sequence: Synthetic oligonucleotide
tctcccccgagtacttgtgggaccaac

SEQ ID NO: 172964 - DNA, 27 bp, Artificial Sequence
  Description of Artificial Sequence: Synthetic oligonucleotide
ctcccccgagtacttgtgggaccaaca

SEQ ID NO: 172965 - DNA, 27 bp, Artificial Sequence
  Description of Artificial Sequence: Synthetic oligonucleotide
tcccccgagtacttgtgggaccaacag

SEQ ID NO: 172966 - DNA, 26 bp, Artificial Sequence
  Description of Artificial Sequence: Synthetic oligonucleotide
cccccgagtacttgtgggaccaacag

SEQ ID NO: 172967 - DNA, 27 bp, Artificial Sequence
  Description of Artificial Sequence: Synthetic oligonucleotide
ccccgagtacttgtgggaccaacagct

SEQ ID NO: 172968 - DNA, 27 bp, Artificial Sequence
  Description of Artificial Sequence: Synthetic oligonucleotide
cccgagtacttgtgggaccaacagctg

SEQ ID NO: 172969 - DNA, 27 bp, Artificial Sequence
  Description of Artificial Sequence: Synthetic oligonucleotide
ccgagtacttgtgggaccaacagctgc

SEQ ID NO: 172970 - DNA, 28 bp, Artificial Sequence
  Description of Artificial Sequence: Synthetic oligonucleotide
cgagtacttgtgggaccaacagctgctg

SEQ ID NO: 172971 - DNA, 28 bp, Artificial Sequence
  Description of Artificial Sequence: Synthetic oligonucleotide
gagtacttgtgggaccaacagctgctgg

SEQ ID NO: 172972 - DNA, 28 bp, Artificial Sequence
  Description of Artificial Sequence: Synthetic oligonucleotide
agtacttgtgggaccaacagctgctggg

SEQ ID NO: 172973 - DNA, 27 bp, Artificial Sequence
  Description of Artificial Sequence: Synthetic oligonucleotide
gtacttgtgggaccaacagctgctggg

SEQ ID NO: 172974 - DNA, 27 bp, Artificial Sequence
  Description of Artificial Sequence: Synthetic oligonucleotide
tacttgtgggaccaacagctgctgggc

SEQ ID NO: 172975 - DNA, 27 bp, Artificial Sequence
  Description of Artificial Sequence: Synthetic oligonucleotide
acttgtgggaccaacagctgctgggct

SEQ ID NO: 172976 - DNA, 26 bp, Artificial Sequence
  Description of Artificial Sequence: Synthetic oligonucleotide
cttgtgggaccaacagctgctgggct

SEQ ID NO: 172977 - DNA, 26 bp, Artificial Sequence
  Description of Artificial Sequence: Synthetic oligonucleotide
ttgtgggaccaacagctgctgggctg

SEQ ID NO: 172978 - DNA, 25 bp, Artificial Sequence
  Description of Artificial Sequence: Synthetic oligonucleotide
tgtgggaccaacagctgctgggctg

SEQ ID NO: 172979 - DNA, 24 bp, Artificial Sequence
  Description of Artificial Sequence: Synthetic oligonucleotide
gtgggaccaacagctgctgggctg

SEQ ID NO: 172980 - DNA, 24 bp, Artificial Sequence
  Description of Artificial Sequence: Synthetic oligonucleotide
tgggaccaacagctgctgggctgg

SEQ ID NO: 172981 - DNA, 23 bp, Artificial Sequence
  Description of Artificial Sequence: Synthetic oligonucleotide
gggaccaacagctgctgggctgg

SEQ ID NO: 172982 - DNA, 23 bp, Artificial Sequence
  Description of Artificial Sequence: Synthetic oligonucleotide
ggaccaacagctgctgggctggc

SEQ ID NO: 172983 - DNA, 23 bp, Artificial Sequence
  Description of Artificial Sequence: Synthetic oligonucleotide
gaccaacagctgctgggctggcc

SEQ ID NO: 172984 - DNA, 23 bp, Artificial Sequence
  Description of Artificial Sequence: Synthetic oligonucleotide
accaacagctgctgggctggccc

SEQ ID NO: 172985 - DNA, 22 bp, Artificial Sequence
  Description of Artificial Sequence: Synthetic oligonucleotide
ccaacagctgctgggctggccc

SEQ ID NO: 172986 - DNA, 22 bp, Artificial Sequence
  Description of Artificial Sequence: Synthetic oligonucleotide
caacagctgctgggctggcccg

SEQ ID NO: 172987 - DNA, 22 bp, Artificial Sequence
  Description of Artificial Sequence: Synthetic oligonucleotide
aacagctgctgggctggcccgc

SEQ ID NO: 172988 - DNA, 21 bp, Artificial Sequence
  Description of Artificial Sequence: Synthetic oligonucleotide
acagctgctgggctggcccgc

SEQ ID NO: 172989 - DNA, 26 bp, Artificial Sequence
  Description of Artificial Sequence: Synthetic oligonucleotide
aagcgctggcaggacgtgtccatgca

SEQ ID NO: 172990 - DNA, 25 bp, Artificial Sequence
  Description of Artificial Sequence: Synthetic oligonucleotide
agcgctggcaggacgtgtccatgca

SEQ ID NO: 172991 - DNA, 24 bp, Artificial Sequence
  Description of Artificial Sequence: Synthetic oligonucleotide
gcgctggcaggacgtgtccatgca

SEQ ID NO: 172992 - DNA, 24 bp, Artificial Sequence
  Description of Artificial Sequence: Synthetic oligonucleotide
cgctggcaggacgtgtccatgcac

SEQ ID NO: 172993 - DNA, 24 bp, Artificial Sequence
  Description of Artificial Sequence: Synthetic oligonucleotide
gctggcaggacgtgtccatgcacc

SEQ ID NO: 172994 - DNA, 24 bp, Artificial Sequence
  Description of Artificial Sequence: Synthetic oligonucleotide
ctggcaggacgtgtccatgcaccg

SEQ ID NO: 172995 - DNA, 26 bp, Artificial Sequence
  Description of Artificial Sequence: Synthetic oligonucleotide
tggcaggacgtgtccatgcaccgcat

SEQ ID NO: 172996 - DNA, 25 bp, Artificial Sequence
  Description of Artificial Sequence: Synthetic oligonucleotide
ggcaggacgtgtccatgcaccgcat

SEQ ID NO: 172997 - DNA, 25 bp, Artificial Sequence
  Description of Artificial Sequence: Synthetic oligonucleotide
gcaggacgtgtccatgcaccgcatg

SEQ ID NO: 172998 - DNA, 26 bp, Artificial Sequence
  Description of Artificial Sequence: Synthetic oligonucleotide
caggacgtgtccatgcaccgcatgga

SEQ ID NO: 172999 - DNA, 27 bp, Artificial Sequence
  Description of Artificial Sequence: Synthetic oligonucleotide
aggacgtgtccatgcaccgcatggaga

SEQ ID NO: 173000 - DNA, 27 bp, Artificial Sequence
  Description of Artificial Sequence: Synthetic oligonucleotide
ggacgtgtccatgcaccgcatggagat

SEQ ID NO: 173001 - DNA, 27 bp, Artificial Sequence
  Description of Artificial Sequence: Synthetic oligonucleotide
gacgtgtccatgcaccgcatggagatg

SEQ ID NO: 173002 - DNA, 29 bp, Artificial Sequence
  Description of Artificial Sequence: Synthetic oligonucleotide
acgtgtccatgcaccgcatggagatgatc

SEQ ID NO: 173003 - DNA, 28 bp, Artificial Sequence
  Description of Artificial Sequence: Synthetic oligonucleotide
cgtgtccatgcaccgcatggagatgatc

SEQ ID NO: 173004 - DNA, 29 bp, Artificial Sequence
  Description of Artificial Sequence: Synthetic oligonucleotide
gtgtccatgcaccgcatggagatgatcag

SEQ ID NO: 173005 - DNA, 30 bp, Artificial Sequence
  Description of Artificial Sequence: Synthetic oligonucleotide
tgtccatgcaccgcatggagatgatcagtg

SEQ ID NO: 173006 - DNA, 29 bp, Artificial Sequence
  Description of Artificial Sequence: Synthetic oligonucleotide
gtccatgcaccgcatggagatgatcagtg

SEQ ID NO: 173007 - DNA, 30 bp, Artificial Sequence
  Description of Artificial Sequence: Synthetic oligonucleotide
tccatgcaccgcatggagatgatcagtgac

SEQ ID NO: 173008 - DNA, 29 bp, Artificial Sequence
  Description of Artificial Sequence: Synthetic oligonucleotide
ccatgcaccgcatggagatgatcagtgac

SEQ ID NO: 173009 - DNA, 31 bp, Artificial Sequence
  Description of Artificial Sequence: Synthetic oligonucleotide
catgcaccgcatggagatgatcagtgacttc

SEQ ID NO: 173010 - DNA, 32 bp, Artificial Sequence
  Description of Artificial Sequence: Synthetic oligonucleotide
atgcaccgcatggagatgatcagtgacttctg

SEQ ID NO: 173011 - DNA, 31 bp, Artificial Sequence
  Description of Artificial Sequence: Synthetic oligonucleotide
tgcaccgcatggagatgatcagtgacttctg

SEQ ID NO: 173012 - DNA, 30 bp, Artificial Sequence
  Description of Artificial Sequence: Synthetic oligonucleotide
gcaccgcatggagatgatcagtgacttctg

SEQ ID NO: 173013 - DNA, 30 bp, Artificial Sequence
  Description of Artificial Sequence: Synthetic oligonucleotide
caccgcatggagatgatcagtgacttctgc

SEQ ID NO: 173014 - DNA, 30 bp, Artificial Sequence
  Description of Artificial Sequence: Synthetic oligonucleotide
accgcatggagatgatcagtgacttctgcg

SEQ ID NO: 173015 - DNA, 34 bp, Artificial Sequence
  Description of Artificial Sequence: Synthetic oligonucleotide
agttcaggctccagaacaccaccattggattaac

SEQ ID NO: 173016 - DNA, 33 bp, Artificial Sequence
  Description of Artificial Sequence: Synthetic oligonucleotide
gttcaggctccagaacaccaccattggattaac

SEQ ID NO: 173017 - DNA, 34 bp, Artificial Sequence
  Description of Artificial Sequence: Synthetic oligonucleotide
ttcaggctccagaacaccaccattggattaactg

SEQ ID NO: 173018 - DNA, 33 bp, Artificial Sequence
  Description of Artificial Sequence: Synthetic oligonucleotide
tcaggctccagaacaccaccattggattaactg

SEQ ID NO: 173019 - DNA, 32 bp, Artificial Sequence
  Description of Artificial Sequence: Synthetic oligonucleotide
caggctccagaacaccaccattggattaactg

SEQ ID NO: 173020 - DNA, 33 bp, Artificial Sequence
  Description of Artificial Sequence: Synthetic oligonucleotide
aggctccagaacaccaccattggattaactgtg

SEQ ID NO: 173021 - DNA, 32 bp, Artificial Sequence
  Description of Artificial Sequence: Synthetic oligonucleotide
ggctccagaacaccaccattggattaactgtg

SEQ ID NO: 173022 - DNA, 35 bp, Artificial Sequence
  Description of Artificial Sequence: Synthetic oligonucleotide
gctccagaacaccaccattggattaactgtgtttg

SEQ ID NO: 173023 - DNA, 35 bp, Artificial Sequence
  Description of Artificial Sequence: Synthetic oligonucleotide
ctccagaacaccaccattggattaactgtgtttgc

SEQ ID NO: 173024 - DNA, 35 bp, Artificial Sequence
  Description of Artificial Sequence: Synthetic oligonucleotide
tccagaacaccaccattggattaactgtgtttgcc

SEQ ID NO: 173025 - DNA, 34 bp, Artificial Sequence
  Description of Artificial Sequence: Synthetic oligonucleotide
ccagaacaccaccattggattaactgtgtttgcc

SEQ ID NO: 173026 - DNA, 36 bp, Artificial Sequence
  Description of Artificial Sequence: Synthetic oligonucleotide
cagaacaccaccattggattaactgtgtttgccatc

SEQ ID NO: 173027 - DNA, 38 bp, Artificial Sequence
  Description of Artificial Sequence: Synthetic oligonucleotide
agaacaccaccattggattaactgtgtttgccatcaag

SEQ ID NO: 173028 - DNA, 37 bp, Artificial Sequence
  Description of Artificial Sequence: Synthetic oligonucleotide
gaacaccaccattggattaactgtgtttgccatcaag

SEQ ID NO: 173029 - DNA, 42 bp, Artificial Sequence
  Description of Artificial Sequence: Synthetic oligonucleotide
aacaccaccattggattaactgtgtttgccatcaagaaatac

SEQ ID NO: 173030 - DNA, 41 bp, Artificial Sequence
  Description of Artificial Sequence: Synthetic oligonucleotide
acaccaccattggattaactgtgtttgccatcaagaaatac

SEQ ID NO: 173031 - DNA, 40 bp, Artificial Sequence
  Description of Artificial Sequence: Synthetic oligonucleotide
caccaccattggattaactgtgtttgccatcaagaaatac

SEQ ID NO: 173032 - DNA, 40 bp, Artificial Sequence
  Description of Artificial Sequence: Synthetic oligonucleotide
accaccattggattaactgtgtttgccatcaagaaatacg

SEQ ID NO: 173033 - DNA, 39 bp, Artificial Sequence
  Description of Artificial Sequence: Synthetic oligonucleotide
ccaccattggattaactgtgtttgccatcaagaaatacg

SEQ ID NO: 173034 - DNA, 40 bp, Artificial Sequence
  Description of Artificial Sequence: Synthetic oligonucleotide
caccattggattaactgtgtttgccatcaagaaatacgtg

SEQ ID NO: 173035 - DNA, 40 bp, Artificial Sequence
  Description of Artificial Sequence: Synthetic oligonucleotide
accattggattaactgtgtttgccatcaagaaatacgtgg

SEQ ID NO: 173036 - DNA, 39 bp, Artificial Sequence
  Description of Artificial Sequence: Synthetic oligonucleotide
ccattggattaactgtgtttgccatcaagaaatacgtgg

SEQ ID NO: 173037 - DNA, 39 bp, Artificial Sequence
  Description of Artificial Sequence: Synthetic oligonucleotide
cattggattaactgtgtttgccatcaagaaatacgtggc

SEQ ID NO: 173038 - DNA, 42 bp, Artificial Sequence
  Description of Artificial Sequence: Synthetic oligonucleotide
attggattaactgtgtttgccatcaagaaatacgtggctttc

SEQ ID NO: 173039 - DNA, 41 bp, Artificial Sequence
  Description of Artificial Sequence: Synthetic oligonucleotide
ttggattaactgtgtttgccatcaagaaatacgtggctttc

SEQ ID NO: 173040 - DNA, 40 bp, Artificial Sequence
  Description of Artificial Sequence: Synthetic oligonucleotide
tggattaactgtgtttgccatcaagaaatacgtggctttc

SEQ ID NO: 173041 - DNA, 39 bp, Artificial Sequence
  Description of Artificial Sequence: Synthetic oligonucleotide
ggattaactgtgtttgccatcaagaaatacgtggctttc

SEQ ID NO: 173042 - DNA, 39 bp, Artificial Sequence
  Description of Artificial Sequence: Synthetic oligonucleotide
gattaactgtgtttgccatcaagaaatacgtggctttcc

SEQ ID NO: 173043 - DNA, 40 bp, Artificial Sequence
  Description of Artificial Sequence: Synthetic oligonucleotide
attaactgtgtttgccatcaagaaatacgtggctttcctg

SEQ ID NO: 173044 - DNA, 27 bp, Artificial Sequence
  Description of Artificial Sequence: Synthetic oligonucleotide
tgggtcagtatgcttccccgacagcca

SEQ ID NO: 173045 - DNA, 27 bp, Artificial Sequence
  Description of Artificial Sequence: Synthetic oligonucleotide
gggtcagtatgcttccccgacagccaa

SEQ ID NO: 173046 - DNA, 27 bp, Artificial Sequence
  Description of Artificial Sequence: Synthetic oligonucleotide
ggtcagtatgcttccccgacagccaag

SEQ ID NO: 173047 - DNA, 27 bp, Artificial Sequence
  Description of Artificial Sequence: Synthetic oligonucleotide
gtcagtatgcttccccgacagccaagc

SEQ ID NO: 173048 - DNA, 27 bp, Artificial Sequence
  Description of Artificial Sequence: Synthetic oligonucleotide
tcagtatgcttccccgacagccaagcg

SEQ ID NO: 173049 - DNA, 26 bp, Artificial Sequence
  Description of Artificial Sequence: Synthetic oligonucleotide
cagtatgcttccccgacagccaagcg

SEQ ID NO: 173050 - DNA, 27 bp, Artificial Sequence
  Description of Artificial Sequence: Synthetic oligonucleotide
agtatgcttccccgacagccaagcgct

SEQ ID NO: 173051 - DNA, 26 bp, Artificial Sequence
  Description of Artificial Sequence: Synthetic oligonucleotide
gtatgcttccccgacagccaagcgct

SEQ ID NO: 173052 - DNA, 26 bp, Artificial Sequence
  Description of Artificial Sequence: Synthetic oligonucleotide
tatgcttccccgacagccaagcgctg

SEQ ID NO: 173053 - DNA, 25 bp, Artificial Sequence
  Description of Artificial Sequence: Synthetic oligonucleotide
atgcttccccgacagccaagcgctg

SEQ ID NO: 173054 - DNA, 24 bp, Artificial Sequence
  Description of Artificial Sequence: Synthetic oligonucleotide
tgcttccccgacagccaagcgctg

SEQ ID NO: 173055 - DNA, 23 bp, Artificial Sequence
  Description of Artificial Sequence: Synthetic oligonucleotide
gcttccccgacagccaagcgctg

SEQ ID NO: 173056 - DNA, 24 bp, Artificial Sequence
  Description of Artificial Sequence: Synthetic oligonucleotide
cttccccgacagccaagcgctgct

SEQ ID NO: 173057 - DNA, 24 bp, Artificial Sequence
  Description of Artificial Sequence: Synthetic oligonucleotide
ttccccgacagccaagcgctgctg

SEQ ID NO: 173058 - DNA, 23 bp, Artificial Sequence
  Description of Artificial Sequence: Synthetic oligonucleotide
tccccgacagccaagcgctgctg

SEQ ID NO: 173059 - DNA, 22 bp, Artificial Sequence
  Description of Artificial Sequence: Synthetic oligonucleotide
ccccgacagccaagcgctgctg

SEQ ID NO: 173060 - DNA, 22 bp, Artificial Sequence
  Description of Artificial Sequence: Synthetic oligonucleotide
cccgacagccaagcgctgctgc

SEQ ID NO: 173061 - DNA, 23 bp, Artificial Sequence
  Description of Artificial Sequence: Synthetic oligonucleotide
ccgacagccaagcgctgctgcca

SEQ ID NO: 173062 - DNA, 23 bp, Artificial Sequence
  Description of Artificial Sequence: Synthetic oligonucleotide
cgacagccaagcgctgctgccag

SEQ ID NO: 173063 - DNA, 25 bp, Artificial Sequence
  Description of Artificial Sequence: Synthetic oligonucleotide
gacagccaagcgctgctgccaggat

SEQ ID NO: 173064 - DNA, 25 bp, Artificial Sequence
  Description of Artificial Sequence: Synthetic oligonucleotide
acagccaagcgctgctgccaggatg

SEQ ID NO: 173065 - DNA, 24 bp, Artificial Sequence
  Description of Artificial Sequence: Synthetic oligonucleotide
cagccaagcgctgctgccaggatg

SEQ ID NO: 173066 - DNA, 24 bp, Artificial Sequence
  Description of Artificial Sequence: Synthetic oligonucleotide
agccaagcgctgctgccaggatgg

SEQ ID NO: 173067 - DNA, 23 bp, Artificial Sequence
  Description of Artificial Sequence: Synthetic oligonucleotide
gccaagcgctgctgccaggatgg

SEQ ID NO: 173068 - DNA, 23 bp, Artificial Sequence
  Description of Artificial Sequence: Synthetic oligonucleotide
ccaagcgctgctgccaggatggg

SEQ ID NO: 173069 - DNA, 24 bp, Artificial Sequence
  Description of Artificial Sequence: Synthetic oligonucleotide
caagcgctgctgccaggatggggt

SEQ ID NO: 173070 - DNA, 25 bp, Artificial Sequence
  Description of Artificial Sequence: Synthetic oligonucleotide
aagcgctgctgccaggatggggtga

SEQ ID NO: 173071 - DNA, 24 bp, Artificial Sequence
  Description of Artificial Sequence: Synthetic oligonucleotide
agcgctgctgccaggatggggtga

SEQ ID NO: 173072 - DNA, 23 bp, Artificial Sequence
  Description of Artificial Sequence: Synthetic oligonucleotide
gcgctgctgccaggatggggtga

SEQ ID NO: 173073 - DNA, 24 bp, Artificial Sequence
  Description of Artificial Sequence: Synthetic oligonucleotide
cgctgctgccaggatggggtgaca

SEQ ID NO: 173074 - DNA, 24 bp, Artificial Sequence
  Description of Artificial Sequence: Synthetic oligonucleotide
gctgctgccaggatggggtgacac

SEQ ID NO: 173075 - DNA, 25 bp, Artificial Sequence
  Description of Artificial Sequence: Synthetic oligonucleotide
ctgctgccaggatggggtgacacgt

SEQ ID NO: 173076 - DNA, 26 bp, Artificial Sequence
  Description of Artificial Sequence: Synthetic oligonucleotide
tgctgccaggatggggtgacacgtct

SEQ ID NO: 173077 - DNA, 25 bp, Artificial Sequence
  Description of Artificial Sequence: Synthetic oligonucleotide
gctgccaggatggggtgacacgtct

SEQ ID NO: 173078 - DNA, 25 bp, Artificial Sequence
  Description of Artificial Sequence: Synthetic oligonucleotide
ctgccaggatggggtgacacgtctg

SEQ ID NO: 173079 - DNA, 25 bp, Artificial Sequence
  Description of Artificial Sequence: Synthetic oligonucleotide
tgccaggatggggtgacacgtctgc

SEQ ID NO: 173080 - DNA, 24 bp, Artificial Sequence
  Description of Artificial Sequence: Synthetic oligonucleotide
gccaggatggggtgacacgtctgc

SEQ ID NO: 173081 - DNA, 24 bp, Artificial Sequence
  Description of Artificial Sequence: Synthetic oligonucleotide
ccaggatggggtgacacgtctgcc

SEQ ID NO: 173082 - DNA, 26 bp, Artificial Sequence
  Description of Artificial Sequence: Synthetic oligonucleotide
caggatggggtgacacgtctgcccat

SEQ ID NO: 173083 - DNA, 27 bp, Artificial Sequence
  Description of Artificial Sequence: Synthetic oligonucleotide
aggatggggtgacacgtctgcccatga

SEQ ID NO: 173084 - DNA, 27 bp, Artificial Sequence
  Description of Artificial Sequence: Synthetic oligonucleotide
ggatggggtgacacgtctgcccatgat

SEQ ID NO: 173085 - DNA, 27 bp, Artificial Sequence
  Description of Artificial Sequence: Synthetic oligonucleotide
gatggggtgacacgtctgcccatgatg

SEQ ID NO: 173086 - DNA, 27 bp, Artificial Sequence
  Description of Artificial Sequence: Synthetic oligonucleotide
atggggtgacacgtctgcccatgatgc

SEQ ID NO: 173087 - DNA, 26 bp, Artificial Sequence
  Description of Artificial Sequence: Synthetic oligonucleotide
tggggtgacacgtctgcccatgatgc

SEQ ID NO: 173088 - DNA, 25 bp, Artificial Sequence
  Description of Artificial Sequence: Synthetic oligonucleotide
ggggtgacacgtctgcccatgatgc

SEQ ID NO: 173089 - DNA, 27 bp, Artificial Sequence
  Description of Artificial Sequence: Synthetic oligonucleotide
gggtgacacgtctgcccatgatgcgtt

SEQ ID NO: 173090 - DNA, 27 bp, Artificial Sequence
  Description of Artificial Sequence: Synthetic oligonucleotide
ggtgacacgtctgcccatgatgcgttc

SEQ ID NO: 173091 - DNA, 27 bp, Artificial Sequence
  Description of Artificial Sequence: Synthetic oligonucleotide
gtgacacgtctgcccatgatgcgttcc

SEQ ID NO: 173092 - DNA, 28 bp, Artificial Sequence
  Description of Artificial Sequence: Synthetic oligonucleotide
tgacacgtctgcccatgatgcgttcctg

SEQ ID NO: 173093 - DNA, 27 bp, Artificial Sequence
  Description of Artificial Sequence: Synthetic oligonucleotide
gacacgtctgcccatgatgcgttcctg

SEQ ID NO: 173094 - DNA, 27 bp, Artificial Sequence
  Description of Artificial Sequence: Synthetic oligonucleotide
acacgtctgcccatgatgcgttcctgc

SEQ ID NO: 173095 - DNA, 26 bp, Artificial Sequence
  Description of Artificial Sequence: Synthetic oligonucleotide
cacgtctgcccatgatgcgttcctgc

SEQ ID NO: 173096 - DNA, 27 bp, Artificial Sequence
  Description of Artificial Sequence: Synthetic oligonucleotide
acgtctgcccatgatgcgttcctgcga

SEQ ID NO: 173097 - DNA, 26 bp, Artificial Sequence
  Description of Artificial Sequence: Synthetic oligonucleotide
cgtctgcccatgatgcgttcctgcga

SEQ ID NO: 173098 - DNA, 26 bp, Artificial Sequence
  Description of Artificial Sequence: Synthetic oligonucleotide
gtctgcccatgatgcgttcctgcgag

SEQ ID NO: 173099 - DNA, 27 bp, Artificial Sequence
  Description of Artificial Sequence: Synthetic oligonucleotide
tctgcccatgatgcgttcctgcgagca

SEQ ID NO: 173100 - DNA, 26 bp, Artificial Sequence
  Description of Artificial Sequence: Synthetic oligonucleotide
ctgcccatgatgcgttcctgcgagca

SEQ ID NO: 173101 - DNA, 26 bp, Artificial Sequence
  Description of Artificial Sequence: Synthetic oligonucleotide
tgcccatgatgcgttcctgcgagcag

SEQ ID NO: 173102 - DNA, 25 bp, Artificial Sequence
  Description of Artificial Sequence: Synthetic oligonucleotide
gcccatgatgcgttcctgcgagcag

SEQ ID NO: 173103 - DNA, 25 bp, Artificial Sequence
  Description of Artificial Sequence: Synthetic oligonucleotide
cccatgatgcgttcctgcgagcagc

SEQ ID NO: 173104 - DNA, 25 bp, Artificial Sequence
  Description of Artificial Sequence: Synthetic oligonucleotide
ccatgatgcgttcctgcgagcagcg

SEQ ID NO: 173105 - DNA, 25 bp, Artificial Sequence
  Description of Artificial Sequence: Synthetic oligonucleotide
catgatgcgttcctgcgagcagcgg

SEQ ID NO: 173106 - DNA, 25 bp, Artificial Sequence
  Description of Artificial Sequence: Synthetic oligonucleotide
atgatgcgttcctgcgagcagcggg

SEQ ID NO: 173107 - DNA, 24 bp, Artificial Sequence
  Description of Artificial Sequence: Synthetic oligonucleotide
tgatgcgttcctgcgagcagcggg

SEQ ID NO: 173108 - DNA, 23 bp, Artificial Sequence
  Description of Artificial Sequence: Synthetic oligonucleotide
gatgcgttcctgcgagcagcggg

SEQ ID NO: 173109 - DNA, 24 bp, Artificial Sequence
  Description of Artificial Sequence: Synthetic oligonucleotide
atgcgttcctgcgagcagcgggca

SEQ ID NO: 173110 - DNA, 23 bp, Artificial Sequence
  Description of Artificial Sequence: Synthetic oligonucleotide
tgcgttcctgcgagcagcgggca

SEQ ID NO: 173111 - DNA, 22 bp, Artificial Sequence
  Description of Artificial Sequence: Synthetic oligonucleotide
gcgttcctgcgagcagcgggca

SEQ ID NO: 173112 - DNA, 22 bp, Artificial Sequence
  Description of Artificial Sequence: Synthetic oligonucleotide
cgttcctgcgagcagcgggcag

SEQ ID NO: 173113 - DNA, 22 bp, Artificial Sequence
  Description of Artificial Sequence: Synthetic oligonucleotide
gttcctgcgagcagcgggcagc

SEQ ID NO: 173114 - DNA, 22 bp, Artificial Sequence
  Description of Artificial Sequence: Synthetic oligonucleotide
ttcctgcgagcagcgggcagcc

SEQ ID NO: 173115 - DNA, 21 bp, Artificial Sequence
  Description of Artificial Sequence: Synthetic oligonucleotide
tcctgcgagcagcgggcagcc

SEQ ID NO: 173116 - DNA, 20 bp, Artificial Sequence
  Description of Artificial Sequence: Synthetic oligonucleotide
cctgcgagcagcgggcagcc

SEQ ID NO: 173117 - DNA, 20 bp, Artificial Sequence
  Description of Artificial Sequence: Synthetic oligonucleotide
ctgcgagcagcgggcagccc

SEQ ID NO: 173118 - DNA, 20 bp, Artificial Sequence
  Description of Artificial Sequence: Synthetic oligonucleotide
tgcgagcagcgggcagcccg

SEQ ID NO: 173119 - DNA, 20 bp, Artificial Sequence
  Description of Artificial Sequence: Synthetic oligonucleotide
gcgagcagcgggcagcccgt

SEQ ID NO: 173120 - DNA, 20 bp, Artificial Sequence
  Description of Artificial Sequence: Synthetic oligonucleotide
cgagcagcgggcagcccgct

SEQ ID NO: 173121 - DNA, 20 bp, Artificial Sequence
  Description of Artificial Sequence: Synthetic oligonucleotide
gagcagcgggcagcccgcgt

SEQ ID NO: 173122 - DNA, 20 bp, Artificial Sequence
  Description of Artificial Sequence: Synthetic oligonucleotide
agcagcgggcagcccgcgtg

SEQ ID NO: 173123 - DNA, 20 bp, Artificial Sequence
  Description of Artificial Sequence: Synthetic oligonucleotide
gcagcgggcagcccgcgtgt

SEQ ID NO: 173124 - DNA, 20 bp, Artificial Sequence
  Description of Artificial Sequence: Synthetic oligonucleotide
cagcgggcagcccgcgtgca

SEQ ID NO: 173125 - DNA, 20 bp, Artificial Sequence
  Description of Artificial Sequence: Synthetic oligonucleotide
agcgggcagcccgcgtgcag

SEQ ID NO: 173126 - DNA, 20 bp, Artificial Sequence
  Description of Artificial Sequence: Synthetic oligonucleotide
gcgggcagcccgcgtgcagt

SEQ ID NO: 173127 - DNA, 20 bp, Artificial Sequence
  Description of Artificial Sequence: Synthetic oligonucleotide
cgggcagcccgcgtgcagca

SEQ ID NO: 173128 - DNA, 20 bp, Artificial Sequence
  Description of Artificial Sequence: Synthetic oligonucleotide
gggcagcccgcgtgcagcag

SEQ ID NO: 173129 - DNA, 20 bp, Artificial Sequence
  Description of Artificial Sequence: Synthetic oligonucleotide
ggcagcccgcgtgcagcagc

SEQ ID NO: 173130 - DNA, 20 bp, Artificial Sequence
  Description of Artificial Sequence: Synthetic oligonucleotide
gcagcccgcgtgcagcagcc

SEQ ID NO: 173131 - DNA, 20 bp, Artificial Sequence
  Description of Artificial Sequence: Synthetic oligonucleotide
cagcccgcgtgcagcagccg

SEQ ID NO: 173132 - DNA, 21 bp, Artificial Sequence
  Description of Artificial Sequence: Synthetic oligonucleotide
agcccgcgtgcagcagccgga

SEQ ID NO: 173133 - DNA, 20 bp, Artificial Sequence
  Description of Artificial Sequence: Synthetic oligonucleotide
gcccgcgtgcagcagccgga

SEQ ID NO: 173134 - DNA, 21 bp, Artificial Sequence
  Description of Artificial Sequence: Synthetic oligonucleotide
cccgcgtgcagcagccggact

SEQ ID NO: 173135 - DNA, 21 bp, Artificial Sequence
  Description of Artificial Sequence: Synthetic oligonucleotide
ccgcgtgcagcagccggactg

SEQ ID NO: 173136 - DNA, 21 bp, Artificial Sequence
  Description of Artificial Sequence: Synthetic oligonucleotide
cgcgtgcagcagccggactgc

SEQ ID NO: 173137 - DNA, 21 bp, Artificial Sequence
  Description of Artificial Sequence: Synthetic oligonucleotide
gcgtgcagcagccggactgcc

SEQ ID NO: 173138 - DNA, 21 bp, Artificial Sequence
  Description of Artificial Sequence: Synthetic oligonucleotide
cgtgcagcagccggactgccg

SEQ ID NO: 173139 - DNA, 21 bp, Artificial Sequence
  Description of Artificial Sequence: Synthetic oligonucleotide
gtgcagcagccggactgccgg

SEQ ID NO: 173140 - DNA, 22 bp, Artificial Sequence
  Description of Artificial Sequence: Synthetic oligonucleotide
tgcagcagccggactgccggga

SEQ ID NO: 173141 - DNA, 21 bp, Artificial Sequence
  Description of Artificial Sequence: Synthetic oligonucleotide
gcagcagccggactgccggga

SEQ ID NO: 173142 - DNA, 21 bp, Artificial Sequence
  Description of Artificial Sequence: Synthetic oligonucleotide
cagcagccggactgccgggag

SEQ ID NO: 173143 - DNA, 21 bp, Artificial Sequence
  Description of Artificial Sequence: Synthetic oligonucleotide
agcagccggactgccgggagc

SEQ ID NO: 173144 - DNA, 20 bp, Artificial Sequence
  Description of Artificial Sequence: Synthetic oligonucleotide
gcagccggactgccgggagc

SEQ ID NO: 173145 - DNA, 20 bp, Artificial Sequence
  Description of Artificial Sequence: Synthetic oligonucleotide
cagccggactgccgggagcc

SEQ ID NO: 173146 - DNA, 22 bp, Artificial Sequence
  Description of Artificial Sequence: Synthetic oligonucleotide
agccggactgccgggagccctt

SEQ ID NO: 173147 - DNA, 21 bp, Artificial Sequence
  Description of Artificial Sequence: Synthetic oligonucleotide
gccggactgccgggagccctt

SEQ ID NO: 173148 - DNA, 21 bp, Artificial Sequence
  Description of Artificial Sequence: Synthetic oligonucleotide
ccggactgccgggagcccttc

SEQ ID NO: 173149 - DNA, 22 bp, Artificial Sequence
  Description of Artificial Sequence: Synthetic oligonucleotide
cggactgccgggagcccttcct

SEQ ID NO: 173150 - DNA, 23 bp, Artificial Sequence
  Description of Artificial Sequence: Synthetic oligonucleotide
ggactgccgggagcccttcctgt

SEQ ID NO: 173151 - DNA, 23 bp, Artificial Sequence
  Description of Artificial Sequence: Synthetic oligonucleotide
gactgccgggagcccttcctgtc

SEQ ID NO: 173152 - DNA, 24 bp, Artificial Sequence
  Description of Artificial Sequence: Synthetic oligonucleotide
actgccgggagcccttcctgtcct

SEQ ID NO: 173153 - DNA, 23 bp, Artificial Sequence
  Description of Artificial Sequence: Synthetic oligonucleotide
ctgccgggagcccttcctgtcct

SEQ ID NO: 173154 - DNA, 23 bp, Artificial Sequence
  Description of Artificial Sequence: Synthetic oligonucleotide
tgccgggagcccttcctgtcctg

SEQ ID NO: 173155 - DNA, 22 bp, Artificial Sequence
  Description of Artificial Sequence: Synthetic oligonucleotide
gccgggagcccttcctgtcctg

SEQ ID NO: 173156 - DNA, 23 bp, Artificial Sequence
  Description of Artificial Sequence: Synthetic oligonucleotide
ccgggagcccttcctgtcctgct

SEQ ID NO: 173157 - DNA, 23 bp, Artificial Sequence
  Description of Artificial Sequence: Synthetic oligonucleotide
cgggagcccttcctgtcctgctg

SEQ ID NO: 173158 - DNA, 23 bp, Artificial Sequence
  Description of Artificial Sequence: Synthetic oligonucleotide
gggagcccttcctgtcctgctgc

SEQ ID NO: 173159 - DNA, 27 bp, Artificial Sequence
  Description of Artificial Sequence: Synthetic oligonucleotide
ggagcccttcctgtcctgctgccaatt

SEQ ID NO: 173160 - DNA, 28 bp, Artificial Sequence
  Description of Artificial Sequence: Synthetic oligonucleotide
gagcccttcctgtcctgctgccaatttg

SEQ ID NO: 173161 - DNA, 28 bp, Artificial Sequence
  Description of Artificial Sequence: Synthetic oligonucleotide
agcccttcctgtcctgctgccaatttgc

SEQ ID NO: 173162 - DNA, 27 bp, Artificial Sequence
  Description of Artificial Sequence: Synthetic oligonucleotide
gcccttcctgtcctgctgccaatttgc

SEQ ID NO: 173163 - DNA, 28 bp, Artificial Sequence
  Description of Artificial Sequence: Synthetic oligonucleotide
cccttcctgtcctgctgccaatttgctg

SEQ ID NO: 173164 - DNA, 29 bp, Artificial Sequence
  Description of Artificial Sequence: Synthetic oligonucleotide
ccttcctgtcctgctgccaatttgctgag

SEQ ID NO: 173165 - DNA, 30 bp, Artificial Sequence
  Description of Artificial Sequence: Synthetic oligonucleotide
cttcctgtcctgctgccaatttgctgagag

SEQ ID NO: 173166 - DNA, 31 bp, Artificial Sequence
  Description of Artificial Sequence: Synthetic oligonucleotide
ttcctgtcctgctgccaatttgctgagagtc

SEQ ID NO: 173167 - DNA, 30 bp, Artificial Sequence
  Description of Artificial Sequence: Synthetic oligonucleotide
tcctgtcctgctgccaatttgctgagagtc

SEQ ID NO: 173168 - DNA, 29 bp, Artificial Sequence
  Description of Artificial Sequence: Synthetic oligonucleotide
cctgtcctgctgccaatttgctgagagtc

SEQ ID NO: 173169 - DNA, 30 bp, Artificial Sequence
  Description of Artificial Sequence: Synthetic oligonucleotide
ctgtcctgctgccaatttgctgagagtctg

SEQ ID NO: 173170 - DNA, 30 bp, Artificial Sequence
  Description of Artificial Sequence: Synthetic oligonucleotide
tgtcctgctgccaatttgctgagagtctgc

SEQ ID NO: 173171 - DNA, 29 bp, Artificial Sequence
  Description of Artificial Sequence: Synthetic oligonucleotide
gtcctgctgccaatttgctgagagtctgc

SEQ ID NO: 173172 - DNA, 29 bp, Artificial Sequence
  Description of Artificial Sequence: Synthetic oligonucleotide
tcctgctgccaatttgctgagagtctgcg

SEQ ID NO: 173173 - DNA, 28 bp, Artificial Sequence
  Description of Artificial Sequence: Synthetic oligonucleotide
cctgctgccaatttgctgagagtctgcg

SEQ ID NO: 173174 - DNA, 28 bp, Artificial Sequence
  Description of Artificial Sequence: Synthetic oligonucleotide
ctgctgccaatttgctgagagtctgcgc

SEQ ID NO: 173175 - DNA, 30 bp, Artificial Sequence
  Description of Artificial Sequence: Synthetic oligonucleotide
tgctgccaatttgctgagagtctgcgcaag

SEQ ID NO: 173176 - DNA, 29 bp, Artificial Sequence
  Description of Artificial Sequence: Synthetic oligonucleotide
gctgccaatttgctgagagtctgcgcaag

SEQ ID NO: 173177 - DNA, 31 bp, Artificial Sequence
  Description of Artificial Sequence: Synthetic oligonucleotide
ctgccaatttgctgagagtctgcgcaagaag

SEQ ID NO: 173178 - DNA, 32 bp, Artificial Sequence
  Description of Artificial Sequence: Synthetic oligonucleotide
tgccaatttgctgagagtctgcgcaagaagag

SEQ ID NO: 173179 - DNA, 31 bp, Artificial Sequence
  Description of Artificial Sequence: Synthetic oligonucleotide
gccaatttgctgagagtctgcgcaagaagag

SEQ ID NO: 173180 - DNA, 31 bp, Artificial Sequence
  Description of Artificial Sequence: Synthetic oligonucleotide
ccaatttgctgagagtctgcgcaagaagagc

SEQ ID NO: 173181 - DNA, 32 bp, Artificial Sequence
  Description of Artificial Sequence: Synthetic oligonucleotide
caatttgctgagagtctgcgcaagaagagcag

SEQ ID NO: 173182 - DNA, 32 bp, Artificial Sequence
  Description of Artificial Sequence: Synthetic oligonucleotide
aatttgctgagagtctgcgcaagaagagcagg

SEQ ID NO: 173183 - DNA, 31 bp, Artificial Sequence
  Description of Artificial Sequence: Synthetic oligonucleotide
atttgctgagagtctgcgcaagaagagcagg

SEQ ID NO: 173184 - DNA, 30 bp, Artificial Sequence
  Description of Artificial Sequence: Synthetic oligonucleotide
tttgctgagagtctgcgcaagaagagcagg

SEQ ID NO: 173185 - DNA, 29 bp, Artificial Sequence
  Description of Artificial Sequence: Synthetic oligonucleotide
ttgctgagagtctgcgcaagaagagcagg

SEQ ID NO: 173186 - DNA, 28 bp, Artificial Sequence
  Description of Artificial Sequence: Synthetic oligonucleotide
tgctgagagtctgcgcaagaagagcagg

SEQ ID NO: 173187 - DNA, 27 bp, Artificial Sequence
  Description of Artificial Sequence: Synthetic oligonucleotide
gctgagagtctgcgcaagaagagcagg

SEQ ID NO: 173188 - DNA, 27 bp, Artificial Sequence
  Description of Artificial Sequence: Synthetic oligonucleotide
ctgagagtctgcgcaagaagagcaggg

SEQ ID NO: 173189 - DNA, 28 bp, Artificial Sequence
  Description of Artificial Sequence: Synthetic oligonucleotide
tgagagtctgcgcaagaagagcagggac

SEQ ID NO: 173190 - DNA, 27 bp, Artificial Sequence
  Description of Artificial Sequence: Synthetic oligonucleotide
gagagtctgcgcaagaagagcagggac

SEQ ID NO: 173191 - DNA, 29 bp, Artificial Sequence
  Description of Artificial Sequence: Synthetic oligonucleotide
agagtctgcgcaagaagagcagggacaag

SEQ ID NO: 173192 - DNA, 28 bp, Artificial Sequence
  Description of Artificial Sequence: Synthetic oligonucleotide
gagtctgcgcaagaagagcagggacaag

SEQ ID NO: 173193 - DNA, 28 bp, Artificial Sequence
  Description of Artificial Sequence: Synthetic oligonucleotide
agtctgcgcaagaagagcagggacaagg

SEQ ID NO: 173194 - DNA, 27 bp, Artificial Sequence
  Description of Artificial Sequence: Synthetic oligonucleotide
gtctgcgcaagaagagcagggacaagg

SEQ ID NO: 173195 - DNA, 27 bp, Artificial Sequence
  Description of Artificial Sequence: Synthetic oligonucleotide
tctgcgcaagaagagcagggacaaggg

SEQ ID NO: 173196 - DNA, 26 bp, Artificial Sequence
  Description of Artificial Sequence: Synthetic oligonucleotide
ctgcgcaagaagagcagggacaaggg

SEQ ID NO: 173197 - DNA, 26 bp, Artificial Sequence
  Description of Artificial Sequence: Synthetic oligonucleotide
tgcgcaagaagagcagggacaagggc

SEQ ID NO: 173198 - DNA, 25 bp, Artificial Sequence
  Description of Artificial Sequence: Synthetic oligonucleotide
gcgcaagaagagcagggacaagggc

SEQ ID NO: 173199 - DNA, 26 bp, Artificial Sequence
  Description of Artificial Sequence: Synthetic oligonucleotide
cgcaagaagagcagggacaagggcca

SEQ ID NO: 173200 - DNA, 26 bp, Artificial Sequence
  Description of Artificial Sequence: Synthetic oligonucleotide
gcaagaagagcagggacaagggccag

SEQ ID NO: 173201 - DNA, 26 bp, Artificial Sequence
  Description of Artificial Sequence: Synthetic oligonucleotide
caagaagagcagggacaagggccagg

SEQ ID NO: 173202 - DNA, 26 bp, Artificial Sequence
  Description of Artificial Sequence: Synthetic oligonucleotide
aagaagagcagggacaagggccaggc

SEQ ID NO: 173203 - DNA, 25 bp, Artificial Sequence
  Description of Artificial Sequence: Synthetic oligonucleotide
agaagagcagggacaagggccaggc

SEQ ID NO: 173204 - DNA, 24 bp, Artificial Sequence
  Description of Artificial Sequence: Synthetic oligonucleotide
gaagagcagggacaagggccaggc

SEQ ID NO: 173205 - DNA, 24 bp, Artificial Sequence
  Description of Artificial Sequence: Synthetic oligonucleotide
aagagcagggacaagggccaggcg

SEQ ID NO: 173206 - DNA, 23 bp, Artificial Sequence
  Description of Artificial Sequence: Synthetic oligonucleotide
agagcagggacaagggccaggcg

SEQ ID NO: 173207 - DNA, 22 bp, Artificial Sequence
  Description of Artificial Sequence: Synthetic oligonucleotide
gagcagggacaagggccaggcg

SEQ ID NO: 173208 - DNA, 22 bp, Artificial Sequence
  Description of Artificial Sequence: Synthetic oligonucleotide
agcagggacaagggccaggcgg

SEQ ID NO: 173209 - DNA, 21 bp, Artificial Sequence
  Description of Artificial Sequence: Synthetic oligonucleotide
gcagggacaagggccaggcgg

SEQ ID NO: 173210 - DNA, 21 bp, Artificial Sequence
  Description of Artificial Sequence: Synthetic oligonucleotide
cagggacaagggccaggcggg

SEQ ID NO: 173211 - DNA, 21 bp, Artificial Sequence
  Description of Artificial Sequence: Synthetic oligonucleotide
agggacaagggccaggcgggc

SEQ ID NO: 173212 - DNA, 20 bp, Artificial Sequence
  Description of Artificial Sequence: Synthetic oligonucleotide
gggacaagggccaggcgggc

SEQ ID NO: 173213 - DNA, 21 bp, Artificial Sequence
  Description of Artificial Sequence: Synthetic oligonucleotide
ggacaagggccaggcgggcct

SEQ ID NO: 173214 - DNA, 21 bp, Artificial Sequence
  Description of Artificial Sequence: Synthetic oligonucleotide
gacaagggccaggcgggcctc

SEQ ID NO: 173215 - DNA, 23 bp, Artificial Sequence
  Description of Artificial Sequence: Synthetic oligonucleotide
acaagggccaggcgggcctccaa

SEQ ID NO: 173216 - DNA, 22 bp, Artificial Sequence
  Description of Artificial Sequence: Synthetic oligonucleotide
caagggccaggcgggcctccaa

SEQ ID NO: 173217 - DNA, 22 bp, Artificial Sequence
  Description of Artificial Sequence: Synthetic oligonucleotide
aagggccaggcgggcctccaac

SEQ ID NO: 173218 - DNA, 21 bp, Artificial Sequence
  Description of Artificial Sequence: Synthetic oligonucleotide
agggccaggcgggcctccaac

SEQ ID NO: 173219 - DNA, 20 bp, Artificial Sequence
  Description of Artificial Sequence: Synthetic oligonucleotide
gggccaggcgggcctccaac

SEQ ID NO: 173220 - DNA, 21 bp, Artificial Sequence
  Description of Artificial Sequence: Synthetic oligonucleotide
ggccaggcgggcctccaacga

SEQ ID NO: 173221 - DNA, 21 bp, Artificial Sequence
  Description of Artificial Sequence: Synthetic oligonucleotide
gccaggcgggcctccaacgag

SEQ ID NO: 173222 - DNA, 21 bp, Artificial Sequence
  Description of Artificial Sequence: Synthetic oligonucleotide
ccaggcgggcctccaacgagc

SEQ ID NO: 173223 - DNA, 21 bp, Artificial Sequence
  Description of Artificial Sequence: Synthetic oligonucleotide
caggcgggcctccaacgagcc

SEQ ID NO: 173224 - DNA, 22 bp, Artificial Sequence
  Description of Artificial Sequence: Synthetic oligonucleotide
aggcgggcctccaacgagccct

SEQ ID NO: 173225 - DNA, 21 bp, Artificial Sequence
  Description of Artificial Sequence: Synthetic oligonucleotide
ggcgggcctccaacgagccct

SEQ ID NO: 173226 - DNA, 21 bp, Artificial Sequence
  Description of Artificial Sequence: Synthetic oligonucleotide
gcgggcctccaacgagccctg

SEQ ID NO: 173227 - DNA, 22 bp, Artificial Sequence
  Description of Artificial Sequence: Synthetic oligonucleotide
cgggcctccaacgagccctgga

SEQ ID NO: 173228 - DNA, 24 bp, Artificial Sequence
  Description of Artificial Sequence: Synthetic oligonucleotide
gggcctccaacgagccctggagat

SEQ ID NO: 173229 - DNA, 24 bp, Artificial Sequence
  Description of Artificial Sequence: Synthetic oligonucleotide
ggcctccaacgagccctggagatc

SEQ ID NO: 173230 - DNA, 25 bp, Artificial Sequence
  Description of Artificial Sequence: Synthetic oligonucleotide
gcctccaacgagccctggagatcct

SEQ ID NO: 173231 - DNA, 25 bp, Artificial Sequence
  Description of Artificial Sequence: Synthetic oligonucleotide
cctccaacgagccctggagatcctg

SEQ ID NO: 173232 - DNA, 26 bp, Artificial Sequence
  Description of Artificial Sequence: Synthetic oligonucleotide
ctccaacgagccctggagatcctgca

SEQ ID NO: 173233 - DNA, 26 bp, Artificial Sequence
  Description of Artificial Sequence: Synthetic oligonucleotide
tccaacgagccctggagatcctgcag

SEQ ID NO: 173234 - DNA, 25 bp, Artificial Sequence
  Description of Artificial Sequence: Synthetic oligonucleotide
ccaacgagccctggagatcctgcag

SEQ ID NO: 173235 - DNA, 26 bp, Artificial Sequence
  Description of Artificial Sequence: Synthetic oligonucleotide
caacgagccctggagatcctgcagga

SEQ ID NO: 173236 - DNA, 26 bp, Artificial Sequence
  Description of Artificial Sequence: Synthetic oligonucleotide
aacgagccctggagatcctgcaggag

SEQ ID NO: 173237 - DNA, 25 bp, Artificial Sequence
  Description of Artificial Sequence: Synthetic oligonucleotide
acgagccctggagatcctgcaggag

SEQ ID NO: 173238 - DNA, 24 bp, Artificial Sequence
  Description of Artificial Sequence: Synthetic oligonucleotide
cgagccctggagatcctgcaggag

SEQ ID NO: 173239 - DNA, 25 bp, Artificial Sequence
  Description of Artificial Sequence: Synthetic oligonucleotide
gagccctggagatcctgcaggagga

SEQ ID NO: 173240 - DNA, 25 bp, Artificial Sequence
  Description of Artificial Sequence: Synthetic oligonucleotide
agccctggagatcctgcaggaggag

SEQ ID NO: 173241 - DNA, 24 bp, Artificial Sequence
  Description of Artificial Sequence: Synthetic oligonucleotide
gccctggagatcctgcaggaggag

SEQ ID NO: 173242 - DNA, 25 bp, Artificial Sequence
  Description of Artificial Sequence: Synthetic oligonucleotide
ccctggagatcctgcaggaggagga

SEQ ID NO: 173243 - DNA, 25 bp, Artificial Sequence
  Description of Artificial Sequence: Synthetic oligonucleotide
cctggagatcctgcaggaggaggac

SEQ ID NO: 173244 - DNA, 26 bp, Artificial Sequence
  Description of Artificial Sequence: Synthetic oligonucleotide
ctggagatcctgcaggaggaggacct

SEQ ID NO: 173245 - DNA, 27 bp, Artificial Sequence
  Description of Artificial Sequence: Synthetic oligonucleotide
tggagatcctgcaggaggaggacctga

SEQ ID NO: 173246 - DNA, 27 bp, Artificial Sequence
  Description of Artificial Sequence: Synthetic oligonucleotide
ggagatcctgcaggaggaggacctgat

SEQ ID NO: 173247 - DNA, 28 bp, Artificial Sequence
  Description of Artificial Sequence: Synthetic oligonucleotide
gagatcctgcaggaggaggacctgattg

SEQ ID NO: 173248 - DNA, 30 bp, Artificial Sequence
  Description of Artificial Sequence: Synthetic oligonucleotide
agatcctgcaggaggaggacctgattgatg

SEQ ID NO: 173249 - DNA, 29 bp, Artificial Sequence
  Description of Artificial Sequence: Synthetic oligonucleotide
gatcctgcaggaggaggacctgattgatg

SEQ ID NO: 173250 - DNA, 30 bp, Artificial Sequence
  Description of Artificial Sequence: Synthetic oligonucleotide
atcctgcaggaggaggacctgattgatgag

SEQ ID NO: 173251 - DNA, 29 bp, Artificial Sequence
  Description of Artificial Sequence: Synthetic oligonucleotide
tcctgcaggaggaggacctgattgatgag

SEQ ID NO: 173252 - DNA, 28 bp, Artificial Sequence
  Description of Artificial Sequence: Synthetic oligonucleotide
cctgcaggaggaggacctgattgatgag

SEQ ID NO: 173253 - DNA, 28 bp, Artificial Sequence
  Description of Artificial Sequence: Synthetic oligonucleotide
ctgcaggaggaggacctgattgatgagg

SEQ ID NO: 173254 - DNA, 30 bp, Artificial Sequence
  Description of Artificial Sequence: Synthetic oligonucleotide
tgcaggaggaggacctgattgatgaggatg

SEQ ID NO: 173255 - DNA, 29 bp, Artificial Sequence
  Description of Artificial Sequence: Synthetic oligonucleotide
gcaggaggaggacctgattgatgaggatg

SEQ ID NO: 173256 - DNA, 30 bp, Artificial Sequence
  Description of Artificial Sequence: Synthetic oligonucleotide
caggaggaggacctgattgatgaggatgac

SEQ ID NO: 173257 - DNA, 33 bp, Artificial Sequence
  Description of Artificial Sequence: Synthetic oligonucleotide
aggaggaggacctgattgatgaggatgacattc

SEQ ID NO: 173258 - DNA, 32 bp, Artificial Sequence
  Description of Artificial Sequence: Synthetic oligonucleotide
ggaggaggacctgattgatgaggatgacattc

SEQ ID NO: 173259 - DNA, 32 bp, Artificial Sequence
  Description of Artificial Sequence: Synthetic oligonucleotide
gaggaggacctgattgatgaggatgacattcc

SEQ ID NO: 173260 - DNA, 32 bp, Artificial Sequence
  Description of Artificial Sequence: Synthetic oligonucleotide
aggaggacctgattgatgaggatgacattccc

SEQ ID NO: 173261 - DNA, 31 bp, Artificial Sequence
  Description of Artificial Sequence: Synthetic oligonucleotide
ggaggacctgattgatgaggatgacattccc

SEQ ID NO: 173262 - DNA, 31 bp, Artificial Sequence
  Description of Artificial Sequence: Synthetic oligonucleotide
gaggacctgattgatgaggatgacattcccg

SEQ ID NO: 173263 - DNA, 32 bp, Artificial Sequence
  Description of Artificial Sequence: Synthetic oligonucleotide
aggacctgattgatgaggatgacattcccgtg

SEQ ID NO: 173264 - DNA, 31 bp, Artificial Sequence
  Description of Artificial Sequence: Synthetic oligonucleotide
ggacctgattgatgaggatgacattcccgtg

SEQ ID NO: 173265 - DNA, 31 bp, Artificial Sequence
  Description of Artificial Sequence: Synthetic oligonucleotide
gacctgattgatgaggatgacattcccgtgc

SEQ ID NO: 173266 - DNA, 31 bp, Artificial Sequence
  Description of Artificial Sequence: Synthetic oligonucleotide
acctgattgatgaggatgacattcccgtgcg

SEQ ID NO: 173267 - DNA, 30 bp, Artificial Sequence
  Description of Artificial Sequence: Synthetic oligonucleotide
cctgattgatgaggatgacattcccgtgcg

SEQ ID NO: 173268 - DNA, 30 bp, Artificial Sequence
  Description of Artificial Sequence: Synthetic oligonucleotide
ctgattgatgaggatgacattcccgtgcgc

SEQ ID NO: 173269 - DNA, 31 bp, Artificial Sequence
  Description of Artificial Sequence: Synthetic oligonucleotide
tgattgatgaggatgacattcccgtgcgcag

SEQ ID NO: 173270 - DNA, 30 bp, Artificial Sequence
  Description of Artificial Sequence: Synthetic oligonucleotide
gattgatgaggatgacattcccgtgcgcag

SEQ ID NO: 173271 - DNA, 30 bp, Artificial Sequence
  Description of Artificial Sequence: Synthetic oligonucleotide
attgatgaggatgacattcccgtgcgcagc

SEQ ID NO: 173272 - DNA, 29 bp, Artificial Sequence
  Description of Artificial Sequence: Synthetic oligonucleotide
ttgatgaggatgacattcccgtgcgcagc

SEQ ID NO: 173273 - DNA, 28 bp, Artificial Sequence
  Description of Artificial Sequence: Synthetic oligonucleotide
tgatgaggatgacattcccgtgcgcagc

SEQ ID NO: 173274 - DNA, 27 bp, Artificial Sequence
  Description of Artificial Sequence: Synthetic oligonucleotide
gatgaggatgacattcccgtgcgcagc

SEQ ID NO: 173275 - DNA, 29 bp, Artificial Sequence
  Description of Artificial Sequence: Synthetic oligonucleotide
atgaggatgacattcccgtgcgcagcttc

SEQ ID NO: 173276 - DNA, 28 bp, Artificial Sequence
  Description of Artificial Sequence: Synthetic oligonucleotide
tgaggatgacattcccgtgcgcagcttc

SEQ ID NO: 173277 - DNA, 27 bp, Artificial Sequence
  Description of Artificial Sequence: Synthetic oligonucleotide
gaggatgacattcccgtgcgcagcttc

SEQ ID NO: 173278 - DNA, 29 bp, Artificial Sequence
  Description of Artificial Sequence: Synthetic oligonucleotide
aggatgacattcccgtgcgcagcttcttc

SEQ ID NO: 173279 - DNA, 28 bp, Artificial Sequence
  Description of Artificial Sequence: Synthetic oligonucleotide
ggatgacattcccgtgcgcagcttcttc

SEQ ID NO: 173280 - DNA, 28 bp, Artificial Sequence
  Description of Artificial Sequence: Synthetic oligonucleotide
gatgacattcccgtgcgcagcttcttcc

SEQ ID NO: 173281 - DNA, 28 bp, Artificial Sequence
  Description of Artificial Sequence: Synthetic oligonucleotide
atgacattcccgtgcgcagcttcttccc

SEQ ID NO: 173282 - DNA, 27 bp, Artificial Sequence
  Description of Artificial Sequence: Synthetic oligonucleotide
tgacattcccgtgcgcagcttcttccc

SEQ ID NO: 173283 - DNA, 27 bp, Artificial Sequence
  Description of Artificial Sequence: Synthetic oligonucleotide
gacattcccgtgcgcagcttcttccca

SEQ ID NO: 173284 - DNA, 27 bp, Artificial Sequence
  Description of Artificial Sequence: Synthetic oligonucleotide
acattcccgtgcgcagcttcttcccag

SEQ ID NO: 173285 - DNA, 27 bp, Artificial Sequence
  Description of Artificial Sequence: Synthetic oligonucleotide
cattcccgtgcgcagcttcttcccaga

SEQ ID NO: 173286 - DNA, 27 bp, Artificial Sequence
  Description of Artificial Sequence: Synthetic oligonucleotide
attcccgtgcgcagcttcttcccagag

SEQ ID NO: 173287 - DNA, 27 bp, Artificial Sequence
  Description of Artificial Sequence: Synthetic oligonucleotide
ttcccgtgcgcagcttcttcccagaga

SEQ ID NO: 173288 - DNA, 27 bp, Artificial Sequence
  Description of Artificial Sequence: Synthetic oligonucleotide
tcccgtgcgcagcttcttcccagagaa

SEQ ID NO: 173289 - DNA, 26 bp, Artificial Sequence
  Description of Artificial Sequence: Synthetic oligonucleotide
cccgtgcgcagcttcttcccagagaa

SEQ ID NO: 173290 - DNA, 27 bp, Artificial Sequence
  Description of Artificial Sequence: Synthetic oligonucleotide
ccgtgcgcagcttcttcccagagaact

SEQ ID NO: 173291 - DNA, 27 bp, Artificial Sequence
  Description of Artificial Sequence: Synthetic oligonucleotide
cgtgcgcagcttcttcccagagaactg

SEQ ID NO: 173292 - DNA, 27 bp, Artificial Sequence
  Description of Artificial Sequence: Synthetic oligonucleotide
gtgcgcagcttcttcccagagaactgg

SEQ ID NO: 173293 - DNA, 27 bp, Artificial Sequence
  Description of Artificial Sequence: Synthetic oligonucleotide
tgcgcagcttcttcccagagaactggc

SEQ ID NO: 173294 - DNA, 27 bp, Artificial Sequence
  Description of Artificial Sequence: Synthetic oligonucleotide
gcgcagcttcttcccagagaactggct

SEQ ID NO: 173295 - DNA, 27 bp, Artificial Sequence
  Description of Artificial Sequence: Synthetic oligonucleotide
cgcagcttcttcccagagaactggctc

SEQ ID NO: 173296 - DNA, 28 bp, Artificial Sequence
  Description of Artificial Sequence: Synthetic oligonucleotide
gcagcttcttcccagagaactggctctg

SEQ ID NO: 173297 - DNA, 28 bp, Artificial Sequence
  Description of Artificial Sequence: Synthetic oligonucleotide
cagcttcttcccagagaactggctctgg

SEQ ID NO: 173298 - DNA, 29 bp, Artificial Sequence
  Description of Artificial Sequence: Synthetic oligonucleotide
agcttcttcccagagaactggctctggag

SEQ ID NO: 173299 - DNA, 28 bp, Artificial Sequence
  Description of Artificial Sequence: Synthetic oligonucleotide
gcttcttcccagagaactggctctggag

SEQ ID NO: 173300 - DNA, 29 bp, Artificial Sequence
  Description of Artificial Sequence: Synthetic oligonucleotide
cttcttcccagagaactggctctggagag

SEQ ID NO: 173301 - DNA, 30 bp, Artificial Sequence
  Description of Artificial Sequence: Synthetic oligonucleotide
ttcttcccagagaactggctctggagagtg

SEQ ID NO: 173302 - DNA, 29 bp, Artificial Sequence
  Description of Artificial Sequence: Synthetic oligonucleotide
tcttcccagagaactggctctggagagtg

SEQ ID NO: 173303 - DNA, 28 bp, Artificial Sequence
  Description of Artificial Sequence: Synthetic oligonucleotide
cttcccagagaactggctctggagagtg

SEQ ID NO: 173304 - DNA, 28 bp, Artificial Sequence
  Description of Artificial Sequence: Synthetic oligonucleotide
ttcccagagaactggctctggagagtgg

SEQ ID NO: 173305 - DNA, 27 bp, Artificial Sequence
  Description of Artificial Sequence: Synthetic oligonucleotide
tcccagagaactggctctggagagtgg

SEQ ID NO: 173306 - DNA, 27 bp, Artificial Sequence
  Description of Artificial Sequence: Synthetic oligonucleotide
cccagagaactggctctggagagtgga

SEQ ID NO: 173307 - DNA, 29 bp, Artificial Sequence
  Description of Artificial Sequence: Synthetic oligonucleotide
ccagagaactggctctggagagtggaaac

SEQ ID NO: 173308 - DNA, 30 bp, Artificial Sequence
  Description of Artificial Sequence: Synthetic oligonucleotide
cagagaactggctctggagagtggaaacag

SEQ ID NO: 173309 - DNA, 31 bp, Artificial Sequence
  Description of Artificial Sequence: Synthetic oligonucleotide
agagaactggctctggagagtggaaacagtg

SEQ ID NO: 173310 - DNA, 30 bp, Artificial Sequence
  Description of Artificial Sequence: Synthetic oligonucleotide
gagaactggctctggagagtggaaacagtg

SEQ ID NO: 173311 - DNA, 30 bp, Artificial Sequence
  Description of Artificial Sequence: Synthetic oligonucleotide
agaactggctctggagagtggaaacagtgg

SEQ ID NO: 173312 - DNA, 29 bp, Artificial Sequence
  Description of Artificial Sequence: Synthetic oligonucleotide
gaactggctctggagagtggaaacagtgg

SEQ ID NO: 173313 - DNA, 30 bp, Artificial Sequence
  Description of Artificial Sequence: Synthetic oligonucleotide
aactggctctggagagtggaaacagtggac

SEQ ID NO: 173314 - DNA, 29 bp, Artificial Sequence
  Description of Artificial Sequence: Synthetic oligonucleotide
actggctctggagagtggaaacagtggac

SEQ ID NO: 173315 - DNA, 28 bp, Artificial Sequence
  Description of Artificial Sequence: Synthetic oligonucleotide
ctggctctggagagtggaaacagtggac

SEQ ID NO: 173316 - DNA, 28 bp, Artificial Sequence
  Description of Artificial Sequence: Synthetic oligonucleotide
tggctctggagagtggaaacagtggacc

SEQ ID NO: 173317 - DNA, 27 bp, Artificial Sequence
  Description of Artificial Sequence: Synthetic oligonucleotide
ggctctggagagtggaaacagtggacc

SEQ ID NO: 173318 - DNA, 27 bp, Artificial Sequence
  Description of Artificial Sequence: Synthetic oligonucleotide
gctctggagagtggaaacagtggaccg

SEQ ID NO: 173319 - DNA, 27 bp, Artificial Sequence
  Description of Artificial Sequence: Synthetic oligonucleotide
ctctggagagtggaaacagtggaccgc

SEQ ID NO: 173320 - DNA, 30 bp, Artificial Sequence
  Description of Artificial Sequence: Synthetic oligonucleotide
tctggagagtggaaacagtggaccgctttc

SEQ ID NO: 173321 - DNA, 29 bp, Artificial Sequence
  Description of Artificial Sequence: Synthetic oligonucleotide
ctggagagtggaaacagtggaccgctttc

SEQ ID NO: 173322 - DNA, 36 bp, Artificial Sequence
  Description of Artificial Sequence: Synthetic oligonucleotide
tggagagtggaaacagtggaccgctttcaaatattg

SEQ ID NO: 173323 - DNA, 35 bp, Artificial Sequence
  Description of Artificial Sequence: Synthetic oligonucleotide
ggagagtggaaacagtggaccgctttcaaatattg

SEQ ID NO: 173324 - DNA, 36 bp, Artificial Sequence
  Description of Artificial Sequence: Synthetic oligonucleotide
gagagtggaaacagtggaccgctttcaaatattgac

SEQ ID NO: 173325 - DNA, 37 bp, Artificial Sequence
  Description of Artificial Sequence: Synthetic oligonucleotide
agagtggaaacagtggaccgctttcaaatattgacac

SEQ ID NO: 173326 - DNA, 36 bp, Artificial Sequence
  Description of Artificial Sequence: Synthetic oligonucleotide
gagtggaaacagtggaccgctttcaaatattgacac

SEQ ID NO: 173327 - DNA, 37 bp, Artificial Sequence
  Description of Artificial Sequence: Synthetic oligonucleotide
agtggaaacagtggaccgctttcaaatattgacactg

SEQ ID NO: 173328 - DNA, 36 bp, Artificial Sequence
  Description of Artificial Sequence: Synthetic oligonucleotide
gtggaaacagtggaccgctttcaaatattgacactg

SEQ ID NO: 173329 - DNA, 37 bp, Artificial Sequence
  Description of Artificial Sequence: Synthetic oligonucleotide
tggaaacagtggaccgctttcaaatattgacactgtg

SEQ ID NO: 173330 - DNA, 36 bp, Artificial Sequence
  Description of Artificial Sequence: Synthetic oligonucleotide
ggaaacagtggaccgctttcaaatattgacactgtg

SEQ ID NO: 173331 - DNA, 36 bp, Artificial Sequence
  Description of Artificial Sequence: Synthetic oligonucleotide
gaaacagtggaccgctttcaaatattgacactgtgg

SEQ ID NO: 173332 - DNA, 36 bp, Artificial Sequence
  Description of Artificial Sequence: Synthetic oligonucleotide
aaacagtggaccgctttcaaatattgacactgtggc

SEQ ID NO: 173333 - DNA, 35 bp, Artificial Sequence
  Description of Artificial Sequence: Synthetic oligonucleotide
aacagtggaccgctttcaaatattgacactgtggc

SEQ ID NO: 173334 - DNA, 34 bp, Artificial Sequence
  Description of Artificial Sequence: Synthetic oligonucleotide
acagtggaccgctttcaaatattgacactgtggc

SEQ ID NO: 173335 - DNA, 33 bp, Artificial Sequence
  Description of Artificial Sequence: Synthetic oligonucleotide
cagtggaccgctttcaaatattgacactgtggc

SEQ ID NO: 173336 - DNA, 34 bp, Artificial Sequence
  Description of Artificial Sequence: Synthetic oligonucleotide
agtggaccgctttcaaatattgacactgtggctc

SEQ ID NO: 173337 - DNA, 33 bp, Artificial Sequence
  Description of Artificial Sequence: Synthetic oligonucleotide
gtggaccgctttcaaatattgacactgtggctc

SEQ ID NO: 173338 - DNA, 33 bp, Artificial Sequence
  Description of Artificial Sequence: Synthetic oligonucleotide
tggaccgctttcaaatattgacactgtggctcc

SEQ ID NO: 173339 - DNA, 32 bp, Artificial Sequence
  Description of Artificial Sequence: Synthetic oligonucleotide
ggaccgctttcaaatattgacactgtggctcc

SEQ ID NO: 173340 - DNA, 32 bp, Artificial Sequence
  Description of Artificial Sequence: Synthetic oligonucleotide
gaccgctttcaaatattgacactgtggctccc

SEQ ID NO: 173341 - DNA, 32 bp, Artificial Sequence
  Description of Artificial Sequence: Synthetic oligonucleotide
accgctttcaaatattgacactgtggctcccc

SEQ ID NO: 173342 - DNA, 31 bp, Artificial Sequence
  Description of Artificial Sequence: Synthetic oligonucleotide
ccgctttcaaatattgacactgtggctcccc

SEQ ID NO: 173343 - DNA, 31 bp, Artificial Sequence
  Description of Artificial Sequence: Synthetic oligonucleotide
cgctttcaaatattgacactgtggctccccg

SEQ ID NO: 173344 - DNA, 32 bp, Artificial Sequence
  Description of Artificial Sequence: Synthetic oligonucleotide
gctttcaaatattgacactgtggctccccgac

SEQ ID NO: 173345 - DNA, 33 bp, Artificial Sequence
  Description of Artificial Sequence: Synthetic oligonucleotide
ctttcaaatattgacactgtggctccccgactc

SEQ ID NO: 173346 - DNA, 34 bp, Artificial Sequence
  Description of Artificial Sequence: Synthetic oligonucleotide
tttcaaatattgacactgtggctccccgactctc

SEQ ID NO: 173347 - DNA, 33 bp, Artificial Sequence
  Description of Artificial Sequence: Synthetic oligonucleotide
ttcaaatattgacactgtggctccccgactctc

SEQ ID NO: 173348 - DNA, 32 bp, Artificial Sequence
  Description of Artificial Sequence: Synthetic oligonucleotide
tcaaatattgacactgtggctccccgactctc

SEQ ID NO: 173349 - DNA, 31 bp, Artificial Sequence
  Description of Artificial Sequence: Synthetic oligonucleotide
caaatattgacactgtggctccccgactctc

SEQ ID NO: 173350 - DNA, 32 bp, Artificial Sequence
  Description of Artificial Sequence: Synthetic oligonucleotide
aaatattgacactgtggctccccgactctctg

SEQ ID NO: 173351 - DNA, 31 bp, Artificial Sequence
  Description of Artificial Sequence: Synthetic oligonucleotide
aatattgacactgtggctccccgactctctg

SEQ ID NO: 173352 - DNA, 30 bp, Artificial Sequence
  Description of Artificial Sequence: Synthetic oligonucleotide
atattgacactgtggctccccgactctctg

SEQ ID NO: 173353 - DNA, 29 bp, Artificial Sequence
  Description of Artificial Sequence: Synthetic oligonucleotide
tattgacactgtggctccccgactctctg

SEQ ID NO: 173354 - DNA, 28 bp, Artificial Sequence
  Description of Artificial Sequence: Synthetic oligonucleotide
attgacactgtggctccccgactctctg

SEQ ID NO: 173355 - DNA, 27 bp, Artificial Sequence
  Description of Artificial Sequence: Synthetic oligonucleotide
ttgacactgtggctccccgactctctg

SEQ ID NO: 173356 - DNA, 27 bp, Artificial Sequence
  Description of Artificial Sequence: Synthetic oligonucleotide
tgacactgtggctccccgactctctga

SEQ ID NO: 173357 - DNA, 26 bp, Artificial Sequence
  Description of Artificial Sequence: Synthetic oligonucleotide
gacactgtggctccccgactctctga

SEQ ID NO: 173358 - DNA, 26 bp, Artificial Sequence
  Description of Artificial Sequence: Synthetic oligonucleotide
acactgtggctccccgactctctgac

SEQ ID NO: 173359 - DNA, 25 bp, Artificial Sequence
  Description of Artificial Sequence: Synthetic oligonucleotide
cactgtggctccccgactctctgac

SEQ ID NO: 173360 - DNA, 26 bp, Artificial Sequence
  Description of Artificial Sequence: Synthetic oligonucleotide
actgtggctccccgactctctgacca

SEQ ID NO: 173361 - DNA, 25 bp, Artificial Sequence
  Description of Artificial Sequence: Synthetic oligonucleotide
ctgtggctccccgactctctgacca

SEQ ID NO: 173362 - DNA, 25 bp, Artificial Sequence
  Description of Artificial Sequence: Synthetic oligonucleotide
tgtggctccccgactctctgaccac

SEQ ID NO: 173363 - DNA, 24 bp, Artificial Sequence
  Description of Artificial Sequence: Synthetic oligonucleotide
gtggctccccgactctctgaccac

SEQ ID NO: 173364 - DNA, 25 bp, Artificial Sequence
  Description of Artificial Sequence: Synthetic oligonucleotide
tggctccccgactctctgaccacgt

SEQ ID NO: 173365 - DNA, 24 bp, Artificial Sequence
  Description of Artificial Sequence: Synthetic oligonucleotide
ggctccccgactctctgaccacgt

SEQ ID NO: 173366 - DNA, 24 bp, Artificial Sequence
  Description of Artificial Sequence: Synthetic oligonucleotide
gctccccgactctctgaccacgtg

SEQ ID NO: 173367 - DNA, 24 bp, Artificial Sequence
  Description of Artificial Sequence: Synthetic oligonucleotide
ctccccgactctctgaccacgtgg

SEQ ID NO: 173368 - DNA, 25 bp, Artificial Sequence
  Description of Artificial Sequence: Synthetic oligonucleotide
tccccgactctctgaccacgtggga

SEQ ID NO: 173369 - DNA, 24 bp, Artificial Sequence
  Description of Artificial Sequence: Synthetic oligonucleotide
ccccgactctctgaccacgtggga

SEQ ID NO: 173370 - DNA, 26 bp, Artificial Sequence
  Description of Artificial Sequence: Synthetic oligonucleotide
cccgactctctgaccacgtgggagat

SEQ ID NO: 173371 - DNA, 26 bp, Artificial Sequence
  Description of Artificial Sequence: Synthetic oligonucleotide
ccgactctctgaccacgtgggagatc

SEQ ID NO: 173372 - DNA, 27 bp, Artificial Sequence
  Description of Artificial Sequence: Synthetic oligonucleotide
cgactctctgaccacgtgggagatcca

SEQ ID NO: 173373 - DNA, 28 bp, Artificial Sequence
  Description of Artificial Sequence: Synthetic oligonucleotide
gactctctgaccacgtgggagatccatg

SEQ ID NO: 173374 - DNA, 28 bp, Artificial Sequence
  Description of Artificial Sequence: Synthetic oligonucleotide
actctctgaccacgtgggagatccatgg

SEQ ID NO: 173375 - DNA, 27 bp, Artificial Sequence
  Description of Artificial Sequence: Synthetic oligonucleotide
ctctctgaccacgtgggagatccatgg

SEQ ID NO: 173376 - DNA, 27 bp, Artificial Sequence
  Description of Artificial Sequence: Synthetic oligonucleotide
tctctgaccacgtgggagatccatggc

SEQ ID NO: 173377 - DNA, 26 bp, Artificial Sequence
  Description of Artificial Sequence: Synthetic oligonucleotide
ctctgaccacgtgggagatccatggc

SEQ ID NO: 173378 - DNA, 27 bp, Artificial Sequence
  Description of Artificial Sequence: Synthetic oligonucleotide
tctgaccacgtgggagatccatggcct

SEQ ID NO: 173379 - DNA, 26 bp, Artificial Sequence
  Description of Artificial Sequence: Synthetic oligonucleotide
ctgaccacgtgggagatccatggcct

SEQ ID NO: 173380 - DNA, 27 bp, Artificial Sequence
  Description of Artificial Sequence: Synthetic oligonucleotide
tgaccacgtgggagatccatggcctga

SEQ ID NO: 173381 - DNA, 26 bp, Artificial Sequence
  Description of Artificial Sequence: Synthetic oligonucleotide
gaccacgtgggagatccatggcctga

SEQ ID NO: 173382 - DNA, 26 bp, Artificial Sequence
  Description of Artificial Sequence: Synthetic oligonucleotide
accacgtgggagatccatggcctgag

SEQ ID NO: 173383 - DNA, 25 bp, Artificial Sequence
  Description of Artificial Sequence: Synthetic oligonucleotide
ccacgtgggagatccatggcctgag

SEQ ID NO: 173384 - DNA, 25 bp, Artificial Sequence
  Description of Artificial Sequence: Synthetic oligonucleotide
cacgtgggagatccatggcctgagc

SEQ ID NO: 173385 - DNA, 26 bp, Artificial Sequence
  Description of Artificial Sequence: Synthetic oligonucleotide
acgtgggagatccatggcctgagcct

SEQ ID NO: 173386 - DNA, 25 bp, Artificial Sequence
  Description of Artificial Sequence: Synthetic oligonucleotide
cgtgggagatccatggcctgagcct

SEQ ID NO: 173387 - DNA, 26 bp, Artificial Sequence
  Description of Artificial Sequence: Synthetic oligonucleotide
gtgggagatccatggcctgagcctgt

SEQ ID NO: 173388 - DNA, 26 bp, Artificial Sequence
  Description of Artificial Sequence: Synthetic oligonucleotide
tgggagatccatggcctgagcctgtc

SEQ ID NO: 173389 - DNA, 25 bp, Artificial Sequence
  Description of Artificial Sequence: Synthetic oligonucleotide
gggagatccatggcctgagcctgtc

SEQ ID NO: 173390 - DNA, 27 bp, Artificial Sequence
  Description of Artificial Sequence: Synthetic oligonucleotide
ggagatccatggcctgagcctgtccaa

SEQ ID NO: 173391 - DNA, 29 bp, Artificial Sequence
  Description of Artificial Sequence: Synthetic oligonucleotide
gagatccatggcctgagcctgtccaaaac

SEQ ID NO: 173392 - DNA, 29 bp, Artificial Sequence
  Description of Artificial Sequence: Synthetic oligonucleotide
agatccatggcctgagcctgtccaaaacc

SEQ ID NO: 173393 - DNA, 28 bp, Artificial Sequence
  Description of Artificial Sequence: Synthetic oligonucleotide
gatccatggcctgagcctgtccaaaacc

SEQ ID NO: 173394 - DNA, 31 bp, Artificial Sequence
  Description of Artificial Sequence: Synthetic oligonucleotide
atccatggcctgagcctgtccaaaaccaaag

SEQ ID NO: 173395 - DNA, 30 bp, Artificial Sequence
  Description of Artificial Sequence: Synthetic oligonucleotide
tccatggcctgagcctgtccaaaaccaaag

SEQ ID NO: 173396 - DNA, 29 bp, Artificial Sequence
  Description of Artificial Sequence: Synthetic oligonucleotide
ccatggcctgagcctgtccaaaaccaaag

SEQ ID NO: 173397 - DNA, 29 bp, Artificial Sequence
  Description of Artificial Sequence: Synthetic oligonucleotide
catggcctgagcctgtccaaaaccaaagg

SEQ ID NO: 173398 - DNA, 29 bp, Artificial Sequence
  Description of Artificial Sequence: Synthetic oligonucleotide
atggcctgagcctgtccaaaaccaaaggc

SEQ ID NO: 173399 - DNA, 28 bp, Artificial Sequence
  Description of Artificial Sequence: Synthetic oligonucleotide
tggcctgagcctgtccaaaaccaaaggc

SEQ ID NO: 173400 - DNA, 27 bp, Artificial Sequence
  Description of Artificial Sequence: Synthetic oligonucleotide
ggcctgagcctgtccaaaaccaaaggc

SEQ ID NO: 173401 - DNA, 27 bp, Artificial Sequence
  Description of Artificial Sequence: Synthetic oligonucleotide
gcctgagcctgtccaaaaccaaaggcc

SEQ ID NO: 173402 - DNA, 30 bp, Artificial Sequence
  Description of Artificial Sequence: Synthetic oligonucleotide
cctgagcctgtccaaaaccaaaggcctatg

SEQ ID NO: 173403 - DNA, 31 bp, Artificial Sequence
  Description of Artificial Sequence: Synthetic oligonucleotide
ctgagcctgtccaaaaccaaaggcctatgtg

SEQ ID NO: 173404 - DNA, 32 bp, Artificial Sequence
  Description of Artificial Sequence: Synthetic oligonucleotide
tgagcctgtccaaaaccaaaggcctatgtgtg

SEQ ID NO: 173405 - DNA, 31 bp, Artificial Sequence
  Description of Artificial Sequence: Synthetic oligonucleotide
gagcctgtccaaaaccaaaggcctatgtgtg

SEQ ID NO: 173406 - DNA, 31 bp, Artificial Sequence
  Description of Artificial Sequence: Synthetic oligonucleotide
agcctgtccaaaaccaaaggcctatgtgtgg

SEQ ID NO: 173407 - DNA, 30 bp, Artificial Sequence
  Description of Artificial Sequence: Synthetic oligonucleotide
gcctgtccaaaaccaaaggcctatgtgtgg

SEQ ID NO: 173408 - DNA, 30 bp, Artificial Sequence
  Description of Artificial Sequence: Synthetic oligonucleotide
cctgtccaaaaccaaaggcctatgtgtggc

SEQ ID NO: 173409 - DNA, 30 bp, Artificial Sequence
  Description of Artificial Sequence: Synthetic oligonucleotide
ctgtccaaaaccaaaggcctatgtgtggcc

SEQ ID NO: 173410 - DNA, 31 bp, Artificial Sequence
  Description of Artificial Sequence: Synthetic oligonucleotide
tgtccaaaaccaaaggcctatgtgtggccac

SEQ ID NO: 173411 - DNA, 30 bp, Artificial Sequence
  Description of Artificial Sequence: Synthetic oligonucleotide
gtccaaaaccaaaggcctatgtgtggccac

SEQ ID NO: 173412 - DNA, 30 bp, Artificial Sequence
  Description of Artificial Sequence: Synthetic oligonucleotide
tccaaaaccaaaggcctatgtgtggccacc

SEQ ID NO: 173413 - DNA, 29 bp, Artificial Sequence
  Description of Artificial Sequence: Synthetic oligonucleotide
ccaaaaccaaaggcctatgtgtggccacc

SEQ ID NO: 173414 - DNA, 29 bp, Artificial Sequence
  Description of Artificial Sequence: Synthetic oligonucleotide
caaaaccaaaggcctatgtgtggccaccc

SEQ ID NO: 173415 - DNA, 29 bp, Artificial Sequence
  Description of Artificial Sequence: Synthetic oligonucleotide
aaaaccaaaggcctatgtgtggccacccc

SEQ ID NO: 173416 - DNA, 28 bp, Artificial Sequence
  Description of Artificial Sequence: Synthetic oligonucleotide
aaaccaaaggcctatgtgtggccacccc

SEQ ID NO: 173417 - DNA, 27 bp, Artificial Sequence
  Description of Artificial Sequence: Synthetic oligonucleotide
aaccaaaggcctatgtgtggccacccc

SEQ ID NO: 173418 - DNA, 27 bp, Artificial Sequence
  Description of Artificial Sequence: Synthetic oligonucleotide
accaaaggcctatgtgtggccacccca

SEQ ID NO: 173419 - DNA, 26 bp, Artificial Sequence
  Description of Artificial Sequence: Synthetic oligonucleotide
ccaaaggcctatgtgtggccacccca

SEQ ID NO: 173420 - DNA, 27 bp, Artificial Sequence
  Description of Artificial Sequence: Synthetic oligonucleotide
caaaggcctatgtgtggccaccccagt

SEQ ID NO: 173421 - DNA, 28 bp, Artificial Sequence
  Description of Artificial Sequence: Synthetic oligonucleotide
aaaggcctatgtgtggccaccccagttc

SEQ ID NO: 173422 - DNA, 27 bp, Artificial Sequence
  Description of Artificial Sequence: Synthetic oligonucleotide
aaggcctatgtgtggccaccccagttc

SEQ ID NO: 173423 - DNA, 27 bp, Artificial Sequence
  Description of Artificial Sequence: Synthetic oligonucleotide
aggcctatgtgtggccaccccagttca

SEQ ID NO: 173424 - DNA, 26 bp, Artificial Sequence
  Description of Artificial Sequence: Synthetic oligonucleotide
ggcctatgtgtggccaccccagttca

SEQ ID NO: 173425 - DNA, 26 bp, Artificial Sequence
  Description of Artificial Sequence: Synthetic oligonucleotide
gcctatgtgtggccaccccagttcag

SEQ ID NO: 173426 - DNA, 27 bp, Artificial Sequence
  Description of Artificial Sequence: Synthetic oligonucleotide
cctatgtgtggccaccccagttcagct

SEQ ID NO: 173427 - DNA, 27 bp, Artificial Sequence
  Description of Artificial Sequence: Synthetic oligonucleotide
ctatgtgtggccaccccagttcagctc

SEQ ID NO: 173428 - DNA, 27 bp, Artificial Sequence
  Description of Artificial Sequence: Synthetic oligonucleotide
tatgtgtggccaccccagttcagctcc

SEQ ID NO: 173429 - DNA, 26 bp, Artificial Sequence
  Description of Artificial Sequence: Synthetic oligonucleotide
atgtgtggccaccccagttcagctcc

SEQ ID NO: 173430 - DNA, 25 bp, Artificial Sequence
  Description of Artificial Sequence: Synthetic oligonucleotide
tgtgtggccaccccagttcagctcc

SEQ ID NO: 173431 - DNA, 24 bp, Artificial Sequence
  Description of Artificial Sequence: Synthetic oligonucleotide
gtgtggccaccccagttcagctcc

SEQ ID NO: 173432 - DNA, 24 bp, Artificial Sequence
  Description of Artificial Sequence: Synthetic oligonucleotide
tgtggccaccccagttcagctccg

SEQ ID NO: 173433 - DNA, 23 bp, Artificial Sequence
  Description of Artificial Sequence: Synthetic oligonucleotide
gtggccaccccagttcagctccg

SEQ ID NO: 173434 - DNA, 23 bp, Artificial Sequence
  Description of Artificial Sequence: Synthetic oligonucleotide
tggccaccccagttcagctccgg

SEQ ID NO: 173435 - DNA, 22 bp, Artificial Sequence
  Description of Artificial Sequence: Synthetic oligonucleotide
ggccaccccagttcagctccgg

SEQ ID NO: 173436 - DNA, 23 bp, Artificial Sequence
  Description of Artificial Sequence: Synthetic oligonucleotide
gccaccccagttcagctccgggt

SEQ ID NO: 173437 - DNA, 25 bp, Artificial Sequence
  Description of Artificial Sequence: Synthetic oligonucleotide
ccaccccagttcagctccgggtgtt

SEQ ID NO: 173438 - DNA, 25 bp, Artificial Sequence
  Description of Artificial Sequence: Synthetic oligonucleotide
caccccagttcagctccgggtgttc

SEQ ID NO: 173439 - DNA, 25 bp, Artificial Sequence
  Description of Artificial Sequence: Synthetic oligonucleotide
accccagttcagctccgggtgttcc

SEQ ID NO: 173440 - DNA, 24 bp, Artificial Sequence
  Description of Artificial Sequence: Synthetic oligonucleotide
ccccagttcagctccgggtgttcc

SEQ ID NO: 173441 - DNA, 24 bp, Artificial Sequence
  Description of Artificial Sequence: Synthetic oligonucleotide
cccagttcagctccgggtgttccg

SEQ ID NO: 173442 - DNA, 24 bp, Artificial Sequence
  Description of Artificial Sequence: Synthetic oligonucleotide
ccagttcagctccgggtgttccgc

SEQ ID NO: 173443 - DNA, 25 bp, Artificial Sequence
  Description of Artificial Sequence: Synthetic oligonucleotide
cagttcagctccgggtgttccgcga

SEQ ID NO: 173444 - DNA, 27 bp, Artificial Sequence
  Description of Artificial Sequence: Synthetic oligonucleotide
agttcagctccgggtgttccgcgagtt

SEQ ID NO: 173445 - DNA, 26 bp, Artificial Sequence
  Description of Artificial Sequence: Synthetic oligonucleotide
gttcagctccgggtgttccgcgagtt

SEQ ID NO: 173446 - DNA, 26 bp, Artificial Sequence
  Description of Artificial Sequence: Synthetic oligonucleotide
ttcagctccgggtgttccgcgagttc

SEQ ID NO: 173447 - DNA, 25 bp, Artificial Sequence
  Description of Artificial Sequence: Synthetic oligonucleotide
tcagctccgggtgttccgcgagttc

SEQ ID NO: 173448 - DNA, 24 bp, Artificial Sequence
  Description of Artificial Sequence: Synthetic oligonucleotide
cagctccgggtgttccgcgagttc

SEQ ID NO: 173449 - DNA, 25 bp, Artificial Sequence
  Description of Artificial Sequence: Synthetic oligonucleotide
agctccgggtgttccgcgagttcca

SEQ ID NO: 173450 - DNA, 24 bp, Artificial Sequence
  Description of Artificial Sequence: Synthetic oligonucleotide
gctccgggtgttccgcgagttcca

SEQ ID NO: 173451 - DNA, 24 bp, Artificial Sequence
  Description of Artificial Sequence: Synthetic oligonucleotide
ctccgggtgttccgcgagttccac

SEQ ID NO: 173452 - DNA, 25 bp, Artificial Sequence
  Description of Artificial Sequence: Synthetic oligonucleotide
tccgggtgttccgcgagttccacct

SEQ ID NO: 173453 - DNA, 24 bp, Artificial Sequence
  Description of Artificial Sequence: Synthetic oligonucleotide
ccgggtgttccgcgagttccacct

SEQ ID NO: 173454 - DNA, 24 bp, Artificial Sequence
  Description of Artificial Sequence: Synthetic oligonucleotide
cgggtgttccgcgagttccacctg

SEQ ID NO: 173455 - DNA, 25 bp, Artificial Sequence
  Description of Artificial Sequence: Synthetic oligonucleotide
gggtgttccgcgagttccacctgca

SEQ ID NO: 173456 - DNA, 25 bp, Artificial Sequence
  Description of Artificial Sequence: Synthetic oligonucleotide
ggtgttccgcgagttccacctgcac

SEQ ID NO: 173457 - DNA, 26 bp, Artificial Sequence
  Description of Artificial Sequence: Synthetic oligonucleotide
gtgttccgcgagttccacctgcacct

SEQ ID NO: 173458 - DNA, 26 bp, Artificial Sequence
  Description of Artificial Sequence: Synthetic oligonucleotide
tgttccgcgagttccacctgcacctc

SEQ ID NO: 173459 - DNA, 25 bp, Artificial Sequence
  Description of Artificial Sequence: Synthetic oligonucleotide
gttccgcgagttccacctgcacctc

SEQ ID NO: 173460 - DNA, 25 bp, Artificial Sequence
  Description of Artificial Sequence: Synthetic oligonucleotide
ttccgcgagttccacctgcacctcc

SEQ ID NO: 173461 - DNA, 24 bp, Artificial Sequence
  Description of Artificial Sequence: Synthetic oligonucleotide
tccgcgagttccacctgcacctcc

SEQ ID NO: 173462 - DNA, 23 bp, Artificial Sequence
  Description of Artificial Sequence: Synthetic oligonucleotide
ccgcgagttccacctgcacctcc

SEQ ID NO: 173463 - DNA, 23 bp, Artificial Sequence
  Description of Artificial Sequence: Synthetic oligonucleotide
cgcgagttccacctgcacctccg

SEQ ID NO: 173464 - DNA, 23 bp, Artificial Sequence
  Description of Artificial Sequence: Synthetic oligonucleotide
gcgagttccacctgcacctccgc

SEQ ID NO: 173465 - DNA, 24 bp, Artificial Sequence
  Description of Artificial Sequence: Synthetic oligonucleotide
cgagttccacctgcacctccgcct

SEQ ID NO: 173466 - DNA, 24 bp, Artificial Sequence
  Description of Artificial Sequence: Synthetic oligonucleotide
gagttccacctgcacctccgcctg

SEQ ID NO: 173467 - DNA, 24 bp, Artificial Sequence
  Description of Artificial Sequence: Synthetic oligonucleotide
agttccacctgcacctccgcctgc

SEQ ID NO: 173468 - DNA, 23 bp, Artificial Sequence
  Description of Artificial Sequence: Synthetic oligonucleotide
gttccacctgcacctccgcctgc

SEQ ID NO: 173469 - DNA, 23 bp, Artificial Sequence
  Description of Artificial Sequence: Synthetic oligonucleotide
ttccacctgcacctccgcctgcc

SEQ ID NO: 173470 - DNA, 22 bp, Artificial Sequence
  Description of Artificial Sequence: Synthetic oligonucleotide
tccacctgcacctccgcctgcc

SEQ ID NO: 173471 - DNA, 21 bp, Artificial Sequence
  Description of Artificial Sequence: Synthetic oligonucleotide
ccacctgcacctccgcctgcc

SEQ ID NO: 173472 - DNA, 23 bp, Artificial Sequence
  Description of Artificial Sequence: Synthetic oligonucleotide
cacctgcacctccgcctgcccat

SEQ ID NO: 173473 - DNA, 24 bp, Artificial Sequence
  Description of Artificial Sequence: Synthetic oligonucleotide
acctgcacctccgcctgcccatgt

SEQ ID NO: 173474 - DNA, 23 bp, Artificial Sequence
  Description of Artificial Sequence: Synthetic oligonucleotide
cctgcacctccgcctgcccatgt

SEQ ID NO: 173475 - DNA, 24 bp, Artificial Sequence
  Description of Artificial Sequence: Synthetic oligonucleotide
ctgcacctccgcctgcccatgtct

SEQ ID NO: 173476 - DNA, 25 bp, Artificial Sequence
  Description of Artificial Sequence: Synthetic oligonucleotide
tgcacctccgcctgcccatgtctgt

SEQ ID NO: 173477 - DNA, 24 bp, Artificial Sequence
  Description of Artificial Sequence: Synthetic oligonucleotide
gcacctccgcctgcccatgtctgt

SEQ ID NO: 173478 - DNA, 24 bp, Artificial Sequence
  Description of Artificial Sequence: Synthetic oligonucleotide
cacctccgcctgcccatgtctgtc

SEQ ID NO: 173479 - DNA, 24 bp, Artificial Sequence
  Description of Artificial Sequence: Synthetic oligonucleotide
acctccgcctgcccatgtctgtcc

SEQ ID NO: 173480 - DNA, 23 bp, Artificial Sequence
  Description of Artificial Sequence: Synthetic oligonucleotide
cctccgcctgcccatgtctgtcc

SEQ ID NO: 173481 - DNA, 23 bp, Artificial Sequence
  Description of Artificial Sequence: Synthetic oligonucleotide
ctccgcctgcccatgtctgtccg

SEQ ID NO: 173482 - DNA, 23 bp, Artificial Sequence
  Description of Artificial Sequence: Synthetic oligonucleotide
tccgcctgcccatgtctgtccgc

SEQ ID NO: 173483 - DNA, 22 bp, Artificial Sequence
  Description of Artificial Sequence: Synthetic oligonucleotide
ccgcctgcccatgtctgtccgc

SEQ ID NO: 173484 - DNA, 22 bp, Artificial Sequence
  Description of Artificial Sequence: Synthetic oligonucleotide
cgcctgcccatgtctgtccgcc

SEQ ID NO: 173485 - DNA, 22 bp, Artificial Sequence
  Description of Artificial Sequence: Synthetic oligonucleotide
gcctgcccatgtctgtccgccg

SEQ ID NO: 173486 - DNA, 25 bp, Artificial Sequence
  Description of Artificial Sequence: Synthetic oligonucleotide
cctgcccatgtctgtccgccgcttt

SEQ ID NO: 173487 - DNA, 26 bp, Artificial Sequence
  Description of Artificial Sequence: Synthetic oligonucleotide
ctgcccatgtctgtccgccgctttga

SEQ ID NO: 173488 - DNA, 26 bp, Artificial Sequence
  Description of Artificial Sequence: Synthetic oligonucleotide
tgcccatgtctgtccgccgctttgag

SEQ ID NO: 173489 - DNA, 25 bp, Artificial Sequence
  Description of Artificial Sequence: Synthetic oligonucleotide
gcccatgtctgtccgccgctttgag

SEQ ID NO: 173490 - DNA, 26 bp, Artificial Sequence
  Description of Artificial Sequence: Synthetic oligonucleotide
cccatgtctgtccgccgctttgagca

SEQ ID NO: 173491 - DNA, 26 bp, Artificial Sequence
  Description of Artificial Sequence: Synthetic oligonucleotide
ccatgtctgtccgccgctttgagcag

SEQ ID NO: 173492 - DNA, 27 bp, Artificial Sequence
  Description of Artificial Sequence: Synthetic oligonucleotide
catgtctgtccgccgctttgagcagct

SEQ ID NO: 173493 - DNA, 27 bp, Artificial Sequence
  Description of Artificial Sequence: Synthetic oligonucleotide
atgtctgtccgccgctttgagcagctg

SEQ ID NO: 173494 - DNA, 26 bp, Artificial Sequence
  Description of Artificial Sequence: Synthetic oligonucleotide
tgtctgtccgccgctttgagcagctg

SEQ ID NO: 173495 - DNA, 25 bp, Artificial Sequence
  Description of Artificial Sequence: Synthetic oligonucleotide
gtctgtccgccgctttgagcagctg

SEQ ID NO: 173496 - DNA, 26 bp, Artificial Sequence
  Description of Artificial Sequence: Synthetic oligonucleotide
tctgtccgccgctttgagcagctgga

SEQ ID NO: 173497 - DNA, 25 bp, Artificial Sequence
  Description of Artificial Sequence: Synthetic oligonucleotide
ctgtccgccgctttgagcagctgga

SEQ ID NO: 173498 - DNA, 25 bp, Artificial Sequence
  Description of Artificial Sequence: Synthetic oligonucleotide
tgtccgccgctttgagcagctggag

SEQ ID NO: 173499 - DNA, 24 bp, Artificial Sequence
  Description of Artificial Sequence: Synthetic oligonucleotide
gtccgccgctttgagcagctggag

SEQ ID NO: 173500 - DNA, 25 bp, Artificial Sequence
  Description of Artificial Sequence: Synthetic oligonucleotide
tccgccgctttgagcagctggagct

SEQ ID NO: 173501 - DNA, 24 bp, Artificial Sequence
  Description of Artificial Sequence: Synthetic oligonucleotide
ccgccgctttgagcagctggagct

SEQ ID NO: 173502 - DNA, 24 bp, Artificial Sequence
  Description of Artificial Sequence: Synthetic oligonucleotide
cgccgctttgagcagctggagctg

SEQ ID NO: 173503 - DNA, 24 bp, Artificial Sequence
  Description of Artificial Sequence: Synthetic oligonucleotide
gccgctttgagcagctggagctgc

SEQ ID NO: 173504 - DNA, 24 bp, Artificial Sequence
  Description of Artificial Sequence: Synthetic oligonucleotide
ccgctttgagcagctggagctgcg

SEQ ID NO: 173505 - DNA, 24 bp, Artificial Sequence
  Description of Artificial Sequence: Synthetic oligonucleotide
cgctttgagcagctggagctgcgg

SEQ ID NO: 173506 - DNA, 24 bp, Artificial Sequence
  Description of Artificial Sequence: Synthetic oligonucleotide
gctttgagcagctggagctgcggc

SEQ ID NO: 173507 - DNA, 25 bp, Artificial Sequence
  Description of Artificial Sequence: Synthetic oligonucleotide
ctttgagcagctggagctgcggcct

SEQ ID NO: 173508 - DNA, 26 bp, Artificial Sequence
  Description of Artificial Sequence: Synthetic oligonucleotide
tttgagcagctggagctgcggcctgt

SEQ ID NO: 173509 - DNA, 25 bp, Artificial Sequence
  Description of Artificial Sequence: Synthetic oligonucleotide
ttgagcagctggagctgcggcctgt

SEQ ID NO: 173510 - DNA, 24 bp, Artificial Sequence
  Description of Artificial Sequence: Synthetic oligonucleotide
tgagcagctggagctgcggcctgt

SEQ ID NO: 173511 - DNA, 23 bp, Artificial Sequence
  Description of Artificial Sequence: Synthetic oligonucleotide
gagcagctggagctgcggcctgt

SEQ ID NO: 173512 - DNA, 23 bp, Artificial Sequence
  Description of Artificial Sequence: Synthetic oligonucleotide
agcagctggagctgcggcctgtc

SEQ ID NO: 173513 - DNA, 22 bp, Artificial Sequence
  Description of Artificial Sequence: Synthetic oligonucleotide
gcagctggagctgcggcctgtc

SEQ ID NO: 173514 - DNA, 23 bp, Artificial Sequence
  Description of Artificial Sequence: Synthetic oligonucleotide
cagctggagctgcggcctgtcct

SEQ ID NO: 173515 - DNA, 27 bp, Artificial Sequence
  Description of Artificial Sequence: Synthetic oligonucleotide
agctggagctgcggcctgtcctctata

SEQ ID NO: 173516 - DNA, 27 bp, Artificial Sequence
  Description of Artificial Sequence: Synthetic oligonucleotide
gctggagctgcggcctgtcctctataa

SEQ ID NO: 173517 - DNA, 27 bp, Artificial Sequence
  Description of Artificial Sequence: Synthetic oligonucleotide
ctggagctgcggcctgtcctctataac

SEQ ID NO: 173518 - DNA, 29 bp, Artificial Sequence
  Description of Artificial Sequence: Synthetic oligonucleotide
tggagctgcggcctgtcctctataactac

SEQ ID NO: 173519 - DNA, 28 bp, Artificial Sequence
  Description of Artificial Sequence: Synthetic oligonucleotide
ggagctgcggcctgtcctctataactac

SEQ ID NO: 173520 - DNA, 28 bp, Artificial Sequence
  Description of Artificial Sequence: Synthetic oligonucleotide
gagctgcggcctgtcctctataactacc

SEQ ID NO: 173521 - DNA, 29 bp, Artificial Sequence
  Description of Artificial Sequence: Synthetic oligonucleotide
agctgcggcctgtcctctataactacctg

SEQ ID NO: 173522 - DNA, 28 bp, Artificial Sequence
  Description of Artificial Sequence: Synthetic oligonucleotide
gctgcggcctgtcctctataactacctg

SEQ ID NO: 173523 - DNA, 28 bp, Artificial Sequence
  Description of Artificial Sequence: Synthetic oligonucleotide
ctgcggcctgtcctctataactacctgg

SEQ ID NO: 173524 - DNA, 35 bp, Artificial Sequence
  Description of Artificial Sequence: Synthetic oligonucleotide
tgcggcctgtcctctataactacctggataaaaac

SEQ ID NO: 173525 - DNA, 34 bp, Artificial Sequence
  Description of Artificial Sequence: Synthetic oligonucleotide
gcggcctgtcctctataactacctggataaaaac

SEQ ID NO: 173526 - DNA, 34 bp, Artificial Sequence
  Description of Artificial Sequence: Synthetic oligonucleotide
cggcctgtcctctataactacctggataaaaacc

SEQ ID NO: 173527 - DNA, 35 bp, Artificial Sequence
  Description of Artificial Sequence: Synthetic oligonucleotide
ggcctgtcctctataactacctggataaaaacctg

SEQ ID NO: 173528 - DNA, 36 bp, Artificial Sequence
  Description of Artificial Sequence: Synthetic oligonucleotide
gcctgtcctctataactacctggataaaaacctgac

SEQ ID NO: 173529 - DNA, 37 bp, Artificial Sequence
  Description of Artificial Sequence: Synthetic oligonucleotide
cctgtcctctataactacctggataaaaacctgactg

SEQ ID NO: 173530 - DNA, 38 bp, Artificial Sequence
  Description of Artificial Sequence: Synthetic oligonucleotide
ctgtcctctataactacctggataaaaacctgactgtg

SEQ ID NO: 173531 - DNA, 39 bp, Artificial Sequence
  Description of Artificial Sequence: Synthetic oligonucleotide
tgtcctctataactacctggataaaaacctgactgtgag

SEQ ID NO: 173532 - DNA, 38 bp, Artificial Sequence
  Description of Artificial Sequence: Synthetic oligonucleotide
gtcctctataactacctggataaaaacctgactgtgag

SEQ ID NO: 173533 - DNA, 38 bp, Artificial Sequence
  Description of Artificial Sequence: Synthetic oligonucleotide
tcctctataactacctggataaaaacctgactgtgagc

SEQ ID NO: 173534 - DNA, 37 bp, Artificial Sequence
  Description of Artificial Sequence: Synthetic oligonucleotide
cctctataactacctggataaaaacctgactgtgagc

SEQ ID NO: 173535 - DNA, 37 bp, Artificial Sequence
  Description of Artificial Sequence: Synthetic oligonucleotide
ctctataactacctggataaaaacctgactgtgagcg

SEQ ID NO: 173536 - DNA, 38 bp, Artificial Sequence
  Description of Artificial Sequence: Synthetic oligonucleotide
tctataactacctggataaaaacctgactgtgagcgtc

SEQ ID NO: 173537 - DNA, 37 bp, Artificial Sequence
  Description of Artificial Sequence: Synthetic oligonucleotide
ctataactacctggataaaaacctgactgtgagcgtc

SEQ ID NO: 173538 - DNA, 37 bp, Artificial Sequence
  Description of Artificial Sequence: Synthetic oligonucleotide
tataactacctggataaaaacctgactgtgagcgtcc

SEQ ID NO: 173539 - DNA, 36 bp, Artificial Sequence
  Description of Artificial Sequence: Synthetic oligonucleotide
ataactacctggataaaaacctgactgtgagcgtcc

SEQ ID NO: 173540 - DNA, 35 bp, Artificial Sequence
  Description of Artificial Sequence: Synthetic oligonucleotide
taactacctggataaaaacctgactgtgagcgtcc

SEQ ID NO: 173541 - DNA, 34 bp, Artificial Sequence
  Description of Artificial Sequence: Synthetic oligonucleotide
aactacctggataaaaacctgactgtgagcgtcc

SEQ ID NO: 173542 - DNA, 33 bp, Artificial Sequence
  Description of Artificial Sequence: Synthetic oligonucleotide
actacctggataaaaacctgactgtgagcgtcc

SEQ ID NO: 173543 - DNA, 32 bp, Artificial Sequence
  Description of Artificial Sequence: Synthetic oligonucleotide
ctacctggataaaaacctgactgtgagcgtcc

SEQ ID NO: 173544 - DNA, 33 bp, Artificial Sequence
  Description of Artificial Sequence: Synthetic oligonucleotide
tacctggataaaaacctgactgtgagcgtccac

SEQ ID NO: 173545 - DNA, 32 bp, Artificial Sequence
  Description of Artificial Sequence: Synthetic oligonucleotide
acctggataaaaacctgactgtgagcgtccac

SEQ ID NO: 173546 - DNA, 31 bp, Artificial Sequence
  Description of Artificial Sequence: Synthetic oligonucleotide
cctggataaaaacctgactgtgagcgtccac

SEQ ID NO: 173547 - DNA, 31 bp, Artificial Sequence
  Description of Artificial Sequence: Synthetic oligonucleotide
ctggataaaaacctgactgtgagcgtccacg

SEQ ID NO: 173548 - DNA, 32 bp, Artificial Sequence
  Description of Artificial Sequence: Synthetic oligonucleotide
tggataaaaacctgactgtgagcgtccacgtg

SEQ ID NO: 173549 - DNA, 31 bp, Artificial Sequence
  Description of Artificial Sequence: Synthetic oligonucleotide
ggataaaaacctgactgtgagcgtccacgtg

SEQ ID NO: 173550 - DNA, 32 bp, Artificial Sequence
  Description of Artificial Sequence: Synthetic oligonucleotide
gataaaaacctgactgtgagcgtccacgtgtc

SEQ ID NO: 173551 - DNA, 32 bp, Artificial Sequence
  Description of Artificial Sequence: Synthetic oligonucleotide
ataaaaacctgactgtgagcgtccacgtgtcc

SEQ ID NO: 173552 - DNA, 31 bp, Artificial Sequence
  Description of Artificial Sequence: Synthetic oligonucleotide
taaaaacctgactgtgagcgtccacgtgtcc

SEQ ID NO: 173553 - DNA, 30 bp, Artificial Sequence
  Description of Artificial Sequence: Synthetic oligonucleotide
aaaaacctgactgtgagcgtccacgtgtcc

SEQ ID NO: 173554 - DNA, 29 bp, Artificial Sequence
  Description of Artificial Sequence: Synthetic oligonucleotide
aaaacctgactgtgagcgtccacgtgtcc

SEQ ID NO: 173555 - DNA, 28 bp, Artificial Sequence
  Description of Artificial Sequence: Synthetic oligonucleotide
aaacctgactgtgagcgtccacgtgtcc

SEQ ID NO: 173556 - DNA, 27 bp, Artificial Sequence
  Description of Artificial Sequence: Synthetic oligonucleotide
aacctgactgtgagcgtccacgtgtcc

SEQ ID NO: 173557 - DNA, 26 bp, Artificial Sequence
  Description of Artificial Sequence: Synthetic oligonucleotide
acctgactgtgagcgtccacgtgtcc

SEQ ID NO: 173558 - DNA, 25 bp, Artificial Sequence
  Description of Artificial Sequence: Synthetic oligonucleotide
cctgactgtgagcgtccacgtgtcc

SEQ ID NO: 173559 - DNA, 25 bp, Artificial Sequence
  Description of Artificial Sequence: Synthetic oligonucleotide
ctgactgtgagcgtccacgtgtccc

SEQ ID NO: 173560 - DNA, 26 bp, Artificial Sequence
  Description of Artificial Sequence: Synthetic oligonucleotide
tgactgtgagcgtccacgtgtcccca

SEQ ID NO: 173561 - DNA, 25 bp, Artificial Sequence
  Description of Artificial Sequence: Synthetic oligonucleotide
gactgtgagcgtccacgtgtcccca

SEQ ID NO: 173562 - DNA, 26 bp, Artificial Sequence
  Description of Artificial Sequence: Synthetic oligonucleotide
actgtgagcgtccacgtgtccccagt

SEQ ID NO: 173563 - DNA, 25 bp, Artificial Sequence
  Description of Artificial Sequence: Synthetic oligonucleotide
ctgtgagcgtccacgtgtccccagt

SEQ ID NO: 173564 - DNA, 25 bp, Artificial Sequence
  Description of Artificial Sequence: Synthetic oligonucleotide
tgtgagcgtccacgtgtccccagtg

SEQ ID NO: 173565 - DNA, 24 bp, Artificial Sequence
  Description of Artificial Sequence: Synthetic oligonucleotide
gtgagcgtccacgtgtccccagtg

SEQ ID NO: 173566 - DNA, 25 bp, Artificial Sequence
  Description of Artificial Sequence: Synthetic oligonucleotide
tgagcgtccacgtgtccccagtgga

SEQ ID NO: 173567 - DNA, 24 bp, Artificial Sequence
  Description of Artificial Sequence: Synthetic oligonucleotide
gagcgtccacgtgtccccagtgga

SEQ ID NO: 173568 - DNA, 24 bp, Artificial Sequence
  Description of Artificial Sequence: Synthetic oligonucleotide
agcgtccacgtgtccccagtggag

SEQ ID NO: 173569 - DNA, 23 bp, Artificial Sequence
  Description of Artificial Sequence: Synthetic oligonucleotide
gcgtccacgtgtccccagtggag

SEQ ID NO: 173570 - DNA, 23 bp, Artificial Sequence
  Description of Artificial Sequence: Synthetic oligonucleotide
cgtccacgtgtccccagtggagg

SEQ ID NO: 173571 - DNA, 23 bp, Artificial Sequence
  Description of Artificial Sequence: Synthetic oligonucleotide
gtccacgtgtccccagtggaggg

SEQ ID NO: 173572 - DNA, 23 bp, Artificial Sequence
  Description of Artificial Sequence: Synthetic oligonucleotide
tccacgtgtccccagtggagggg

SEQ ID NO: 173573 - DNA, 22 bp, Artificial Sequence
  Description of Artificial Sequence: Synthetic oligonucleotide
ccacgtgtccccagtggagggg

SEQ ID NO: 173574 - DNA, 23 bp, Artificial Sequence
  Description of Artificial Sequence: Synthetic oligonucleotide
cacgtgtccccagtggaggggct

SEQ ID NO: 173575 - DNA, 24 bp, Artificial Sequence
  Description of Artificial Sequence: Synthetic oligonucleotide
acgtgtccccagtggaggggctgt

SEQ ID NO: 173576 - DNA, 23 bp, Artificial Sequence
  Description of Artificial Sequence: Synthetic oligonucleotide
cgtgtccccagtggaggggctgt

SEQ ID NO: 173577 - DNA, 23 bp, Artificial Sequence
  Description of Artificial Sequence: Synthetic oligonucleotide
gtgtccccagtggaggggctgtg

SEQ ID NO: 173578 - DNA, 23 bp, Artificial Sequence
  Description of Artificial Sequence: Synthetic oligonucleotide
tgtccccagtggaggggctgtgc

SEQ ID NO: 173579 - DNA, 22 bp, Artificial Sequence
  Description of Artificial Sequence: Synthetic oligonucleotide
gtccccagtggaggggctgtgc

SEQ ID NO: 173580 - DNA, 23 bp, Artificial Sequence
  Description of Artificial Sequence: Synthetic oligonucleotide
tccccagtggaggggctgtgcct

SEQ ID NO: 173581 - DNA, 22 bp, Artificial Sequence
  Description of Artificial Sequence: Synthetic oligonucleotide
ccccagtggaggggctgtgcct

SEQ ID NO: 173582 - DNA, 22 bp, Artificial Sequence
  Description of Artificial Sequence: Synthetic oligonucleotide
cccagtggaggggctgtgcctg

SEQ ID NO: 173583 - DNA, 22 bp, Artificial Sequence
  Description of Artificial Sequence: Synthetic oligonucleotide
ccagtggaggggctgtgcctgg

SEQ ID NO: 173584 - DNA, 23 bp, Artificial Sequence
  Description of Artificial Sequence: Synthetic oligonucleotide
cagtggaggggctgtgcctggct

SEQ ID NO: 173585 - DNA, 23 bp, Artificial Sequence
  Description of Artificial Sequence: Synthetic oligonucleotide
agtggaggggctgtgcctggctg

SEQ ID NO: 173586 - DNA, 22 bp, Artificial Sequence
  Description of Artificial Sequence: Synthetic oligonucleotide
gtggaggggctgtgcctggctg

SEQ ID NO: 173587 - DNA, 22 bp, Artificial Sequence
  Description of Artificial Sequence: Synthetic oligonucleotide
tggaggggctgtgcctggctgg

SEQ ID NO: 173588 - DNA, 21 bp, Artificial Sequence
  Description of Artificial Sequence: Synthetic oligonucleotide
ggaggggctgtgcctggctgg

SEQ ID NO: 173589 - DNA, 21 bp, Artificial Sequence
  Description of Artificial Sequence: Synthetic oligonucleotide
gaggggctgtgcctggctggg

SEQ ID NO: 173590 - DNA, 21 bp, Artificial Sequence
  Description of Artificial Sequence: Synthetic oligonucleotide
aggggctgtgcctggctgggg

SEQ ID NO: 173591 - DNA, 20 bp, Artificial Sequence
  Description of Artificial Sequence: Synthetic oligonucleotide
ggggctgtgcctggctgggg

SEQ ID NO: 173592 - DNA, 20 bp, Artificial Sequence
  Description of Artificial Sequence: Synthetic oligonucleotide
gggctgtgcctggctggggg

SEQ ID NO: 173593 - DNA, 20 bp, Artificial Sequence
  Description of Artificial Sequence: Synthetic oligonucleotide
ggctgtgcctggctgggggc

SEQ ID NO: 173594 - DNA, 20 bp, Artificial Sequence
  Description of Artificial Sequence: Synthetic oligonucleotide
gctgtgcctggctgggggcg

SEQ ID NO: 173595 - DNA, 21 bp, Artificial Sequence
  Description of Artificial Sequence: Synthetic oligonucleotide
ctgtgcctggctgggggcgga

SEQ ID NO: 173596 - DNA, 21 bp, Artificial Sequence
  Description of Artificial Sequence: Synthetic oligonucleotide
tgtgcctggctgggggcggag

SEQ ID NO: 173597 - DNA, 20 bp, Artificial Sequence
  Description of Artificial Sequence: Synthetic oligonucleotide
gtgcctggctgggggcggag

SEQ ID NO: 173598 - DNA, 20 bp, Artificial Sequence
  Description of Artificial Sequence: Synthetic oligonucleotide
tgcctggctgggggcggagg

SEQ ID NO: 173599 - DNA, 20 bp, Artificial Sequence
  Description of Artificial Sequence: Synthetic oligonucleotide
gcctggctgggggcggaggt

SEQ ID NO: 173600 - DNA, 20 bp, Artificial Sequence
  Description of Artificial Sequence: Synthetic oligonucleotide
cctggctgggggcggagggt

SEQ ID NO: 173601 - DNA, 20 bp, Artificial Sequence
  Description of Artificial Sequence: Synthetic oligonucleotide
ctggctgggggcggagggct

SEQ ID NO: 173602 - DNA, 20 bp, Artificial Sequence
  Description of Artificial Sequence: Synthetic oligonucleotide
tggctgggggcggagggctg

SEQ ID NO: 173603 - DNA, 20 bp, Artificial Sequence
  Description of Artificial Sequence: Synthetic oligonucleotide
ggctgggggcggagggctgt

SEQ ID NO: 173604 - DNA, 20 bp, Artificial Sequence
  Description of Artificial Sequence: Synthetic oligonucleotide
gctgggggcggagggctggt

SEQ ID NO: 173605 - DNA, 20 bp, Artificial Sequence
  Description of Artificial Sequence: Synthetic oligonucleotide
ctgggggcggagggctggct

SEQ ID NO: 173606 - DNA, 20 bp, Artificial Sequence
  Description of Artificial Sequence: Synthetic oligonucleotide
tgggggcggagggctggcct

SEQ ID NO: 173607 - DNA, 20 bp, Artificial Sequence
  Description of Artificial Sequence: Synthetic oligonucleotide
gggggcggagggctggcctt

SEQ ID NO: 173608 - DNA, 20 bp, Artificial Sequence
  Description of Artificial Sequence: Synthetic oligonucleotide
ggggcggagggctggcccat

SEQ ID NO: 173609 - DNA, 20 bp, Artificial Sequence
  Description of Artificial Sequence: Synthetic oligonucleotide
gggcggagggctggcccagt

SEQ ID NO: 173610 - DNA, 20 bp, Artificial Sequence
  Description of Artificial Sequence: Synthetic oligonucleotide
ggcggagggctggcccagca

SEQ ID NO: 173611 - DNA, 20 bp, Artificial Sequence
  Description of Artificial Sequence: Synthetic oligonucleotide
gcggagggctggcccagcag

SEQ ID NO: 173612 - DNA, 21 bp, Artificial Sequence
  Description of Artificial Sequence: Synthetic oligonucleotide
cggagggctggcccagcaggt

SEQ ID NO: 173613 - DNA, 21 bp, Artificial Sequence
  Description of Artificial Sequence: Synthetic oligonucleotide
ggagggctggcccagcaggtg

SEQ ID NO: 173614 - DNA, 22 bp, Artificial Sequence
  Description of Artificial Sequence: Synthetic oligonucleotide
gagggctggcccagcaggtgct

SEQ ID NO: 173615 - DNA, 22 bp, Artificial Sequence
  Description of Artificial Sequence: Synthetic oligonucleotide
agggctggcccagcaggtgctg

SEQ ID NO: 173616 - DNA, 21 bp, Artificial Sequence
  Description of Artificial Sequence: Synthetic oligonucleotide
gggctggcccagcaggtgctg

SEQ ID NO: 173617 - DNA, 22 bp, Artificial Sequence
  Description of Artificial Sequence: Synthetic oligonucleotide
ggctggcccagcaggtgctggt

SEQ ID NO: 173618 - DNA, 22 bp, Artificial Sequence
  Description of Artificial Sequence: Synthetic oligonucleotide
gctggcccagcaggtgctggtg

SEQ ID NO: 173619 - DNA, 22 bp, Artificial Sequence
  Description of Artificial Sequence: Synthetic oligonucleotide
ctggcccagcaggtgctggtgc

SEQ ID NO: 173620 - DNA, 23 bp, Artificial Sequence
  Description of Artificial Sequence: Synthetic oligonucleotide
tggcccagcaggtgctggtgcct

SEQ ID NO: 173621 - DNA, 22 bp, Artificial Sequence
  Description of Artificial Sequence: Synthetic oligonucleotide
ggcccagcaggtgctggtgcct

SEQ ID NO: 173622 - DNA, 22 bp, Artificial Sequence
  Description of Artificial Sequence: Synthetic oligonucleotide
gcccagcaggtgctggtgcctg

SEQ ID NO: 173623 - DNA, 22 bp, Artificial Sequence
  Description of Artificial Sequence: Synthetic oligonucleotide
cccagcaggtgctggtgcctgc

SEQ ID NO: 173624 - DNA, 22 bp, Artificial Sequence
  Description of Artificial Sequence: Synthetic oligonucleotide
ccagcaggtgctggtgcctgcg

SEQ ID NO: 173625 - DNA, 22 bp, Artificial Sequence
  Description of Artificial Sequence: Synthetic oligonucleotide
cagcaggtgctggtgcctgcgg

SEQ ID NO: 173626 - DNA, 22 bp, Artificial Sequence
  Description of Artificial Sequence: Synthetic oligonucleotide
agcaggtgctggtgcctgcggg

SEQ ID NO: 173627 - DNA, 21 bp, Artificial Sequence
  Description of Artificial Sequence: Synthetic oligonucleotide
gcaggtgctggtgcctgcggg

SEQ ID NO: 173628 - DNA, 22 bp, Artificial Sequence
  Description of Artificial Sequence: Synthetic oligonucleotide
caggtgctggtgcctgcgggct

SEQ ID NO: 173629 - DNA, 23 bp, Artificial Sequence
  Description of Artificial Sequence: Synthetic oligonucleotide
aggtgctggtgcctgcgggctct

SEQ ID NO: 173630 - DNA, 22 bp, Artificial Sequence
  Description of Artificial Sequence: Synthetic oligonucleotide
ggtgctggtgcctgcgggctct

SEQ ID NO: 173631 - DNA, 22 bp, Artificial Sequence
  Description of Artificial Sequence: Synthetic oligonucleotide
gtgctggtgcctgcgggctctg

SEQ ID NO: 173632 - DNA, 22 bp, Artificial Sequence
  Description of Artificial Sequence: Synthetic oligonucleotide
tgctggtgcctgcgggctctgc

SEQ ID NO: 173633 - DNA, 21 bp, Artificial Sequence
  Description of Artificial Sequence: Synthetic oligonucleotide
gctggtgcctgcgggctctgc

SEQ ID NO: 173634 - DNA, 21 bp, Artificial Sequence
  Description of Artificial Sequence: Synthetic oligonucleotide
ctggtgcctgcgggctctgcc

SEQ ID NO: 173635 - DNA, 21 bp, Artificial Sequence
  Description of Artificial Sequence: Synthetic oligonucleotide
tggtgcctgcgggctctgccc

SEQ ID NO: 173636 - DNA, 20 bp, Artificial Sequence
  Description of Artificial Sequence: Synthetic oligonucleotide
ggtgcctgcgggctctgccc

SEQ ID NO: 173637 - DNA, 20 bp, Artificial Sequence
  Description of Artificial Sequence: Synthetic oligonucleotide
gtgcctgcgggctctgcccg

SEQ ID NO: 173638 - DNA, 20 bp, Artificial Sequence
  Description of Artificial Sequence: Synthetic oligonucleotide
tgcctgcgggctctgcccgg

SEQ ID NO: 173639 - DNA, 20 bp, Artificial Sequence
  Description of Artificial Sequence: Synthetic oligonucleotide
gcctgcgggctctgcccggt

SEQ ID NO: 173640 - DNA, 20 bp, Artificial Sequence
  Description of Artificial Sequence: Synthetic oligonucleotide
cctgcgggctctgcccggct

SEQ ID NO: 173641 - DNA, 20 bp, Artificial Sequence
  Description of Artificial Sequence: Synthetic oligonucleotide
ctgcgggctctgcccggcct

SEQ ID NO: 173642 - DNA, 22 bp, Artificial Sequence
  Description of Artificial Sequence: Synthetic oligonucleotide
tgcgggctctgcccggcctgtt

SEQ ID NO: 173643 - DNA, 21 bp, Artificial Sequence
  Description of Artificial Sequence: Synthetic oligonucleotide
gcgggctctgcccggcctgtt

SEQ ID NO: 173644 - DNA, 21 bp, Artificial Sequence
  Description of Artificial Sequence: Synthetic oligonucleotide
cgggctctgcccggcctgttg

SEQ ID NO: 173645 - DNA, 21 bp, Artificial Sequence
  Description of Artificial Sequence: Synthetic oligonucleotide
gggctctgcccggcctgttgc

SEQ ID NO: 173646 - DNA, 23 bp, Artificial Sequence
  Description of Artificial Sequence: Synthetic oligonucleotide
ggctctgcccggcctgttgcctt

SEQ ID NO: 173647 - DNA, 24 bp, Artificial Sequence
  Description of Artificial Sequence: Synthetic oligonucleotide
gctctgcccggcctgttgccttct

SEQ ID NO: 173648 - DNA, 25 bp, Artificial Sequence
  Description of Artificial Sequence: Synthetic oligonucleotide
ctctgcccggcctgttgccttctct

SEQ ID NO: 173649 - DNA, 26 bp, Artificial Sequence
  Description of Artificial Sequence: Synthetic oligonucleotide
tctgcccggcctgttgccttctctgt

SEQ ID NO: 173650 - DNA, 25 bp, Artificial Sequence
  Description of Artificial Sequence: Synthetic oligonucleotide
ctgcccggcctgttgccttctctgt

SEQ ID NO: 173651 - DNA, 25 bp, Artificial Sequence
  Description of Artificial Sequence: Synthetic oligonucleotide
tgcccggcctgttgccttctctgtg

SEQ ID NO: 173652 - DNA, 24 bp, Artificial Sequence
  Description of Artificial Sequence: Synthetic oligonucleotide
gcccggcctgttgccttctctgtg

SEQ ID NO: 173653 - DNA, 25 bp, Artificial Sequence
  Description of Artificial Sequence: Synthetic oligonucleotide
cccggcctgttgccttctctgtggt

SEQ ID NO: 173654 - DNA, 25 bp, Artificial Sequence
  Description of Artificial Sequence: Synthetic oligonucleotide
ccggcctgttgccttctctgtggtg

SEQ ID NO: 173655 - DNA, 25 bp, Artificial Sequence
  Description of Artificial Sequence: Synthetic oligonucleotide
cggcctgttgccttctctgtggtgc

SEQ ID NO: 173656 - DNA, 25 bp, Artificial Sequence
  Description of Artificial Sequence: Synthetic oligonucleotide
ggcctgttgccttctctgtggtgcc

SEQ ID NO: 173657 - DNA, 26 bp, Artificial Sequence
  Description of Artificial Sequence: Synthetic oligonucleotide
gcctgttgccttctctgtggtgccca

SEQ ID NO: 173658 - DNA, 26 bp, Artificial Sequence
  Description of Artificial Sequence: Synthetic oligonucleotide
cctgttgccttctctgtggtgcccac

SEQ ID NO: 173659 - DNA, 26 bp, Artificial Sequence
  Description of Artificial Sequence: Synthetic oligonucleotide
ctgttgccttctctgtggtgcccacg

SEQ ID NO: 173660 - DNA, 26 bp, Artificial Sequence
  Description of Artificial Sequence: Synthetic oligonucleotide
tgttgccttctctgtggtgcccacgg

SEQ ID NO: 173661 - DNA, 25 bp, Artificial Sequence
  Description of Artificial Sequence: Synthetic oligonucleotide
gttgccttctctgtggtgcccacgg

SEQ ID NO: 173662 - DNA, 26 bp, Artificial Sequence
  Description of Artificial Sequence: Synthetic oligonucleotide
ttgccttctctgtggtgcccacggca

SEQ ID NO: 173663 - DNA, 25 bp, Artificial Sequence
  Description of Artificial Sequence: Synthetic oligonucleotide
tgccttctctgtggtgcccacggca

SEQ ID NO: 173664 - DNA, 24 bp, Artificial Sequence
  Description of Artificial Sequence: Synthetic oligonucleotide
gccttctctgtggtgcccacggca

SEQ ID NO: 173665 - DNA, 24 bp, Artificial Sequence
  Description of Artificial Sequence: Synthetic oligonucleotide
ccttctctgtggtgcccacggcag

SEQ ID NO: 173666 - DNA, 24 bp, Artificial Sequence
  Description of Artificial Sequence: Synthetic oligonucleotide
cttctctgtggtgcccacggcagc

SEQ ID NO: 173667 - DNA, 25 bp, Artificial Sequence
  Description of Artificial Sequence: Synthetic oligonucleotide
ttctctgtggtgcccacggcagcca

SEQ ID NO: 173668 - DNA, 24 bp, Artificial Sequence
  Description of Artificial Sequence: Synthetic oligonucleotide
tctctgtggtgcccacggcagcca

SEQ ID NO: 173669 - DNA, 23 bp, Artificial Sequence
  Description of Artificial Sequence: Synthetic oligonucleotide
ctctgtggtgcccacggcagcca

SEQ ID NO: 173670 - DNA, 23 bp, Artificial Sequence
  Description of Artificial Sequence: Synthetic oligonucleotide
tctgtggtgcccacggcagccac

SEQ ID NO: 173671 - DNA, 22 bp, Artificial Sequence
  Description of Artificial Sequence: Synthetic oligonucleotide
ctgtggtgcccacggcagccac

SEQ ID NO: 173672 - DNA, 22 bp, Artificial Sequence
  Description of Artificial Sequence: Synthetic oligonucleotide
tgtggtgcccacggcagccacc

SEQ ID NO: 173673 - DNA, 21 bp, Artificial Sequence
  Description of Artificial Sequence: Synthetic oligonucleotide
gtggtgcccacggcagccacc

SEQ ID NO: 173674 - DNA, 21 bp, Artificial Sequence
  Description of Artificial Sequence: Synthetic oligonucleotide
tggtgcccacggcagccaccg

SEQ ID NO: 173675 - DNA, 20 bp, Artificial Sequence
  Description of Artificial Sequence: Synthetic oligonucleotide
ggtgcccacggcagccaccg

SEQ ID NO: 173676 - DNA, 21 bp, Artificial Sequence
  Description of Artificial Sequence: Synthetic oligonucleotide
gtgcccacggcagccaccgct

SEQ ID NO: 173677 - DNA, 22 bp, Artificial Sequence
  Description of Artificial Sequence: Synthetic oligonucleotide
tgcccacggcagccaccgctgt

SEQ ID NO: 173678 - DNA, 21 bp, Artificial Sequence
  Description of Artificial Sequence: Synthetic oligonucleotide
gcccacggcagccaccgctgt

SEQ ID NO: 173679 - DNA, 22 bp, Artificial Sequence
  Description of Artificial Sequence: Synthetic oligonucleotide
cccacggcagccaccgctgtgt

SEQ ID NO: 173680 - DNA, 23 bp, Artificial Sequence
  Description of Artificial Sequence: Synthetic oligonucleotide
ccacggcagccaccgctgtgtct

SEQ ID NO: 173681 - DNA, 24 bp, Artificial Sequence
  Description of Artificial Sequence: Synthetic oligonucleotide
cacggcagccaccgctgtgtctct

SEQ ID NO: 173682 - DNA, 26 bp, Artificial Sequence
  Description of Artificial Sequence: Synthetic oligonucleotide
acggcagccaccgctgtgtctctgaa

SEQ ID NO: 173683 - DNA, 25 bp, Artificial Sequence
  Description of Artificial Sequence: Synthetic oligonucleotide
cggcagccaccgctgtgtctctgaa

SEQ ID NO: 173684 - DNA, 25 bp, Artificial Sequence
  Description of Artificial Sequence: Synthetic oligonucleotide
ggcagccaccgctgtgtctctgaag

SEQ ID NO: 173685 - DNA, 26 bp, Artificial Sequence
  Description of Artificial Sequence: Synthetic oligonucleotide
gcagccaccgctgtgtctctgaaggt

SEQ ID NO: 173686 - DNA, 26 bp, Artificial Sequence
  Description of Artificial Sequence: Synthetic oligonucleotide
cagccaccgctgtgtctctgaaggtg

SEQ ID NO: 173687 - DNA, 27 bp, Artificial Sequence
  Description of Artificial Sequence: Synthetic oligonucleotide
agccaccgctgtgtctctgaaggtggt

SEQ ID NO: 173688 - DNA, 26 bp, Artificial Sequence
  Description of Artificial Sequence: Synthetic oligonucleotide
gccaccgctgtgtctctgaaggtggt

SEQ ID NO: 173689 - DNA, 26 bp, Artificial Sequence
  Description of Artificial Sequence: Synthetic oligonucleotide
ccaccgctgtgtctctgaaggtggtg

SEQ ID NO: 173690 - DNA, 26 bp, Artificial Sequence
  Description of Artificial Sequence: Synthetic oligonucleotide
caccgctgtgtctctgaaggtggtgg

SEQ ID NO: 173691 - DNA, 27 bp, Artificial Sequence
  Description of Artificial Sequence: Synthetic oligonucleotide
accgctgtgtctctgaaggtggtggct

SEQ ID NO: 173692 - DNA, 26 bp, Artificial Sequence
  Description of Artificial Sequence: Synthetic oligonucleotide
ccgctgtgtctctgaaggtggtggct

SEQ ID NO: 173693 - DNA, 26 bp, Artificial Sequence
  Description of Artificial Sequence: Synthetic oligonucleotide
cgctgtgtctctgaaggtggtggctc

SEQ ID NO: 173694 - DNA, 27 bp, Artificial Sequence
  Description of Artificial Sequence: Synthetic oligonucleotide
gctgtgtctctgaaggtggtggctcga

SEQ ID NO: 173695 - DNA, 27 bp, Artificial Sequence
  Description of Artificial Sequence: Synthetic oligonucleotide
ctgtgtctctgaaggtggtggctcgag

SEQ ID NO: 173696 - DNA, 27 bp, Artificial Sequence
  Description of Artificial Sequence: Synthetic oligonucleotide
tgtgtctctgaaggtggtggctcgagg

SEQ ID NO: 173697 - DNA, 26 bp, Artificial Sequence
  Description of Artificial Sequence: Synthetic oligonucleotide
gtgtctctgaaggtggtggctcgagg

SEQ ID NO: 173698 - DNA, 27 bp, Artificial Sequence
  Description of Artificial Sequence: Synthetic oligonucleotide
tgtctctgaaggtggtggctcgagggt

SEQ ID NO: 173699 - DNA, 26 bp, Artificial Sequence
  Description of Artificial Sequence: Synthetic oligonucleotide
gtctctgaaggtggtggctcgagggt

SEQ ID NO: 173700 - DNA, 26 bp, Artificial Sequence
  Description of Artificial Sequence: Synthetic oligonucleotide
tctctgaaggtggtggctcgagggtc

SEQ ID NO: 173701 - DNA, 25 bp, Artificial Sequence
  Description of Artificial Sequence: Synthetic oligonucleotide
ctctgaaggtggtggctcgagggtc

SEQ ID NO: 173702 - DNA, 27 bp, Artificial Sequence
  Description of Artificial Sequence: Synthetic oligonucleotide
tctgaaggtggtggctcgagggtcctt

SEQ ID NO: 173703 - DNA, 26 bp, Artificial Sequence
  Description of Artificial Sequence: Synthetic oligonucleotide
ctgaaggtggtggctcgagggtcctt

SEQ ID NO: 173704 - DNA, 26 bp, Artificial Sequence
  Description of Artificial Sequence: Synthetic oligonucleotide
tgaaggtggtggctcgagggtccttc

SEQ ID NO: 173705 - DNA, 25 bp, Artificial Sequence
  Description of Artificial Sequence: Synthetic oligonucleotide
gaaggtggtggctcgagggtccttc

SEQ ID NO: 173706 - DNA, 27 bp, Artificial Sequence
  Description of Artificial Sequence: Synthetic oligonucleotide
aaggtggtggctcgagggtccttcgaa

SEQ ID NO: 173707 - DNA, 27 bp, Artificial Sequence
  Description of Artificial Sequence: Synthetic oligonucleotide
aggtggtggctcgagggtccttcgaat

SEQ ID NO: 173708 - DNA, 27 bp, Artificial Sequence
  Description of Artificial Sequence: Synthetic oligonucleotide
ggtggtggctcgagggtccttcgaatt

SEQ ID NO: 173709 - DNA, 27 bp, Artificial Sequence
  Description of Artificial Sequence: Synthetic oligonucleotide
gtggtggctcgagggtccttcgaattc

SEQ ID NO: 173710 - DNA, 27 bp, Artificial Sequence
  Description of Artificial Sequence: Synthetic oligonucleotide
tggtggctcgagggtccttcgaattcc

SEQ ID NO: 173711 - DNA, 26 bp, Artificial Sequence
  Description of Artificial Sequence: Synthetic oligonucleotide
ggtggctcgagggtccttcgaattcc

SEQ ID NO: 173712 - DNA, 27 bp, Artificial Sequence
  Description of Artificial Sequence: Synthetic oligonucleotide
gtggctcgagggtccttcgaattccct

SEQ ID NO: 173713 - DNA, 27 bp, Artificial Sequence
  Description of Artificial Sequence: Synthetic oligonucleotide
tggctcgagggtccttcgaattccctg

SEQ ID NO: 173714 - DNA, 27 bp, Artificial Sequence
  Description of Artificial Sequence: Synthetic oligonucleotide
ggctcgagggtccttcgaattccctgt

SEQ ID NO: 173715 - DNA, 27 bp, Artificial Sequence
  Description of Artificial Sequence: Synthetic oligonucleotide
gctcgagggtccttcgaattccctgtg

SEQ ID NO: 173716 - DNA, 27 bp, Artificial Sequence
  Description of Artificial Sequence: Synthetic oligonucleotide
ctcgagggtccttcgaattccctgtgg

SEQ ID NO: 173717 - DNA, 27 bp, Artificial Sequence
  Description of Artificial Sequence: Synthetic oligonucleotide
tcgagggtccttcgaattccctgtggg

SEQ ID NO: 173718 - DNA, 27 bp, Artificial Sequence
  Description of Artificial Sequence: Synthetic oligonucleotide
cgagggtccttcgaattccctgtggga

SEQ ID NO: 173719 - DNA, 27 bp, Artificial Sequence
  Description of Artificial Sequence: Synthetic oligonucleotide
gagggtccttcgaattccctgtgggag

SEQ ID NO: 173720 - DNA, 29 bp, Artificial Sequence
  Description of Artificial Sequence: Synthetic oligonucleotide
agggtccttcgaattccctgtgggagatg

SEQ ID NO: 173721 - DNA, 28 bp, Artificial Sequence
  Description of Artificial Sequence: Synthetic oligonucleotide
gggtccttcgaattccctgtgggagatg

SEQ ID NO: 173722 - DNA, 28 bp, Artificial Sequence
  Description of Artificial Sequence: Synthetic oligonucleotide
ggtccttcgaattccctgtgggagatgc

SEQ ID NO: 173723 - DNA, 28 bp, Artificial Sequence
  Description of Artificial Sequence: Synthetic oligonucleotide
gtccttcgaattccctgtgggagatgcg

SEQ ID NO: 173724 - DNA, 28 bp, Artificial Sequence
  Description of Artificial Sequence: Synthetic oligonucleotide
tccttcgaattccctgtgggagatgcgg

SEQ ID NO: 173725 - DNA, 27 bp, Artificial Sequence
  Description of Artificial Sequence: Synthetic oligonucleotide
ccttcgaattccctgtgggagatgcgg

SEQ ID NO: 173726 - DNA, 28 bp, Artificial Sequence
  Description of Artificial Sequence: Synthetic oligonucleotide
cttcgaattccctgtgggagatgcggtg

SEQ ID NO: 173727 - DNA, 29 bp, Artificial Sequence
  Description of Artificial Sequence: Synthetic oligonucleotide
ttcgaattccctgtgggagatgcggtgtc

SEQ ID NO: 173728 - DNA, 28 bp, Artificial Sequence
  Description of Artificial Sequence: Synthetic oligonucleotide
tcgaattccctgtgggagatgcggtgtc

SEQ ID NO: 173729 - DNA, 27 bp, Artificial Sequence
  Description of Artificial Sequence: Synthetic oligonucleotide
cgaattccctgtgggagatgcggtgtc

SEQ ID NO: 173730 - DNA, 27 bp, Artificial Sequence
  Description of Artificial Sequence: Synthetic oligonucleotide
gaattccctgtgggagatgcggtgtcc

SEQ ID NO: 173731 - DNA, 29 bp, Artificial Sequence
  Description of Artificial Sequence: Synthetic oligonucleotide
aattccctgtgggagatgcggtgtccaag

SEQ ID NO: 173732 - DNA, 28 bp, Artificial Sequence
  Description of Artificial Sequence: Synthetic oligonucleotide
attccctgtgggagatgcggtgtccaag

SEQ ID NO: 173733 - DNA, 27 bp, Artificial Sequence
  Description of Artificial Sequence: Synthetic oligonucleotide
ttccctgtgggagatgcggtgtccaag

SEQ ID NO: 173734 - DNA, 26 bp, Artificial Sequence
  Description of Artificial Sequence: Synthetic oligonucleotide
tccctgtgggagatgcggtgtccaag

SEQ ID NO: 173735 - DNA, 25 bp, Artificial Sequence
  Description of Artificial Sequence: Synthetic oligonucleotide
ccctgtgggagatgcggtgtccaag

SEQ ID NO: 173736 - DNA, 27 bp, Artificial Sequence
  Description of Artificial Sequence: Synthetic oligonucleotide
cctgtgggagatgcggtgtccaaggtt

SEQ ID NO: 173737 - DNA, 27 bp, Artificial Sequence
  Description of Artificial Sequence: Synthetic oligonucleotide
ctgtgggagatgcggtgtccaaggttc

SEQ ID NO: 173738 - DNA, 28 bp, Artificial Sequence
  Description of Artificial Sequence: Synthetic oligonucleotide
tgtgggagatgcggtgtccaaggttctg

SEQ ID NO: 173739 - DNA, 27 bp, Artificial Sequence
  Description of Artificial Sequence: Synthetic oligonucleotide
gtgggagatgcggtgtccaaggttctg

SEQ ID NO: 173740 - DNA, 27 bp, Artificial Sequence
  Description of Artificial Sequence: Synthetic oligonucleotide
tgggagatgcggtgtccaaggttctgc

SEQ ID NO: 173741 - DNA, 27 bp, Artificial Sequence
  Description of Artificial Sequence: Synthetic oligonucleotide
gggagatgcggtgtccaaggttctgca

SEQ ID NO: 173742 - DNA, 27 bp, Artificial Sequence
  Description of Artificial Sequence: Synthetic oligonucleotide
ggagatgcggtgtccaaggttctgcag

SEQ ID NO: 173743 - DNA, 30 bp, Artificial Sequence
  Description of Artificial Sequence: Synthetic oligonucleotide
gagatgcggtgtccaaggttctgcagattg

SEQ ID NO: 173744 - DNA, 31 bp, Artificial Sequence
  Description of Artificial Sequence: Synthetic oligonucleotide
agatgcggtgtccaaggttctgcagattgag

SEQ ID NO: 173745 - DNA, 30 bp, Artificial Sequence
  Description of Artificial Sequence: Synthetic oligonucleotide
gatgcggtgtccaaggttctgcagattgag

SEQ ID NO: 173746 - DNA, 32 bp, Artificial Sequence
  Description of Artificial Sequence: Synthetic oligonucleotide
atgcggtgtccaaggttctgcagattgagaag

SEQ ID NO: 173747 - DNA, 31 bp, Artificial Sequence
  Description of Artificial Sequence: Synthetic oligonucleotide
tgcggtgtccaaggttctgcagattgagaag

SEQ ID NO: 173748 - DNA, 30 bp, Artificial Sequence
  Description of Artificial Sequence: Synthetic oligonucleotide
gcggtgtccaaggttctgcagattgagaag

SEQ ID NO: 173749 - DNA, 30 bp, Artificial Sequence
  Description of Artificial Sequence: Synthetic oligonucleotide
cggtgtccaaggttctgcagattgagaagg

SEQ ID NO: 173750 - DNA, 32 bp, Artificial Sequence
  Description of Artificial Sequence: Synthetic oligonucleotide
ggtgtccaaggttctgcagattgagaaggaag

SEQ ID NO: 173751 - DNA, 32 bp, Artificial Sequence
  Description of Artificial Sequence: Synthetic oligonucleotide
gtgtccaaggttctgcagattgagaaggaagg

SEQ ID NO: 173752 - DNA, 32 bp, Artificial Sequence
  Description of Artificial Sequence: Synthetic oligonucleotide
tgtccaaggttctgcagattgagaaggaaggg

SEQ ID NO: 173753 - DNA, 31 bp, Artificial Sequence
  Description of Artificial Sequence: Synthetic oligonucleotide
gtccaaggttctgcagattgagaaggaaggg

SEQ ID NO: 173754 - DNA, 31 bp, Artificial Sequence
  Description of Artificial Sequence: Synthetic oligonucleotide
tccaaggttctgcagattgagaaggaagggg

SEQ ID NO: 173755 - DNA, 30 bp, Artificial Sequence
  Description of Artificial Sequence: Synthetic oligonucleotide
ccaaggttctgcagattgagaaggaagggg

SEQ ID NO: 173756 - DNA, 30 bp, Artificial Sequence
  Description of Artificial Sequence: Synthetic oligonucleotide
caaggttctgcagattgagaaggaaggggc

SEQ ID NO: 173757 - DNA, 30 bp, Artificial Sequence
  Description of Artificial Sequence: Synthetic oligonucleotide
aaggttctgcagattgagaaggaaggggcc

SEQ ID NO: 173758 - DNA, 29 bp, Artificial Sequence
  Description of Artificial Sequence: Synthetic oligonucleotide
aggttctgcagattgagaaggaaggggcc

SEQ ID NO: 173759 - DNA, 28 bp, Artificial Sequence
  Description of Artificial Sequence: Synthetic oligonucleotide
ggttctgcagattgagaaggaaggggcc

SEQ ID NO: 173760 - DNA, 30 bp, Artificial Sequence
  Description of Artificial Sequence: Synthetic oligonucleotide
gttctgcagattgagaaggaaggggccatc

SEQ ID NO: 173761 - DNA, 30 bp, Artificial Sequence
  Description of Artificial Sequence: Synthetic oligonucleotide
ttctgcagattgagaaggaaggggccatcc

SEQ ID NO: 173762 - DNA, 29 bp, Artificial Sequence
  Description of Artificial Sequence: Synthetic oligonucleotide
tctgcagattgagaaggaaggggccatcc

SEQ ID NO: 173763 - DNA, 28 bp, Artificial Sequence
  Description of Artificial Sequence: Synthetic oligonucleotide
ctgcagattgagaaggaaggggccatcc

SEQ ID NO: 173764 - DNA, 31 bp, Artificial Sequence
  Description of Artificial Sequence: Synthetic oligonucleotide
tgcagattgagaaggaaggggccatccatag

SEQ ID NO: 173765 - DNA, 30 bp, Artificial Sequence
  Description of Artificial Sequence: Synthetic oligonucleotide
gcagattgagaaggaaggggccatccatag

SEQ ID NO: 173766 - DNA, 31 bp, Artificial Sequence
  Description of Artificial Sequence: Synthetic oligonucleotide
cagattgagaaggaaggggccatccatagag

SEQ ID NO: 173767 - DNA, 32 bp, Artificial Sequence
  Description of Artificial Sequence: Synthetic oligonucleotide
agattgagaaggaaggggccatccatagagag

SEQ ID NO: 173768 - DNA, 31 bp, Artificial Sequence
  Description of Artificial Sequence: Synthetic oligonucleotide
gattgagaaggaaggggccatccatagagag

SEQ ID NO: 173769 - DNA, 31 bp, Artificial Sequence
  Description of Artificial Sequence: Synthetic oligonucleotide
attgagaaggaaggggccatccatagagagg

SEQ ID NO: 173770 - DNA, 30 bp, Artificial Sequence
  Description of Artificial Sequence: Synthetic oligonucleotide
ttgagaaggaaggggccatccatagagagg

SEQ ID NO: 173771 - DNA, 29 bp, Artificial Sequence
  Description of Artificial Sequence: Synthetic oligonucleotide
tgagaaggaaggggccatccatagagagg

SEQ ID NO: 173772 - DNA, 28 bp, Artificial Sequence
  Description of Artificial Sequence: Synthetic oligonucleotide
gagaaggaaggggccatccatagagagg

SEQ ID NO: 173773 - DNA, 29 bp, Artificial Sequence
  Description of Artificial Sequence: Synthetic oligonucleotide
agaaggaaggggccatccatagagaggag

SEQ ID NO: 173774 - DNA, 28 bp, Artificial Sequence
  Description of Artificial Sequence: Synthetic oligonucleotide
gaaggaaggggccatccatagagaggag

SEQ ID NO: 173775 - DNA, 28 bp, Artificial Sequence
  Description of Artificial Sequence: Synthetic oligonucleotide
aaggaaggggccatccatagagaggagc

SEQ ID NO: 173776 - DNA, 27 bp, Artificial Sequence
  Description of Artificial Sequence: Synthetic oligonucleotide
aggaaggggccatccatagagaggagc

SEQ ID NO: 173777 - DNA, 27 bp, Artificial Sequence
  Description of Artificial Sequence: Synthetic oligonucleotide
ggaaggggccatccatagagaggagct

SEQ ID NO: 173778 - DNA, 27 bp, Artificial Sequence
  Description of Artificial Sequence: Synthetic oligonucleotide
gaaggggccatccatagagaggagctg

SEQ ID NO: 173779 - DNA, 27 bp, Artificial Sequence
  Description of Artificial Sequence: Synthetic oligonucleotide
aaggggccatccatagagaggagctgg

SEQ ID NO: 173780 - DNA, 27 bp, Artificial Sequence
  Description of Artificial Sequence: Synthetic oligonucleotide
aggggccatccatagagaggagctggt

SEQ ID NO: 173781 - DNA, 26 bp, Artificial Sequence
  Description of Artificial Sequence: Synthetic oligonucleotide
ggggccatccatagagaggagctggt

SEQ ID NO: 173782 - DNA, 27 bp, Artificial Sequence
  Description of Artificial Sequence: Synthetic oligonucleotide
gggccatccatagagaggagctggtct

SEQ ID NO: 173783 - DNA, 29 bp, Artificial Sequence
  Description of Artificial Sequence: Synthetic oligonucleotide
ggccatccatagagaggagctggtctatg

SEQ ID NO: 173784 - DNA, 31 bp, Artificial Sequence
  Description of Artificial Sequence: Synthetic oligonucleotide
gccatccatagagaggagctggtctatgaac

SEQ ID NO: 173785 - DNA, 32 bp, Artificial Sequence
  Description of Artificial Sequence: Synthetic oligonucleotide
ccatccatagagaggagctggtctatgaactc

SEQ ID NO: 173786 - DNA, 34 bp, Artificial Sequence
  Description of Artificial Sequence: Synthetic oligonucleotide
catccatagagaggagctggtctatgaactcaac

SEQ ID NO: 173787 - DNA, 34 bp, Artificial Sequence
  Description of Artificial Sequence: Synthetic oligonucleotide
atccatagagaggagctggtctatgaactcaacc

SEQ ID NO: 173788 - DNA, 33 bp, Artificial Sequence
  Description of Artificial Sequence: Synthetic oligonucleotide
tccatagagaggagctggtctatgaactcaacc

SEQ ID NO: 173789 - DNA, 32 bp, Artificial Sequence
  Description of Artificial Sequence: Synthetic oligonucleotide
ccatagagaggagctggtctatgaactcaacc

SEQ ID NO: 173790 - DNA, 32 bp, Artificial Sequence
  Description of Artificial Sequence: Synthetic oligonucleotide
catagagaggagctggtctatgaactcaaccc

SEQ ID NO: 173791 - DNA, 32 bp, Artificial Sequence
  Description of Artificial Sequence: Synthetic oligonucleotide
atagagaggagctggtctatgaactcaacccc

SEQ ID NO: 173792 - DNA, 31 bp, Artificial Sequence
  Description of Artificial Sequence: Synthetic oligonucleotide
tagagaggagctggtctatgaactcaacccc

SEQ ID NO: 173793 - DNA, 30 bp, Artificial Sequence
  Description of Artificial Sequence: Synthetic oligonucleotide
agagaggagctggtctatgaactcaacccc

SEQ ID NO: 173794 - DNA, 29 bp, Artificial Sequence
  Description of Artificial Sequence: Synthetic oligonucleotide
gagaggagctggtctatgaactcaacccc

SEQ ID NO: 173795 - DNA, 31 bp, Artificial Sequence
  Description of Artificial Sequence: Synthetic oligonucleotide
agaggagctggtctatgaactcaaccccttg

SEQ ID NO: 173796 - DNA, 30 bp, Artificial Sequence
  Description of Artificial Sequence: Synthetic oligonucleotide
gaggagctggtctatgaactcaaccccttg

SEQ ID NO: 173797 - DNA, 30 bp, Artificial Sequence
  Description of Artificial Sequence: Synthetic oligonucleotide
aggagctggtctatgaactcaaccccttgg

SEQ ID NO: 173798 - DNA, 29 bp, Artificial Sequence
  Description of Artificial Sequence: Synthetic oligonucleotide
ggagctggtctatgaactcaaccccttgg

SEQ ID NO: 173799 - DNA, 30 bp, Artificial Sequence
  Description of Artificial Sequence: Synthetic oligonucleotide
gagctggtctatgaactcaaccccttggac

SEQ ID NO: 173800 - DNA, 30 bp, Artificial Sequence
  Description of Artificial Sequence: Synthetic oligonucleotide
agctggtctatgaactcaaccccttggacc

SEQ ID NO: 173801 - DNA, 29 bp, Artificial Sequence
  Description of Artificial Sequence: Synthetic oligonucleotide
gctggtctatgaactcaaccccttggacc

SEQ ID NO: 173802 - DNA, 30 bp, Artificial Sequence
  Description of Artificial Sequence: Synthetic oligonucleotide
ctggtctatgaactcaaccccttggaccac

SEQ ID NO: 173803 - DNA, 30 bp, Artificial Sequence
  Description of Artificial Sequence: Synthetic oligonucleotide
tggtctatgaactcaaccccttggaccacc

SEQ ID NO: 173804 - DNA, 29 bp, Artificial Sequence
  Description of Artificial Sequence: Synthetic oligonucleotide
ggtctatgaactcaaccccttggaccacc

SEQ ID NO: 173805 - DNA, 29 bp, Artificial Sequence
  Description of Artificial Sequence: Synthetic oligonucleotide
gtctatgaactcaaccccttggaccaccg

SEQ ID NO: 173806 - DNA, 30 bp, Artificial Sequence
  Description of Artificial Sequence: Synthetic oligonucleotide
tctatgaactcaaccccttggaccaccgag

SEQ ID NO: 173807 - DNA, 29 bp, Artificial Sequence
  Description of Artificial Sequence: Synthetic oligonucleotide
ctatgaactcaaccccttggaccaccgag

SEQ ID NO: 173808 - DNA, 29 bp, Artificial Sequence
  Description of Artificial Sequence: Synthetic oligonucleotide
tatgaactcaaccccttggaccaccgagg

SEQ ID NO: 173809 - DNA, 28 bp, Artificial Sequence
  Description of Artificial Sequence: Synthetic oligonucleotide
atgaactcaaccccttggaccaccgagg

SEQ ID NO: 173810 - DNA, 27 bp, Artificial Sequence
  Description of Artificial Sequence: Synthetic oligonucleotide
tgaactcaaccccttggaccaccgagg

SEQ ID NO: 173811 - DNA, 26 bp, Artificial Sequence
  Description of Artificial Sequence: Synthetic oligonucleotide
gaactcaaccccttggaccaccgagg

SEQ ID NO: 173812 - DNA, 26 bp, Artificial Sequence
  Description of Artificial Sequence: Synthetic oligonucleotide
aactcaaccccttggaccaccgaggc

SEQ ID NO: 173813 - DNA, 25 bp, Artificial Sequence
  Description of Artificial Sequence: Synthetic oligonucleotide
actcaaccccttggaccaccgaggc

SEQ ID NO: 173814 - DNA, 24 bp, Artificial Sequence
  Description of Artificial Sequence: Synthetic oligonucleotide
ctcaaccccttggaccaccgaggc

SEQ ID NO: 173815 - DNA, 24 bp, Artificial Sequence
  Description of Artificial Sequence: Synthetic oligonucleotide
tcaaccccttggaccaccgaggcc

SEQ ID NO: 173816 - DNA, 23 bp, Artificial Sequence
  Description of Artificial Sequence: Synthetic oligonucleotide
caaccccttggaccaccgaggcc

SEQ ID NO: 173817 - DNA, 23 bp, Artificial Sequence
  Description of Artificial Sequence: Synthetic oligonucleotide
aaccccttggaccaccgaggccg

SEQ ID NO: 173818 - DNA, 22 bp, Artificial Sequence
  Description of Artificial Sequence: Synthetic oligonucleotide
accccttggaccaccgaggccg

SEQ ID NO: 173819 - DNA, 21 bp, Artificial Sequence
  Description of Artificial Sequence: Synthetic oligonucleotide
ccccttggaccaccgaggccg

SEQ ID NO: 173820 - DNA, 22 bp, Artificial Sequence
  Description of Artificial Sequence: Synthetic oligonucleotide
cccttggaccaccgaggccgga

SEQ ID NO: 173821 - DNA, 22 bp, Artificial Sequence
  Description of Artificial Sequence: Synthetic oligonucleotide
ccttggaccaccgaggccggac

SEQ ID NO: 173822 - DNA, 24 bp, Artificial Sequence
  Description of Artificial Sequence: Synthetic oligonucleotide
cttggaccaccgaggccggacctt

SEQ ID NO: 173823 - DNA, 24 bp, Artificial Sequence
  Description of Artificial Sequence: Synthetic oligonucleotide
ttggaccaccgaggccggaccttg

SEQ ID NO: 173824 - DNA, 23 bp, Artificial Sequence
  Description of Artificial Sequence: Synthetic oligonucleotide
tggaccaccgaggccggaccttg

SEQ ID NO: 173825 - DNA, 22 bp, Artificial Sequence
  Description of Artificial Sequence: Synthetic oligonucleotide
ggaccaccgaggccggaccttg

SEQ ID NO: 173826 - DNA, 27 bp, Artificial Sequence
  Description of Artificial Sequence: Synthetic oligonucleotide
gaccaccgaggccggaccttggaaata

SEQ ID NO: 173827 - DNA, 27 bp, Artificial Sequence
  Description of Artificial Sequence: Synthetic oligonucleotide
accaccgaggccggaccttggaaatac

SEQ ID NO: 173828 - DNA, 26 bp, Artificial Sequence
  Description of Artificial Sequence: Synthetic oligonucleotide
ccaccgaggccggaccttggaaatac

SEQ ID NO: 173829 - DNA, 27 bp, Artificial Sequence
  Description of Artificial Sequence: Synthetic oligonucleotide
caccgaggccggaccttggaaatacct

SEQ ID NO: 173830 - DNA, 27 bp, Artificial Sequence
  Description of Artificial Sequence: Synthetic oligonucleotide
accgaggccggaccttggaaatacctg

SEQ ID NO: 173831 - DNA, 26 bp, Artificial Sequence
  Description of Artificial Sequence: Synthetic oligonucleotide
ccgaggccggaccttggaaatacctg

SEQ ID NO: 173832 - DNA, 26 bp, Artificial Sequence
  Description of Artificial Sequence: Synthetic oligonucleotide
cgaggccggaccttggaaatacctgg

SEQ ID NO: 173833 - DNA, 27 bp, Artificial Sequence
  Description of Artificial Sequence: Synthetic oligonucleotide
gaggccggaccttggaaatacctggca

SEQ ID NO: 173834 - DNA, 28 bp, Artificial Sequence
  Description of Artificial Sequence: Synthetic oligonucleotide
aggccggaccttggaaatacctggcaac

SEQ ID NO: 173835 - DNA, 27 bp, Artificial Sequence
  Description of Artificial Sequence: Synthetic oligonucleotide
ggccggaccttggaaatacctggcaac

SEQ ID NO: 173836 - DNA, 28 bp, Artificial Sequence
  Description of Artificial Sequence: Synthetic oligonucleotide
gccggaccttggaaatacctggcaactc

SEQ ID NO: 173837 - DNA, 29 bp, Artificial Sequence
  Description of Artificial Sequence: Synthetic oligonucleotide
ccggaccttggaaatacctggcaactctg

SEQ ID NO: 173838 - DNA, 31 bp, Artificial Sequence
  Description of Artificial Sequence: Synthetic oligonucleotide
cggaccttggaaatacctggcaactctgatc

SEQ ID NO: 173839 - DNA, 31 bp, Artificial Sequence
  Description of Artificial Sequence: Synthetic oligonucleotide
ggaccttggaaatacctggcaactctgatcc

SEQ ID NO: 173840 - DNA, 31 bp, Artificial Sequence
  Description of Artificial Sequence: Synthetic oligonucleotide
gaccttggaaatacctggcaactctgatccc

SEQ ID NO: 173841 - DNA, 36 bp, Artificial Sequence
  Description of Artificial Sequence: Synthetic oligonucleotide
accttggaaatacctggcaactctgatcccaatatg

SEQ ID NO: 173842 - DNA, 35 bp, Artificial Sequence
  Description of Artificial Sequence: Synthetic oligonucleotide
ccttggaaatacctggcaactctgatcccaatatg

SEQ ID NO: 173843 - DNA, 37 bp, Artificial Sequence
  Description of Artificial Sequence: Synthetic oligonucleotide
cttggaaatacctggcaactctgatcccaatatgatc

SEQ ID NO: 173844 - DNA, 37 bp, Artificial Sequence
  Description of Artificial Sequence: Synthetic oligonucleotide
ttggaaatacctggcaactctgatcccaatatgatcc

SEQ ID NO: 173845 - DNA, 36 bp, Artificial Sequence
  Description of Artificial Sequence: Synthetic oligonucleotide
tggaaatacctggcaactctgatcccaatatgatcc

SEQ ID NO: 173846 - DNA, 35 bp, Artificial Sequence
  Description of Artificial Sequence: Synthetic oligonucleotide
ggaaatacctggcaactctgatcccaatatgatcc

SEQ ID NO: 173847 - DNA, 35 bp, Artificial Sequence
  Description of Artificial Sequence: Synthetic oligonucleotide
gaaatacctggcaactctgatcccaatatgatccc

SEQ ID NO: 173848 - DNA, 36 bp, Artificial Sequence
  Description of Artificial Sequence: Synthetic oligonucleotide
aaatacctggcaactctgatcccaatatgatccctg

SEQ ID NO: 173849 - DNA, 35 bp, Artificial Sequence
  Description of Artificial Sequence: Synthetic oligonucleotide
aatacctggcaactctgatcccaatatgatccctg

SEQ ID NO: 173850 - DNA, 34 bp, Artificial Sequence
  Description of Artificial Sequence: Synthetic oligonucleotide
atacctggcaactctgatcccaatatgatccctg

SEQ ID NO: 173851 - DNA, 33 bp, Artificial Sequence
  Description of Artificial Sequence: Synthetic oligonucleotide
tacctggcaactctgatcccaatatgatccctg

SEQ ID NO: 173852 - DNA, 32 bp, Artificial Sequence
  Description of Artificial Sequence: Synthetic oligonucleotide
acctggcaactctgatcccaatatgatccctg

SEQ ID NO: 173853 - DNA, 31 bp, Artificial Sequence
  Description of Artificial Sequence: Synthetic oligonucleotide
cctggcaactctgatcccaatatgatccctg

SEQ ID NO: 173854 - DNA, 33 bp, Artificial Sequence
  Description of Artificial Sequence: Synthetic oligonucleotide
ctggcaactctgatcccaatatgatccctgatg

SEQ ID NO: 173855 - DNA, 33 bp, Artificial Sequence
  Description of Artificial Sequence: Synthetic oligonucleotide
tggcaactctgatcccaatatgatccctgatgg

SEQ ID NO: 173856 - DNA, 32 bp, Artificial Sequence
  Description of Artificial Sequence: Synthetic oligonucleotide
ggcaactctgatcccaatatgatccctgatgg

SEQ ID NO: 173857 - DNA, 32 bp, Artificial Sequence
  Description of Artificial Sequence: Synthetic oligonucleotide
gcaactctgatcccaatatgatccctgatggg

SEQ ID NO: 173858 - DNA, 32 bp, Artificial Sequence
  Description of Artificial Sequence: Synthetic oligonucleotide
caactctgatcccaatatgatccctgatgggg

SEQ ID NO: 173859 - DNA, 33 bp, Artificial Sequence
  Description of Artificial Sequence: Synthetic oligonucleotide
aactctgatcccaatatgatccctgatggggac

SEQ ID NO: 173860 - DNA, 32 bp, Artificial Sequence
  Description of Artificial Sequence: Synthetic oligonucleotide
actctgatcccaatatgatccctgatggggac

SEQ ID NO: 173861 - DNA, 31 bp, Artificial Sequence
  Description of Artificial Sequence: Synthetic oligonucleotide
ctctgatcccaatatgatccctgatggggac

SEQ ID NO: 173862 - DNA, 36 bp, Artificial Sequence
  Description of Artificial Sequence: Synthetic oligonucleotide
tctgatcccaatatgatccctgatggggactttaac

SEQ ID NO: 173863 - DNA, 35 bp, Artificial Sequence
  Description of Artificial Sequence: Synthetic oligonucleotide
ctgatcccaatatgatccctgatggggactttaac

SEQ ID NO: 173864 - DNA, 36 bp, Artificial Sequence
  Description of Artificial Sequence: Synthetic oligonucleotide
tgatcccaatatgatccctgatggggactttaacag

SEQ ID NO: 173865 - DNA, 35 bp, Artificial Sequence
  Description of Artificial Sequence: Synthetic oligonucleotide
gatcccaatatgatccctgatggggactttaacag

SEQ ID NO: 173866 - DNA, 35 bp, Artificial Sequence
  Description of Artificial Sequence: Synthetic oligonucleotide
atcccaatatgatccctgatggggactttaacagc

SEQ ID NO: 173867 - DNA, 34 bp, Artificial Sequence
  Description of Artificial Sequence: Synthetic oligonucleotide
tcccaatatgatccctgatggggactttaacagc

SEQ ID NO: 173868 - DNA, 33 bp, Artificial Sequence
  Description of Artificial Sequence: Synthetic oligonucleotide
cccaatatgatccctgatggggactttaacagc

SEQ ID NO: 173869 - DNA, 35 bp, Artificial Sequence
  Description of Artificial Sequence: Synthetic oligonucleotide
ccaatatgatccctgatggggactttaacagctac

SEQ ID NO: 173870 - DNA, 35 bp, Artificial Sequence
  Description of Artificial Sequence: Synthetic oligonucleotide
caatatgatccctgatggggactttaacagctacg

SEQ ID NO: 173871 - DNA, 36 bp, Artificial Sequence
  Description of Artificial Sequence: Synthetic oligonucleotide
aatatgatccctgatggggactttaacagctacgtc

SEQ ID NO: 173872 - DNA, 35 bp, Artificial Sequence
  Description of Artificial Sequence: Synthetic oligonucleotide
atatgatccctgatggggactttaacagctacgtc

SEQ ID NO: 173873 - DNA, 34 bp, Artificial Sequence
  Description of Artificial Sequence: Synthetic oligonucleotide
tatgatccctgatggggactttaacagctacgtc

SEQ ID NO: 173874 - DNA, 33 bp, Artificial Sequence
  Description of Artificial Sequence: Synthetic oligonucleotide
atgatccctgatggggactttaacagctacgtc

SEQ ID NO: 173875 - DNA, 32 bp, Artificial Sequence
  Description of Artificial Sequence: Synthetic oligonucleotide
tgatccctgatggggactttaacagctacgtc

SEQ ID NO: 173876 - DNA, 31 bp, Artificial Sequence
  Description of Artificial Sequence: Synthetic oligonucleotide
gatccctgatggggactttaacagctacgtc

SEQ ID NO: 173877 - DNA, 32 bp, Artificial Sequence
  Description of Artificial Sequence: Synthetic oligonucleotide
atccctgatggggactttaacagctacgtcag

SEQ ID NO: 173878 - DNA, 31 bp, Artificial Sequence
  Description of Artificial Sequence: Synthetic oligonucleotide
tccctgatggggactttaacagctacgtcag

SEQ ID NO: 173879 - DNA, 30 bp, Artificial Sequence
  Description of Artificial Sequence: Synthetic oligonucleotide
ccctgatggggactttaacagctacgtcag

SEQ ID NO: 173880 - DNA, 30 bp, Artificial Sequence
  Description of Artificial Sequence: Synthetic oligonucleotide
cctgatggggactttaacagctacgtcagg

SEQ ID NO: 173881 - DNA, 30 bp, Artificial Sequence
  Description of Artificial Sequence: Synthetic oligonucleotide
ctgatggggactttaacagctacgtcaggg

SEQ ID NO: 173882 - DNA, 33 bp, Artificial Sequence
  Description of Artificial Sequence: Synthetic oligonucleotide
tgatggggactttaacagctacgtcagggttac

SEQ ID NO: 173883 - DNA, 32 bp, Artificial Sequence
  Description of Artificial Sequence: Synthetic oligonucleotide
gatggggactttaacagctacgtcagggttac

SEQ ID NO: 173884 - DNA, 33 bp, Artificial Sequence
  Description of Artificial Sequence: Synthetic oligonucleotide
atggggactttaacagctacgtcagggttacag

SEQ ID NO: 173885 - DNA, 32 bp, Artificial Sequence
  Description of Artificial Sequence: Synthetic oligonucleotide
tggggactttaacagctacgtcagggttacag

SEQ ID NO: 173886 - DNA, 31 bp, Artificial Sequence
  Description of Artificial Sequence: Synthetic oligonucleotide
ggggactttaacagctacgtcagggttacag

SEQ ID NO: 173887 - DNA, 31 bp, Artificial Sequence
  Description of Artificial Sequence: Synthetic oligonucleotide
gggactttaacagctacgtcagggttacagc

SEQ ID NO: 173888 - DNA, 31 bp, Artificial Sequence
  Description of Artificial Sequence: Synthetic oligonucleotide
ggactttaacagctacgtcagggttacagcc

SEQ ID NO: 173889 - DNA, 32 bp, Artificial Sequence
  Description of Artificial Sequence: Synthetic oligonucleotide
gactttaacagctacgtcagggttacagcctc

SEQ ID NO: 173890 - DNA, 33 bp, Artificial Sequence
  Description of Artificial Sequence: Synthetic oligonucleotide
actttaacagctacgtcagggttacagcctcag

SEQ ID NO: 173891 - DNA, 32 bp, Artificial Sequence
  Description of Artificial Sequence: Synthetic oligonucleotide
ctttaacagctacgtcagggttacagcctcag

SEQ ID NO: 173892 - DNA, 34 bp, Artificial Sequence
  Description of Artificial Sequence: Synthetic oligonucleotide
tttaacagctacgtcagggttacagcctcagatc

SEQ ID NO: 173893 - DNA, 33 bp, Artificial Sequence
  Description of Artificial Sequence: Synthetic oligonucleotide
ttaacagctacgtcagggttacagcctcagatc

SEQ ID NO: 173894 - DNA, 32 bp, Artificial Sequence
  Description of Artificial Sequence: Synthetic oligonucleotide
taacagctacgtcagggttacagcctcagatc

SEQ ID NO: 173895 - DNA, 31 bp, Artificial Sequence
  Description of Artificial Sequence: Synthetic oligonucleotide
aacagctacgtcagggttacagcctcagatc

SEQ ID NO: 173896 - DNA, 30 bp, Artificial Sequence
  Description of Artificial Sequence: Synthetic oligonucleotide
acagctacgtcagggttacagcctcagatc

SEQ ID NO: 173897 - DNA, 29 bp, Artificial Sequence
  Description of Artificial Sequence: Synthetic oligonucleotide
cagctacgtcagggttacagcctcagatc

SEQ ID NO: 173898 - DNA, 29 bp, Artificial Sequence
  Description of Artificial Sequence: Synthetic oligonucleotide
agctacgtcagggttacagcctcagatcc

SEQ ID NO: 173899 - DNA, 28 bp, Artificial Sequence
  Description of Artificial Sequence: Synthetic oligonucleotide
gctacgtcagggttacagcctcagatcc

SEQ ID NO: 173900 - DNA, 31 bp, Artificial Sequence
  Description of Artificial Sequence: Synthetic oligonucleotide
ctacgtcagggttacagcctcagatccattg

SEQ ID NO: 173901 - DNA, 31 bp, Artificial Sequence
  Description of Artificial Sequence: Synthetic oligonucleotide
tacgtcagggttacagcctcagatccattgg

SEQ ID NO: 173902 - DNA, 30 bp, Artificial Sequence
  Description of Artificial Sequence: Synthetic oligonucleotide
acgtcagggttacagcctcagatccattgg

SEQ ID NO: 173903 - DNA, 29 bp, Artificial Sequence
  Description of Artificial Sequence: Synthetic oligonucleotide
cgtcagggttacagcctcagatccattgg

SEQ ID NO: 173904 - DNA, 30 bp, Artificial Sequence
  Description of Artificial Sequence: Synthetic oligonucleotide
gtcagggttacagcctcagatccattggac

SEQ ID NO: 173905 - DNA, 31 bp, Artificial Sequence
  Description of Artificial Sequence: Synthetic oligonucleotide
tcagggttacagcctcagatccattggacac

SEQ ID NO: 173906 - DNA, 30 bp, Artificial Sequence
  Description of Artificial Sequence: Synthetic oligonucleotide
cagggttacagcctcagatccattggacac

SEQ ID NO: 173907 - DNA, 34 bp, Artificial Sequence
  Description of Artificial Sequence: Synthetic oligonucleotide
agggttacagcctcagatccattggacactttag

SEQ ID NO: 173908 - DNA, 33 bp, Artificial Sequence
  Description of Artificial Sequence: Synthetic oligonucleotide
gggttacagcctcagatccattggacactttag

SEQ ID NO: 173909 - DNA, 33 bp, Artificial Sequence
  Description of Artificial Sequence: Synthetic oligonucleotide
ggttacagcctcagatccattggacactttagg

SEQ ID NO: 173910 - DNA, 33 bp, Artificial Sequence
  Description of Artificial Sequence: Synthetic oligonucleotide
gttacagcctcagatccattggacactttaggc

SEQ ID NO: 173911 - DNA, 34 bp, Artificial Sequence
  Description of Artificial Sequence: Synthetic oligonucleotide
ttacagcctcagatccattggacactttaggctc

SEQ ID NO: 173912 - DNA, 33 bp, Artificial Sequence
  Description of Artificial Sequence: Synthetic oligonucleotide
tacagcctcagatccattggacactttaggctc

SEQ ID NO: 173913 - DNA, 32 bp, Artificial Sequence
  Description of Artificial Sequence: Synthetic oligonucleotide
acagcctcagatccattggacactttaggctc

SEQ ID NO: 173914 - DNA, 31 bp, Artificial Sequence
  Description of Artificial Sequence: Synthetic oligonucleotide
cagcctcagatccattggacactttaggctc

SEQ ID NO: 173915 - DNA, 32 bp, Artificial Sequence
  Description of Artificial Sequence: Synthetic oligonucleotide
agcctcagatccattggacactttaggctctg

SEQ ID NO: 173916 - DNA, 31 bp, Artificial Sequence
  Description of Artificial Sequence: Synthetic oligonucleotide
gcctcagatccattggacactttaggctctg

SEQ ID NO: 173917 - DNA, 32 bp, Artificial Sequence
  Description of Artificial Sequence: Synthetic oligonucleotide
cctcagatccattggacactttaggctctgag

SEQ ID NO: 173918 - DNA, 32 bp, Artificial Sequence
  Description of Artificial Sequence: Synthetic oligonucleotide
ctcagatccattggacactttaggctctgagg

SEQ ID NO: 173919 - DNA, 32 bp, Artificial Sequence
  Description of Artificial Sequence: Synthetic oligonucleotide
tcagatccattggacactttaggctctgaggg

SEQ ID NO: 173920 - DNA, 31 bp, Artificial Sequence
  Description of Artificial Sequence: Synthetic oligonucleotide
cagatccattggacactttaggctctgaggg

SEQ ID NO: 173921 - DNA, 31 bp, Artificial Sequence
  Description of Artificial Sequence: Synthetic oligonucleotide
agatccattggacactttaggctctgagggg

SEQ ID NO: 173922 - DNA, 30 bp, Artificial Sequence
  Description of Artificial Sequence: Synthetic oligonucleotide
gatccattggacactttaggctctgagggg

SEQ ID NO: 173923 - DNA, 30 bp, Artificial Sequence
  Description of Artificial Sequence: Synthetic oligonucleotide
atccattggacactttaggctctgaggggg

SEQ ID NO: 173924 - DNA, 29 bp, Artificial Sequence
  Description of Artificial Sequence: Synthetic oligonucleotide
tccattggacactttaggctctgaggggg

SEQ ID NO: 173925 - DNA, 28 bp, Artificial Sequence
  Description of Artificial Sequence: Synthetic oligonucleotide
ccattggacactttaggctctgaggggg

SEQ ID NO: 173926 - DNA, 28 bp, Artificial Sequence
  Description of Artificial Sequence: Synthetic oligonucleotide
cattggacactttaggctctgagggggc

SEQ ID NO: 173927 - DNA, 28 bp, Artificial Sequence
  Description of Artificial Sequence: Synthetic oligonucleotide
attggacactttaggctctgagggggcc

SEQ ID NO: 173928 - DNA, 27 bp, Artificial Sequence
  Description of Artificial Sequence: Synthetic oligonucleotide
ttggacactttaggctctgagggggcc

SEQ ID NO: 173929 - DNA, 27 bp, Artificial Sequence
  Description of Artificial Sequence: Synthetic oligonucleotide
tggacactttaggctctgagggggcct

SEQ ID NO: 173930 - DNA, 27 bp, Artificial Sequence
  Description of Artificial Sequence: Synthetic oligonucleotide
ggacactttaggctctgagggggcctt

SEQ ID NO: 173931 - DNA, 27 bp, Artificial Sequence
  Description of Artificial Sequence: Synthetic oligonucleotide
gacactttaggctctgagggggccttg

SEQ ID NO: 173932 - DNA, 28 bp, Artificial Sequence
  Description of Artificial Sequence: Synthetic oligonucleotide
acactttaggctctgagggggccttgtc

SEQ ID NO: 173933 - DNA, 27 bp, Artificial Sequence
  Description of Artificial Sequence: Synthetic oligonucleotide
cactttaggctctgagggggccttgtc

SEQ ID NO: 173934 - DNA, 28 bp, Artificial Sequence
  Description of Artificial Sequence: Synthetic oligonucleotide
actttaggctctgagggggccttgtcac

SEQ ID NO: 173935 - DNA, 27 bp, Artificial Sequence
  Description of Artificial Sequence: Synthetic oligonucleotide
ctttaggctctgagggggccttgtcac

SEQ ID NO: 173936 - DNA, 27 bp, Artificial Sequence
  Description of Artificial Sequence: Synthetic oligonucleotide
tttaggctctgagggggccttgtcacc

SEQ ID NO: 173937 - DNA, 27 bp, Artificial Sequence
  Description of Artificial Sequence: Synthetic oligonucleotide
ttaggctctgagggggccttgtcacca

SEQ ID NO: 173938 - DNA, 26 bp, Artificial Sequence
  Description of Artificial Sequence: Synthetic oligonucleotide
taggctctgagggggccttgtcacca

SEQ ID NO: 173939 - DNA, 25 bp, Artificial Sequence
  Description of Artificial Sequence: Synthetic oligonucleotide
aggctctgagggggccttgtcacca

SEQ ID NO: 173940 - DNA, 24 bp, Artificial Sequence
  Description of Artificial Sequence: Synthetic oligonucleotide
ggctctgagggggccttgtcacca

SEQ ID NO: 173941 - DNA, 24 bp, Artificial Sequence
  Description of Artificial Sequence: Synthetic oligonucleotide
gctctgagggggccttgtcaccag

SEQ ID NO: 173942 - DNA, 25 bp, Artificial Sequence
  Description of Artificial Sequence: Synthetic oligonucleotide
ctctgagggggccttgtcaccagga

SEQ ID NO: 173943 - DNA, 25 bp, Artificial Sequence
  Description of Artificial Sequence: Synthetic oligonucleotide
tctgagggggccttgtcaccaggag

SEQ ID NO: 173944 - DNA, 24 bp, Artificial Sequence
  Description of Artificial Sequence: Synthetic oligonucleotide
ctgagggggccttgtcaccaggag

SEQ ID NO: 173945 - DNA, 24 bp, Artificial Sequence
  Description of Artificial Sequence: Synthetic oligonucleotide
tgagggggccttgtcaccaggagg

SEQ ID NO: 173946 - DNA, 23 bp, Artificial Sequence
  Description of Artificial Sequence: Synthetic oligonucleotide
gagggggccttgtcaccaggagg

SEQ ID NO: 173947 - DNA, 23 bp, Artificial Sequence
  Description of Artificial Sequence: Synthetic oligonucleotide
agggggccttgtcaccaggaggc

SEQ ID NO: 173948 - DNA, 22 bp, Artificial Sequence
  Description of Artificial Sequence: Synthetic oligonucleotide
gggggccttgtcaccaggaggc

SEQ ID NO: 173949 - DNA, 23 bp, Artificial Sequence
  Description of Artificial Sequence: Synthetic oligonucleotide
ggggccttgtcaccaggaggcgt

SEQ ID NO: 173950 - DNA, 23 bp, Artificial Sequence
  Description of Artificial Sequence: Synthetic oligonucleotide
gggccttgtcaccaggaggcgtg

SEQ ID NO: 173951 - DNA, 23 bp, Artificial Sequence
  Description of Artificial Sequence: Synthetic oligonucleotide
ggccttgtcaccaggaggcgtgg

SEQ ID NO: 173952 - DNA, 23 bp, Artificial Sequence
  Description of Artificial Sequence: Synthetic oligonucleotide
gccttgtcaccaggaggcgtggc

SEQ ID NO: 173953 - DNA, 24 bp, Artificial Sequence
  Description of Artificial Sequence: Synthetic oligonucleotide
ccttgtcaccaggaggcgtggcct

SEQ ID NO: 173954 - DNA, 24 bp, Artificial Sequence
  Description of Artificial Sequence: Synthetic oligonucleotide
cttgtcaccaggaggcgtggcctc

SEQ ID NO: 173955 - DNA, 24 bp, Artificial Sequence
  Description of Artificial Sequence: Synthetic oligonucleotide
ttgtcaccaggaggcgtggcctcc

SEQ ID NO: 173956 - DNA, 23 bp, Artificial Sequence
  Description of Artificial Sequence: Synthetic oligonucleotide
tgtcaccaggaggcgtggcctcc

SEQ ID NO: 173957 - DNA, 22 bp, Artificial Sequence
  Description of Artificial Sequence: Synthetic oligonucleotide
gtcaccaggaggcgtggcctcc

SEQ ID NO: 173958 - DNA, 23 bp, Artificial Sequence
  Description of Artificial Sequence: Synthetic oligonucleotide
tcaccaggaggcgtggcctccct

SEQ ID NO: 173959 - DNA, 22 bp, Artificial Sequence
  Description of Artificial Sequence: Synthetic oligonucleotide
caccaggaggcgtggcctccct

SEQ ID NO: 173960 - DNA, 24 bp, Artificial Sequence
  Description of Artificial Sequence: Synthetic oligonucleotide
accaggaggcgtggcctccctctt

SEQ ID NO: 173961 - DNA, 23 bp, Artificial Sequence
  Description of Artificial Sequence: Synthetic oligonucleotide
ccaggaggcgtggcctccctctt

SEQ ID NO: 173962 - DNA, 24 bp, Artificial Sequence
  Description of Artificial Sequence: Synthetic oligonucleotide
caggaggcgtggcctccctcttga

SEQ ID NO: 173963 - DNA, 24 bp, Artificial Sequence
  Description of Artificial Sequence: Synthetic oligonucleotide
aggaggcgtggcctccctcttgag

SEQ ID NO: 173964 - DNA, 23 bp, Artificial Sequence
  Description of Artificial Sequence: Synthetic oligonucleotide
ggaggcgtggcctccctcttgag

SEQ ID NO: 173965 - DNA, 23 bp, Artificial Sequence
  Description of Artificial Sequence: Synthetic oligonucleotide
gaggcgtggcctccctcttgagg

SEQ ID NO: 173966 - DNA, 25 bp, Artificial Sequence
  Description of Artificial Sequence: Synthetic oligonucleotide
aggcgtggcctccctcttgaggctt

SEQ ID NO: 173967 - DNA, 24 bp, Artificial Sequence
  Description of Artificial Sequence: Synthetic oligonucleotide
ggcgtggcctccctcttgaggctt

SEQ ID NO: 173968 - DNA, 24 bp, Artificial Sequence
  Description of Artificial Sequence: Synthetic oligonucleotide
gcgtggcctccctcttgaggcttc

SEQ ID NO: 173969 - DNA, 25 bp, Artificial Sequence
  Description of Artificial Sequence: Synthetic oligonucleotide
cgtggcctccctcttgaggcttcct

SEQ ID NO: 173970 - DNA, 25 bp, Artificial Sequence
  Description of Artificial Sequence: Synthetic oligonucleotide
gtggcctccctcttgaggcttcctc

SEQ ID NO: 173971 - DNA, 26 bp, Artificial Sequence
  Description of Artificial Sequence: Synthetic oligonucleotide
tggcctccctcttgaggcttcctcga

SEQ ID NO: 173972 - DNA, 25 bp, Artificial Sequence
  Description of Artificial Sequence: Synthetic oligonucleotide
ggcctccctcttgaggcttcctcga

SEQ ID NO: 173973 - DNA, 25 bp, Artificial Sequence
  Description of Artificial Sequence: Synthetic oligonucleotide
gcctccctcttgaggcttcctcgag

SEQ ID NO: 173974 - DNA, 25 bp, Artificial Sequence
  Description of Artificial Sequence: Synthetic oligonucleotide
cctccctcttgaggcttcctcgagg

SEQ ID NO: 173975 - DNA, 26 bp, Artificial Sequence
  Description of Artificial Sequence: Synthetic oligonucleotide
ctccctcttgaggcttcctcgaggct

SEQ ID NO: 173976 - DNA, 27 bp, Artificial Sequence
  Description of Artificial Sequence: Synthetic oligonucleotide
tccctcttgaggcttcctcgaggctgt

SEQ ID NO: 173977 - DNA, 26 bp, Artificial Sequence
  Description of Artificial Sequence: Synthetic oligonucleotide
ccctcttgaggcttcctcgaggctgt

SEQ ID NO: 173978 - DNA, 26 bp, Artificial Sequence
  Description of Artificial Sequence: Synthetic oligonucleotide
cctcttgaggcttcctcgaggctgtg

SEQ ID NO: 173979 - DNA, 26 bp, Artificial Sequence
  Description of Artificial Sequence: Synthetic oligonucleotide
ctcttgaggcttcctcgaggctgtgg

SEQ ID NO: 173980 - DNA, 26 bp, Artificial Sequence
  Description of Artificial Sequence: Synthetic oligonucleotide
tcttgaggcttcctcgaggctgtggg

SEQ ID NO: 173981 - DNA, 25 bp, Artificial Sequence
  Description of Artificial Sequence: Synthetic oligonucleotide
cttgaggcttcctcgaggctgtggg

SEQ ID NO: 173982 - DNA, 26 bp, Artificial Sequence
  Description of Artificial Sequence: Synthetic oligonucleotide
ttgaggcttcctcgaggctgtgggga

SEQ ID NO: 173983 - DNA, 25 bp, Artificial Sequence
  Description of Artificial Sequence: Synthetic oligonucleotide
tgaggcttcctcgaggctgtgggga

SEQ ID NO: 173984 - DNA, 24 bp, Artificial Sequence
  Description of Artificial Sequence: Synthetic oligonucleotide
gaggcttcctcgaggctgtgggga

SEQ ID NO: 173985 - DNA, 24 bp, Artificial Sequence
  Description of Artificial Sequence: Synthetic oligonucleotide
aggcttcctcgaggctgtggggag

SEQ ID NO: 173986 - DNA, 23 bp, Artificial Sequence
  Description of Artificial Sequence: Synthetic oligonucleotide
ggcttcctcgaggctgtggggag

SEQ ID NO: 173987 - DNA, 26 bp, Artificial Sequence
  Description of Artificial Sequence: Synthetic oligonucleotide
gcttcctcgaggctgtggggagcaaa

SEQ ID NO: 173988 - DNA, 26 bp, Artificial Sequence
  Description of Artificial Sequence: Synthetic oligonucleotide
cttcctcgaggctgtggggagcaaac

SEQ ID NO: 173989 - DNA, 27 bp, Artificial Sequence
  Description of Artificial Sequence: Synthetic oligonucleotide
ttcctcgaggctgtggggagcaaacca

SEQ ID NO: 173990 - DNA, 27 bp, Artificial Sequence
  Description of Artificial Sequence: Synthetic oligonucleotide
tcctcgaggctgtggggagcaaaccat

SEQ ID NO: 173991 - DNA, 26 bp, Artificial Sequence
  Description of Artificial Sequence: Synthetic oligonucleotide
cctcgaggctgtggggagcaaaccat

SEQ ID NO: 173992 - DNA, 27 bp, Artificial Sequence
  Description of Artificial Sequence: Synthetic oligonucleotide
ctcgaggctgtggggagcaaaccatga

SEQ ID NO: 173993 - DNA, 28 bp, Artificial Sequence
  Description of Artificial Sequence: Synthetic oligonucleotide
tcgaggctgtggggagcaaaccatgatc

SEQ ID NO: 173994 - DNA, 27 bp, Artificial Sequence
  Description of Artificial Sequence: Synthetic oligonucleotide
cgaggctgtggggagcaaaccatgatc

SEQ ID NO: 173995 - DNA, 29 bp, Artificial Sequence
  Description of Artificial Sequence: Synthetic oligonucleotide
gaggctgtggggagcaaaccatgatctac

SEQ ID NO: 173996 - DNA, 31 bp, Artificial Sequence
  Description of Artificial Sequence: Synthetic oligonucleotide
aggctgtggggagcaaaccatgatctacttg

SEQ ID NO: 173997 - DNA, 30 bp, Artificial Sequence
  Description of Artificial Sequence: Synthetic oligonucleotide
ggctgtggggagcaaaccatgatctacttg

SEQ ID NO: 173998 - DNA, 30 bp, Artificial Sequence
  Description of Artificial Sequence: Synthetic oligonucleotide
gctgtggggagcaaaccatgatctacttgg

SEQ ID NO: 173999 - DNA, 30 bp, Artificial Sequence
  Description of Artificial Sequence: Synthetic oligonucleotide
ctgtggggagcaaaccatgatctacttggc

SEQ ID NO: 174000 - DNA, 31 bp, Artificial Sequence
  Description of Artificial Sequence: Synthetic oligonucleotide
tgtggggagcaaaccatgatctacttggctc

SEQ ID NO: 174001 - DNA, 30 bp, Artificial Sequence
  Description of Artificial Sequence: Synthetic oligonucleotide
gtggggagcaaaccatgatctacttggctc

SEQ ID NO: 174002 - DNA, 30 bp, Artificial Sequence
  Description of Artificial Sequence: Synthetic oligonucleotide
tggggagcaaaccatgatctacttggctcc

SEQ ID NO: 174003 - DNA, 29 bp, Artificial Sequence
  Description of Artificial Sequence: Synthetic oligonucleotide
ggggagcaaaccatgatctacttggctcc

SEQ ID NO: 174004 - DNA, 29 bp, Artificial Sequence
  Description of Artificial Sequence: Synthetic oligonucleotide
gggagcaaaccatgatctacttggctccg

SEQ ID NO: 174005 - DNA, 30 bp, Artificial Sequence
  Description of Artificial Sequence: Synthetic oligonucleotide
ggagcaaaccatgatctacttggctccgac

SEQ ID NO: 174006 - DNA, 31 bp, Artificial Sequence
  Description of Artificial Sequence: Synthetic oligonucleotide
gagcaaaccatgatctacttggctccgacac

SEQ ID NO: 174007 - DNA, 32 bp, Artificial Sequence
  Description of Artificial Sequence: Synthetic oligonucleotide
agcaaaccatgatctacttggctccgacactg

SEQ ID NO: 174008 - DNA, 31 bp, Artificial Sequence
  Description of Artificial Sequence: Synthetic oligonucleotide
gcaaaccatgatctacttggctccgacactg

SEQ ID NO: 174009 - DNA, 31 bp, Artificial Sequence
  Description of Artificial Sequence: Synthetic oligonucleotide
caaaccatgatctacttggctccgacactgg

SEQ ID NO: 174010 - DNA, 31 bp, Artificial Sequence
  Description of Artificial Sequence: Synthetic oligonucleotide
aaaccatgatctacttggctccgacactggc

SEQ ID NO: 174011 - DNA, 30 bp, Artificial Sequence
  Description of Artificial Sequence: Synthetic oligonucleotide
aaccatgatctacttggctccgacactggc

SEQ ID NO: 174012 - DNA, 29 bp, Artificial Sequence
  Description of Artificial Sequence: Synthetic oligonucleotide
accatgatctacttggctccgacactggc

SEQ ID NO: 174013 - DNA, 28 bp, Artificial Sequence
  Description of Artificial Sequence: Synthetic oligonucleotide
ccatgatctacttggctccgacactggc

SEQ ID NO: 174014 - DNA, 29 bp, Artificial Sequence
  Description of Artificial Sequence: Synthetic oligonucleotide
catgatctacttggctccgacactggctg

SEQ ID NO: 174015 - DNA, 29 bp, Artificial Sequence
  Description of Artificial Sequence: Synthetic oligonucleotide
atgatctacttggctccgacactggctgc

SEQ ID NO: 174016 - DNA, 28 bp, Artificial Sequence
  Description of Artificial Sequence: Synthetic oligonucleotide
tgatctacttggctccgacactggctgc

SEQ ID NO: 174017 - DNA, 27 bp, Artificial Sequence
  Description of Artificial Sequence: Synthetic oligonucleotide
gatctacttggctccgacactggctgc

SEQ ID NO: 174018 - DNA, 29 bp, Artificial Sequence
  Description of Artificial Sequence: Synthetic oligonucleotide
atctacttggctccgacactggctgcttc

SEQ ID NO: 174019 - DNA, 28 bp, Artificial Sequence
  Description of Artificial Sequence: Synthetic oligonucleotide
tctacttggctccgacactggctgcttc

SEQ ID NO: 174020 - DNA, 27 bp, Artificial Sequence
  Description of Artificial Sequence: Synthetic oligonucleotide
ctacttggctccgacactggctgcttc

SEQ ID NO: 174021 - DNA, 27 bp, Artificial Sequence
  Description of Artificial Sequence: Synthetic oligonucleotide
tacttggctccgacactggctgcttcc

SEQ ID NO: 174022 - DNA, 26 bp, Artificial Sequence
  Description of Artificial Sequence: Synthetic oligonucleotide
acttggctccgacactggctgcttcc

SEQ ID NO: 174023 - DNA, 25 bp, Artificial Sequence
  Description of Artificial Sequence: Synthetic oligonucleotide
cttggctccgacactggctgcttcc

SEQ ID NO: 174024 - DNA, 25 bp, Artificial Sequence
  Description of Artificial Sequence: Synthetic oligonucleotide
ttggctccgacactggctgcttccc

SEQ ID NO: 174025 - DNA, 24 bp, Artificial Sequence
  Description of Artificial Sequence: Synthetic oligonucleotide
tggctccgacactggctgcttccc

SEQ ID NO: 174026 - DNA, 23 bp, Artificial Sequence
  Description of Artificial Sequence: Synthetic oligonucleotide
ggctccgacactggctgcttccc

SEQ ID NO: 174027 - DNA, 23 bp, Artificial Sequence
  Description of Artificial Sequence: Synthetic oligonucleotide
gctccgacactggctgcttcccg

SEQ ID NO: 174028 - DNA, 25 bp, Artificial Sequence
  Description of Artificial Sequence: Synthetic oligonucleotide
ctccgacactggctgcttcccgcta

SEQ ID NO: 174029 - DNA, 25 bp, Artificial Sequence
  Description of Artificial Sequence: Synthetic oligonucleotide
tccgacactggctgcttcccgctac

SEQ ID NO: 174030 - DNA, 24 bp, Artificial Sequence
  Description of Artificial Sequence: Synthetic oligonucleotide
ccgacactggctgcttcccgctac

SEQ ID NO: 174031 - DNA, 25 bp, Artificial Sequence
  Description of Artificial Sequence: Synthetic oligonucleotide
cgacactggctgcttcccgctacct

SEQ ID NO: 174032 - DNA, 25 bp, Artificial Sequence
  Description of Artificial Sequence: Synthetic oligonucleotide
gacactggctgcttcccgctacctg

SEQ ID NO: 174033 - DNA, 26 bp, Artificial Sequence
  Description of Artificial Sequence: Synthetic oligonucleotide
acactggctgcttcccgctacctgga

SEQ ID NO: 174034 - DNA, 25 bp, Artificial Sequence
  Description of Artificial Sequence: Synthetic oligonucleotide
cactggctgcttcccgctacctgga

SEQ ID NO: 174035 - DNA, 27 bp, Artificial Sequence
  Description of Artificial Sequence: Synthetic oligonucleotide
actggctgcttcccgctacctggacaa

SEQ ID NO: 174036 - DNA, 26 bp, Artificial Sequence
  Description of Artificial Sequence: Synthetic oligonucleotide
ctggctgcttcccgctacctggacaa

SEQ ID NO: 174037 - DNA, 27 bp, Artificial Sequence
  Description of Artificial Sequence: Synthetic oligonucleotide
tggctgcttcccgctacctggacaaga

SEQ ID NO: 174038 - DNA, 26 bp, Artificial Sequence
  Description of Artificial Sequence: Synthetic oligonucleotide
ggctgcttcccgctacctggacaaga

SEQ ID NO: 174039 - DNA, 27 bp, Artificial Sequence
  Description of Artificial Sequence: Synthetic oligonucleotide
gctgcttcccgctacctggacaagaca

SEQ ID NO: 174040 - DNA, 27 bp, Artificial Sequence
  Description of Artificial Sequence: Synthetic oligonucleotide
ctgcttcccgctacctggacaagacag

SEQ ID NO: 174041 - DNA, 28 bp, Artificial Sequence
  Description of Artificial Sequence: Synthetic oligonucleotide
tgcttcccgctacctggacaagacagag

SEQ ID NO: 174042 - DNA, 27 bp, Artificial Sequence
  Description of Artificial Sequence: Synthetic oligonucleotide
gcttcccgctacctggacaagacagag

SEQ ID NO: 174043 - DNA, 27 bp, Artificial Sequence
  Description of Artificial Sequence: Synthetic oligonucleotide
cttcccgctacctggacaagacagagc

SEQ ID NO: 174044 - DNA, 28 bp, Artificial Sequence
  Description of Artificial Sequence: Synthetic oligonucleotide
ttcccgctacctggacaagacagagcag

SEQ ID NO: 174045 - DNA, 27 bp, Artificial Sequence
  Description of Artificial Sequence: Synthetic oligonucleotide
tcccgctacctggacaagacagagcag

SEQ ID NO: 174046 - DNA, 27 bp, Artificial Sequence
  Description of Artificial Sequence: Synthetic oligonucleotide
cccgctacctggacaagacagagcagt

SEQ ID NO: 174047 - DNA, 27 bp, Artificial Sequence
  Description of Artificial Sequence: Synthetic oligonucleotide
ccgctacctggacaagacagagcagtg

SEQ ID NO: 174048 - DNA, 27 bp, Artificial Sequence
  Description of Artificial Sequence: Synthetic oligonucleotide
cgctacctggacaagacagagcagtgg

SEQ ID NO: 174049 - DNA, 28 bp, Artificial Sequence
  Description of Artificial Sequence: Synthetic oligonucleotide
gctacctggacaagacagagcagtggag

SEQ ID NO: 174050 - DNA, 28 bp, Artificial Sequence
  Description of Artificial Sequence: Synthetic oligonucleotide
ctacctggacaagacagagcagtggagc

SEQ ID NO: 174051 - DNA, 29 bp, Artificial Sequence
  Description of Artificial Sequence: Synthetic oligonucleotide
tacctggacaagacagagcagtggagcac

SEQ ID NO: 174052 - DNA, 28 bp, Artificial Sequence
  Description of Artificial Sequence: Synthetic oligonucleotide
acctggacaagacagagcagtggagcac

SEQ ID NO: 174053 - DNA, 27 bp, Artificial Sequence
  Description of Artificial Sequence: Synthetic oligonucleotide
cctggacaagacagagcagtggagcac

SEQ ID NO: 174054 - DNA, 28 bp, Artificial Sequence
  Description of Artificial Sequence: Synthetic oligonucleotide
ctggacaagacagagcagtggagcacac

SEQ ID NO: 174055 - DNA, 29 bp, Artificial Sequence
  Description of Artificial Sequence: Synthetic oligonucleotide
tggacaagacagagcagtggagcacactg

SEQ ID NO: 174056 - DNA, 28 bp, Artificial Sequence
  Description of Artificial Sequence: Synthetic oligonucleotide
ggacaagacagagcagtggagcacactg

SEQ ID NO: 174057 - DNA, 28 bp, Artificial Sequence
  Description of Artificial Sequence: Synthetic oligonucleotide
gacaagacagagcagtggagcacactgc

SEQ ID NO: 174058 - DNA, 28 bp, Artificial Sequence
  Description of Artificial Sequence: Synthetic oligonucleotide
acaagacagagcagtggagcacactgcc

SEQ ID NO: 174059 - DNA, 27 bp, Artificial Sequence
  Description of Artificial Sequence: Synthetic oligonucleotide
caagacagagcagtggagcacactgcc

SEQ ID NO: 174060 - DNA, 28 bp, Artificial Sequence
  Description of Artificial Sequence: Synthetic oligonucleotide
aagacagagcagtggagcacactgcctc

SEQ ID NO: 174061 - DNA, 27 bp, Artificial Sequence
  Description of Artificial Sequence: Synthetic oligonucleotide
agacagagcagtggagcacactgcctc

SEQ ID NO: 174062 - DNA, 26 bp, Artificial Sequence
  Description of Artificial Sequence: Synthetic oligonucleotide
gacagagcagtggagcacactgcctc

SEQ ID NO: 174063 - DNA, 26 bp, Artificial Sequence
  Description of Artificial Sequence: Synthetic oligonucleotide
acagagcagtggagcacactgcctcc

SEQ ID NO: 174064 - DNA, 25 bp, Artificial Sequence
  Description of Artificial Sequence: Synthetic oligonucleotide
cagagcagtggagcacactgcctcc

SEQ ID NO: 174065 - DNA, 25 bp, Artificial Sequence
  Description of Artificial Sequence: Synthetic oligonucleotide
agagcagtggagcacactgcctccc

SEQ ID NO: 174066 - DNA, 24 bp, Artificial Sequence
  Description of Artificial Sequence: Synthetic oligonucleotide
gagcagtggagcacactgcctccc

SEQ ID NO: 174067 - DNA, 25 bp, Artificial Sequence
  Description of Artificial Sequence: Synthetic oligonucleotide
agcagtggagcacactgcctcccga

SEQ ID NO: 174068 - DNA, 24 bp, Artificial Sequence
  Description of Artificial Sequence: Synthetic oligonucleotide
gcagtggagcacactgcctcccga

SEQ ID NO: 174069 - DNA, 25 bp, Artificial Sequence
  Description of Artificial Sequence: Synthetic oligonucleotide
cagtggagcacactgcctcccgaga

SEQ ID NO: 174070 - DNA, 25 bp, Artificial Sequence
  Description of Artificial Sequence: Synthetic oligonucleotide
agtggagcacactgcctcccgagac

SEQ ID NO: 174071 - DNA, 24 bp, Artificial Sequence
  Description of Artificial Sequence: Synthetic oligonucleotide
gtggagcacactgcctcccgagac

SEQ ID NO: 174072 - DNA, 26 bp, Artificial Sequence
  Description of Artificial Sequence: Synthetic oligonucleotide
tggagcacactgcctcccgagaccaa

SEQ ID NO: 174073 - DNA, 25 bp, Artificial Sequence
  Description of Artificial Sequence: Synthetic oligonucleotide
ggagcacactgcctcccgagaccaa

SEQ ID NO: 174074 - DNA, 25 bp, Artificial Sequence
  Description of Artificial Sequence: Synthetic oligonucleotide
gagcacactgcctcccgagaccaag

SEQ ID NO: 174075 - DNA, 26 bp, Artificial Sequence
  Description of Artificial Sequence: Synthetic oligonucleotide
agcacactgcctcccgagaccaagga

SEQ ID NO: 174076 - DNA, 25 bp, Artificial Sequence
  Description of Artificial Sequence: Synthetic oligonucleotide
gcacactgcctcccgagaccaagga

SEQ ID NO: 174077 - DNA, 25 bp, Artificial Sequence
  Description of Artificial Sequence: Synthetic oligonucleotide
cacactgcctcccgagaccaaggac

SEQ ID NO: 174078 - DNA, 26 bp, Artificial Sequence
  Description of Artificial Sequence: Synthetic oligonucleotide
acactgcctcccgagaccaaggacca

SEQ ID NO: 174079 - DNA, 25 bp, Artificial Sequence
  Description of Artificial Sequence: Synthetic oligonucleotide
cactgcctcccgagaccaaggacca

SEQ ID NO: 174080 - DNA, 25 bp, Artificial Sequence
  Description of Artificial Sequence: Synthetic oligonucleotide
actgcctcccgagaccaaggaccac

SEQ ID NO: 174081 - DNA, 24 bp, Artificial Sequence
  Description of Artificial Sequence: Synthetic oligonucleotide
ctgcctcccgagaccaaggaccac

SEQ ID NO: 174082 - DNA, 24 bp, Artificial Sequence
  Description of Artificial Sequence: Synthetic oligonucleotide
tgcctcccgagaccaaggaccacg

SEQ ID NO: 174083 - DNA, 23 bp, Artificial Sequence
  Description of Artificial Sequence: Synthetic oligonucleotide
gcctcccgagaccaaggaccacg

SEQ ID NO: 174084 - DNA, 23 bp, Artificial Sequence
  Description of Artificial Sequence: Synthetic oligonucleotide
cctcccgagaccaaggaccacgc

SEQ ID NO: 174085 - DNA, 23 bp, Artificial Sequence
  Description of Artificial Sequence: Synthetic oligonucleotide
ctcccgagaccaaggaccacgcc

SEQ ID NO: 174086 - DNA, 24 bp, Artificial Sequence
  Description of Artificial Sequence: Synthetic oligonucleotide
tcccgagaccaaggaccacgccgt

SEQ ID NO: 174087 - DNA, 23 bp, Artificial Sequence
  Description of Artificial Sequence: Synthetic oligonucleotide
cccgagaccaaggaccacgccgt

SEQ ID NO: 174088 - DNA, 23 bp, Artificial Sequence
  Description of Artificial Sequence: Synthetic oligonucleotide
ccgagaccaaggaccacgccgtg

SEQ ID NO: 174089 - DNA, 25 bp, Artificial Sequence
  Description of Artificial Sequence: Synthetic oligonucleotide
cgagaccaaggaccacgccgtggat

SEQ ID NO: 174090 - DNA, 26 bp, Artificial Sequence
  Description of Artificial Sequence: Synthetic oligonucleotide
gagaccaaggaccacgccgtggatct

SEQ ID NO: 174091 - DNA, 27 bp, Artificial Sequence
  Description of Artificial Sequence: Synthetic oligonucleotide
agaccaaggaccacgccgtggatctga

SEQ ID NO: 174092 - DNA, 27 bp, Artificial Sequence
  Description of Artificial Sequence: Synthetic oligonucleotide
gaccaaggaccacgccgtggatctgat

SEQ ID NO: 174093 - DNA, 27 bp, Artificial Sequence
  Description of Artificial Sequence: Synthetic oligonucleotide
accaaggaccacgccgtggatctgatc

SEQ ID NO: 174094 - DNA, 26 bp, Artificial Sequence
  Description of Artificial Sequence: Synthetic oligonucleotide
ccaaggaccacgccgtggatctgatc

SEQ ID NO: 174095 - DNA, 27 bp, Artificial Sequence
  Description of Artificial Sequence: Synthetic oligonucleotide
caaggaccacgccgtggatctgatcca

SEQ ID NO: 174096 - DNA, 27 bp, Artificial Sequence
  Description of Artificial Sequence: Synthetic oligonucleotide
aaggaccacgccgtggatctgatccag

SEQ ID NO: 174097 - DNA, 27 bp, Artificial Sequence
  Description of Artificial Sequence: Synthetic oligonucleotide
aggaccacgccgtggatctgatccaga

SEQ ID NO: 174098 - DNA, 27 bp, Artificial Sequence
  Description of Artificial Sequence: Synthetic oligonucleotide
ggaccacgccgtggatctgatccagaa

SEQ ID NO: 174099 - DNA, 28 bp, Artificial Sequence
  Description of Artificial Sequence: Synthetic oligonucleotide
gaccacgccgtggatctgatccagaaag

SEQ ID NO: 174100 - DNA, 28 bp, Artificial Sequence
  Description of Artificial Sequence: Synthetic oligonucleotide
accacgccgtggatctgatccagaaagg

SEQ ID NO: 174101 - DNA, 27 bp, Artificial Sequence
  Description of Artificial Sequence: Synthetic oligonucleotide
ccacgccgtggatctgatccagaaagg

SEQ ID NO: 174102 - DNA, 27 bp, Artificial Sequence
  Description of Artificial Sequence: Synthetic oligonucleotide
cacgccgtggatctgatccagaaaggc

SEQ ID NO: 174103 - DNA, 29 bp, Artificial Sequence
  Description of Artificial Sequence: Synthetic oligonucleotide
acgccgtggatctgatccagaaaggctac

SEQ ID NO: 174104 - DNA, 28 bp, Artificial Sequence
  Description of Artificial Sequence: Synthetic oligonucleotide
cgccgtggatctgatccagaaaggctac

SEQ ID NO: 174105 - DNA, 30 bp, Artificial Sequence
  Description of Artificial Sequence: Synthetic oligonucleotide
gccgtggatctgatccagaaaggctacatg

SEQ ID NO: 174106 - DNA, 30 bp, Artificial Sequence
  Description of Artificial Sequence: Synthetic oligonucleotide
ccgtggatctgatccagaaaggctacatgc

SEQ ID NO: 174107 - DNA, 30 bp, Artificial Sequence
  Description of Artificial Sequence: Synthetic oligonucleotide
cgtggatctgatccagaaaggctacatgcg

SEQ ID NO: 174108 - DNA, 30 bp, Artificial Sequence
  Description of Artificial Sequence: Synthetic oligonucleotide
gtggatctgatccagaaaggctacatgcgg

SEQ ID NO: 174109 - DNA, 32 bp, Artificial Sequence
  Description of Artificial Sequence: Synthetic oligonucleotide
tggatctgatccagaaaggctacatgcggatc

SEQ ID NO: 174110 - DNA, 31 bp, Artificial Sequence
  Description of Artificial Sequence: Synthetic oligonucleotide
ggatctgatccagaaaggctacatgcggatc

SEQ ID NO: 174111 - DNA, 31 bp, Artificial Sequence
  Description of Artificial Sequence: Synthetic oligonucleotide
gatctgatccagaaaggctacatgcggatcc

SEQ ID NO: 174112 - DNA, 32 bp, Artificial Sequence
  Description of Artificial Sequence: Synthetic oligonucleotide
atctgatccagaaaggctacatgcggatccag

SEQ ID NO: 174113 - DNA, 31 bp, Artificial Sequence
  Description of Artificial Sequence: Synthetic oligonucleotide
tctgatccagaaaggctacatgcggatccag

SEQ ID NO: 174114 - DNA, 30 bp, Artificial Sequence
  Description of Artificial Sequence: Synthetic oligonucleotide
ctgatccagaaaggctacatgcggatccag

SEQ ID NO: 174115 - DNA, 30 bp, Artificial Sequence
  Description of Artificial Sequence: Synthetic oligonucleotide
tgatccagaaaggctacatgcggatccagc

SEQ ID NO: 174116 - DNA, 29 bp, Artificial Sequence
  Description of Artificial Sequence: Synthetic oligonucleotide
gatccagaaaggctacatgcggatccagc

SEQ ID NO: 174117 - DNA, 30 bp, Artificial Sequence
  Description of Artificial Sequence: Synthetic oligonucleotide
atccagaaaggctacatgcggatccagcag

SEQ ID NO: 174118 - DNA, 29 bp, Artificial Sequence
  Description of Artificial Sequence: Synthetic oligonucleotide
tccagaaaggctacatgcggatccagcag

SEQ ID NO: 174119 - DNA, 28 bp, Artificial Sequence
  Description of Artificial Sequence: Synthetic oligonucleotide
ccagaaaggctacatgcggatccagcag

SEQ ID NO: 174120 - DNA, 31 bp, Artificial Sequence
  Description of Artificial Sequence: Synthetic oligonucleotide
cagaaaggctacatgcggatccagcagtttc

SEQ ID NO: 174121 - DNA, 31 bp, Artificial Sequence
  Description of Artificial Sequence: Synthetic oligonucleotide
agaaaggctacatgcggatccagcagtttcg

SEQ ID NO: 174122 - DNA, 30 bp, Artificial Sequence
  Description of Artificial Sequence: Synthetic oligonucleotide
gaaaggctacatgcggatccagcagtttcg

SEQ ID NO: 174123 - DNA, 30 bp, Artificial Sequence
  Description of Artificial Sequence: Synthetic oligonucleotide
aaaggctacatgcggatccagcagtttcgg

SEQ ID NO: 174124 - DNA, 29 bp, Artificial Sequence
  Description of Artificial Sequence: Synthetic oligonucleotide
aaggctacatgcggatccagcagtttcgg

SEQ ID NO: 174125 - DNA, 28 bp, Artificial Sequence
  Description of Artificial Sequence: Synthetic oligonucleotide
aggctacatgcggatccagcagtttcgg

SEQ ID NO: 174126 - DNA, 27 bp, Artificial Sequence
  Description of Artificial Sequence: Synthetic oligonucleotide
ggctacatgcggatccagcagtttcgg

SEQ ID NO: 174127 - DNA, 29 bp, Artificial Sequence
  Description of Artificial Sequence: Synthetic oligonucleotide
gctacatgcggatccagcagtttcggaag

SEQ ID NO: 174128 - DNA, 29 bp, Artificial Sequence
  Description of Artificial Sequence: Synthetic oligonucleotide
ctacatgcggatccagcagtttcggaagg

SEQ ID NO: 174129 - DNA, 29 bp, Artificial Sequence
  Description of Artificial Sequence: Synthetic oligonucleotide
tacatgcggatccagcagtttcggaaggc

SEQ ID NO: 174130 - DNA, 28 bp, Artificial Sequence
  Description of Artificial Sequence: Synthetic oligonucleotide
acatgcggatccagcagtttcggaaggc

SEQ ID NO: 174131 - DNA, 27 bp, Artificial Sequence
  Description of Artificial Sequence: Synthetic oligonucleotide
catgcggatccagcagtttcggaaggc

SEQ ID NO: 174132 - DNA, 27 bp, Artificial Sequence
  Description of Artificial Sequence: Synthetic oligonucleotide
atgcggatccagcagtttcggaaggcg

SEQ ID NO: 174133 - DNA, 26 bp, Artificial Sequence
  Description of Artificial Sequence: Synthetic oligonucleotide
tgcggatccagcagtttcggaaggcg

SEQ ID NO: 174134 - DNA, 25 bp, Artificial Sequence
  Description of Artificial Sequence: Synthetic oligonucleotide
gcggatccagcagtttcggaaggcg

SEQ ID NO: 174135 - DNA, 27 bp, Artificial Sequence
  Description of Artificial Sequence: Synthetic oligonucleotide
cggatccagcagtttcggaaggcggat

SEQ ID NO: 174136 - DNA, 27 bp, Artificial Sequence
  Description of Artificial Sequence: Synthetic oligonucleotide
ggatccagcagtttcggaaggcggatg

SEQ ID NO: 174137 - DNA, 27 bp, Artificial Sequence
  Description of Artificial Sequence: Synthetic oligonucleotide
gatccagcagtttcggaaggcggatgg

SEQ ID NO: 174138 - DNA, 29 bp, Artificial Sequence
  Description of Artificial Sequence: Synthetic oligonucleotide
atccagcagtttcggaaggcggatggttc

SEQ ID NO: 174139 - DNA, 28 bp, Artificial Sequence
  Description of Artificial Sequence: Synthetic oligonucleotide
tccagcagtttcggaaggcggatggttc

SEQ ID NO: 174140 - DNA, 27 bp, Artificial Sequence
  Description of Artificial Sequence: Synthetic oligonucleotide
ccagcagtttcggaaggcggatggttc

SEQ ID NO: 174141 - DNA, 27 bp, Artificial Sequence
  Description of Artificial Sequence: Synthetic oligonucleotide
cagcagtttcggaaggcggatggttcc

SEQ ID NO: 174142 - DNA, 30 bp, Artificial Sequence
  Description of Artificial Sequence: Synthetic oligonucleotide
agcagtttcggaaggcggatggttcctatg

SEQ ID NO: 174143 - DNA, 29 bp, Artificial Sequence
  Description of Artificial Sequence: Synthetic oligonucleotide
gcagtttcggaaggcggatggttcctatg

SEQ ID NO: 174144 - DNA, 29 bp, Artificial Sequence
  Description of Artificial Sequence: Synthetic oligonucleotide
cagtttcggaaggcggatggttcctatgc

SEQ ID NO: 174145 - DNA, 29 bp, Artificial Sequence
  Description of Artificial Sequence: Synthetic oligonucleotide
agtttcggaaggcggatggttcctatgcg

SEQ ID NO: 174146 - DNA, 28 bp, Artificial Sequence
  Description of Artificial Sequence: Synthetic oligonucleotide
gtttcggaaggcggatggttcctatgcg

SEQ ID NO: 174147 - DNA, 28 bp, Artificial Sequence
  Description of Artificial Sequence: Synthetic oligonucleotide
tttcggaaggcggatggttcctatgcgg

SEQ ID NO: 174148 - DNA, 27 bp, Artificial Sequence
  Description of Artificial Sequence: Synthetic oligonucleotide
ttcggaaggcggatggttcctatgcgg

SEQ ID NO: 174149 - DNA, 26 bp, Artificial Sequence
  Description of Artificial Sequence: Synthetic oligonucleotide
tcggaaggcggatggttcctatgcgg

SEQ ID NO: 174150 - DNA, 25 bp, Artificial Sequence
  Description of Artificial Sequence: Synthetic oligonucleotide
cggaaggcggatggttcctatgcgg

SEQ ID NO: 174151 - DNA, 27 bp, Artificial Sequence
  Description of Artificial Sequence: Synthetic oligonucleotide
ggaaggcggatggttcctatgcggctt

SEQ ID NO: 174152 - DNA, 27 bp, Artificial Sequence
  Description of Artificial Sequence: Synthetic oligonucleotide
gaaggcggatggttcctatgcggcttg

SEQ ID NO: 174153 - DNA, 27 bp, Artificial Sequence
  Description of Artificial Sequence: Synthetic oligonucleotide
aaggcggatggttcctatgcggcttgg

SEQ ID NO: 174154 - DNA, 27 bp, Artificial Sequence
  Description of Artificial Sequence: Synthetic oligonucleotide
aggcggatggttcctatgcggcttggt

SEQ ID NO: 174155 - DNA, 27 bp, Artificial Sequence
  Description of Artificial Sequence: Synthetic oligonucleotide
ggcggatggttcctatgcggcttggtt

SEQ ID NO: 174156 - DNA, 27 bp, Artificial Sequence
  Description of Artificial Sequence: Synthetic oligonucleotide
gcggatggttcctatgcggcttggttg

SEQ ID NO: 174157 - DNA, 28 bp, Artificial Sequence
  Description of Artificial Sequence: Synthetic oligonucleotide
cggatggttcctatgcggcttggttgtc

SEQ ID NO: 174158 - DNA, 29 bp, Artificial Sequence
  Description of Artificial Sequence: Synthetic oligonucleotide
ggatggttcctatgcggcttggttgtcac

SEQ ID NO: 174159 - DNA, 29 bp, Artificial Sequence
  Description of Artificial Sequence: Synthetic oligonucleotide
gatggttcctatgcggcttggttgtcacg

SEQ ID NO: 174160 - DNA, 29 bp, Artificial Sequence
  Description of Artificial Sequence: Synthetic oligonucleotide
atggttcctatgcggcttggttgtcacgg

SEQ ID NO: 174161 - DNA, 28 bp, Artificial Sequence
  Description of Artificial Sequence: Synthetic oligonucleotide
tggttcctatgcggcttggttgtcacgg

SEQ ID NO: 174162 - DNA, 27 bp, Artificial Sequence
  Description of Artificial Sequence: Synthetic oligonucleotide
ggttcctatgcggcttggttgtcacgg

SEQ ID NO: 174163 - DNA, 27 bp, Artificial Sequence
  Description of Artificial Sequence: Synthetic oligonucleotide
gttcctatgcggcttggttgtcacggg

SEQ ID NO: 174164 - DNA, 27 bp, Artificial Sequence
  Description of Artificial Sequence: Synthetic oligonucleotide
ttcctatgcggcttggttgtcacgggg

SEQ ID NO: 174165 - DNA, 26 bp, Artificial Sequence
  Description of Artificial Sequence: Synthetic oligonucleotide
tcctatgcggcttggttgtcacgggg

SEQ ID NO: 174166 - DNA, 25 bp, Artificial Sequence
  Description of Artificial Sequence: Synthetic oligonucleotide
cctatgcggcttggttgtcacgggg

SEQ ID NO: 174167 - DNA, 26 bp, Artificial Sequence
  Description of Artificial Sequence: Synthetic oligonucleotide
ctatgcggcttggttgtcacggggca

SEQ ID NO: 174168 - DNA, 26 bp, Artificial Sequence
  Description of Artificial Sequence: Synthetic oligonucleotide
tatgcggcttggttgtcacggggcag

SEQ ID NO: 174169 - DNA, 25 bp, Artificial Sequence
  Description of Artificial Sequence: Synthetic oligonucleotide
atgcggcttggttgtcacggggcag

SEQ ID NO: 174170 - DNA, 24 bp, Artificial Sequence
  Description of Artificial Sequence: Synthetic oligonucleotide
tgcggcttggttgtcacggggcag

SEQ ID NO: 174171 - DNA, 23 bp, Artificial Sequence
  Description of Artificial Sequence: Synthetic oligonucleotide
gcggcttggttgtcacggggcag

SEQ ID NO: 174172 - DNA, 24 bp, Artificial Sequence
  Description of Artificial Sequence: Synthetic oligonucleotide
cggcttggttgtcacggggcagca

SEQ ID NO: 174173 - DNA, 24 bp, Artificial Sequence
  Description of Artificial Sequence: Synthetic oligonucleotide
ggcttggttgtcacggggcagcag

SEQ ID NO: 174174 - DNA, 25 bp, Artificial Sequence
  Description of Artificial Sequence: Synthetic oligonucleotide
gcttggttgtcacggggcagcagca

SEQ ID NO: 174175 - DNA, 25 bp, Artificial Sequence
  Description of Artificial Sequence: Synthetic oligonucleotide
cttggttgtcacggggcagcagcac

SEQ ID NO: 174176 - DNA, 26 bp, Artificial Sequence
  Description of Artificial Sequence: Synthetic oligonucleotide
ttggttgtcacggggcagcagcacct

SEQ ID NO: 174177 - DNA, 25 bp, Artificial Sequence
  Description of Artificial Sequence: Synthetic oligonucleotide
tggttgtcacggggcagcagcacct

SEQ ID NO: 174178 - DNA, 24 bp, Artificial Sequence
  Description of Artificial Sequence: Synthetic oligonucleotide
ggttgtcacggggcagcagcacct

SEQ ID NO: 174179 - DNA, 24 bp, Artificial Sequence
  Description of Artificial Sequence: Synthetic oligonucleotide
gttgtcacggggcagcagcacctg

SEQ ID NO: 174180 - DNA, 24 bp, Artificial Sequence
  Description of Artificial Sequence: Synthetic oligonucleotide
ttgtcacggggcagcagcacctgg

SEQ ID NO: 174181 - DNA, 23 bp, Artificial Sequence
  Description of Artificial Sequence: Synthetic oligonucleotide
tgtcacggggcagcagcacctgg

SEQ ID NO: 174182 - DNA, 22 bp, Artificial Sequence
  Description of Artificial Sequence: Synthetic oligonucleotide
gtcacggggcagcagcacctgg

SEQ ID NO: 174183 - DNA, 23 bp, Artificial Sequence
  Description of Artificial Sequence: Synthetic oligonucleotide
tcacggggcagcagcacctggct

SEQ ID NO: 174184 - DNA, 22 bp, Artificial Sequence
  Description of Artificial Sequence: Synthetic oligonucleotide
cacggggcagcagcacctggct

SEQ ID NO: 174185 - DNA, 23 bp, Artificial Sequence
  Description of Artificial Sequence: Synthetic oligonucleotide
acggggcagcagcacctggctca

SEQ ID NO: 174186 - DNA, 22 bp, Artificial Sequence
  Description of Artificial Sequence: Synthetic oligonucleotide
cggggcagcagcacctggctca

SEQ ID NO: 174187 - DNA, 23 bp, Artificial Sequence
  Description of Artificial Sequence: Synthetic oligonucleotide
ggggcagcagcacctggctcaca

SEQ ID NO: 174188 - DNA, 23 bp, Artificial Sequence
  Description of Artificial Sequence: Synthetic oligonucleotide
gggcagcagcacctggctcacag

SEQ ID NO: 174189 - DNA, 23 bp, Artificial Sequence
  Description of Artificial Sequence: Synthetic oligonucleotide
ggcagcagcacctggctcacagc

SEQ ID NO: 174190 - DNA, 26 bp, Artificial Sequence
  Description of Artificial Sequence: Synthetic oligonucleotide
gcagcagcacctggctcacagccttt

SEQ ID NO: 174191 - DNA, 27 bp, Artificial Sequence
  Description of Artificial Sequence: Synthetic oligonucleotide
cagcagcacctggctcacagcctttgt

SEQ ID NO: 174192 - DNA, 27 bp, Artificial Sequence
  Description of Artificial Sequence: Synthetic oligonucleotide
agcagcacctggctcacagcctttgtg

SEQ ID NO: 174193 - DNA, 27 bp, Artificial Sequence
  Description of Artificial Sequence: Synthetic oligonucleotide
gcagcacctggctcacagcctttgtgt

SEQ ID NO: 174194 - DNA, 28 bp, Artificial Sequence
  Description of Artificial Sequence: Synthetic oligonucleotide
cagcacctggctcacagcctttgtgttg

SEQ ID NO: 174195 - DNA, 30 bp, Artificial Sequence
  Description of Artificial Sequence: Synthetic oligonucleotide
agcacctggctcacagcctttgtgttgaag

SEQ ID NO: 174196 - DNA, 29 bp, Artificial Sequence
  Description of Artificial Sequence: Synthetic oligonucleotide
gcacctggctcacagcctttgtgttgaag

SEQ ID NO: 174197 - DNA, 29 bp, Artificial Sequence
  Description of Artificial Sequence: Synthetic oligonucleotide
cacctggctcacagcctttgtgttgaagg

SEQ ID NO: 174198 - DNA, 30 bp, Artificial Sequence
  Description of Artificial Sequence: Synthetic oligonucleotide
acctggctcacagcctttgtgttgaaggtc

SEQ ID NO: 174199 - DNA, 29 bp, Artificial Sequence
  Description of Artificial Sequence: Synthetic oligonucleotide
cctggctcacagcctttgtgttgaaggtc

SEQ ID NO: 174200 - DNA, 29 bp, Artificial Sequence
  Description of Artificial Sequence: Synthetic oligonucleotide
ctggctcacagcctttgtgttgaaggtcc

SEQ ID NO: 174201 - DNA, 30 bp, Artificial Sequence
  Description of Artificial Sequence: Synthetic oligonucleotide
tggctcacagcctttgtgttgaaggtcctg

SEQ ID NO: 174202 - DNA, 29 bp, Artificial Sequence
  Description of Artificial Sequence: Synthetic oligonucleotide
ggctcacagcctttgtgttgaaggtcctg

SEQ ID NO: 174203 - DNA, 30 bp, Artificial Sequence
  Description of Artificial Sequence: Synthetic oligonucleotide
gctcacagcctttgtgttgaaggtcctgag

SEQ ID NO: 174204 - DNA, 33 bp, Artificial Sequence
  Description of Artificial Sequence: Synthetic oligonucleotide
ctcacagcctttgtgttgaaggtcctgagtttg

SEQ ID NO: 174205 - DNA, 33 bp, Artificial Sequence
  Description of Artificial Sequence: Synthetic oligonucleotide
tcacagcctttgtgttgaaggtcctgagtttgg

SEQ ID NO: 174206 - DNA, 32 bp, Artificial Sequence
  Description of Artificial Sequence: Synthetic oligonucleotide
cacagcctttgtgttgaaggtcctgagtttgg

SEQ ID NO: 174207 - DNA, 32 bp, Artificial Sequence
  Description of Artificial Sequence: Synthetic oligonucleotide
acagcctttgtgttgaaggtcctgagtttggc

SEQ ID NO: 174208 - DNA, 31 bp, Artificial Sequence
  Description of Artificial Sequence: Synthetic oligonucleotide
cagcctttgtgttgaaggtcctgagtttggc

SEQ ID NO: 174209 - DNA, 31 bp, Artificial Sequence
  Description of Artificial Sequence: Synthetic oligonucleotide
agcctttgtgttgaaggtcctgagtttggcc

SEQ ID NO: 174210 - DNA, 30 bp, Artificial Sequence
  Description of Artificial Sequence: Synthetic oligonucleotide
gcctttgtgttgaaggtcctgagtttggcc

SEQ ID NO: 174211 - DNA, 30 bp, Artificial Sequence
  Description of Artificial Sequence: Synthetic oligonucleotide
cctttgtgttgaaggtcctgagtttggccc

SEQ ID NO: 174212 - DNA, 31 bp, Artificial Sequence
  Description of Artificial Sequence: Synthetic oligonucleotide
ctttgtgttgaaggtcctgagtttggcccag

SEQ ID NO: 174213 - DNA, 31 bp, Artificial Sequence
  Description of Artificial Sequence: Synthetic oligonucleotide
tttgtgttgaaggtcctgagtttggcccagg

SEQ ID NO: 174214 - DNA, 30 bp, Artificial Sequence
  Description of Artificial Sequence: Synthetic oligonucleotide
ttgtgttgaaggtcctgagtttggcccagg

SEQ ID NO: 174215 - DNA, 29 bp, Artificial Sequence
  Description of Artificial Sequence: Synthetic oligonucleotide
tgtgttgaaggtcctgagtttggcccagg

SEQ ID NO: 174216 - DNA, 28 bp, Artificial Sequence
  Description of Artificial Sequence: Synthetic oligonucleotide
gtgttgaaggtcctgagtttggcccagg

SEQ ID NO: 174217 - DNA, 29 bp, Artificial Sequence
  Description of Artificial Sequence: Synthetic oligonucleotide
tgttgaaggtcctgagtttggcccaggag

SEQ ID NO: 174218 - DNA, 28 bp, Artificial Sequence
  Description of Artificial Sequence: Synthetic oligonucleotide
gttgaaggtcctgagtttggcccaggag

SEQ ID NO: 174219 - DNA, 28 bp, Artificial Sequence
  Description of Artificial Sequence: Synthetic oligonucleotide
ttgaaggtcctgagtttggcccaggagc

SEQ ID NO: 174220 - DNA, 27 bp, Artificial Sequence
  Description of Artificial Sequence: Synthetic oligonucleotide
tgaaggtcctgagtttggcccaggagc

SEQ ID NO: 174221 - DNA, 27 bp, Artificial Sequence
  Description of Artificial Sequence: Synthetic oligonucleotide
gaaggtcctgagtttggcccaggagca

SEQ ID NO: 174222 - DNA, 27 bp, Artificial Sequence
  Description of Artificial Sequence: Synthetic oligonucleotide
aaggtcctgagtttggcccaggagcag

SEQ ID NO: 174223 - DNA, 26 bp, Artificial Sequence
  Description of Artificial Sequence: Synthetic oligonucleotide
aggtcctgagtttggcccaggagcag

SEQ ID NO: 174224 - DNA, 25 bp, Artificial Sequence
  Description of Artificial Sequence: Synthetic oligonucleotide
ggtcctgagtttggcccaggagcag

SEQ ID NO: 174225 - DNA, 27 bp, Artificial Sequence
  Description of Artificial Sequence: Synthetic oligonucleotide
gtcctgagtttggcccaggagcaggta

SEQ ID NO: 174226 - DNA, 27 bp, Artificial Sequence
  Description of Artificial Sequence: Synthetic oligonucleotide
tcctgagtttggcccaggagcaggtag

SEQ ID NO: 174227 - DNA, 26 bp, Artificial Sequence
  Description of Artificial Sequence: Synthetic oligonucleotide
cctgagtttggcccaggagcaggtag

SEQ ID NO: 174228 - DNA, 26 bp, Artificial Sequence
  Description of Artificial Sequence: Synthetic oligonucleotide
ctgagtttggcccaggagcaggtagg

SEQ ID NO: 174229 - DNA, 26 bp, Artificial Sequence
  Description of Artificial Sequence: Synthetic oligonucleotide
tgagtttggcccaggagcaggtaggc

SEQ ID NO: 174230 - DNA, 25 bp, Artificial Sequence
  Description of Artificial Sequence: Synthetic oligonucleotide
gagtttggcccaggagcaggtaggc

SEQ ID NO: 174231 - DNA, 25 bp, Artificial Sequence
  Description of Artificial Sequence: Synthetic oligonucleotide
agtttggcccaggagcaggtaggcg

SEQ ID NO: 174232 - DNA, 24 bp, Artificial Sequence
  Description of Artificial Sequence: Synthetic oligonucleotide
gtttggcccaggagcaggtaggcg

SEQ ID NO: 174233 - DNA, 24 bp, Artificial Sequence
  Description of Artificial Sequence: Synthetic oligonucleotide
tttggcccaggagcaggtaggcgg

SEQ ID NO: 174234 - DNA, 23 bp, Artificial Sequence
  Description of Artificial Sequence: Synthetic oligonucleotide
ttggcccaggagcaggtaggcgg

SEQ ID NO: 174235 - DNA, 22 bp, Artificial Sequence
  Description of Artificial Sequence: Synthetic oligonucleotide
tggcccaggagcaggtaggcgg

SEQ ID NO: 174236 - DNA, 21 bp, Artificial Sequence
  Description of Artificial Sequence: Synthetic oligonucleotide
ggcccaggagcaggtaggcgg

SEQ ID NO: 174237 - DNA, 22 bp, Artificial Sequence
  Description of Artificial Sequence: Synthetic oligonucleotide
gcccaggagcaggtaggcggct

SEQ ID NO: 174238 - DNA, 22 bp, Artificial Sequence
  Description of Artificial Sequence: Synthetic oligonucleotide
cccaggagcaggtaggcggctc

SEQ ID NO: 174239 - DNA, 22 bp, Artificial Sequence
  Description of Artificial Sequence: Synthetic oligonucleotide
ccaggagcaggtaggcggctcg

SEQ ID NO: 174240 - DNA, 22 bp, Artificial Sequence
  Description of Artificial Sequence: Synthetic oligonucleotide
caggagcaggtaggcggctcgc

SEQ ID NO: 174241 - DNA, 23 bp, Artificial Sequence
  Description of Artificial Sequence: Synthetic oligonucleotide
aggagcaggtaggcggctcgcct

SEQ ID NO: 174242 - DNA, 22 bp, Artificial Sequence
  Description of Artificial Sequence: Synthetic oligonucleotide
ggagcaggtaggcggctcgcct

SEQ ID NO: 174243 - DNA, 23 bp, Artificial Sequence
  Description of Artificial Sequence: Synthetic oligonucleotide
gagcaggtaggcggctcgcctga

SEQ ID NO: 174244 - DNA, 26 bp, Artificial Sequence
  Description of Artificial Sequence: Synthetic oligonucleotide
agcaggtaggcggctcgcctgagaaa

SEQ ID NO: 174245 - DNA, 25 bp, Artificial Sequence
  Description of Artificial Sequence: Synthetic oligonucleotide
gcaggtaggcggctcgcctgagaaa

SEQ ID NO: 174246 - DNA, 26 bp, Artificial Sequence
  Description of Artificial Sequence: Synthetic oligonucleotide
caggtaggcggctcgcctgagaaact

SEQ ID NO: 174247 - DNA, 26 bp, Artificial Sequence
  Description of Artificial Sequence: Synthetic oligonucleotide
aggtaggcggctcgcctgagaaactg

SEQ ID NO: 174248 - DNA, 25 bp, Artificial Sequence
  Description of Artificial Sequence: Synthetic oligonucleotide
ggtaggcggctcgcctgagaaactg

SEQ ID NO: 174249 - DNA, 26 bp, Artificial Sequence
  Description of Artificial Sequence: Synthetic oligonucleotide
gtaggcggctcgcctgagaaactgca

SEQ ID NO: 174250 - DNA, 26 bp, Artificial Sequence
  Description of Artificial Sequence: Synthetic oligonucleotide
taggcggctcgcctgagaaactgcag

SEQ ID NO: 174251 - DNA, 25 bp, Artificial Sequence
  Description of Artificial Sequence: Synthetic oligonucleotide
aggcggctcgcctgagaaactgcag

SEQ ID NO: 174252 - DNA, 24 bp, Artificial Sequence
  Description of Artificial Sequence: Synthetic oligonucleotide
ggcggctcgcctgagaaactgcag

SEQ ID NO: 174253 - DNA, 25 bp, Artificial Sequence
  Description of Artificial Sequence: Synthetic oligonucleotide
gcggctcgcctgagaaactgcagga

SEQ ID NO: 174254 - DNA, 26 bp, Artificial Sequence
  Description of Artificial Sequence: Synthetic oligonucleotide
cggctcgcctgagaaactgcaggaga

SEQ ID NO: 174255 - DNA, 27 bp, Artificial Sequence
  Description of Artificial Sequence: Synthetic oligonucleotide
ggctcgcctgagaaactgcaggagaca

SEQ ID NO: 174256 - DNA, 28 bp, Artificial Sequence
  Description of Artificial Sequence: Synthetic oligonucleotide
gctcgcctgagaaactgcaggagacatc

SEQ ID NO: 174257 - DNA, 31 bp, Artificial Sequence
  Description of Artificial Sequence: Synthetic oligonucleotide
ctcgcctgagaaactgcaggagacatctaac

SEQ ID NO: 174258 - DNA, 32 bp, Artificial Sequence
  Description of Artificial Sequence: Synthetic oligonucleotide
tcgcctgagaaactgcaggagacatctaactg

SEQ ID NO: 174259 - DNA, 31 bp, Artificial Sequence
  Description of Artificial Sequence: Synthetic oligonucleotide
cgcctgagaaactgcaggagacatctaactg

SEQ ID NO: 174260 - DNA, 31 bp, Artificial Sequence
  Description of Artificial Sequence: Synthetic oligonucleotide
gcctgagaaactgcaggagacatctaactgg

SEQ ID NO: 174261 - DNA, 31 bp, Artificial Sequence
  Description of Artificial Sequence: Synthetic oligonucleotide
cctgagaaactgcaggagacatctaactggc

SEQ ID NO: 174262 - DNA, 33 bp, Artificial Sequence
  Description of Artificial Sequence: Synthetic oligonucleotide
ctgagaaactgcaggagacatctaactggcttc

SEQ ID NO: 174263 - DNA, 34 bp, Artificial Sequence
  Description of Artificial Sequence: Synthetic oligonucleotide
tgagaaactgcaggagacatctaactggcttctg

SEQ ID NO: 174264 - DNA, 33 bp, Artificial Sequence
  Description of Artificial Sequence: Synthetic oligonucleotide
gagaaactgcaggagacatctaactggcttctg

SEQ ID NO: 174265 - DNA, 34 bp, Artificial Sequence
  Description of Artificial Sequence: Synthetic oligonucleotide
agaaactgcaggagacatctaactggcttctgtc

SEQ ID NO: 174266 - DNA, 33 bp, Artificial Sequence
  Description of Artificial Sequence: Synthetic oligonucleotide
gaaactgcaggagacatctaactggcttctgtc

SEQ ID NO: 174267 - DNA, 33 bp, Artificial Sequence
  Description of Artificial Sequence: Synthetic oligonucleotide
aaactgcaggagacatctaactggcttctgtcc

SEQ ID NO: 174268 - DNA, 32 bp, Artificial Sequence
  Description of Artificial Sequence: Synthetic oligonucleotide
aactgcaggagacatctaactggcttctgtcc

SEQ ID NO: 174269 - DNA, 31 bp, Artificial Sequence
  Description of Artificial Sequence: Synthetic oligonucleotide
actgcaggagacatctaactggcttctgtcc

SEQ ID NO: 174270 - DNA, 30 bp, Artificial Sequence
  Description of Artificial Sequence: Synthetic oligonucleotide
ctgcaggagacatctaactggcttctgtcc

SEQ ID NO: 174271 - DNA, 30 bp, Artificial Sequence
  Description of Artificial Sequence: Synthetic oligonucleotide
tgcaggagacatctaactggcttctgtccc

SEQ ID NO: 174272 - DNA, 29 bp, Artificial Sequence
  Description of Artificial Sequence: Synthetic oligonucleotide
gcaggagacatctaactggcttctgtccc

SEQ ID NO: 174273 - DNA, 30 bp, Artificial Sequence
  Description of Artificial Sequence: Synthetic oligonucleotide
caggagacatctaactggcttctgtcccag

SEQ ID NO: 174274 - DNA, 30 bp, Artificial Sequence
  Description of Artificial Sequence: Synthetic oligonucleotide
aggagacatctaactggcttctgtcccagc

SEQ ID NO: 174275 - DNA, 29 bp, Artificial Sequence
  Description of Artificial Sequence: Synthetic oligonucleotide
ggagacatctaactggcttctgtcccagc

SEQ ID NO: 174276 - DNA, 30 bp, Artificial Sequence
  Description of Artificial Sequence: Synthetic oligonucleotide
gagacatctaactggcttctgtcccagcag

SEQ ID NO: 174277 - DNA, 30 bp, Artificial Sequence
  Description of Artificial Sequence: Synthetic oligonucleotide
agacatctaactggcttctgtcccagcagc

SEQ ID NO: 174278 - DNA, 29 bp, Artificial Sequence
  Description of Artificial Sequence: Synthetic oligonucleotide
gacatctaactggcttctgtcccagcagc

SEQ ID NO: 174279 - DNA, 30 bp, Artificial Sequence
  Description of Artificial Sequence: Synthetic oligonucleotide
acatctaactggcttctgtcccagcagcag

SEQ ID NO: 174280 - DNA, 29 bp, Artificial Sequence
  Description of Artificial Sequence: Synthetic oligonucleotide
catctaactggcttctgtcccagcagcag

SEQ ID NO: 174281 - DNA, 29 bp, Artificial Sequence
  Description of Artificial Sequence: Synthetic oligonucleotide
atctaactggcttctgtcccagcagcagg

SEQ ID NO: 174282 - DNA, 28 bp, Artificial Sequence
  Description of Artificial Sequence: Synthetic oligonucleotide
tctaactggcttctgtcccagcagcagg

SEQ ID NO: 174283 - DNA, 27 bp, Artificial Sequence
  Description of Artificial Sequence: Synthetic oligonucleotide
ctaactggcttctgtcccagcagcagg

SEQ ID NO: 174284 - DNA, 27 bp, Artificial Sequence
  Description of Artificial Sequence: Synthetic oligonucleotide
taactggcttctgtcccagcagcaggc

SEQ ID NO: 174285 - DNA, 27 bp, Artificial Sequence
  Description of Artificial Sequence: Synthetic oligonucleotide
aactggcttctgtcccagcagcaggct

SEQ ID NO: 174286 - DNA, 26 bp, Artificial Sequence
  Description of Artificial Sequence: Synthetic oligonucleotide
actggcttctgtcccagcagcaggct

SEQ ID NO: 174287 - DNA, 25 bp, Artificial Sequence
  Description of Artificial Sequence: Synthetic oligonucleotide
ctggcttctgtcccagcagcaggct

SEQ ID NO: 174288 - DNA, 26 bp, Artificial Sequence
  Description of Artificial Sequence: Synthetic oligonucleotide
tggcttctgtcccagcagcaggctga

SEQ ID NO: 174289 - DNA, 25 bp, Artificial Sequence
  Description of Artificial Sequence: Synthetic oligonucleotide
ggcttctgtcccagcagcaggctga

SEQ ID NO: 174290 - DNA, 25 bp, Artificial Sequence
  Description of Artificial Sequence: Synthetic oligonucleotide
gcttctgtcccagcagcaggctgac

SEQ ID NO: 174291 - DNA, 25 bp, Artificial Sequence
  Description of Artificial Sequence: Synthetic oligonucleotide
cttctgtcccagcagcaggctgacg

SEQ ID NO: 174292 - DNA, 25 bp, Artificial Sequence
  Description of Artificial Sequence: Synthetic oligonucleotide
ttctgtcccagcagcaggctgacgg

SEQ ID NO: 174293 - DNA, 24 bp, Artificial Sequence
  Description of Artificial Sequence: Synthetic oligonucleotide
tctgtcccagcagcaggctgacgg

SEQ ID NO: 174294 - DNA, 23 bp, Artificial Sequence
  Description of Artificial Sequence: Synthetic oligonucleotide
ctgtcccagcagcaggctgacgg

SEQ ID NO: 174295 - DNA, 24 bp, Artificial Sequence
  Description of Artificial Sequence: Synthetic oligonucleotide
tgtcccagcagcaggctgacggct

SEQ ID NO: 174296 - DNA, 23 bp, Artificial Sequence
  Description of Artificial Sequence: Synthetic oligonucleotide
gtcccagcagcaggctgacggct

SEQ ID NO: 174297 - DNA, 23 bp, Artificial Sequence
  Description of Artificial Sequence: Synthetic oligonucleotide
tcccagcagcaggctgacggctc

SEQ ID NO: 174298 - DNA, 22 bp, Artificial Sequence
  Description of Artificial Sequence: Synthetic oligonucleotide
cccagcagcaggctgacggctc

SEQ ID NO: 174299 - DNA, 24 bp, Artificial Sequence
  Description of Artificial Sequence: Synthetic oligonucleotide
ccagcagcaggctgacggctcgtt

SEQ ID NO: 174300 - DNA, 24 bp, Artificial Sequence
  Description of Artificial Sequence: Synthetic oligonucleotide
cagcagcaggctgacggctcgttc

SEQ ID NO: 174301 - DNA, 25 bp, Artificial Sequence
  Description of Artificial Sequence: Synthetic oligonucleotide
agcagcaggctgacggctcgttcca

SEQ ID NO: 174302 - DNA, 24 bp, Artificial Sequence
  Description of Artificial Sequence: Synthetic oligonucleotide
gcagcaggctgacggctcgttcca

SEQ ID NO: 174303 - DNA, 24 bp, Artificial Sequence
  Description of Artificial Sequence: Synthetic oligonucleotide
cagcaggctgacggctcgttccag

SEQ ID NO: 174304 - DNA, 25 bp, Artificial Sequence
  Description of Artificial Sequence: Synthetic oligonucleotide
agcaggctgacggctcgttccagga

SEQ ID NO: 174305 - DNA, 24 bp, Artificial Sequence
  Description of Artificial Sequence: Synthetic oligonucleotide
gcaggctgacggctcgttccagga

SEQ ID NO: 174306 - DNA, 24 bp, Artificial Sequence
  Description of Artificial Sequence: Synthetic oligonucleotide
caggctgacggctcgttccaggac

SEQ ID NO: 174307 - DNA, 25 bp, Artificial Sequence
  Description of Artificial Sequence: Synthetic oligonucleotide
aggctgacggctcgttccaggacca

SEQ ID NO: 174308 - DNA, 24 bp, Artificial Sequence
  Description of Artificial Sequence: Synthetic oligonucleotide
ggctgacggctcgttccaggacca

SEQ ID NO: 174309 - DNA, 24 bp, Artificial Sequence
  Description of Artificial Sequence: Synthetic oligonucleotide
gctgacggctcgttccaggaccag

SEQ ID NO: 174310 - DNA, 25 bp, Artificial Sequence
  Description of Artificial Sequence: Synthetic oligonucleotide
ctgacggctcgttccaggaccagga

SEQ ID NO: 174311 - DNA, 25 bp, Artificial Sequence
  Description of Artificial Sequence: Synthetic oligonucleotide
tgacggctcgttccaggaccaggag

SEQ ID NO: 174312 - DNA, 24 bp, Artificial Sequence
  Description of Artificial Sequence: Synthetic oligonucleotide
gacggctcgttccaggaccaggag

SEQ ID NO: 174313 - DNA, 26 bp, Artificial Sequence
  Description of Artificial Sequence: Synthetic oligonucleotide
acggctcgttccaggaccaggagcat

SEQ ID NO: 174314 - DNA, 25 bp, Artificial Sequence
  Description of Artificial Sequence: Synthetic oligonucleotide
cggctcgttccaggaccaggagcat

SEQ ID NO: 174315 - DNA, 25 bp, Artificial Sequence
  Description of Artificial Sequence: Synthetic oligonucleotide
ggctcgttccaggaccaggagcatg

SEQ ID NO: 174316 - DNA, 26 bp, Artificial Sequence
  Description of Artificial Sequence: Synthetic oligonucleotide
gctcgttccaggaccaggagcatgca

SEQ ID NO: 174317 - DNA, 26 bp, Artificial Sequence
  Description of Artificial Sequence: Synthetic oligonucleotide
ctcgttccaggaccaggagcatgcag

SEQ ID NO: 174318 - DNA, 26 bp, Artificial Sequence
  Description of Artificial Sequence: Synthetic oligonucleotide
tcgttccaggaccaggagcatgcagg

SEQ ID NO: 174319 - DNA, 25 bp, Artificial Sequence
  Description of Artificial Sequence: Synthetic oligonucleotide
cgttccaggaccaggagcatgcagg

SEQ ID NO: 174320 - DNA, 25 bp, Artificial Sequence
  Description of Artificial Sequence: Synthetic oligonucleotide
gttccaggaccaggagcatgcaggg

SEQ ID NO: 174321 - DNA, 25 bp, Artificial Sequence
  Description of Artificial Sequence: Synthetic oligonucleotide
ttccaggaccaggagcatgcagggg

SEQ ID NO: 174322 - DNA, 24 bp, Artificial Sequence
  Description of Artificial Sequence: Synthetic oligonucleotide
tccaggaccaggagcatgcagggg

SEQ ID NO: 174323 - DNA, 23 bp, Artificial Sequence
  Description of Artificial Sequence: Synthetic oligonucleotide
ccaggaccaggagcatgcagggg

SEQ ID NO: 174324 - DNA, 23 bp, Artificial Sequence
  Description of Artificial Sequence: Synthetic oligonucleotide
caggaccaggagcatgcaggggg

SEQ ID NO: 174325 - DNA, 26 bp, Artificial Sequence
  Description of Artificial Sequence: Synthetic oligonucleotide
aggaccaggagcatgcaggggggttt

SEQ ID NO: 174326 - DNA, 25 bp, Artificial Sequence
  Description of Artificial Sequence: Synthetic oligonucleotide
ggaccaggagcatgcaggggggttt

SEQ ID NO: 174327 - DNA, 25 bp, Artificial Sequence
  Description of Artificial Sequence: Synthetic oligonucleotide
gaccaggagcatgcaggggggtttg

SEQ ID NO: 174328 - DNA, 26 bp, Artificial Sequence
  Description of Artificial Sequence: Synthetic oligonucleotide
accaggagcatgcaggggggtttggt

SEQ ID NO: 174329 - DNA, 25 bp, Artificial Sequence
  Description of Artificial Sequence: Synthetic oligonucleotide
ccaggagcatgcaggggggtttggt

SEQ ID NO: 174330 - DNA, 25 bp, Artificial Sequence
  Description of Artificial Sequence: Synthetic oligonucleotide
caggagcatgcaggggggtttggtg

SEQ ID NO: 174331 - DNA, 25 bp, Artificial Sequence
  Description of Artificial Sequence: Synthetic oligonucleotide
aggagcatgcaggggggtttggtgg

SEQ ID NO: 174332 - DNA, 24 bp, Artificial Sequence
  Description of Artificial Sequence: Synthetic oligonucleotide
ggagcatgcaggggggtttggtgg

SEQ ID NO: 174333 - DNA, 24 bp, Artificial Sequence
  Description of Artificial Sequence: Synthetic oligonucleotide
gagcatgcaggggggtttggtggg

SEQ ID NO: 174334 - DNA, 27 bp, Artificial Sequence
  Description of Artificial Sequence: Synthetic oligonucleotide
agcatgcaggggggtttggtgggcaat

SEQ ID NO: 174335 - DNA, 26 bp, Artificial Sequence
  Description of Artificial Sequence: Synthetic oligonucleotide
gcatgcaggggggtttggtgggcaat

SEQ ID NO: 174336 - DNA, 27 bp, Artificial Sequence
  Description of Artificial Sequence: Synthetic oligonucleotide
catgcaggggggtttggtgggcaatga

SEQ ID NO: 174337 - DNA, 28 bp, Artificial Sequence
  Description of Artificial Sequence: Synthetic oligonucleotide
atgcaggggggtttggtgggcaatgatg

SEQ ID NO: 174338 - DNA, 27 bp, Artificial Sequence
  Description of Artificial Sequence: Synthetic oligonucleotide
tgcaggggggtttggtgggcaatgatg

SEQ ID NO: 174339 - DNA, 27 bp, Artificial Sequence
  Description of Artificial Sequence: Synthetic oligonucleotide
gcaggggggtttggtgggcaatgatga

SEQ ID NO: 174340 - DNA, 27 bp, Artificial Sequence
  Description of Artificial Sequence: Synthetic oligonucleotide
caggggggtttggtgggcaatgatgag

SEQ ID NO: 174341 - DNA, 28 bp, Artificial Sequence
  Description of Artificial Sequence: Synthetic oligonucleotide
aggggggtttggtgggcaatgatgagac

SEQ ID NO: 174342 - DNA, 27 bp, Artificial Sequence
  Description of Artificial Sequence: Synthetic oligonucleotide
ggggggtttggtgggcaatgatgagac

SEQ ID NO: 174343 - DNA, 28 bp, Artificial Sequence
  Description of Artificial Sequence: Synthetic oligonucleotide
gggggtttggtgggcaatgatgagactg

SEQ ID NO: 174344 - DNA, 29 bp, Artificial Sequence
  Description of Artificial Sequence: Synthetic oligonucleotide
ggggtttggtgggcaatgatgagactgtg

SEQ ID NO: 174345 - DNA, 29 bp, Artificial Sequence
  Description of Artificial Sequence: Synthetic oligonucleotide
gggtttggtgggcaatgatgagactgtgg

SEQ ID NO: 174346 - DNA, 29 bp, Artificial Sequence
  Description of Artificial Sequence: Synthetic oligonucleotide
ggtttggtgggcaatgatgagactgtggc

SEQ ID NO: 174347 - DNA, 30 bp, Artificial Sequence
  Description of Artificial Sequence: Synthetic oligonucleotide
gtttggtgggcaatgatgagactgtggcac

SEQ ID NO: 174348 - DNA, 31 bp, Artificial Sequence
  Description of Artificial Sequence: Synthetic oligonucleotide
tttggtgggcaatgatgagactgtggcactc

SEQ ID NO: 174349 - DNA, 30 bp, Artificial Sequence
  Description of Artificial Sequence: Synthetic oligonucleotide
ttggtgggcaatgatgagactgtggcactc

SEQ ID NO: 174350 - DNA, 29 bp, Artificial Sequence
  Description of Artificial Sequence: Synthetic oligonucleotide
tggtgggcaatgatgagactgtggcactc

SEQ ID NO: 174351 - DNA, 28 bp, Artificial Sequence
  Description of Artificial Sequence: Synthetic oligonucleotide
ggtgggcaatgatgagactgtggcactc

SEQ ID NO: 174352 - DNA, 29 bp, Artificial Sequence
  Description of Artificial Sequence: Synthetic oligonucleotide
gtgggcaatgatgagactgtggcactcac

SEQ ID NO: 174353 - DNA, 30 bp, Artificial Sequence
  Description of Artificial Sequence: Synthetic oligonucleotide
tgggcaatgatgagactgtggcactcacag

SEQ ID NO: 174354 - DNA, 29 bp, Artificial Sequence
  Description of Artificial Sequence: Synthetic oligonucleotide
gggcaatgatgagactgtggcactcacag

SEQ ID NO: 174355 - DNA, 29 bp, Artificial Sequence
  Description of Artificial Sequence: Synthetic oligonucleotide
ggcaatgatgagactgtggcactcacagc

SEQ ID NO: 174356 - DNA, 29 bp, Artificial Sequence
  Description of Artificial Sequence: Synthetic oligonucleotide
gcaatgatgagactgtggcactcacagcc

SEQ ID NO: 174357 - DNA, 32 bp, Artificial Sequence
  Description of Artificial Sequence: Synthetic oligonucleotide
caatgatgagactgtggcactcacagcctttg

SEQ ID NO: 174358 - DNA, 33 bp, Artificial Sequence
  Description of Artificial Sequence: Synthetic oligonucleotide
aatgatgagactgtggcactcacagcctttgtg

SEQ ID NO: 174359 - DNA, 32 bp, Artificial Sequence
  Description of Artificial Sequence: Synthetic oligonucleotide
atgatgagactgtggcactcacagcctttgtg

SEQ ID NO: 174360 - DNA, 31 bp, Artificial Sequence
  Description of Artificial Sequence: Synthetic oligonucleotide
tgatgagactgtggcactcacagcctttgtg

SEQ ID NO: 174361 - DNA, 30 bp, Artificial Sequence
  Description of Artificial Sequence: Synthetic oligonucleotide
gatgagactgtggcactcacagcctttgtg

SEQ ID NO: 174362 - DNA, 31 bp, Artificial Sequence
  Description of Artificial Sequence: Synthetic oligonucleotide
atgagactgtggcactcacagcctttgtgac

SEQ ID NO: 174363 - DNA, 30 bp, Artificial Sequence
  Description of Artificial Sequence: Synthetic oligonucleotide
tgagactgtggcactcacagcctttgtgac

SEQ ID NO: 174364 - DNA, 29 bp, Artificial Sequence
  Description of Artificial Sequence: Synthetic oligonucleotide
gagactgtggcactcacagcctttgtgac

SEQ ID NO: 174365 - DNA, 29 bp, Artificial Sequence
  Description of Artificial Sequence: Synthetic oligonucleotide
agactgtggcactcacagcctttgtgacc

SEQ ID NO: 174366 - DNA, 28 bp, Artificial Sequence
  Description of Artificial Sequence: Synthetic oligonucleotide
gactgtggcactcacagcctttgtgacc

SEQ ID NO: 174367 - DNA, 30 bp, Artificial Sequence
  Description of Artificial Sequence: Synthetic oligonucleotide
actgtggcactcacagcctttgtgaccatc

SEQ ID NO: 174368 - DNA, 29 bp, Artificial Sequence
  Description of Artificial Sequence: Synthetic oligonucleotide
ctgtggcactcacagcctttgtgaccatc

SEQ ID NO: 174369 - DNA, 29 bp, Artificial Sequence
  Description of Artificial Sequence: Synthetic oligonucleotide
tgtggcactcacagcctttgtgaccatcg

SEQ ID NO: 174370 - DNA, 28 bp, Artificial Sequence
  Description of Artificial Sequence: Synthetic oligonucleotide
gtggcactcacagcctttgtgaccatcg

SEQ ID NO: 174371 - DNA, 28 bp, Artificial Sequence
  Description of Artificial Sequence: Synthetic oligonucleotide
tggcactcacagcctttgtgaccatcgc

SEQ ID NO: 174372 - DNA, 27 bp, Artificial Sequence
  Description of Artificial Sequence: Synthetic oligonucleotide
ggcactcacagcctttgtgaccatcgc

SEQ ID NO: 174373 - DNA, 27 bp, Artificial Sequence
  Description of Artificial Sequence: Synthetic oligonucleotide
gcactcacagcctttgtgaccatcgcc

SEQ ID NO: 174374 - DNA, 27 bp, Artificial Sequence
  Description of Artificial Sequence: Synthetic oligonucleotide
cactcacagcctttgtgaccatcgccc

SEQ ID NO: 174375 - DNA, 29 bp, Artificial Sequence
  Description of Artificial Sequence: Synthetic oligonucleotide
actcacagcctttgtgaccatcgcccttc

SEQ ID NO: 174376 - DNA, 28 bp, Artificial Sequence
  Description of Artificial Sequence: Synthetic oligonucleotide
ctcacagcctttgtgaccatcgcccttc

SEQ ID NO: 174377 - DNA, 30 bp, Artificial Sequence
  Description of Artificial Sequence: Synthetic oligonucleotide
tcacagcctttgtgaccatcgcccttcatc

SEQ ID NO: 174378 - DNA, 29 bp, Artificial Sequence
  Description of Artificial Sequence: Synthetic oligonucleotide
cacagcctttgtgaccatcgcccttcatc

SEQ ID NO: 174379 - DNA, 31 bp, Artificial Sequence
  Description of Artificial Sequence: Synthetic oligonucleotide
acagcctttgtgaccatcgcccttcatcatg

SEQ ID NO: 174380 - DNA, 30 bp, Artificial Sequence
  Description of Artificial Sequence: Synthetic oligonucleotide
cagcctttgtgaccatcgcccttcatcatg

SEQ ID NO: 174381 - DNA, 30 bp, Artificial Sequence
  Description of Artificial Sequence: Synthetic oligonucleotide
agcctttgtgaccatcgcccttcatcatgg

SEQ ID NO: 174382 - DNA, 29 bp, Artificial Sequence
  Description of Artificial Sequence: Synthetic oligonucleotide
gcctttgtgaccatcgcccttcatcatgg

SEQ ID NO: 174383 - DNA, 29 bp, Artificial Sequence
  Description of Artificial Sequence: Synthetic oligonucleotide
cctttgtgaccatcgcccttcatcatggg

SEQ ID NO: 174384 - DNA, 29 bp, Artificial Sequence
  Description of Artificial Sequence: Synthetic oligonucleotide
ctttgtgaccatcgcccttcatcatgggc

SEQ ID NO: 174385 - DNA, 30 bp, Artificial Sequence
  Description of Artificial Sequence: Synthetic oligonucleotide
tttgtgaccatcgcccttcatcatgggctg

SEQ ID NO: 174386 - DNA, 29 bp, Artificial Sequence
  Description of Artificial Sequence: Synthetic oligonucleotide
ttgtgaccatcgcccttcatcatgggctg

SEQ ID NO: 174387 - DNA, 28 bp, Artificial Sequence
  Description of Artificial Sequence: Synthetic oligonucleotide
tgtgaccatcgcccttcatcatgggctg

SEQ ID NO: 174388 - DNA, 27 bp, Artificial Sequence
  Description of Artificial Sequence: Synthetic oligonucleotide
gtgaccatcgcccttcatcatgggctg

SEQ ID NO: 174389 - DNA, 27 bp, Artificial Sequence
  Description of Artificial Sequence: Synthetic oligonucleotide
tgaccatcgcccttcatcatgggctgg

SEQ ID NO: 174390 - DNA, 26 bp, Artificial Sequence
  Description of Artificial Sequence: Synthetic oligonucleotide
gaccatcgcccttcatcatgggctgg

SEQ ID NO: 174391 - DNA, 26 bp, Artificial Sequence
  Description of Artificial Sequence: Synthetic oligonucleotide
accatcgcccttcatcatgggctggc

SEQ ID NO: 174392 - DNA, 25 bp, Artificial Sequence
  Description of Artificial Sequence: Synthetic oligonucleotide
ccatcgcccttcatcatgggctggc

SEQ ID NO: 174393 - DNA, 25 bp, Artificial Sequence
  Description of Artificial Sequence: Synthetic oligonucleotide
catcgcccttcatcatgggctggcc

SEQ ID NO: 174394 - DNA, 26 bp, Artificial Sequence
  Description of Artificial Sequence: Synthetic oligonucleotide
atcgcccttcatcatgggctggccgt

SEQ ID NO: 174395 - DNA, 25 bp, Artificial Sequence
  Description of Artificial Sequence: Synthetic oligonucleotide
tcgcccttcatcatgggctggccgt

SEQ ID NO: 174396 - DNA, 24 bp, Artificial Sequence
  Description of Artificial Sequence: Synthetic oligonucleotide
cgcccttcatcatgggctggccgt

SEQ ID NO: 174397 - DNA, 26 bp, Artificial Sequence
  Description of Artificial Sequence: Synthetic oligonucleotide
gcccttcatcatgggctggccgtctt

SEQ ID NO: 174398 - DNA, 26 bp, Artificial Sequence
  Description of Artificial Sequence: Synthetic oligonucleotide
cccttcatcatgggctggccgtcttc

SEQ ID NO: 174399 - DNA, 27 bp, Artificial Sequence
  Description of Artificial Sequence: Synthetic oligonucleotide
ccttcatcatgggctggccgtcttcca

SEQ ID NO: 174400 - DNA, 27 bp, Artificial Sequence
  Description of Artificial Sequence: Synthetic oligonucleotide
cttcatcatgggctggccgtcttccag

SEQ ID NO: 174401 - DNA, 27 bp, Artificial Sequence
  Description of Artificial Sequence: Synthetic oligonucleotide
ttcatcatgggctggccgtcttccagg

SEQ ID NO: 174402 - DNA, 27 bp, Artificial Sequence
  Description of Artificial Sequence: Synthetic oligonucleotide
tcatcatgggctggccgtcttccagga

SEQ ID NO: 174403 - DNA, 27 bp, Artificial Sequence
  Description of Artificial Sequence: Synthetic oligonucleotide
catcatgggctggccgtcttccaggat

SEQ ID NO: 174404 - DNA, 27 bp, Artificial Sequence
  Description of Artificial Sequence: Synthetic oligonucleotide
atcatgggctggccgtcttccaggatg

SEQ ID NO: 174405 - DNA, 27 bp, Artificial Sequence
  Description of Artificial Sequence: Synthetic oligonucleotide
tcatgggctggccgtcttccaggatga

SEQ ID NO: 174406 - DNA, 26 bp, Artificial Sequence
  Description of Artificial Sequence: Synthetic oligonucleotide
catgggctggccgtcttccaggatga

SEQ ID NO: 174407 - DNA, 26 bp, Artificial Sequence
  Description of Artificial Sequence: Synthetic oligonucleotide
atgggctggccgtcttccaggatgag

SEQ ID NO: 174408 - DNA, 25 bp, Artificial Sequence
  Description of Artificial Sequence: Synthetic oligonucleotide
tgggctggccgtcttccaggatgag

SEQ ID NO: 174409 - DNA, 24 bp, Artificial Sequence
  Description of Artificial Sequence: Synthetic oligonucleotide
gggctggccgtcttccaggatgag

SEQ ID NO: 174410 - DNA, 24 bp, Artificial Sequence
  Description of Artificial Sequence: Synthetic oligonucleotide
ggctggccgtcttccaggatgagg

SEQ ID NO: 174411 - DNA, 25 bp, Artificial Sequence
  Description of Artificial Sequence: Synthetic oligonucleotide
gctggccgtcttccaggatgagggt

SEQ ID NO: 174412 - DNA, 25 bp, Artificial Sequence
  Description of Artificial Sequence: Synthetic oligonucleotide
ctggccgtcttccaggatgagggtg

SEQ ID NO: 174413 - DNA, 26 bp, Artificial Sequence
  Description of Artificial Sequence: Synthetic oligonucleotide
tggccgtcttccaggatgagggtgca

SEQ ID NO: 174414 - DNA, 25 bp, Artificial Sequence
  Description of Artificial Sequence: Synthetic oligonucleotide
ggccgtcttccaggatgagggtgca

SEQ ID NO: 174415 - DNA, 26 bp, Artificial Sequence
  Description of Artificial Sequence: Synthetic oligonucleotide
gccgtcttccaggatgagggtgcaga

SEQ ID NO: 174416 - DNA, 26 bp, Artificial Sequence
  Description of Artificial Sequence: Synthetic oligonucleotide
ccgtcttccaggatgagggtgcagag

SEQ ID NO: 174417 - DNA, 26 bp, Artificial Sequence
  Description of Artificial Sequence: Synthetic oligonucleotide
cgtcttccaggatgagggtgcagagc

SEQ ID NO: 174418 - DNA, 27 bp, Artificial Sequence
  Description of Artificial Sequence: Synthetic oligonucleotide
gtcttccaggatgagggtgcagagcca

SEQ ID NO: 174419 - DNA, 29 bp, Artificial Sequence
  Description of Artificial Sequence: Synthetic oligonucleotide
tcttccaggatgagggtgcagagccattg

SEQ ID NO: 174420 - DNA, 28 bp, Artificial Sequence
  Description of Artificial Sequence: Synthetic oligonucleotide
cttccaggatgagggtgcagagccattg

SEQ ID NO: 174421 - DNA, 30 bp, Artificial Sequence
  Description of Artificial Sequence: Synthetic oligonucleotide
ttccaggatgagggtgcagagccattgaag

SEQ ID NO: 174422 - DNA, 29 bp, Artificial Sequence
  Description of Artificial Sequence: Synthetic oligonucleotide
tccaggatgagggtgcagagccattgaag

SEQ ID NO: 174423 - DNA, 28 bp, Artificial Sequence
  Description of Artificial Sequence: Synthetic oligonucleotide
ccaggatgagggtgcagagccattgaag

SEQ ID NO: 174424 - DNA, 28 bp, Artificial Sequence
  Description of Artificial Sequence: Synthetic oligonucleotide
caggatgagggtgcagagccattgaagc

SEQ ID NO: 174425 - DNA, 29 bp, Artificial Sequence
  Description of Artificial Sequence: Synthetic oligonucleotide
aggatgagggtgcagagccattgaagcag

SEQ ID NO: 174426 - DNA, 28 bp, Artificial Sequence
  Description of Artificial Sequence: Synthetic oligonucleotide
ggatgagggtgcagagccattgaagcag

SEQ ID NO: 174427 - DNA, 29 bp, Artificial Sequence
  Description of Artificial Sequence: Synthetic oligonucleotide
gatgagggtgcagagccattgaagcagag

SEQ ID NO: 174428 - DNA, 30 bp, Artificial Sequence
  Description of Artificial Sequence: Synthetic oligonucleotide
atgagggtgcagagccattgaagcagagag

SEQ ID NO: 174429 - DNA, 29 bp, Artificial Sequence
  Description of Artificial Sequence: Synthetic oligonucleotide
tgagggtgcagagccattgaagcagagag

SEQ ID NO: 174430 - DNA, 28 bp, Artificial Sequence
  Description of Artificial Sequence: Synthetic oligonucleotide
gagggtgcagagccattgaagcagagag

SEQ ID NO: 174431 - DNA, 29 bp, Artificial Sequence
  Description of Artificial Sequence: Synthetic oligonucleotide
agggtgcagagccattgaagcagagagtg

SEQ ID NO: 174432 - DNA, 28 bp, Artificial Sequence
  Description of Artificial Sequence: Synthetic oligonucleotide
gggtgcagagccattgaagcagagagtg

SEQ ID NO: 174433 - DNA, 28 bp, Artificial Sequence
  Description of Artificial Sequence: Synthetic oligonucleotide
ggtgcagagccattgaagcagagagtgg

SEQ ID NO: 174434 - DNA, 30 bp, Artificial Sequence
  Description of Artificial Sequence: Synthetic oligonucleotide
gtgcagagccattgaagcagagagtggaag

SEQ ID NO: 174435 - DNA, 30 bp, Artificial Sequence
  Description of Artificial Sequence: Synthetic oligonucleotide
tgcagagccattgaagcagagagtggaagc

SEQ ID NO: 174436 - DNA, 29 bp, Artificial Sequence
  Description of Artificial Sequence: Synthetic oligonucleotide
gcagagccattgaagcagagagtggaagc

SEQ ID NO: 174437 - DNA, 29 bp, Artificial Sequence
  Description of Artificial Sequence: Synthetic oligonucleotide
cagagccattgaagcagagagtggaagcc

SEQ ID NO: 174438 - DNA, 30 bp, Artificial Sequence
  Description of Artificial Sequence: Synthetic oligonucleotide
agagccattgaagcagagagtggaagcctc

SEQ ID NO: 174439 - DNA, 29 bp, Artificial Sequence
  Description of Artificial Sequence: Synthetic oligonucleotide
gagccattgaagcagagagtggaagcctc

SEQ ID NO: 174440 - DNA, 29 bp, Artificial Sequence
  Description of Artificial Sequence: Synthetic oligonucleotide
agccattgaagcagagagtggaagcctcc

SEQ ID NO: 174441 - DNA, 28 bp, Artificial Sequence
  Description of Artificial Sequence: Synthetic oligonucleotide
gccattgaagcagagagtggaagcctcc

SEQ ID NO: 174442 - DNA, 30 bp, Artificial Sequence
  Description of Artificial Sequence: Synthetic oligonucleotide
ccattgaagcagagagtggaagcctccatc

SEQ ID NO: 174443 - DNA, 31 bp, Artificial Sequence
  Description of Artificial Sequence: Synthetic oligonucleotide
cattgaagcagagagtggaagcctccatctc

SEQ ID NO: 174444 - DNA, 34 bp, Artificial Sequence
  Description of Artificial Sequence: Synthetic oligonucleotide
attgaagcagagagtggaagcctccatctcaaag

SEQ ID NO: 174445 - DNA, 33 bp, Artificial Sequence
  Description of Artificial Sequence: Synthetic oligonucleotide
ttgaagcagagagtggaagcctccatctcaaag

SEQ ID NO: 174446 - DNA, 32 bp, Artificial Sequence
  Description of Artificial Sequence: Synthetic oligonucleotide
tgaagcagagagtggaagcctccatctcaaag

SEQ ID NO: 174447 - DNA, 31 bp, Artificial Sequence
  Description of Artificial Sequence: Synthetic oligonucleotide
gaagcagagagtggaagcctccatctcaaag

SEQ ID NO: 174448 - DNA, 31 bp, Artificial Sequence
  Description of Artificial Sequence: Synthetic oligonucleotide
aagcagagagtggaagcctccatctcaaagg

SEQ ID NO: 174449 - DNA, 30 bp, Artificial Sequence
  Description of Artificial Sequence: Synthetic oligonucleotide
agcagagagtggaagcctccatctcaaagg

SEQ ID NO: 174450 - DNA, 29 bp, Artificial Sequence
  Description of Artificial Sequence: Synthetic oligonucleotide
gcagagagtggaagcctccatctcaaagg

SEQ ID NO: 174451 - DNA, 29 bp, Artificial Sequence
  Description of Artificial Sequence: Synthetic oligonucleotide
cagagagtggaagcctccatctcaaaggc

SEQ ID NO: 174452 - DNA, 31 bp, Artificial Sequence
  Description of Artificial Sequence: Synthetic oligonucleotide
agagagtggaagcctccatctcaaaggcaag

SEQ ID NO: 174453 - DNA, 30 bp, Artificial Sequence
  Description of Artificial Sequence: Synthetic oligonucleotide
gagagtggaagcctccatctcaaaggcaag

SEQ ID NO: 174454 - DNA, 30 bp, Artificial Sequence
  Description of Artificial Sequence: Synthetic oligonucleotide
agagtggaagcctccatctcaaaggcaagc

SEQ ID NO: 174455 - DNA, 29 bp, Artificial Sequence
  Description of Artificial Sequence: Synthetic oligonucleotide
gagtggaagcctccatctcaaaggcaagc

SEQ ID NO: 174456 - DNA, 30 bp, Artificial Sequence
  Description of Artificial Sequence: Synthetic oligonucleotide
agtggaagcctccatctcaaaggcaagctc

SEQ ID NO: 174457 - DNA, 29 bp, Artificial Sequence
  Description of Artificial Sequence: Synthetic oligonucleotide
gtggaagcctccatctcaaaggcaagctc

SEQ ID NO: 174458 - DNA, 35 bp, Artificial Sequence
  Description of Artificial Sequence: Synthetic oligonucleotide
tggaagcctccatctcaaaggcaagctcatttttg

SEQ ID NO: 174459 - DNA, 34 bp, Artificial Sequence
  Description of Artificial Sequence: Synthetic oligonucleotide
ggaagcctccatctcaaaggcaagctcatttttg

SEQ ID NO: 174460 - DNA, 34 bp, Artificial Sequence
  Description of Artificial Sequence: Synthetic oligonucleotide
gaagcctccatctcaaaggcaagctcatttttgg

SEQ ID NO: 174461 - DNA, 34 bp, Artificial Sequence
  Description of Artificial Sequence: Synthetic oligonucleotide
aagcctccatctcaaaggcaagctcatttttggg

SEQ ID NO: 174462 - DNA, 33 bp, Artificial Sequence
  Description of Artificial Sequence: Synthetic oligonucleotide
agcctccatctcaaaggcaagctcatttttggg

SEQ ID NO: 174463 - DNA, 32 bp, Artificial Sequence
  Description of Artificial Sequence: Synthetic oligonucleotide
gcctccatctcaaaggcaagctcatttttggg

SEQ ID NO: 174464 - DNA, 32 bp, Artificial Sequence
  Description of Artificial Sequence: Synthetic oligonucleotide
cctccatctcaaaggcaagctcatttttgggg

SEQ ID NO: 174465 - DNA, 32 bp, Artificial Sequence
  Description of Artificial Sequence: Synthetic oligonucleotide
ctccatctcaaaggcaagctcatttttggggg

SEQ ID NO: 174466 - DNA, 33 bp, Artificial Sequence
  Description of Artificial Sequence: Synthetic oligonucleotide
tccatctcaaaggcaagctcatttttgggggag

SEQ ID NO: 174467 - DNA, 32 bp, Artificial Sequence
  Description of Artificial Sequence: Synthetic oligonucleotide
ccatctcaaaggcaagctcatttttgggggag

SEQ ID NO: 174468 - DNA, 35 bp, Artificial Sequence
  Description of Artificial Sequence: Synthetic oligonucleotide
catctcaaaggcaagctcatttttgggggagaaag

SEQ ID NO: 174469 - DNA, 35 bp, Artificial Sequence
  Description of Artificial Sequence: Synthetic oligonucleotide
atctcaaaggcaagctcatttttgggggagaaagc

SEQ ID NO: 174470 - DNA, 34 bp, Artificial Sequence
  Description of Artificial Sequence: Synthetic oligonucleotide
tctcaaaggcaagctcatttttgggggagaaagc

SEQ ID NO: 174471 - DNA, 33 bp, Artificial Sequence
  Description of Artificial Sequence: Synthetic oligonucleotide
ctcaaaggcaagctcatttttgggggagaaagc

SEQ ID NO: 174472 - DNA, 35 bp, Artificial Sequence
  Description of Artificial Sequence: Synthetic oligonucleotide
tcaaaggcaagctcatttttgggggagaaagcaag

SEQ ID NO: 174473 - DNA, 34 bp, Artificial Sequence
  Description of Artificial Sequence: Synthetic oligonucleotide
caaaggcaagctcatttttgggggagaaagcaag

SEQ ID NO: 174474 - DNA, 35 bp, Artificial Sequence
  Description of Artificial Sequence: Synthetic oligonucleotide
aaaggcaagctcatttttgggggagaaagcaagtg

SEQ ID NO: 174475 - DNA, 34 bp, Artificial Sequence
  Description of Artificial Sequence: Synthetic oligonucleotide
aaggcaagctcatttttgggggagaaagcaagtg

SEQ ID NO: 174476 - DNA, 33 bp, Artificial Sequence
  Description of Artificial Sequence: Synthetic oligonucleotide
aggcaagctcatttttgggggagaaagcaagtg

SEQ ID NO: 174477 - DNA, 32 bp, Artificial Sequence
  Description of Artificial Sequence: Synthetic oligonucleotide
ggcaagctcatttttgggggagaaagcaagtg

SEQ ID NO: 174478 - DNA, 32 bp, Artificial Sequence
  Description of Artificial Sequence: Synthetic oligonucleotide
gcaagctcatttttgggggagaaagcaagtgc

SEQ ID NO: 174479 - DNA, 33 bp, Artificial Sequence
  Description of Artificial Sequence: Synthetic oligonucleotide
caagctcatttttgggggagaaagcaagtgctg

SEQ ID NO: 174480 - DNA, 33 bp, Artificial Sequence
  Description of Artificial Sequence: Synthetic oligonucleotide
aagctcatttttgggggagaaagcaagtgctgg

SEQ ID NO: 174481 - DNA, 32 bp, Artificial Sequence
  Description of Artificial Sequence: Synthetic oligonucleotide
agctcatttttgggggagaaagcaagtgctgg

SEQ ID NO: 174482 - DNA, 31 bp, Artificial Sequence
  Description of Artificial Sequence: Synthetic oligonucleotide
gctcatttttgggggagaaagcaagtgctgg

SEQ ID NO: 174483 - DNA, 31 bp, Artificial Sequence
  Description of Artificial Sequence: Synthetic oligonucleotide
ctcatttttgggggagaaagcaagtgctggg

SEQ ID NO: 174484 - DNA, 31 bp, Artificial Sequence
  Description of Artificial Sequence: Synthetic oligonucleotide
tcatttttgggggagaaagcaagtgctgggc

SEQ ID NO: 174485 - DNA, 30 bp, Artificial Sequence
  Description of Artificial Sequence: Synthetic oligonucleotide
catttttgggggagaaagcaagtgctgggc

SEQ ID NO: 174486 - DNA, 31 bp, Artificial Sequence
  Description of Artificial Sequence: Synthetic oligonucleotide
atttttgggggagaaagcaagtgctgggctc

SEQ ID NO: 174487 - DNA, 30 bp, Artificial Sequence
  Description of Artificial Sequence: Synthetic oligonucleotide
tttttgggggagaaagcaagtgctgggctc

SEQ ID NO: 174488 - DNA, 29 bp, Artificial Sequence
  Description of Artificial Sequence: Synthetic oligonucleotide
ttttgggggagaaagcaagtgctgggctc

SEQ ID NO: 174489 - DNA, 28 bp, Artificial Sequence
  Description of Artificial Sequence: Synthetic oligonucleotide
tttgggggagaaagcaagtgctgggctc

SEQ ID NO: 174490 - DNA, 27 bp, Artificial Sequence
  Description of Artificial Sequence: Synthetic oligonucleotide
ttgggggagaaagcaagtgctgggctc

SEQ ID NO: 174491 - DNA, 26 bp, Artificial Sequence
  Description of Artificial Sequence: Synthetic oligonucleotide
tgggggagaaagcaagtgctgggctc

SEQ ID NO: 174492 - DNA, 25 bp, Artificial Sequence
  Description of Artificial Sequence: Synthetic oligonucleotide
gggggagaaagcaagtgctgggctc

SEQ ID NO: 174493 - DNA, 26 bp, Artificial Sequence
  Description of Artificial Sequence: Synthetic oligonucleotide
ggggagaaagcaagtgctgggctcct

SEQ ID NO: 174494 - DNA, 26 bp, Artificial Sequence
  Description of Artificial Sequence: Synthetic oligonucleotide
gggagaaagcaagtgctgggctcctg

SEQ ID NO: 174495 - DNA, 26 bp, Artificial Sequence
  Description of Artificial Sequence: Synthetic oligonucleotide
ggagaaagcaagtgctgggctcctgg

SEQ ID NO: 174496 - DNA, 27 bp, Artificial Sequence
  Description of Artificial Sequence: Synthetic oligonucleotide
gagaaagcaagtgctgggctcctgggt

SEQ ID NO: 174497 - DNA, 27 bp, Artificial Sequence
  Description of Artificial Sequence: Synthetic oligonucleotide
agaaagcaagtgctgggctcctgggtg

SEQ ID NO: 174498 - DNA, 26 bp, Artificial Sequence
  Description of Artificial Sequence: Synthetic oligonucleotide
gaaagcaagtgctgggctcctgggtg

SEQ ID NO: 174499 - DNA, 26 bp, Artificial Sequence
  Description of Artificial Sequence: Synthetic oligonucleotide
aaagcaagtgctgggctcctgggtgc

SEQ ID NO: 174500 - DNA, 25 bp, Artificial Sequence
  Description of Artificial Sequence: Synthetic oligonucleotide
aagcaagtgctgggctcctgggtgc

SEQ ID NO: 174501 - DNA, 24 bp, Artificial Sequence
  Description of Artificial Sequence: Synthetic oligonucleotide
agcaagtgctgggctcctgggtgc

SEQ ID NO: 174502 - DNA, 23 bp, Artificial Sequence
  Description of Artificial Sequence: Synthetic oligonucleotide
gcaagtgctgggctcctgggtgc

SEQ ID NO: 174503 - DNA, 23 bp, Artificial Sequence
  Description of Artificial Sequence: Synthetic oligonucleotide
caagtgctgggctcctgggtgcc

SEQ ID NO: 174504 - DNA, 24 bp, Artificial Sequence
  Description of Artificial Sequence: Synthetic oligonucleotide
aagtgctgggctcctgggtgccca

SEQ ID NO: 174505 - DNA, 23 bp, Artificial Sequence
  Description of Artificial Sequence: Synthetic oligonucleotide
agtgctgggctcctgggtgccca

SEQ ID NO: 174506 - DNA, 22 bp, Artificial Sequence
  Description of Artificial Sequence: Synthetic oligonucleotide
gtgctgggctcctgggtgccca

SEQ ID NO: 174507 - DNA, 22 bp, Artificial Sequence
  Description of Artificial Sequence: Synthetic oligonucleotide
tgctgggctcctgggtgcccac

SEQ ID NO: 174508 - DNA, 21 bp, Artificial Sequence
  Description of Artificial Sequence: Synthetic oligonucleotide
gctgggctcctgggtgcccac

SEQ ID NO: 174509 - DNA, 21 bp, Artificial Sequence
  Description of Artificial Sequence: Synthetic oligonucleotide
ctgggctcctgggtgcccacg

SEQ ID NO: 174510 - DNA, 22 bp, Artificial Sequence
  Description of Artificial Sequence: Synthetic oligonucleotide
tgggctcctgggtgcccacgca

SEQ ID NO: 174511 - DNA, 21 bp, Artificial Sequence
  Description of Artificial Sequence: Synthetic oligonucleotide
gggctcctgggtgcccacgca

SEQ ID NO: 174512 - DNA, 21 bp, Artificial Sequence
  Description of Artificial Sequence: Synthetic oligonucleotide
ggctcctgggtgcccacgcag

SEQ ID NO: 174513 - DNA, 22 bp, Artificial Sequence
  Description of Artificial Sequence: Synthetic oligonucleotide
gctcctgggtgcccacgcagct

SEQ ID NO: 174514 - DNA, 22 bp, Artificial Sequence
  Description of Artificial Sequence: Synthetic oligonucleotide
ctcctgggtgcccacgcagctg

SEQ ID NO: 174515 - DNA, 22 bp, Artificial Sequence
  Description of Artificial Sequence: Synthetic oligonucleotide
tcctgggtgcccacgcagctgc

SEQ ID NO: 174516 - DNA, 21 bp, Artificial Sequence
  Description of Artificial Sequence: Synthetic oligonucleotide
cctgggtgcccacgcagctgc

SEQ ID NO: 174517 - DNA, 23 bp, Artificial Sequence
  Description of Artificial Sequence: Synthetic oligonucleotide
ctgggtgcccacgcagctgccat

SEQ ID NO: 174518 - DNA, 24 bp, Artificial Sequence
  Description of Artificial Sequence: Synthetic oligonucleotide
tgggtgcccacgcagctgccatca

SEQ ID NO: 174519 - DNA, 23 bp, Artificial Sequence
  Description of Artificial Sequence: Synthetic oligonucleotide
gggtgcccacgcagctgccatca

SEQ ID NO: 174520 - DNA, 23 bp, Artificial Sequence
  Description of Artificial Sequence: Synthetic oligonucleotide
ggtgcccacgcagctgccatcac

SEQ ID NO: 174521 - DNA, 23 bp, Artificial Sequence
  Description of Artificial Sequence: Synthetic oligonucleotide
gtgcccacgcagctgccatcacg

SEQ ID NO: 174522 - DNA, 23 bp, Artificial Sequence
  Description of Artificial Sequence: Synthetic oligonucleotide
tgcccacgcagctgccatcacgg

SEQ ID NO: 174523 - DNA, 22 bp, Artificial Sequence
  Description of Artificial Sequence: Synthetic oligonucleotide
gcccacgcagctgccatcacgg

SEQ ID NO: 174524 - DNA, 22 bp, Artificial Sequence
  Description of Artificial Sequence: Synthetic oligonucleotide
cccacgcagctgccatcacggc

SEQ ID NO: 174525 - DNA, 25 bp, Artificial Sequence
  Description of Artificial Sequence: Synthetic oligonucleotide
ccacgcagctgccatcacggcctat

SEQ ID NO: 174526 - DNA, 25 bp, Artificial Sequence
  Description of Artificial Sequence: Synthetic oligonucleotide
cacgcagctgccatcacggcctatg

SEQ ID NO: 174527 - DNA, 25 bp, Artificial Sequence
  Description of Artificial Sequence: Synthetic oligonucleotide
acgcagctgccatcacggcctatgc

SEQ ID NO: 174528 - DNA, 24 bp, Artificial Sequence
  Description of Artificial Sequence: Synthetic oligonucleotide
cgcagctgccatcacggcctatgc

SEQ ID NO: 174529 - DNA, 24 bp, Artificial Sequence
  Description of Artificial Sequence: Synthetic oligonucleotide
gcagctgccatcacggcctatgcc

SEQ ID NO: 174530 - DNA, 25 bp, Artificial Sequence
  Description of Artificial Sequence: Synthetic oligonucleotide
cagctgccatcacggcctatgccct

SEQ ID NO: 174531 - DNA, 26 bp, Artificial Sequence
  Description of Artificial Sequence: Synthetic oligonucleotide
agctgccatcacggcctatgccctga

SEQ ID NO: 174532 - DNA, 25 bp, Artificial Sequence
  Description of Artificial Sequence: Synthetic oligonucleotide
gctgccatcacggcctatgccctga

SEQ ID NO: 174533 - DNA, 26 bp, Artificial Sequence
  Description of Artificial Sequence: Synthetic oligonucleotide
ctgccatcacggcctatgccctgaca

SEQ ID NO: 174534 - DNA, 27 bp, Artificial Sequence
  Description of Artificial Sequence: Synthetic oligonucleotide
tgccatcacggcctatgccctgacact

SEQ ID NO: 174535 - DNA, 26 bp, Artificial Sequence
  Description of Artificial Sequence: Synthetic oligonucleotide
gccatcacggcctatgccctgacact

SEQ ID NO: 174536 - DNA, 27 bp, Artificial Sequence
  Description of Artificial Sequence: Synthetic oligonucleotide
ccatcacggcctatgccctgacactga

SEQ ID NO: 174537 - DNA, 27 bp, Artificial Sequence
  Description of Artificial Sequence: Synthetic oligonucleotide
catcacggcctatgccctgacactgac

SEQ ID NO: 174538 - DNA, 27 bp, Artificial Sequence
  Description of Artificial Sequence: Synthetic oligonucleotide
atcacggcctatgccctgacactgacc

SEQ ID NO: 174539 - DNA, 27 bp, Artificial Sequence
  Description of Artificial Sequence: Synthetic oligonucleotide
tcacggcctatgccctgacactgacca

SEQ ID NO: 174540 - DNA, 27 bp, Artificial Sequence
  Description of Artificial Sequence: Synthetic oligonucleotide
cacggcctatgccctgacactgaccaa

SEQ ID NO: 174541 - DNA, 27 bp, Artificial Sequence
  Description of Artificial Sequence: Synthetic oligonucleotide
acggcctatgccctgacactgaccaag

SEQ ID NO: 174542 - DNA, 26 bp, Artificial Sequence
  Description of Artificial Sequence: Synthetic oligonucleotide
cggcctatgccctgacactgaccaag

SEQ ID NO: 174543 - DNA, 26 bp, Artificial Sequence
  Description of Artificial Sequence: Synthetic oligonucleotide
ggcctatgccctgacactgaccaagg

SEQ ID NO: 174544 - DNA, 26 bp, Artificial Sequence
  Description of Artificial Sequence: Synthetic oligonucleotide
gcctatgccctgacactgaccaaggc

SEQ ID NO: 174545 - DNA, 26 bp, Artificial Sequence
  Description of Artificial Sequence: Synthetic oligonucleotide
cctatgccctgacactgaccaaggcc

SEQ ID NO: 174546 - DNA, 26 bp, Artificial Sequence
  Description of Artificial Sequence: Synthetic oligonucleotide
ctatgccctgacactgaccaaggccc

SEQ ID NO: 174547 - DNA, 27 bp, Artificial Sequence
  Description of Artificial Sequence: Synthetic oligonucleotide
tatgccctgacactgaccaaggcccct

SEQ ID NO: 174548 - DNA, 26 bp, Artificial Sequence
  Description of Artificial Sequence: Synthetic oligonucleotide
atgccctgacactgaccaaggcccct

SEQ ID NO: 174549 - DNA, 25 bp, Artificial Sequence
  Description of Artificial Sequence: Synthetic oligonucleotide
tgccctgacactgaccaaggcccct

SEQ ID NO: 174550 - DNA, 24 bp, Artificial Sequence
  Description of Artificial Sequence: Synthetic oligonucleotide
gccctgacactgaccaaggcccct

SEQ ID NO: 174551 - DNA, 24 bp, Artificial Sequence
  Description of Artificial Sequence: Synthetic oligonucleotide
ccctgacactgaccaaggcccctg

SEQ ID NO: 174552 - DNA, 24 bp, Artificial Sequence
  Description of Artificial Sequence: Synthetic oligonucleotide
cctgacactgaccaaggcccctgc

SEQ ID NO: 174553 - DNA, 24 bp, Artificial Sequence
  Description of Artificial Sequence: Synthetic oligonucleotide
ctgacactgaccaaggcccctgcg

SEQ ID NO: 174554 - DNA, 25 bp, Artificial Sequence
  Description of Artificial Sequence: Synthetic oligonucleotide
tgacactgaccaaggcccctgcgga

SEQ ID NO: 174555 - DNA, 24 bp, Artificial Sequence
  Description of Artificial Sequence: Synthetic oligonucleotide
gacactgaccaaggcccctgcgga

SEQ ID NO: 174556 - DNA, 24 bp, Artificial Sequence
  Description of Artificial Sequence: Synthetic oligonucleotide
acactgaccaaggcccctgcggac

SEQ ID NO: 174557 - DNA, 23 bp, Artificial Sequence
  Description of Artificial Sequence: Synthetic oligonucleotide
cactgaccaaggcccctgcggac

SEQ ID NO: 174558 - DNA, 24 bp, Artificial Sequence
  Description of Artificial Sequence: Synthetic oligonucleotide
actgaccaaggcccctgcggacct

SEQ ID NO: 174559 - DNA, 23 bp, Artificial Sequence
  Description of Artificial Sequence: Synthetic oligonucleotide
ctgaccaaggcccctgcggacct

SEQ ID NO: 174560 - DNA, 23 bp, Artificial Sequence
  Description of Artificial Sequence: Synthetic oligonucleotide
tgaccaaggcccctgcggacctg

SEQ ID NO: 174561 - DNA, 22 bp, Artificial Sequence
  Description of Artificial Sequence: Synthetic oligonucleotide
gaccaaggcccctgcggacctg

SEQ ID NO: 174562 - DNA, 22 bp, Artificial Sequence
  Description of Artificial Sequence: Synthetic oligonucleotide
accaaggcccctgcggacctgc

SEQ ID NO: 174563 - DNA, 21 bp, Artificial Sequence
  Description of Artificial Sequence: Synthetic oligonucleotide
ccaaggcccctgcggacctgc

SEQ ID NO: 174564 - DNA, 21 bp, Artificial Sequence
  Description of Artificial Sequence: Synthetic oligonucleotide
caaggcccctgcggacctgcg

SEQ ID NO: 174565 - DNA, 21 bp, Artificial Sequence
  Description of Artificial Sequence: Synthetic oligonucleotide
aaggcccctgcggacctgcgg

SEQ ID NO: 174566 - DNA, 20 bp, Artificial Sequence
  Description of Artificial Sequence: Synthetic oligonucleotide
aggcccctgcggacctgcgg

SEQ ID NO: 174567 - DNA, 20 bp, Artificial Sequence
  Description of Artificial Sequence: Synthetic oligonucleotide
ggcccctgcggacctgcggt

SEQ ID NO: 174568 - DNA, 20 bp, Artificial Sequence
  Description of Artificial Sequence: Synthetic oligonucleotide
gcccctgcggacctgcgggt

SEQ ID NO: 174569 - DNA, 20 bp, Artificial Sequence
  Description of Artificial Sequence: Synthetic oligonucleotide
cccctgcggacctgcggggt

SEQ ID NO: 174570 - DNA, 22 bp, Artificial Sequence
  Description of Artificial Sequence: Synthetic oligonucleotide
ccctgcggacctgcggggtgtt

SEQ ID NO: 174571 - DNA, 22 bp, Artificial Sequence
  Description of Artificial Sequence: Synthetic oligonucleotide
cctgcggacctgcggggtgttg

SEQ ID NO: 174572 - DNA, 22 bp, Artificial Sequence
  Description of Artificial Sequence: Synthetic oligonucleotide
ctgcggacctgcggggtgttgc

SEQ ID NO: 174573 - DNA, 22 bp, Artificial Sequence
  Description of Artificial Sequence: Synthetic oligonucleotide
tgcggacctgcggggtgttgcc

SEQ ID NO: 174574 - DNA, 21 bp, Artificial Sequence
  Description of Artificial Sequence: Synthetic oligonucleotide
gcggacctgcggggtgttgcc

SEQ ID NO: 174575 - DNA, 22 bp, Artificial Sequence
  Description of Artificial Sequence: Synthetic oligonucleotide
cggacctgcggggtgttgccca

SEQ ID NO: 174576 - DNA, 24 bp, Artificial Sequence
  Description of Artificial Sequence: Synthetic oligonucleotide
ggacctgcggggtgttgcccacaa

SEQ ID NO: 174577 - DNA, 26 bp, Artificial Sequence
  Description of Artificial Sequence: Synthetic oligonucleotide
gacctgcggggtgttgcccacaacaa

SEQ ID NO: 174578 - DNA, 26 bp, Artificial Sequence
  Description of Artificial Sequence: Synthetic oligonucleotide
acctgcggggtgttgcccacaacaac

SEQ ID NO: 174579 - DNA, 25 bp, Artificial Sequence
  Description of Artificial Sequence: Synthetic oligonucleotide
cctgcggggtgttgcccacaacaac

SEQ ID NO: 174580 - DNA, 26 bp, Artificial Sequence
  Description of Artificial Sequence: Synthetic oligonucleotide
ctgcggggtgttgcccacaacaacct

SEQ ID NO: 174581 - DNA, 27 bp, Artificial Sequence
  Description of Artificial Sequence: Synthetic oligonucleotide
tgcggggtgttgcccacaacaacctca

SEQ ID NO: 174582 - DNA, 27 bp, Artificial Sequence
  Description of Artificial Sequence: Synthetic oligonucleotide
gcggggtgttgcccacaacaacctcat

SEQ ID NO: 174583 - DNA, 27 bp, Artificial Sequence
  Description of Artificial Sequence: Synthetic oligonucleotide
cggggtgttgcccacaacaacctcatg

SEQ ID NO: 174584 - DNA, 27 bp, Artificial Sequence
  Description of Artificial Sequence: Synthetic oligonucleotide
ggggtgttgcccacaacaacctcatgg

SEQ ID NO: 174585 - DNA, 27 bp, Artificial Sequence
  Description of Artificial Sequence: Synthetic oligonucleotide
gggtgttgcccacaacaacctcatggc

SEQ ID NO: 174586 - DNA, 30 bp, Artificial Sequence
  Description of Artificial Sequence: Synthetic oligonucleotide
ggtgttgcccacaacaacctcatggcaatg

SEQ ID NO: 174587 - DNA, 30 bp, Artificial Sequence
  Description of Artificial Sequence: Synthetic oligonucleotide
gtgttgcccacaacaacctcatggcaatgg

SEQ ID NO: 174588 - DNA, 30 bp, Artificial Sequence
  Description of Artificial Sequence: Synthetic oligonucleotide
tgttgcccacaacaacctcatggcaatggc

SEQ ID NO: 174589 - DNA, 29 bp, Artificial Sequence
  Description of Artificial Sequence: Synthetic oligonucleotide
gttgcccacaacaacctcatggcaatggc

SEQ ID NO: 174590 - DNA, 29 bp, Artificial Sequence
  Description of Artificial Sequence: Synthetic oligonucleotide
ttgcccacaacaacctcatggcaatggcc

SEQ ID NO: 174591 - DNA, 28 bp, Artificial Sequence
  Description of Artificial Sequence: Synthetic oligonucleotide
tgcccacaacaacctcatggcaatggcc

SEQ ID NO: 174592 - DNA, 27 bp, Artificial Sequence
  Description of Artificial Sequence: Synthetic oligonucleotide
gcccacaacaacctcatggcaatggcc

SEQ ID NO: 174593 - DNA, 27 bp, Artificial Sequence
  Description of Artificial Sequence: Synthetic oligonucleotide
cccacaacaacctcatggcaatggccc

SEQ ID NO: 174594 - DNA, 28 bp, Artificial Sequence
  Description of Artificial Sequence: Synthetic oligonucleotide
ccacaacaacctcatggcaatggcccag

SEQ ID NO: 174595 - DNA, 28 bp, Artificial Sequence
  Description of Artificial Sequence: Synthetic oligonucleotide
cacaacaacctcatggcaatggcccagg

SEQ ID NO: 174596 - DNA, 29 bp, Artificial Sequence
  Description of Artificial Sequence: Synthetic oligonucleotide
acaacaacctcatggcaatggcccaggag

SEQ ID NO: 174597 - DNA, 28 bp, Artificial Sequence
  Description of Artificial Sequence: Synthetic oligonucleotide
caacaacctcatggcaatggcccaggag

SEQ ID NO: 174598 - DNA, 29 bp, Artificial Sequence
  Description of Artificial Sequence: Synthetic oligonucleotide
aacaacctcatggcaatggcccaggagac

SEQ ID NO: 174599 - DNA, 28 bp, Artificial Sequence
  Description of Artificial Sequence: Synthetic oligonucleotide
acaacctcatggcaatggcccaggagac

SEQ ID NO: 174600 - DNA, 27 bp, Artificial Sequence
  Description of Artificial Sequence: Synthetic oligonucleotide
caacctcatggcaatggcccaggagac

SEQ ID NO: 174601 - DNA, 28 bp, Artificial Sequence
  Description of Artificial Sequence: Synthetic oligonucleotide
aacctcatggcaatggcccaggagactg

SEQ ID NO: 174602 - DNA, 27 bp, Artificial Sequence
  Description of Artificial Sequence: Synthetic oligonucleotide
acctcatggcaatggcccaggagactg

SEQ ID NO: 174603 - DNA, 26 bp, Artificial Sequence
  Description of Artificial Sequence: Synthetic oligonucleotide
cctcatggcaatggcccaggagactg

SEQ ID NO: 174604 - DNA, 27 bp, Artificial Sequence
  Description of Artificial Sequence: Synthetic oligonucleotide
ctcatggcaatggcccaggagactgga

SEQ ID NO: 174605 - DNA, 27 bp, Artificial Sequence
  Description of Artificial Sequence: Synthetic oligonucleotide
tcatggcaatggcccaggagactggag

SEQ ID NO: 174606 - DNA, 27 bp, Artificial Sequence
  Description of Artificial Sequence: Synthetic oligonucleotide
aaaggcctatgtgtggccaccccagtc

SEQ ID NO: 174607 - DNA, 26 bp, Artificial Sequence
  Description of Artificial Sequence: Synthetic oligonucleotide
aaggcctatgtgtggccaccccagtc

SEQ ID NO: 174608 - DNA, 25 bp, Artificial Sequence
  Description of Artificial Sequence: Synthetic oligonucleotide
aggcctatgtgtggccaccccagtc

SEQ ID NO: 174609 - DNA, 24 bp, Artificial Sequence
  Description of Artificial Sequence: Synthetic oligonucleotide
ggcctatgtgtggccaccccagtc

SEQ ID NO: 174610 - DNA, 25 bp, Artificial Sequence
  Description of Artificial Sequence: Synthetic oligonucleotide
gcctatgtgtggccaccccagtcca

SEQ ID NO: 174611 - DNA, 25 bp, Artificial Sequence
  Description of Artificial Sequence: Synthetic oligonucleotide
cctatgtgtggccaccccagtccag

SEQ ID NO: 174612 - DNA, 26 bp, Artificial Sequence
  Description of Artificial Sequence: Synthetic oligonucleotide
ctatgtgtggccaccccagtccagct

SEQ ID NO: 174613 - DNA, 26 bp, Artificial Sequence
  Description of Artificial Sequence: Synthetic oligonucleotide
tatgtgtggccaccccagtccagctc

SEQ ID NO: 174614 - DNA, 25 bp, Artificial Sequence
  Description of Artificial Sequence: Synthetic oligonucleotide
atgtgtggccaccccagtccagctc

SEQ ID NO: 174615 - DNA, 24 bp, Artificial Sequence
  Description of Artificial Sequence: Synthetic oligonucleotide
tgtgtggccaccccagtccagctc

SEQ ID NO: 174616 - DNA, 23 bp, Artificial Sequence
  Description of Artificial Sequence: Synthetic oligonucleotide
gtgtggccaccccagtccagctc

SEQ ID NO: 174617 - DNA, 23 bp, Artificial Sequence
  Description of Artificial Sequence: Synthetic oligonucleotide
tgtggccaccccagtccagctcc

SEQ ID NO: 174618 - DNA, 22 bp, Artificial Sequence
  Description of Artificial Sequence: Synthetic oligonucleotide
gtggccaccccagtccagctcc

SEQ ID NO: 174619 - DNA, 22 bp, Artificial Sequence
  Description of Artificial Sequence: Synthetic oligonucleotide
tggccaccccagtccagctccg

SEQ ID NO: 174620 - DNA, 21 bp, Artificial Sequence
  Description of Artificial Sequence: Synthetic oligonucleotide
ggccaccccagtccagctccg

SEQ ID NO: 174621 - DNA, 21 bp, Artificial Sequence
  Description of Artificial Sequence: Synthetic oligonucleotide
gccaccccagtccagctccgg

SEQ ID NO: 174622 - DNA, 22 bp, Artificial Sequence
  Description of Artificial Sequence: Synthetic oligonucleotide
ccaccccagtccagctccgggt

SEQ ID NO: 174623 - DNA, 24 bp, Artificial Sequence
  Description of Artificial Sequence: Synthetic oligonucleotide
caccccagtccagctccgggtgtt

SEQ ID NO: 174624 - DNA, 24 bp, Artificial Sequence
  Description of Artificial Sequence: Synthetic oligonucleotide
accccagtccagctccgggtgttc

SEQ ID NO: 174625 - DNA, 23 bp, Artificial Sequence
  Description of Artificial Sequence: Synthetic oligonucleotide
ccccagtccagctccgggtgttc

SEQ ID NO: 174626 - DNA, 23 bp, Artificial Sequence
  Description of Artificial Sequence: Synthetic oligonucleotide
cccagtccagctccgggtgttcc

SEQ ID NO: 174627 - DNA, 23 bp, Artificial Sequence
  Description of Artificial Sequence: Synthetic oligonucleotide
ccagtccagctccgggtgttccg

SEQ ID NO: 174628 - DNA, 23 bp, Artificial Sequence
  Description of Artificial Sequence: Synthetic oligonucleotide
cagtccagctccgggtgttccgc

SEQ ID NO: 174629 - DNA, 24 bp, Artificial Sequence
  Description of Artificial Sequence: Synthetic oligonucleotide
agtccagctccgggtgttccgcga

SEQ ID NO: 174630 - DNA, 23 bp, Artificial Sequence
  Description of Artificial Sequence: Synthetic oligonucleotide
gtccagctccgggtgttccgcga

SEQ ID NO: 174631 - DNA, 25 bp, Artificial Sequence
  Description of Artificial Sequence: Synthetic oligonucleotide
tccagctccgggtgttccgcgagtt

SEQ ID NO: 174632 - DNA, 24 bp, Artificial Sequence
  Description of Artificial Sequence: Synthetic oligonucleotide
ccagctccgggtgttccgcgagtt

SEQ ID NO: 174633 - DNA, 24 bp, Artificial Sequence
  Description of Artificial Sequence: Synthetic oligonucleotide
ttctctgtggtgcccacggcagcc

SEQ ID NO: 174634 - DNA, 23 bp, Artificial Sequence
  Description of Artificial Sequence: Synthetic oligonucleotide
tctctgtggtgcccacggcagcc

SEQ ID NO: 174635 - DNA, 22 bp, Artificial Sequence
  Description of Artificial Sequence: Synthetic oligonucleotide
ctctgtggtgcccacggcagcc

SEQ ID NO: 174636 - DNA, 22 bp, Artificial Sequence
  Description of Artificial Sequence: Synthetic oligonucleotide
tctgtggtgcccacggcagccg

SEQ ID NO: 174637 - DNA, 21 bp, Artificial Sequence
  Description of Artificial Sequence: Synthetic oligonucleotide
ctgtggtgcccacggcagccg

SEQ ID NO: 174638 - DNA, 21 bp, Artificial Sequence
  Description of Artificial Sequence: Synthetic oligonucleotide
tgtggtgcccacggcagccgc

SEQ ID NO: 174639 - DNA, 20 bp, Artificial Sequence
  Description of Artificial Sequence: Synthetic oligonucleotide
gtggtgcccacggcagccgc

SEQ ID NO: 174640 - DNA, 20 bp, Artificial Sequence
  Description of Artificial Sequence: Synthetic oligonucleotide
tggtgcccacggcagccgcc

SEQ ID NO: 174641 - DNA, 20 bp, Artificial Sequence
  Description of Artificial Sequence: Synthetic oligonucleotide
ggtgcccacggcagccgcct

SEQ ID NO: 174642 - DNA, 20 bp, Artificial Sequence
  Description of Artificial Sequence: Synthetic oligonucleotide
gtgcccacggcagccgccgt

SEQ ID NO: 174643 - DNA, 20 bp, Artificial Sequence
  Description of Artificial Sequence: Synthetic oligonucleotide
tgcccacggcagccgccgct

SEQ ID NO: 174644 - DNA, 20 bp, Artificial Sequence
  Description of Artificial Sequence: Synthetic oligonucleotide
gcccacggcagccgccgctt

SEQ ID NO: 174645 - DNA, 20 bp, Artificial Sequence
  Description of Artificial Sequence: Synthetic oligonucleotide
cccacggcagccgccgctgt

SEQ ID NO: 174646 - DNA, 21 bp, Artificial Sequence
  Description of Artificial Sequence: Synthetic oligonucleotide
ccacggcagccgccgctgtgt

SEQ ID NO: 174647 - DNA, 22 bp, Artificial Sequence
  Description of Artificial Sequence: Synthetic oligonucleotide
cacggcagccgccgctgtgtct

SEQ ID NO: 174648 - DNA, 23 bp, Artificial Sequence
  Description of Artificial Sequence: Synthetic oligonucleotide
acggcagccgccgctgtgtctct

SEQ ID NO: 174649 - DNA, 22 bp, Artificial Sequence
  Description of Artificial Sequence: Synthetic oligonucleotide
cggcagccgccgctgtgtctct

SEQ ID NO: 174650 - DNA, 24 bp, Artificial Sequence
  Description of Artificial Sequence: Synthetic oligonucleotide
ggcagccgccgctgtgtctctgaa

SEQ ID NO: 174651 - DNA, 24 bp, Artificial Sequence
  Description of Artificial Sequence: Synthetic oligonucleotide
gcagccgccgctgtgtctctgaag

SEQ ID NO: 174652 - DNA, 25 bp, Artificial Sequence
  Description of Artificial Sequence: Synthetic oligonucleotide
cagccgccgctgtgtctctgaaggt

SEQ ID NO: 174653 - DNA, 25 bp, Artificial Sequence
  Description of Artificial Sequence: Synthetic oligonucleotide
agccgccgctgtgtctctgaaggtg

SEQ ID NO: 174654 - DNA, 24 bp, Artificial Sequence
  Description of Artificial Sequence: Synthetic oligonucleotide
gccgccgctgtgtctctgaaggtg

SEQ ID NO: 174655 - DNA, 25 bp, Artificial Sequence
  Description of Artificial Sequence: Synthetic oligonucleotide
ccgccgctgtgtctctgaaggtggt

SEQ ID NO: 174656 - DNA, 25 bp, Artificial Sequence
  Description of Artificial Sequence: Synthetic oligonucleotide
cgccgctgtgtctctgaaggtggtg

SEQ ID NO: 174657 - DNA, 25 bp, Artificial Sequence
  Description of Artificial Sequence: Synthetic oligonucleotide
gccgctgtgtctctgaaggtggtgg

SEQ ID NO: 174658 - DNA, 28 bp, Artificial Sequence
  Description of Artificial Sequence: Synthetic oligonucleotide
ttcctatgcggcttggttgtcacgggac

SEQ ID NO: 174659 - DNA, 27 bp, Artificial Sequence
  Description of Artificial Sequence: Synthetic oligonucleotide
tcctatgcggcttggttgtcacgggac

SEQ ID NO: 174660 - DNA, 27 bp, Artificial Sequence
  Description of Artificial Sequence: Synthetic oligonucleotide
cctatgcggcttggttgtcacgggaca

SEQ ID NO: 174661 - DNA, 27 bp, Artificial Sequence
  Description of Artificial Sequence: Synthetic oligonucleotide
ctatgcggcttggttgtcacgggacag

SEQ ID NO: 174662 - DNA, 27 bp, Artificial Sequence
  Description of Artificial Sequence: Synthetic oligonucleotide
tatgcggcttggttgtcacgggacagc

SEQ ID NO: 174663 - DNA, 27 bp, Artificial Sequence
  Description of Artificial Sequence: Synthetic oligonucleotide
atgcggcttggttgtcacgggacagca

SEQ ID NO: 174664 - DNA, 26 bp, Artificial Sequence
  Description of Artificial Sequence: Synthetic oligonucleotide
tgcggcttggttgtcacgggacagca

SEQ ID NO: 174665 - DNA, 25 bp, Artificial Sequence
  Description of Artificial Sequence: Synthetic oligonucleotide
gcggcttggttgtcacgggacagca

SEQ ID NO: 174666 - DNA, 25 bp, Artificial Sequence
  Description of Artificial Sequence: Synthetic oligonucleotide
cggcttggttgtcacgggacagcag

SEQ ID NO: 174667 - DNA, 26 bp, Artificial Sequence
  Description of Artificial Sequence: Synthetic oligonucleotide
ggcttggttgtcacgggacagcagca

SEQ ID NO: 174668 - DNA, 26 bp, Artificial Sequence
  Description of Artificial Sequence: Synthetic oligonucleotide
gcttggttgtcacgggacagcagcac

SEQ ID NO: 174669 - DNA, 27 bp, Artificial Sequence
  Description of Artificial Sequence: Synthetic oligonucleotide
cttggttgtcacgggacagcagcacct

SEQ ID NO: 174670 - DNA, 27 bp, Artificial Sequence
  Description of Artificial Sequence: Synthetic oligonucleotide
ttggttgtcacgggacagcagcacctg

SEQ ID NO: 174671 - DNA, 26 bp, Artificial Sequence
  Description of Artificial Sequence: Synthetic oligonucleotide
tggttgtcacgggacagcagcacctg

SEQ ID NO: 174672 - DNA, 25 bp, Artificial Sequence
  Description of Artificial Sequence: Synthetic oligonucleotide
ggttgtcacgggacagcagcacctg

SEQ ID NO: 174673 - DNA, 25 bp, Artificial Sequence
  Description of Artificial Sequence: Synthetic oligonucleotide
gttgtcacgggacagcagcacctgg

SEQ ID NO: 174674 - DNA, 26 bp, Artificial Sequence
  Description of Artificial Sequence: Synthetic oligonucleotide
ttgtcacgggacagcagcacctggct

SEQ ID NO: 174675 - DNA, 25 bp, Artificial Sequence
  Description of Artificial Sequence: Synthetic oligonucleotide
tgtcacgggacagcagcacctggct

SEQ ID NO: 174676 - DNA, 24 bp, Artificial Sequence
  Description of Artificial Sequence: Synthetic oligonucleotide
gtcacgggacagcagcacctggct

SEQ ID NO: 174677 - DNA, 25 bp, Artificial Sequence
  Description of Artificial Sequence: Synthetic oligonucleotide
tcacgggacagcagcacctggctca

SEQ ID NO: 174678 - DNA, 24 bp, Artificial Sequence
  Description of Artificial Sequence: Synthetic oligonucleotide
cacgggacagcagcacctggctca

SEQ ID NO: 174679 - DNA, 25 bp, Artificial Sequence
  Description of Artificial Sequence: Synthetic oligonucleotide
acgggacagcagcacctggctcaca

SEQ ID NO: 174680 - DNA, 24 bp, Artificial Sequence
  Description of Artificial Sequence: Synthetic oligonucleotide
cgggacagcagcacctggctcaca

SEQ ID NO: 174681 - DNA, 24 bp, Artificial Sequence
  Description of Artificial Sequence: Synthetic oligonucleotide
gggacagcagcacctggctcacag

SEQ ID NO: 174682 - DNA, 24 bp, Artificial Sequence
  Description of Artificial Sequence: Synthetic oligonucleotide
ggacagcagcacctggctcacagc

SEQ ID NO: 174683 - DNA, 27 bp, Artificial Sequence
  Description of Artificial Sequence: Synthetic oligonucleotide
gacagcagcacctggctcacagccttt

SEQ ID NO: 174684 - DNA, 27 bp, Artificial Sequence
  Description of Artificial Sequence: Synthetic oligonucleotide
acagcagcacctggctcacagcctttg

SEQ ID NO: 174685 - DNA, 32 bp, Artificial Sequence
  Description of Artificial Sequence: Synthetic oligonucleotide
agagagtggaagcctccatctcaaaggcaarc

SEQ ID NO: 174686 - DNA, 31 bp, Artificial Sequence
  Description of Artificial Sequence: Synthetic oligonucleotide
gagagtggaagcctccatctcaaaggcaarc

SEQ ID NO: 174687 - DNA, 32 bp, Artificial Sequence
  Description of Artificial Sequence: Synthetic oligonucleotide
agagtggaagcctccatctcaaaggcaarctc

SEQ ID NO: 174688 - DNA, 31 bp, Artificial Sequence
  Description of Artificial Sequence: Synthetic oligonucleotide
gagtggaagcctccatctcaaaggcaarctc

SEQ ID NO: 174689 - DNA, 37 bp, Artificial Sequence
  Description of Artificial Sequence: Synthetic oligonucleotide
agtggaagcctccatctcaaaggcaarctcatttttg

SEQ ID NO: 174690 - DNA, 36 bp, Artificial Sequence
  Description of Artificial Sequence: Synthetic oligonucleotide
gtggaagcctccatctcaaaggcaarctcatttttg

SEQ ID NO: 174691 - DNA, 36 bp, Artificial Sequence
  Description of Artificial Sequence: Synthetic oligonucleotide
tggaagcctccatctcaaaggcaarctcatttttgg

SEQ ID NO: 174692 - DNA, 35 bp, Artificial Sequence
  Description of Artificial Sequence: Synthetic oligonucleotide
ggaagcctccatctcaaaggcaarctcatttttgg

SEQ ID NO: 174693 - DNA, 35 bp, Artificial Sequence
  Description of Artificial Sequence: Synthetic oligonucleotide
gaagcctccatctcaaaggcaarctcatttttggg

SEQ ID NO: 174694 - DNA, 35 bp, Artificial Sequence
  Description of Artificial Sequence: Synthetic oligonucleotide
aagcctccatctcaaaggcaarctcatttttgggg

SEQ ID NO: 174695 - DNA, 34 bp, Artificial Sequence
  Description of Artificial Sequence: Synthetic oligonucleotide
agcctccatctcaaaggcaarctcatttttgggg

SEQ ID NO: 174696 - DNA, 33 bp, Artificial Sequence
  Description of Artificial Sequence: Synthetic oligonucleotide
gcctccatctcaaaggcaarctcatttttgggg

SEQ ID NO: 174697 - DNA, 33 bp, Artificial Sequence
  Description of Artificial Sequence: Synthetic oligonucleotide
cctccatctcaaaggcaarctcatttttggggg

SEQ ID NO: 174698 - DNA, 34 bp, Artificial Sequence
  Description of Artificial Sequence: Synthetic oligonucleotide
ctccatctcaaaggcaarctcatttttgggggag

SEQ ID NO: 174699 - DNA, 37 bp, Artificial Sequence
  Description of Artificial Sequence: Synthetic oligonucleotide
tccatctcaaaggcaarctcatttttgggggagaaag

SEQ ID NO: 174700 - DNA, 36 bp, Artificial Sequence
  Description of Artificial Sequence: Synthetic oligonucleotide
ccatctcaaaggcaarctcatttttgggggagaaag

SEQ ID NO: 174701 - DNA, 36 bp, Artificial Sequence
  Description of Artificial Sequence: Synthetic oligonucleotide
catctcaaaggcaarctcatttttgggggagaaagc

SEQ ID NO: 174702 - DNA, 38 bp, Artificial Sequence
  Description of Artificial Sequence: Synthetic oligonucleotide
atctcaaaggcaarctcatttttgggggagaaagcaag

SEQ ID NO: 174703 - DNA, 37 bp, Artificial Sequence
  Description of Artificial Sequence: Synthetic oligonucleotide
tctcaaaggcaarctcatttttgggggagaaagcaag

SEQ ID NO: 174704 - DNA, 36 bp, Artificial Sequence
  Description of Artificial Sequence: Synthetic oligonucleotide
ctcaaaggcaarctcatttttgggggagaaagcaag

SEQ ID NO: 174705 - DNA, 37 bp, Artificial Sequence
  Description of Artificial Sequence: Synthetic oligonucleotide
tcaaaggcaarctcatttttgggggagaaagcaagtg

SEQ ID NO: 174706 - DNA, 36 bp, Artificial Sequence
  Description of Artificial Sequence: Synthetic oligonucleotide
caaaggcaarctcatttttgggggagaaagcaagtg

SEQ ID NO: 174707 - DNA, 36 bp, Artificial Sequence
  Description of Artificial Sequence: Synthetic oligonucleotide
aaaggcaarctcatttttgggggagaaagcaagtgc

SEQ ID NO: 174708 - DNA, 35 bp, Artificial Sequence
  Description of Artificial Sequence: Synthetic oligonucleotide
aaggcaarctcatttttgggggagaaagcaagtgc

SEQ ID NO: 174709 - DNA, 34 bp, Artificial Sequence
  Description of Artificial Sequence: Synthetic oligonucleotide
aggcaarctcatttttgggggagaaagcaagtgc

SEQ ID NO: 174710 - DNA, 33 bp, Artificial Sequence
  Description of Artificial Sequence: Synthetic oligonucleotide
ggcaarctcatttttgggggagaaagcaagtgc

SEQ ID NO: 174711 - DNA, 34 bp, Artificial Sequence
  Description of Artificial Sequence: Synthetic oligonucleotide
gcaarctcatttttgggggagaaagcaagtgctg

SEQ ID NO: 174712 - DNA, 34 bp, Artificial Sequence
  Description of Artificial Sequence: Synthetic oligonucleotide
caarctcatttttgggggagaaagcaagtgctgg

SEQ ID NO: 174713 - DNA, 34 bp, Artificial Sequence
  Description of Artificial Sequence: Synthetic oligonucleotide
aarctcatttttgggggagaaagcaagtgctggg

SEQ ID NO: 174714 - DNA, 33 bp, Artificial Sequence
  Description of Artificial Sequence: Synthetic oligonucleotide
arctcatttttgggggagaaagcaagtgctggg

SEQ ID NO: 174715 - DNA, 32 bp, Artificial Sequence
  Description of Artificial Sequence: Synthetic oligonucleotide
rctcatttttgggggagaaagcaagtgctggg

SEQ ID NO: 174716 - DNA, 28 bp, Artificial Sequence
  Description of Artificial Sequence: Synthetic oligonucleotide
atggggtgacacgtctgcccatgatgag

SEQ ID NO: 174717 - DNA, 27 bp, Artificial Sequence
  Description of Artificial Sequence: Synthetic oligonucleotide
tggggtgacacgtctgcccatgatgag

SEQ ID NO: 174718 - DNA, 27 bp, Artificial Sequence
  Description of Artificial Sequence: Synthetic oligonucleotide
ggggtgacacgtctgcccatgatgagt

SEQ ID NO: 174719 - DNA, 28 bp, Artificial Sequence
  Description of Artificial Sequence: Synthetic oligonucleotide
gggtgacacgtctgcccatgatgagttc

SEQ ID NO: 174720 - DNA, 28 bp, Artificial Sequence
  Description of Artificial Sequence: Synthetic oligonucleotide
ggtgacacgtctgcccatgatgagttcc

SEQ ID NO: 174721 - DNA, 29 bp, Artificial Sequence
  Description of Artificial Sequence: Synthetic oligonucleotide
gtgacacgtctgcccatgatgagttcctg

SEQ ID NO: 174722 - DNA, 29 bp, Artificial Sequence
  Description of Artificial Sequence: Synthetic oligonucleotide
tgacacgtctgcccatgatgagttcctgc

SEQ ID NO: 174723 - DNA, 28 bp, Artificial Sequence
  Description of Artificial Sequence: Synthetic oligonucleotide
gacacgtctgcccatgatgagttcctgc

SEQ ID NO: 174724 - DNA, 28 bp, Artificial Sequence
  Description of Artificial Sequence: Synthetic oligonucleotide
acacgtctgcccatgatgagttcctgcg

SEQ ID NO: 174725 - DNA, 27 bp, Artificial Sequence
  Description of Artificial Sequence: Synthetic oligonucleotide
cacgtctgcccatgatgagttcctgcg

SEQ ID NO: 174726 - DNA, 28 bp, Artificial Sequence
  Description of Artificial Sequence: Synthetic oligonucleotide
acgtctgcccatgatgagttcctgcgag

SEQ ID NO: 174727 - DNA, 27 bp, Artificial Sequence
  Description of Artificial Sequence: Synthetic oligonucleotide
cgtctgcccatgatgagttcctgcgag

SEQ ID NO: 174728 - DNA, 27 bp, Artificial Sequence
  Description of Artificial Sequence: Synthetic oligonucleotide
gtctgcccatgatgagttcctgcgagc

SEQ ID NO: 174729 - DNA, 28 bp, Artificial Sequence
  Description of Artificial Sequence: Synthetic oligonucleotide
tctgcccatgatgagttcctgcgagcag

SEQ ID NO: 174730 - DNA, 27 bp, Artificial Sequence
  Description of Artificial Sequence: Synthetic oligonucleotide
ctgcccatgatgagttcctgcgagcag

SEQ ID NO: 174731 - DNA, 27 bp, Artificial Sequence
  Description of Artificial Sequence: Synthetic oligonucleotide
tgcccatgatgagttcctgcgagcagc

SEQ ID NO: 174732 - DNA, 26 bp, Artificial Sequence
  Description of Artificial Sequence: Synthetic oligonucleotide
gcccatgatgagttcctgcgagcagc

SEQ ID NO: 174733 - DNA, 26 bp, Artificial Sequence
  Description of Artificial Sequence: Synthetic oligonucleotide
cccatgatgagttcctgcgagcagcg

SEQ ID NO: 174734 - DNA, 26 bp, Artificial Sequence
  Description of Artificial Sequence: Synthetic oligonucleotide
ccatgatgagttcctgcgagcagcgg

SEQ ID NO: 174735 - DNA, 26 bp, Artificial Sequence
  Description of Artificial Sequence: Synthetic oligonucleotide
catgatgagttcctgcgagcagcggg

SEQ ID NO: 174736 - DNA, 27 bp, Artificial Sequence
  Description of Artificial Sequence: Synthetic oligonucleotide
atgatgagttcctgcgagcagcgggca

SEQ ID NO: 174737 - DNA, 26 bp, Artificial Sequence
  Description of Artificial Sequence: Synthetic oligonucleotide
tgatgagttcctgcgagcagcgggca

SEQ ID NO: 174738 - DNA, 25 bp, Artificial Sequence
  Description of Artificial Sequence: Synthetic oligonucleotide
gatgagttcctgcgagcagcgggca

SEQ ID NO: 174739 - DNA, 25 bp, Artificial Sequence
  Description of Artificial Sequence: Synthetic oligonucleotide
atgagttcctgcgagcagcgggcag

SEQ ID NO: 174740 - DNA, 24 bp, Artificial Sequence
  Description of Artificial Sequence: Synthetic oligonucleotide
tgagttcctgcgagcagcgggcag

SEQ ID NO: 174741 - DNA, 23 bp, Artificial Sequence
  Description of Artificial Sequence: Synthetic oligonucleotide
gagttcctgcgagcagcgggcag

SEQ ID NO: 174742 - DNA, 23 bp, Artificial Sequence
  Description of Artificial Sequence: Synthetic oligonucleotide
agttcctgcgagcagcgggcagc

SEQ ID NO: 174743 - DNA, 27 bp, Artificial Sequence
  Description of Artificial Sequence: Synthetic oligonucleotide
ctgagtttggcccaggagcaggtagga

SEQ ID NO: 174744 - DNA, 27 bp, Artificial Sequence
  Description of Artificial Sequence: Synthetic oligonucleotide
tgagtttggcccaggagcaggtaggag

SEQ ID NO: 174745 - DNA, 26 bp, Artificial Sequence
  Description of Artificial Sequence: Synthetic oligonucleotide
gagtttggcccaggagcaggtaggag

SEQ ID NO: 174746 - DNA, 26 bp, Artificial Sequence
  Description of Artificial Sequence: Synthetic oligonucleotide
agtttggcccaggagcaggtaggagg

SEQ ID NO: 174747 - DNA, 25 bp, Artificial Sequence
  Description of Artificial Sequence: Synthetic oligonucleotide
gtttggcccaggagcaggtaggagg

SEQ ID NO: 174748 - DNA, 26 bp, Artificial Sequence
  Description of Artificial Sequence: Synthetic oligonucleotide
tttggcccaggagcaggtaggaggct

SEQ ID NO: 174749 - DNA, 25 bp, Artificial Sequence
  Description of Artificial Sequence: Synthetic oligonucleotide
ttggcccaggagcaggtaggaggct

SEQ ID NO: 174750 - DNA, 24 bp, Artificial Sequence
  Description of Artificial Sequence: Synthetic oligonucleotide
tggcccaggagcaggtaggaggct

SEQ ID NO: 174751 - DNA, 23 bp, Artificial Sequence
  Description of Artificial Sequence: Synthetic oligonucleotide
ggcccaggagcaggtaggaggct

SEQ ID NO: 174752 - DNA, 23 bp, Artificial Sequence
  Description of Artificial Sequence: Synthetic oligonucleotide
gcccaggagcaggtaggaggctc

SEQ ID NO: 174753 - DNA, 23 bp, Artificial Sequence
  Description of Artificial Sequence: Synthetic oligonucleotide
cccaggagcaggtaggaggctcg

SEQ ID NO: 174754 - DNA, 23 bp, Artificial Sequence
  Description of Artificial Sequence: Synthetic oligonucleotide
ccaggagcaggtaggaggctcgc

SEQ ID NO: 174755 - DNA, 24 bp, Artificial Sequence
  Description of Artificial Sequence: Synthetic oligonucleotide
caggagcaggtaggaggctcgcct

SEQ ID NO: 174756 - DNA, 25 bp, Artificial Sequence
  Description of Artificial Sequence: Synthetic oligonucleotide
aggagcaggtaggaggctcgcctga

SEQ ID NO: 174757 - DNA, 24 bp, Artificial Sequence
  Description of Artificial Sequence: Synthetic oligonucleotide
ggagcaggtaggaggctcgcctga

SEQ ID NO: 174758 - DNA, 27 bp, Artificial Sequence
  Description of Artificial Sequence: Synthetic oligonucleotide
gagcaggtaggaggctcgcctgagaaa

SEQ ID NO: 174759 - DNA, 27 bp, Artificial Sequence
  Description of Artificial Sequence: Synthetic oligonucleotide
agcaggtaggaggctcgcctgagaaac

SEQ ID NO: 174760 - DNA, 27 bp, Artificial Sequence
  Description of Artificial Sequence: Synthetic oligonucleotide
gcaggtaggaggctcgcctgagaaact

SEQ ID NO: 174761 - DNA, 27 bp, Artificial Sequence
  Description of Artificial Sequence: Synthetic oligonucleotide
caggtaggaggctcgcctgagaaactg

SEQ ID NO: 174762 - DNA, 27 bp, Artificial Sequence
  Description of Artificial Sequence: Synthetic oligonucleotide
aggtaggaggctcgcctgagaaactgc

SEQ ID NO: 174763 - DNA, 27 bp, Artificial Sequence
  Description of Artificial Sequence: Synthetic oligonucleotide
ggtaggaggctcgcctgagaaactgca

SEQ ID NO: 174764 - DNA, 27 bp, Artificial Sequence
  Description of Artificial Sequence: Synthetic oligonucleotide
gtaggaggctcgcctgagaaactgcag

SEQ ID NO: 174765 - DNA, 27 bp, Artificial Sequence
  Description of Artificial Sequence: Synthetic oligonucleotide
taggaggctcgcctgagaaactgcagg

SEQ ID NO: 174766 - DNA, 27 bp, Artificial Sequence
  Description of Artificial Sequence: Synthetic oligonucleotide
aggaggctcgcctgagaaactgcagga

SEQ ID NO: 174767 - DNA, 26 bp, Artificial Sequence
  Description of Artificial Sequence: Synthetic oligonucleotide
ggaggctcgcctgagaaactgcagga

SEQ ID NO: 174768 - DNA, 27 bp, Artificial Sequence
  Description of Artificial Sequence: Synthetic oligonucleotide
gaggctcgcctgagaaactgcaggaga

SEQ ID NO: 174769 - DNA, 27 bp, Artificial Sequence
  Description of Artificial Sequence: Synthetic oligonucleotide
aggctcgcctgagaaactgcaggagac

SEQ ID NO: 174770 - DNA, 22 bp, Artificial Sequence
  Description of Artificial Sequence: Synthetic oligonucleotide
gcgtgcagcagccggactgcca

SEQ ID NO: 174771 - DNA, 22 bp, Artificial Sequence
  Description of Artificial Sequence: Synthetic oligonucleotide
cgtgcagcagccggactgccag

SEQ ID NO: 174772 - DNA, 23 bp, Artificial Sequence
  Description of Artificial Sequence: Synthetic oligonucleotide
gtgcagcagccggactgccagga

SEQ ID NO: 174773 - DNA, 23 bp, Artificial Sequence
  Description of Artificial Sequence: Synthetic oligonucleotide
tgcagcagccggactgccaggag

SEQ ID NO: 174774 - DNA, 22 bp, Artificial Sequence
  Description of Artificial Sequence: Synthetic oligonucleotide
gcagcagccggactgccaggag

SEQ ID NO: 174775 - DNA, 22 bp, Artificial Sequence
  Description of Artificial Sequence: Synthetic oligonucleotide
cagcagccggactgccaggagc

SEQ ID NO: 174776 - DNA, 22 bp, Artificial Sequence
  Description of Artificial Sequence: Synthetic oligonucleotide
agcagccggactgccaggagcc

SEQ ID NO: 174777 - DNA, 21 bp, Artificial Sequence
  Description of Artificial Sequence: Synthetic oligonucleotide
gcagccggactgccaggagcc

SEQ ID NO: 174778 - DNA, 23 bp, Artificial Sequence
  Description of Artificial Sequence: Synthetic oligonucleotide
cagccggactgccaggagccctt

SEQ ID NO: 174779 - DNA, 23 bp, Artificial Sequence
  Description of Artificial Sequence: Synthetic oligonucleotide
agccggactgccaggagcccttc

SEQ ID NO: 174780 - DNA, 22 bp, Artificial Sequence
  Description of Artificial Sequence: Synthetic oligonucleotide
gccggactgccaggagcccttc

SEQ ID NO: 174781 - DNA, 23 bp, Artificial Sequence
  Description of Artificial Sequence: Synthetic oligonucleotide
ccggactgccaggagcccttcct

SEQ ID NO: 174782 - DNA, 24 bp, Artificial Sequence
  Description of Artificial Sequence: Synthetic oligonucleotide
cggactgccaggagcccttcctgt

SEQ ID NO: 174783 - DNA, 24 bp, Artificial Sequence
  Description of Artificial Sequence: Synthetic oligonucleotide
ggactgccaggagcccttcctgtc

SEQ ID NO: 174784 - DNA, 25 bp, Artificial Sequence
  Description of Artificial Sequence: Synthetic oligonucleotide
gactgccaggagcccttcctgtcct

SEQ ID NO: 174785 - DNA, 25 bp, Artificial Sequence
  Description of Artificial Sequence: Synthetic oligonucleotide
actgccaggagcccttcctgtcctg

SEQ ID NO: 174786 - DNA, 24 bp, Artificial Sequence
  Description of Artificial Sequence: Synthetic oligonucleotide
ctgccaggagcccttcctgtcctg

SEQ ID NO: 174787 - DNA, 25 bp, Artificial Sequence
  Description of Artificial Sequence: Synthetic oligonucleotide
tgccaggagcccttcctgtcctgct

SEQ ID NO: 174788 - DNA, 24 bp, Artificial Sequence
  Description of Artificial Sequence: Synthetic oligonucleotide
gccaggagcccttcctgtcctgct

SEQ ID NO: 174789 - DNA, 24 bp, Artificial Sequence
  Description of Artificial Sequence: Synthetic oligonucleotide
ccaggagcccttcctgtcctgctg

SEQ ID NO: 174790 - DNA, 24 bp, Artificial Sequence
  Description of Artificial Sequence: Synthetic oligonucleotide
caggagcccttcctgtcctgctgc

SEQ ID NO: 174791 - DNA, 27 bp, Artificial Sequence
  Description of Artificial Sequence: Synthetic oligonucleotide
aggagcccttcctgtcctgctgccaat

SEQ ID NO: 174792 - DNA, 26 bp, Artificial Sequence
  Description of Artificial Sequence: Synthetic oligonucleotide
atgaggctgctctgggggctgatctg

SEQ ID NO: 174793 - DNA, 25 bp, Artificial Sequence
  Description of Artificial Sequence: Synthetic oligonucleotide
tgaggctgctctgggggctgatctg

SEQ ID NO: 174794 - DNA, 24 bp, Artificial Sequence
  Description of Artificial Sequence: Synthetic oligonucleotide
gaggctgctctgggggctgatctg

SEQ ID NO: 174795 - DNA, 24 bp, Artificial Sequence
  Description of Artificial Sequence: Synthetic oligonucleotide
aggctgctctgggggctgatctgg

SEQ ID NO: 174796 - DNA, 23 bp, Artificial Sequence
  Description of Artificial Sequence: Synthetic oligonucleotide
ggctgctctgggggctgatctgg

SEQ ID NO: 174797 - DNA, 23 bp, Artificial Sequence
  Description of Artificial Sequence: Synthetic oligonucleotide
gctgctctgggggctgatctggg

SEQ ID NO: 174798 - DNA, 25 bp, Artificial Sequence
  Description of Artificial Sequence: Synthetic oligonucleotide
ctgctctgggggctgatctgggcat

SEQ ID NO: 174799 - DNA, 25 bp, Artificial Sequence
  Description of Artificial Sequence: Synthetic oligonucleotide
tgctctgggggctgatctgggcatc

SEQ ID NO: 174800 - DNA, 24 bp, Artificial Sequence
  Description of Artificial Sequence: Synthetic oligonucleotide
gctctgggggctgatctgggcatc

SEQ ID NO: 174801 - DNA, 25 bp, Artificial Sequence
  Description of Artificial Sequence: Synthetic oligonucleotide
ctctgggggctgatctgggcatcca

SEQ ID NO: 174802 - DNA, 25 bp, Artificial Sequence
  Description of Artificial Sequence: Synthetic oligonucleotide
tctgggggctgatctgggcatccag

SEQ ID NO: 174803 - DNA, 24 bp, Artificial Sequence
  Description of Artificial Sequence: Synthetic oligonucleotide
ctgggggctgatctgggcatccag

SEQ ID NO: 174804 - DNA, 26 bp, Artificial Sequence
  Description of Artificial Sequence: Synthetic oligonucleotide
tgggggctgatctgggcatccagctt

SEQ ID NO: 174805 - DNA, 25 bp, Artificial Sequence
  Description of Artificial Sequence: Synthetic oligonucleotide
gggggctgatctgggcatccagctt

SEQ ID NO: 174806 - DNA, 27 bp, Artificial Sequence
  Description of Artificial Sequence: Synthetic oligonucleotide
ggggctgatctgggcatccagcttctt

SEQ ID NO: 174807 - DNA, 27 bp, Artificial Sequence
  Description of Artificial Sequence: Synthetic oligonucleotide
gggctgatctgggcatccagcttcttc

SEQ ID NO: 174808 - DNA, 28 bp, Artificial Sequence
  Description of Artificial Sequence: Synthetic oligonucleotide
ggctgatctgggcatccagcttcttcac

SEQ ID NO: 174809 - DNA, 28 bp, Artificial Sequence
  Description of Artificial Sequence: Synthetic oligonucleotide
gctgatctgggcatccagcttcttcacc

SEQ ID NO: 174810 - DNA, 32 bp, Artificial Sequence
  Description of Artificial Sequence: Synthetic oligonucleotide
ctgatctgggcatccagcttcttcaccttatc

SEQ ID NO: 174811 - DNA, 33 bp, Artificial Sequence
  Description of Artificial Sequence: Synthetic oligonucleotide
tgatctgggcatccagcttcttcaccttatctc

SEQ ID NO: 174812 - DNA, 32 bp, Artificial Sequence
  Description of Artificial Sequence: Synthetic oligonucleotide
gatctgggcatccagcttcttcaccttatctc

SEQ ID NO: 174813 - DNA, 33 bp, Artificial Sequence
  Description of Artificial Sequence: Synthetic oligonucleotide
atctgggcatccagcttcttcaccttatctctg

SEQ ID NO: 174814 - DNA, 32 bp, Artificial Sequence
  Description of Artificial Sequence: Synthetic oligonucleotide
tctgggcatccagcttcttcaccttatctctg

SEQ ID NO: 174815 - DNA, 31 bp, Artificial Sequence
  Description of Artificial Sequence: Synthetic oligonucleotide
ctgggcatccagcttcttcaccttatctctg

SEQ ID NO: 174816 - DNA, 31 bp, Artificial Sequence
  Description of Artificial Sequence: Synthetic oligonucleotide
tgggcatccagcttcttcaccttatctctgc

SEQ ID NO: 174817 - DNA, 30 bp, Artificial Sequence
  Description of Artificial Sequence: Synthetic oligonucleotide
gggcatccagcttcttcaccttatctctgc

SEQ ID NO: 174818 - DNA, 31 bp, Artificial Sequence
  Description of Artificial Sequence: Synthetic oligonucleotide
ggcatccagcttcttcaccttatctctgcag

SEQ ID NO: 174819 - DNA, 33 bp, Artificial Sequence
  Description of Artificial Sequence: Synthetic oligonucleotide
gcatccagcttcttcaccttatctctgcagaag

SEQ ID NO: 174820 - DNA, 33 bp, Artificial Sequence
  Description of Artificial Sequence: Synthetic oligonucleotide
catccagcttcttcaccttatctctgcagaagc

SEQ ID NO: 174821 - DNA, 33 bp, Artificial Sequence
  Description of Artificial Sequence: Synthetic oligonucleotide
atccagcttcttcaccttatctctgcagaagcc

SEQ ID NO: 174822 - DNA, 32 bp, Artificial Sequence
  Description of Artificial Sequence: Synthetic oligonucleotide
tccagcttcttcaccttatctctgcagaagcc

SEQ ID NO: 174823 - DNA, 31 bp, Artificial Sequence
  Description of Artificial Sequence: Synthetic oligonucleotide
ccagcttcttcaccttatctctgcagaagcc

SEQ ID NO: 174824 - DNA, 31 bp, Artificial Sequence
  Description of Artificial Sequence: Synthetic oligonucleotide
cagcttcttcaccttatctctgcagaagccc

SEQ ID NO: 174825 - DNA, 32 bp, Artificial Sequence
  Description of Artificial Sequence: Synthetic oligonucleotide
agcttcttcaccttatctctgcagaagcccag

SEQ ID NO: 174826 - DNA, 31 bp, Artificial Sequence
  Description of Artificial Sequence: Synthetic oligonucleotide
gcttcttcaccttatctctgcagaagcccag

SEQ ID NO: 174827 - DNA, 31 bp, Artificial Sequence
  Description of Artificial Sequence: Synthetic oligonucleotide
cttcttcaccttatctctgcagaagcccagg

SEQ ID NO: 174828 - DNA, 33 bp, Artificial Sequence
  Description of Artificial Sequence: Synthetic oligonucleotide
ttcttcaccttatctctgcagaagcccaggttg

SEQ ID NO: 174829 - DNA, 32 bp, Artificial Sequence
  Description of Artificial Sequence: Synthetic oligonucleotide
tcttcaccttatctctgcagaagcccaggttg

SEQ ID NO: 174830 - DNA, 31 bp, Artificial Sequence
  Description of Artificial Sequence: Synthetic oligonucleotide
cttcaccttatctctgcagaagcccaggttg

SEQ ID NO: 174831 - DNA, 31 bp, Artificial Sequence
  Description of Artificial Sequence: Synthetic oligonucleotide
ttcaccttatctctgcagaagcccaggttgc

SEQ ID NO: 174832 - DNA, 30 bp, Artificial Sequence
  Description of Artificial Sequence: Synthetic oligonucleotide
tcaccttatctctgcagaagcccaggttgc

SEQ ID NO: 174833 - DNA, 29 bp, Artificial Sequence
  Description of Artificial Sequence: Synthetic oligonucleotide
caccttatctctgcagaagcccaggttgc

SEQ ID NO: 174834 - DNA, 30 bp, Artificial Sequence
  Description of Artificial Sequence: Synthetic oligonucleotide
accttatctctgcagaagcccaggttgctc

SEQ ID NO: 174835 - DNA, 29 bp, Artificial Sequence
  Description of Artificial Sequence: Synthetic oligonucleotide
ccttatctctgcagaagcccaggttgctc

SEQ ID NO: 174836 - DNA, 31 bp, Artificial Sequence
  Description of Artificial Sequence: Synthetic oligonucleotide
cttatctctgcagaagcccaggttgctcttg

SEQ ID NO: 174837 - DNA, 33 bp, Artificial Sequence
  Description of Artificial Sequence: Synthetic oligonucleotide
ttatctctgcagaagcccaggttgctcttgttc

SEQ ID NO: 174838 - DNA, 32 bp, Artificial Sequence
  Description of Artificial Sequence: Synthetic oligonucleotide
tatctctgcagaagcccaggttgctcttgttc

SEQ ID NO: 174839 - DNA, 31 bp, Artificial Sequence
  Description of Artificial Sequence: Synthetic oligonucleotide
atctctgcagaagcccaggttgctcttgttc

SEQ ID NO: 174840 - DNA, 30 bp, Artificial Sequence
  Description of Artificial Sequence: Synthetic oligonucleotide
tctctgcagaagcccaggttgctcttgttc

SEQ ID NO: 174841 - DNA, 29 bp, Artificial Sequence
  Description of Artificial Sequence: Synthetic oligonucleotide
ctctgcagaagcccaggttgctcttgttc

SEQ ID NO: 174842 - DNA, 30 bp, Artificial Sequence
  Description of Artificial Sequence: Synthetic oligonucleotide
tctgcagaagcccaggttgctcttgttctc

SEQ ID NO: 174843 - DNA, 29 bp, Artificial Sequence
  Description of Artificial Sequence: Synthetic oligonucleotide
ctgcagaagcccaggttgctcttgttctc

SEQ ID NO: 174844 - DNA, 30 bp, Artificial Sequence
  Description of Artificial Sequence: Synthetic oligonucleotide
tgcagaagcccaggttgctcttgttctctc

SEQ ID NO: 174845 - DNA, 29 bp, Artificial Sequence
  Description of Artificial Sequence: Synthetic oligonucleotide
gcagaagcccaggttgctcttgttctctc

SEQ ID NO: 174846 - DNA, 29 bp, Artificial Sequence
  Description of Artificial Sequence: Synthetic oligonucleotide
cagaagcccaggttgctcttgttctctcc

SEQ ID NO: 174847 - DNA, 31 bp, Artificial Sequence
  Description of Artificial Sequence: Synthetic oligonucleotide
agaagcccaggttgctcttgttctctccttc

SEQ ID NO: 174848 - DNA, 30 bp, Artificial Sequence
  Description of Artificial Sequence: Synthetic oligonucleotide
gaagcccaggttgctcttgttctctccttc

SEQ ID NO: 174849 - DNA, 31 bp, Artificial Sequence
  Description of Artificial Sequence: Synthetic oligonucleotide
aagcccaggttgctcttgttctctccttctg

SEQ ID NO: 174850 - DNA, 30 bp, Artificial Sequence
  Description of Artificial Sequence: Synthetic oligonucleotide
agcccaggttgctcttgttctctccttctg

SEQ ID NO: 174851 - DNA, 29 bp, Artificial Sequence
  Description of Artificial Sequence: Synthetic oligonucleotide
gcccaggttgctcttgttctctccttctg

SEQ ID NO: 174852 - DNA, 30 bp, Artificial Sequence
  Description of Artificial Sequence: Synthetic oligonucleotide
cccaggttgctcttgttctctccttctgtg

SEQ ID NO: 174853 - DNA, 30 bp, Artificial Sequence
  Description of Artificial Sequence: Synthetic oligonucleotide
ccaggttgctcttgttctctccttctgtgg

SEQ ID NO: 174854 - DNA, 32 bp, Artificial Sequence
  Description of Artificial Sequence: Synthetic oligonucleotide
caggttgctcttgttctctccttctgtggttc

SEQ ID NO: 174855 - DNA, 34 bp, Artificial Sequence
  Description of Artificial Sequence: Synthetic oligonucleotide
aggttgctcttgttctctccttctgtggttcatc

SEQ ID NO: 174856 - DNA, 33 bp, Artificial Sequence
  Description of Artificial Sequence: Synthetic oligonucleotide
ggttgctcttgttctctccttctgtggttcatc

SEQ ID NO: 174857 - DNA, 34 bp, Artificial Sequence
  Description of Artificial Sequence: Synthetic oligonucleotide
gttgctcttgttctctccttctgtggttcatctg

SEQ ID NO: 174858 - DNA, 34 bp, Artificial Sequence
  Description of Artificial Sequence: Synthetic oligonucleotide
ttgctcttgttctctccttctgtggttcatctgg

SEQ ID NO: 174859 - DNA, 33 bp, Artificial Sequence
  Description of Artificial Sequence: Synthetic oligonucleotide
tgctcttgttctctccttctgtggttcatctgg

SEQ ID NO: 174860 - DNA, 32 bp, Artificial Sequence
  Description of Artificial Sequence: Synthetic oligonucleotide
gctcttgttctctccttctgtggttcatctgg

SEQ ID NO: 174861 - DNA, 32 bp, Artificial Sequence
  Description of Artificial Sequence: Synthetic oligonucleotide
ctcttgttctctccttctgtggttcatctggg

SEQ ID NO: 174862 - DNA, 32 bp, Artificial Sequence
  Description of Artificial Sequence: Synthetic oligonucleotide
tcttgttctctccttctgtggttcatctgggg

SEQ ID NO: 174863 - DNA, 31 bp, Artificial Sequence
  Description of Artificial Sequence: Synthetic oligonucleotide
cttgttctctccttctgtggttcatctgggg

SEQ ID NO: 174864 - DNA, 31 bp, Artificial Sequence
  Description of Artificial Sequence: Synthetic oligonucleotide
ttgttctctccttctgtggttcatctggggg

SEQ ID NO: 174865 - DNA, 30 bp, Artificial Sequence
  Description of Artificial Sequence: Synthetic oligonucleotide
tgttctctccttctgtggttcatctggggg

SEQ ID NO: 174866 - DNA, 29 bp, Artificial Sequence
  Description of Artificial Sequence: Synthetic oligonucleotide
gttctctccttctgtggttcatctggggg

SEQ ID NO: 174867 - DNA, 30 bp, Artificial Sequence
  Description of Artificial Sequence: Synthetic oligonucleotide
ttctctccttctgtggttcatctgggggtc

SEQ ID NO: 174868 - DNA, 29 bp, Artificial Sequence
  Description of Artificial Sequence: Synthetic oligonucleotide
tctctccttctgtggttcatctgggggtc

SEQ ID NO: 174869 - DNA, 28 bp, Artificial Sequence
  Description of Artificial Sequence: Synthetic oligonucleotide
ctctccttctgtggttcatctgggggtc

SEQ ID NO: 174870 - DNA, 28 bp, Artificial Sequence
  Description of Artificial Sequence: Synthetic oligonucleotide
tctccttctgtggttcatctgggggtcc

SEQ ID NO: 174871 - DNA, 27 bp, Artificial Sequence
  Description of Artificial Sequence: Synthetic oligonucleotide
ctccttctgtggttcatctgggggtcc

SEQ ID NO: 174872 - DNA, 27 bp, Artificial Sequence
  Description of Artificial Sequence: Synthetic oligonucleotide
tccttctgtggttcatctgggggtccc

SEQ ID NO: 174873 - DNA, 26 bp, Artificial Sequence
  Description of Artificial Sequence: Synthetic oligonucleotide
ccttctgtggttcatctgggggtccc

SEQ ID NO: 174874 - DNA, 26 bp, Artificial Sequence
  Description of Artificial Sequence: Synthetic oligonucleotide
cttctgtggttcatctgggggtcccc

SEQ ID NO: 174875 - DNA, 27 bp, Artificial Sequence
  Description of Artificial Sequence: Synthetic oligonucleotide
ttctgtggttcatctgggggtccccct

SEQ ID NO: 174876 - DNA, 27 bp, Artificial Sequence
  Description of Artificial Sequence: Synthetic oligonucleotide
tctgtggttcatctgggggtcccccta

SEQ ID NO: 174877 - DNA, 27 bp, Artificial Sequence
  Description of Artificial Sequence: Synthetic oligonucleotide
ctgtggttcatctgggggtccccctat

SEQ ID NO: 174878 - DNA, 27 bp, Artificial Sequence
  Description of Artificial Sequence: Synthetic oligonucleotide
tgtggttcatctgggggtccccctatc

SEQ ID NO: 174879 - DNA, 26 bp, Artificial Sequence
  Description of Artificial Sequence: Synthetic oligonucleotide
gtggttcatctgggggtccccctatc

SEQ ID NO: 174880 - DNA, 26 bp, Artificial Sequence
  Description of Artificial Sequence: Synthetic oligonucleotide
tggttcatctgggggtccccctatcg

SEQ ID NO: 174881 - DNA, 25 bp, Artificial Sequence
  Description of Artificial Sequence: Synthetic oligonucleotide
ggttcatctgggggtccccctatcg

SEQ ID NO: 174882 - DNA, 26 bp, Artificial Sequence
  Description of Artificial Sequence: Synthetic oligonucleotide
gttcatctgggggtccccctatcggt

SEQ ID NO: 174883 - DNA, 26 bp, Artificial Sequence
  Description of Artificial Sequence: Synthetic oligonucleotide
ttcatctgggggtccccctatcggtg

SEQ ID NO: 174884 - DNA, 25 bp, Artificial Sequence
  Description of Artificial Sequence: Synthetic oligonucleotide
tcatctgggggtccccctatcggtg

SEQ ID NO: 174885 - DNA, 24 bp, Artificial Sequence
  Description of Artificial Sequence: Synthetic oligonucleotide
catctgggggtccccctatcggtg

SEQ ID NO: 174886 - DNA, 24 bp, Artificial Sequence
  Description of Artificial Sequence: Synthetic oligonucleotide
atctgggggtccccctatcggtgg

SEQ ID NO: 174887 - DNA, 23 bp, Artificial Sequence
  Description of Artificial Sequence: Synthetic oligonucleotide
tctgggggtccccctatcggtgg

SEQ ID NO: 174888 - DNA, 22 bp, Artificial Sequence
  Description of Artificial Sequence: Synthetic oligonucleotide
ctgggggtccccctatcggtgg

SEQ ID NO: 174889 - DNA, 22 bp, Artificial Sequence
  Description of Artificial Sequence: Synthetic oligonucleotide
tgggggtccccctatcggtggg

SEQ ID NO: 174890 - DNA, 21 bp, Artificial Sequence
  Description of Artificial Sequence: Synthetic oligonucleotide
gggggtccccctatcggtggg

SEQ ID NO: 174891 - DNA, 21 bp, Artificial Sequence
  Description of Artificial Sequence: Synthetic oligonucleotide
ggggtccccctatcggtgggg

SEQ ID NO: 174892 - DNA, 22 bp, Artificial Sequence
  Description of Artificial Sequence: Synthetic oligonucleotide
gggtccccctatcggtgggggt

SEQ ID NO: 174893 - DNA, 22 bp, Artificial Sequence
  Description of Artificial Sequence: Synthetic oligonucleotide
ggtccccctatcggtgggggtg

SEQ ID NO: 174894 - DNA, 23 bp, Artificial Sequence
  Description of Artificial Sequence: Synthetic oligonucleotide
gtccccctatcggtgggggtgca

SEQ ID NO: 174895 - DNA, 23 bp, Artificial Sequence
  Description of Artificial Sequence: Synthetic oligonucleotide
tccccctatcggtgggggtgcag

SEQ ID NO: 174896 - DNA, 22 bp, Artificial Sequence
  Description of Artificial Sequence: Synthetic oligonucleotide
ccccctatcggtgggggtgcag

SEQ ID NO: 174897 - DNA, 23 bp, Artificial Sequence
  Description of Artificial Sequence: Synthetic oligonucleotide
cccctatcggtgggggtgcagct

SEQ ID NO: 174898 - DNA, 23 bp, Artificial Sequence
  Description of Artificial Sequence: Synthetic oligonucleotide
ccctatcggtgggggtgcagctc

SEQ ID NO: 174899 - DNA, 24 bp, Artificial Sequence
  Description of Artificial Sequence: Synthetic oligonucleotide
cctatcggtgggggtgcagctcca

SEQ ID NO: 174900 - DNA, 24 bp, Artificial Sequence
  Description of Artificial Sequence: Synthetic oligonucleotide
ctatcggtgggggtgcagctccag

SEQ ID NO: 174901 - DNA, 26 bp, Artificial Sequence
  Description of Artificial Sequence: Synthetic oligonucleotide
tatcggtgggggtgcagctccaggat

SEQ ID NO: 174902 - DNA, 25 bp, Artificial Sequence
  Description of Artificial Sequence: Synthetic oligonucleotide
atcggtgggggtgcagctccaggat

SEQ ID NO: 174903 - DNA, 24 bp, Artificial Sequence
  Description of Artificial Sequence: Synthetic oligonucleotide
tcggtgggggtgcagctccaggat

SEQ ID NO: 174904 - DNA, 23 bp, Artificial Sequence
  Description of Artificial Sequence: Synthetic oligonucleotide
cggtgggggtgcagctccaggat

SEQ ID NO: 174905 - DNA, 24 bp, Artificial Sequence
  Description of Artificial Sequence: Synthetic oligonucleotide
ggtgggggtgcagctccaggatgt

SEQ ID NO: 174906 - DNA, 24 bp, Artificial Sequence
  Description of Artificial Sequence: Synthetic oligonucleotide
gtgggggtgcagctccaggatgtg

SEQ ID NO: 174907 - DNA, 24 bp, Artificial Sequence
  Description of Artificial Sequence: Synthetic oligonucleotide
tgggggtgcagctccaggatgtgc

SEQ ID NO: 174908 - DNA, 23 bp, Artificial Sequence
  Description of Artificial Sequence: Synthetic oligonucleotide
gggggtgcagctccaggatgtgc

SEQ ID NO: 174909 - DNA, 23 bp, Artificial Sequence
  Description of Artificial Sequence: Synthetic oligonucleotide
ggggtgcagctccaggatgtgcc

SEQ ID NO: 174910 - DNA, 23 bp, Artificial Sequence
  Description of Artificial Sequence: Synthetic oligonucleotide
gggtgcagctccaggatgtgccc

SEQ ID NO: 174911 - DNA, 23 bp, Artificial Sequence
  Description of Artificial Sequence: Synthetic oligonucleotide
ggtgcagctccaggatgtgcccc

SEQ ID NO: 174912 - DNA, 24 bp, Artificial Sequence
  Description of Artificial Sequence: Synthetic oligonucleotide
gtgcagctccaggatgtgccccga

SEQ ID NO: 174913 - DNA, 24 bp, Artificial Sequence
  Description of Artificial Sequence: Synthetic oligonucleotide
tgcagctccaggatgtgccccgag

SEQ ID NO: 174914 - DNA, 23 bp, Artificial Sequence
  Description of Artificial Sequence: Synthetic oligonucleotide
gcagctccaggatgtgccccgag

SEQ ID NO: 174915 - DNA, 24 bp, Artificial Sequence
  Description of Artificial Sequence: Synthetic oligonucleotide
cagctccaggatgtgccccgagga

SEQ ID NO: 174916 - DNA, 25 bp, Artificial Sequence
  Description of Artificial Sequence: Synthetic oligonucleotide
agctccaggatgtgccccgaggaca

SEQ ID NO: 174917 - DNA, 24 bp, Artificial Sequence
  Description of Artificial Sequence: Synthetic oligonucleotide
gctccaggatgtgccccgaggaca

SEQ ID NO: 174918 - DNA, 24 bp, Artificial Sequence
  Description of Artificial Sequence: Synthetic oligonucleotide
ctccaggatgtgccccgaggacag

SEQ ID NO: 174919 - DNA, 26 bp, Artificial Sequence
  Description of Artificial Sequence: Synthetic oligonucleotide
tccaggatgtgccccgaggacaggta

SEQ ID NO: 174920 - DNA, 25 bp, Artificial Sequence
  Description of Artificial Sequence: Synthetic oligonucleotide
ccaggatgtgccccgaggacaggta

SEQ ID NO: 174921 - DNA, 26 bp, Artificial Sequence
  Description of Artificial Sequence: Synthetic oligonucleotide
caggatgtgccccgaggacaggtagt

SEQ ID NO: 174922 - DNA, 27 bp, Artificial Sequence
  Description of Artificial Sequence: Synthetic oligonucleotide
aggatgtgccccgaggacaggtagtga

SEQ ID NO: 174923 - DNA, 27 bp, Artificial Sequence
  Description of Artificial Sequence: Synthetic oligonucleotide
ggatgtgccccgaggacaggtagtgaa

SEQ ID NO: 174924 - DNA, 28 bp, Artificial Sequence
  Description of Artificial Sequence: Synthetic oligonucleotide
gatgtgccccgaggacaggtagtgaaag

SEQ ID NO: 174925 - DNA, 28 bp, Artificial Sequence
  Description of Artificial Sequence: Synthetic oligonucleotide
atgtgccccgaggacaggtagtgaaagg

SEQ ID NO: 174926 - DNA, 27 bp, Artificial Sequence
  Description of Artificial Sequence: Synthetic oligonucleotide
tgtgccccgaggacaggtagtgaaagg

SEQ ID NO: 174927 - DNA, 27 bp, Artificial Sequence
  Description of Artificial Sequence: Synthetic oligonucleotide
gtgccccgaggacaggtagtgaaagga

SEQ ID NO: 174928 - DNA, 28 bp, Artificial Sequence
  Description of Artificial Sequence: Synthetic oligonucleotide
tgccccgaggacaggtagtgaaaggatc

SEQ ID NO: 174929 - DNA, 27 bp, Artificial Sequence
  Description of Artificial Sequence: Synthetic oligonucleotide
gccccgaggacaggtagtgaaaggatc

SEQ ID NO: 174930 - DNA, 28 bp, Artificial Sequence
  Description of Artificial Sequence: Synthetic oligonucleotide
ccccgaggacaggtagtgaaaggatcag

SEQ ID NO: 174931 - DNA, 29 bp, Artificial Sequence
  Description of Artificial Sequence: Synthetic oligonucleotide
cccgaggacaggtagtgaaaggatcagtg

SEQ ID NO: 174932 - DNA, 31 bp, Artificial Sequence
  Description of Artificial Sequence: Synthetic oligonucleotide
ccgaggacaggtagtgaaaggatcagtgttc

SEQ ID NO: 174933 - DNA, 31 bp, Artificial Sequence
  Description of Artificial Sequence: Synthetic oligonucleotide
cgaggacaggtagtgaaaggatcagtgttcc

SEQ ID NO: 174934 - DNA, 32 bp, Artificial Sequence
  Description of Artificial Sequence: Synthetic oligonucleotide
gaggacaggtagtgaaaggatcagtgttcctg

SEQ ID NO: 174935 - DNA, 33 bp, Artificial Sequence
  Description of Artificial Sequence: Synthetic oligonucleotide
aggacaggtagtgaaaggatcagtgttcctgag

SEQ ID NO: 174936 - DNA, 32 bp, Artificial Sequence
  Description of Artificial Sequence: Synthetic oligonucleotide
ggacaggtagtgaaaggatcagtgttcctgag

SEQ ID NO: 174937 - DNA, 35 bp, Artificial Sequence
  Description of Artificial Sequence: Synthetic oligonucleotide
gacaggtagtgaaaggatcagtgttcctgagaaac

SEQ ID NO: 174938 - DNA, 35 bp, Artificial Sequence
  Description of Artificial Sequence: Synthetic oligonucleotide
acaggtagtgaaaggatcagtgttcctgagaaacc

SEQ ID NO: 174939 - DNA, 34 bp, Artificial Sequence
  Description of Artificial Sequence: Synthetic oligonucleotide
caggtagtgaaaggatcagtgttcctgagaaacc

SEQ ID NO: 174940 - DNA, 34 bp, Artificial Sequence
  Description of Artificial Sequence: Synthetic oligonucleotide
aggtagtgaaaggatcagtgttcctgagaaaccc

SEQ ID NO: 174941 - DNA, 33 bp, Artificial Sequence
  Description of Artificial Sequence: Synthetic oligonucleotide
ggtagtgaaaggatcagtgttcctgagaaaccc

SEQ ID NO: 174942 - DNA, 35 bp, Artificial Sequence
  Description of Artificial Sequence: Synthetic oligonucleotide
gtagtgaaaggatcagtgttcctgagaaacccatc

SEQ ID NO: 174943 - DNA, 36 bp, Artificial Sequence
  Description of Artificial Sequence: Synthetic oligonucleotide
tagtgaaaggatcagtgttcctgagaaacccatctc

SEQ ID NO: 174944 - DNA, 35 bp, Artificial Sequence
  Description of Artificial Sequence: Synthetic oligonucleotide
agtgaaaggatcagtgttcctgagaaacccatctc

SEQ ID NO: 174945 - DNA, 34 bp, Artificial Sequence
  Description of Artificial Sequence: Synthetic oligonucleotide
gtgaaaggatcagtgttcctgagaaacccatctc

SEQ ID NO: 174946 - DNA, 34 bp, Artificial Sequence
  Description of Artificial Sequence: Synthetic oligonucleotide
tgaaaggatcagtgttcctgagaaacccatctcg

SEQ ID NO: 174947 - DNA, 33 bp, Artificial Sequence
  Description of Artificial Sequence: Synthetic oligonucleotide
gaaaggatcagtgttcctgagaaacccatctcg

SEQ ID NO: 174948 - DNA, 40 bp, Artificial Sequence
  Description of Artificial Sequence: Synthetic oligonucleotide
aaaggatcagtgttcctgagaaacccatctcgtaataatg

SEQ ID NO: 174949 - DNA, 39 bp, Artificial Sequence
  Description of Artificial Sequence: Synthetic oligonucleotide
aaggatcagtgttcctgagaaacccatctcgtaataatg

SEQ ID NO: 174950 - DNA, 38 bp, Artificial Sequence
  Description of Artificial Sequence: Synthetic oligonucleotide
aggatcagtgttcctgagaaacccatctcgtaataatg

SEQ ID NO: 174951 - DNA, 37 bp, Artificial Sequence
  Description of Artificial Sequence: Synthetic oligonucleotide
ggatcagtgttcctgagaaacccatctcgtaataatg

SEQ ID NO: 174952 - DNA, 38 bp, Artificial Sequence
  Description of Artificial Sequence: Synthetic oligonucleotide
gatcagtgttcctgagaaacccatctcgtaataatgtc

SEQ ID NO: 174953 - DNA, 38 bp, Artificial Sequence
  Description of Artificial Sequence: Synthetic oligonucleotide
atcagtgttcctgagaaacccatctcgtaataatgtcc

SEQ ID NO: 174954 - DNA, 37 bp, Artificial Sequence
  Description of Artificial Sequence: Synthetic oligonucleotide
tcagtgttcctgagaaacccatctcgtaataatgtcc

SEQ ID NO: 174955 - DNA, 36 bp, Artificial Sequence
  Description of Artificial Sequence: Synthetic oligonucleotide
cagtgttcctgagaaacccatctcgtaataatgtcc

SEQ ID NO: 174956 - DNA, 36 bp, Artificial Sequence
  Description of Artificial Sequence: Synthetic oligonucleotide
agtgttcctgagaaacccatctcgtaataatgtccc

SEQ ID NO: 174957 - DNA, 35 bp, Artificial Sequence
  Description of Artificial Sequence: Synthetic oligonucleotide
gtgttcctgagaaacccatctcgtaataatgtccc

SEQ ID NO: 174958 - DNA, 35 bp, Artificial Sequence
  Description of Artificial Sequence: Synthetic oligonucleotide
tgttcctgagaaacccatctcgtaataatgtcccc

SEQ ID NO: 174959 - DNA, 34 bp, Artificial Sequence
  Description of Artificial Sequence: Synthetic oligonucleotide
gttcctgagaaacccatctcgtaataatgtcccc

SEQ ID NO: 174960 - DNA, 35 bp, Artificial Sequence
  Description of Artificial Sequence: Synthetic oligonucleotide
ttcctgagaaacccatctcgtaataatgtcccctg

SEQ ID NO: 174961 - DNA, 34 bp, Artificial Sequence
  Description of Artificial Sequence: Synthetic oligonucleotide
tcctgagaaacccatctcgtaataatgtcccctg

SEQ ID NO: 174962 - DNA, 33 bp, Artificial Sequence
  Description of Artificial Sequence: Synthetic oligonucleotide
cctgagaaacccatctcgtaataatgtcccctg

SEQ ID NO: 174963 - DNA, 33 bp, Artificial Sequence
  Description of Artificial Sequence: Synthetic oligonucleotide
ctgagaaacccatctcgtaataatgtcccctgc

SEQ ID NO: 174964 - DNA, 34 bp, Artificial Sequence
  Description of Artificial Sequence: Synthetic oligonucleotide
tgagaaacccatctcgtaataatgtcccctgctc

SEQ ID NO: 174965 - DNA, 33 bp, Artificial Sequence
  Description of Artificial Sequence: Synthetic oligonucleotide
gagaaacccatctcgtaataatgtcccctgctc

SEQ ID NO: 174966 - DNA, 33 bp, Artificial Sequence
  Description of Artificial Sequence: Synthetic oligonucleotide
agaaacccatctcgtaataatgtcccctgctcc

SEQ ID NO: 174967 - DNA, 32 bp, Artificial Sequence
  Description of Artificial Sequence: Synthetic oligonucleotide
gaaacccatctcgtaataatgtcccctgctcc

SEQ ID NO: 174968 - DNA, 32 bp, Artificial Sequence
  Description of Artificial Sequence: Synthetic oligonucleotide
aaacccatctcgtaataatgtcccctgctccc

SEQ ID NO: 174969 - DNA, 31 bp, Artificial Sequence
  Description of Artificial Sequence: Synthetic oligonucleotide
aacccatctcgtaataatgtcccctgctccc

SEQ ID NO: 174970 - DNA, 30 bp, Artificial Sequence
  Description of Artificial Sequence: Synthetic oligonucleotide
acccatctcgtaataatgtcccctgctccc

SEQ ID NO: 174971 - DNA, 29 bp, Artificial Sequence
  Description of Artificial Sequence: Synthetic oligonucleotide
cccatctcgtaataatgtcccctgctccc

SEQ ID NO: 174972 - DNA, 29 bp, Artificial Sequence
  Description of Artificial Sequence: Synthetic oligonucleotide
ccatctcgtaataatgtcccctgctcccc

SEQ ID NO: 174973 - DNA, 32 bp, Artificial Sequence
  Description of Artificial Sequence: Synthetic oligonucleotide
catctcgtaataatgtcccctgctccccaaag

SEQ ID NO: 174974 - DNA, 32 bp, Artificial Sequence
  Description of Artificial Sequence: Synthetic oligonucleotide
atctcgtaataatgtcccctgctccccaaagg

SEQ ID NO: 174975 - DNA, 31 bp, Artificial Sequence
  Description of Artificial Sequence: Synthetic oligonucleotide
tctcgtaataatgtcccctgctccccaaagg

SEQ ID NO: 174976 - DNA, 30 bp, Artificial Sequence
  Description of Artificial Sequence: Synthetic oligonucleotide
ctcgtaataatgtcccctgctccccaaagg

SEQ ID NO: 174977 - DNA, 31 bp, Artificial Sequence
  Description of Artificial Sequence: Synthetic oligonucleotide
tcgtaataatgtcccctgctccccaaaggtg

SEQ ID NO: 174978 - DNA, 30 bp, Artificial Sequence
  Description of Artificial Sequence: Synthetic oligonucleotide
cgtaataatgtcccctgctccccaaaggtg

SEQ ID NO: 174979 - DNA, 30 bp, Artificial Sequence
  Description of Artificial Sequence: Synthetic oligonucleotide
gtaataatgtcccctgctccccaaaggtgg

SEQ ID NO: 174980 - DNA, 31 bp, Artificial Sequence
  Description of Artificial Sequence: Synthetic oligonucleotide
taataatgtcccctgctccccaaaggtggac

SEQ ID NO: 174981 - DNA, 30 bp, Artificial Sequence
  Description of Artificial Sequence: Synthetic oligonucleotide
aataatgtcccctgctccccaaaggtggac

SEQ ID NO: 174982 - DNA, 29 bp, Artificial Sequence
  Description of Artificial Sequence: Synthetic oligonucleotide
ataatgtcccctgctccccaaaggtggac

SEQ ID NO: 174983 - DNA, 28 bp, Artificial Sequence
  Description of Artificial Sequence: Synthetic oligonucleotide
taatgtcccctgctccccaaaggtggac

SEQ ID NO: 174984 - DNA, 27 bp, Artificial Sequence
  Description of Artificial Sequence: Synthetic oligonucleotide
aatgtcccctgctccccaaaggtggac

SEQ ID NO: 174985 - DNA, 27 bp, Artificial Sequence
  Description of Artificial Sequence: Synthetic oligonucleotide
atgtcccctgctccccaaaggtggact

SEQ ID NO: 174986 - DNA, 27 bp, Artificial Sequence
  Description of Artificial Sequence: Synthetic oligonucleotide
tgtcccctgctccccaaaggtggactt

SEQ ID NO: 174987 - DNA, 26 bp, Artificial Sequence
  Description of Artificial Sequence: Synthetic oligonucleotide
gtcccctgctccccaaaggtggactt

SEQ ID NO: 174988 - DNA, 27 bp, Artificial Sequence
  Description of Artificial Sequence: Synthetic oligonucleotide
tcccctgctccccaaaggtggacttca

SEQ ID NO: 174989 - DNA, 26 bp, Artificial Sequence
  Description of Artificial Sequence: Synthetic oligonucleotide
cccctgctccccaaaggtggacttca

SEQ ID NO: 174990 - DNA, 26 bp, Artificial Sequence
  Description of Artificial Sequence: Synthetic oligonucleotide
ccctgctccccaaaggtggacttcac

SEQ ID NO: 174991 - DNA, 26 bp, Artificial Sequence
  Description of Artificial Sequence: Synthetic oligonucleotide
cctgctccccaaaggtggacttcacc

SEQ ID NO: 174992 - DNA, 27 bp, Artificial Sequence
  Description of Artificial Sequence: Synthetic oligonucleotide
ctgctccccaaaggtggacttcaccct

SEQ ID NO: 174993 - DNA, 29 bp, Artificial Sequence
  Description of Artificial Sequence: Synthetic oligonucleotide
tgctccccaaaggtggacttcacccttag

SEQ ID NO: 174994 - DNA, 28 bp, Artificial Sequence
  Description of Artificial Sequence: Synthetic oligonucleotide
gctccccaaaggtggacttcacccttag

SEQ ID NO: 174995 - DNA, 28 bp, Artificial Sequence
  Description of Artificial Sequence: Synthetic oligonucleotide
ctccccaaaggtggacttcacccttagc

SEQ ID NO: 174996 - DNA, 29 bp, Artificial Sequence
  Description of Artificial Sequence: Synthetic oligonucleotide
tccccaaaggtggacttcacccttagctc

SEQ ID NO: 174997 - DNA, 28 bp, Artificial Sequence
  Description of Artificial Sequence: Synthetic oligonucleotide
ccccaaaggtggacttcacccttagctc

SEQ ID NO: 174998 - DNA, 29 bp, Artificial Sequence
  Description of Artificial Sequence: Synthetic oligonucleotide
cccaaaggtggacttcacccttagctcag

SEQ ID NO: 174999 - DNA, 32 bp, Artificial Sequence
  Description of Artificial Sequence: Synthetic oligonucleotide
ccaaaggtggacttcacccttagctcagaaag

SEQ ID NO: 175000 - DNA, 33 bp, Artificial Sequence
  Description of Artificial Sequence: Synthetic oligonucleotide
caaaggtggacttcacccttagctcagaaagag

SEQ ID NO: 175001 - DNA, 34 bp, Artificial Sequence
  Description of Artificial Sequence: Synthetic oligonucleotide
aaaggtggacttcacccttagctcagaaagagac

SEQ ID NO: 175002 - DNA, 33 bp, Artificial Sequence
  Description of Artificial Sequence: Synthetic oligonucleotide
aaggtggacttcacccttagctcagaaagagac

SEQ ID NO: 175003 - DNA, 32 bp, Artificial Sequence
  Description of Artificial Sequence: Synthetic oligonucleotide
aggtggacttcacccttagctcagaaagagac

SEQ ID NO: 175004 - DNA, 31 bp, Artificial Sequence
  Description of Artificial Sequence: Synthetic oligonucleotide
ggtggacttcacccttagctcagaaagagac

SEQ ID NO: 175005 - DNA, 33 bp, Artificial Sequence
  Description of Artificial Sequence: Synthetic oligonucleotide
gtggacttcacccttagctcagaaagagacttc

SEQ ID NO: 175006 - DNA, 33 bp, Artificial Sequence
  Description of Artificial Sequence: Synthetic oligonucleotide
tggacttcacccttagctcagaaagagacttcg

SEQ ID NO: 175007 - DNA, 32 bp, Artificial Sequence
  Description of Artificial Sequence: Synthetic oligonucleotide
ggacttcacccttagctcagaaagagacttcg

SEQ ID NO: 175008 - DNA, 32 bp, Artificial Sequence
  Description of Artificial Sequence: Synthetic oligonucleotide
gacttcacccttagctcagaaagagacttcgc

SEQ ID NO: 175009 - DNA, 33 bp, Artificial Sequence
  Description of Artificial Sequence: Synthetic oligonucleotide
acttcacccttagctcagaaagagacttcgcac

SEQ ID NO: 175010 - DNA, 32 bp, Artificial Sequence
  Description of Artificial Sequence: Synthetic oligonucleotide
cttcacccttagctcagaaagagacttcgcac

SEQ ID NO: 175011 - DNA, 33 bp, Artificial Sequence
  Description of Artificial Sequence: Synthetic oligonucleotide
ttcacccttagctcagaaagagacttcgcactc

SEQ ID NO: 175012 - DNA, 32 bp, Artificial Sequence
  Description of Artificial Sequence: Synthetic oligonucleotide
tcacccttagctcagaaagagacttcgcactc

SEQ ID NO: 175013 - DNA, 31 bp, Artificial Sequence
  Description of Artificial Sequence: Synthetic oligonucleotide
cacccttagctcagaaagagacttcgcactc

SEQ ID NO: 175014 - DNA, 31 bp, Artificial Sequence
  Description of Artificial Sequence: Synthetic oligonucleotide
acccttagctcagaaagagacttcgcactcc

SEQ ID NO: 175015 - DNA, 30 bp, Artificial Sequence
  Description of Artificial Sequence: Synthetic oligonucleotide
cccttagctcagaaagagacttcgcactcc

SEQ ID NO: 175016 - DNA, 31 bp, Artificial Sequence
  Description of Artificial Sequence: Synthetic oligonucleotide
ccttagctcagaaagagacttcgcactcctc

SEQ ID NO: 175017 - DNA, 32 bp, Artificial Sequence
  Description of Artificial Sequence: Synthetic oligonucleotide
cttagctcagaaagagacttcgcactcctcag

SEQ ID NO: 175018 - DNA, 33 bp, Artificial Sequence
  Description of Artificial Sequence: Synthetic oligonucleotide
ttagctcagaaagagacttcgcactcctcagtc

SEQ ID NO: 175019 - DNA, 32 bp, Artificial Sequence
  Description of Artificial Sequence: Synthetic oligonucleotide
tagctcagaaagagacttcgcactcctcagtc

SEQ ID NO: 175020 - DNA, 31 bp, Artificial Sequence
  Description of Artificial Sequence: Synthetic oligonucleotide
agctcagaaagagacttcgcactcctcagtc

SEQ ID NO: 175021 - DNA, 30 bp, Artificial Sequence
  Description of Artificial Sequence: Synthetic oligonucleotide
gctcagaaagagacttcgcactcctcagtc

SEQ ID NO: 175022 - DNA, 31 bp, Artificial Sequence
  Description of Artificial Sequence: Synthetic oligonucleotide
ctcagaaagagacttcgcactcctcagtctc

SEQ ID NO: 175023 - DNA, 31 bp, Artificial Sequence
  Description of Artificial Sequence: Synthetic oligonucleotide
tcagaaagagacttcgcactcctcagtctcc

SEQ ID NO: 175024 - DNA, 30 bp, Artificial Sequence
  Description of Artificial Sequence: Synthetic oligonucleotide
cagaaagagacttcgcactcctcagtctcc

SEQ ID NO: 175025 - DNA, 31 bp, Artificial Sequence
  Description of Artificial Sequence: Synthetic oligonucleotide
agaaagagacttcgcactcctcagtctccag

SEQ ID NO: 175026 - DNA, 30 bp, Artificial Sequence
  Description of Artificial Sequence: Synthetic oligonucleotide
gaaagagacttcgcactcctcagtctccag

SEQ ID NO: 175027 - DNA, 30 bp, Artificial Sequence
  Description of Artificial Sequence: Synthetic oligonucleotide
aaagagacttcgcactcctcagtctccagg

SEQ ID NO: 175028 - DNA, 29 bp, Artificial Sequence
  Description of Artificial Sequence: Synthetic oligonucleotide
aagagacttcgcactcctcagtctccagg

SEQ ID NO: 175029 - DNA, 28 bp, Artificial Sequence
  Description of Artificial Sequence: Synthetic oligonucleotide
agagacttcgcactcctcagtctccagg

SEQ ID NO: 175030 - DNA, 27 bp, Artificial Sequence
  Description of Artificial Sequence: Synthetic oligonucleotide
gagacttcgcactcctcagtctccagg

SEQ ID NO: 175031 - DNA, 28 bp, Artificial Sequence
  Description of Artificial Sequence: Synthetic oligonucleotide
agacttcgcactcctcagtctccaggtg

SEQ ID NO: 175032 - DNA, 27 bp, Artificial Sequence
  Description of Artificial Sequence: Synthetic oligonucleotide
gacttcgcactcctcagtctccaggtg

SEQ ID NO: 175033 - DNA, 27 bp, Artificial Sequence
  Description of Artificial Sequence: Synthetic oligonucleotide
acttcgcactcctcagtctccaggtgc

SEQ ID NO: 175034 - DNA, 26 bp, Artificial Sequence
  Description of Artificial Sequence: Synthetic oligonucleotide
cttcgcactcctcagtctccaggtgc

SEQ ID NO: 175035 - DNA, 26 bp, Artificial Sequence
  Description of Artificial Sequence: Synthetic oligonucleotide
ttcgcactcctcagtctccaggtgcc

SEQ ID NO: 175036 - DNA, 25 bp, Artificial Sequence
  Description of Artificial Sequence: Synthetic oligonucleotide
tcgcactcctcagtctccaggtgcc

SEQ ID NO: 175037 - DNA, 24 bp, Artificial Sequence
  Description of Artificial Sequence: Synthetic oligonucleotide
cgcactcctcagtctccaggtgcc

SEQ ID NO: 175038 - DNA, 26 bp, Artificial Sequence
  Description of Artificial Sequence: Synthetic oligonucleotide
gcactcctcagtctccaggtgccctt

SEQ ID NO: 175039 - DNA, 27 bp, Artificial Sequence
  Description of Artificial Sequence: Synthetic oligonucleotide
cactcctcagtctccaggtgcccttga

SEQ ID NO: 175040 - DNA, 29 bp, Artificial Sequence
  Description of Artificial Sequence: Synthetic oligonucleotide
actcctcagtctccaggtgcccttgaaag

SEQ ID NO: 175041 - DNA, 28 bp, Artificial Sequence
  Description of Artificial Sequence: Synthetic oligonucleotide
ctcctcagtctccaggtgcccttgaaag

SEQ ID NO: 175042 - DNA, 30 bp, Artificial Sequence
  Description of Artificial Sequence: Synthetic oligonucleotide
tcctcagtctccaggtgcccttgaaagatg

SEQ ID NO: 175043 - DNA, 29 bp, Artificial Sequence
  Description of Artificial Sequence: Synthetic oligonucleotide
cctcagtctccaggtgcccttgaaagatg

SEQ ID NO: 175044 - DNA, 29 bp, Artificial Sequence
  Description of Artificial Sequence: Synthetic oligonucleotide
ctcagtctccaggtgcccttgaaagatgc

SEQ ID NO: 175045 - DNA, 29 bp, Artificial Sequence
  Description of Artificial Sequence: Synthetic oligonucleotide
tcagtctccaggtgcccttgaaagatgcg

SEQ ID NO: 175046 - DNA, 28 bp, Artificial Sequence
  Description of Artificial Sequence: Synthetic oligonucleotide
cagtctccaggtgcccttgaaagatgcg

SEQ ID NO: 175047 - DNA, 30 bp, Artificial Sequence
  Description of Artificial Sequence: Synthetic oligonucleotide
agtctccaggtgcccttgaaagatgcgaag

SEQ ID NO: 175048 - DNA, 29 bp, Artificial Sequence
  Description of Artificial Sequence: Synthetic oligonucleotide
gtctccaggtgcccttgaaagatgcgaag

SEQ ID NO: 175049 - DNA, 30 bp, Artificial Sequence
  Description of Artificial Sequence: Synthetic oligonucleotide
tctccaggtgcccttgaaagatgcgaagag

SEQ ID NO: 175050 - DNA, 29 bp, Artificial Sequence
  Description of Artificial Sequence: Synthetic oligonucleotide
ctccaggtgcccttgaaagatgcgaagag

SEQ ID NO: 175051 - DNA, 29 bp, Artificial Sequence
  Description of Artificial Sequence: Synthetic oligonucleotide
tccaggtgcccttgaaagatgcgaagagc

SEQ ID NO: 175052 - DNA, 28 bp, Artificial Sequence
  Description of Artificial Sequence: Synthetic oligonucleotide
ccaggtgcccttgaaagatgcgaagagc

SEQ ID NO: 175053 - DNA, 29 bp, Artificial Sequence
  Description of Artificial Sequence: Synthetic oligonucleotide
caggtgcccttgaaagatgcgaagagctg

SEQ ID NO: 175054 - DNA, 30 bp, Artificial Sequence
  Description of Artificial Sequence: Synthetic oligonucleotide
aggtgcccttgaaagatgcgaagagctgtg

SEQ ID NO: 175055 - DNA, 29 bp, Artificial Sequence
  Description of Artificial Sequence: Synthetic oligonucleotide
ggtgcccttgaaagatgcgaagagctgtg

SEQ ID NO: 175056 - DNA, 29 bp, Artificial Sequence
  Description of Artificial Sequence: Synthetic oligonucleotide
gtgcccttgaaagatgcgaagagctgtgg

SEQ ID NO: 175057 - DNA, 29 bp, Artificial Sequence
  Description of Artificial Sequence: Synthetic oligonucleotide
tgcccttgaaagatgcgaagagctgtggc

SEQ ID NO: 175058 - DNA, 28 bp, Artificial Sequence
  Description of Artificial Sequence: Synthetic oligonucleotide
gcccttgaaagatgcgaagagctgtggc

SEQ ID NO: 175059 - DNA, 28 bp, Artificial Sequence
  Description of Artificial Sequence: Synthetic oligonucleotide
cccttgaaagatgcgaagagctgtggcc

SEQ ID NO: 175060 - DNA, 29 bp, Artificial Sequence
  Description of Artificial Sequence: Synthetic oligonucleotide
ccttgaaagatgcgaagagctgtggcctc

SEQ ID NO: 175061 - DNA, 29 bp, Artificial Sequence
  Description of Artificial Sequence: Synthetic oligonucleotide
cttgaaagatgcgaagagctgtggcctcc

SEQ ID NO: 175062 - DNA, 31 bp, Artificial Sequence
  Description of Artificial Sequence: Synthetic oligonucleotide
ttgaaagatgcgaagagctgtggcctccatc

SEQ ID NO: 175063 - DNA, 30 bp, Artificial Sequence
  Description of Artificial Sequence: Synthetic oligonucleotide
tgaaagatgcgaagagctgtggcctccatc

SEQ ID NO: 175064 - DNA, 29 bp, Artificial Sequence
  Description of Artificial Sequence: Synthetic oligonucleotide
gaaagatgcgaagagctgtggcctccatc

SEQ ID NO: 175065 - DNA, 31 bp, Artificial Sequence
  Description of Artificial Sequence: Synthetic oligonucleotide
aaagatgcgaagagctgtggcctccatcaac

SEQ ID NO: 175066 - DNA, 30 bp, Artificial Sequence
  Description of Artificial Sequence: Synthetic oligonucleotide
aagatgcgaagagctgtggcctccatcaac

SEQ ID NO: 175067 - DNA, 29 bp, Artificial Sequence
  Description of Artificial Sequence: Synthetic oligonucleotide
agatgcgaagagctgtggcctccatcaac

SEQ ID NO: 175068 - DNA, 28 bp, Artificial Sequence
  Description of Artificial Sequence: Synthetic oligonucleotide
gatgcgaagagctgtggcctccatcaac

SEQ ID NO: 175069 - DNA, 29 bp, Artificial Sequence
  Description of Artificial Sequence: Synthetic oligonucleotide
atgcgaagagctgtggcctccatcaactc

SEQ ID NO: 175070 - DNA, 28 bp, Artificial Sequence
  Description of Artificial Sequence: Synthetic oligonucleotide
tgcgaagagctgtggcctccatcaactc

SEQ ID NO: 175071 - DNA, 27 bp, Artificial Sequence
  Description of Artificial Sequence: Synthetic oligonucleotide
gcgaagagctgtggcctccatcaactc

SEQ ID NO: 175072 - DNA, 27 bp, Artificial Sequence
  Description of Artificial Sequence: Synthetic oligonucleotide
cgaagagctgtggcctccatcaactcc

SEQ ID NO: 175073 - DNA, 28 bp, Artificial Sequence
  Description of Artificial Sequence: Synthetic oligonucleotide
gaagagctgtggcctccatcaactcctc

SEQ ID NO: 175074 - DNA, 29 bp, Artificial Sequence
  Description of Artificial Sequence: Synthetic oligonucleotide
aagagctgtggcctccatcaactcctcag

SEQ ID NO: 175075 - DNA, 28 bp, Artificial Sequence
  Description of Artificial Sequence: Synthetic oligonucleotide
agagctgtggcctccatcaactcctcag

SEQ ID NO: 175076 - DNA, 27 bp, Artificial Sequence
  Description of Artificial Sequence: Synthetic oligonucleotide
gagctgtggcctccatcaactcctcag

SEQ ID NO: 175077 - DNA, 28 bp, Artificial Sequence
  Description of Artificial Sequence: Synthetic oligonucleotide
agctgtggcctccatcaactcctcagag

SEQ ID NO: 175078 - DNA, 27 bp, Artificial Sequence
  Description of Artificial Sequence: Synthetic oligonucleotide
gctgtggcctccatcaactcctcagag

SEQ ID NO: 175079 - DNA, 27 bp, Artificial Sequence
  Description of Artificial Sequence: Synthetic oligonucleotide
ctgtggcctccatcaactcctcagagg

SEQ ID NO: 175080 - DNA, 27 bp, Artificial Sequence
  Description of Artificial Sequence: Synthetic oligonucleotide
tgtggcctccatcaactcctcagaggc

SEQ ID NO: 175081 - DNA, 26 bp, Artificial Sequence
  Description of Artificial Sequence: Synthetic oligonucleotide
gtggcctccatcaactcctcagaggc

SEQ ID NO: 175082 - DNA, 26 bp, Artificial Sequence
  Description of Artificial Sequence: Synthetic oligonucleotide
tggcctccatcaactcctcagaggcc

SEQ ID NO: 175083 - DNA, 25 bp, Artificial Sequence
  Description of Artificial Sequence: Synthetic oligonucleotide
ggcctccatcaactcctcagaggcc

SEQ ID NO: 175084 - DNA, 26 bp, Artificial Sequence
  Description of Artificial Sequence: Synthetic oligonucleotide
gcctccatcaactcctcagaggccct

SEQ ID NO: 175085 - DNA, 27 bp, Artificial Sequence
  Description of Artificial Sequence: Synthetic oligonucleotide
cctccatcaactcctcagaggccctga

SEQ ID NO: 175086 - DNA, 27 bp, Artificial Sequence
  Description of Artificial Sequence: Synthetic oligonucleotide
ctccatcaactcctcagaggccctgag

SEQ ID NO: 175087 - DNA, 27 bp, Artificial Sequence
  Description of Artificial Sequence: Synthetic oligonucleotide
tccatcaactcctcagaggccctgagg

SEQ ID NO: 175088 - DNA, 27 bp, Artificial Sequence
  Description of Artificial Sequence: Synthetic oligonucleotide
ccatcaactcctcagaggccctgaggt

SEQ ID NO: 175089 - DNA, 27 bp, Artificial Sequence
  Description of Artificial Sequence: Synthetic oligonucleotide
catcaactcctcagaggccctgaggtc

SEQ ID NO: 175090 - DNA, 27 bp, Artificial Sequence
  Description of Artificial Sequence: Synthetic oligonucleotide
atcaactcctcagaggccctgaggtcc

SEQ ID NO: 175091 - DNA, 27 bp, Artificial Sequence
  Description of Artificial Sequence: Synthetic oligonucleotide
tcaactcctcagaggccctgaggtcca

SEQ ID NO: 175092 - DNA, 26 bp, Artificial Sequence
  Description of Artificial Sequence: Synthetic oligonucleotide
caactcctcagaggccctgaggtcca

SEQ ID NO: 175093 - DNA, 26 bp, Artificial Sequence
  Description of Artificial Sequence: Synthetic oligonucleotide
aactcctcagaggccctgaggtccag

SEQ ID NO: 175094 - DNA, 25 bp, Artificial Sequence
  Description of Artificial Sequence: Synthetic oligonucleotide
actcctcagaggccctgaggtccag

SEQ ID NO: 175095 - DNA, 24 bp, Artificial Sequence
  Description of Artificial Sequence: Synthetic oligonucleotide
ctcctcagaggccctgaggtccag

SEQ ID NO: 175096 - DNA, 25 bp, Artificial Sequence
  Description of Artificial Sequence: Synthetic oligonucleotide
tcctcagaggccctgaggtccagct

SEQ ID NO: 175097 - DNA, 24 bp, Artificial Sequence
  Description of Artificial Sequence: Synthetic oligonucleotide
cctcagaggccctgaggtccagct

SEQ ID NO: 175098 - DNA, 24 bp, Artificial Sequence
  Description of Artificial Sequence: Synthetic oligonucleotide
ctcagaggccctgaggtccagctg

SEQ ID NO: 175099 - DNA, 25 bp, Artificial Sequence
  Description of Artificial Sequence: Synthetic oligonucleotide
tcagaggccctgaggtccagctggt

SEQ ID NO: 175100 - DNA, 24 bp, Artificial Sequence
  Description of Artificial Sequence: Synthetic oligonucleotide
cagaggccctgaggtccagctggt

SEQ ID NO: 175101 - DNA, 24 bp, Artificial Sequence
  Description of Artificial Sequence: Synthetic oligonucleotide
agaggccctgaggtccagctggtg

SEQ ID NO: 175102 - DNA, 23 bp, Artificial Sequence
  Description of Artificial Sequence: Synthetic oligonucleotide
gaggccctgaggtccagctggtg

SEQ ID NO: 175103 - DNA, 23 bp, Artificial Sequence
  Description of Artificial Sequence: Synthetic oligonucleotide
aggccctgaggtccagctggtgg

SEQ ID NO: 175104 - DNA, 22 bp, Artificial Sequence
  Description of Artificial Sequence: Synthetic oligonucleotide
ggccctgaggtccagctggtgg

SEQ ID NO: 175105 - DNA, 22 bp, Artificial Sequence
  Description of Artificial Sequence: Synthetic oligonucleotide
gccctgaggtccagctggtggc

SEQ ID NO: 175106 - DNA, 22 bp, Artificial Sequence
  Description of Artificial Sequence: Synthetic oligonucleotide
ccctgaggtccagctggtggcc

SEQ ID NO: 175107 - DNA, 25 bp, Artificial Sequence
  Description of Artificial Sequence: Synthetic oligonucleotide
cctgaggtccagctggtggcccatt

SEQ ID NO: 175108 - DNA, 25 bp, Artificial Sequence
  Description of Artificial Sequence: Synthetic oligonucleotide
ctgaggtccagctggtggcccattc

SEQ ID NO: 175109 - DNA, 25 bp, Artificial Sequence
  Description of Artificial Sequence: Synthetic oligonucleotide
tgaggtccagctggtggcccattcg

SEQ ID NO: 175110 - DNA, 24 bp, Artificial Sequence
  Description of Artificial Sequence: Synthetic oligonucleotide
gaggtccagctggtggcccattcg

SEQ ID NO: 175111 - DNA, 24 bp, Artificial Sequence
  Description of Artificial Sequence: Synthetic oligonucleotide
aggtccagctggtggcccattcgc

SEQ ID NO: 175112 - DNA, 23 bp, Artificial Sequence
  Description of Artificial Sequence: Synthetic oligonucleotide
ggtccagctggtggcccattcgc

SEQ ID NO: 175113 - DNA, 25 bp, Artificial Sequence
  Description of Artificial Sequence: Synthetic oligonucleotide
gtccagctggtggcccattcgccat

SEQ ID NO: 175114 - DNA, 25 bp, Artificial Sequence
  Description of Artificial Sequence: Synthetic oligonucleotide
tccagctggtggcccattcgccatg

SEQ ID NO: 175115 - DNA, 24 bp, Artificial Sequence
  Description of Artificial Sequence: Synthetic oligonucleotide
ccagctggtggcccattcgccatg

SEQ ID NO: 175116 - DNA, 24 bp, Artificial Sequence
  Description of Artificial Sequence: Synthetic oligonucleotide
cagctggtggcccattcgccatgg

SEQ ID NO: 175117 - DNA, 27 bp, Artificial Sequence
  Description of Artificial Sequence: Synthetic oligonucleotide
agctggtggcccattcgccatggctaa

SEQ ID NO: 175118 - DNA, 27 bp, Artificial Sequence
  Description of Artificial Sequence: Synthetic oligonucleotide
gctggtggcccattcgccatggctaaa

SEQ ID NO: 175119 - DNA, 27 bp, Artificial Sequence
  Description of Artificial Sequence: Synthetic oligonucleotide
ctggtggcccattcgccatggctaaag

SEQ ID NO: 175120 - DNA, 27 bp, Artificial Sequence
  Description of Artificial Sequence: Synthetic oligonucleotide
tggtggcccattcgccatggctaaagg

SEQ ID NO: 175121 - DNA, 27 bp, Artificial Sequence
  Description of Artificial Sequence: Synthetic oligonucleotide
ggtggcccattcgccatggctaaagga

SEQ ID NO: 175122 - DNA, 27 bp, Artificial Sequence
  Description of Artificial Sequence: Synthetic oligonucleotide
gtggcccattcgccatggctaaaggac

SEQ ID NO: 175123 - DNA, 28 bp, Artificial Sequence
  Description of Artificial Sequence: Synthetic oligonucleotide
tggcccattcgccatggctaaaggactc

SEQ ID NO: 175124 - DNA, 27 bp, Artificial Sequence
  Description of Artificial Sequence: Synthetic oligonucleotide
ggcccattcgccatggctaaaggactc

SEQ ID NO: 175125 - DNA, 28 bp, Artificial Sequence
  Description of Artificial Sequence: Synthetic oligonucleotide
gcccattcgccatggctaaaggactctc

SEQ ID NO: 175126 - DNA, 29 bp, Artificial Sequence
  Description of Artificial Sequence: Synthetic oligonucleotide
cccattcgccatggctaaaggactctctg

SEQ ID NO: 175127 - DNA, 30 bp, Artificial Sequence
  Description of Artificial Sequence: Synthetic oligonucleotide
ccattcgccatggctaaaggactctctgtc

SEQ ID NO: 175128 - DNA, 30 bp, Artificial Sequence
  Description of Artificial Sequence: Synthetic oligonucleotide
cattcgccatggctaaaggactctctgtcc

SEQ ID NO: 175129 - DNA, 31 bp, Artificial Sequence
  Description of Artificial Sequence: Synthetic oligonucleotide
attcgccatggctaaaggactctctgtccag

SEQ ID NO: 175130 - DNA, 30 bp, Artificial Sequence
  Description of Artificial Sequence: Synthetic oligonucleotide
ttcgccatggctaaaggactctctgtccag

SEQ ID NO: 175131 - DNA, 29 bp, Artificial Sequence
  Description of Artificial Sequence: Synthetic oligonucleotide
tcgccatggctaaaggactctctgtccag

SEQ ID NO: 175132 - DNA, 28 bp, Artificial Sequence
  Description of Artificial Sequence: Synthetic oligonucleotide
cgccatggctaaaggactctctgtccag

SEQ ID NO: 175133 - DNA, 30 bp, Artificial Sequence
  Description of Artificial Sequence: Synthetic oligonucleotide
gccatggctaaaggactctctgtccagaac

SEQ ID NO: 175134 - DNA, 30 bp, Artificial Sequence
  Description of Artificial Sequence: Synthetic oligonucleotide
ccatggctaaaggactctctgtccagaacg

SEQ ID NO: 175135 - DNA, 31 bp, Artificial Sequence
  Description of Artificial Sequence: Synthetic oligonucleotide
catggctaaaggactctctgtccagaacgac

SEQ ID NO: 175136 - DNA, 34 bp, Artificial Sequence
  Description of Artificial Sequence: Synthetic oligonucleotide
atggctaaaggactctctgtccagaacgacaaac

SEQ ID NO: 175137 - DNA, 33 bp, Artificial Sequence
  Description of Artificial Sequence: Synthetic oligonucleotide
tggctaaaggactctctgtccagaacgacaaac

SEQ ID NO: 175138 - DNA, 32 bp, Artificial Sequence
  Description of Artificial Sequence: Synthetic oligonucleotide
ggctaaaggactctctgtccagaacgacaaac

SEQ ID NO: 175139 - DNA, 34 bp, Artificial Sequence
  Description of Artificial Sequence: Synthetic oligonucleotide
gctaaaggactctctgtccagaacgacaaacatc

SEQ ID NO: 175140 - DNA, 34 bp, Artificial Sequence
  Description of Artificial Sequence: Synthetic oligonucleotide
ctaaaggactctctgtccagaacgacaaacatcc

SEQ ID NO: 175141 - DNA, 35 bp, Artificial Sequence
  Description of Artificial Sequence: Synthetic oligonucleotide
taaaggactctctgtccagaacgacaaacatccag

SEQ ID NO: 175142 - DNA, 34 bp, Artificial Sequence
  Description of Artificial Sequence: Synthetic oligonucleotide
aaaggactctctgtccagaacgacaaacatccag

SEQ ID NO: 175143 - DNA, 33 bp, Artificial Sequence
  Description of Artificial Sequence: Synthetic oligonucleotide
aaggactctctgtccagaacgacaaacatccag

SEQ ID NO: 175144 - DNA, 32 bp, Artificial Sequence
  Description of Artificial Sequence: Synthetic oligonucleotide
aggactctctgtccagaacgacaaacatccag

SEQ ID NO: 175145 - DNA, 31 bp, Artificial Sequence
  Description of Artificial Sequence: Synthetic oligonucleotide
ggactctctgtccagaacgacaaacatccag

SEQ ID NO: 175146 - DNA, 31 bp, Artificial Sequence
  Description of Artificial Sequence: Synthetic oligonucleotide
gactctctgtccagaacgacaaacatccagg

SEQ ID NO: 175147 - DNA, 31 bp, Artificial Sequence
  Description of Artificial Sequence: Synthetic oligonucleotide
actctctgtccagaacgacaaacatccaggg

SEQ ID NO: 175148 - DNA, 30 bp, Artificial Sequence
  Description of Artificial Sequence: Synthetic oligonucleotide
ctctctgtccagaacgacaaacatccaggg

SEQ ID NO: 175149 - DNA, 33 bp, Artificial Sequence
  Description of Artificial Sequence: Synthetic oligonucleotide
tctctgtccagaacgacaaacatccagggtatc

SEQ ID NO: 175150 - DNA, 32 bp, Artificial Sequence
  Description of Artificial Sequence: Synthetic oligonucleotide
ctctgtccagaacgacaaacatccagggtatc

SEQ ID NO: 175151 - DNA, 34 bp, Artificial Sequence
  Description of Artificial Sequence: Synthetic oligonucleotide
tctgtccagaacgacaaacatccagggtatcaac

SEQ ID NO: 175152 - DNA, 33 bp, Artificial Sequence
  Description of Artificial Sequence: Synthetic oligonucleotide
ctgtccagaacgacaaacatccagggtatcaac

SEQ ID NO: 175153 - DNA, 33 bp, Artificial Sequence
  Description of Artificial Sequence: Synthetic oligonucleotide
tgtccagaacgacaaacatccagggtatcaacc

SEQ ID NO: 175154 - DNA, 32 bp, Artificial Sequence
  Description of Artificial Sequence: Synthetic oligonucleotide
gtccagaacgacaaacatccagggtatcaacc

SEQ ID NO: 175155 - DNA, 33 bp, Artificial Sequence
  Description of Artificial Sequence: Synthetic oligonucleotide
tccagaacgacaaacatccagggtatcaacctg

SEQ ID NO: 175156 - DNA, 32 bp, Artificial Sequence
  Description of Artificial Sequence: Synthetic oligonucleotide
ccagaacgacaaacatccagggtatcaacctg

SEQ ID NO: 175157 - DNA, 32 bp, Artificial Sequence
  Description of Artificial Sequence: Synthetic oligonucleotide
cagaacgacaaacatccagggtatcaacctgc

SEQ ID NO: 175158 - DNA, 33 bp, Artificial Sequence
  Description of Artificial Sequence: Synthetic oligonucleotide
agaacgacaaacatccagggtatcaacctgctc

SEQ ID NO: 175159 - DNA, 32 bp, Artificial Sequence
  Description of Artificial Sequence: Synthetic oligonucleotide
gaacgacaaacatccagggtatcaacctgctc

SEQ ID NO: 175160 - DNA, 34 bp, Artificial Sequence
  Description of Artificial Sequence: Synthetic oligonucleotide
aacgacaaacatccagggtatcaacctgctcttc

SEQ ID NO: 175161 - DNA, 33 bp, Artificial Sequence
  Description of Artificial Sequence: Synthetic oligonucleotide
acgacaaacatccagggtatcaacctgctcttc

SEQ ID NO: 175162 - DNA, 32 bp, Artificial Sequence
  Description of Artificial Sequence: Synthetic oligonucleotide
cgacaaacatccagggtatcaacctgctcttc

SEQ ID NO: 175163 - DNA, 33 bp, Artificial Sequence
  Description of Artificial Sequence: Synthetic oligonucleotide
gacaaacatccagggtatcaacctgctcttctc

SEQ ID NO: 175164 - DNA, 33 bp, Artificial Sequence
  Description of Artificial Sequence: Synthetic oligonucleotide
acaaacatccagggtatcaacctgctcttctcc

SEQ ID NO: 175165 - DNA, 32 bp, Artificial Sequence
  Description of Artificial Sequence: Synthetic oligonucleotide
caaacatccagggtatcaacctgctcttctcc

SEQ ID NO: 175166 - DNA, 33 bp, Artificial Sequence
  Description of Artificial Sequence: Synthetic oligonucleotide
aaacatccagggtatcaacctgctcttctcctc

SEQ ID NO: 175167 - DNA, 32 bp, Artificial Sequence
  Description of Artificial Sequence: Synthetic oligonucleotide
aacatccagggtatcaacctgctcttctcctc

SEQ ID NO: 175168 - DNA, 31 bp, Artificial Sequence
  Description of Artificial Sequence: Synthetic oligonucleotide
acatccagggtatcaacctgctcttctcctc

SEQ ID NO: 175169 - DNA, 30 bp, Artificial Sequence
  Description of Artificial Sequence: Synthetic oligonucleotide
catccagggtatcaacctgctcttctcctc

SEQ ID NO: 175170 - DNA, 31 bp, Artificial Sequence
  Description of Artificial Sequence: Synthetic oligonucleotide
atccagggtatcaacctgctcttctcctctc

SEQ ID NO: 175171 - DNA, 30 bp, Artificial Sequence
  Description of Artificial Sequence: Synthetic oligonucleotide
tccagggtatcaacctgctcttctcctctc

SEQ ID NO: 175172 - DNA, 29 bp, Artificial Sequence
  Description of Artificial Sequence: Synthetic oligonucleotide
ccagggtatcaacctgctcttctcctctc

SEQ ID NO: 175173 - DNA, 29 bp, Artificial Sequence
  Description of Artificial Sequence: Synthetic oligonucleotide
cagggtatcaacctgctcttctcctctcg

SEQ ID NO: 175174 - DNA, 29 bp, Artificial Sequence
  Description of Artificial Sequence: Synthetic oligonucleotide
agggtatcaacctgctcttctcctctcgc

SEQ ID NO: 175175 - DNA, 28 bp, Artificial Sequence
  Description of Artificial Sequence: Synthetic oligonucleotide
gggtatcaacctgctcttctcctctcgc

SEQ ID NO: 175176 - DNA, 28 bp, Artificial Sequence
  Description of Artificial Sequence: Synthetic oligonucleotide
ggtatcaacctgctcttctcctctcgcc

SEQ ID NO: 175177 - DNA, 28 bp, Artificial Sequence
  Description of Artificial Sequence: Synthetic oligonucleotide
gtatcaacctgctcttctcctctcgccg

SEQ ID NO: 175178 - DNA, 28 bp, Artificial Sequence
  Description of Artificial Sequence: Synthetic oligonucleotide
tatcaacctgctcttctcctctcgccgg

SEQ ID NO: 175179 - DNA, 27 bp, Artificial Sequence
  Description of Artificial Sequence: Synthetic oligonucleotide
atcaacctgctcttctcctctcgccgg

SEQ ID NO: 175180 - DNA, 26 bp, Artificial Sequence
  Description of Artificial Sequence: Synthetic oligonucleotide
tcaacctgctcttctcctctcgccgg

SEQ ID NO: 175181 - DNA, 25 bp, Artificial Sequence
  Description of Artificial Sequence: Synthetic oligonucleotide
caacctgctcttctcctctcgccgg

SEQ ID NO: 175182 - DNA, 25 bp, Artificial Sequence
  Description of Artificial Sequence: Synthetic oligonucleotide
aacctgctcttctcctctcgccggg

SEQ ID NO: 175183 - DNA, 24 bp, Artificial Sequence
  Description of Artificial Sequence: Synthetic oligonucleotide
acctgctcttctcctctcgccggg

SEQ ID NO: 175184 - DNA, 23 bp, Artificial Sequence
  Description of Artificial Sequence: Synthetic oligonucleotide
cctgctcttctcctctcgccggg

SEQ ID NO: 175185 - DNA, 23 bp, Artificial Sequence
  Description of Artificial Sequence: Synthetic oligonucleotide
ctgctcttctcctctcgccgggg

SEQ ID NO: 175186 - DNA, 23 bp, Artificial Sequence
  Description of Artificial Sequence: Synthetic oligonucleotide
tgctcttctcctctcgccggggg

SEQ ID NO: 175187 - DNA, 22 bp, Artificial Sequence
  Description of Artificial Sequence: Synthetic oligonucleotide
gctcttctcctctcgccggggg

SEQ ID NO: 175188 - DNA, 23 bp, Artificial Sequence
  Description of Artificial Sequence: Synthetic oligonucleotide
ctcttctcctctcgccgggggca

SEQ ID NO: 175189 - DNA, 23 bp, Artificial Sequence
  Description of Artificial Sequence: Synthetic oligonucleotide
tcttctcctctcgccgggggcac

SEQ ID NO: 175190 - DNA, 22 bp, Artificial Sequence
  Description of Artificial Sequence: Synthetic oligonucleotide
cttctcctctcgccgggggcac

SEQ ID NO: 175191 - DNA, 23 bp, Artificial Sequence
  Description of Artificial Sequence: Synthetic oligonucleotide
ttctcctctcgccgggggcacct

SEQ ID NO: 175192 - DNA, 22 bp, Artificial Sequence
  Description of Artificial Sequence: Synthetic oligonucleotide
tctcctctcgccgggggcacct

SEQ ID NO: 175193 - DNA, 21 bp, Artificial Sequence
  Description of Artificial Sequence: Synthetic oligonucleotide
ctcctctcgccgggggcacct

SEQ ID NO: 175194 - DNA, 26 bp, Artificial Sequence
  Description of Artificial Sequence: Synthetic oligonucleotide
tcctctcgccgggggcacctcttttt

SEQ ID NO: 175195 - DNA, 25 bp, Artificial Sequence
  Description of Artificial Sequence: Synthetic oligonucleotide
cctctcgccgggggcacctcttttt

SEQ ID NO: 175196 - DNA, 25 bp, Artificial Sequence
  Description of Artificial Sequence: Synthetic oligonucleotide
ctctcgccgggggcacctctttttg

SEQ ID NO: 175197 - DNA, 26 bp, Artificial Sequence
  Description of Artificial Sequence: Synthetic oligonucleotide
tctcgccgggggcacctctttttgca

SEQ ID NO: 175198 - DNA, 25 bp, Artificial Sequence
  Description of Artificial Sequence: Synthetic oligonucleotide
ctcgccgggggcacctctttttgca

SEQ ID NO: 175199 - DNA, 26 bp, Artificial Sequence
  Description of Artificial Sequence: Synthetic oligonucleotide
tcgccgggggcacctctttttgcaga

SEQ ID NO: 175200 - DNA, 25 bp, Artificial Sequence
  Description of Artificial Sequence: Synthetic oligonucleotide
cgccgggggcacctctttttgcaga

SEQ ID NO: 175201 - DNA, 25 bp, Artificial Sequence
  Description of Artificial Sequence: Synthetic oligonucleotide
gccgggggcacctctttttgcagac

SEQ ID NO: 175202 - DNA, 25 bp, Artificial Sequence
  Description of Artificial Sequence: Synthetic oligonucleotide
ccgggggcacctctttttgcagacg

SEQ ID NO: 175203 - DNA, 26 bp, Artificial Sequence
  Description of Artificial Sequence: Synthetic oligonucleotide
cgggggcacctctttttgcagacgga

SEQ ID NO: 175204 - DNA, 26 bp, Artificial Sequence
  Description of Artificial Sequence: Synthetic oligonucleotide
gggggcacctctttttgcagacggac

SEQ ID NO: 175205 - DNA, 27 bp, Artificial Sequence
  Description of Artificial Sequence: Synthetic oligonucleotide
ggggcacctctttttgcagacggacca

SEQ ID NO: 175206 - DNA, 27 bp, Artificial Sequence
  Description of Artificial Sequence: Synthetic oligonucleotide
gggcacctctttttgcagacggaccag

SEQ ID NO: 175207 - DNA, 27 bp, Artificial Sequence
  Description of Artificial Sequence: Synthetic oligonucleotide
ggcacctctttttgcagacggaccagc

SEQ ID NO: 175208 - DNA, 27 bp, Artificial Sequence
  Description of Artificial Sequence: Synthetic oligonucleotide
gcacctctttttgcagacggaccagcc

SEQ ID NO: 175209 - DNA, 27 bp, Artificial Sequence
  Description of Artificial Sequence: Synthetic oligonucleotide
cacctctttttgcagacggaccagccc

SEQ ID NO: 175210 - DNA, 32 bp, Artificial Sequence
  Description of Artificial Sequence: Synthetic oligonucleotide
acctctttttgcagacggaccagcccatttac

SEQ ID NO: 175211 - DNA, 31 bp, Artificial Sequence
  Description of Artificial Sequence: Synthetic oligonucleotide
cctctttttgcagacggaccagcccatttac

SEQ ID NO: 175212 - DNA, 33 bp, Artificial Sequence
  Description of Artificial Sequence: Synthetic oligonucleotide
ctctttttgcagacggaccagcccatttacaac

SEQ ID NO: 175213 - DNA, 33 bp, Artificial Sequence
  Description of Artificial Sequence: Synthetic oligonucleotide
tctttttgcagacggaccagcccatttacaacc

SEQ ID NO: 175214 - DNA, 32 bp, Artificial Sequence
  Description of Artificial Sequence: Synthetic oligonucleotide
ctttttgcagacggaccagcccatttacaacc

SEQ ID NO: 175215 - DNA, 32 bp, Artificial Sequence
  Description of Artificial Sequence: Synthetic oligonucleotide
tttttgcagacggaccagcccatttacaaccc

SEQ ID NO: 175216 - DNA, 31 bp, Artificial Sequence
  Description of Artificial Sequence: Synthetic oligonucleotide
ttttgcagacggaccagcccatttacaaccc

SEQ ID NO: 175217 - DNA, 30 bp, Artificial Sequence
  Description of Artificial Sequence: Synthetic oligonucleotide
tttgcagacggaccagcccatttacaaccc

SEQ ID NO: 175218 - DNA, 29 bp, Artificial Sequence
  Description of Artificial Sequence: Synthetic oligonucleotide
ttgcagacggaccagcccatttacaaccc

SEQ ID NO: 175219 - DNA, 28 bp, Artificial Sequence
  Description of Artificial Sequence: Synthetic oligonucleotide
tgcagacggaccagcccatttacaaccc

SEQ ID NO: 175220 - DNA, 27 bp, Artificial Sequence
  Description of Artificial Sequence: Synthetic oligonucleotide
gcagacggaccagcccatttacaaccc

SEQ ID NO: 175221 - DNA, 28 bp, Artificial Sequence
  Description of Artificial Sequence: Synthetic oligonucleotide
cagacggaccagcccatttacaaccctg

SEQ ID NO: 175222 - DNA, 28 bp, Artificial Sequence
  Description of Artificial Sequence: Synthetic oligonucleotide
agacggaccagcccatttacaaccctgg

SEQ ID NO: 175223 - DNA, 27 bp, Artificial Sequence
  Description of Artificial Sequence: Synthetic oligonucleotide
gacggaccagcccatttacaaccctgg

SEQ ID NO: 175224 - DNA, 27 bp, Artificial Sequence
  Description of Artificial Sequence: Synthetic oligonucleotide
acggaccagcccatttacaaccctggc

SEQ ID NO: 175225 - DNA, 26 bp, Artificial Sequence
  Description of Artificial Sequence: Synthetic oligonucleotide
cggaccagcccatttacaaccctggc

SEQ ID NO: 175226 - DNA, 27 bp, Artificial Sequence
  Description of Artificial Sequence: Synthetic oligonucleotide
ggaccagcccatttacaaccctggcca

SEQ ID NO: 175227 - DNA, 27 bp, Artificial Sequence
  Description of Artificial Sequence: Synthetic oligonucleotide
gaccagcccatttacaaccctggccag

SEQ ID NO: 175228 - DNA, 27 bp, Artificial Sequence
  Description of Artificial Sequence: Synthetic oligonucleotide
accagcccatttacaaccctggccagc

SEQ ID NO: 175229 - DNA, 26 bp, Artificial Sequence
  Description of Artificial Sequence: Synthetic oligonucleotide
ccagcccatttacaaccctggccagc

SEQ ID NO: 175230 - DNA, 26 bp, Artificial Sequence
  Description of Artificial Sequence: Synthetic oligonucleotide
cagcccatttacaaccctggccagcg

SEQ ID NO: 175231 - DNA, 26 bp, Artificial Sequence
  Description of Artificial Sequence: Synthetic oligonucleotide
agcccatttacaaccctggccagcgg

SEQ ID NO: 175232 - DNA, 25 bp, Artificial Sequence
  Description of Artificial Sequence: Synthetic oligonucleotide
gcccatttacaaccctggccagcgg

SEQ ID NO: 175233 - DNA, 27 bp, Artificial Sequence
  Description of Artificial Sequence: Synthetic oligonucleotide
cccatttacaaccctggccagcgggtt

SEQ ID NO: 175234 - DNA, 27 bp, Artificial Sequence
  Description of Artificial Sequence: Synthetic oligonucleotide
ccatttacaaccctggccagcgggttc

SEQ ID NO: 175235 - DNA, 27 bp, Artificial Sequence
  Description of Artificial Sequence: Synthetic oligonucleotide
catttacaaccctggccagcgggttcg

SEQ ID NO: 175236 - DNA, 27 bp, Artificial Sequence
  Description of Artificial Sequence: Synthetic oligonucleotide
atttacaaccctggccagcgggttcgg

SEQ ID NO: 175237 - DNA, 27 bp, Artificial Sequence
  Description of Artificial Sequence: Synthetic oligonucleotide
tttacaaccctggccagcgggttcggt

SEQ ID NO: 175238 - DNA, 27 bp, Artificial Sequence
  Description of Artificial Sequence: Synthetic oligonucleotide
ttacaaccctggccagcgggttcggta

SEQ ID NO: 175239 - DNA, 26 bp, Artificial Sequence
  Description of Artificial Sequence: Synthetic oligonucleotide
tacaaccctggccagcgggttcggta

SEQ ID NO: 175240 - DNA, 25 bp, Artificial Sequence
  Description of Artificial Sequence: Synthetic oligonucleotide
acaaccctggccagcgggttcggta

SEQ ID NO: 175241 - DNA, 24 bp, Artificial Sequence
  Description of Artificial Sequence: Synthetic oligonucleotide
caaccctggccagcgggttcggta

SEQ ID NO: 175242 - DNA, 24 bp, Artificial Sequence
  Description of Artificial Sequence: Synthetic oligonucleotide
aaccctggccagcgggttcggtac

SEQ ID NO: 175243 - DNA, 23 bp, Artificial Sequence
  Description of Artificial Sequence: Synthetic oligonucleotide
accctggccagcgggttcggtac

SEQ ID NO: 175244 - DNA, 22 bp, Artificial Sequence
  Description of Artificial Sequence: Synthetic oligonucleotide
ccctggccagcgggttcggtac

SEQ ID NO: 175245 - DNA, 22 bp, Artificial Sequence
  Description of Artificial Sequence: Synthetic oligonucleotide
cctggccagcgggttcggtacc

SEQ ID NO: 175246 - DNA, 22 bp, Artificial Sequence
  Description of Artificial Sequence: Synthetic oligonucleotide
ctggccagcgggttcggtaccg

SEQ ID NO: 175247 - DNA, 22 bp, Artificial Sequence
  Description of Artificial Sequence: Synthetic oligonucleotide
tggccagcgggttcggtaccgg

SEQ ID NO: 175248 - DNA, 21 bp, Artificial Sequence
  Description of Artificial Sequence: Synthetic oligonucleotide
ggccagcgggttcggtaccgg

SEQ ID NO: 175249 - DNA, 22 bp, Artificial Sequence
  Description of Artificial Sequence: Synthetic oligonucleotide
gccagcgggttcggtaccgggt

SEQ ID NO: 175250 - DNA, 25 bp, Artificial Sequence
  Description of Artificial Sequence: Synthetic oligonucleotide
ccagcgggttcggtaccgggtcttt

SEQ ID NO: 175251 - DNA, 25 bp, Artificial Sequence
  Description of Artificial Sequence: Synthetic oligonucleotide
cagcgggttcggtaccgggtctttg

SEQ ID NO: 175252 - DNA, 26 bp, Artificial Sequence
  Description of Artificial Sequence: Synthetic oligonucleotide
agcgggttcggtaccgggtctttgct

SEQ ID NO: 175253 - DNA, 25 bp, Artificial Sequence
  Description of Artificial Sequence: Synthetic oligonucleotide
gcgggttcggtaccgggtctttgct

SEQ ID NO: 175254 - DNA, 26 bp, Artificial Sequence
  Description of Artificial Sequence: Synthetic oligonucleotide
cgggttcggtaccgggtctttgctct

SEQ ID NO: 175255 - DNA, 26 bp, Artificial Sequence
  Description of Artificial Sequence: Synthetic oligonucleotide
gggttcggtaccgggtctttgctctg

SEQ ID NO: 175256 - DNA, 27 bp, Artificial Sequence
  Description of Artificial Sequence: Synthetic oligonucleotide
ggttcggtaccgggtctttgctctgga

SEQ ID NO: 175257 - DNA, 28 bp, Artificial Sequence
  Description of Artificial Sequence: Synthetic oligonucleotide
gttcggtaccgggtctttgctctggatc

SEQ ID NO: 175258 - DNA, 29 bp, Artificial Sequence
  Description of Artificial Sequence: Synthetic oligonucleotide
ttcggtaccgggtctttgctctggatcag

SEQ ID NO: 175259 - DNA, 28 bp, Artificial Sequence
  Description of Artificial Sequence: Synthetic oligonucleotide
tcggtaccgggtctttgctctggatcag

SEQ ID NO: 175260 - DNA, 27 bp, Artificial Sequence
  Description of Artificial Sequence: Synthetic oligonucleotide
cggtaccgggtctttgctctggatcag

SEQ ID NO: 175261 - DNA, 29 bp, Artificial Sequence
  Description of Artificial Sequence: Synthetic oligonucleotide
ggtaccgggtctttgctctggatcagaag

SEQ ID NO: 175262 - DNA, 31 bp, Artificial Sequence
  Description of Artificial Sequence: Synthetic oligonucleotide
gtaccgggtctttgctctggatcagaagatg

SEQ ID NO: 175263 - DNA, 31 bp, Artificial Sequence
  Description of Artificial Sequence: Synthetic oligonucleotide
taccgggtctttgctctggatcagaagatgc

SEQ ID NO: 175264 - DNA, 30 bp, Artificial Sequence
  Description of Artificial Sequence: Synthetic oligonucleotide
accgggtctttgctctggatcagaagatgc

SEQ ID NO: 175265 - DNA, 29 bp, Artificial Sequence
  Description of Artificial Sequence: Synthetic oligonucleotide
ccgggtctttgctctggatcagaagatgc

SEQ ID NO: 175266 - DNA, 29 bp, Artificial Sequence
  Description of Artificial Sequence: Synthetic oligonucleotide
cgggtctttgctctggatcagaagatgcg

SEQ ID NO: 175267 - DNA, 29 bp, Artificial Sequence
  Description of Artificial Sequence: Synthetic oligonucleotide
gggtctttgctctggatcagaagatgcgc

SEQ ID NO: 175268 - DNA, 29 bp, Artificial Sequence
  Description of Artificial Sequence: Synthetic oligonucleotide
ggtctttgctctggatcagaagatgcgcc

SEQ ID NO: 175269 - DNA, 29 bp, Artificial Sequence
  Description of Artificial Sequence: Synthetic oligonucleotide
gtctttgctctggatcagaagatgcgccc

SEQ ID NO: 175270 - DNA, 29 bp, Artificial Sequence
  Description of Artificial Sequence: Synthetic oligonucleotide
tctttgctctggatcagaagatgcgcccg

SEQ ID NO: 175271 - DNA, 28 bp, Artificial Sequence
  Description of Artificial Sequence: Synthetic oligonucleotide
ctttgctctggatcagaagatgcgcccg

SEQ ID NO: 175272 - DNA, 29 bp, Artificial Sequence
  Description of Artificial Sequence: Synthetic oligonucleotide
tttgctctggatcagaagatgcgcccgag

SEQ ID NO: 175273 - DNA, 28 bp, Artificial Sequence
  Description of Artificial Sequence: Synthetic oligonucleotide
ttgctctggatcagaagatgcgcccgag

SEQ ID NO: 175274 - DNA, 27 bp, Artificial Sequence
  Description of Artificial Sequence: Synthetic oligonucleotide
tgctctggatcagaagatgcgcccgag

SEQ ID NO: 175275 - DNA, 26 bp, Artificial Sequence
  Description of Artificial Sequence: Synthetic oligonucleotide
gctctggatcagaagatgcgcccgag

SEQ ID NO: 175276 - DNA, 27 bp, Artificial Sequence
  Description of Artificial Sequence: Synthetic oligonucleotide
ctctggatcagaagatgcgcccgagca

SEQ ID NO: 175277 - DNA, 27 bp, Artificial Sequence
  Description of Artificial Sequence: Synthetic oligonucleotide
tctggatcagaagatgcgcccgagcac

SEQ ID NO: 175278 - DNA, 27 bp, Artificial Sequence
  Description of Artificial Sequence: Synthetic oligonucleotide
ctggatcagaagatgcgcccgagcact

SEQ ID NO: 175279 - DNA, 27 bp, Artificial Sequence
  Description of Artificial Sequence: Synthetic oligonucleotide
tggatcagaagatgcgcccgagcactg

SEQ ID NO: 175280 - DNA, 27 bp, Artificial Sequence
  Description of Artificial Sequence: Synthetic oligonucleotide
ggatcagaagatgcgcccgagcactga

SEQ ID NO: 175281 - DNA, 27 bp, Artificial Sequence
  Description of Artificial Sequence: Synthetic oligonucleotide
gatcagaagatgcgcccgagcactgac

SEQ ID NO: 175282 - DNA, 28 bp, Artificial Sequence
  Description of Artificial Sequence: Synthetic oligonucleotide
atcagaagatgcgcccgagcactgacac

SEQ ID NO: 175283 - DNA, 27 bp, Artificial Sequence
  Description of Artificial Sequence: Synthetic oligonucleotide
tcagaagatgcgcccgagcactgacac

SEQ ID NO: 175284 - DNA, 26 bp, Artificial Sequence
  Description of Artificial Sequence: Synthetic oligonucleotide
cagaagatgcgcccgagcactgacac

SEQ ID NO: 175285 - DNA, 27 bp, Artificial Sequence
  Description of Artificial Sequence: Synthetic oligonucleotide
agaagatgcgcccgagcactgacacca

SEQ ID NO: 175286 - DNA, 27 bp, Artificial Sequence
  Description of Artificial Sequence: Synthetic oligonucleotide
gaagatgcgcccgagcactgacaccat

SEQ ID NO: 175287 - DNA, 27 bp, Artificial Sequence
  Description of Artificial Sequence: Synthetic oligonucleotide
aagatgcgcccgagcactgacaccatc

SEQ ID NO: 175288 - DNA, 27 bp, Artificial Sequence
  Description of Artificial Sequence: Synthetic oligonucleotide
agatgcgcccgagcactgacaccatca

SEQ ID NO: 175289 - DNA, 26 bp, Artificial Sequence
  Description of Artificial Sequence: Synthetic oligonucleotide
gatgcgcccgagcactgacaccatca

SEQ ID NO: 175290 - DNA, 27 bp, Artificial Sequence
  Description of Artificial Sequence: Synthetic oligonucleotide
atgcgcccgagcactgacaccatcaca

SEQ ID NO: 175291 - DNA, 26 bp, Artificial Sequence
  Description of Artificial Sequence: Synthetic oligonucleotide
tgcgcccgagcactgacaccatcaca

SEQ ID NO: 175292 - DNA, 25 bp, Artificial Sequence
  Description of Artificial Sequence: Synthetic oligonucleotide
gcgcccgagcactgacaccatcaca

SEQ ID NO: 175293 - DNA, 26 bp, Artificial Sequence
  Description of Artificial Sequence: Synthetic oligonucleotide
cgcccgagcactgacaccatcacagt

SEQ ID NO: 175294 - DNA, 27 bp, Artificial Sequence
  Description of Artificial Sequence: Synthetic oligonucleotide
gcccgagcactgacaccatcacagtca

SEQ ID NO: 175295 - DNA, 28 bp, Artificial Sequence
  Description of Artificial Sequence: Synthetic oligonucleotide
cccgagcactgacaccatcacagtcatg

SEQ ID NO: 175296 - DNA, 28 bp, Artificial Sequence
  Description of Artificial Sequence: Synthetic oligonucleotide
ccgagcactgacaccatcacagtcatgg

SEQ ID NO: 175297 - DNA, 29 bp, Artificial Sequence
  Description of Artificial Sequence: Synthetic oligonucleotide
cgagcactgacaccatcacagtcatggtg

SEQ ID NO: 175298 - DNA, 29 bp, Artificial Sequence
  Description of Artificial Sequence: Synthetic oligonucleotide
gagcactgacaccatcacagtcatggtgg

SEQ ID NO: 175299 - DNA, 30 bp, Artificial Sequence
  Description of Artificial Sequence: Synthetic oligonucleotide
agcactgacaccatcacagtcatggtggag

SEQ ID NO: 175300 - DNA, 29 bp, Artificial Sequence
  Description of Artificial Sequence: Synthetic oligonucleotide
gcactgacaccatcacagtcatggtggag

SEQ ID NO: 175301 - DNA, 31 bp, Artificial Sequence
  Description of Artificial Sequence: Synthetic oligonucleotide
cactgacaccatcacagtcatggtggagaac

SEQ ID NO: 175302 - DNA, 32 bp, Artificial Sequence
  Description of Artificial Sequence: Synthetic oligonucleotide
actgacaccatcacagtcatggtggagaactc

SEQ ID NO: 175303 - DNA, 31 bp, Artificial Sequence
  Description of Artificial Sequence: Synthetic oligonucleotide
ctgacaccatcacagtcatggtggagaactc

SEQ ID NO: 175304 - DNA, 32 bp, Artificial Sequence
  Description of Artificial Sequence: Synthetic oligonucleotide
tgacaccatcacagtcatggtggagaactctc

SEQ ID NO: 175305 - DNA, 31 bp, Artificial Sequence
  Description of Artificial Sequence: Synthetic oligonucleotide
gacaccatcacagtcatggtggagaactctc

SEQ ID NO: 175306 - DNA, 32 bp, Artificial Sequence
  Description of Artificial Sequence: Synthetic oligonucleotide
acaccatcacagtcatggtggagaactctcac

SEQ ID NO: 175307 - DNA, 31 bp, Artificial Sequence
  Description of Artificial Sequence: Synthetic oligonucleotide
caccatcacagtcatggtggagaactctcac

SEQ ID NO: 175308 - DNA, 31 bp, Artificial Sequence
  Description of Artificial Sequence: Synthetic oligonucleotide
accatcacagtcatggtggagaactctcacg

SEQ ID NO: 175309 - DNA, 30 bp, Artificial Sequence
  Description of Artificial Sequence: Synthetic oligonucleotide
ccatcacagtcatggtggagaactctcacg

SEQ ID NO: 175310 - DNA, 30 bp, Artificial Sequence
  Description of Artificial Sequence: Synthetic oligonucleotide
catcacagtcatggtggagaactctcacgg

SEQ ID NO: 175311 - DNA, 30 bp, Artificial Sequence
  Description of Artificial Sequence: Synthetic oligonucleotide
atcacagtcatggtggagaactctcacggc

SEQ ID NO: 175312 - DNA, 29 bp, Artificial Sequence
  Description of Artificial Sequence: Synthetic oligonucleotide
tcacagtcatggtggagaactctcacggc

SEQ ID NO: 175313 - DNA, 28 bp, Artificial Sequence
  Description of Artificial Sequence: Synthetic oligonucleotide
cacagtcatggtggagaactctcacggc

SEQ ID NO: 175314 - DNA, 28 bp, Artificial Sequence
  Description of Artificial Sequence: Synthetic oligonucleotide
acagtcatggtggagaactctcacggcc

SEQ ID NO: 175315 - DNA, 27 bp, Artificial Sequence
  Description of Artificial Sequence: Synthetic oligonucleotide
cagtcatggtggagaactctcacggcc

SEQ ID NO: 175316 - DNA, 28 bp, Artificial Sequence
  Description of Artificial Sequence: Synthetic oligonucleotide
agtcatggtggagaactctcacggcctc

SEQ ID NO: 175317 - DNA, 27 bp, Artificial Sequence
  Description of Artificial Sequence: Synthetic oligonucleotide
gtcatggtggagaactctcacggcctc

SEQ ID NO: 175318 - DNA, 27 bp, Artificial Sequence
  Description of Artificial Sequence: Synthetic oligonucleotide
tcatggtggagaactctcacggcctcc

SEQ ID NO: 175319 - DNA, 26 bp, Artificial Sequence
  Description of Artificial Sequence: Synthetic oligonucleotide
catggtggagaactctcacggcctcc

SEQ ID NO: 175320 - DNA, 26 bp, Artificial Sequence
  Description of Artificial Sequence: Synthetic oligonucleotide
atggtggagaactctcacggcctccg

SEQ ID NO: 175321 - DNA, 25 bp, Artificial Sequence
  Description of Artificial Sequence: Synthetic oligonucleotide
tggtggagaactctcacggcctccg

SEQ ID NO: 175322 - DNA, 24 bp, Artificial Sequence
  Description of Artificial Sequence: Synthetic oligonucleotide
ggtggagaactctcacggcctccg

SEQ ID NO: 175323 - DNA, 24 bp, Artificial Sequence
  Description of Artificial Sequence: Synthetic oligonucleotide
gtggagaactctcacggcctccgc

SEQ ID NO: 175324 - DNA, 25 bp, Artificial Sequence
  Description of Artificial Sequence: Synthetic oligonucleotide
tggagaactctcacggcctccgcgt

SEQ ID NO: 175325 - DNA, 24 bp, Artificial Sequence
  Description of Artificial Sequence: Synthetic oligonucleotide
ggagaactctcacggcctccgcgt

SEQ ID NO: 175326 - DNA, 24 bp, Artificial Sequence
  Description of Artificial Sequence: Synthetic oligonucleotide
gagaactctcacggcctccgcgtg

SEQ ID NO: 175327 - DNA, 24 bp, Artificial Sequence
  Description of Artificial Sequence: Synthetic oligonucleotide
agaactctcacggcctccgcgtgc

SEQ ID NO: 175328 - DNA, 23 bp, Artificial Sequence
  Description of Artificial Sequence: Synthetic oligonucleotide
gaactctcacggcctccgcgtgc

SEQ ID NO: 175329 - DNA, 23 bp, Artificial Sequence
  Description of Artificial Sequence: Synthetic oligonucleotide
aactctcacggcctccgcgtgcg

SEQ ID NO: 175330 - DNA, 22 bp, Artificial Sequence
  Description of Artificial Sequence: Synthetic oligonucleotide
actctcacggcctccgcgtgcg

SEQ ID NO: 175331 - DNA, 21 bp, Artificial Sequence
  Description of Artificial Sequence: Synthetic oligonucleotide
ctctcacggcctccgcgtgcg

SEQ ID NO: 175332 - DNA, 23 bp, Artificial Sequence
  Description of Artificial Sequence: Synthetic oligonucleotide
tctcacggcctccgcgtgcggaa

SEQ ID NO: 175333 - DNA, 22 bp, Artificial Sequence
  Description of Artificial Sequence: Synthetic oligonucleotide
ctcacggcctccgcgtgcggaa

SEQ ID NO: 175334 - DNA, 24 bp, Artificial Sequence
  Description of Artificial Sequence: Synthetic oligonucleotide
tcacggcctccgcgtgcggaagaa

SEQ ID NO: 175335 - DNA, 23 bp, Artificial Sequence
  Description of Artificial Sequence: Synthetic oligonucleotide
cacggcctccgcgtgcggaagaa

SEQ ID NO: 175336 - DNA, 23 bp, Artificial Sequence
  Description of Artificial Sequence: Synthetic oligonucleotide
acggcctccgcgtgcggaagaag

SEQ ID NO: 175337 - DNA, 22 bp, Artificial Sequence
  Description of Artificial Sequence: Synthetic oligonucleotide
cggcctccgcgtgcggaagaag

SEQ ID NO: 175338 - DNA, 23 bp, Artificial Sequence
  Description of Artificial Sequence: Synthetic oligonucleotide
ggcctccgcgtgcggaagaagga

SEQ ID NO: 175339 - DNA, 23 bp, Artificial Sequence
  Description of Artificial Sequence: Synthetic oligonucleotide
gcctccgcgtgcggaagaaggag

SEQ ID NO: 175340 - DNA, 24 bp, Artificial Sequence
  Description of Artificial Sequence: Synthetic oligonucleotide
cctccgcgtgcggaagaaggaggt

SEQ ID NO: 175341 - DNA, 26 bp, Artificial Sequence
  Description of Artificial Sequence: Synthetic oligonucleotide
ctccgcgtgcggaagaaggaggtgta

SEQ ID NO: 175342 - DNA, 27 bp, Artificial Sequence
  Description of Artificial Sequence: Synthetic oligonucleotide
tccgcgtgcggaagaaggaggtgtaca

SEQ ID NO: 175343 - DNA, 27 bp, Artificial Sequence
  Description of Artificial Sequence: Synthetic oligonucleotide
ccgcgtgcggaagaaggaggtgtacat

SEQ ID NO: 175344 - DNA, 27 bp, Artificial Sequence
  Description of Artificial Sequence: Synthetic oligonucleotide
cgcgtgcggaagaaggaggtgtacatg

SEQ ID NO: 175345 - DNA, 27 bp, Artificial Sequence
  Description of Artificial Sequence: Synthetic oligonucleotide
gcgtgcggaagaaggaggtgtacatgc

SEQ ID NO: 175346 - DNA, 27 bp, Artificial Sequence
  Description of Artificial Sequence: Synthetic oligonucleotide
cgtgcggaagaaggaggtgtacatgcc

SEQ ID NO: 175347 - DNA, 27 bp, Artificial Sequence
  Description of Artificial Sequence: Synthetic oligonucleotide
gtgcggaagaaggaggtgtacatgccc

SEQ ID NO: 175348 - DNA, 28 bp, Artificial Sequence
  Description of Artificial Sequence: Synthetic oligonucleotide
tgcggaagaaggaggtgtacatgccctc

SEQ ID NO: 175349 - DNA, 27 bp, Artificial Sequence
  Description of Artificial Sequence: Synthetic oligonucleotide
gcggaagaaggaggtgtacatgccctc

SEQ ID NO: 175350 - DNA, 27 bp, Artificial Sequence
  Description of Artificial Sequence: Synthetic oligonucleotide
cggaagaaggaggtgtacatgccctcg

SEQ ID NO: 175351 - DNA, 28 bp, Artificial Sequence
  Description of Artificial Sequence: Synthetic oligonucleotide
ggaagaaggaggtgtacatgccctcgtc

SEQ ID NO: 175352 - DNA, 28 bp, Artificial Sequence
  Description of Artificial Sequence: Synthetic oligonucleotide
gaagaaggaggtgtacatgccctcgtcc

SEQ ID NO: 175353 - DNA, 30 bp, Artificial Sequence
  Description of Artificial Sequence: Synthetic oligonucleotide
aagaaggaggtgtacatgccctcgtccatc

SEQ ID NO: 175354 - DNA, 29 bp, Artificial Sequence
  Description of Artificial Sequence: Synthetic oligonucleotide
agaaggaggtgtacatgccctcgtccatc

SEQ ID NO: 175355 - DNA, 28 bp, Artificial Sequence
  Description of Artificial Sequence: Synthetic oligonucleotide
gaaggaggtgtacatgccctcgtccatc

SEQ ID NO: 175356 - DNA, 30 bp, Artificial Sequence
  Description of Artificial Sequence: Synthetic oligonucleotide
aaggaggtgtacatgccctcgtccatcttc

SEQ ID NO: 175357 - DNA, 29 bp, Artificial Sequence
  Description of Artificial Sequence: Synthetic oligonucleotide
aggaggtgtacatgccctcgtccatcttc

SEQ ID NO: 175358 - DNA, 28 bp, Artificial Sequence
  Description of Artificial Sequence: Synthetic oligonucleotide
ggaggtgtacatgccctcgtccatcttc

SEQ ID NO: 175359 - DNA, 28 bp, Artificial Sequence
  Description of Artificial Sequence: Synthetic oligonucleotide
gaggtgtacatgccctcgtccatcttcc

SEQ ID NO: 175360 - DNA, 29 bp, Artificial Sequence
  Description of Artificial Sequence: Synthetic oligonucleotide
aggtgtacatgccctcgtccatcttccag

SEQ ID NO: 175361 - DNA, 28 bp, Artificial Sequence
  Description of Artificial Sequence: Synthetic oligonucleotide
ggtgtacatgccctcgtccatcttccag

SEQ ID NO: 175362 - DNA, 28 bp, Artificial Sequence
  Description of Artificial Sequence: Synthetic oligonucleotide
gtgtacatgccctcgtccatcttccagg

SEQ ID NO: 175363 - DNA, 30 bp, Artificial Sequence
  Description of Artificial Sequence: Synthetic oligonucleotide
tgtacatgccctcgtccatcttccaggatg

SEQ ID NO: 175364 - DNA, 29 bp, Artificial Sequence
  Description of Artificial Sequence: Synthetic oligonucleotide
gtacatgccctcgtccatcttccaggatg

SEQ ID NO: 175365 - DNA, 30 bp, Artificial Sequence
  Description of Artificial Sequence: Synthetic oligonucleotide
tacatgccctcgtccatcttccaggatgac

SEQ ID NO: 175366 - DNA, 29 bp, Artificial Sequence
  Description of Artificial Sequence: Synthetic oligonucleotide
acatgccctcgtccatcttccaggatgac

SEQ ID NO: 175367 - DNA, 28 bp, Artificial Sequence
  Description of Artificial Sequence: Synthetic oligonucleotide
catgccctcgtccatcttccaggatgac

SEQ ID NO: 175368 - DNA, 31 bp, Artificial Sequence
  Description of Artificial Sequence: Synthetic oligonucleotide
atgccctcgtccatcttccaggatgactttg

SEQ ID NO: 175369 - DNA, 30 bp, Artificial Sequence
  Description of Artificial Sequence: Synthetic oligonucleotide
tgccctcgtccatcttccaggatgactttg

SEQ ID NO: 175370 - DNA, 29 bp, Artificial Sequence
  Description of Artificial Sequence: Synthetic oligonucleotide
gccctcgtccatcttccaggatgactttg

SEQ ID NO: 175371 - DNA, 30 bp, Artificial Sequence
  Description of Artificial Sequence: Synthetic oligonucleotide
ccctcgtccatcttccaggatgactttgtg

SEQ ID NO: 175372 - DNA, 32 bp, Artificial Sequence
  Description of Artificial Sequence: Synthetic oligonucleotide
cctcgtccatcttccaggatgactttgtgatc

SEQ ID NO: 175373 - DNA, 32 bp, Artificial Sequence
  Description of Artificial Sequence: Synthetic oligonucleotide
ctcgtccatcttccaggatgactttgtgatcc

SEQ ID NO: 175374 - DNA, 32 bp, Artificial Sequence
  Description of Artificial Sequence: Synthetic oligonucleotide
tcgtccatcttccaggatgactttgtgatccc

SEQ ID NO: 175375 - DNA, 31 bp, Artificial Sequence
  Description of Artificial Sequence: Synthetic oligonucleotide
cgtccatcttccaggatgactttgtgatccc

SEQ ID NO: 175376 - DNA, 32 bp, Artificial Sequence
  Description of Artificial Sequence: Synthetic oligonucleotide
gtccatcttccaggatgactttgtgatcccag

SEQ ID NO: 175377 - DNA, 33 bp, Artificial Sequence
  Description of Artificial Sequence: Synthetic oligonucleotide
tccatcttccaggatgactttgtgatcccagac

SEQ ID NO: 175378 - DNA, 32 bp, Artificial Sequence
  Description of Artificial Sequence: Synthetic oligonucleotide
ccatcttccaggatgactttgtgatcccagac

SEQ ID NO: 175379 - DNA, 34 bp, Artificial Sequence
  Description of Artificial Sequence: Synthetic oligonucleotide
catcttccaggatgactttgtgatcccagacatc

SEQ ID NO: 175380 - DNA, 35 bp, Artificial Sequence
  Description of Artificial Sequence: Synthetic oligonucleotide
atcttccaggatgactttgtgatcccagacatctc

SEQ ID NO: 175381 - DNA, 34 bp, Artificial Sequence
  Description of Artificial Sequence: Synthetic oligonucleotide
tcttccaggatgactttgtgatcccagacatctc

SEQ ID NO: 175382 - DNA, 33 bp, Artificial Sequence
  Description of Artificial Sequence: Synthetic oligonucleotide
cttccaggatgactttgtgatcccagacatctc

SEQ ID NO: 175383 - DNA, 34 bp, Artificial Sequence
  Description of Artificial Sequence: Synthetic oligonucleotide
ttccaggatgactttgtgatcccagacatctcag

SEQ ID NO: 175384 - DNA, 33 bp, Artificial Sequence
  Description of Artificial Sequence: Synthetic oligonucleotide
tccaggatgactttgtgatcccagacatctcag

SEQ ID NO: 175385 - DNA, 32 bp, Artificial Sequence
  Description of Artificial Sequence: Synthetic oligonucleotide
ccaggatgactttgtgatcccagacatctcag

SEQ ID NO: 175386 - DNA, 33 bp, Artificial Sequence
  Description of Artificial Sequence: Synthetic oligonucleotide
caggatgactttgtgatcccagacatctcagag

SEQ ID NO: 175387 - DNA, 33 bp, Artificial Sequence
  Description of Artificial Sequence: Synthetic oligonucleotide
aggatgactttgtgatcccagacatctcagagc

SEQ ID NO: 175388 - DNA, 32 bp, Artificial Sequence
  Description of Artificial Sequence: Synthetic oligonucleotide
ggatgactttgtgatcccagacatctcagagc

SEQ ID NO: 175389 - DNA, 32 bp, Artificial Sequence
  Description of Artificial Sequence: Synthetic oligonucleotide
gatgactttgtgatcccagacatctcagagcc

SEQ ID NO: 175390 - DNA, 33 bp, Artificial Sequence
  Description of Artificial Sequence: Synthetic oligonucleotide
atgactttgtgatcccagacatctcagagccag

SEQ ID NO: 175391 - DNA, 32 bp, Artificial Sequence
  Description of Artificial Sequence: Synthetic oligonucleotide
tgactttgtgatcccagacatctcagagccag

SEQ ID NO: 175392 - DNA, 31 bp, Artificial Sequence
  Description of Artificial Sequence: Synthetic oligonucleotide
gactttgtgatcccagacatctcagagccag

SEQ ID NO: 175393 - DNA, 31 bp, Artificial Sequence
  Description of Artificial Sequence: Synthetic oligonucleotide
actttgtgatcccagacatctcagagccagg

SEQ ID NO: 175394 - DNA, 30 bp, Artificial Sequence
  Description of Artificial Sequence: Synthetic oligonucleotide
ctttgtgatcccagacatctcagagccagg

SEQ ID NO: 175395 - DNA, 30 bp, Artificial Sequence
  Description of Artificial Sequence: Synthetic oligonucleotide
tttgtgatcccagacatctcagagccaggg

SEQ ID NO: 175396 - DNA, 29 bp, Artificial Sequence
  Description of Artificial Sequence: Synthetic oligonucleotide
ttgtgatcccagacatctcagagccaggg

SEQ ID NO: 175397 - DNA, 28 bp, Artificial Sequence
  Description of Artificial Sequence: Synthetic oligonucleotide
tgtgatcccagacatctcagagccaggg

SEQ ID NO: 175398 - DNA, 27 bp, Artificial Sequence
  Description of Artificial Sequence: Synthetic oligonucleotide
gtgatcccagacatctcagagccaggg

SEQ ID NO: 175399 - DNA, 28 bp, Artificial Sequence
  Description of Artificial Sequence: Synthetic oligonucleotide
tgatcccagacatctcagagccagggac

SEQ ID NO: 175400 - DNA, 27 bp, Artificial Sequence
  Description of Artificial Sequence: Synthetic oligonucleotide
gatcccagacatctcagagccagggac

SEQ ID NO: 175401 - DNA, 27 bp, Artificial Sequence
  Description of Artificial Sequence: Synthetic oligonucleotide
atcccagacatctcagagccagggacc

SEQ ID NO: 175402 - DNA, 27 bp, Artificial Sequence
  Description of Artificial Sequence: Synthetic oligonucleotide
tcccagacatctcagagccagggacct

SEQ ID NO: 175403 - DNA, 26 bp, Artificial Sequence
  Description of Artificial Sequence: Synthetic oligonucleotide
cccagacatctcagagccagggacct

SEQ ID NO: 175404 - DNA, 26 bp, Artificial Sequence
  Description of Artificial Sequence: Synthetic oligonucleotide
ccagacatctcagagccagggacctg

SEQ ID NO: 175405 - DNA, 27 bp, Artificial Sequence
  Description of Artificial Sequence: Synthetic oligonucleotide
cagacatctcagagccagggacctgga

SEQ ID NO: 175406 - DNA, 28 bp, Artificial Sequence
  Description of Artificial Sequence: Synthetic oligonucleotide
agacatctcagagccagggacctggaag

SEQ ID NO: 175407 - DNA, 27 bp, Artificial Sequence
  Description of Artificial Sequence: Synthetic oligonucleotide
gacatctcagagccagggacctggaag

SEQ ID NO: 175408 - DNA, 29 bp, Artificial Sequence
  Description of Artificial Sequence: Synthetic oligonucleotide
acatctcagagccagggacctggaagatc

SEQ ID NO: 175409 - DNA, 28 bp, Artificial Sequence
  Description of Artificial Sequence: Synthetic oligonucleotide
catctcagagccagggacctggaagatc

SEQ ID NO: 175410 - DNA, 29 bp, Artificial Sequence
  Description of Artificial Sequence: Synthetic oligonucleotide
atctcagagccagggacctggaagatctc

SEQ ID NO: 175411 - DNA, 28 bp, Artificial Sequence
  Description of Artificial Sequence: Synthetic oligonucleotide
tctcagagccagggacctggaagatctc

SEQ ID NO: 175412 - DNA, 27 bp, Artificial Sequence
  Description of Artificial Sequence: Synthetic oligonucleotide
ctcagagccagggacctggaagatctc

SEQ ID NO: 175413 - DNA, 28 bp, Artificial Sequence
  Description of Artificial Sequence: Synthetic oligonucleotide
tcagagccagggacctggaagatctcag

SEQ ID NO: 175414 - DNA, 27 bp, Artificial Sequence
  Description of Artificial Sequence: Synthetic oligonucleotide
cagagccagggacctggaagatctcag

SEQ ID NO: 175415 - DNA, 27 bp, Artificial Sequence
  Description of Artificial Sequence: Synthetic oligonucleotide
agagccagggacctggaagatctcagc

SEQ ID NO: 175416 - DNA, 26 bp, Artificial Sequence
  Description of Artificial Sequence: Synthetic oligonucleotide
gagccagggacctggaagatctcagc

SEQ ID NO: 175417 - DNA, 26 bp, Artificial Sequence
  Description of Artificial Sequence: Synthetic oligonucleotide
agccagggacctggaagatctcagcc

SEQ ID NO: 175418 - DNA, 25 bp, Artificial Sequence
  Description of Artificial Sequence: Synthetic oligonucleotide
gccagggacctggaagatctcagcc

SEQ ID NO: 175419 - DNA, 25 bp, Artificial Sequence
  Description of Artificial Sequence: Synthetic oligonucleotide
ccagggacctggaagatctcagccc

SEQ ID NO: 175420 - DNA, 27 bp, Artificial Sequence
  Description of Artificial Sequence: Synthetic oligonucleotide
cagggacctggaagatctcagcccgat

SEQ ID NO: 175421 - DNA, 28 bp, Artificial Sequence
  Description of Artificial Sequence: Synthetic oligonucleotide
agggacctggaagatctcagcccgattc

SEQ ID NO: 175422 - DNA, 27 bp, Artificial Sequence
  Description of Artificial Sequence: Synthetic oligonucleotide
gggacctggaagatctcagcccgattc

SEQ ID NO: 175423 - DNA, 28 bp, Artificial Sequence
  Description of Artificial Sequence: Synthetic oligonucleotide
ggacctggaagatctcagcccgattctc

SEQ ID NO: 175424 - DNA, 29 bp, Artificial Sequence
  Description of Artificial Sequence: Synthetic oligonucleotide
gacctggaagatctcagcccgattctcag

SEQ ID NO: 175425 - DNA, 31 bp, Artificial Sequence
  Description of Artificial Sequence: Synthetic oligonucleotide
acctggaagatctcagcccgattctcagatg

SEQ ID NO: 175426 - DNA, 30 bp, Artificial Sequence
  Description of Artificial Sequence: Synthetic oligonucleotide
cctggaagatctcagcccgattctcagatg

SEQ ID NO: 175427 - DNA, 30 bp, Artificial Sequence
  Description of Artificial Sequence: Synthetic oligonucleotide
ctggaagatctcagcccgattctcagatgg

SEQ ID NO: 175428 - DNA, 30 bp, Artificial Sequence
  Description of Artificial Sequence: Synthetic oligonucleotide
tggaagatctcagcccgattctcagatggc

SEQ ID NO: 175429 - DNA, 29 bp, Artificial Sequence
  Description of Artificial Sequence: Synthetic oligonucleotide
ggaagatctcagcccgattctcagatggc

SEQ ID NO: 175430 - DNA, 29 bp, Artificial Sequence
  Description of Artificial Sequence: Synthetic oligonucleotide
gaagatctcagcccgattctcagatggcc

SEQ ID NO: 175431 - DNA, 30 bp, Artificial Sequence
  Description of Artificial Sequence: Synthetic oligonucleotide
aagatctcagcccgattctcagatggcctg

SEQ ID NO: 175432 - DNA, 29 bp, Artificial Sequence
  Description of Artificial Sequence: Synthetic oligonucleotide
agatctcagcccgattctcagatggcctg

SEQ ID NO: 175433 - DNA, 28 bp, Artificial Sequence
  Description of Artificial Sequence: Synthetic oligonucleotide
gatctcagcccgattctcagatggcctg

SEQ ID NO: 175434 - DNA, 28 bp, Artificial Sequence
  Description of Artificial Sequence: Synthetic oligonucleotide
atctcagcccgattctcagatggcctgg

SEQ ID NO: 175435 - DNA, 27 bp, Artificial Sequence
  Description of Artificial Sequence: Synthetic oligonucleotide
tctcagcccgattctcagatggcctgg

SEQ ID NO: 175436 - DNA, 27 bp, Artificial Sequence
  Description of Artificial Sequence: Synthetic oligonucleotide
ctcagcccgattctcagatggcctgga

SEQ ID NO: 175437 - DNA, 29 bp, Artificial Sequence
  Description of Artificial Sequence: Synthetic oligonucleotide
tcagcccgattctcagatggcctggaatc

SEQ ID NO: 175438 - DNA, 28 bp, Artificial Sequence
  Description of Artificial Sequence: Synthetic oligonucleotide
cagcccgattctcagatggcctggaatc

SEQ ID NO: 175439 - DNA, 28 bp, Artificial Sequence
  Description of Artificial Sequence: Synthetic oligonucleotide
agcccgattctcagatggcctggaatcc

SEQ ID NO: 175440 - DNA, 27 bp, Artificial Sequence
  Description of Artificial Sequence: Synthetic oligonucleotide
gcccgattctcagatggcctggaatcc

SEQ ID NO: 175441 - DNA, 29 bp, Artificial Sequence
  Description of Artificial Sequence: Synthetic oligonucleotide
cccgattctcagatggcctggaatccaac

SEQ ID NO: 175442 - DNA, 30 bp, Artificial Sequence
  Description of Artificial Sequence: Synthetic oligonucleotide
ccgattctcagatggcctggaatccaacag

SEQ ID NO: 175443 - DNA, 30 bp, Artificial Sequence
  Description of Artificial Sequence: Synthetic oligonucleotide
cgattctcagatggcctggaatccaacagc

SEQ ID NO: 175444 - DNA, 31 bp, Artificial Sequence
  Description of Artificial Sequence: Synthetic oligonucleotide
gattctcagatggcctggaatccaacagcag

SEQ ID NO: 175445 - DNA, 31 bp, Artificial Sequence
  Description of Artificial Sequence: Synthetic oligonucleotide
attctcagatggcctggaatccaacagcagc

SEQ ID NO: 175446 - DNA, 30 bp, Artificial Sequence
  Description of Artificial Sequence: Synthetic oligonucleotide
ttctcagatggcctggaatccaacagcagc

SEQ ID NO: 175447 - DNA, 29 bp, Artificial Sequence
  Description of Artificial Sequence: Synthetic oligonucleotide
tctcagatggcctggaatccaacagcagc

SEQ ID NO: 175448 - DNA, 28 bp, Artificial Sequence
  Description of Artificial Sequence: Synthetic oligonucleotide
ctcagatggcctggaatccaacagcagc

SEQ ID NO: 175449 - DNA, 29 bp, Artificial Sequence
  Description of Artificial Sequence: Synthetic oligonucleotide
tcagatggcctggaatccaacagcagcac

SEQ ID NO: 175450 - DNA, 28 bp, Artificial Sequence
  Description of Artificial Sequence: Synthetic oligonucleotide
cagatggcctggaatccaacagcagcac

SEQ ID NO: 175451 - DNA, 28 bp, Artificial Sequence
  Description of Artificial Sequence: Synthetic oligonucleotide
agatggcctggaatccaacagcagcacc

SEQ ID NO: 175452 - DNA, 27 bp, Artificial Sequence
  Description of Artificial Sequence: Synthetic oligonucleotide
gatggcctggaatccaacagcagcacc

SEQ ID NO: 175453 - DNA, 27 bp, Artificial Sequence
  Description of Artificial Sequence: Synthetic oligonucleotide
atggcctggaatccaacagcagcaccc

SEQ ID NO: 175454 - DNA, 27 bp, Artificial Sequence
  Description of Artificial Sequence: Synthetic oligonucleotide
tggcctggaatccaacagcagcaccca

SEQ ID NO: 175455 - DNA, 26 bp, Artificial Sequence
  Description of Artificial Sequence: Synthetic oligonucleotide
ggcctggaatccaacagcagcaccca

SEQ ID NO: 175456 - DNA, 27 bp, Artificial Sequence
  Description of Artificial Sequence: Synthetic oligonucleotide
gcctggaatccaacagcagcacccagt

SEQ ID NO: 175457 - DNA, 29 bp, Artificial Sequence
  Description of Artificial Sequence: Synthetic oligonucleotide
cctggaatccaacagcagcacccagtttg

SEQ ID NO: 175458 - DNA, 30 bp, Artificial Sequence
  Description of Artificial Sequence: Synthetic oligonucleotide
ctggaatccaacagcagcacccagtttgag

SEQ ID NO: 175459 - DNA, 30 bp, Artificial Sequence
  Description of Artificial Sequence: Synthetic oligonucleotide
tggaatccaacagcagcacccagtttgagg

SEQ ID NO: 175460 - DNA, 29 bp, Artificial Sequence
  Description of Artificial Sequence: Synthetic oligonucleotide
ggaatccaacagcagcacccagtttgagg

SEQ ID NO: 175461 - DNA, 30 bp, Artificial Sequence
  Description of Artificial Sequence: Synthetic oligonucleotide
gaatccaacagcagcacccagtttgaggtg

SEQ ID NO: 175462 - DNA, 32 bp, Artificial Sequence
  Description of Artificial Sequence: Synthetic oligonucleotide
aatccaacagcagcacccagtttgaggtgaag

SEQ ID NO: 175463 - DNA, 31 bp, Artificial Sequence
  Description of Artificial Sequence: Synthetic oligonucleotide
atccaacagcagcacccagtttgaggtgaag

SEQ ID NO: 175464 - DNA, 30 bp, Artificial Sequence
  Description of Artificial Sequence: Synthetic oligonucleotide
tccaacagcagcacccagtttgaggtgaag

SEQ ID NO: 175465 - DNA, 29 bp, Artificial Sequence
  Description of Artificial Sequence: Synthetic oligonucleotide
ccaacagcagcacccagtttgaggtgaag

SEQ ID NO: 175466 - DNA, 35 bp, Artificial Sequence
  Description of Artificial Sequence: Synthetic oligonucleotide
caacagcagcacccagtttgaggtgaagaaatatg

SEQ ID NO: 175467 - DNA, 36 bp, Artificial Sequence
  Description of Artificial Sequence: Synthetic oligonucleotide
aacagcagcacccagtttgaggtgaagaaatatgtc

SEQ ID NO: 175468 - DNA, 35 bp, Artificial Sequence
  Description of Artificial Sequence: Synthetic oligonucleotide
acagcagcacccagtttgaggtgaagaaatatgtc

SEQ ID NO: 175469 - DNA, 34 bp, Artificial Sequence
  Description of Artificial Sequence: Synthetic oligonucleotide
cagcagcacccagtttgaggtgaagaaatatgtc

SEQ ID NO: 175470 - DNA, 34 bp, Artificial Sequence
  Description of Artificial Sequence: Synthetic oligonucleotide
agcagcacccagtttgaggtgaagaaatatgtcc

SEQ ID NO: 175471 - DNA, 33 bp, Artificial Sequence
  Description of Artificial Sequence: Synthetic oligonucleotide
gcagcacccagtttgaggtgaagaaatatgtcc

SEQ ID NO: 175472 - DNA, 35 bp, Artificial Sequence
  Description of Artificial Sequence: Synthetic oligonucleotide
cagcacccagtttgaggtgaagaaatatgtccttc

SEQ ID NO: 175473 - DNA, 35 bp, Artificial Sequence
  Description of Artificial Sequence: Synthetic oligonucleotide
agcacccagtttgaggtgaagaaatatgtccttcc

SEQ ID NO: 175474 - DNA, 34 bp, Artificial Sequence
  Description of Artificial Sequence: Synthetic oligonucleotide
gcacccagtttgaggtgaagaaatatgtccttcc

SEQ ID NO: 175475 - DNA, 34 bp, Artificial Sequence
  Description of Artificial Sequence: Synthetic oligonucleotide
cacccagtttgaggtgaagaaatatgtccttccc

SEQ ID NO: 175476 - DNA, 36 bp, Artificial Sequence
  Description of Artificial Sequence: Synthetic oligonucleotide
acccagtttgaggtgaagaaatatgtccttcccaac

SEQ ID NO: 175477 - DNA, 35 bp, Artificial Sequence
  Description of Artificial Sequence: Synthetic oligonucleotide
cccagtttgaggtgaagaaatatgtccttcccaac

SEQ ID NO: 175478 - DNA, 38 bp, Artificial Sequence
  Description of Artificial Sequence: Synthetic oligonucleotide
ccagtttgaggtgaagaaatatgtccttcccaactttg

SEQ ID NO: 175479 - DNA, 39 bp, Artificial Sequence
  Description of Artificial Sequence: Synthetic oligonucleotide
cagtttgaggtgaagaaatatgtccttcccaactttgag

SEQ ID NO: 175480 - DNA, 39 bp, Artificial Sequence
  Description of Artificial Sequence: Synthetic oligonucleotide
agtttgaggtgaagaaatatgtccttcccaactttgagg

SEQ ID NO: 175481 - DNA, 38 bp, Artificial Sequence
  Description of Artificial Sequence: Synthetic oligonucleotide
gtttgaggtgaagaaatatgtccttcccaactttgagg

SEQ ID NO: 175482 - DNA, 39 bp, Artificial Sequence
  Description of Artificial Sequence: Synthetic oligonucleotide
tttgaggtgaagaaatatgtccttcccaactttgaggtg

SEQ ID NO: 175483 - DNA, 38 bp, Artificial Sequence
  Description of Artificial Sequence: Synthetic oligonucleotide
ttgaggtgaagaaatatgtccttcccaactttgaggtg

SEQ ID NO: 175484 - DNA, 37 bp, Artificial Sequence
  Description of Artificial Sequence: Synthetic oligonucleotide
tgaggtgaagaaatatgtccttcccaactttgaggtg

SEQ ID NO: 175485 - DNA, 36 bp, Artificial Sequence
  Description of Artificial Sequence: Synthetic oligonucleotide
gaggtgaagaaatatgtccttcccaactttgaggtg

SEQ ID NO: 175486 - DNA, 38 bp, Artificial Sequence
  Description of Artificial Sequence: Synthetic oligonucleotide
aggtgaagaaatatgtccttcccaactttgaggtgaag

SEQ ID NO: 175487 - DNA, 37 bp, Artificial Sequence
  Description of Artificial Sequence: Synthetic oligonucleotide
ggtgaagaaatatgtccttcccaactttgaggtgaag

SEQ ID NO: 175488 - DNA, 39 bp, Artificial Sequence
  Description of Artificial Sequence: Synthetic oligonucleotide
gtgaagaaatatgtccttcccaactttgaggtgaagatc

SEQ ID NO: 175489 - DNA, 40 bp, Artificial Sequence
  Description of Artificial Sequence: Synthetic oligonucleotide
tgaagaaatatgtccttcccaactttgaggtgaagatcac

SEQ ID NO: 175490 - DNA, 39 bp, Artificial Sequence
  Description of Artificial Sequence: Synthetic oligonucleotide
gaagaaatatgtccttcccaactttgaggtgaagatcac

SEQ ID NO: 175491 - DNA, 39 bp, Artificial Sequence
  Description of Artificial Sequence: Synthetic oligonucleotide
aagaaatatgtccttcccaactttgaggtgaagatcacc

SEQ ID NO: 175492 - DNA, 38 bp, Artificial Sequence
  Description of Artificial Sequence: Synthetic oligonucleotide
agaaatatgtccttcccaactttgaggtgaagatcacc

SEQ ID NO: 175493 - DNA, 37 bp, Artificial Sequence
  Description of Artificial Sequence: Synthetic oligonucleotide
gaaatatgtccttcccaactttgaggtgaagatcacc

SEQ ID NO: 175494 - DNA, 37 bp, Artificial Sequence
  Description of Artificial Sequence: Synthetic oligonucleotide
aaatatgtccttcccaactttgaggtgaagatcaccc

SEQ ID NO: 175495 - DNA, 36 bp, Artificial Sequence
  Description of Artificial Sequence: Synthetic oligonucleotide
aatatgtccttcccaactttgaggtgaagatcaccc

SEQ ID NO: 175496 - DNA, 35 bp, Artificial Sequence
  Description of Artificial Sequence: Synthetic oligonucleotide
atatgtccttcccaactttgaggtgaagatcaccc

SEQ ID NO: 175497 - DNA, 34 bp, Artificial Sequence
  Description of Artificial Sequence: Synthetic oligonucleotide
tatgtccttcccaactttgaggtgaagatcaccc

SEQ ID NO: 175498 - DNA, 33 bp, Artificial Sequence
  Description of Artificial Sequence: Synthetic oligonucleotide
atgtccttcccaactttgaggtgaagatcaccc

SEQ ID NO: 175499 - DNA, 32 bp, Artificial Sequence
  Description of Artificial Sequence: Synthetic oligonucleotide
tgtccttcccaactttgaggtgaagatcaccc

SEQ ID NO: 175500 - DNA, 31 bp, Artificial Sequence
  Description of Artificial Sequence: Synthetic oligonucleotide
gtccttcccaactttgaggtgaagatcaccc

SEQ ID NO: 175501 - DNA, 31 bp, Artificial Sequence
  Description of Artificial Sequence: Synthetic oligonucleotide
tccttcccaactttgaggtgaagatcacccc

SEQ ID NO: 175502 - DNA, 30 bp, Artificial Sequence
  Description of Artificial Sequence: Synthetic oligonucleotide
ccttcccaactttgaggtgaagatcacccc

SEQ ID NO: 175503 - DNA, 31 bp, Artificial Sequence
  Description of Artificial Sequence: Synthetic oligonucleotide
cttcccaactttgaggtgaagatcacccctg

SEQ ID NO: 175504 - DNA, 31 bp, Artificial Sequence
  Description of Artificial Sequence: Synthetic oligonucleotide
ttcccaactttgaggtgaagatcacccctgg

SEQ ID NO: 175505 - DNA, 30 bp, Artificial Sequence
  Description of Artificial Sequence: Synthetic oligonucleotide
tcccaactttgaggtgaagatcacccctgg

SEQ ID NO: 175506 - DNA, 29 bp, Artificial Sequence
  Description of Artificial Sequence: Synthetic oligonucleotide
cccaactttgaggtgaagatcacccctgg

SEQ ID NO: 175507 - DNA, 32 bp, Artificial Sequence
  Description of Artificial Sequence: Synthetic oligonucleotide
ccaactttgaggtgaagatcacccctggaaag

SEQ ID NO: 175508 - DNA, 32 bp, Artificial Sequence
  Description of Artificial Sequence: Synthetic oligonucleotide
caactttgaggtgaagatcacccctggaaagc

SEQ ID NO: 175509 - DNA, 32 bp, Artificial Sequence
  Description of Artificial Sequence: Synthetic oligonucleotide
aactttgaggtgaagatcacccctggaaagcc

SEQ ID NO: 175510 - DNA, 31 bp, Artificial Sequence
  Description of Artificial Sequence: Synthetic oligonucleotide
actttgaggtgaagatcacccctggaaagcc

SEQ ID NO: 175511 - DNA, 30 bp, Artificial Sequence
  Description of Artificial Sequence: Synthetic oligonucleotide
ctttgaggtgaagatcacccctggaaagcc

SEQ ID NO: 175512 - DNA, 30 bp, Artificial Sequence
  Description of Artificial Sequence: Synthetic oligonucleotide
tttgaggtgaagatcacccctggaaagccc

SEQ ID NO: 175513 - DNA, 29 bp, Artificial Sequence
  Description of Artificial Sequence: Synthetic oligonucleotide
ttgaggtgaagatcacccctggaaagccc

SEQ ID NO: 175514 - DNA, 28 bp, Artificial Sequence
  Description of Artificial Sequence: Synthetic oligonucleotide
tgaggtgaagatcacccctggaaagccc

SEQ ID NO: 175515 - DNA, 27 bp, Artificial Sequence
  Description of Artificial Sequence: Synthetic oligonucleotide
gaggtgaagatcacccctggaaagccc

SEQ ID NO: 175516 - DNA, 29 bp, Artificial Sequence
  Description of Artificial Sequence: Synthetic oligonucleotide
aggtgaagatcacccctggaaagccctac

SEQ ID NO: 175517 - DNA, 28 bp, Artificial Sequence
  Description of Artificial Sequence: Synthetic oligonucleotide
ggtgaagatcacccctggaaagccctac

SEQ ID NO: 175518 - DNA, 30 bp, Artificial Sequence
  Description of Artificial Sequence: Synthetic oligonucleotide
gtgaagatcacccctggaaagccctacatc

SEQ ID NO: 175519 - DNA, 30 bp, Artificial Sequence
  Description of Artificial Sequence: Synthetic oligonucleotide
tgaagatcacccctggaaagccctacatcc

SEQ ID NO: 175520 - DNA, 29 bp, Artificial Sequence
  Description of Artificial Sequence: Synthetic oligonucleotide
gaagatcacccctggaaagccctacatcc

SEQ ID NO: 175521 - DNA, 30 bp, Artificial Sequence
  Description of Artificial Sequence: Synthetic oligonucleotide
aagatcacccctggaaagccctacatcctg

SEQ ID NO: 175522 - DNA, 29 bp, Artificial Sequence
  Description of Artificial Sequence: Synthetic oligonucleotide
agatcacccctggaaagccctacatcctg

SEQ ID NO: 175523 - DNA, 28 bp, Artificial Sequence
  Description of Artificial Sequence: Synthetic oligonucleotide
gatcacccctggaaagccctacatcctg

SEQ ID NO: 175524 - DNA, 29 bp, Artificial Sequence
  Description of Artificial Sequence: Synthetic oligonucleotide
atcacccctggaaagccctacatcctgac

SEQ ID NO: 175525 - DNA, 28 bp, Artificial Sequence
  Description of Artificial Sequence: Synthetic oligonucleotide
tcacccctggaaagccctacatcctgac

SEQ ID NO: 175526 - DNA, 27 bp, Artificial Sequence
  Description of Artificial Sequence: Synthetic oligonucleotide
cacccctggaaagccctacatcctgac

SEQ ID NO: 175527 - DNA, 27 bp, Artificial Sequence
  Description of Artificial Sequence: Synthetic oligonucleotide
acccctggaaagccctacatcctgacg

SEQ ID NO: 175528 - DNA, 26 bp, Artificial Sequence
  Description of Artificial Sequence: Synthetic oligonucleotide
cccctggaaagccctacatcctgacg

SEQ ID NO: 175529 - DNA, 27 bp, Artificial Sequence
  Description of Artificial Sequence: Synthetic oligonucleotide
ccctggaaagccctacatcctgacggt

SEQ ID NO: 175530 - DNA, 27 bp, Artificial Sequence
  Description of Artificial Sequence: Synthetic oligonucleotide
cctggaaagccctacatcctgacggtg

SEQ ID NO: 175531 - DNA, 27 bp, Artificial Sequence
  Description of Artificial Sequence: Synthetic oligonucleotide
ctggaaagccctacatcctgacggtgc

SEQ ID NO: 175532 - DNA, 27 bp, Artificial Sequence
  Description of Artificial Sequence: Synthetic oligonucleotide
tggaaagccctacatcctgacggtgcc

SEQ ID NO: 175533 - DNA, 27 bp, Artificial Sequence
  Description of Artificial Sequence: Synthetic oligonucleotide
ggaaagccctacatcctgacggtgcca

SEQ ID NO: 175534 - DNA, 27 bp, Artificial Sequence
  Description of Artificial Sequence: Synthetic oligonucleotide
gaaagccctacatcctgacggtgccag

SEQ ID NO: 175535 - DNA, 27 bp, Artificial Sequence
  Description of Artificial Sequence: Synthetic oligonucleotide
aaagccctacatcctgacggtgccagg

SEQ ID NO: 175536 - DNA, 26 bp, Artificial Sequence
  Description of Artificial Sequence: Synthetic oligonucleotide
aagccctacatcctgacggtgccagg

SEQ ID NO: 175537 - DNA, 25 bp, Artificial Sequence
  Description of Artificial Sequence: Synthetic oligonucleotide
agccctacatcctgacggtgccagg

SEQ ID NO: 175538 - DNA, 24 bp, Artificial Sequence
  Description of Artificial Sequence: Synthetic oligonucleotide
gccctacatcctgacggtgccagg

SEQ ID NO: 175539 - DNA, 24 bp, Artificial Sequence
  Description of Artificial Sequence: Synthetic oligonucleotide
ccctacatcctgacggtgccaggc

SEQ ID NO: 175540 - DNA, 26 bp, Artificial Sequence
  Description of Artificial Sequence: Synthetic oligonucleotide
cctacatcctgacggtgccaggccat

SEQ ID NO: 175541 - DNA, 27 bp, Artificial Sequence
  Description of Artificial Sequence: Synthetic oligonucleotide
ctacatcctgacggtgccaggccatct

SEQ ID NO: 175542 - DNA, 28 bp, Artificial Sequence
  Description of Artificial Sequence: Synthetic oligonucleotide
tacatcctgacggtgccaggccatcttg

SEQ ID NO: 175543 - DNA, 27 bp, Artificial Sequence
  Description of Artificial Sequence: Synthetic oligonucleotide
acatcctgacggtgccaggccatcttg

SEQ ID NO: 175544 - DNA, 27 bp, Artificial Sequence
  Description of Artificial Sequence: Synthetic oligonucleotide
catcctgacggtgccaggccatcttga

SEQ ID NO: 175545 - DNA, 28 bp, Artificial Sequence
  Description of Artificial Sequence: Synthetic oligonucleotide
atcctgacggtgccaggccatcttgatg

SEQ ID NO: 175546 - DNA, 27 bp, Artificial Sequence
  Description of Artificial Sequence: Synthetic oligonucleotide
tcctgacggtgccaggccatcttgatg

SEQ ID NO: 175547 - DNA, 27 bp, Artificial Sequence
  Description of Artificial Sequence: Synthetic oligonucleotide
cctgacggtgccaggccatcttgatga

SEQ ID NO: 175548 - DNA, 30 bp, Artificial Sequence
  Description of Artificial Sequence: Synthetic oligonucleotide
ctgacggtgccaggccatcttgatgaaatg

SEQ ID NO: 175549 - DNA, 30 bp, Artificial Sequence
  Description of Artificial Sequence: Synthetic oligonucleotide
tgacggtgccaggccatcttgatgaaatgc

SEQ ID NO: 175550 - DNA, 29 bp, Artificial Sequence
  Description of Artificial Sequence: Synthetic oligonucleotide
gacggtgccaggccatcttgatgaaatgc

SEQ ID NO: 175551 - DNA, 30 bp, Artificial Sequence
  Description of Artificial Sequence: Synthetic oligonucleotide
acggtgccaggccatcttgatgaaatgcag

SEQ ID NO: 175552 - DNA, 29 bp, Artificial Sequence
  Description of Artificial Sequence: Synthetic oligonucleotide
cggtgccaggccatcttgatgaaatgcag

SEQ ID NO: 175553 - DNA, 32 bp, Artificial Sequence
  Description of Artificial Sequence: Synthetic oligonucleotide
ggtgccaggccatcttgatgaaatgcagttag

SEQ ID NO: 175554 - DNA, 33 bp, Artificial Sequence
  Description of Artificial Sequence: Synthetic oligonucleotide
gtgccaggccatcttgatgaaatgcagttagac

SEQ ID NO: 175555 - DNA, 35 bp, Artificial Sequence
  Description of Artificial Sequence: Synthetic oligonucleotide
tgccaggccatcttgatgaaatgcagttagacatc

SEQ ID NO: 175556 - DNA, 34 bp, Artificial Sequence
  Description of Artificial Sequence: Synthetic oligonucleotide
gccaggccatcttgatgaaatgcagttagacatc

SEQ ID NO: 175557 - DNA, 34 bp, Artificial Sequence
  Description of Artificial Sequence: Synthetic oligonucleotide
ccaggccatcttgatgaaatgcagttagacatcc

SEQ ID NO: 175558 - DNA, 35 bp, Artificial Sequence
  Description of Artificial Sequence: Synthetic oligonucleotide
caggccatcttgatgaaatgcagttagacatccag

SEQ ID NO: 175559 - DNA, 35 bp, Artificial Sequence
  Description of Artificial Sequence: Synthetic oligonucleotide
aggccatcttgatgaaatgcagttagacatccagg

SEQ ID NO: 175560 - DNA, 34 bp, Artificial Sequence
  Description of Artificial Sequence: Synthetic oligonucleotide
ggccatcttgatgaaatgcagttagacatccagg

SEQ ID NO: 175561 - DNA, 34 bp, Artificial Sequence
  Description of Artificial Sequence: Synthetic oligonucleotide
gccatcttgatgaaatgcagttagacatccaggc

SEQ ID NO: 175562 - DNA, 34 bp, Artificial Sequence
  Description of Artificial Sequence: Synthetic oligonucleotide
ccatcttgatgaaatgcagttagacatccaggcc

SEQ ID NO: 175563 - DNA, 35 bp, Artificial Sequence
  Description of Artificial Sequence: Synthetic oligonucleotide
catcttgatgaaatgcagttagacatccaggccag

SEQ ID NO: 175564 - DNA, 35 bp, Artificial Sequence
  Description of Artificial Sequence: Synthetic oligonucleotide
atcttgatgaaatgcagttagacatccaggccagg

SEQ ID NO: 175565 - DNA, 34 bp, Artificial Sequence
  Description of Artificial Sequence: Synthetic oligonucleotide
tcttgatgaaatgcagttagacatccaggccagg

SEQ ID NO: 175566 - DNA, 33 bp, Artificial Sequence
  Description of Artificial Sequence: Synthetic oligonucleotide
cttgatgaaatgcagttagacatccaggccagg

SEQ ID NO: 175567 - DNA, 35 bp, Artificial Sequence
  Description of Artificial Sequence: Synthetic oligonucleotide
ttgatgaaatgcagttagacatccaggccaggtac

SEQ ID NO: 175568 - DNA, 34 bp, Artificial Sequence
  Description of Artificial Sequence: Synthetic oligonucleotide
tgatgaaatgcagttagacatccaggccaggtac

SEQ ID NO: 175569 - DNA, 33 bp, Artificial Sequence
  Description of Artificial Sequence: Synthetic oligonucleotide
gatgaaatgcagttagacatccaggccaggtac

SEQ ID NO: 175570 - DNA, 35 bp, Artificial Sequence
  Description of Artificial Sequence: Synthetic oligonucleotide
atgaaatgcagttagacatccaggccaggtacatc

SEQ ID NO: 175571 - DNA, 34 bp, Artificial Sequence
  Description of Artificial Sequence: Synthetic oligonucleotide
tgaaatgcagttagacatccaggccaggtacatc

SEQ ID NO: 175572 - DNA, 33 bp, Artificial Sequence
  Description of Artificial Sequence: Synthetic oligonucleotide
gaaatgcagttagacatccaggccaggtacatc

SEQ ID NO: 175573 - DNA, 36 bp, Artificial Sequence
  Description of Artificial Sequence: Synthetic oligonucleotide
aaatgcagttagacatccaggccaggtacatctatg

SEQ ID NO: 175574 - DNA, 35 bp, Artificial Sequence
  Description of Artificial Sequence: Synthetic oligonucleotide
aatgcagttagacatccaggccaggtacatctatg

SEQ ID NO: 175575 - DNA, 34 bp, Artificial Sequence
  Description of Artificial Sequence: Synthetic oligonucleotide
atgcagttagacatccaggccaggtacatctatg

SEQ ID NO: 175576 - DNA, 33 bp, Artificial Sequence
  Description of Artificial Sequence: Synthetic oligonucleotide
tgcagttagacatccaggccaggtacatctatg

SEQ ID NO: 175577 - DNA, 32 bp, Artificial Sequence
  Description of Artificial Sequence: Synthetic oligonucleotide
gcagttagacatccaggccaggtacatctatg

SEQ ID NO: 175578 - DNA, 32 bp, Artificial Sequence
  Description of Artificial Sequence: Synthetic oligonucleotide
cagttagacatccaggccaggtacatctatgg

SEQ ID NO: 175579 - DNA, 32 bp, Artificial Sequence
  Description of Artificial Sequence: Synthetic oligonucleotide
agttagacatccaggccaggtacatctatggg

SEQ ID NO: 175580 - DNA, 31 bp, Artificial Sequence
  Description of Artificial Sequence: Synthetic oligonucleotide
gttagacatccaggccaggtacatctatggg

SEQ ID NO: 175581 - DNA, 33 bp, Artificial Sequence
  Description of Artificial Sequence: Synthetic oligonucleotide
ttagacatccaggccaggtacatctatgggaag

SEQ ID NO: 175582 - DNA, 32 bp, Artificial Sequence
  Description of Artificial Sequence: Synthetic oligonucleotide
tagacatccaggccaggtacatctatgggaag

SEQ ID NO: 175583 - DNA, 31 bp, Artificial Sequence
  Description of Artificial Sequence: Synthetic oligonucleotide
agacatccaggccaggtacatctatgggaag

SEQ ID NO: 175584 - DNA, 30 bp, Artificial Sequence
  Description of Artificial Sequence: Synthetic oligonucleotide
gacatccaggccaggtacatctatgggaag

SEQ ID NO: 175585 - DNA, 30 bp, Artificial Sequence
  Description of Artificial Sequence: Synthetic oligonucleotide
acatccaggccaggtacatctatgggaagc

SEQ ID NO: 175586 - DNA, 29 bp, Artificial Sequence
  Description of Artificial Sequence: Synthetic oligonucleotide
catccaggccaggtacatctatgggaagc

SEQ ID NO: 175587 - DNA, 29 bp, Artificial Sequence
  Description of Artificial Sequence: Synthetic oligonucleotide
atccaggccaggtacatctatgggaagcc

SEQ ID NO: 175588 - DNA, 28 bp, Artificial Sequence
  Description of Artificial Sequence: Synthetic oligonucleotide
tccaggccaggtacatctatgggaagcc

SEQ ID NO: 175589 - DNA, 27 bp, Artificial Sequence
  Description of Artificial Sequence: Synthetic oligonucleotide
ccaggccaggtacatctatgggaagcc

SEQ ID NO: 175590 - DNA, 28 bp, Artificial Sequence
  Description of Artificial Sequence: Synthetic oligonucleotide
caggccaggtacatctatgggaagccag

SEQ ID NO: 175591 - DNA, 29 bp, Artificial Sequence
  Description of Artificial Sequence: Synthetic oligonucleotide
aggccaggtacatctatgggaagccagtg

SEQ ID NO: 175592 - DNA, 28 bp, Artificial Sequence
  Description of Artificial Sequence: Synthetic oligonucleotide
ggccaggtacatctatgggaagccagtg

SEQ ID NO: 175593 - DNA, 28 bp, Artificial Sequence
  Description of Artificial Sequence: Synthetic oligonucleotide
gccaggtacatctatgggaagccagtgc

SEQ ID NO: 175594 - DNA, 29 bp, Artificial Sequence
  Description of Artificial Sequence: Synthetic oligonucleotide
ccaggtacatctatgggaagccagtgcag

SEQ ID NO: 175595 - DNA, 29 bp, Artificial Sequence
  Description of Artificial Sequence: Synthetic oligonucleotide
caggtacatctatgggaagccagtgcagg

SEQ ID NO: 175596 - DNA, 29 bp, Artificial Sequence
  Description of Artificial Sequence: Synthetic oligonucleotide
aggtacatctatgggaagccagtgcaggg

SEQ ID NO: 175597 - DNA, 28 bp, Artificial Sequence
  Description of Artificial Sequence: Synthetic oligonucleotide
ggtacatctatgggaagccagtgcaggg

SEQ ID NO: 175598 - DNA, 28 bp, Artificial Sequence
  Description of Artificial Sequence: Synthetic oligonucleotide
gtacatctatgggaagccagtgcagggg

SEQ ID NO: 175599 - DNA, 28 bp, Artificial Sequence
  Description of Artificial Sequence: Synthetic oligonucleotide
tacatctatgggaagccagtgcaggggg

SEQ ID NO: 175600 - DNA, 27 bp, Artificial Sequence
  Description of Artificial Sequence: Synthetic oligonucleotide
acatctatgggaagccagtgcaggggg

SEQ ID NO: 175601 - DNA, 27 bp, Artificial Sequence
  Description of Artificial Sequence: Synthetic oligonucleotide
catctatgggaagccagtgcagggggt

SEQ ID NO: 175602 - DNA, 27 bp, Artificial Sequence
  Description of Artificial Sequence: Synthetic oligonucleotide
atctatgggaagccagtgcagggggtg

SEQ ID NO: 175603 - DNA, 26 bp, Artificial Sequence
  Description of Artificial Sequence: Synthetic oligonucleotide
tctatgggaagccagtgcagggggtg

SEQ ID NO: 175604 - DNA, 25 bp, Artificial Sequence
  Description of Artificial Sequence: Synthetic oligonucleotide
ctatgggaagccagtgcagggggtg

SEQ ID NO: 175605 - DNA, 25 bp, Artificial Sequence
  Description of Artificial Sequence: Synthetic oligonucleotide
tatgggaagccagtgcagggggtgg

SEQ ID NO: 175606 - DNA, 24 bp, Artificial Sequence
  Description of Artificial Sequence: Synthetic oligonucleotide
atgggaagccagtgcagggggtgg

SEQ ID NO: 175607 - DNA, 23 bp, Artificial Sequence
  Description of Artificial Sequence: Synthetic oligonucleotide
tgggaagccagtgcagggggtgg

SEQ ID NO: 175608 - DNA, 22 bp, Artificial Sequence
  Description of Artificial Sequence: Synthetic oligonucleotide
gggaagccagtgcagggggtgg

SEQ ID NO: 175609 - DNA, 26 bp, Artificial Sequence
  Description of Artificial Sequence: Synthetic oligonucleotide
ggaagccagtgcagggggtggcatat

SEQ ID NO: 175610 - DNA, 27 bp, Artificial Sequence
  Description of Artificial Sequence: Synthetic oligonucleotide
gaagccagtgcagggggtggcatatgt

SEQ ID NO: 175611 - DNA, 27 bp, Artificial Sequence
  Description of Artificial Sequence: Synthetic oligonucleotide
aagccagtgcagggggtggcatatgtg

SEQ ID NO: 175612 - DNA, 26 bp, Artificial Sequence
  Description of Artificial Sequence: Synthetic oligonucleotide
agccagtgcagggggtggcatatgtg

SEQ ID NO: 175613 - DNA, 25 bp, Artificial Sequence
  Description of Artificial Sequence: Synthetic oligonucleotide
gccagtgcagggggtggcatatgtg

SEQ ID NO: 175614 - DNA, 25 bp, Artificial Sequence
  Description of Artificial Sequence: Synthetic oligonucleotide
ccagtgcagggggtggcatatgtgc

SEQ ID NO: 175615 - DNA, 25 bp, Artificial Sequence
  Description of Artificial Sequence: Synthetic oligonucleotide
cagtgcagggggtggcatatgtgcg

SEQ ID NO: 175616 - DNA, 27 bp, Artificial Sequence
  Description of Artificial Sequence: Synthetic oligonucleotide
agtgcagggggtggcatatgtgcgctt

SEQ ID NO: 175617 - DNA, 27 bp, Artificial Sequence
  Description of Artificial Sequence: Synthetic oligonucleotide
gtgcagggggtggcatatgtgcgcttt

SEQ ID NO: 175618 - DNA, 27 bp, Artificial Sequence
  Description of Artificial Sequence: Synthetic oligonucleotide
tgcagggggtggcatatgtgcgctttg

SEQ ID NO: 175619 - DNA, 26 bp, Artificial Sequence
  Description of Artificial Sequence: Synthetic oligonucleotide
gcagggggtggcatatgtgcgctttg

SEQ ID NO: 175620 - DNA, 26 bp, Artificial Sequence
  Description of Artificial Sequence: Synthetic oligonucleotide
cagggggtggcatatgtgcgctttgg

SEQ ID NO: 175621 - DNA, 26 bp, Artificial Sequence
  Description of Artificial Sequence: Synthetic oligonucleotide
agggggtggcatatgtgcgctttggg

SEQ ID NO: 175622 - DNA, 25 bp, Artificial Sequence
  Description of Artificial Sequence: Synthetic oligonucleotide
gggggtggcatatgtgcgctttggg

SEQ ID NO: 175623 - DNA, 26 bp, Artificial Sequence
  Description of Artificial Sequence: Synthetic oligonucleotide
ggggtggcatatgtgcgctttgggct

SEQ ID NO: 175624 - DNA, 26 bp, Artificial Sequence
  Description of Artificial Sequence: Synthetic oligonucleotide
gggtggcatatgtgcgctttgggctc

SEQ ID NO: 175625 - DNA, 27 bp, Artificial Sequence
  Description of Artificial Sequence: Synthetic oligonucleotide
ggtggcatatgtgcgctttgggctcct

SEQ ID NO: 175626 - DNA, 28 bp, Artificial Sequence
  Description of Artificial Sequence: Synthetic oligonucleotide
gtggcatatgtgcgctttgggctcctag

SEQ ID NO: 175627 - DNA, 30 bp, Artificial Sequence
  Description of Artificial Sequence: Synthetic oligonucleotide
tggcatatgtgcgctttgggctcctagatg

SEQ ID NO: 175628 - DNA, 29 bp, Artificial Sequence
  Description of Artificial Sequence: Synthetic oligonucleotide
ggcatatgtgcgctttgggctcctagatg

SEQ ID NO: 175629 - DNA, 30 bp, Artificial Sequence
  Description of Artificial Sequence: Synthetic oligonucleotide
gcatatgtgcgctttgggctcctagatgag

SEQ ID NO: 175630 - DNA, 30 bp, Artificial Sequence
  Description of Artificial Sequence: Synthetic oligonucleotide
catatgtgcgctttgggctcctagatgagg

SEQ ID NO: 175631 - DNA, 32 bp, Artificial Sequence
  Description of Artificial Sequence: Synthetic oligonucleotide
atatgtgcgctttgggctcctagatgaggatg

SEQ ID NO: 175632 - DNA, 31 bp, Artificial Sequence
  Description of Artificial Sequence: Synthetic oligonucleotide
tatgtgcgctttgggctcctagatgaggatg

SEQ ID NO: 175633 - DNA, 30 bp, Artificial Sequence
  Description of Artificial Sequence: Synthetic oligonucleotide
atgtgcgctttgggctcctagatgaggatg

SEQ ID NO: 175634 - DNA, 29 bp, Artificial Sequence
  Description of Artificial Sequence: Synthetic oligonucleotide
tgtgcgctttgggctcctagatgaggatg

SEQ ID NO: 175635 - DNA, 28 bp, Artificial Sequence
  Description of Artificial Sequence: Synthetic oligonucleotide
gtgcgctttgggctcctagatgaggatg

SEQ ID NO: 175636 - DNA, 28 bp, Artificial Sequence
  Description of Artificial Sequence: Synthetic oligonucleotide
tgcgctttgggctcctagatgaggatgg

SEQ ID NO: 175637 - DNA, 27 bp, Artificial Sequence
  Description of Artificial Sequence: Synthetic oligonucleotide
gcgctttgggctcctagatgaggatgg

SEQ ID NO: 175638 - DNA, 30 bp, Artificial Sequence
  Description of Artificial Sequence: Synthetic oligonucleotide
cgctttgggctcctagatgaggatggtaag

SEQ ID NO: 175639 - DNA, 32 bp, Artificial Sequence
  Description of Artificial Sequence: Synthetic oligonucleotide
gctttgggctcctagatgaggatggtaagaag

SEQ ID NO: 175640 - DNA, 33 bp, Artificial Sequence
  Description of Artificial Sequence: Synthetic oligonucleotide
ctttgggctcctagatgaggatggtaagaagac

SEQ ID NO: 175641 - DNA, 36 bp, Artificial Sequence
  Description of Artificial Sequence: Synthetic oligonucleotide
tttgggctcctagatgaggatggtaagaagactttc

SEQ ID NO: 175642 - DNA, 35 bp, Artificial Sequence
  Description of Artificial Sequence: Synthetic oligonucleotide
ttgggctcctagatgaggatggtaagaagactttc

SEQ ID NO: 175643 - DNA, 34 bp, Artificial Sequence
  Description of Artificial Sequence: Synthetic oligonucleotide
tgggctcctagatgaggatggtaagaagactttc

SEQ ID NO: 175644 - DNA, 33 bp, Artificial Sequence
  Description of Artificial Sequence: Synthetic oligonucleotide
gggctcctagatgaggatggtaagaagactttc

SEQ ID NO: 175645 - DNA, 36 bp, Artificial Sequence
  Description of Artificial Sequence: Synthetic oligonucleotide
ggctcctagatgaggatggtaagaagactttctttc

SEQ ID NO: 175646 - DNA, 36 bp, Artificial Sequence
  Description of Artificial Sequence: Synthetic oligonucleotide
gctcctagatgaggatggtaagaagactttctttcg

SEQ ID NO: 175647 - DNA, 36 bp, Artificial Sequence
  Description of Artificial Sequence: Synthetic oligonucleotide
ctcctagatgaggatggtaagaagactttctttcgg

SEQ ID NO: 175648 - DNA, 36 bp, Artificial Sequence
  Description of Artificial Sequence: Synthetic oligonucleotide
tcctagatgaggatggtaagaagactttctttcggg

SEQ ID NO: 175649 - DNA, 35 bp, Artificial Sequence
  Description of Artificial Sequence: Synthetic oligonucleotide
cctagatgaggatggtaagaagactttctttcggg

SEQ ID NO: 175650 - DNA, 35 bp, Artificial Sequence
  Description of Artificial Sequence: Synthetic oligonucleotide
ctagatgaggatggtaagaagactttctttcgggg

SEQ ID NO: 175651 - DNA, 35 bp, Artificial Sequence
  Description of Artificial Sequence: Synthetic oligonucleotide
tagatgaggatggtaagaagactttctttcggggg

SEQ ID NO: 175652 - DNA, 34 bp, Artificial Sequence
  Description of Artificial Sequence: Synthetic oligonucleotide
agatgaggatggtaagaagactttctttcggggg

SEQ ID NO: 175653 - DNA, 33 bp, Artificial Sequence
  Description of Artificial Sequence: Synthetic oligonucleotide
gatgaggatggtaagaagactttctttcggggg

SEQ ID NO: 175654 - DNA, 33 bp, Artificial Sequence
  Description of Artificial Sequence: Synthetic oligonucleotide
atgaggatggtaagaagactttctttcgggggc

SEQ ID NO: 175655 - DNA, 32 bp, Artificial Sequence
  Description of Artificial Sequence: Synthetic oligonucleotide
tgaggatggtaagaagactttctttcgggggc

SEQ ID NO: 175656 - DNA, 31 bp, Artificial Sequence
  Description of Artificial Sequence: Synthetic oligonucleotide
gaggatggtaagaagactttctttcgggggc

SEQ ID NO: 175657 - DNA, 32 bp, Artificial Sequence
  Description of Artificial Sequence: Synthetic oligonucleotide
aggatggtaagaagactttctttcgggggctg

SEQ ID NO: 175658 - DNA, 31 bp, Artificial Sequence
  Description of Artificial Sequence: Synthetic oligonucleotide
ggatggtaagaagactttctttcgggggctg

SEQ ID NO: 175659 - DNA, 31 bp, Artificial Sequence
  Description of Artificial Sequence: Synthetic oligonucleotide
gatggtaagaagactttctttcgggggctgg

SEQ ID NO: 175660 - DNA, 32 bp, Artificial Sequence
  Description of Artificial Sequence: Synthetic oligonucleotide
atggtaagaagactttctttcgggggctggag

SEQ ID NO: 175661 - DNA, 31 bp, Artificial Sequence
  Description of Artificial Sequence: Synthetic oligonucleotide
tggtaagaagactttctttcgggggctggag

SEQ ID NO: 175662 - DNA, 30 bp, Artificial Sequence
  Description of Artificial Sequence: Synthetic oligonucleotide
ggtaagaagactttctttcgggggctggag

SEQ ID NO: 175663 - DNA, 31 bp, Artificial Sequence
  Description of Artificial Sequence: Synthetic oligonucleotide
gtaagaagactttctttcgggggctggagag

SEQ ID NO: 175664 - DNA, 32 bp, Artificial Sequence
  Description of Artificial Sequence: Synthetic oligonucleotide
taagaagactttctttcgggggctggagagtc

SEQ ID NO: 175665 - DNA, 31 bp, Artificial Sequence
  Description of Artificial Sequence: Synthetic oligonucleotide
aagaagactttctttcgggggctggagagtc

SEQ ID NO: 175666 - DNA, 30 bp, Artificial Sequence
  Description of Artificial Sequence: Synthetic oligonucleotide
agaagactttctttcgggggctggagagtc

SEQ ID NO: 175667 - DNA, 29 bp, Artificial Sequence
  Description of Artificial Sequence: Synthetic oligonucleotide
gaagactttctttcgggggctggagagtc

SEQ ID NO: 175668 - DNA, 30 bp, Artificial Sequence
  Description of Artificial Sequence: Synthetic oligonucleotide
aagactttctttcgggggctggagagtcag

SEQ ID NO: 175669 - DNA, 29 bp, Artificial Sequence
  Description of Artificial Sequence: Synthetic oligonucleotide
agactttctttcgggggctggagagtcag

SEQ ID NO: 175670 - DNA, 28 bp, Artificial Sequence
  Description of Artificial Sequence: Synthetic oligonucleotide
gactttctttcgggggctggagagtcag

SEQ ID NO: 175671 - DNA, 29 bp, Artificial Sequence
  Description of Artificial Sequence: Synthetic oligonucleotide
actttctttcgggggctggagagtcagac

SEQ ID NO: 175672 - DNA, 28 bp, Artificial Sequence
  Description of Artificial Sequence: Synthetic oligonucleotide
ctttctttcgggggctggagagtcagac

SEQ ID NO: 175673 - DNA, 28 bp, Artificial Sequence
  Description of Artificial Sequence: Synthetic oligonucleotide
tttctttcgggggctggagagtcagacc

SEQ ID NO: 175674 - DNA, 27 bp, Artificial Sequence
  Description of Artificial Sequence: Synthetic oligonucleotide
ttctttcgggggctggagagtcagacc

SEQ ID NO: 175675 - DNA, 27 bp, Artificial Sequence
  Description of Artificial Sequence: Synthetic oligonucleotide
tctttcgggggctggagagtcagacca

SEQ ID NO: 175676 - DNA, 27 bp, Artificial Sequence
  Description of Artificial Sequence: Synthetic oligonucleotide
ctttcgggggctggagagtcagaccaa

SEQ ID NO: 175677 - DNA, 27 bp, Artificial Sequence
  Description of Artificial Sequence: Synthetic oligonucleotide
tttcgggggctggagagtcagaccaag

SEQ ID NO: 175678 - DNA, 26 bp, Artificial Sequence
  Description of Artificial Sequence: Synthetic oligonucleotide
ttcgggggctggagagtcagaccaag

SEQ ID NO: 175679 - DNA, 25 bp, Artificial Sequence
  Description of Artificial Sequence: Synthetic oligonucleotide
tcgggggctggagagtcagaccaag

SEQ ID NO: 175680 - DNA, 24 bp, Artificial Sequence
  Description of Artificial Sequence: Synthetic oligonucleotide
cgggggctggagagtcagaccaag

SEQ ID NO: 175681 - DNA, 25 bp, Artificial Sequence
  Description of Artificial Sequence: Synthetic oligonucleotide
gggggctggagagtcagaccaagct

SEQ ID NO: 175682 - DNA, 25 bp, Artificial Sequence
  Description of Artificial Sequence: Synthetic oligonucleotide
ggggctggagagtcagaccaagctg

SEQ ID NO: 175683 - DNA, 26 bp, Artificial Sequence
  Description of Artificial Sequence: Synthetic oligonucleotide
gggctggagagtcagaccaagctggt

SEQ ID NO: 175684 - DNA, 27 bp, Artificial Sequence
  Description of Artificial Sequence: Synthetic oligonucleotide
ggctggagagtcagaccaagctggtga

SEQ ID NO: 175685 - DNA, 29 bp, Artificial Sequence
  Description of Artificial Sequence: Synthetic oligonucleotide
gctggagagtcagaccaagctggtgaatg

SEQ ID NO: 175686 - DNA, 29 bp, Artificial Sequence
  Description of Artificial Sequence: Synthetic oligonucleotide
ctggagagtcagaccaagctggtgaatgg

SEQ ID NO: 175687 - DNA, 30 bp, Artificial Sequence
  Description of Artificial Sequence: Synthetic oligonucleotide
tggagagtcagaccaagctggtgaatggac

SEQ ID NO: 175688 - DNA, 29 bp, Artificial Sequence
  Description of Artificial Sequence: Synthetic oligonucleotide
ggagagtcagaccaagctggtgaatggac

SEQ ID NO: 175689 - DNA, 30 bp, Artificial Sequence
  Description of Artificial Sequence: Synthetic oligonucleotide
gagagtcagaccaagctggtgaatggacag

SEQ ID NO: 175690 - DNA, 31 bp, Artificial Sequence
  Description of Artificial Sequence: Synthetic oligonucleotide
agagtcagaccaagctggtgaatggacagag

SEQ ID NO: 175691 - DNA, 30 bp, Artificial Sequence
  Description of Artificial Sequence: Synthetic oligonucleotide
gagtcagaccaagctggtgaatggacagag

SEQ ID NO: 175692 - DNA, 30 bp, Artificial Sequence
  Description of Artificial Sequence: Synthetic oligonucleotide
agtcagaccaagctggtgaatggacagagc

SEQ ID NO: 175693 - DNA, 29 bp, Artificial Sequence
  Description of Artificial Sequence: Synthetic oligonucleotide
gtcagaccaagctggtgaatggacagagc

SEQ ID NO: 175694 - DNA, 29 bp, Artificial Sequence
  Description of Artificial Sequence: Synthetic oligonucleotide
tcagaccaagctggtgaatggacagagcc

SEQ ID NO: 175695 - DNA, 28 bp, Artificial Sequence
  Description of Artificial Sequence: Synthetic oligonucleotide
cagaccaagctggtgaatggacagagcc

SEQ ID NO: 175696 - DNA, 29 bp, Artificial Sequence
  Description of Artificial Sequence: Synthetic oligonucleotide
agaccaagctggtgaatggacagagccac

SEQ ID NO: 175697 - DNA, 28 bp, Artificial Sequence
  Description of Artificial Sequence: Synthetic oligonucleotide
gaccaagctggtgaatggacagagccac

SEQ ID NO: 175698 - DNA, 32 bp, Artificial Sequence
  Description of Artificial Sequence: Synthetic oligonucleotide
accaagctggtgaatggacagagccacatttc

SEQ ID NO: 175699 - DNA, 31 bp, Artificial Sequence
  Description of Artificial Sequence: Synthetic oligonucleotide
ccaagctggtgaatggacagagccacatttc

SEQ ID NO: 175700 - DNA, 31 bp, Artificial Sequence
  Description of Artificial Sequence: Synthetic oligonucleotide
caagctggtgaatggacagagccacatttcc

SEQ ID NO: 175701 - DNA, 31 bp, Artificial Sequence
  Description of Artificial Sequence: Synthetic oligonucleotide
aagctggtgaatggacagagccacatttccc

SEQ ID NO: 175702 - DNA, 30 bp, Artificial Sequence
  Description of Artificial Sequence: Synthetic oligonucleotide
agctggtgaatggacagagccacatttccc

SEQ ID NO: 175703 - DNA, 29 bp, Artificial Sequence
  Description of Artificial Sequence: Synthetic oligonucleotide
gctggtgaatggacagagccacatttccc

SEQ ID NO: 175704 - DNA, 30 bp, Artificial Sequence
  Description of Artificial Sequence: Synthetic oligonucleotide
ctggtgaatggacagagccacatttccctc

SEQ ID NO: 175705 - DNA, 31 bp, Artificial Sequence
  Description of Artificial Sequence: Synthetic oligonucleotide
tggtgaatggacagagccacatttccctctc

SEQ ID NO: 175706 - DNA, 30 bp, Artificial Sequence
  Description of Artificial Sequence: Synthetic oligonucleotide
ggtgaatggacagagccacatttccctctc

SEQ ID NO: 175707 - DNA, 33 bp, Artificial Sequence
  Description of Artificial Sequence: Synthetic oligonucleotide
gtgaatggacagagccacatttccctctcaaag

SEQ ID NO: 175708 - DNA, 33 bp, Artificial Sequence
  Description of Artificial Sequence: Synthetic oligonucleotide
tgaatggacagagccacatttccctctcaaagg

SEQ ID NO: 175709 - DNA, 32 bp, Artificial Sequence
  Description of Artificial Sequence: Synthetic oligonucleotide
gaatggacagagccacatttccctctcaaagg

SEQ ID NO: 175710 - DNA, 32 bp, Artificial Sequence
  Description of Artificial Sequence: Synthetic oligonucleotide
aatggacagagccacatttccctctcaaaggc

SEQ ID NO: 175711 - DNA, 31 bp, Artificial Sequence
  Description of Artificial Sequence: Synthetic oligonucleotide
atggacagagccacatttccctctcaaaggc

SEQ ID NO: 175712 - DNA, 30 bp, Artificial Sequence
  Description of Artificial Sequence: Synthetic oligonucleotide
tggacagagccacatttccctctcaaaggc

SEQ ID NO: 175713 - DNA, 29 bp, Artificial Sequence
  Description of Artificial Sequence: Synthetic oligonucleotide
ggacagagccacatttccctctcaaaggc

SEQ ID NO: 175714 - DNA, 30 bp, Artificial Sequence
  Description of Artificial Sequence: Synthetic oligonucleotide
gacagagccacatttccctctcaaaggcag

SEQ ID NO: 175715 - DNA, 31 bp, Artificial Sequence
  Description of Artificial Sequence: Synthetic oligonucleotide
acagagccacatttccctctcaaaggcagag

SEQ ID NO: 175716 - DNA, 30 bp, Artificial Sequence
  Description of Artificial Sequence: Synthetic oligonucleotide
cagagccacatttccctctcaaaggcagag

SEQ ID NO: 175717 - DNA, 32 bp, Artificial Sequence
  Description of Artificial Sequence: Synthetic oligonucleotide
agagccacatttccctctcaaaggcagagttc

SEQ ID NO: 175718 - DNA, 31 bp, Artificial Sequence
  Description of Artificial Sequence: Synthetic oligonucleotide
gagccacatttccctctcaaaggcagagttc

SEQ ID NO: 175719 - DNA, 31 bp, Artificial Sequence
  Description of Artificial Sequence: Synthetic oligonucleotide
agccacatttccctctcaaaggcagagttcc

SEQ ID NO: 175720 - DNA, 30 bp, Artificial Sequence
  Description of Artificial Sequence: Synthetic oligonucleotide
gccacatttccctctcaaaggcagagttcc

SEQ ID NO: 175721 - DNA, 31 bp, Artificial Sequence
  Description of Artificial Sequence: Synthetic oligonucleotide
ccacatttccctctcaaaggcagagttccag

SEQ ID NO: 175722 - DNA, 31 bp, Artificial Sequence
  Description of Artificial Sequence: Synthetic oligonucleotide
cacatttccctctcaaaggcagagttccagg

SEQ ID NO: 175723 - DNA, 32 bp, Artificial Sequence
  Description of Artificial Sequence: Synthetic oligonucleotide
acatttccctctcaaaggcagagttccaggac

SEQ ID NO: 175724 - DNA, 31 bp, Artificial Sequence
  Description of Artificial Sequence: Synthetic oligonucleotide
catttccctctcaaaggcagagttccaggac

SEQ ID NO: 175725 - DNA, 31 bp, Artificial Sequence
  Description of Artificial Sequence: Synthetic oligonucleotide
atttccctctcaaaggcagagttccaggacg

SEQ ID NO: 175726 - DNA, 30 bp, Artificial Sequence
  Description of Artificial Sequence: Synthetic oligonucleotide
tttccctctcaaaggcagagttccaggacg

SEQ ID NO: 175727 - DNA, 29 bp, Artificial Sequence
  Description of Artificial Sequence: Synthetic oligonucleotide
ttccctctcaaaggcagagttccaggacg

SEQ ID NO: 175728 - DNA, 28 bp, Artificial Sequence
  Description of Artificial Sequence: Synthetic oligonucleotide
tccctctcaaaggcagagttccaggacg

SEQ ID NO: 175729 - DNA, 27 bp, Artificial Sequence
  Description of Artificial Sequence: Synthetic oligonucleotide
ccctctcaaaggcagagttccaggacg

SEQ ID NO: 175730 - DNA, 27 bp, Artificial Sequence
  Description of Artificial Sequence: Synthetic oligonucleotide
cctctcaaaggcagagttccaggacgc

SEQ ID NO: 175731 - DNA, 27 bp, Artificial Sequence
  Description of Artificial Sequence: Synthetic oligonucleotide
ctctcaaaggcagagttccaggacgcc

SEQ ID NO: 175732 - DNA, 27 bp, Artificial Sequence
  Description of Artificial Sequence: Synthetic oligonucleotide
tctcaaaggcagagttccaggacgccc

SEQ ID NO: 175733 - DNA, 27 bp, Artificial Sequence
  Description of Artificial Sequence: Synthetic oligonucleotide
ctcaaaggcagagttccaggacgccct

SEQ ID NO: 175734 - DNA, 27 bp, Artificial Sequence
  Description of Artificial Sequence: Synthetic oligonucleotide
tcaaaggcagagttccaggacgccctg

SEQ ID NO: 175735 - DNA, 26 bp, Artificial Sequence
  Description of Artificial Sequence: Synthetic oligonucleotide
caaaggcagagttccaggacgccctg

SEQ ID NO: 175736 - DNA, 27 bp, Artificial Sequence
  Description of Artificial Sequence: Synthetic oligonucleotide
aaaggcagagttccaggacgccctgga

SEQ ID NO: 175737 - DNA, 26 bp, Artificial Sequence
  Description of Artificial Sequence: Synthetic oligonucleotide
aaggcagagttccaggacgccctgga

SEQ ID NO: 175738 - DNA, 25 bp, Artificial Sequence
  Description of Artificial Sequence: Synthetic oligonucleotide
aggcagagttccaggacgccctgga

SEQ ID NO: 175739 - DNA, 24 bp, Artificial Sequence
  Description of Artificial Sequence: Synthetic oligonucleotide
ggcagagttccaggacgccctgga

SEQ ID NO: 175740 - DNA, 26 bp, Artificial Sequence
  Description of Artificial Sequence: Synthetic oligonucleotide
gcagagttccaggacgccctggagaa

SEQ ID NO: 175741 - DNA, 26 bp, Artificial Sequence
  Description of Artificial Sequence: Synthetic oligonucleotide
cagagttccaggacgccctggagaag

SEQ ID NO: 175742 - DNA, 27 bp, Artificial Sequence
  Description of Artificial Sequence: Synthetic oligonucleotide
agagttccaggacgccctggagaagct

SEQ ID NO: 175743 - DNA, 26 bp, Artificial Sequence
  Description of Artificial Sequence: Synthetic oligonucleotide
gagttccaggacgccctggagaagct

SEQ ID NO: 175744 - DNA, 27 bp, Artificial Sequence
  Description of Artificial Sequence: Synthetic oligonucleotide
agttccaggacgccctggagaagctga

SEQ ID NO: 175745 - DNA, 27 bp, Artificial Sequence
  Description of Artificial Sequence: Synthetic oligonucleotide
gttccaggacgccctggagaagctgaa

SEQ ID NO: 175746 - DNA, 30 bp, Artificial Sequence
  Description of Artificial Sequence: Synthetic oligonucleotide
ttccaggacgccctggagaagctgaatatg

SEQ ID NO: 175747 - DNA, 29 bp, Artificial Sequence
  Description of Artificial Sequence: Synthetic oligonucleotide
tccaggacgccctggagaagctgaatatg

SEQ ID NO: 175748 - DNA, 28 bp, Artificial Sequence
  Description of Artificial Sequence: Synthetic oligonucleotide
ccaggacgccctggagaagctgaatatg

SEQ ID NO: 175749 - DNA, 28 bp, Artificial Sequence
  Description of Artificial Sequence: Synthetic oligonucleotide
caggacgccctggagaagctgaatatgg

SEQ ID NO: 175750 - DNA, 28 bp, Artificial Sequence
  Description of Artificial Sequence: Synthetic oligonucleotide
aggacgccctggagaagctgaatatggg

SEQ ID NO: 175751 - DNA, 27 bp, Artificial Sequence
  Description of Artificial Sequence: Synthetic oligonucleotide
ggacgccctggagaagctgaatatggg

SEQ ID NO: 175752 - DNA, 27 bp, Artificial Sequence
  Description of Artificial Sequence: Synthetic oligonucleotide
gacgccctggagaagctgaatatgggc

SEQ ID NO: 175753 - DNA, 31 bp, Artificial Sequence
  Description of Artificial Sequence: Synthetic oligonucleotide
acgccctggagaagctgaatatgggcattac

SEQ ID NO: 175754 - DNA, 30 bp, Artificial Sequence
  Description of Artificial Sequence: Synthetic oligonucleotide
cgccctggagaagctgaatatgggcattac

SEQ ID NO: 175755 - DNA, 31 bp, Artificial Sequence
  Description of Artificial Sequence: Synthetic oligonucleotide
gccctggagaagctgaatatgggcattactg

SEQ ID NO: 175756 - DNA, 32 bp, Artificial Sequence
  Description of Artificial Sequence: Synthetic oligonucleotide
ccctggagaagctgaatatgggcattactgac

SEQ ID NO: 175757 - DNA, 32 bp, Artificial Sequence
  Description of Artificial Sequence: Synthetic oligonucleotide
cctggagaagctgaatatgggcattactgacc

SEQ ID NO: 175758 - DNA, 33 bp, Artificial Sequence
  Description of Artificial Sequence: Synthetic oligonucleotide
ctggagaagctgaatatgggcattactgacctc

SEQ ID NO: 175759 - DNA, 33 bp, Artificial Sequence
  Description of Artificial Sequence: Synthetic oligonucleotide
tggagaagctgaatatgggcattactgacctcc

SEQ ID NO: 175760 - DNA, 32 bp, Artificial Sequence
  Description of Artificial Sequence: Synthetic oligonucleotide
ggagaagctgaatatgggcattactgacctcc

SEQ ID NO: 175761 - DNA, 33 bp, Artificial Sequence
  Description of Artificial Sequence: Synthetic oligonucleotide
gagaagctgaatatgggcattactgacctccag

SEQ ID NO: 175762 - DNA, 33 bp, Artificial Sequence
  Description of Artificial Sequence: Synthetic oligonucleotide
agaagctgaatatgggcattactgacctccagg

SEQ ID NO: 175763 - DNA, 32 bp, Artificial Sequence
  Description of Artificial Sequence: Synthetic oligonucleotide
gaagctgaatatgggcattactgacctccagg

SEQ ID NO: 175764 - DNA, 32 bp, Artificial Sequence
  Description of Artificial Sequence: Synthetic oligonucleotide
aagctgaatatgggcattactgacctccaggg

SEQ ID NO: 175765 - DNA, 31 bp, Artificial Sequence
  Description of Artificial Sequence: Synthetic oligonucleotide
agctgaatatgggcattactgacctccaggg

SEQ ID NO: 175766 - DNA, 30 bp, Artificial Sequence
  Description of Artificial Sequence: Synthetic oligonucleotide
gctgaatatgggcattactgacctccaggg

SEQ ID NO: 175767 - DNA, 30 bp, Artificial Sequence
  Description of Artificial Sequence: Synthetic oligonucleotide
ctgaatatgggcattactgacctccagggg

SEQ ID NO: 175768 - DNA, 30 bp, Artificial Sequence
  Description of Artificial Sequence: Synthetic oligonucleotide
tgaatatgggcattactgacctccaggggc

SEQ ID NO: 175769 - DNA, 29 bp, Artificial Sequence
  Description of Artificial Sequence: Synthetic oligonucleotide
gaatatgggcattactgacctccaggggc

SEQ ID NO: 175770 - DNA, 30 bp, Artificial Sequence
  Description of Artificial Sequence: Synthetic oligonucleotide
aatatgggcattactgacctccaggggctg

SEQ ID NO: 175771 - DNA, 29 bp, Artificial Sequence
  Description of Artificial Sequence: Synthetic oligonucleotide
atatgggcattactgacctccaggggctg

SEQ ID NO: 175772 - DNA, 28 bp, Artificial Sequence
  Description of Artificial Sequence: Synthetic oligonucleotide
tatgggcattactgacctccaggggctg

SEQ ID NO: 175773 - DNA, 27 bp, Artificial Sequence
  Description of Artificial Sequence: Synthetic oligonucleotide
atgggcattactgacctccaggggctg

SEQ ID NO: 175774 - DNA, 26 bp, Artificial Sequence
  Description of Artificial Sequence: Synthetic oligonucleotide
tgggcattactgacctccaggggctg

SEQ ID NO: 175775 - DNA, 25 bp, Artificial Sequence
  Description of Artificial Sequence: Synthetic oligonucleotide
gggcattactgacctccaggggctg

SEQ ID NO: 175776 - DNA, 25 bp, Artificial Sequence
  Description of Artificial Sequence: Synthetic oligonucleotide
ggcattactgacctccaggggctgc

SEQ ID NO: 175777 - DNA, 25 bp, Artificial Sequence
  Description of Artificial Sequence: Synthetic oligonucleotide
gcattactgacctccaggggctgcg

SEQ ID NO: 175778 - DNA, 25 bp, Artificial Sequence
  Description of Artificial Sequence: Synthetic oligonucleotide
cattactgacctccaggggctgcgc

SEQ ID NO: 175779 - DNA, 26 bp, Artificial Sequence
  Description of Artificial Sequence: Synthetic oligonucleotide
attactgacctccaggggctgcgcct

SEQ ID NO: 175780 - DNA, 25 bp, Artificial Sequence
  Description of Artificial Sequence: Synthetic oligonucleotide
ttactgacctccaggggctgcgcct

SEQ ID NO: 175781 - DNA, 24 bp, Artificial Sequence
  Description of Artificial Sequence: Synthetic oligonucleotide
tactgacctccaggggctgcgcct

SEQ ID NO: 175782 - DNA, 23 bp, Artificial Sequence
  Description of Artificial Sequence: Synthetic oligonucleotide
actgacctccaggggctgcgcct

SEQ ID NO: 175783 - DNA, 22 bp, Artificial Sequence
  Description of Artificial Sequence: Synthetic oligonucleotide
ctgacctccaggggctgcgcct

SEQ ID NO: 175784 - DNA, 24 bp, Artificial Sequence
  Description of Artificial Sequence: Synthetic oligonucleotide
tgacctccaggggctgcgcctcta

SEQ ID NO: 175785 - DNA, 23 bp, Artificial Sequence
  Description of Artificial Sequence: Synthetic oligonucleotide
gacctccaggggctgcgcctcta

SEQ ID NO: 175786 - DNA, 23 bp, Artificial Sequence
  Description of Artificial Sequence: Synthetic oligonucleotide
acctccaggggctgcgcctctac

SEQ ID NO: 175787 - DNA, 22 bp, Artificial Sequence
  Description of Artificial Sequence: Synthetic oligonucleotide
cctccaggggctgcgcctctac

SEQ ID NO: 175788 - DNA, 24 bp, Artificial Sequence
  Description of Artificial Sequence: Synthetic oligonucleotide
ctccaggggctgcgcctctacgtt

SEQ ID NO: 175789 - DNA, 24 bp, Artificial Sequence
  Description of Artificial Sequence: Synthetic oligonucleotide
tccaggggctgcgcctctacgttg

SEQ ID NO: 175790 - DNA, 23 bp, Artificial Sequence
  Description of Artificial Sequence: Synthetic oligonucleotide
ccaggggctgcgcctctacgttg

SEQ ID NO: 175791 - DNA, 24 bp, Artificial Sequence
  Description of Artificial Sequence: Synthetic oligonucleotide
caggggctgcgcctctacgttgct

SEQ ID NO: 175792 - DNA, 24 bp, Artificial Sequence
  Description of Artificial Sequence: Synthetic oligonucleotide
aggggctgcgcctctacgttgctg

SEQ ID NO: 175793 - DNA, 23 bp, Artificial Sequence
  Description of Artificial Sequence: Synthetic oligonucleotide
ggggctgcgcctctacgttgctg

SEQ ID NO: 175794 - DNA, 24 bp, Artificial Sequence
  Description of Artificial Sequence: Synthetic oligonucleotide
gggctgcgcctctacgttgctgca

SEQ ID NO: 175795 - DNA, 24 bp, Artificial Sequence
  Description of Artificial Sequence: Synthetic oligonucleotide
ggctgcgcctctacgttgctgcag

SEQ ID NO: 175796 - DNA, 24 bp, Artificial Sequence
  Description of Artificial Sequence: Synthetic oligonucleotide
gctgcgcctctacgttgctgcagc

SEQ ID NO: 175797 - DNA, 26 bp, Artificial Sequence
  Description of Artificial Sequence: Synthetic oligonucleotide
ctgcgcctctacgttgctgcagccat

SEQ ID NO: 175798 - DNA, 27 bp, Artificial Sequence
  Description of Artificial Sequence: Synthetic oligonucleotide
tgcgcctctacgttgctgcagccatca

SEQ ID NO: 175799 - DNA, 27 bp, Artificial Sequence
  Description of Artificial Sequence: Synthetic oligonucleotide
gcgcctctacgttgctgcagccatcat

SEQ ID NO: 175800 - DNA, 28 bp, Artificial Sequence
  Description of Artificial Sequence: Synthetic oligonucleotide
cgcctctacgttgctgcagccatcattg

SEQ ID NO: 175801 - DNA, 29 bp, Artificial Sequence
  Description of Artificial Sequence: Synthetic oligonucleotide
gcctctacgttgctgcagccatcattgag

SEQ ID NO: 175802 - DNA, 30 bp, Artificial Sequence
  Description of Artificial Sequence: Synthetic oligonucleotide
cctctacgttgctgcagccatcattgagtc

SEQ ID NO: 175803 - DNA, 31 bp, Artificial Sequence
  Description of Artificial Sequence: Synthetic oligonucleotide
ctctacgttgctgcagccatcattgagtctc

SEQ ID NO: 175804 - DNA, 31 bp, Artificial Sequence
  Description of Artificial Sequence: Synthetic oligonucleotide
tctacgttgctgcagccatcattgagtctcc

SEQ ID NO: 175805 - DNA, 30 bp, Artificial Sequence
  Description of Artificial Sequence: Synthetic oligonucleotide
ctacgttgctgcagccatcattgagtctcc

SEQ ID NO: 175806 - DNA, 31 bp, Artificial Sequence
  Description of Artificial Sequence: Synthetic oligonucleotide
tacgttgctgcagccatcattgagtctccag

SEQ ID NO: 175807 - DNA, 30 bp, Artificial Sequence
  Description of Artificial Sequence: Synthetic oligonucleotide
acgttgctgcagccatcattgagtctccag

SEQ ID NO: 175808 - DNA, 29 bp, Artificial Sequence
  Description of Artificial Sequence: Synthetic oligonucleotide
cgttgctgcagccatcattgagtctccag

SEQ ID NO: 175809 - DNA, 29 bp, Artificial Sequence
  Description of Artificial Sequence: Synthetic oligonucleotide
gttgctgcagccatcattgagtctccagg

SEQ ID NO: 175810 - DNA, 30 bp, Artificial Sequence
  Description of Artificial Sequence: Synthetic oligonucleotide
ttgctgcagccatcattgagtctccaggtg

SEQ ID NO: 175811 - DNA, 29 bp, Artificial Sequence
  Description of Artificial Sequence: Synthetic oligonucleotide
tgctgcagccatcattgagtctccaggtg

SEQ ID NO: 175812 - DNA, 28 bp, Artificial Sequence
  Description of Artificial Sequence: Synthetic oligonucleotide
gctgcagccatcattgagtctccaggtg

SEQ ID NO: 175813 - DNA, 28 bp, Artificial Sequence
  Description of Artificial Sequence: Synthetic oligonucleotide
ctgcagccatcattgagtctccaggtgg

SEQ ID NO: 175814 - DNA, 28 bp, Artificial Sequence
  Description of Artificial Sequence: Synthetic oligonucleotide
tgcagccatcattgagtctccaggtggg

SEQ ID NO: 175815 - DNA, 27 bp, Artificial Sequence
  Description of Artificial Sequence: Synthetic oligonucleotide
gcagccatcattgagtctccaggtggg

SEQ ID NO: 175816 - DNA, 27 bp, Artificial Sequence
  Description of Artificial Sequence: Synthetic oligonucleotide
cagccatcattgagtctccaggtgggg

SEQ ID NO: 175817 - DNA, 28 bp, Artificial Sequence
  Description of Artificial Sequence: Synthetic oligonucleotide
agccatcattgagtctccaggtggggag

SEQ ID NO: 175818 - DNA, 27 bp, Artificial Sequence
  Description of Artificial Sequence: Synthetic oligonucleotide
gccatcattgagtctccaggtggggag

SEQ ID NO: 175819 - DNA, 29 bp, Artificial Sequence
  Description of Artificial Sequence: Synthetic oligonucleotide
ccatcattgagtctccaggtggggagatg

SEQ ID NO: 175820 - DNA, 29 bp, Artificial Sequence
  Description of Artificial Sequence: Synthetic oligonucleotide
catcattgagtctccaggtggggagatgg

SEQ ID NO: 175821 - DNA, 30 bp, Artificial Sequence
  Description of Artificial Sequence: Synthetic oligonucleotide
atcattgagtctccaggtggggagatggag

SEQ ID NO: 175822 - DNA, 29 bp, Artificial Sequence
  Description of Artificial Sequence: Synthetic oligonucleotide
tcattgagtctccaggtggggagatggag

SEQ ID NO: 175823 - DNA, 28 bp, Artificial Sequence
  Description of Artificial Sequence: Synthetic oligonucleotide
cattgagtctccaggtggggagatggag

SEQ ID NO: 175824 - DNA, 28 bp, Artificial Sequence
  Description of Artificial Sequence: Synthetic oligonucleotide
attgagtctccaggtggggagatggagg

SEQ ID NO: 175825 - DNA, 27 bp, Artificial Sequence
  Description of Artificial Sequence: Synthetic oligonucleotide
ttgagtctccaggtggggagatggagg

SEQ ID NO: 175826 - DNA, 27 bp, Artificial Sequence
  Description of Artificial Sequence: Synthetic oligonucleotide
tgagtctccaggtggggagatggagga

SEQ ID NO: 175827 - DNA, 26 bp, Artificial Sequence
  Description of Artificial Sequence: Synthetic oligonucleotide
gagtctccaggtggggagatggagga

SEQ ID NO: 175828 - DNA, 26 bp, Artificial Sequence
  Description of Artificial Sequence: Synthetic oligonucleotide
agtctccaggtggggagatggaggag

SEQ ID NO: 175829 - DNA, 25 bp, Artificial Sequence
  Description of Artificial Sequence: Synthetic oligonucleotide
gtctccaggtggggagatggaggag

SEQ ID NO: 175830 - DNA, 25 bp, Artificial Sequence
  Description of Artificial Sequence: Synthetic oligonucleotide
tctccaggtggggagatggaggagg

SEQ ID NO: 175831 - DNA, 24 bp, Artificial Sequence
  Description of Artificial Sequence: Synthetic oligonucleotide
ctccaggtggggagatggaggagg

SEQ ID NO: 175832 - DNA, 25 bp, Artificial Sequence
  Description of Artificial Sequence: Synthetic oligonucleotide
tccaggtggggagatggaggaggca

SEQ ID NO: 175833 - DNA, 24 bp, Artificial Sequence
  Description of Artificial Sequence: Synthetic oligonucleotide
ccaggtggggagatggaggaggca

SEQ ID NO: 175834 - DNA, 25 bp, Artificial Sequence
  Description of Artificial Sequence: Synthetic oligonucleotide
caggtggggagatggaggaggcaga

SEQ ID NO: 175835 - DNA, 25 bp, Artificial Sequence
  Description of Artificial Sequence: Synthetic oligonucleotide
aggtggggagatggaggaggcagag

SEQ ID NO: 175836 - DNA, 24 bp, Artificial Sequence
  Description of Artificial Sequence: Synthetic oligonucleotide
ggtggggagatggaggaggcagag

SEQ ID NO: 175837 - DNA, 25 bp, Artificial Sequence
  Description of Artificial Sequence: Synthetic oligonucleotide
gtggggagatggaggaggcagagct

SEQ ID NO: 175838 - DNA, 26 bp, Artificial Sequence
  Description of Artificial Sequence: Synthetic oligonucleotide
tggggagatggaggaggcagagctca

SEQ ID NO: 175839 - DNA, 25 bp, Artificial Sequence
  Description of Artificial Sequence: Synthetic oligonucleotide
ggggagatggaggaggcagagctca

SEQ ID NO: 175840 - DNA, 27 bp, Artificial Sequence
  Description of Artificial Sequence: Synthetic oligonucleotide
gggagatggaggaggcagagctcacat

SEQ ID NO: 175841 - DNA, 27 bp, Artificial Sequence
  Description of Artificial Sequence: Synthetic oligonucleotide
ggagatggaggaggcagagctcacatc

SEQ ID NO: 175842 - DNA, 27 bp, Artificial Sequence
  Description of Artificial Sequence: Synthetic oligonucleotide
gagatggaggaggcagagctcacatcc

SEQ ID NO: 175843 - DNA, 28 bp, Artificial Sequence
  Description of Artificial Sequence: Synthetic oligonucleotide
agatggaggaggcagagctcacatcctg

SEQ ID NO: 175844 - DNA, 27 bp, Artificial Sequence
  Description of Artificial Sequence: Synthetic oligonucleotide
gatggaggaggcagagctcacatcctg

SEQ ID NO: 175845 - DNA, 27 bp, Artificial Sequence
  Description of Artificial Sequence: Synthetic oligonucleotide
atggaggaggcagagctcacatcctgg

SEQ ID NO: 175846 - DNA, 27 bp, Artificial Sequence
  Description of Artificial Sequence: Synthetic oligonucleotide
tggaggaggcagagctcacatcctggt

SEQ ID NO: 175847 - DNA, 27 bp, Artificial Sequence
  Description of Artificial Sequence: Synthetic oligonucleotide
ggaggaggcagagctcacatcctggta

SEQ ID NO: 175848 - DNA, 31 bp, Artificial Sequence
  Description of Artificial Sequence: Synthetic oligonucleotide
gaggaggcagagctcacatcctggtattttg

SEQ ID NO: 175849 - DNA, 32 bp, Artificial Sequence
  Description of Artificial Sequence: Synthetic oligonucleotide
aggaggcagagctcacatcctggtattttgtg

SEQ ID NO: 175850 - DNA, 31 bp, Artificial Sequence
  Description of Artificial Sequence: Synthetic oligonucleotide
ggaggcagagctcacatcctggtattttgtg

SEQ ID NO: 175851 - DNA, 32 bp, Artificial Sequence
  Description of Artificial Sequence: Synthetic oligonucleotide
gaggcagagctcacatcctggtattttgtgtc

SEQ ID NO: 175852 - DNA, 34 bp, Artificial Sequence
  Description of Artificial Sequence: Synthetic oligonucleotide
aggcagagctcacatcctggtattttgtgtcatc

SEQ ID NO: 175853 - DNA, 33 bp, Artificial Sequence
  Description of Artificial Sequence: Synthetic oligonucleotide
ggcagagctcacatcctggtattttgtgtcatc

SEQ ID NO: 175854 - DNA, 34 bp, Artificial Sequence
  Description of Artificial Sequence: Synthetic oligonucleotide
gcagagctcacatcctggtattttgtgtcatctc

SEQ ID NO: 175855 - DNA, 34 bp, Artificial Sequence
  Description of Artificial Sequence: Synthetic oligonucleotide
cagagctcacatcctggtattttgtgtcatctcc

SEQ ID NO: 175856 - DNA, 34 bp, Artificial Sequence
  Description of Artificial Sequence: Synthetic oligonucleotide
agagctcacatcctggtattttgtgtcatctccc

SEQ ID NO: 175857 - DNA, 33 bp, Artificial Sequence
  Description of Artificial Sequence: Synthetic oligonucleotide
gagctcacatcctggtattttgtgtcatctccc

SEQ ID NO: 175858 - DNA, 35 bp, Artificial Sequence
  Description of Artificial Sequence: Synthetic oligonucleotide
agctcacatcctggtattttgtgtcatctcccttc

SEQ ID NO: 175859 - DNA, 34 bp, Artificial Sequence
  Description of Artificial Sequence: Synthetic oligonucleotide
gctcacatcctggtattttgtgtcatctcccttc

SEQ ID NO: 175860 - DNA, 35 bp, Artificial Sequence
  Description of Artificial Sequence: Synthetic oligonucleotide
ctcacatcctggtattttgtgtcatctcccttctc

SEQ ID NO: 175861 - DNA, 35 bp, Artificial Sequence
  Description of Artificial Sequence: Synthetic oligonucleotide
tcacatcctggtattttgtgtcatctcccttctcc

SEQ ID NO: 175862 - DNA, 34 bp, Artificial Sequence
  Description of Artificial Sequence: Synthetic oligonucleotide
cacatcctggtattttgtgtcatctcccttctcc

SEQ ID NO: 175863 - DNA, 36 bp, Artificial Sequence
  Description of Artificial Sequence: Synthetic oligonucleotide
acatcctggtattttgtgtcatctcccttctccttg

SEQ ID NO: 175864 - DNA, 35 bp, Artificial Sequence
  Description of Artificial Sequence: Synthetic oligonucleotide
catcctggtattttgtgtcatctcccttctccttg

SEQ ID NO: 175865 - DNA, 35 bp, Artificial Sequence
  Description of Artificial Sequence: Synthetic oligonucleotide
atcctggtattttgtgtcatctcccttctccttgg

SEQ ID NO: 175866 - DNA, 34 bp, Artificial Sequence
  Description of Artificial Sequence: Synthetic oligonucleotide
tcctggtattttgtgtcatctcccttctccttgg

SEQ ID NO: 175867 - DNA, 33 bp, Artificial Sequence
  Description of Artificial Sequence: Synthetic oligonucleotide
cctggtattttgtgtcatctcccttctccttgg

SEQ ID NO: 175868 - DNA, 35 bp, Artificial Sequence
  Description of Artificial Sequence: Synthetic oligonucleotide
ctggtattttgtgtcatctcccttctccttggatc

SEQ ID NO: 175869 - DNA, 38 bp, Artificial Sequence
  Description of Artificial Sequence: Synthetic oligonucleotide
tggtattttgtgtcatctcccttctccttggatcttag

SEQ ID NO: 175870 - DNA, 37 bp, Artificial Sequence
  Description of Artificial Sequence: Synthetic oligonucleotide
ggtattttgtgtcatctcccttctccttggatcttag

SEQ ID NO: 175871 - DNA, 37 bp, Artificial Sequence
  Description of Artificial Sequence: Synthetic oligonucleotide
gtattttgtgtcatctcccttctccttggatcttagc

SEQ ID NO: 175872 - DNA, 39 bp, Artificial Sequence
  Description of Artificial Sequence: Synthetic oligonucleotide
tattttgtgtcatctcccttctccttggatcttagcaag

SEQ ID NO: 175873 - DNA, 38 bp, Artificial Sequence
  Description of Artificial Sequence: Synthetic oligonucleotide
attttgtgtcatctcccttctccttggatcttagcaag

SEQ ID NO: 175874 - DNA, 37 bp, Artificial Sequence
  Description of Artificial Sequence: Synthetic oligonucleotide
ttttgtgtcatctcccttctccttggatcttagcaag

SEQ ID NO: 175875 - DNA, 36 bp, Artificial Sequence
  Description of Artificial Sequence: Synthetic oligonucleotide
tttgtgtcatctcccttctccttggatcttagcaag

SEQ ID NO: 175876 - DNA, 35 bp, Artificial Sequence
  Description of Artificial Sequence: Synthetic oligonucleotide
ttgtgtcatctcccttctccttggatcttagcaag

SEQ ID NO: 175877 - DNA, 34 bp, Artificial Sequence
  Description of Artificial Sequence: Synthetic oligonucleotide
tgtgtcatctcccttctccttggatcttagcaag

SEQ ID NO: 175878 - DNA, 33 bp, Artificial Sequence
  Description of Artificial Sequence: Synthetic oligonucleotide
gtgtcatctcccttctccttggatcttagcaag

SEQ ID NO: 175879 - DNA, 34 bp, Artificial Sequence
  Description of Artificial Sequence: Synthetic oligonucleotide
tgtcatctcccttctccttggatcttagcaagac

SEQ ID NO: 175880 - DNA, 33 bp, Artificial Sequence
  Description of Artificial Sequence: Synthetic oligonucleotide
gtcatctcccttctccttggatcttagcaagac

SEQ ID NO: 175881 - DNA, 33 bp, Artificial Sequence
  Description of Artificial Sequence: Synthetic oligonucleotide
tcatctcccttctccttggatcttagcaagacc

SEQ ID NO: 175882 - DNA, 32 bp, Artificial Sequence
  Description of Artificial Sequence: Synthetic oligonucleotide
catctcccttctccttggatcttagcaagacc

SEQ ID NO: 175883 - DNA, 34 bp, Artificial Sequence
  Description of Artificial Sequence: Synthetic oligonucleotide
atctcccttctccttggatcttagcaagaccaag

SEQ ID NO: 175884 - DNA, 33 bp, Artificial Sequence
  Description of Artificial Sequence: Synthetic oligonucleotide
tctcccttctccttggatcttagcaagaccaag

SEQ ID NO: 175885 - DNA, 32 bp, Artificial Sequence
  Description of Artificial Sequence: Synthetic oligonucleotide
ctcccttctccttggatcttagcaagaccaag

SEQ ID NO: 175886 - DNA, 32 bp, Artificial Sequence
  Description of Artificial Sequence: Synthetic oligonucleotide
tcccttctccttggatcttagcaagaccaagc

SEQ ID NO: 175887 - DNA, 31 bp, Artificial Sequence
  Description of Artificial Sequence: Synthetic oligonucleotide
cccttctccttggatcttagcaagaccaagc

SEQ ID NO: 175888 - DNA, 31 bp, Artificial Sequence
  Description of Artificial Sequence: Synthetic oligonucleotide
ccttctccttggatcttagcaagaccaagcg

SEQ ID NO: 175889 - DNA, 32 bp, Artificial Sequence
  Description of Artificial Sequence: Synthetic oligonucleotide
cttctccttggatcttagcaagaccaagcgac

SEQ ID NO: 175890 - DNA, 33 bp, Artificial Sequence
  Description of Artificial Sequence: Synthetic oligonucleotide
ttctccttggatcttagcaagaccaagcgacac

SEQ ID NO: 175891 - DNA, 32 bp, Artificial Sequence
  Description of Artificial Sequence: Synthetic oligonucleotide
tctccttggatcttagcaagaccaagcgacac

SEQ ID NO: 175892 - DNA, 31 bp, Artificial Sequence
  Description of Artificial Sequence: Synthetic oligonucleotide
ctccttggatcttagcaagaccaagcgacac

SEQ ID NO: 175893 - DNA, 31 bp, Artificial Sequence
  Description of Artificial Sequence: Synthetic oligonucleotide
tccttggatcttagcaagaccaagcgacacc

SEQ ID NO: 175894 - DNA, 30 bp, Artificial Sequence
  Description of Artificial Sequence: Synthetic oligonucleotide
ccttggatcttagcaagaccaagcgacacc

SEQ ID NO: 175895 - DNA, 32 bp, Artificial Sequence
  Description of Artificial Sequence: Synthetic oligonucleotide
cttggatcttagcaagaccaagcgacaccttg

SEQ ID NO: 175896 - DNA, 33 bp, Artificial Sequence
  Description of Artificial Sequence: Synthetic oligonucleotide
ttggatcttagcaagaccaagcgacaccttgtg

SEQ ID NO: 175897 - DNA, 32 bp, Artificial Sequence
  Description of Artificial Sequence: Synthetic oligonucleotide
tggatcttagcaagaccaagcgacaccttgtg

SEQ ID NO: 175898 - DNA, 31 bp, Artificial Sequence
  Description of Artificial Sequence: Synthetic oligonucleotide
ggatcttagcaagaccaagcgacaccttgtg

SEQ ID NO: 175899 - DNA, 31 bp, Artificial Sequence
  Description of Artificial Sequence: Synthetic oligonucleotide
gatcttagcaagaccaagcgacaccttgtgc

SEQ ID NO: 175900 - DNA, 31 bp, Artificial Sequence
  Description of Artificial Sequence: Synthetic oligonucleotide
atcttagcaagaccaagcgacaccttgtgcc

SEQ ID NO: 175901 - DNA, 30 bp, Artificial Sequence
  Description of Artificial Sequence: Synthetic oligonucleotide
tcttagcaagaccaagcgacaccttgtgcc

SEQ ID NO: 175902 - DNA, 29 bp, Artificial Sequence
  Description of Artificial Sequence: Synthetic oligonucleotide
cttagcaagaccaagcgacaccttgtgcc

SEQ ID NO: 175903 - DNA, 30 bp, Artificial Sequence
  Description of Artificial Sequence: Synthetic oligonucleotide
ttagcaagaccaagcgacaccttgtgcctg

SEQ ID NO: 175904 - DNA, 29 bp, Artificial Sequence
  Description of Artificial Sequence: Synthetic oligonucleotide
tagcaagaccaagcgacaccttgtgcctg

SEQ ID NO: 175905 - DNA, 28 bp, Artificial Sequence
  Description of Artificial Sequence: Synthetic oligonucleotide
agcaagaccaagcgacaccttgtgcctg

SEQ ID NO: 175906 - DNA, 27 bp, Artificial Sequence
  Description of Artificial Sequence: Synthetic oligonucleotide
gcaagaccaagcgacaccttgtgcctg

SEQ ID NO: 175907 - DNA, 27 bp, Artificial Sequence
  Description of Artificial Sequence: Synthetic oligonucleotide
caagaccaagcgacaccttgtgcctgg

SEQ ID NO: 175908 - DNA, 27 bp, Artificial Sequence
  Description of Artificial Sequence: Synthetic oligonucleotide
aagaccaagcgacaccttgtgcctggg

SEQ ID NO: 175909 - DNA, 26 bp, Artificial Sequence
  Description of Artificial Sequence: Synthetic oligonucleotide
agaccaagcgacaccttgtgcctggg

SEQ ID NO: 175910 - DNA, 25 bp, Artificial Sequence
  Description of Artificial Sequence: Synthetic oligonucleotide
gaccaagcgacaccttgtgcctggg

SEQ ID NO: 175911 - DNA, 25 bp, Artificial Sequence
  Description of Artificial Sequence: Synthetic oligonucleotide
accaagcgacaccttgtgcctgggg

SEQ ID NO: 175912 - DNA, 24 bp, Artificial Sequence
  Description of Artificial Sequence: Synthetic oligonucleotide
ccaagcgacaccttgtgcctgggg

SEQ ID NO: 175913 - DNA, 24 bp, Artificial Sequence
  Description of Artificial Sequence: Synthetic oligonucleotide
caagcgacaccttgtgcctggggc

SEQ ID NO: 175914 - DNA, 24 bp, Artificial Sequence
  Description of Artificial Sequence: Synthetic oligonucleotide
aagcgacaccttgtgcctggggcc

SEQ ID NO: 175915 - DNA, 23 bp, Artificial Sequence
  Description of Artificial Sequence: Synthetic oligonucleotide
agcgacaccttgtgcctggggcc

SEQ ID NO: 175916 - DNA, 22 bp, Artificial Sequence
  Description of Artificial Sequence: Synthetic oligonucleotide
gcgacaccttgtgcctggggcc

SEQ ID NO: 175917 - DNA, 22 bp, Artificial Sequence
  Description of Artificial Sequence: Synthetic oligonucleotide
cgacaccttgtgcctggggccc

SEQ ID NO: 175918 - DNA, 22 bp, Artificial Sequence
  Description of Artificial Sequence: Synthetic oligonucleotide
gacaccttgtgcctggggcccc

SEQ ID NO: 175919 - DNA, 24 bp, Artificial Sequence
  Description of Artificial Sequence: Synthetic oligonucleotide
acaccttgtgcctggggccccctt

SEQ ID NO: 175920 - DNA, 23 bp, Artificial Sequence
  Description of Artificial Sequence: Synthetic oligonucleotide
caccttgtgcctggggccccctt

SEQ ID NO: 175921 - DNA, 23 bp, Artificial Sequence
  Description of Artificial Sequence: Synthetic oligonucleotide
accttgtgcctggggcccccttc

SEQ ID NO: 175922 - DNA, 22 bp, Artificial Sequence
  Description of Artificial Sequence: Synthetic oligonucleotide
ccttgtgcctggggcccccttc

SEQ ID NO: 175923 - DNA, 23 bp, Artificial Sequence
  Description of Artificial Sequence: Synthetic oligonucleotide
cttgtgcctggggcccccttcct

SEQ ID NO: 175924 - DNA, 23 bp, Artificial Sequence
  Description of Artificial Sequence: Synthetic oligonucleotide
ttgtgcctggggcccccttcctg

SEQ ID NO: 175925 - DNA, 22 bp, Artificial Sequence
  Description of Artificial Sequence: Synthetic oligonucleotide
tgtgcctggggcccccttcctg

SEQ ID NO: 175926 - DNA, 21 bp, Artificial Sequence
  Description of Artificial Sequence: Synthetic oligonucleotide
gtgcctggggcccccttcctg

SEQ ID NO: 175927 - DNA, 22 bp, Artificial Sequence
  Description of Artificial Sequence: Synthetic oligonucleotide
tgcctggggcccccttcctgct

SEQ ID NO: 175928 - DNA, 21 bp, Artificial Sequence
  Description of Artificial Sequence: Synthetic oligonucleotide
gcctggggcccccttcctgct

SEQ ID NO: 175929 - DNA, 21 bp, Artificial Sequence
  Description of Artificial Sequence: Synthetic oligonucleotide
cctggggcccccttcctgctg

SEQ ID NO: 175930 - DNA, 22 bp, Artificial Sequence
  Description of Artificial Sequence: Synthetic oligonucleotide
ctggggcccccttcctgctgca

SEQ ID NO: 175931 - DNA, 22 bp, Artificial Sequence
  Description of Artificial Sequence: Synthetic oligonucleotide
tggggcccccttcctgctgcag

SEQ ID NO: 175932 - DNA, 21 bp, Artificial Sequence
  Description of Artificial Sequence: Synthetic oligonucleotide
ggggcccccttcctgctgcag

SEQ ID NO: 175933 - DNA, 21 bp, Artificial Sequence
  Description of Artificial Sequence: Synthetic oligonucleotide
gggcccccttcctgctgcagg

SEQ ID NO: 175934 - DNA, 21 bp, Artificial Sequence
  Description of Artificial Sequence: Synthetic oligonucleotide
ggcccccttcctgctgcaggc

SEQ ID NO: 175935 - DNA, 23 bp, Artificial Sequence
  Description of Artificial Sequence: Synthetic oligonucleotide
gcccccttcctgctgcaggcctt

SEQ ID NO: 175936 - DNA, 23 bp, Artificial Sequence
  Description of Artificial Sequence: Synthetic oligonucleotide
cccccttcctgctgcaggccttg

SEQ ID NO: 175937 - DNA, 24 bp, Artificial Sequence
  Description of Artificial Sequence: Synthetic oligonucleotide
ccccttcctgctgcaggccttggt

SEQ ID NO: 175938 - DNA, 24 bp, Artificial Sequence
  Description of Artificial Sequence: Synthetic oligonucleotide
cccttcctgctgcaggccttggtc

SEQ ID NO: 175939 - DNA, 24 bp, Artificial Sequence
  Description of Artificial Sequence: Synthetic oligonucleotide
ccttcctgctgcaggccttggtcc

SEQ ID NO: 175940 - DNA, 25 bp, Artificial Sequence
  Description of Artificial Sequence: Synthetic oligonucleotide
cttcctgctgcaggccttggtccgt

SEQ ID NO: 175941 - DNA, 26 bp, Artificial Sequence
  Description of Artificial Sequence: Synthetic oligonucleotide
ttcctgctgcaggccttggtccgtga

SEQ ID NO: 175942 - DNA, 25 bp, Artificial Sequence
  Description of Artificial Sequence: Synthetic oligonucleotide
tcctgctgcaggccttggtccgtga

SEQ ID NO: 175943 - DNA, 24 bp, Artificial Sequence
  Description of Artificial Sequence: Synthetic oligonucleotide
cctgctgcaggccttggtccgtga

SEQ ID NO: 175944 - DNA, 26 bp, Artificial Sequence
  Description of Artificial Sequence: Synthetic oligonucleotide
ctgctgcaggccttggtccgtgagat

SEQ ID NO: 175945 - DNA, 27 bp, Artificial Sequence
  Description of Artificial Sequence: Synthetic oligonucleotide
tgctgcaggccttggtccgtgagatgt

SEQ ID NO: 175946 - DNA, 26 bp, Artificial Sequence
  Description of Artificial Sequence: Synthetic oligonucleotide
gctgcaggccttggtccgtgagatgt

SEQ ID NO: 175947 - DNA, 27 bp, Artificial Sequence
  Description of Artificial Sequence: Synthetic oligonucleotide
ctgcaggccttggtccgtgagatgtca

SEQ ID NO: 175948 - DNA, 27 bp, Artificial Sequence
  Description of Artificial Sequence: Synthetic oligonucleotide
tgcaggccttggtccgtgagatgtcag

SEQ ID NO: 175949 - DNA, 26 bp, Artificial Sequence
  Description of Artificial Sequence: Synthetic oligonucleotide
gcaggccttggtccgtgagatgtcag

SEQ ID NO: 175950 - DNA, 26 bp, Artificial Sequence
  Description of Artificial Sequence: Synthetic oligonucleotide
caggccttggtccgtgagatgtcagg

SEQ ID NO: 175951 - DNA, 27 bp, Artificial Sequence
  Description of Artificial Sequence: Synthetic oligonucleotide
aggccttggtccgtgagatgtcaggct

SEQ ID NO: 175952 - DNA, 26 bp, Artificial Sequence
  Description of Artificial Sequence: Synthetic oligonucleotide
ggccttggtccgtgagatgtcaggct

SEQ ID NO: 175953 - DNA, 26 bp, Artificial Sequence
  Description of Artificial Sequence: Synthetic oligonucleotide
gccttggtccgtgagatgtcaggctc

SEQ ID NO: 175954 - DNA, 26 bp, Artificial Sequence
  Description of Artificial Sequence: Synthetic oligonucleotide
ccttggtccgtgagatgtcaggctcc

SEQ ID NO: 175955 - DNA, 26 bp, Artificial Sequence
  Description of Artificial Sequence: Synthetic oligonucleotide
cttggtccgtgagatgtcaggctccc

SEQ ID NO: 175956 - DNA, 27 bp, Artificial Sequence
  Description of Artificial Sequence: Synthetic oligonucleotide
ttggtccgtgagatgtcaggctcccca

SEQ ID NO: 175957 - DNA, 26 bp, Artificial Sequence
  Description of Artificial Sequence: Synthetic oligonucleotide
tggtccgtgagatgtcaggctcccca

SEQ ID NO: 175958 - DNA, 25 bp, Artificial Sequence
  Description of Artificial Sequence: Synthetic oligonucleotide
ggtccgtgagatgtcaggctcccca

SEQ ID NO: 175959 - DNA, 25 bp, Artificial Sequence
  Description of Artificial Sequence: Synthetic oligonucleotide
gtccgtgagatgtcaggctccccag

SEQ ID NO: 175960 - DNA, 27 bp, Artificial Sequence
  Description of Artificial Sequence: Synthetic oligonucleotide
tccgtgagatgtcaggctccccagctt

SEQ ID NO: 175961 - DNA, 26 bp, Artificial Sequence
  Description of Artificial Sequence: Synthetic oligonucleotide
ccgtgagatgtcaggctccccagctt

SEQ ID NO: 175962 - DNA, 27 bp, Artificial Sequence
  Description of Artificial Sequence: Synthetic oligonucleotide
cgtgagatgtcaggctccccagcttct

SEQ ID NO: 175963 - DNA, 27 bp, Artificial Sequence
  Description of Artificial Sequence: Synthetic oligonucleotide
gtgagatgtcaggctccccagcttctg

SEQ ID NO: 175964 - DNA, 27 bp, Artificial Sequence
  Description of Artificial Sequence: Synthetic oligonucleotide
tgagatgtcaggctccccagcttctgg

SEQ ID NO: 175965 - DNA, 26 bp, Artificial Sequence
  Description of Artificial Sequence: Synthetic oligonucleotide
gagatgtcaggctccccagcttctgg

SEQ ID NO: 175966 - DNA, 27 bp, Artificial Sequence
  Description of Artificial Sequence: Synthetic oligonucleotide
agatgtcaggctccccagcttctggca

SEQ ID NO: 175967 - DNA, 27 bp, Artificial Sequence
  Description of Artificial Sequence: Synthetic oligonucleotide
gatgtcaggctccccagcttctggcat

SEQ ID NO: 175968 - DNA, 28 bp, Artificial Sequence
  Description of Artificial Sequence: Synthetic oligonucleotide
atgtcaggctccccagcttctggcattc

SEQ ID NO: 175969 - DNA, 27 bp, Artificial Sequence
  Description of Artificial Sequence: Synthetic oligonucleotide
tgtcaggctccccagcttctggcattc

SEQ ID NO: 175970 - DNA, 26 bp, Artificial Sequence
  Description of Artificial Sequence: Synthetic oligonucleotide
gtcaggctccccagcttctggcattc

SEQ ID NO: 175971 - DNA, 27 bp, Artificial Sequence
  Description of Artificial Sequence: Synthetic oligonucleotide
tcaggctccccagcttctggcattcct

SEQ ID NO: 175972 - DNA, 26 bp, Artificial Sequence
  Description of Artificial Sequence: Synthetic oligonucleotide
caggctccccagcttctggcattcct

SEQ ID NO: 175973 - DNA, 27 bp, Artificial Sequence
  Description of Artificial Sequence: Synthetic oligonucleotide
aggctccccagcttctggcattcctgt

SEQ ID NO: 175974 - DNA, 26 bp, Artificial Sequence
  Description of Artificial Sequence: Synthetic oligonucleotide
ggctccccagcttctggcattcctgt

SEQ ID NO: 175975 - DNA, 27 bp, Artificial Sequence
  Description of Artificial Sequence: Synthetic oligonucleotide
gctccccagcttctggcattcctgtca

SEQ ID NO: 175976 - DNA, 29 bp, Artificial Sequence
  Description of Artificial Sequence: Synthetic oligonucleotide
ctccccagcttctggcattcctgtcaaag

SEQ ID NO: 175977 - DNA, 32 bp, Artificial Sequence
  Description of Artificial Sequence: Synthetic oligonucleotide
tccccagcttctggcattcctgtcaaagtttc

SEQ ID NO: 175978 - DNA, 31 bp, Artificial Sequence
  Description of Artificial Sequence: Synthetic oligonucleotide
ccccagcttctggcattcctgtcaaagtttc

SEQ ID NO: 175979 - DNA, 32 bp, Artificial Sequence
  Description of Artificial Sequence: Synthetic oligonucleotide
cccagcttctggcattcctgtcaaagtttctg

SEQ ID NO: 175980 - DNA, 32 bp, Artificial Sequence
  Description of Artificial Sequence: Synthetic oligonucleotide
ccagcttctggcattcctgtcaaagtttctgc

SEQ ID NO: 175981 - DNA, 32 bp, Artificial Sequence
  Description of Artificial Sequence: Synthetic oligonucleotide
cagcttctggcattcctgtcaaagtttctgcc

SEQ ID NO: 175982 - DNA, 33 bp, Artificial Sequence
  Description of Artificial Sequence: Synthetic oligonucleotide
agcttctggcattcctgtcaaagtttctgccac

SEQ ID NO: 175983 - DNA, 32 bp, Artificial Sequence
  Description of Artificial Sequence: Synthetic oligonucleotide
gcttctggcattcctgtcaaagtttctgccac

SEQ ID NO: 175984 - DNA, 32 bp, Artificial Sequence
  Description of Artificial Sequence: Synthetic oligonucleotide
cttctggcattcctgtcaaagtttctgccacg

SEQ ID NO: 175985 - DNA, 32 bp, Artificial Sequence
  Description of Artificial Sequence: Synthetic oligonucleotide
ttctggcattcctgtcaaagtttctgccacgg

SEQ ID NO: 175986 - DNA, 31 bp, Artificial Sequence
  Description of Artificial Sequence: Synthetic oligonucleotide
tctggcattcctgtcaaagtttctgccacgg

SEQ ID NO: 175987 - DNA, 30 bp, Artificial Sequence
  Description of Artificial Sequence: Synthetic oligonucleotide
ctggcattcctgtcaaagtttctgccacgg

SEQ ID NO: 175988 - DNA, 31 bp, Artificial Sequence
  Description of Artificial Sequence: Synthetic oligonucleotide
tggcattcctgtcaaagtttctgccacggtg

SEQ ID NO: 175989 - DNA, 30 bp, Artificial Sequence
  Description of Artificial Sequence: Synthetic oligonucleotide
ggcattcctgtcaaagtttctgccacggtg

SEQ ID NO: 175990 - DNA, 31 bp, Artificial Sequence
  Description of Artificial Sequence: Synthetic oligonucleotide
gcattcctgtcaaagtttctgccacggtgtc

SEQ ID NO: 175991 - DNA, 33 bp, Artificial Sequence
  Description of Artificial Sequence: Synthetic oligonucleotide
cattcctgtcaaagtttctgccacggtgtcttc

SEQ ID NO: 175992 - DNA, 34 bp, Artificial Sequence
  Description of Artificial Sequence: Synthetic oligonucleotide
attcctgtcaaagtttctgccacggtgtcttctc

SEQ ID NO: 175993 - DNA, 33 bp, Artificial Sequence
  Description of Artificial Sequence: Synthetic oligonucleotide
ttcctgtcaaagtttctgccacggtgtcttctc

SEQ ID NO: 175994 - DNA, 32 bp, Artificial Sequence
  Description of Artificial Sequence: Synthetic oligonucleotide
tcctgtcaaagtttctgccacggtgtcttctc

SEQ ID NO: 175995 - DNA, 31 bp, Artificial Sequence
  Description of Artificial Sequence: Synthetic oligonucleotide
cctgtcaaagtttctgccacggtgtcttctc

SEQ ID NO: 175996 - DNA, 31 bp, Artificial Sequence
  Description of Artificial Sequence: Synthetic oligonucleotide
ctgtcaaagtttctgccacggtgtcttctcc

SEQ ID NO: 175997 - DNA, 32 bp, Artificial Sequence
  Description of Artificial Sequence: Synthetic oligonucleotide
tgtcaaagtttctgccacggtgtcttctcctg

SEQ ID NO: 175998 - DNA, 31 bp, Artificial Sequence
  Description of Artificial Sequence: Synthetic oligonucleotide
gtcaaagtttctgccacggtgtcttctcctg

SEQ ID NO: 175999 - DNA, 31 bp, Artificial Sequence
  Description of Artificial Sequence: Synthetic oligonucleotide
tcaaagtttctgccacggtgtcttctcctgg

SEQ ID NO: 176000 - DNA, 30 bp, Artificial Sequence
  Description of Artificial Sequence: Synthetic oligonucleotide
caaagtttctgccacggtgtcttctcctgg

SEQ ID NO: 176001 - DNA, 30 bp, Artificial Sequence
  Description of Artificial Sequence: Synthetic oligonucleotide
aaagtttctgccacggtgtcttctcctggg

SEQ ID NO: 176002 - DNA, 29 bp, Artificial Sequence
  Description of Artificial Sequence: Synthetic oligonucleotide
aagtttctgccacggtgtcttctcctggg

SEQ ID NO: 176003 - DNA, 28 bp, Artificial Sequence
  Description of Artificial Sequence: Synthetic oligonucleotide
agtttctgccacggtgtcttctcctggg

SEQ ID NO: 176004 - DNA, 27 bp, Artificial Sequence
  Description of Artificial Sequence: Synthetic oligonucleotide
gtttctgccacggtgtcttctcctggg

SEQ ID NO: 176005 - DNA, 28 bp, Artificial Sequence
  Description of Artificial Sequence: Synthetic oligonucleotide
tttctgccacggtgtcttctcctgggtc

SEQ ID NO: 176006 - DNA, 27 bp, Artificial Sequence
  Description of Artificial Sequence: Synthetic oligonucleotide
ttctgccacggtgtcttctcctgggtc

SEQ ID NO: 176007 - DNA, 27 bp, Artificial Sequence
  Description of Artificial Sequence: Synthetic oligonucleotide
tctgccacggtgtcttctcctgggtct

SEQ ID NO: 176008 - DNA, 26 bp, Artificial Sequence
  Description of Artificial Sequence: Synthetic oligonucleotide
ctgccacggtgtcttctcctgggtct

SEQ ID NO: 176009 - DNA, 27 bp, Artificial Sequence
  Description of Artificial Sequence: Synthetic oligonucleotide
tgccacggtgtcttctcctgggtctgt

SEQ ID NO: 176010 - DNA, 27 bp, Artificial Sequence
  Description of Artificial Sequence: Synthetic oligonucleotide
gccacggtgtcttctcctgggtctgtt

SEQ ID NO: 176011 - DNA, 27 bp, Artificial Sequence
  Description of Artificial Sequence: Synthetic oligonucleotide
ccacggtgtcttctcctgggtctgttc

SEQ ID NO: 176012 - DNA, 27 bp, Artificial Sequence
  Description of Artificial Sequence: Synthetic oligonucleotide
cacggtgtcttctcctgggtctgttcc

SEQ ID NO: 176013 - DNA, 28 bp, Artificial Sequence
  Description of Artificial Sequence: Synthetic oligonucleotide
acggtgtcttctcctgggtctgttcctg

SEQ ID NO: 176014 - DNA, 27 bp, Artificial Sequence
  Description of Artificial Sequence: Synthetic oligonucleotide
cggtgtcttctcctgggtctgttcctg

SEQ ID NO: 176015 - DNA, 29 bp, Artificial Sequence
  Description of Artificial Sequence: Synthetic oligonucleotide
ggtgtcttctcctgggtctgttcctgaag

SEQ ID NO: 176016 - DNA, 30 bp, Artificial Sequence
  Description of Artificial Sequence: Synthetic oligonucleotide
gtgtcttctcctgggtctgttcctgaagtc

SEQ ID NO: 176017 - DNA, 30 bp, Artificial Sequence
  Description of Artificial Sequence: Synthetic oligonucleotide
tgtcttctcctgggtctgttcctgaagtcc

SEQ ID NO: 176018 - DNA, 29 bp, Artificial Sequence
  Description of Artificial Sequence: Synthetic oligonucleotide
gtcttctcctgggtctgttcctgaagtcc

SEQ ID NO: 176019 - DNA, 30 bp, Artificial Sequence
  Description of Artificial Sequence: Synthetic oligonucleotide
tcttctcctgggtctgttcctgaagtccag

SEQ ID NO: 176020 - DNA, 29 bp, Artificial Sequence
  Description of Artificial Sequence: Synthetic oligonucleotide
cttctcctgggtctgttcctgaagtccag

SEQ ID NO: 176021 - DNA, 29 bp, Artificial Sequence
  Description of Artificial Sequence: Synthetic oligonucleotide
ttctcctgggtctgttcctgaagtccagg

SEQ ID NO: 176022 - DNA, 28 bp, Artificial Sequence
  Description of Artificial Sequence: Synthetic oligonucleotide
tctcctgggtctgttcctgaagtccagg

SEQ ID NO: 176023 - DNA, 27 bp, Artificial Sequence
  Description of Artificial Sequence: Synthetic oligonucleotide
ctcctgggtctgttcctgaagtccagg

SEQ ID NO: 176024 - DNA, 28 bp, Artificial Sequence
  Description of Artificial Sequence: Synthetic oligonucleotide
tcctgggtctgttcctgaagtccaggac

SEQ ID NO: 176025 - DNA, 27 bp, Artificial Sequence
  Description of Artificial Sequence: Synthetic oligonucleotide
cctgggtctgttcctgaagtccaggac

SEQ ID NO: 176026 - DNA, 30 bp, Artificial Sequence
  Description of Artificial Sequence: Synthetic oligonucleotide
ctgggtctgttcctgaagtccaggacattc

SEQ ID NO: 176027 - DNA, 31 bp, Artificial Sequence
  Description of Artificial Sequence: Synthetic oligonucleotide
tgggtctgttcctgaagtccaggacattcag

SEQ ID NO: 176028 - DNA, 30 bp, Artificial Sequence
  Description of Artificial Sequence: Synthetic oligonucleotide
gggtctgttcctgaagtccaggacattcag

SEQ ID NO: 176029 - DNA, 30 bp, Artificial Sequence
  Description of Artificial Sequence: Synthetic oligonucleotide
ggtctgttcctgaagtccaggacattcagc

SEQ ID NO: 176030 - DNA, 34 bp, Artificial Sequence
  Description of Artificial Sequence: Synthetic oligonucleotide
gtctgttcctgaagtccaggacattcagcaaaac

SEQ ID NO: 176031 - DNA, 35 bp, Artificial Sequence
  Description of Artificial Sequence: Synthetic oligonucleotide
tctgttcctgaagtccaggacattcagcaaaacac

SEQ ID NO: 176032 - DNA, 34 bp, Artificial Sequence
  Description of Artificial Sequence: Synthetic oligonucleotide
ctgttcctgaagtccaggacattcagcaaaacac

SEQ ID NO: 176033 - DNA, 35 bp, Artificial Sequence
  Description of Artificial Sequence: Synthetic oligonucleotide
tgttcctgaagtccaggacattcagcaaaacacag

SEQ ID NO: 176034 - DNA, 34 bp, Artificial Sequence
  Description of Artificial Sequence: Synthetic oligonucleotide
gttcctgaagtccaggacattcagcaaaacacag

SEQ ID NO: 176035 - DNA, 35 bp, Artificial Sequence
  Description of Artificial Sequence: Synthetic oligonucleotide
ttcctgaagtccaggacattcagcaaaacacagac

SEQ ID NO: 176036 - DNA, 34 bp, Artificial Sequence
  Description of Artificial Sequence: Synthetic oligonucleotide
tcctgaagtccaggacattcagcaaaacacagac

SEQ ID NO: 176037 - DNA, 33 bp, Artificial Sequence
  Description of Artificial Sequence: Synthetic oligonucleotide
cctgaagtccaggacattcagcaaaacacagac

SEQ ID NO: 176038 - DNA, 33 bp, Artificial Sequence
  Description of Artificial Sequence: Synthetic oligonucleotide
ctgaagtccaggacattcagcaaaacacagacg

SEQ ID NO: 176039 - DNA, 33 bp, Artificial Sequence
  Description of Artificial Sequence: Synthetic oligonucleotide
tgaagtccaggacattcagcaaaacacagacgg

SEQ ID NO: 176040 - DNA, 32 bp, Artificial Sequence
  Description of Artificial Sequence: Synthetic oligonucleotide
gaagtccaggacattcagcaaaacacagacgg

SEQ ID NO: 176041 - DNA, 32 bp, Artificial Sequence
  Description of Artificial Sequence: Synthetic oligonucleotide
aagtccaggacattcagcaaaacacagacggg

SEQ ID NO: 176042 - DNA, 31 bp, Artificial Sequence
  Description of Artificial Sequence: Synthetic oligonucleotide
agtccaggacattcagcaaaacacagacggg

SEQ ID NO: 176043 - DNA, 30 bp, Artificial Sequence
  Description of Artificial Sequence: Synthetic oligonucleotide
gtccaggacattcagcaaaacacagacggg

SEQ ID NO: 176044 - DNA, 31 bp, Artificial Sequence
  Description of Artificial Sequence: Synthetic oligonucleotide
tccaggacattcagcaaaacacagacgggag

SEQ ID NO: 176045 - DNA, 30 bp, Artificial Sequence
  Description of Artificial Sequence: Synthetic oligonucleotide
ccaggacattcagcaaaacacagacgggag

SEQ ID NO: 176046 - DNA, 30 bp, Artificial Sequence
  Description of Artificial Sequence: Synthetic oligonucleotide
caggacattcagcaaaacacagacgggagc

SEQ ID NO: 176047 - DNA, 30 bp, Artificial Sequence
  Description of Artificial Sequence: Synthetic oligonucleotide
aggacattcagcaaaacacagacgggagcg

SEQ ID NO: 176048 - DNA, 29 bp, Artificial Sequence
  Description of Artificial Sequence: Synthetic oligonucleotide
ggacattcagcaaaacacagacgggagcg

SEQ ID NO: 176049 - DNA, 29 bp, Artificial Sequence
  Description of Artificial Sequence: Synthetic oligonucleotide
gacattcagcaaaacacagacgggagcgg

SEQ ID NO: 176050 - DNA, 29 bp, Artificial Sequence
  Description of Artificial Sequence: Synthetic oligonucleotide
acattcagcaaaacacagacgggagcggc

SEQ ID NO: 176051 - DNA, 28 bp, Artificial Sequence
  Description of Artificial Sequence: Synthetic oligonucleotide
cattcagcaaaacacagacgggagcggc

SEQ ID NO: 176052 - DNA, 28 bp, Artificial Sequence
  Description of Artificial Sequence: Synthetic oligonucleotide
attcagcaaaacacagacgggagcggcc

SEQ ID NO: 176053 - DNA, 27 bp, Artificial Sequence
  Description of Artificial Sequence: Synthetic oligonucleotide
ttcagcaaaacacagacgggagcggcc

SEQ ID NO: 176054 - DNA, 27 bp, Artificial Sequence
  Description of Artificial Sequence: Synthetic oligonucleotide
tcagcaaaacacagacgggagcggcca

SEQ ID NO: 176055 - DNA, 27 bp, Artificial Sequence
  Description of Artificial Sequence: Synthetic oligonucleotide
cagcaaaacacagacgggagcggccaa

SEQ ID NO: 176056 - DNA, 27 bp, Artificial Sequence
  Description of Artificial Sequence: Synthetic oligonucleotide
agcaaaacacagacgggagcggccaag

SEQ ID NO: 176057 - DNA, 27 bp, Artificial Sequence
  Description of Artificial Sequence: Synthetic oligonucleotide
gcaaaacacagacgggagcggccaagt

SEQ ID NO: 176058 - DNA, 27 bp, Artificial Sequence
  Description of Artificial Sequence: Synthetic oligonucleotide
caaaacacagacgggagcggccaagtc

SEQ ID NO: 176059 - DNA, 28 bp, Artificial Sequence
  Description of Artificial Sequence: Synthetic oligonucleotide
aaaacacagacgggagcggccaagtcag

SEQ ID NO: 176060 - DNA, 27 bp, Artificial Sequence
  Description of Artificial Sequence: Synthetic oligonucleotide
aaacacagacgggagcggccaagtcag

SEQ ID NO: 176061 - DNA, 26 bp, Artificial Sequence
  Description of Artificial Sequence: Synthetic oligonucleotide
aacacagacgggagcggccaagtcag

SEQ ID NO: 176062 - DNA, 25 bp, Artificial Sequence
  Description of Artificial Sequence: Synthetic oligonucleotide
acacagacgggagcggccaagtcag

SEQ ID NO: 176063 - DNA, 24 bp, Artificial Sequence
  Description of Artificial Sequence: Synthetic oligonucleotide
cacagacgggagcggccaagtcag

SEQ ID NO: 176064 - DNA, 27 bp, Artificial Sequence
  Description of Artificial Sequence: Synthetic oligonucleotide
acagacgggagcggccaagtcagcatt

SEQ ID NO: 176065 - DNA, 26 bp, Artificial Sequence
  Description of Artificial Sequence: Synthetic oligonucleotide
cagacgggagcggccaagtcagcatt

SEQ ID NO: 176066 - DNA, 26 bp, Artificial Sequence
  Description of Artificial Sequence: Synthetic oligonucleotide
agacgggagcggccaagtcagcattc

SEQ ID NO: 176067 - DNA, 25 bp, Artificial Sequence
  Description of Artificial Sequence: Synthetic oligonucleotide
gacgggagcggccaagtcagcattc

SEQ ID NO: 176068 - DNA, 27 bp, Artificial Sequence
  Description of Artificial Sequence: Synthetic oligonucleotide
acgggagcggccaagtcagcattccaa

SEQ ID NO: 176069 - DNA, 27 bp, Artificial Sequence
  Description of Artificial Sequence: Synthetic oligonucleotide
cgggagcggccaagtcagcattccaat

SEQ ID NO: 176070 - DNA, 33 bp, Artificial Sequence
  Description of Artificial Sequence: Synthetic oligonucleotide
gggagcggccaagtcagcattccaataattatc

SEQ ID NO: 176071 - DNA, 33 bp, Artificial Sequence
  Description of Artificial Sequence: Synthetic oligonucleotide
ggagcggccaagtcagcattccaataattatcc

SEQ ID NO: 176072 - DNA, 33 bp, Artificial Sequence
  Description of Artificial Sequence: Synthetic oligonucleotide
gagcggccaagtcagcattccaataattatccc

SEQ ID NO: 176073 - DNA, 34 bp, Artificial Sequence
  Description of Artificial Sequence: Synthetic oligonucleotide
agcggccaagtcagcattccaataattatccctc

SEQ ID NO: 176074 - DNA, 33 bp, Artificial Sequence
  Description of Artificial Sequence: Synthetic oligonucleotide
gcggccaagtcagcattccaataattatccctc

SEQ ID NO: 176075 - DNA, 34 bp, Artificial Sequence
  Description of Artificial Sequence: Synthetic oligonucleotide
cggccaagtcagcattccaataattatccctcag

SEQ ID NO: 176076 - DNA, 35 bp, Artificial Sequence
  Description of Artificial Sequence: Synthetic oligonucleotide
ggccaagtcagcattccaataattatccctcagac

SEQ ID NO: 176077 - DNA, 35 bp, Artificial Sequence
  Description of Artificial Sequence: Synthetic oligonucleotide
gccaagtcagcattccaataattatccctcagacc

SEQ ID NO: 176078 - DNA, 37 bp, Artificial Sequence
  Description of Artificial Sequence: Synthetic oligonucleotide
ccaagtcagcattccaataattatccctcagaccatc

SEQ ID NO: 176079 - DNA, 38 bp, Artificial Sequence
  Description of Artificial Sequence: Synthetic oligonucleotide
caagtcagcattccaataattatccctcagaccatctc

SEQ ID NO: 176080 - DNA, 39 bp, Artificial Sequence
  Description of Artificial Sequence: Synthetic oligonucleotide
aagtcagcattccaataattatccctcagaccatctcag

SEQ ID NO: 176081 - DNA, 38 bp, Artificial Sequence
  Description of Artificial Sequence: Synthetic oligonucleotide
agtcagcattccaataattatccctcagaccatctcag

SEQ ID NO: 176082 - DNA, 37 bp, Artificial Sequence
  Description of Artificial Sequence: Synthetic oligonucleotide
gtcagcattccaataattatccctcagaccatctcag

SEQ ID NO: 176083 - DNA, 38 bp, Artificial Sequence
  Description of Artificial Sequence: Synthetic oligonucleotide
tcagcattccaataattatccctcagaccatctcagag

SEQ ID NO: 176084 - DNA, 37 bp, Artificial Sequence
  Description of Artificial Sequence: Synthetic oligonucleotide
cagcattccaataattatccctcagaccatctcagag

SEQ ID NO: 176085 - DNA, 37 bp, Artificial Sequence
  Description of Artificial Sequence: Synthetic oligonucleotide
agcattccaataattatccctcagaccatctcagagc

SEQ ID NO: 176086 - DNA, 36 bp, Artificial Sequence
  Description of Artificial Sequence: Synthetic oligonucleotide
gcattccaataattatccctcagaccatctcagagc

SEQ ID NO: 176087 - DNA, 37 bp, Artificial Sequence
  Description of Artificial Sequence: Synthetic oligonucleotide
cattccaataattatccctcagaccatctcagagctg

SEQ ID NO: 176088 - DNA, 37 bp, Artificial Sequence
  Description of Artificial Sequence: Synthetic oligonucleotide
attccaataattatccctcagaccatctcagagctgc

SEQ ID NO: 176089 - DNA, 36 bp, Artificial Sequence
  Description of Artificial Sequence: Synthetic oligonucleotide
ttccaataattatccctcagaccatctcagagctgc

SEQ ID NO: 176090 - DNA, 35 bp, Artificial Sequence
  Description of Artificial Sequence: Synthetic oligonucleotide
tccaataattatccctcagaccatctcagagctgc

SEQ ID NO: 176091 - DNA, 34 bp, Artificial Sequence
  Description of Artificial Sequence: Synthetic oligonucleotide
ccaataattatccctcagaccatctcagagctgc

SEQ ID NO: 176092 - DNA, 35 bp, Artificial Sequence
  Description of Artificial Sequence: Synthetic oligonucleotide
caataattatccctcagaccatctcagagctgcag

SEQ ID NO: 176093 - DNA, 35 bp, Artificial Sequence
  Description of Artificial Sequence: Synthetic oligonucleotide
aataattatccctcagaccatctcagagctgcagc

SEQ ID NO: 176094 - DNA, 34 bp, Artificial Sequence
  Description of Artificial Sequence: Synthetic oligonucleotide
ataattatccctcagaccatctcagagctgcagc

SEQ ID NO: 176095 - DNA, 33 bp, Artificial Sequence
  Description of Artificial Sequence: Synthetic oligonucleotide
taattatccctcagaccatctcagagctgcagc

SEQ ID NO: 176096 - DNA, 32 bp, Artificial Sequence
  Description of Artificial Sequence: Synthetic oligonucleotide
aattatccctcagaccatctcagagctgcagc

SEQ ID NO: 176097 - DNA, 31 bp, Artificial Sequence
  Description of Artificial Sequence: Synthetic oligonucleotide
attatccctcagaccatctcagagctgcagc

SEQ ID NO: 176098 - DNA, 30 bp, Artificial Sequence
  Description of Artificial Sequence: Synthetic oligonucleotide
ttatccctcagaccatctcagagctgcagc

SEQ ID NO: 176099 - DNA, 29 bp, Artificial Sequence
  Description of Artificial Sequence: Synthetic oligonucleotide
tatccctcagaccatctcagagctgcagc

SEQ ID NO: 176100 - DNA, 28 bp, Artificial Sequence
  Description of Artificial Sequence: Synthetic oligonucleotide
atccctcagaccatctcagagctgcagc

SEQ ID NO: 176101 - DNA, 27 bp, Artificial Sequence
  Description of Artificial Sequence: Synthetic oligonucleotide
tccctcagaccatctcagagctgcagc

SEQ ID NO: 176102 - DNA, 27 bp, Artificial Sequence
  Description of Artificial Sequence: Synthetic oligonucleotide
ccctcagaccatctcagagctgcagct

SEQ ID NO: 176103 - DNA, 27 bp, Artificial Sequence
  Description of Artificial Sequence: Synthetic oligonucleotide
cctcagaccatctcagagctgcagctc

SEQ ID NO: 176104 - DNA, 28 bp, Artificial Sequence
  Description of Artificial Sequence: Synthetic oligonucleotide
ctcagaccatctcagagctgcagctctc

SEQ ID NO: 176105 - DNA, 29 bp, Artificial Sequence
  Description of Artificial Sequence: Synthetic oligonucleotide
tcagaccatctcagagctgcagctctcag

SEQ ID NO: 176106 - DNA, 28 bp, Artificial Sequence
  Description of Artificial Sequence: Synthetic oligonucleotide
cagaccatctcagagctgcagctctcag

SEQ ID NO: 176107 - DNA, 31 bp, Artificial Sequence
  Description of Artificial Sequence: Synthetic oligonucleotide
agaccatctcagagctgcagctctcagtatc

SEQ ID NO: 176108 - DNA, 30 bp, Artificial Sequence
  Description of Artificial Sequence: Synthetic oligonucleotide
gaccatctcagagctgcagctctcagtatc

SEQ ID NO: 176109 - DNA, 31 bp, Artificial Sequence
  Description of Artificial Sequence: Synthetic oligonucleotide
accatctcagagctgcagctctcagtatctg

SEQ ID NO: 176110 - DNA, 30 bp, Artificial Sequence
  Description of Artificial Sequence: Synthetic oligonucleotide
ccatctcagagctgcagctctcagtatctg

SEQ ID NO: 176111 - DNA, 30 bp, Artificial Sequence
  Description of Artificial Sequence: Synthetic oligonucleotide
catctcagagctgcagctctcagtatctgc

SEQ ID NO: 176112 - DNA, 31 bp, Artificial Sequence
  Description of Artificial Sequence: Synthetic oligonucleotide
atctcagagctgcagctctcagtatctgcag

SEQ ID NO: 176113 - DNA, 30 bp, Artificial Sequence
  Description of Artificial Sequence: Synthetic oligonucleotide
tctcagagctgcagctctcagtatctgcag

SEQ ID NO: 176114 - DNA, 29 bp, Artificial Sequence
  Description of Artificial Sequence: Synthetic oligonucleotide
ctcagagctgcagctctcagtatctgcag

SEQ ID NO: 176115 - DNA, 29 bp, Artificial Sequence
  Description of Artificial Sequence: Synthetic oligonucleotide
tcagagctgcagctctcagtatctgcagg

SEQ ID NO: 176116 - DNA, 28 bp, Artificial Sequence
  Description of Artificial Sequence: Synthetic oligonucleotide
cagagctgcagctctcagtatctgcagg

SEQ ID NO: 176117 - DNA, 28 bp, Artificial Sequence
  Description of Artificial Sequence: Synthetic oligonucleotide
agagctgcagctctcagtatctgcaggc

SEQ ID NO: 176118 - DNA, 27 bp, Artificial Sequence
  Description of Artificial Sequence: Synthetic oligonucleotide
gagctgcagctctcagtatctgcaggc

SEQ ID NO: 176119 - DNA, 28 bp, Artificial Sequence
  Description of Artificial Sequence: Synthetic oligonucleotide
agctgcagctctcagtatctgcaggctc

SEQ ID NO: 176120 - DNA, 27 bp, Artificial Sequence
  Description of Artificial Sequence: Synthetic oligonucleotide
gctgcagctctcagtatctgcaggctc

SEQ ID NO: 176121 - DNA, 27 bp, Artificial Sequence
  Description of Artificial Sequence: Synthetic oligonucleotide
ctgcagctctcagtatctgcaggctcc

SEQ ID NO: 176122 - DNA, 27 bp, Artificial Sequence
  Description of Artificial Sequence: Synthetic oligonucleotide
tgcagctctcagtatctgcaggctccc

SEQ ID NO: 176123 - DNA, 26 bp, Artificial Sequence
  Description of Artificial Sequence: Synthetic oligonucleotide
gcagctctcagtatctgcaggctccc

SEQ ID NO: 176124 - DNA, 27 bp, Artificial Sequence
  Description of Artificial Sequence: Synthetic oligonucleotide
cagctctcagtatctgcaggctcccca

SEQ ID NO: 176125 - DNA, 27 bp, Artificial Sequence
  Description of Artificial Sequence: Synthetic oligonucleotide
agctctcagtatctgcaggctccccac

SEQ ID NO: 176126 - DNA, 27 bp, Artificial Sequence
  Description of Artificial Sequence: Synthetic oligonucleotide
gctctcagtatctgcaggctccccaca

SEQ ID NO: 176127 - DNA, 28 bp, Artificial Sequence
  Description of Artificial Sequence: Synthetic oligonucleotide
ctctcagtatctgcaggctccccacatc

SEQ ID NO: 176128 - DNA, 28 bp, Artificial Sequence
  Description of Artificial Sequence: Synthetic oligonucleotide
tctcagtatctgcaggctccccacatcc

SEQ ID NO: 176129 - DNA, 27 bp, Artificial Sequence
  Description of Artificial Sequence: Synthetic oligonucleotide
ctcagtatctgcaggctccccacatcc

SEQ ID NO: 176130 - DNA, 28 bp, Artificial Sequence
  Description of Artificial Sequence: Synthetic oligonucleotide
tcagtatctgcaggctccccacatccag

SEQ ID NO: 176131 - DNA, 27 bp, Artificial Sequence
  Description of Artificial Sequence: Synthetic oligonucleotide
cagtatctgcaggctccccacatccag

SEQ ID NO: 176132 - DNA, 27 bp, Artificial Sequence
  Description of Artificial Sequence: Synthetic oligonucleotide
agtatctgcaggctccccacatccagc

SEQ ID NO: 176133 - DNA, 26 bp, Artificial Sequence
  Description of Artificial Sequence: Synthetic oligonucleotide
gtatctgcaggctccccacatccagc

SEQ ID NO: 176134 - DNA, 27 bp, Artificial Sequence
  Description of Artificial Sequence: Synthetic oligonucleotide
tatctgcaggctccccacatccagcga

SEQ ID NO: 176135 - DNA, 27 bp, Artificial Sequence
  Description of Artificial Sequence: Synthetic oligonucleotide
atctgcaggctccccacatccagcgat

SEQ ID NO: 176136 - DNA, 27 bp, Artificial Sequence
  Description of Artificial Sequence: Synthetic oligonucleotide
tctgcaggctccccacatccagcgata

SEQ ID NO: 176137 - DNA, 26 bp, Artificial Sequence
  Description of Artificial Sequence: Synthetic oligonucleotide
ctgcaggctccccacatccagcgata

SEQ ID NO: 176138 - DNA, 26 bp, Artificial Sequence
  Description of Artificial Sequence: Synthetic oligonucleotide
tgcaggctccccacatccagcgatag

SEQ ID NO: 176139 - DNA, 25 bp, Artificial Sequence
  Description of Artificial Sequence: Synthetic oligonucleotide
gcaggctccccacatccagcgatag

SEQ ID NO: 176140 - DNA, 25 bp, Artificial Sequence
  Description of Artificial Sequence: Synthetic oligonucleotide
caggctccccacatccagcgatagc

SEQ ID NO: 176141 - DNA, 26 bp, Artificial Sequence
  Description of Artificial Sequence: Synthetic oligonucleotide
aggctccccacatccagcgatagcca

SEQ ID NO: 176142 - DNA, 25 bp, Artificial Sequence
  Description of Artificial Sequence: Synthetic oligonucleotide
ggctccccacatccagcgatagcca

SEQ ID NO: 176143 - DNA, 25 bp, Artificial Sequence
  Description of Artificial Sequence: Synthetic oligonucleotide
gctccccacatccagcgatagccag

SEQ ID NO: 176144 - DNA, 25 bp, Artificial Sequence
  Description of Artificial Sequence: Synthetic oligonucleotide
ctccccacatccagcgatagccagg

SEQ ID NO: 176145 - DNA, 26 bp, Artificial Sequence
  Description of Artificial Sequence: Synthetic oligonucleotide
tccccacatccagcgatagccaggct

SEQ ID NO: 176146 - DNA, 25 bp, Artificial Sequence
  Description of Artificial Sequence: Synthetic oligonucleotide
ccccacatccagcgatagccaggct

SEQ ID NO: 176147 - DNA, 26 bp, Artificial Sequence
  Description of Artificial Sequence: Synthetic oligonucleotide
cccacatccagcgatagccaggctca

SEQ ID NO: 176148 - DNA, 27 bp, Artificial Sequence
  Description of Artificial Sequence: Synthetic oligonucleotide
ccacatccagcgatagccaggctcact

SEQ ID NO: 176149 - DNA, 27 bp, Artificial Sequence
  Description of Artificial Sequence: Synthetic oligonucleotide
cacatccagcgatagccaggctcactg

SEQ ID NO: 176150 - DNA, 28 bp, Artificial Sequence
  Description of Artificial Sequence: Synthetic oligonucleotide
acatccagcgatagccaggctcactgtg

SEQ ID NO: 176151 - DNA, 27 bp, Artificial Sequence
  Description of Artificial Sequence: Synthetic oligonucleotide
catccagcgatagccaggctcactgtg

SEQ ID NO: 176152 - DNA, 27 bp, Artificial Sequence
  Description of Artificial Sequence: Synthetic oligonucleotide
atccagcgatagccaggctcactgtgg

SEQ ID NO: 176153 - DNA, 26 bp, Artificial Sequence
  Description of Artificial Sequence: Synthetic oligonucleotide
tccagcgatagccaggctcactgtgg

SEQ ID NO: 176154 - DNA, 25 bp, Artificial Sequence
  Description of Artificial Sequence: Synthetic oligonucleotide
ccagcgatagccaggctcactgtgg

SEQ ID NO: 176155 - DNA, 26 bp, Artificial Sequence
  Description of Artificial Sequence: Synthetic oligonucleotide
cagcgatagccaggctcactgtggca

SEQ ID NO: 176156 - DNA, 26 bp, Artificial Sequence
  Description of Artificial Sequence: Synthetic oligonucleotide
agcgatagccaggctcactgtggcag

SEQ ID NO: 176157 - DNA, 25 bp, Artificial Sequence
  Description of Artificial Sequence: Synthetic oligonucleotide
gcgatagccaggctcactgtggcag

SEQ ID NO: 176158 - DNA, 25 bp, Artificial Sequence
  Description of Artificial Sequence: Synthetic oligonucleotide
cgatagccaggctcactgtggcagc

SEQ ID NO: 176159 - DNA, 25 bp, Artificial Sequence
  Description of Artificial Sequence: Synthetic oligonucleotide
gatagccaggctcactgtggcagcc

SEQ ID NO: 176160 - DNA, 25 bp, Artificial Sequence
  Description of Artificial Sequence: Synthetic oligonucleotide
atagccaggctcactgtggcagccc

SEQ ID NO: 176161 - DNA, 24 bp, Artificial Sequence
  Description of Artificial Sequence: Synthetic oligonucleotide
tagccaggctcactgtggcagccc

SEQ ID NO: 176162 - DNA, 23 bp, Artificial Sequence
  Description of Artificial Sequence: Synthetic oligonucleotide
agccaggctcactgtggcagccc

SEQ ID NO: 176163 - DNA, 22 bp, Artificial Sequence
  Description of Artificial Sequence: Synthetic oligonucleotide
gccaggctcactgtggcagccc

SEQ ID NO: 176164 - DNA, 23 bp, Artificial Sequence
  Description of Artificial Sequence: Synthetic oligonucleotide
ccaggctcactgtggcagcccca

SEQ ID NO: 176165 - DNA, 23 bp, Artificial Sequence
  Description of Artificial Sequence: Synthetic oligonucleotide
caggctcactgtggcagccccac

SEQ ID NO: 176166 - DNA, 25 bp, Artificial Sequence
  Description of Artificial Sequence: Synthetic oligonucleotide
aggctcactgtggcagccccacctt

SEQ ID NO: 176167 - DNA, 24 bp, Artificial Sequence
  Description of Artificial Sequence: Synthetic oligonucleotide
ggctcactgtggcagccccacctt

SEQ ID NO: 176168 - DNA, 25 bp, Artificial Sequence
  Description of Artificial Sequence: Synthetic oligonucleotide
gctcactgtggcagccccaccttca

SEQ ID NO: 176169 - DNA, 25 bp, Artificial Sequence
  Description of Artificial Sequence: Synthetic oligonucleotide
ctcactgtggcagccccaccttcag

SEQ ID NO: 176170 - DNA, 26 bp, Artificial Sequence
  Description of Artificial Sequence: Synthetic oligonucleotide
tcactgtggcagccccaccttcagga

SEQ ID NO: 176171 - DNA, 25 bp, Artificial Sequence
  Description of Artificial Sequence: Synthetic oligonucleotide
cactgtggcagccccaccttcagga

SEQ ID NO: 176172 - DNA, 25 bp, Artificial Sequence
  Description of Artificial Sequence: Synthetic oligonucleotide
actgtggcagccccaccttcaggag

SEQ ID NO: 176173 - DNA, 24 bp, Artificial Sequence
  Description of Artificial Sequence: Synthetic oligonucleotide
ctgtggcagccccaccttcaggag

SEQ ID NO: 176174 - DNA, 24 bp, Artificial Sequence
  Description of Artificial Sequence: Synthetic oligonucleotide
tgtggcagccccaccttcaggagg

SEQ ID NO: 176175 - DNA, 23 bp, Artificial Sequence
  Description of Artificial Sequence: Synthetic oligonucleotide
gtggcagccccaccttcaggagg

SEQ ID NO: 176176 - DNA, 23 bp, Artificial Sequence
  Description of Artificial Sequence: Synthetic oligonucleotide
tggcagccccaccttcaggaggc

SEQ ID NO: 176177 - DNA, 22 bp, Artificial Sequence
  Description of Artificial Sequence: Synthetic oligonucleotide
ggcagccccaccttcaggaggc

SEQ ID NO: 176178 - DNA, 22 bp, Artificial Sequence
  Description of Artificial Sequence: Synthetic oligonucleotide
gcagccccaccttcaggaggcc

SEQ ID NO: 176179 - DNA, 22 bp, Artificial Sequence
  Description of Artificial Sequence: Synthetic oligonucleotide
cagccccaccttcaggaggccc

SEQ ID NO: 176180 - DNA, 22 bp, Artificial Sequence
  Description of Artificial Sequence: Synthetic oligonucleotide
agccccaccttcaggaggcccc

SEQ ID NO: 176181 - DNA, 21 bp, Artificial Sequence
  Description of Artificial Sequence: Synthetic oligonucleotide
gccccaccttcaggaggcccc

SEQ ID NO: 176182 - DNA, 21 bp, Artificial Sequence
  Description of Artificial Sequence: Synthetic oligonucleotide
ccccaccttcaggaggccccg

SEQ ID NO: 176183 - DNA, 21 bp, Artificial Sequence
  Description of Artificial Sequence: Synthetic oligonucleotide
cccaccttcaggaggccccgg

SEQ ID NO: 176184 - DNA, 24 bp, Artificial Sequence
  Description of Artificial Sequence: Synthetic oligonucleotide
ccaccttcaggaggccccgggttt

SEQ ID NO: 176185 - DNA, 25 bp, Artificial Sequence
  Description of Artificial Sequence: Synthetic oligonucleotide
caccttcaggaggccccgggtttct

SEQ ID NO: 176186 - DNA, 26 bp, Artificial Sequence
  Description of Artificial Sequence: Synthetic oligonucleotide
accttcaggaggccccgggtttctgt

SEQ ID NO: 176187 - DNA, 25 bp, Artificial Sequence
  Description of Artificial Sequence: Synthetic oligonucleotide
ccttcaggaggccccgggtttctgt

SEQ ID NO: 176188 - DNA, 27 bp, Artificial Sequence
  Description of Artificial Sequence: Synthetic oligonucleotide
cttcaggaggccccgggtttctgtcta

SEQ ID NO: 176189 - DNA, 29 bp, Artificial Sequence
  Description of Artificial Sequence: Synthetic oligonucleotide
ttcaggaggccccgggtttctgtctattg

SEQ ID NO: 176190 - DNA, 28 bp, Artificial Sequence
  Description of Artificial Sequence: Synthetic oligonucleotide
tcaggaggccccgggtttctgtctattg

SEQ ID NO: 176191 - DNA, 27 bp, Artificial Sequence
  Description of Artificial Sequence: Synthetic oligonucleotide
caggaggccccgggtttctgtctattg

SEQ ID NO: 176192 - DNA, 28 bp, Artificial Sequence
  Description of Artificial Sequence: Synthetic oligonucleotide
aggaggccccgggtttctgtctattgag

SEQ ID NO: 176193 - DNA, 27 bp, Artificial Sequence
  Description of Artificial Sequence: Synthetic oligonucleotide
ggaggccccgggtttctgtctattgag

SEQ ID NO: 176194 - DNA, 27 bp, Artificial Sequence
  Description of Artificial Sequence: Synthetic oligonucleotide
gaggccccgggtttctgtctattgagc

SEQ ID NO: 176195 - DNA, 27 bp, Artificial Sequence
  Description of Artificial Sequence: Synthetic oligonucleotide
aggccccgggtttctgtctattgagcg

SEQ ID NO: 176196 - DNA, 26 bp, Artificial Sequence
  Description of Artificial Sequence: Synthetic oligonucleotide
ggccccgggtttctgtctattgagcg

SEQ ID NO: 176197 - DNA, 26 bp, Artificial Sequence
  Description of Artificial Sequence: Synthetic oligonucleotide
gccccgggtttctgtctattgagcgg

SEQ ID NO: 176198 - DNA, 26 bp, Artificial Sequence
  Description of Artificial Sequence: Synthetic oligonucleotide
ccccgggtttctgtctattgagcggc

SEQ ID NO: 176199 - DNA, 26 bp, Artificial Sequence
  Description of Artificial Sequence: Synthetic oligonucleotide
cccgggtttctgtctattgagcggcc

SEQ ID NO: 176200 - DNA, 26 bp, Artificial Sequence
  Description of Artificial Sequence: Synthetic oligonucleotide
ccgggtttctgtctattgagcggccg

SEQ ID NO: 176201 - DNA, 27 bp, Artificial Sequence
  Description of Artificial Sequence: Synthetic oligonucleotide
cgggtttctgtctattgagcggccgga

SEQ ID NO: 176202 - DNA, 29 bp, Artificial Sequence
  Description of Artificial Sequence: Synthetic oligonucleotide
gggtttctgtctattgagcggccggattc

SEQ ID NO: 176203 - DNA, 30 bp, Artificial Sequence
  Description of Artificial Sequence: Synthetic oligonucleotide
ggtttctgtctattgagcggccggattctc

SEQ ID NO: 176204 - DNA, 30 bp, Artificial Sequence
  Description of Artificial Sequence: Synthetic oligonucleotide
gtttctgtctattgagcggccggattctcg

SEQ ID NO: 176205 - DNA, 31 bp, Artificial Sequence
  Description of Artificial Sequence: Synthetic oligonucleotide
tttctgtctattgagcggccggattctcgac

SEQ ID NO: 176206 - DNA, 30 bp, Artificial Sequence
  Description of Artificial Sequence: Synthetic oligonucleotide
ttctgtctattgagcggccggattctcgac

SEQ ID NO: 176207 - DNA, 29 bp, Artificial Sequence
  Description of Artificial Sequence: Synthetic oligonucleotide
tctgtctattgagcggccggattctcgac

SEQ ID NO: 176208 - DNA, 28 bp, Artificial Sequence
  Description of Artificial Sequence: Synthetic oligonucleotide
ctgtctattgagcggccggattctcgac

SEQ ID NO: 176209 - DNA, 28 bp, Artificial Sequence
  Description of Artificial Sequence: Synthetic oligonucleotide
tgtctattgagcggccggattctcgacc

SEQ ID NO: 176210 - DNA, 27 bp, Artificial Sequence
  Description of Artificial Sequence: Synthetic oligonucleotide
gtctattgagcggccggattctcgacc

SEQ ID NO: 176211 - DNA, 28 bp, Artificial Sequence
  Description of Artificial Sequence: Synthetic oligonucleotide
tctattgagcggccggattctcgacctc

SEQ ID NO: 176212 - DNA, 27 bp, Artificial Sequence
  Description of Artificial Sequence: Synthetic oligonucleotide
ctattgagcggccggattctcgacctc

SEQ ID NO: 176213 - DNA, 27 bp, Artificial Sequence
  Description of Artificial Sequence: Synthetic oligonucleotide
tattgagcggccggattctcgacctcc

SEQ ID NO: 176214 - DNA, 27 bp, Artificial Sequence
  Description of Artificial Sequence: Synthetic oligonucleotide
attgagcggccggattctcgacctcct

SEQ ID NO: 176215 - DNA, 26 bp, Artificial Sequence
  Description of Artificial Sequence: Synthetic oligonucleotide
ttgagcggccggattctcgacctcct

SEQ ID NO: 176216 - DNA, 25 bp, Artificial Sequence
  Description of Artificial Sequence: Synthetic oligonucleotide
tgagcggccggattctcgacctcct

SEQ ID NO: 176217 - DNA, 24 bp, Artificial Sequence
  Description of Artificial Sequence: Synthetic oligonucleotide
gagcggccggattctcgacctcct

SEQ ID NO: 176218 - DNA, 24 bp, Artificial Sequence
  Description of Artificial Sequence: Synthetic oligonucleotide
agcggccggattctcgacctcctc

SEQ ID NO: 176219 - DNA, 23 bp, Artificial Sequence
  Description of Artificial Sequence: Synthetic oligonucleotide
gcggccggattctcgacctcctc

SEQ ID NO: 176220 - DNA, 24 bp, Artificial Sequence
  Description of Artificial Sequence: Synthetic oligonucleotide
cggccggattctcgacctcctcgt

SEQ ID NO: 176221 - DNA, 26 bp, Artificial Sequence
  Description of Artificial Sequence: Synthetic oligonucleotide
ggccggattctcgacctcctcgtgtt

SEQ ID NO: 176222 - DNA, 26 bp, Artificial Sequence
  Description of Artificial Sequence: Synthetic oligonucleotide
gccggattctcgacctcctcgtgttg

SEQ ID NO: 176223 - DNA, 26 bp, Artificial Sequence
  Description of Artificial Sequence: Synthetic oligonucleotide
ccggattctcgacctcctcgtgttgg

SEQ ID NO: 176224 - DNA, 26 bp, Artificial Sequence
  Description of Artificial Sequence: Synthetic oligonucleotide
cggattctcgacctcctcgtgttggg

SEQ ID NO: 176225 - DNA, 27 bp, Artificial Sequence
  Description of Artificial Sequence: Synthetic oligonucleotide
ggattctcgacctcctcgtgttgggga

SEQ ID NO: 176226 - DNA, 27 bp, Artificial Sequence
  Description of Artificial Sequence: Synthetic oligonucleotide
gattctcgacctcctcgtgttggggac

SEQ ID NO: 176227 - DNA, 28 bp, Artificial Sequence
  Description of Artificial Sequence: Synthetic oligonucleotide
attctcgacctcctcgtgttggggacac

SEQ ID NO: 176228 - DNA, 27 bp, Artificial Sequence
  Description of Artificial Sequence: Synthetic oligonucleotide
ttctcgacctcctcgtgttggggacac

SEQ ID NO: 176229 - DNA, 27 bp, Artificial Sequence
  Description of Artificial Sequence: Synthetic oligonucleotide
tctcgacctcctcgtgttggggacact

SEQ ID NO: 176230 - DNA, 26 bp, Artificial Sequence
  Description of Artificial Sequence: Synthetic oligonucleotide
ctcgacctcctcgtgttggggacact

SEQ ID NO: 176231 - DNA, 27 bp, Artificial Sequence
  Description of Artificial Sequence: Synthetic oligonucleotide
tcgacctcctcgtgttggggacactct

SEQ ID NO: 176232 - DNA, 26 bp, Artificial Sequence
  Description of Artificial Sequence: Synthetic oligonucleotide
cgacctcctcgtgttggggacactct

SEQ ID NO: 176233 - DNA, 27 bp, Artificial Sequence
  Description of Artificial Sequence: Synthetic oligonucleotide
gacctcctcgtgttggggacactctga

SEQ ID NO: 176234 - DNA, 28 bp, Artificial Sequence
  Description of Artificial Sequence: Synthetic oligonucleotide
acctcctcgtgttggggacactctgaac

SEQ ID NO: 176235 - DNA, 27 bp, Artificial Sequence
  Description of Artificial Sequence: Synthetic oligonucleotide
cctcctcgtgttggggacactctgaac

SEQ ID NO: 176236 - DNA, 27 bp, Artificial Sequence
  Description of Artificial Sequence: Synthetic oligonucleotide
ctcctcgtgttggggacactctgaacc

SEQ ID NO: 176237 - DNA, 28 bp, Artificial Sequence
  Description of Artificial Sequence: Synthetic oligonucleotide
tcctcgtgttggggacactctgaacctg

SEQ ID NO: 176238 - DNA, 27 bp, Artificial Sequence
  Description of Artificial Sequence: Synthetic oligonucleotide
cctcgtgttggggacactctgaacctg

SEQ ID NO: 176239 - DNA, 29 bp, Artificial Sequence
  Description of Artificial Sequence: Synthetic oligonucleotide
ctcgtgttggggacactctgaacctgaac

SEQ ID NO: 176240 - DNA, 31 bp, Artificial Sequence
  Description of Artificial Sequence: Synthetic oligonucleotide
tcgtgttggggacactctgaacctgaacttg

SEQ ID NO: 176241 - DNA, 30 bp, Artificial Sequence
  Description of Artificial Sequence: Synthetic oligonucleotide
cgtgttggggacactctgaacctgaacttg

SEQ ID NO: 176242 - DNA, 30 bp, Artificial Sequence
  Description of Artificial Sequence: Synthetic oligonucleotide
gtgttggggacactctgaacctgaacttgc

SEQ ID NO: 176243 - DNA, 30 bp, Artificial Sequence
  Description of Artificial Sequence: Synthetic oligonucleotide
tgttggggacactctgaacctgaacttgcg

SEQ ID NO: 176244 - DNA, 29 bp, Artificial Sequence
  Description of Artificial Sequence: Synthetic oligonucleotide
gttggggacactctgaacctgaacttgcg

SEQ ID NO: 176245 - DNA, 30 bp, Artificial Sequence
  Description of Artificial Sequence: Synthetic oligonucleotide
ttggggacactctgaacctgaacttgcgag

SEQ ID NO: 176246 - DNA, 29 bp, Artificial Sequence
  Description of Artificial Sequence: Synthetic oligonucleotide
tggggacactctgaacctgaacttgcgag

SEQ ID NO: 176247 - DNA, 28 bp, Artificial Sequence
  Description of Artificial Sequence: Synthetic oligonucleotide
ggggacactctgaacctgaacttgcgag

SEQ ID NO: 176248 - DNA, 28 bp, Artificial Sequence
  Description of Artificial Sequence: Synthetic oligonucleotide
gggacactctgaacctgaacttgcgagc

SEQ ID NO: 176249 - DNA, 28 bp, Artificial Sequence
  Description of Artificial Sequence: Synthetic oligonucleotide
ggacactctgaacctgaacttgcgagcc

SEQ ID NO: 176250 - DNA, 28 bp, Artificial Sequence
  Description of Artificial Sequence: Synthetic oligonucleotide
gacactctgaacctgaacttgcgagccg

SEQ ID NO: 176251 - DNA, 29 bp, Artificial Sequence
  Description of Artificial Sequence: Synthetic oligonucleotide
acactctgaacctgaacttgcgagccgtg

SEQ ID NO: 176252 - DNA, 28 bp, Artificial Sequence
  Description of Artificial Sequence: Synthetic oligonucleotide
cactctgaacctgaacttgcgagccgtg

SEQ ID NO: 176253 - DNA, 28 bp, Artificial Sequence
  Description of Artificial Sequence: Synthetic oligonucleotide
actctgaacctgaacttgcgagccgtgg

SEQ ID NO: 176254 - DNA, 27 bp, Artificial Sequence
  Description of Artificial Sequence: Synthetic oligonucleotide
ctctgaacctgaacttgcgagccgtgg

SEQ ID NO: 176255 - DNA, 27 bp, Artificial Sequence
  Description of Artificial Sequence: Synthetic oligonucleotide
tctgaacctgaacttgcgagccgtggg

SEQ ID NO: 176256 - DNA, 26 bp, Artificial Sequence
  Description of Artificial Sequence: Synthetic oligonucleotide
ctgaacctgaacttgcgagccgtggg

SEQ ID NO: 176257 - DNA, 27 bp, Artificial Sequence
  Description of Artificial Sequence: Synthetic oligonucleotide
tgaacctgaacttgcgagccgtgggca

SEQ ID NO: 176258 - DNA, 26 bp, Artificial Sequence
  Description of Artificial Sequence: Synthetic oligonucleotide
gaacctgaacttgcgagccgtgggca

SEQ ID NO: 176259 - DNA, 27 bp, Artificial Sequence
  Description of Artificial Sequence: Synthetic oligonucleotide
aacctgaacttgcgagccgtgggcagt

SEQ ID NO: 176260 - DNA, 26 bp, Artificial Sequence
  Description of Artificial Sequence: Synthetic oligonucleotide
acctgaacttgcgagccgtgggcagt

SEQ ID NO: 176261 - DNA, 25 bp, Artificial Sequence
  Description of Artificial Sequence: Synthetic oligonucleotide
cctgaacttgcgagccgtgggcagt

SEQ ID NO: 176262 - DNA, 25 bp, Artificial Sequence
  Description of Artificial Sequence: Synthetic oligonucleotide
ctgaacttgcgagccgtgggcagtg

SEQ ID NO: 176263 - DNA, 25 bp, Artificial Sequence
  Description of Artificial Sequence: Synthetic oligonucleotide
tgaacttgcgagccgtgggcagtgg

SEQ ID NO: 176264 - DNA, 24 bp, Artificial Sequence
  Description of Artificial Sequence: Synthetic oligonucleotide
gaacttgcgagccgtgggcagtgg

SEQ ID NO: 176265 - DNA, 24 bp, Artificial Sequence
  Description of Artificial Sequence: Synthetic oligonucleotide
aacttgcgagccgtgggcagtggg

SEQ ID NO: 176266 - DNA, 23 bp, Artificial Sequence
  Description of Artificial Sequence: Synthetic oligonucleotide
acttgcgagccgtgggcagtggg

SEQ ID NO: 176267 - DNA, 22 bp, Artificial Sequence
  Description of Artificial Sequence: Synthetic oligonucleotide
cttgcgagccgtgggcagtggg

SEQ ID NO: 176268 - DNA, 22 bp, Artificial Sequence
  Description of Artificial Sequence: Synthetic oligonucleotide
ttgcgagccgtgggcagtgggg

SEQ ID NO: 176269 - DNA, 21 bp, Artificial Sequence
  Description of Artificial Sequence: Synthetic oligonucleotide
tgcgagccgtgggcagtgggg

SEQ ID NO: 176270 - DNA, 20 bp, Artificial Sequence
  Description of Artificial Sequence: Synthetic oligonucleotide
gcgagccgtgggcagtgggg

SEQ ID NO: 176271 - DNA, 20 bp, Artificial Sequence
  Description of Artificial Sequence: Synthetic oligonucleotide
cgagccgtgggcagtggggc

SEQ ID NO: 176272 - DNA, 21 bp, Artificial Sequence
  Description of Artificial Sequence: Synthetic oligonucleotide
gagccgtgggcagtggggcca

SEQ ID NO: 176273 - DNA, 21 bp, Artificial Sequence
  Description of Artificial Sequence: Synthetic oligonucleotide
agccgtgggcagtggggccac

SEQ ID NO: 176274 - DNA, 20 bp, Artificial Sequence
  Description of Artificial Sequence: Synthetic oligonucleotide
gccgtgggcagtggggccac

SEQ ID NO: 176275 - DNA, 24 bp, Artificial Sequence
  Description of Artificial Sequence: Synthetic oligonucleotide
ccgtgggcagtggggccacctttt

SEQ ID NO: 176276 - DNA, 25 bp, Artificial Sequence
  Description of Artificial Sequence: Synthetic oligonucleotide
cgtgggcagtggggccaccttttct

SEQ ID NO: 176277 - DNA, 27 bp, Artificial Sequence
  Description of Artificial Sequence: Synthetic oligonucleotide
gtgggcagtggggccaccttttctcat

SEQ ID NO: 176278 - DNA, 29 bp, Artificial Sequence
  Description of Artificial Sequence: Synthetic oligonucleotide
tgggcagtggggccaccttttctcattac

SEQ ID NO: 176279 - DNA, 28 bp, Artificial Sequence
  Description of Artificial Sequence: Synthetic oligonucleotide
gggcagtggggccaccttttctcattac

SEQ ID NO: 176280 - DNA, 30 bp, Artificial Sequence
  Description of Artificial Sequence: Synthetic oligonucleotide
ggcagtggggccaccttttctcattactac

SEQ ID NO: 176281 - DNA, 32 bp, Artificial Sequence
  Description of Artificial Sequence: Synthetic oligonucleotide
gcagtggggccaccttttctcattactactac

SEQ ID NO: 176282 - DNA, 34 bp, Artificial Sequence
  Description of Artificial Sequence: Synthetic oligonucleotide
cagtggggccaccttttctcattactactacatg

SEQ ID NO: 176283 - DNA, 36 bp, Artificial Sequence
  Description of Artificial Sequence: Synthetic oligonucleotide
agtggggccaccttttctcattactactacatgatc

SEQ ID NO: 176284 - DNA, 35 bp, Artificial Sequence
  Description of Artificial Sequence: Synthetic oligonucleotide
gtggggccaccttttctcattactactacatgatc

SEQ ID NO: 176285 - DNA, 35 bp, Artificial Sequence
  Description of Artificial Sequence: Synthetic oligonucleotide
tggggccaccttttctcattactactacatgatcc

SEQ ID NO: 176286 - DNA, 34 bp, Artificial Sequence
  Description of Artificial Sequence: Synthetic oligonucleotide
ggggccaccttttctcattactactacatgatcc

SEQ ID NO: 176287 - DNA, 37 bp, Artificial Sequence
  Description of Artificial Sequence: Synthetic oligonucleotide
gggccaccttttctcattactactacatgatcctatc

SEQ ID NO: 176288 - DNA, 37 bp, Artificial Sequence
  Description of Artificial Sequence: Synthetic oligonucleotide
ggccaccttttctcattactactacatgatcctatcc

SEQ ID NO: 176289 - DNA, 37 bp, Artificial Sequence
  Description of Artificial Sequence: Synthetic oligonucleotide
gccaccttttctcattactactacatgatcctatccc

SEQ ID NO: 176290 - DNA, 37 bp, Artificial Sequence
  Description of Artificial Sequence: Synthetic oligonucleotide
ccaccttttctcattactactacatgatcctatcccg

SEQ ID NO: 176291 - DNA, 38 bp, Artificial Sequence
  Description of Artificial Sequence: Synthetic oligonucleotide
caccttttctcattactactacatgatcctatcccgag

SEQ ID NO: 176292 - DNA, 38 bp, Artificial Sequence
  Description of Artificial Sequence: Synthetic oligonucleotide
accttttctcattactactacatgatcctatcccgagg

SEQ ID NO: 176293 - DNA, 37 bp, Artificial Sequence
  Description of Artificial Sequence: Synthetic oligonucleotide
ccttttctcattactactacatgatcctatcccgagg

SEQ ID NO: 176294 - DNA, 37 bp, Artificial Sequence
  Description of Artificial Sequence: Synthetic oligonucleotide
cttttctcattactactacatgatcctatcccgaggg

SEQ ID NO: 176295 - DNA, 37 bp, Artificial Sequence
  Description of Artificial Sequence: Synthetic oligonucleotide
ttttctcattactactacatgatcctatcccgagggc

SEQ ID NO: 176296 - DNA, 36 bp, Artificial Sequence
  Description of Artificial Sequence: Synthetic oligonucleotide
tttctcattactactacatgatcctatcccgagggc

SEQ ID NO: 176297 - DNA, 35 bp, Artificial Sequence
  Description of Artificial Sequence: Synthetic oligonucleotide
ttctcattactactacatgatcctatcccgagggc

SEQ ID NO: 176298 - DNA, 34 bp, Artificial Sequence
  Description of Artificial Sequence: Synthetic oligonucleotide
tctcattactactacatgatcctatcccgagggc

SEQ ID NO: 176299 - DNA, 33 bp, Artificial Sequence
  Description of Artificial Sequence: Synthetic oligonucleotide
ctcattactactacatgatcctatcccgagggc

SEQ ID NO: 176300 - DNA, 34 bp, Artificial Sequence
  Description of Artificial Sequence: Synthetic oligonucleotide
tcattactactacatgatcctatcccgagggcag

SEQ ID NO: 176301 - DNA, 33 bp, Artificial Sequence
  Description of Artificial Sequence: Synthetic oligonucleotide
cattactactacatgatcctatcccgagggcag

SEQ ID NO: 176302 - DNA, 35 bp, Artificial Sequence
  Description of Artificial Sequence: Synthetic oligonucleotide
attactactacatgatcctatcccgagggcagatc

SEQ ID NO: 176303 - DNA, 34 bp, Artificial Sequence
  Description of Artificial Sequence: Synthetic oligonucleotide
ttactactacatgatcctatcccgagggcagatc

SEQ ID NO: 176304 - DNA, 33 bp, Artificial Sequence
  Description of Artificial Sequence: Synthetic oligonucleotide
tactactacatgatcctatcccgagggcagatc

SEQ ID NO: 176305 - DNA, 32 bp, Artificial Sequence
  Description of Artificial Sequence: Synthetic oligonucleotide
actactacatgatcctatcccgagggcagatc

SEQ ID NO: 176306 - DNA, 31 bp, Artificial Sequence
  Description of Artificial Sequence: Synthetic oligonucleotide
ctactacatgatcctatcccgagggcagatc

SEQ ID NO: 176307 - DNA, 31 bp, Artificial Sequence
  Description of Artificial Sequence: Synthetic oligonucleotide
tactacatgatcctatcccgagggcagatcg

SEQ ID NO: 176308 - DNA, 30 bp, Artificial Sequence
  Description of Artificial Sequence: Synthetic oligonucleotide
actacatgatcctatcccgagggcagatcg

SEQ ID NO: 176309 - DNA, 29 bp, Artificial Sequence
  Description of Artificial Sequence: Synthetic oligonucleotide
ctacatgatcctatcccgagggcagatcg

SEQ ID NO: 176310 - DNA, 30 bp, Artificial Sequence
  Description of Artificial Sequence: Synthetic oligonucleotide
tacatgatcctatcccgagggcagatcgtg

SEQ ID NO: 176311 - DNA, 29 bp, Artificial Sequence
  Description of Artificial Sequence: Synthetic oligonucleotide
acatgatcctatcccgagggcagatcgtg

SEQ ID NO: 176312 - DNA, 28 bp, Artificial Sequence
  Description of Artificial Sequence: Synthetic oligonucleotide
catgatcctatcccgagggcagatcgtg

SEQ ID NO: 176313 - DNA, 30 bp, Artificial Sequence
  Description of Artificial Sequence: Synthetic oligonucleotide
atgatcctatcccgagggcagatcgtgttc

SEQ ID NO: 176314 - DNA, 29 bp, Artificial Sequence
  Description of Artificial Sequence: Synthetic oligonucleotide
tgatcctatcccgagggcagatcgtgttc

SEQ ID NO: 176315 - DNA, 28 bp, Artificial Sequence
  Description of Artificial Sequence: Synthetic oligonucleotide
gatcctatcccgagggcagatcgtgttc

SEQ ID NO: 176316 - DNA, 30 bp, Artificial Sequence
  Description of Artificial Sequence: Synthetic oligonucleotide
atcctatcccgagggcagatcgtgttcatg

SEQ ID NO: 176317 - DNA, 29 bp, Artificial Sequence
  Description of Artificial Sequence: Synthetic oligonucleotide
tcctatcccgagggcagatcgtgttcatg

SEQ ID NO: 176318 - DNA, 28 bp, Artificial Sequence
  Description of Artificial Sequence: Synthetic oligonucleotide
cctatcccgagggcagatcgtgttcatg

SEQ ID NO: 176319 - DNA, 31 bp, Artificial Sequence
  Description of Artificial Sequence: Synthetic oligonucleotide
ctatcccgagggcagatcgtgttcatgaatc

SEQ ID NO: 176320 - DNA, 31 bp, Artificial Sequence
  Description of Artificial Sequence: Synthetic oligonucleotide
tatcccgagggcagatcgtgttcatgaatcg

SEQ ID NO: 176321 - DNA, 30 bp, Artificial Sequence
  Description of Artificial Sequence: Synthetic oligonucleotide
atcccgagggcagatcgtgttcatgaatcg

SEQ ID NO: 176322 - DNA, 29 bp, Artificial Sequence
  Description of Artificial Sequence: Synthetic oligonucleotide
tcccgagggcagatcgtgttcatgaatcg

SEQ ID NO: 176323 - DNA, 28 bp, Artificial Sequence
  Description of Artificial Sequence: Synthetic oligonucleotide
cccgagggcagatcgtgttcatgaatcg

SEQ ID NO: 176324 - DNA, 29 bp, Artificial Sequence
  Description of Artificial Sequence: Synthetic oligonucleotide
ccgagggcagatcgtgttcatgaatcgag

SEQ ID NO: 176325 - DNA, 30 bp, Artificial Sequence
  Description of Artificial Sequence: Synthetic oligonucleotide
cgagggcagatcgtgttcatgaatcgagag

SEQ ID NO: 176326 - DNA, 30 bp, Artificial Sequence
  Description of Artificial Sequence: Synthetic oligonucleotide
gagggcagatcgtgttcatgaatcgagagc

SEQ ID NO: 176327 - DNA, 30 bp, Artificial Sequence
  Description of Artificial Sequence: Synthetic oligonucleotide
agggcagatcgtgttcatgaatcgagagcc

SEQ ID NO: 176328 - DNA, 29 bp, Artificial Sequence
  Description of Artificial Sequence: Synthetic oligonucleotide
gggcagatcgtgttcatgaatcgagagcc

SEQ ID NO: 176329 - DNA, 29 bp, Artificial Sequence
  Description of Artificial Sequence: Synthetic oligonucleotide
ggcagatcgtgttcatgaatcgagagccc

SEQ ID NO: 176330 - DNA, 31 bp, Artificial Sequence
  Description of Artificial Sequence: Synthetic oligonucleotide
gcagatcgtgttcatgaatcgagagcccaag

SEQ ID NO: 176331 - DNA, 32 bp, Artificial Sequence
  Description of Artificial Sequence: Synthetic oligonucleotide
cagatcgtgttcatgaatcgagagcccaagag

SEQ ID NO: 176332 - DNA, 32 bp, Artificial Sequence
  Description of Artificial Sequence: Synthetic oligonucleotide
agatcgtgttcatgaatcgagagcccaagagg

SEQ ID NO: 176333 - DNA, 31 bp, Artificial Sequence
  Description of Artificial Sequence: Synthetic oligonucleotide
gatcgtgttcatgaatcgagagcccaagagg

SEQ ID NO: 176334 - DNA, 32 bp, Artificial Sequence
  Description of Artificial Sequence: Synthetic oligonucleotide
atcgtgttcatgaatcgagagcccaagaggac

SEQ ID NO: 176335 - DNA, 31 bp, Artificial Sequence
  Description of Artificial Sequence: Synthetic oligonucleotide
tcgtgttcatgaatcgagagcccaagaggac

SEQ ID NO: 176336 - DNA, 30 bp, Artificial Sequence
  Description of Artificial Sequence: Synthetic oligonucleotide
cgtgttcatgaatcgagagcccaagaggac

SEQ ID NO: 176337 - DNA, 30 bp, Artificial Sequence
  Description of Artificial Sequence: Synthetic oligonucleotide
gtgttcatgaatcgagagcccaagaggacc

SEQ ID NO: 176338 - DNA, 30 bp, Artificial Sequence
  Description of Artificial Sequence: Synthetic oligonucleotide
tgttcatgaatcgagagcccaagaggaccc

SEQ ID NO: 176339 - DNA, 29 bp, Artificial Sequence
  Description of Artificial Sequence: Synthetic oligonucleotide
gttcatgaatcgagagcccaagaggaccc

SEQ ID NO: 176340 - DNA, 30 bp, Artificial Sequence
  Description of Artificial Sequence: Synthetic oligonucleotide
ttcatgaatcgagagcccaagaggaccctg

SEQ ID NO: 176341 - DNA, 29 bp, Artificial Sequence
  Description of Artificial Sequence: Synthetic oligonucleotide
tcatgaatcgagagcccaagaggaccctg

SEQ ID NO: 176342 - DNA, 28 bp, Artificial Sequence
  Description of Artificial Sequence: Synthetic oligonucleotide
catgaatcgagagcccaagaggaccctg

SEQ ID NO: 176343 - DNA, 29 bp, Artificial Sequence
  Description of Artificial Sequence: Synthetic oligonucleotide
atgaatcgagagcccaagaggaccctgac

SEQ ID NO: 176344 - DNA, 28 bp, Artificial Sequence
  Description of Artificial Sequence: Synthetic oligonucleotide
tgaatcgagagcccaagaggaccctgac

SEQ ID NO: 176345 - DNA, 27 bp, Artificial Sequence
  Description of Artificial Sequence: Synthetic oligonucleotide
gaatcgagagcccaagaggaccctgac

SEQ ID NO: 176346 - DNA, 27 bp, Artificial Sequence
  Description of Artificial Sequence: Synthetic oligonucleotide
aatcgagagcccaagaggaccctgacc

SEQ ID NO: 176347 - DNA, 27 bp, Artificial Sequence
  Description of Artificial Sequence: Synthetic oligonucleotide
atcgagagcccaagaggaccctgacct

SEQ ID NO: 176348 - DNA, 26 bp, Artificial Sequence
  Description of Artificial Sequence: Synthetic oligonucleotide
tcgagagcccaagaggaccctgacct

SEQ ID NO: 176349 - DNA, 25 bp, Artificial Sequence
  Description of Artificial Sequence: Synthetic oligonucleotide
cgagagcccaagaggaccctgacct

SEQ ID NO: 176350 - DNA, 25 bp, Artificial Sequence
  Description of Artificial Sequence: Synthetic oligonucleotide
gagagcccaagaggaccctgacctc

SEQ ID NO: 176351 - DNA, 25 bp, Artificial Sequence
  Description of Artificial Sequence: Synthetic oligonucleotide
agagcccaagaggaccctgacctcg

SEQ ID NO: 176352 - DNA, 24 bp, Artificial Sequence
  Description of Artificial Sequence: Synthetic oligonucleotide
gagcccaagaggaccctgacctcg

SEQ ID NO: 176353 - DNA, 25 bp, Artificial Sequence
  Description of Artificial Sequence: Synthetic oligonucleotide
agcccaagaggaccctgacctcggt

SEQ ID NO: 176354 - DNA, 24 bp, Artificial Sequence
  Description of Artificial Sequence: Synthetic oligonucleotide
gcccaagaggaccctgacctcggt

SEQ ID NO: 176355 - DNA, 25 bp, Artificial Sequence
  Description of Artificial Sequence: Synthetic oligonucleotide
cccaagaggaccctgacctcggtct

SEQ ID NO: 176356 - DNA, 25 bp, Artificial Sequence
  Description of Artificial Sequence: Synthetic oligonucleotide
ccaagaggaccctgacctcggtctc

SEQ ID NO: 176357 - DNA, 25 bp, Artificial Sequence
  Description of Artificial Sequence: Synthetic oligonucleotide
caagaggaccctgacctcggtctcg

SEQ ID NO: 176358 - DNA, 26 bp, Artificial Sequence
  Description of Artificial Sequence: Synthetic oligonucleotide
aagaggaccctgacctcggtctcggt

SEQ ID NO: 176359 - DNA, 25 bp, Artificial Sequence
  Description of Artificial Sequence: Synthetic oligonucleotide
agaggaccctgacctcggtctcggt

SEQ ID NO: 176360 - DNA, 24 bp, Artificial Sequence
  Description of Artificial Sequence: Synthetic oligonucleotide
gaggaccctgacctcggtctcggt

SEQ ID NO: 176361 - DNA, 27 bp, Artificial Sequence
  Description of Artificial Sequence: Synthetic oligonucleotide
aggaccctgacctcggtctcggtgttt

SEQ ID NO: 176362 - DNA, 26 bp, Artificial Sequence
  Description of Artificial Sequence: Synthetic oligonucleotide
ggaccctgacctcggtctcggtgttt

SEQ ID NO: 176363 - DNA, 27 bp, Artificial Sequence
  Description of Artificial Sequence: Synthetic oligonucleotide
gaccctgacctcggtctcggtgtttgt

SEQ ID NO: 176364 - DNA, 27 bp, Artificial Sequence
  Description of Artificial Sequence: Synthetic oligonucleotide
accctgacctcggtctcggtgtttgtg

SEQ ID NO: 176365 - DNA, 26 bp, Artificial Sequence
  Description of Artificial Sequence: Synthetic oligonucleotide
ccctgacctcggtctcggtgtttgtg

SEQ ID NO: 176366 - DNA, 27 bp, Artificial Sequence
  Description of Artificial Sequence: Synthetic oligonucleotide
cctgacctcggtctcggtgtttgtgga

SEQ ID NO: 176367 - DNA, 27 bp, Artificial Sequence
  Description of Artificial Sequence: Synthetic oligonucleotide
ctgacctcggtctcggtgtttgtggac

SEQ ID NO: 176368 - DNA, 27 bp, Artificial Sequence
  Description of Artificial Sequence: Synthetic oligonucleotide
tgacctcggtctcggtgtttgtggacc

SEQ ID NO: 176369 - DNA, 27 bp, Artificial Sequence
  Description of Artificial Sequence: Synthetic oligonucleotide
gacctcggtctcggtgtttgtggacca

SEQ ID NO: 176370 - DNA, 28 bp, Artificial Sequence
  Description of Artificial Sequence: Synthetic oligonucleotide
acctcggtctcggtgtttgtggaccatc

SEQ ID NO: 176371 - DNA, 27 bp, Artificial Sequence
  Description of Artificial Sequence: Synthetic oligonucleotide
cctcggtctcggtgtttgtggaccatc

SEQ ID NO: 176372 - DNA, 28 bp, Artificial Sequence
  Description of Artificial Sequence: Synthetic oligonucleotide
ctcggtctcggtgtttgtggaccatcac

SEQ ID NO: 176373 - DNA, 28 bp, Artificial Sequence
  Description of Artificial Sequence: Synthetic oligonucleotide
tcggtctcggtgtttgtggaccatcacc

SEQ ID NO: 176374 - DNA, 27 bp, Artificial Sequence
  Description of Artificial Sequence: Synthetic oligonucleotide
cggtctcggtgtttgtggaccatcacc

SEQ ID NO: 176375 - DNA, 28 bp, Artificial Sequence
  Description of Artificial Sequence: Synthetic oligonucleotide
ggtctcggtgtttgtggaccatcacctg

SEQ ID NO: 176376 - DNA, 28 bp, Artificial Sequence
  Description of Artificial Sequence: Synthetic oligonucleotide
gtctcggtgtttgtggaccatcacctgg

SEQ ID NO: 176377 - DNA, 28 bp, Artificial Sequence
  Description of Artificial Sequence: Synthetic oligonucleotide
tctcggtgtttgtggaccatcacctggc

SEQ ID NO: 176378 - DNA, 27 bp, Artificial Sequence
  Description of Artificial Sequence: Synthetic oligonucleotide
ctcggtgtttgtggaccatcacctggc

SEQ ID NO: 176379 - DNA, 28 bp, Artificial Sequence
  Description of Artificial Sequence: Synthetic oligonucleotide
tcggtgtttgtggaccatcacctggcac

SEQ ID NO: 176380 - DNA, 27 bp, Artificial Sequence
  Description of Artificial Sequence: Synthetic oligonucleotide
cggtgtttgtggaccatcacctggcac

SEQ ID NO: 176381 - DNA, 27 bp, Artificial Sequence
  Description of Artificial Sequence: Synthetic oligonucleotide
ggtgtttgtggaccatcacctggcacc

SEQ ID NO: 176382 - DNA, 27 bp, Artificial Sequence
  Description of Artificial Sequence: Synthetic oligonucleotide
gtgtttgtggaccatcacctggcaccc

SEQ ID NO: 176383 - DNA, 28 bp, Artificial Sequence
  Description of Artificial Sequence: Synthetic oligonucleotide
tgtttgtggaccatcacctggcaccctc

SEQ ID NO: 176384 - DNA, 27 bp, Artificial Sequence
  Description of Artificial Sequence: Synthetic oligonucleotide
gtttgtggaccatcacctggcaccctc

SEQ ID NO: 176385 - DNA, 27 bp, Artificial Sequence
  Description of Artificial Sequence: Synthetic oligonucleotide
tttgtggaccatcacctggcaccctcc

SEQ ID NO: 176386 - DNA, 27 bp, Artificial Sequence
  Description of Artificial Sequence: Synthetic oligonucleotide
ttgtggaccatcacctggcaccctcct

SEQ ID NO: 176387 - DNA, 27 bp, Artificial Sequence
  Description of Artificial Sequence: Synthetic oligonucleotide
tgtggaccatcacctggcaccctcctt

SEQ ID NO: 176388 - DNA, 26 bp, Artificial Sequence
  Description of Artificial Sequence: Synthetic oligonucleotide
gtggaccatcacctggcaccctcctt

SEQ ID NO: 176389 - DNA, 27 bp, Artificial Sequence
  Description of Artificial Sequence: Synthetic oligonucleotide
tggaccatcacctggcaccctccttct

SEQ ID NO: 176390 - DNA, 27 bp, Artificial Sequence
  Description of Artificial Sequence: Synthetic oligonucleotide
ggaccatcacctggcaccctccttcta

SEQ ID NO: 176391 - DNA, 27 bp, Artificial Sequence
  Description of Artificial Sequence: Synthetic oligonucleotide
gaccatcacctggcaccctccttctac

SEQ ID NO: 176392 - DNA, 30 bp, Artificial Sequence
  Description of Artificial Sequence: Synthetic oligonucleotide
accatcacctggcaccctccttctactttg

SEQ ID NO: 176393 - DNA, 29 bp, Artificial Sequence
  Description of Artificial Sequence: Synthetic oligonucleotide
ccatcacctggcaccctccttctactttg

SEQ ID NO: 176394 - DNA, 30 bp, Artificial Sequence
  Description of Artificial Sequence: Synthetic oligonucleotide
catcacctggcaccctccttctactttgtg

SEQ ID NO: 176395 - DNA, 30 bp, Artificial Sequence
  Description of Artificial Sequence: Synthetic oligonucleotide
atcacctggcaccctccttctactttgtgg

SEQ ID NO: 176396 - DNA, 29 bp, Artificial Sequence
  Description of Artificial Sequence: Synthetic oligonucleotide
tcacctggcaccctccttctactttgtgg

SEQ ID NO: 176397 - DNA, 28 bp, Artificial Sequence
  Description of Artificial Sequence: Synthetic oligonucleotide
cacctggcaccctccttctactttgtgg

SEQ ID NO: 176398 - DNA, 28 bp, Artificial Sequence
  Description of Artificial Sequence: Synthetic oligonucleotide
acctggcaccctccttctactttgtggc

SEQ ID NO: 176399 - DNA, 27 bp, Artificial Sequence
  Description of Artificial Sequence: Synthetic oligonucleotide
cctggcaccctccttctactttgtggc

SEQ ID NO: 176400 - DNA, 27 bp, Artificial Sequence
  Description of Artificial Sequence: Synthetic oligonucleotide
ctggcaccctccttctactttgtggcc

SEQ ID NO: 176401 - DNA, 29 bp, Artificial Sequence
  Description of Artificial Sequence: Synthetic oligonucleotide
tggcaccctccttctactttgtggccttc

SEQ ID NO: 176402 - DNA, 28 bp, Artificial Sequence
  Description of Artificial Sequence: Synthetic oligonucleotide
ggcaccctccttctactttgtggccttc

SEQ ID NO: 176403 - DNA, 30 bp, Artificial Sequence
  Description of Artificial Sequence: Synthetic oligonucleotide
gcaccctccttctactttgtggccttctac

SEQ ID NO: 176404 - DNA, 32 bp, Artificial Sequence
  Description of Artificial Sequence: Synthetic oligonucleotide
caccctccttctactttgtggccttctactac

SEQ ID NO: 176405 - DNA, 32 bp, Artificial Sequence
  Description of Artificial Sequence: Synthetic oligonucleotide
accctccttctactttgtggccttctactacc

SEQ ID NO: 176406 - DNA, 31 bp, Artificial Sequence
  Description of Artificial Sequence: Synthetic oligonucleotide
ccctccttctactttgtggccttctactacc

SEQ ID NO: 176407 - DNA, 33 bp, Artificial Sequence
  Description of Artificial Sequence: Synthetic oligonucleotide
cctccttctactttgtggccttctactaccatg

SEQ ID NO: 176408 - DNA, 33 bp, Artificial Sequence
  Description of Artificial Sequence: Synthetic oligonucleotide
ctccttctactttgtggccttctactaccatgg

SEQ ID NO: 176409 - DNA, 34 bp, Artificial Sequence
  Description of Artificial Sequence: Synthetic oligonucleotide
tccttctactttgtggccttctactaccatggag

SEQ ID NO: 176410 - DNA, 33 bp, Artificial Sequence
  Description of Artificial Sequence: Synthetic oligonucleotide
ccttctactttgtggccttctactaccatggag

SEQ ID NO: 176411 - DNA, 34 bp, Artificial Sequence
  Description of Artificial Sequence: Synthetic oligonucleotide
cttctactttgtggccttctactaccatggagac

SEQ ID NO: 176412 - DNA, 34 bp, Artificial Sequence
  Description of Artificial Sequence: Synthetic oligonucleotide
ttctactttgtggccttctactaccatggagacc

SEQ ID NO: 176413 - DNA, 33 bp, Artificial Sequence
  Description of Artificial Sequence: Synthetic oligonucleotide
tctactttgtggccttctactaccatggagacc

SEQ ID NO: 176414 - DNA, 32 bp, Artificial Sequence
  Description of Artificial Sequence: Synthetic oligonucleotide
ctactttgtggccttctactaccatggagacc

SEQ ID NO: 176415 - DNA, 33 bp, Artificial Sequence
  Description of Artificial Sequence: Synthetic oligonucleotide
tactttgtggccttctactaccatggagaccac

SEQ ID NO: 176416 - DNA, 32 bp, Artificial Sequence
  Description of Artificial Sequence: Synthetic oligonucleotide
actttgtggccttctactaccatggagaccac

SEQ ID NO: 176417 - DNA, 31 bp, Artificial Sequence
  Description of Artificial Sequence: Synthetic oligonucleotide
ctttgtggccttctactaccatggagaccac

SEQ ID NO: 176418 - DNA, 31 bp, Artificial Sequence
  Description of Artificial Sequence: Synthetic oligonucleotide
tttgtggccttctactaccatggagaccacc

SEQ ID NO: 176419 - DNA, 30 bp, Artificial Sequence
  Description of Artificial Sequence: Synthetic oligonucleotide
ttgtggccttctactaccatggagaccacc

SEQ ID NO: 176420 - DNA, 29 bp, Artificial Sequence
  Description of Artificial Sequence: Synthetic oligonucleotide
tgtggccttctactaccatggagaccacc

SEQ ID NO: 176421 - DNA, 28 bp, Artificial Sequence
  Description of Artificial Sequence: Synthetic oligonucleotide
gtggccttctactaccatggagaccacc

SEQ ID NO: 176422 - DNA, 28 bp, Artificial Sequence
  Description of Artificial Sequence: Synthetic oligonucleotide
tggccttctactaccatggagaccaccc

SEQ ID NO: 176423 - DNA, 27 bp, Artificial Sequence
  Description of Artificial Sequence: Synthetic oligonucleotide
ggccttctactaccatggagaccaccc

SEQ ID NO: 176424 - DNA, 28 bp, Artificial Sequence
  Description of Artificial Sequence: Synthetic oligonucleotide
gccttctactaccatggagaccacccag

SEQ ID NO: 176425 - DNA, 29 bp, Artificial Sequence
  Description of Artificial Sequence: Synthetic oligonucleotide
ccttctactaccatggagaccacccagtg

SEQ ID NO: 176426 - DNA, 29 bp, Artificial Sequence
  Description of Artificial Sequence: Synthetic oligonucleotide
cttctactaccatggagaccacccagtgg

SEQ ID NO: 176427 - DNA, 29 bp, Artificial Sequence
  Description of Artificial Sequence: Synthetic oligonucleotide
ttctactaccatggagaccacccagtggc

SEQ ID NO: 176428 - DNA, 28 bp, Artificial Sequence
  Description of Artificial Sequence: Synthetic oligonucleotide
tctactaccatggagaccacccagtggc

SEQ ID NO: 176429 - DNA, 27 bp, Artificial Sequence
  Description of Artificial Sequence: Synthetic oligonucleotide
ctactaccatggagaccacccagtggc

SEQ ID NO: 176430 - DNA, 27 bp, Artificial Sequence
  Description of Artificial Sequence: Synthetic oligonucleotide
tactaccatggagaccacccagtggcc

SEQ ID NO: 176431 - DNA, 27 bp, Artificial Sequence
  Description of Artificial Sequence: Synthetic oligonucleotide
actaccatggagaccacccagtggcca

SEQ ID NO: 176432 - DNA, 27 bp, Artificial Sequence
  Description of Artificial Sequence: Synthetic oligonucleotide
ctaccatggagaccacccagtggccaa

SEQ ID NO: 176433 - DNA, 27 bp, Artificial Sequence
  Description of Artificial Sequence: Synthetic oligonucleotide
taccatggagaccacccagtggccaac

SEQ ID NO: 176434 - DNA, 27 bp, Artificial Sequence
  Description of Artificial Sequence: Synthetic oligonucleotide
accatggagaccacccagtggccaact

SEQ ID NO: 176435 - DNA, 26 bp, Artificial Sequence
  Description of Artificial Sequence: Synthetic oligonucleotide
ccatggagaccacccagtggccaact

SEQ ID NO: 176436 - DNA, 26 bp, Artificial Sequence
  Description of Artificial Sequence: Synthetic oligonucleotide
catggagaccacccagtggccaactc

SEQ ID NO: 176437 - DNA, 26 bp, Artificial Sequence
  Description of Artificial Sequence: Synthetic oligonucleotide
atggagaccacccagtggccaactcc

SEQ ID NO: 176438 - DNA, 25 bp, Artificial Sequence
  Description of Artificial Sequence: Synthetic oligonucleotide
tggagaccacccagtggccaactcc

SEQ ID NO: 176439 - DNA, 24 bp, Artificial Sequence
  Description of Artificial Sequence: Synthetic oligonucleotide
ggagaccacccagtggccaactcc

SEQ ID NO: 176440 - DNA, 25 bp, Artificial Sequence
  Description of Artificial Sequence: Synthetic oligonucleotide
gagaccacccagtggccaactccct

SEQ ID NO: 176441 - DNA, 25 bp, Artificial Sequence
  Description of Artificial Sequence: Synthetic oligonucleotide
agaccacccagtggccaactccctg

SEQ ID NO: 176442 - DNA, 24 bp, Artificial Sequence
  Description of Artificial Sequence: Synthetic oligonucleotide
gaccacccagtggccaactccctg

SEQ ID NO: 176443 - DNA, 24 bp, Artificial Sequence
  Description of Artificial Sequence: Synthetic oligonucleotide
accacccagtggccaactccctgc

SEQ ID NO: 176444 - DNA, 23 bp, Artificial Sequence
  Description of Artificial Sequence: Synthetic oligonucleotide
ccacccagtggccaactccctgc

SEQ ID NO: 176445 - DNA, 24 bp, Artificial Sequence
  Description of Artificial Sequence: Synthetic oligonucleotide
cacccagtggccaactccctgcga

SEQ ID NO: 176446 - DNA, 25 bp, Artificial Sequence
  Description of Artificial Sequence: Synthetic oligonucleotide
acccagtggccaactccctgcgagt

SEQ ID NO: 176447 - DNA, 24 bp, Artificial Sequence
  Description of Artificial Sequence: Synthetic oligonucleotide
cccagtggccaactccctgcgagt

SEQ ID NO: 176448 - DNA, 24 bp, Artificial Sequence
  Description of Artificial Sequence: Synthetic oligonucleotide
ccagtggccaactccctgcgagtg

SEQ ID NO: 176449 - DNA, 26 bp, Artificial Sequence
  Description of Artificial Sequence: Synthetic oligonucleotide
cagtggccaactccctgcgagtggat

SEQ ID NO: 176450 - DNA, 27 bp, Artificial Sequence
  Description of Artificial Sequence: Synthetic oligonucleotide
agtggccaactccctgcgagtggatgt

SEQ ID NO: 176451 - DNA, 26 bp, Artificial Sequence
  Description of Artificial Sequence: Synthetic oligonucleotide
gtggccaactccctgcgagtggatgt

SEQ ID NO: 176452 - DNA, 26 bp, Artificial Sequence
  Description of Artificial Sequence: Synthetic oligonucleotide
tggccaactccctgcgagtggatgtc

SEQ ID NO: 176453 - DNA, 25 bp, Artificial Sequence
  Description of Artificial Sequence: Synthetic oligonucleotide
ggccaactccctgcgagtggatgtc

SEQ ID NO: 176454 - DNA, 26 bp, Artificial Sequence
  Description of Artificial Sequence: Synthetic oligonucleotide
gccaactccctgcgagtggatgtcca

SEQ ID NO: 176455 - DNA, 26 bp, Artificial Sequence
  Description of Artificial Sequence: Synthetic oligonucleotide
ccaactccctgcgagtggatgtccag

SEQ ID NO: 176456 - DNA, 26 bp, Artificial Sequence
  Description of Artificial Sequence: Synthetic oligonucleotide
caactccctgcgagtggatgtccagg

SEQ ID NO: 176457 - DNA, 27 bp, Artificial Sequence
  Description of Artificial Sequence: Synthetic oligonucleotide
aactccctgcgagtggatgtccaggct

SEQ ID NO: 176458 - DNA, 26 bp, Artificial Sequence
  Description of Artificial Sequence: Synthetic oligonucleotide
actccctgcgagtggatgtccaggct

SEQ ID NO: 176459 - DNA, 25 bp, Artificial Sequence
  Description of Artificial Sequence: Synthetic oligonucleotide
ctccctgcgagtggatgtccaggct

SEQ ID NO: 176460 - DNA, 25 bp, Artificial Sequence
  Description of Artificial Sequence: Synthetic oligonucleotide
tccctgcgagtggatgtccaggctg

SEQ ID NO: 176461 - DNA, 24 bp, Artificial Sequence
  Description of Artificial Sequence: Synthetic oligonucleotide
ccctgcgagtggatgtccaggctg

SEQ ID NO: 176462 - DNA, 24 bp, Artificial Sequence
  Description of Artificial Sequence: Synthetic oligonucleotide
cctgcgagtggatgtccaggctgg

SEQ ID NO: 176463 - DNA, 24 bp, Artificial Sequence
  Description of Artificial Sequence: Synthetic oligonucleotide
ctgcgagtggatgtccaggctggg

SEQ ID NO: 176464 - DNA, 24 bp, Artificial Sequence
  Description of Artificial Sequence: Synthetic oligonucleotide
tgcgagtggatgtccaggctgggg

SEQ ID NO: 176465 - DNA, 23 bp, Artificial Sequence
  Description of Artificial Sequence: Synthetic oligonucleotide
gcgagtggatgtccaggctgggg

SEQ ID NO: 176466 - DNA, 23 bp, Artificial Sequence
  Description of Artificial Sequence: Synthetic oligonucleotide
cgagtggatgtccaggctggggc

SEQ ID NO: 176467 - DNA, 24 bp, Artificial Sequence
  Description of Artificial Sequence: Synthetic oligonucleotide
gagtggatgtccaggctggggcct

SEQ ID NO: 176468 - DNA, 24 bp, Artificial Sequence
  Description of Artificial Sequence: Synthetic oligonucleotide
agtggatgtccaggctggggcctg

SEQ ID NO: 176469 - DNA, 23 bp, Artificial Sequence
  Description of Artificial Sequence: Synthetic oligonucleotide
gtggatgtccaggctggggcctg

SEQ ID NO: 176470 - DNA, 23 bp, Artificial Sequence
  Description of Artificial Sequence: Synthetic oligonucleotide
tggatgtccaggctggggcctgc

SEQ ID NO: 176471 - DNA, 22 bp, Artificial Sequence
  Description of Artificial Sequence: Synthetic oligonucleotide
ggatgtccaggctggggcctgc

SEQ ID NO: 176472 - DNA, 23 bp, Artificial Sequence
  Description of Artificial Sequence: Synthetic oligonucleotide
gatgtccaggctggggcctgcga

SEQ ID NO: 176473 - DNA, 23 bp, Artificial Sequence
  Description of Artificial Sequence: Synthetic oligonucleotide
atgtccaggctggggcctgcgag

SEQ ID NO: 176474 - DNA, 22 bp, Artificial Sequence
  Description of Artificial Sequence: Synthetic oligonucleotide
tgtccaggctggggcctgcgag

SEQ ID NO: 176475 - DNA, 21 bp, Artificial Sequence
  Description of Artificial Sequence: Synthetic oligonucleotide
gtccaggctggggcctgcgag

SEQ ID NO: 176476 - DNA, 21 bp, Artificial Sequence
  Description of Artificial Sequence: Synthetic oligonucleotide
tccaggctggggcctgcgagg

SEQ ID NO: 176477 - DNA, 20 bp, Artificial Sequence
  Description of Artificial Sequence: Synthetic oligonucleotide
ccaggctggggcctgcgagg

SEQ ID NO: 176478 - DNA, 20 bp, Artificial Sequence
  Description of Artificial Sequence: Synthetic oligonucleotide
caggctggggcctgcgaggg

SEQ ID NO: 176479 - DNA, 22 bp, Artificial Sequence
  Description of Artificial Sequence: Synthetic oligonucleotide
aggctggggcctgcgagggcaa

SEQ ID NO: 176480 - DNA, 21 bp, Artificial Sequence
  Description of Artificial Sequence: Synthetic oligonucleotide
ggctggggcctgcgagggcaa

SEQ ID NO: 176481 - DNA, 21 bp, Artificial Sequence
  Description of Artificial Sequence: Synthetic oligonucleotide
gctggggcctgcgagggcaag

SEQ ID NO: 176482 - DNA, 22 bp, Artificial Sequence
  Description of Artificial Sequence: Synthetic oligonucleotide
ctggggcctgcgagggcaagct

SEQ ID NO: 176483 - DNA, 22 bp, Artificial Sequence
  Description of Artificial Sequence: Synthetic oligonucleotide
tggggcctgcgagggcaagctg

SEQ ID NO: 176484 - DNA, 21 bp, Artificial Sequence
  Description of Artificial Sequence: Synthetic oligonucleotide
ggggcctgcgagggcaagctg

SEQ ID NO: 176485 - DNA, 22 bp, Artificial Sequence
  Description of Artificial Sequence: Synthetic oligonucleotide
gggcctgcgagggcaagctgga

SEQ ID NO: 176486 - DNA, 22 bp, Artificial Sequence
  Description of Artificial Sequence: Synthetic oligonucleotide
ggcctgcgagggcaagctggag

SEQ ID NO: 176487 - DNA, 23 bp, Artificial Sequence
  Description of Artificial Sequence: Synthetic oligonucleotide
gcctgcgagggcaagctggagct

SEQ ID NO: 176488 - DNA, 24 bp, Artificial Sequence
  Description of Artificial Sequence: Synthetic oligonucleotide
cctgcgagggcaagctggagctca

SEQ ID NO: 176489 - DNA, 24 bp, Artificial Sequence
  Description of Artificial Sequence: Synthetic oligonucleotide
ctgcgagggcaagctggagctcag

SEQ ID NO: 176490 - DNA, 24 bp, Artificial Sequence
  Description of Artificial Sequence: Synthetic oligonucleotide
tgcgagggcaagctggagctcagc

SEQ ID NO: 176491 - DNA, 23 bp, Artificial Sequence
  Description of Artificial Sequence: Synthetic oligonucleotide
gcgagggcaagctggagctcagc

SEQ ID NO: 176492 - DNA, 24 bp, Artificial Sequence
  Description of Artificial Sequence: Synthetic oligonucleotide
cgagggcaagctggagctcagcgt

SEQ ID NO: 176493 - DNA, 24 bp, Artificial Sequence
  Description of Artificial Sequence: Synthetic oligonucleotide
gagggcaagctggagctcagcgtg

SEQ ID NO: 176494 - DNA, 25 bp, Artificial Sequence
  Description of Artificial Sequence: Synthetic oligonucleotide
agggcaagctggagctcagcgtgga

SEQ ID NO: 176495 - DNA, 24 bp, Artificial Sequence
  Description of Artificial Sequence: Synthetic oligonucleotide
gggcaagctggagctcagcgtgga

SEQ ID NO: 176496 - DNA, 24 bp, Artificial Sequence
  Description of Artificial Sequence: Synthetic oligonucleotide
ggcaagctggagctcagcgtggac

SEQ ID NO: 176497 - DNA, 24 bp, Artificial Sequence
  Description of Artificial Sequence: Synthetic oligonucleotide
gcaagctggagctcagcgtggacg

SEQ ID NO: 176498 - DNA, 25 bp, Artificial Sequence
  Description of Artificial Sequence: Synthetic oligonucleotide
caagctggagctcagcgtggacggt

SEQ ID NO: 176499 - DNA, 25 bp, Artificial Sequence
  Description of Artificial Sequence: Synthetic oligonucleotide
aagctggagctcagcgtggacggtg

SEQ ID NO: 176500 - DNA, 24 bp, Artificial Sequence
  Description of Artificial Sequence: Synthetic oligonucleotide
agctggagctcagcgtggacggtg

SEQ ID NO: 176501 - DNA, 23 bp, Artificial Sequence
  Description of Artificial Sequence: Synthetic oligonucleotide
gctggagctcagcgtggacggtg

SEQ ID NO: 176502 - DNA, 23 bp, Artificial Sequence
  Description of Artificial Sequence: Synthetic oligonucleotide
ctggagctcagcgtggacggtgc

SEQ ID NO: 176503 - DNA, 25 bp, Artificial Sequence
  Description of Artificial Sequence: Synthetic oligonucleotide
tggagctcagcgtggacggtgccaa

SEQ ID NO: 176504 - DNA, 24 bp, Artificial Sequence
  Description of Artificial Sequence: Synthetic oligonucleotide
ggagctcagcgtggacggtgccaa

SEQ ID NO: 176505 - DNA, 24 bp, Artificial Sequence
  Description of Artificial Sequence: Synthetic oligonucleotide
gagctcagcgtggacggtgccaag

SEQ ID NO: 176506 - DNA, 25 bp, Artificial Sequence
  Description of Artificial Sequence: Synthetic oligonucleotide
agctcagcgtggacggtgccaagca

SEQ ID NO: 176507 - DNA, 24 bp, Artificial Sequence
  Description of Artificial Sequence: Synthetic oligonucleotide
gctcagcgtggacggtgccaagca

SEQ ID NO: 176508 - DNA, 26 bp, Artificial Sequence
  Description of Artificial Sequence: Synthetic oligonucleotide
ctcagcgtggacggtgccaagcagta

SEQ ID NO: 176509 - DNA, 26 bp, Artificial Sequence
  Description of Artificial Sequence: Synthetic oligonucleotide
tcagcgtggacggtgccaagcagtac

SEQ ID NO: 176510 - DNA, 25 bp, Artificial Sequence
  Description of Artificial Sequence: Synthetic oligonucleotide
cagcgtggacggtgccaagcagtac

SEQ ID NO: 176511 - DNA, 25 bp, Artificial Sequence
  Description of Artificial Sequence: Synthetic oligonucleotide
agcgtggacggtgccaagcagtacc

SEQ ID NO: 176512 - DNA, 24 bp, Artificial Sequence
  Description of Artificial Sequence: Synthetic oligonucleotide
gcgtggacggtgccaagcagtacc

SEQ ID NO: 176513 - DNA, 24 bp, Artificial Sequence
  Description of Artificial Sequence: Synthetic oligonucleotide
cgtggacggtgccaagcagtaccg

SEQ ID NO: 176514 - DNA, 26 bp, Artificial Sequence
  Description of Artificial Sequence: Synthetic oligonucleotide
gtggacggtgccaagcagtaccggaa

SEQ ID NO: 176515 - DNA, 26 bp, Artificial Sequence
  Description of Artificial Sequence: Synthetic oligonucleotide
tggacggtgccaagcagtaccggaac

SEQ ID NO: 176516 - DNA, 25 bp, Artificial Sequence
  Description of Artificial Sequence: Synthetic oligonucleotide
ggacggtgccaagcagtaccggaac

SEQ ID NO: 176517 - DNA, 25 bp, Artificial Sequence
  Description of Artificial Sequence: Synthetic oligonucleotide
gacggtgccaagcagtaccggaacg

SEQ ID NO: 176518 - DNA, 25 bp, Artificial Sequence
  Description of Artificial Sequence: Synthetic oligonucleotide
acggtgccaagcagtaccggaacgg

SEQ ID NO: 176519 - DNA, 24 bp, Artificial Sequence
  Description of Artificial Sequence: Synthetic oligonucleotide
cggtgccaagcagtaccggaacgg

SEQ ID NO: 176520 - DNA, 24 bp, Artificial Sequence
  Description of Artificial Sequence: Synthetic oligonucleotide
ggtgccaagcagtaccggaacggg

SEQ ID NO: 176521 - DNA, 25 bp, Artificial Sequence
  Description of Artificial Sequence: Synthetic oligonucleotide
gtgccaagcagtaccggaacgggga

SEQ ID NO: 176522 - DNA, 26 bp, Artificial Sequence
  Description of Artificial Sequence: Synthetic oligonucleotide
tgccaagcagtaccggaacggggagt

SEQ ID NO: 176523 - DNA, 25 bp, Artificial Sequence
  Description of Artificial Sequence: Synthetic oligonucleotide
gccaagcagtaccggaacggggagt

SEQ ID NO: 176524 - DNA, 25 bp, Artificial Sequence
  Description of Artificial Sequence: Synthetic oligonucleotide
ccaagcagtaccggaacggggagtc

SEQ ID NO: 176525 - DNA, 25 bp, Artificial Sequence
  Description of Artificial Sequence: Synthetic oligonucleotide
caagcagtaccggaacggggagtcc

SEQ ID NO: 176526 - DNA, 26 bp, Artificial Sequence
  Description of Artificial Sequence: Synthetic oligonucleotide
aagcagtaccggaacggggagtccgt

SEQ ID NO: 176527 - DNA, 25 bp, Artificial Sequence
  Description of Artificial Sequence: Synthetic oligonucleotide
agcagtaccggaacggggagtccgt

SEQ ID NO: 176528 - DNA, 24 bp, Artificial Sequence
  Description of Artificial Sequence: Synthetic oligonucleotide
gcagtaccggaacggggagtccgt

SEQ ID NO: 176529 - DNA, 26 bp, Artificial Sequence
  Description of Artificial Sequence: Synthetic oligonucleotide
cagtaccggaacggggagtccgtgaa

SEQ ID NO: 176530 - DNA, 26 bp, Artificial Sequence
  Description of Artificial Sequence: Synthetic oligonucleotide
agtaccggaacggggagtccgtgaag

SEQ ID NO: 176531 - DNA, 25 bp, Artificial Sequence
  Description of Artificial Sequence: Synthetic oligonucleotide
gtaccggaacggggagtccgtgaag

SEQ ID NO: 176532 - DNA, 26 bp, Artificial Sequence
  Description of Artificial Sequence: Synthetic oligonucleotide
taccggaacggggagtccgtgaagct

SEQ ID NO: 176533 - DNA, 25 bp, Artificial Sequence
  Description of Artificial Sequence: Synthetic oligonucleotide
accggaacggggagtccgtgaagct

SEQ ID NO: 176534 - DNA, 24 bp, Artificial Sequence
  Description of Artificial Sequence: Synthetic oligonucleotide
ccggaacggggagtccgtgaagct

SEQ ID NO: 176535 - DNA, 24 bp, Artificial Sequence
  Description of Artificial Sequence: Synthetic oligonucleotide
cggaacggggagtccgtgaagctc

SEQ ID NO: 176536 - DNA, 25 bp, Artificial Sequence
  Description of Artificial Sequence: Synthetic oligonucleotide
ggaacggggagtccgtgaagctcca

SEQ ID NO: 176537 - DNA, 27 bp, Artificial Sequence
  Description of Artificial Sequence: Synthetic oligonucleotide
gaacggggagtccgtgaagctccactt

SEQ ID NO: 176538 - DNA, 28 bp, Artificial Sequence
  Description of Artificial Sequence: Synthetic oligonucleotide
aacggggagtccgtgaagctccacttag

SEQ ID NO: 176539 - DNA, 27 bp, Artificial Sequence
  Description of Artificial Sequence: Synthetic oligonucleotide
acggggagtccgtgaagctccacttag

SEQ ID NO: 176540 - DNA, 27 bp, Artificial Sequence
  Description of Artificial Sequence: Synthetic oligonucleotide
cggggagtccgtgaagctccacttaga

SEQ ID NO: 176541 - DNA, 29 bp, Artificial Sequence
  Description of Artificial Sequence: Synthetic oligonucleotide
ggggagtccgtgaagctccacttagaaac

SEQ ID NO: 176542 - DNA, 29 bp, Artificial Sequence
  Description of Artificial Sequence: Synthetic oligonucleotide
gggagtccgtgaagctccacttagaaacc

SEQ ID NO: 176543 - DNA, 29 bp, Artificial Sequence
  Description of Artificial Sequence: Synthetic oligonucleotide
ggagtccgtgaagctccacttagaaaccg

SEQ ID NO: 176544 - DNA, 30 bp, Artificial Sequence
  Description of Artificial Sequence: Synthetic oligonucleotide
gagtccgtgaagctccacttagaaaccgac

SEQ ID NO: 176545 - DNA, 31 bp, Artificial Sequence
  Description of Artificial Sequence: Synthetic oligonucleotide
agtccgtgaagctccacttagaaaccgactc

SEQ ID NO: 176546 - DNA, 30 bp, Artificial Sequence
  Description of Artificial Sequence: Synthetic oligonucleotide
gtccgtgaagctccacttagaaaccgactc

SEQ ID NO: 176547 - DNA, 30 bp, Artificial Sequence
  Description of Artificial Sequence: Synthetic oligonucleotide
tccgtgaagctccacttagaaaccgactcc

SEQ ID NO: 176548 - DNA, 29 bp, Artificial Sequence
  Description of Artificial Sequence: Synthetic oligonucleotide
ccgtgaagctccacttagaaaccgactcc

SEQ ID NO: 176549 - DNA, 29 bp, Artificial Sequence
  Description of Artificial Sequence: Synthetic oligonucleotide
cgtgaagctccacttagaaaccgactccc

SEQ ID NO: 176550 - DNA, 31 bp, Artificial Sequence
  Description of Artificial Sequence: Synthetic oligonucleotide
gtgaagctccacttagaaaccgactccctag

SEQ ID NO: 176551 - DNA, 31 bp, Artificial Sequence
  Description of Artificial Sequence: Synthetic oligonucleotide
tgaagctccacttagaaaccgactccctagc

SEQ ID NO: 176552 - DNA, 30 bp, Artificial Sequence
  Description of Artificial Sequence: Synthetic oligonucleotide
gaagctccacttagaaaccgactccctagc

SEQ ID NO: 176553 - DNA, 30 bp, Artificial Sequence
  Description of Artificial Sequence: Synthetic oligonucleotide
aagctccacttagaaaccgactccctagcc

SEQ ID NO: 176554 - DNA, 29 bp, Artificial Sequence
  Description of Artificial Sequence: Synthetic oligonucleotide
agctccacttagaaaccgactccctagcc

SEQ ID NO: 176555 - DNA, 28 bp, Artificial Sequence
  Description of Artificial Sequence: Synthetic oligonucleotide
gctccacttagaaaccgactccctagcc

SEQ ID NO: 176556 - DNA, 28 bp, Artificial Sequence
  Description of Artificial Sequence: Synthetic oligonucleotide
ctccacttagaaaccgactccctagccc

SEQ ID NO: 176557 - DNA, 29 bp, Artificial Sequence
  Description of Artificial Sequence: Synthetic oligonucleotide
tccacttagaaaccgactccctagccctg

SEQ ID NO: 176558 - DNA, 28 bp, Artificial Sequence
  Description of Artificial Sequence: Synthetic oligonucleotide
ccacttagaaaccgactccctagccctg

SEQ ID NO: 176559 - DNA, 28 bp, Artificial Sequence
  Description of Artificial Sequence: Synthetic oligonucleotide
cacttagaaaccgactccctagccctgg

SEQ ID NO: 176560 - DNA, 29 bp, Artificial Sequence
  Description of Artificial Sequence: Synthetic oligonucleotide
acttagaaaccgactccctagccctggtg

SEQ ID NO: 176561 - DNA, 28 bp, Artificial Sequence
  Description of Artificial Sequence: Synthetic oligonucleotide
cttagaaaccgactccctagccctggtg

SEQ ID NO: 176562 - DNA, 28 bp, Artificial Sequence
  Description of Artificial Sequence: Synthetic oligonucleotide
ttagaaaccgactccctagccctggtgg

SEQ ID NO: 176563 - DNA, 27 bp, Artificial Sequence
  Description of Artificial Sequence: Synthetic oligonucleotide
tagaaaccgactccctagccctggtgg

SEQ ID NO: 176564 - DNA, 26 bp, Artificial Sequence
  Description of Artificial Sequence: Synthetic oligonucleotide
agaaaccgactccctagccctggtgg

SEQ ID NO: 176565 - DNA, 25 bp, Artificial Sequence
  Description of Artificial Sequence: Synthetic oligonucleotide
gaaaccgactccctagccctggtgg

SEQ ID NO: 176566 - DNA, 25 bp, Artificial Sequence
  Description of Artificial Sequence: Synthetic oligonucleotide
aaaccgactccctagccctggtggc

SEQ ID NO: 176567 - DNA, 24 bp, Artificial Sequence
  Description of Artificial Sequence: Synthetic oligonucleotide
aaccgactccctagccctggtggc

SEQ ID NO: 176568 - DNA, 23 bp, Artificial Sequence
  Description of Artificial Sequence: Synthetic oligonucleotide
accgactccctagccctggtggc

SEQ ID NO: 176569 - DNA, 22 bp, Artificial Sequence
  Description of Artificial Sequence: Synthetic oligonucleotide
ccgactccctagccctggtggc

SEQ ID NO: 176570 - DNA, 22 bp, Artificial Sequence
  Description of Artificial Sequence: Synthetic oligonucleotide
cgactccctagccctggtggcg

SEQ ID NO: 176571 - DNA, 23 bp, Artificial Sequence
  Description of Artificial Sequence: Synthetic oligonucleotide
gactccctagccctggtggcgct

SEQ ID NO: 176572 - DNA, 23 bp, Artificial Sequence
  Description of Artificial Sequence: Synthetic oligonucleotide
actccctagccctggtggcgctg

SEQ ID NO: 176573 - DNA, 22 bp, Artificial Sequence
  Description of Artificial Sequence: Synthetic oligonucleotide
ctccctagccctggtggcgctg

SEQ ID NO: 176574 - DNA, 22 bp, Artificial Sequence
  Description of Artificial Sequence: Synthetic oligonucleotide
tccctagccctggtggcgctgg

SEQ ID NO: 176575 - DNA, 21 bp, Artificial Sequence
  Description of Artificial Sequence: Synthetic oligonucleotide
ccctagccctggtggcgctgg

SEQ ID NO: 176576 - DNA, 22 bp, Artificial Sequence
  Description of Artificial Sequence: Synthetic oligonucleotide
cctagccctggtggcgctggga

SEQ ID NO: 176577 - DNA, 22 bp, Artificial Sequence
  Description of Artificial Sequence: Synthetic oligonucleotide
ctagccctggtggcgctgggag

SEQ ID NO: 176578 - DNA, 22 bp, Artificial Sequence
  Description of Artificial Sequence: Synthetic oligonucleotide
tagccctggtggcgctgggagc

SEQ ID NO: 176579 - DNA, 21 bp, Artificial Sequence
  Description of Artificial Sequence: Synthetic oligonucleotide
agccctggtggcgctgggagc

SEQ ID NO: 176580 - DNA, 20 bp, Artificial Sequence
  Description of Artificial Sequence: Synthetic oligonucleotide
gccctggtggcgctgggagc

SEQ ID NO: 176581 - DNA, 22 bp, Artificial Sequence
  Description of Artificial Sequence: Synthetic oligonucleotide
ccctggtggcgctgggagcctt

SEQ ID NO: 176582 - DNA, 22 bp, Artificial Sequence
  Description of Artificial Sequence: Synthetic oligonucleotide
cctggtggcgctgggagccttg

SEQ ID NO: 176583 - DNA, 23 bp, Artificial Sequence
  Description of Artificial Sequence: Synthetic oligonucleotide
ctggtggcgctgggagccttgga

SEQ ID NO: 176584 - DNA, 24 bp, Artificial Sequence
  Description of Artificial Sequence: Synthetic oligonucleotide
tggtggcgctgggagccttggaca

SEQ ID NO: 176585 - DNA, 23 bp, Artificial Sequence
  Description of Artificial Sequence: Synthetic oligonucleotide
ggtggcgctgggagccttggaca

SEQ ID NO: 176586 - DNA, 24 bp, Artificial Sequence
  Description of Artificial Sequence: Synthetic oligonucleotide
gtggcgctgggagccttggacaca

SEQ ID NO: 176587 - DNA, 24 bp, Artificial Sequence
  Description of Artificial Sequence: Synthetic oligonucleotide
tggcgctgggagccttggacacag

SEQ ID NO: 176588 - DNA, 23 bp, Artificial Sequence
  Description of Artificial Sequence: Synthetic oligonucleotide
ggcgctgggagccttggacacag

SEQ ID NO: 176589 - DNA, 24 bp, Artificial Sequence
  Description of Artificial Sequence: Synthetic oligonucleotide
gcgctgggagccttggacacagct

SEQ ID NO: 176590 - DNA, 25 bp, Artificial Sequence
  Description of Artificial Sequence: Synthetic oligonucleotide
cgctgggagccttggacacagctct

SEQ ID NO: 176591 - DNA, 27 bp, Artificial Sequence
  Description of Artificial Sequence: Synthetic oligonucleotide
gctgggagccttggacacagctctgta

SEQ ID NO: 176592 - DNA, 28 bp, Artificial Sequence
  Description of Artificial Sequence: Synthetic oligonucleotide
ctgggagccttggacacagctctgtatg

SEQ ID NO: 176593 - DNA, 28 bp, Artificial Sequence
  Description of Artificial Sequence: Synthetic oligonucleotide
tgggagccttggacacagctctgtatgc

SEQ ID NO: 176594 - DNA, 27 bp, Artificial Sequence
  Description of Artificial Sequence: Synthetic oligonucleotide
gggagccttggacacagctctgtatgc

SEQ ID NO: 176595 - DNA, 28 bp, Artificial Sequence
  Description of Artificial Sequence: Synthetic oligonucleotide
ggagccttggacacagctctgtatgctg

SEQ ID NO: 176596 - DNA, 28 bp, Artificial Sequence
  Description of Artificial Sequence: Synthetic oligonucleotide
gagccttggacacagctctgtatgctgc

SEQ ID NO: 176597 - DNA, 29 bp, Artificial Sequence
  Description of Artificial Sequence: Synthetic oligonucleotide
agccttggacacagctctgtatgctgcag

SEQ ID NO: 176598 - DNA, 28 bp, Artificial Sequence
  Description of Artificial Sequence: Synthetic oligonucleotide
gccttggacacagctctgtatgctgcag

SEQ ID NO: 176599 - DNA, 28 bp, Artificial Sequence
  Description of Artificial Sequence: Synthetic oligonucleotide
ccttggacacagctctgtatgctgcagg

SEQ ID NO: 176600 - DNA, 28 bp, Artificial Sequence
  Description of Artificial Sequence: Synthetic oligonucleotide
cttggacacagctctgtatgctgcaggc

SEQ ID NO: 176601 - DNA, 29 bp, Artificial Sequence
  Description of Artificial Sequence: Synthetic oligonucleotide
ttggacacagctctgtatgctgcaggcag

SEQ ID NO: 176602 - DNA, 28 bp, Artificial Sequence
  Description of Artificial Sequence: Synthetic oligonucleotide
tggacacagctctgtatgctgcaggcag

SEQ ID NO: 176603 - DNA, 27 bp, Artificial Sequence
  Description of Artificial Sequence: Synthetic oligonucleotide
ggacacagctctgtatgctgcaggcag

SEQ ID NO: 176604 - DNA, 27 bp, Artificial Sequence
  Description of Artificial Sequence: Synthetic oligonucleotide
gacacagctctgtatgctgcaggcagc

SEQ ID NO: 176605 - DNA, 29 bp, Artificial Sequence
  Description of Artificial Sequence: Synthetic oligonucleotide
acacagctctgtatgctgcaggcagcaag

SEQ ID NO: 176606 - DNA, 28 bp, Artificial Sequence
  Description of Artificial Sequence: Synthetic oligonucleotide
cacagctctgtatgctgcaggcagcaag

SEQ ID NO: 176607 - DNA, 29 bp, Artificial Sequence
  Description of Artificial Sequence: Synthetic oligonucleotide
acagctctgtatgctgcaggcagcaagtc

SEQ ID NO: 176608 - DNA, 28 bp, Artificial Sequence
  Description of Artificial Sequence: Synthetic oligonucleotide
cagctctgtatgctgcaggcagcaagtc

SEQ ID NO: 176609 - DNA, 28 bp, Artificial Sequence
  Description of Artificial Sequence: Synthetic oligonucleotide
agctctgtatgctgcaggcagcaagtcc

SEQ ID NO: 176610 - DNA, 27 bp, Artificial Sequence
  Description of Artificial Sequence: Synthetic oligonucleotide
gctctgtatgctgcaggcagcaagtcc

SEQ ID NO: 176611 - DNA, 27 bp, Artificial Sequence
  Description of Artificial Sequence: Synthetic oligonucleotide
ctctgtatgctgcaggcagcaagtccc

SEQ ID NO: 176612 - DNA, 28 bp, Artificial Sequence
  Description of Artificial Sequence: Synthetic oligonucleotide
tctgtatgctgcaggcagcaagtcccac

SEQ ID NO: 176613 - DNA, 27 bp, Artificial Sequence
  Description of Artificial Sequence: Synthetic oligonucleotide
ctgtatgctgcaggcagcaagtcccac

SEQ ID NO: 176614 - DNA, 29 bp, Artificial Sequence
  Description of Artificial Sequence: Synthetic oligonucleotide
tgtatgctgcaggcagcaagtcccacaag

SEQ ID NO: 176615 - DNA, 28 bp, Artificial Sequence
  Description of Artificial Sequence: Synthetic oligonucleotide
gtatgctgcaggcagcaagtcccacaag

SEQ ID NO: 176616 - DNA, 28 bp, Artificial Sequence
  Description of Artificial Sequence: Synthetic oligonucleotide
tatgctgcaggcagcaagtcccacaagc

SEQ ID NO: 176617 - DNA, 27 bp, Artificial Sequence
  Description of Artificial Sequence: Synthetic oligonucleotide
atgctgcaggcagcaagtcccacaagc

SEQ ID NO: 176618 - DNA, 26 bp, Artificial Sequence
  Description of Artificial Sequence: Synthetic oligonucleotide
tgctgcaggcagcaagtcccacaagc

SEQ ID NO: 176619 - DNA, 25 bp, Artificial Sequence
  Description of Artificial Sequence: Synthetic oligonucleotide
gctgcaggcagcaagtcccacaagc

SEQ ID NO: 176620 - DNA, 25 bp, Artificial Sequence
  Description of Artificial Sequence: Synthetic oligonucleotide
ctgcaggcagcaagtcccacaagcc

SEQ ID NO: 176621 - DNA, 25 bp, Artificial Sequence
  Description of Artificial Sequence: Synthetic oligonucleotide
tgcaggcagcaagtcccacaagccc

SEQ ID NO: 176622 - DNA, 24 bp, Artificial Sequence
  Description of Artificial Sequence: Synthetic oligonucleotide
gcaggcagcaagtcccacaagccc

SEQ ID NO: 176623 - DNA, 25 bp, Artificial Sequence
  Description of Artificial Sequence: Synthetic oligonucleotide
caggcagcaagtcccacaagcccct

SEQ ID NO: 176624 - DNA, 27 bp, Artificial Sequence
  Description of Artificial Sequence: Synthetic oligonucleotide
aggcagcaagtcccacaagcccctcaa

SEQ ID NO: 176625 - DNA, 26 bp, Artificial Sequence
  Description of Artificial Sequence: Synthetic oligonucleotide
ggcagcaagtcccacaagcccctcaa

SEQ ID NO: 176626 - DNA, 27 bp, Artificial Sequence
  Description of Artificial Sequence: Synthetic oligonucleotide
gcagcaagtcccacaagcccctcaaca

SEQ ID NO: 176627 - DNA, 28 bp, Artificial Sequence
  Description of Artificial Sequence: Synthetic oligonucleotide
cagcaagtcccacaagcccctcaacatg

SEQ ID NO: 176628 - DNA, 28 bp, Artificial Sequence
  Description of Artificial Sequence: Synthetic oligonucleotide
agcaagtcccacaagcccctcaacatgg

SEQ ID NO: 176629 - DNA, 27 bp, Artificial Sequence
  Description of Artificial Sequence: Synthetic oligonucleotide
gcaagtcccacaagcccctcaacatgg

SEQ ID NO: 176630 - DNA, 27 bp, Artificial Sequence
  Description of Artificial Sequence: Synthetic oligonucleotide
caagtcccacaagcccctcaacatggg

SEQ ID NO: 176631 - DNA, 27 bp, Artificial Sequence
  Description of Artificial Sequence: Synthetic oligonucleotide
aagtcccacaagcccctcaacatgggc

SEQ ID NO: 176632 - DNA, 27 bp, Artificial Sequence
  Description of Artificial Sequence: Synthetic oligonucleotide
agtcccacaagcccctcaacatgggca

SEQ ID NO: 176633 - DNA, 27 bp, Artificial Sequence
  Description of Artificial Sequence: Synthetic oligonucleotide
gtcccacaagcccctcaacatgggcaa

SEQ ID NO: 176634 - DNA, 27 bp, Artificial Sequence
  Description of Artificial Sequence: Synthetic oligonucleotide
tcccacaagcccctcaacatgggcaag

SEQ ID NO: 176635 - DNA, 26 bp, Artificial Sequence
  Description of Artificial Sequence: Synthetic oligonucleotide
cccacaagcccctcaacatgggcaag

SEQ ID NO: 176636 - DNA, 27 bp, Artificial Sequence
  Description of Artificial Sequence: Synthetic oligonucleotide
ccacaagcccctcaacatgggcaaggt

SEQ ID NO: 176637 - DNA, 27 bp, Artificial Sequence
  Description of Artificial Sequence: Synthetic oligonucleotide
cacaagcccctcaacatgggcaaggtc

SEQ ID NO: 176638 - DNA, 30 bp, Artificial Sequence
  Description of Artificial Sequence: Synthetic oligonucleotide
acaagcccctcaacatgggcaaggtctttg

SEQ ID NO: 176639 - DNA, 29 bp, Artificial Sequence
  Description of Artificial Sequence: Synthetic oligonucleotide
caagcccctcaacatgggcaaggtctttg

SEQ ID NO: 176640 - DNA, 31 bp, Artificial Sequence
  Description of Artificial Sequence: Synthetic oligonucleotide
aagcccctcaacatgggcaaggtctttgaag

SEQ ID NO: 176641 - DNA, 30 bp, Artificial Sequence
  Description of Artificial Sequence: Synthetic oligonucleotide
agcccctcaacatgggcaaggtctttgaag

SEQ ID NO: 176642 - DNA, 29 bp, Artificial Sequence
  Description of Artificial Sequence: Synthetic oligonucleotide
gcccctcaacatgggcaaggtctttgaag

SEQ ID NO: 176643 - DNA, 29 bp, Artificial Sequence
  Description of Artificial Sequence: Synthetic oligonucleotide
cccctcaacatgggcaaggtctttgaagc

SEQ ID NO: 176644 - DNA, 32 bp, Artificial Sequence
  Description of Artificial Sequence: Synthetic oligonucleotide
ccctcaacatgggcaaggtctttgaagctatg

SEQ ID NO: 176645 - DNA, 34 bp, Artificial Sequence
  Description of Artificial Sequence: Synthetic oligonucleotide
cctcaacatgggcaaggtctttgaagctatgaac

SEQ ID NO: 176646 - DNA, 35 bp, Artificial Sequence
  Description of Artificial Sequence: Synthetic oligonucleotide
ctcaacatgggcaaggtctttgaagctatgaacag

SEQ ID NO: 176647 - DNA, 35 bp, Artificial Sequence
  Description of Artificial Sequence: Synthetic oligonucleotide
tcaacatgggcaaggtctttgaagctatgaacagc

SEQ ID NO: 176648 - DNA, 34 bp, Artificial Sequence
  Description of Artificial Sequence: Synthetic oligonucleotide
caacatgggcaaggtctttgaagctatgaacagc

SEQ ID NO: 176649 - DNA, 37 bp, Artificial Sequence
  Description of Artificial Sequence: Synthetic oligonucleotide
aacatgggcaaggtctttgaagctatgaacagctatg

SEQ ID NO: 176650 - DNA, 36 bp, Artificial Sequence
  Description of Artificial Sequence: Synthetic oligonucleotide
acatgggcaaggtctttgaagctatgaacagctatg

SEQ ID NO: 176651 - DNA, 35 bp, Artificial Sequence
  Description of Artificial Sequence: Synthetic oligonucleotide
catgggcaaggtctttgaagctatgaacagctatg

SEQ ID NO: 176652 - DNA, 36 bp, Artificial Sequence
  Description of Artificial Sequence: Synthetic oligonucleotide
atgggcaaggtctttgaagctatgaacagctatgac

SEQ ID NO: 176653 - DNA, 35 bp, Artificial Sequence
  Description of Artificial Sequence: Synthetic oligonucleotide
tgggcaaggtctttgaagctatgaacagctatgac

SEQ ID NO: 176654 - DNA, 34 bp, Artificial Sequence
  Description of Artificial Sequence: Synthetic oligonucleotide
gggcaaggtctttgaagctatgaacagctatgac

SEQ ID NO: 176655 - DNA, 34 bp, Artificial Sequence
  Description of Artificial Sequence: Synthetic oligonucleotide
ggcaaggtctttgaagctatgaacagctatgacc

SEQ ID NO: 176656 - DNA, 35 bp, Artificial Sequence
  Description of Artificial Sequence: Synthetic oligonucleotide
gcaaggtctttgaagctatgaacagctatgacctc

SEQ ID NO: 176657 - DNA, 35 bp, Artificial Sequence
  Description of Artificial Sequence: Synthetic oligonucleotide
caaggtctttgaagctatgaacagctatgacctcg

SEQ ID NO: 176658 - DNA, 35 bp, Artificial Sequence
  Description of Artificial Sequence: Synthetic oligonucleotide
aaggtctttgaagctatgaacagctatgacctcgg

SEQ ID NO: 176659 - DNA, 34 bp, Artificial Sequence
  Description of Artificial Sequence: Synthetic oligonucleotide
aggtctttgaagctatgaacagctatgacctcgg

SEQ ID NO: 176660 - DNA, 33 bp, Artificial Sequence
  Description of Artificial Sequence: Synthetic oligonucleotide
ggtctttgaagctatgaacagctatgacctcgg

SEQ ID NO: 176661 - DNA, 33 bp, Artificial Sequence
  Description of Artificial Sequence: Synthetic oligonucleotide
gtctttgaagctatgaacagctatgacctcggc

SEQ ID NO: 176662 - DNA, 34 bp, Artificial Sequence
  Description of Artificial Sequence: Synthetic oligonucleotide
tctttgaagctatgaacagctatgacctcggctg

SEQ ID NO: 176663 - DNA, 33 bp, Artificial Sequence
  Description of Artificial Sequence: Synthetic oligonucleotide
ctttgaagctatgaacagctatgacctcggctg

SEQ ID NO: 176664 - DNA, 34 bp, Artificial Sequence
  Description of Artificial Sequence: Synthetic oligonucleotide
tttgaagctatgaacagctatgacctcggctgtg

SEQ ID NO: 176665 - DNA, 33 bp, Artificial Sequence
  Description of Artificial Sequence: Synthetic oligonucleotide
ttgaagctatgaacagctatgacctcggctgtg

SEQ ID NO: 176666 - DNA, 32 bp, Artificial Sequence
  Description of Artificial Sequence: Synthetic oligonucleotide
tgaagctatgaacagctatgacctcggctgtg

SEQ ID NO: 176667 - DNA, 31 bp, Artificial Sequence
  Description of Artificial Sequence: Synthetic oligonucleotide
gaagctatgaacagctatgacctcggctgtg

SEQ ID NO: 176668 - DNA, 31 bp, Artificial Sequence
  Description of Artificial Sequence: Synthetic oligonucleotide
aagctatgaacagctatgacctcggctgtgg

SEQ ID NO: 176669 - DNA, 30 bp, Artificial Sequence
  Description of Artificial Sequence: Synthetic oligonucleotide
agctatgaacagctatgacctcggctgtgg

SEQ ID NO: 176670 - DNA, 29 bp, Artificial Sequence
  Description of Artificial Sequence: Synthetic oligonucleotide
gctatgaacagctatgacctcggctgtgg

SEQ ID NO: 176671 - DNA, 30 bp, Artificial Sequence
  Description of Artificial Sequence: Synthetic oligonucleotide
ctatgaacagctatgacctcggctgtggtc

SEQ ID NO: 176672 - DNA, 30 bp, Artificial Sequence
  Description of Artificial Sequence: Synthetic oligonucleotide
tatgaacagctatgacctcggctgtggtcc

SEQ ID NO: 176673 - DNA, 29 bp, Artificial Sequence
  Description of Artificial Sequence: Synthetic oligonucleotide
atgaacagctatgacctcggctgtggtcc

SEQ ID NO: 176674 - DNA, 28 bp, Artificial Sequence
  Description of Artificial Sequence: Synthetic oligonucleotide
tgaacagctatgacctcggctgtggtcc

SEQ ID NO: 176675 - DNA, 27 bp, Artificial Sequence
  Description of Artificial Sequence: Synthetic oligonucleotide
gaacagctatgacctcggctgtggtcc

SEQ ID NO: 176676 - DNA, 28 bp, Artificial Sequence
  Description of Artificial Sequence: Synthetic oligonucleotide
aacagctatgacctcggctgtggtcctg

SEQ ID NO: 176677 - DNA, 27 bp, Artificial Sequence
  Description of Artificial Sequence: Synthetic oligonucleotide
acagctatgacctcggctgtggtcctg

SEQ ID NO: 176678 - DNA, 26 bp, Artificial Sequence
  Description of Artificial Sequence: Synthetic oligonucleotide
cagctatgacctcggctgtggtcctg

SEQ ID NO: 176679 - DNA, 26 bp, Artificial Sequence
  Description of Artificial Sequence: Synthetic oligonucleotide
agctatgacctcggctgtggtcctgg

SEQ ID NO: 176680 - DNA, 25 bp, Artificial Sequence
  Description of Artificial Sequence: Synthetic oligonucleotide
gctatgacctcggctgtggtcctgg

SEQ ID NO: 176681 - DNA, 25 bp, Artificial Sequence
  Description of Artificial Sequence: Synthetic oligonucleotide
ctatgacctcggctgtggtcctggg

SEQ ID NO: 176682 - DNA, 25 bp, Artificial Sequence
  Description of Artificial Sequence: Synthetic oligonucleotide
tatgacctcggctgtggtcctgggg

SEQ ID NO: 176683 - DNA, 24 bp, Artificial Sequence
  Description of Artificial Sequence: Synthetic oligonucleotide
atgacctcggctgtggtcctgggg

SEQ ID NO: 176684 - DNA, 23 bp, Artificial Sequence
  Description of Artificial Sequence: Synthetic oligonucleotide
tgacctcggctgtggtcctgggg

SEQ ID NO: 176685 - DNA, 22 bp, Artificial Sequence
  Description of Artificial Sequence: Synthetic oligonucleotide
gacctcggctgtggtcctgggg

SEQ ID NO: 176686 - DNA, 23 bp, Artificial Sequence
  Description of Artificial Sequence: Synthetic oligonucleotide
acctcggctgtggtcctgggggt

SEQ ID NO: 176687 - DNA, 22 bp, Artificial Sequence
  Description of Artificial Sequence: Synthetic oligonucleotide
cctcggctgtggtcctgggggt

SEQ ID NO: 176688 - DNA, 22 bp, Artificial Sequence
  Description of Artificial Sequence: Synthetic oligonucleotide
ctcggctgtggtcctgggggtg

SEQ ID NO: 176689 - DNA, 22 bp, Artificial Sequence
  Description of Artificial Sequence: Synthetic oligonucleotide
tcggctgtggtcctgggggtgg

SEQ ID NO: 176690 - DNA, 21 bp, Artificial Sequence
  Description of Artificial Sequence: Synthetic oligonucleotide
cggctgtggtcctgggggtgg

SEQ ID NO: 176691 - DNA, 21 bp, Artificial Sequence
  Description of Artificial Sequence: Synthetic oligonucleotide
ggctgtggtcctgggggtggg

SEQ ID NO: 176692 - DNA, 22 bp, Artificial Sequence
  Description of Artificial Sequence: Synthetic oligonucleotide
gctgtggtcctgggggtgggga

SEQ ID NO: 176693 - DNA, 23 bp, Artificial Sequence
  Description of Artificial Sequence: Synthetic oligonucleotide
ctgtggtcctgggggtggggaca

SEQ ID NO: 176694 - DNA, 24 bp, Artificial Sequence
  Description of Artificial Sequence: Synthetic oligonucleotide
tgtggtcctgggggtggggacagt

SEQ ID NO: 176695 - DNA, 23 bp, Artificial Sequence
  Description of Artificial Sequence: Synthetic oligonucleotide
gtggtcctgggggtggggacagt

SEQ ID NO: 176696 - DNA, 23 bp, Artificial Sequence
  Description of Artificial Sequence: Synthetic oligonucleotide
tggtcctgggggtggggacagtg

SEQ ID NO: 176697 - DNA, 22 bp, Artificial Sequence
  Description of Artificial Sequence: Synthetic oligonucleotide
ggtcctgggggtggggacagtg

SEQ ID NO: 176698 - DNA, 22 bp, Artificial Sequence
  Description of Artificial Sequence: Synthetic oligonucleotide
gtcctgggggtggggacagtgc

SEQ ID NO: 176699 - DNA, 22 bp, Artificial Sequence
  Description of Artificial Sequence: Synthetic oligonucleotide
tcctgggggtggggacagtgcc

SEQ ID NO: 176700 - DNA, 21 bp, Artificial Sequence
  Description of Artificial Sequence: Synthetic oligonucleotide
cctgggggtggggacagtgcc

SEQ ID NO: 176701 - DNA, 23 bp, Artificial Sequence
  Description of Artificial Sequence: Synthetic oligonucleotide
ctgggggtggggacagtgccctt

SEQ ID NO: 176702 - DNA, 24 bp, Artificial Sequence
  Description of Artificial Sequence: Synthetic oligonucleotide
tgggggtggggacagtgcccttca

SEQ ID NO: 176703 - DNA, 23 bp, Artificial Sequence
  Description of Artificial Sequence: Synthetic oligonucleotide
gggggtggggacagtgcccttca

SEQ ID NO: 176704 - DNA, 23 bp, Artificial Sequence
  Description of Artificial Sequence: Synthetic oligonucleotide
ggggtggggacagtgcccttcag

SEQ ID NO: 176705 - DNA, 24 bp, Artificial Sequence
  Description of Artificial Sequence: Synthetic oligonucleotide
gggtggggacagtgcccttcaggt

SEQ ID NO: 176706 - DNA, 26 bp, Artificial Sequence
  Description of Artificial Sequence: Synthetic oligonucleotide
ggtggggacagtgcccttcaggtgtt

SEQ ID NO: 176707 - DNA, 26 bp, Artificial Sequence
  Description of Artificial Sequence: Synthetic oligonucleotide
gtggggacagtgcccttcaggtgttc

SEQ ID NO: 176708 - DNA, 27 bp, Artificial Sequence
  Description of Artificial Sequence: Synthetic oligonucleotide
tggggacagtgcccttcaggtgttcca

SEQ ID NO: 176709 - DNA, 26 bp, Artificial Sequence
  Description of Artificial Sequence: Synthetic oligonucleotide
ggggacagtgcccttcaggtgttcca

SEQ ID NO: 176710 - DNA, 26 bp, Artificial Sequence
  Description of Artificial Sequence: Synthetic oligonucleotide
gggacagtgcccttcaggtgttccag

SEQ ID NO: 176711 - DNA, 26 bp, Artificial Sequence
  Description of Artificial Sequence: Synthetic oligonucleotide
ggacagtgcccttcaggtgttccagg

SEQ ID NO: 176712 - DNA, 27 bp, Artificial Sequence
  Description of Artificial Sequence: Synthetic oligonucleotide
gacagtgcccttcaggtgttccaggca

SEQ ID NO: 176713 - DNA, 27 bp, Artificial Sequence
  Description of Artificial Sequence: Synthetic oligonucleotide
acagtgcccttcaggtgttccaggcag

SEQ ID NO: 176714 - DNA, 26 bp, Artificial Sequence
  Description of Artificial Sequence: Synthetic oligonucleotide
cagtgcccttcaggtgttccaggcag

SEQ ID NO: 176715 - DNA, 26 bp, Artificial Sequence
  Description of Artificial Sequence: Synthetic oligonucleotide
agtgcccttcaggtgttccaggcagc

SEQ ID NO: 176716 - DNA, 25 bp, Artificial Sequence
  Description of Artificial Sequence: Synthetic oligonucleotide
gtgcccttcaggtgttccaggcagc

SEQ ID NO: 176717 - DNA, 25 bp, Artificial Sequence
  Description of Artificial Sequence: Synthetic oligonucleotide
tgcccttcaggtgttccaggcagcg

SEQ ID NO: 176718 - DNA, 24 bp, Artificial Sequence
  Description of Artificial Sequence: Synthetic oligonucleotide
gcccttcaggtgttccaggcagcg

SEQ ID NO: 176719 - DNA, 24 bp, Artificial Sequence
  Description of Artificial Sequence: Synthetic oligonucleotide
cccttcaggtgttccaggcagcgg

SEQ ID NO: 176720 - DNA, 24 bp, Artificial Sequence
  Description of Artificial Sequence: Synthetic oligonucleotide
ccttcaggtgttccaggcagcggg

SEQ ID NO: 176721 - DNA, 24 bp, Artificial Sequence
  Description of Artificial Sequence: Synthetic oligonucleotide
cttcaggtgttccaggcagcgggc

SEQ ID NO: 176722 - DNA, 25 bp, Artificial Sequence
  Description of Artificial Sequence: Synthetic oligonucleotide
ttcaggtgttccaggcagcgggcct

SEQ ID NO: 176723 - DNA, 24 bp, Artificial Sequence
  Description of Artificial Sequence: Synthetic oligonucleotide
tcaggtgttccaggcagcgggcct

SEQ ID NO: 176724 - DNA, 23 bp, Artificial Sequence
  Description of Artificial Sequence: Synthetic oligonucleotide
caggtgttccaggcagcgggcct

SEQ ID NO: 176725 - DNA, 23 bp, Artificial Sequence
  Description of Artificial Sequence: Synthetic oligonucleotide
aggtgttccaggcagcgggcctg

SEQ ID NO: 176726 - DNA, 22 bp, Artificial Sequence
  Description of Artificial Sequence: Synthetic oligonucleotide
ggtgttccaggcagcgggcctg

SEQ ID NO: 176727 - DNA, 22 bp, Artificial Sequence
  Description of Artificial Sequence: Synthetic oligonucleotide
gtgttccaggcagcgggcctgg

SEQ ID NO: 176728 - DNA, 22 bp, Artificial Sequence
  Description of Artificial Sequence: Synthetic oligonucleotide
tgttccaggcagcgggcctggc

SEQ ID NO: 176729 - DNA, 21 bp, Artificial Sequence
  Description of Artificial Sequence: Synthetic oligonucleotide
gttccaggcagcgggcctggc

SEQ ID NO: 176730 - DNA, 25 bp, Artificial Sequence
  Description of Artificial Sequence: Synthetic oligonucleotide
ttccaggcagcgggcctggcctttt

SEQ ID NO: 176731 - DNA, 24 bp, Artificial Sequence
  Description of Artificial Sequence: Synthetic oligonucleotide
tccaggcagcgggcctggcctttt

SEQ ID NO: 176732 - DNA, 23 bp, Artificial Sequence
  Description of Artificial Sequence: Synthetic oligonucleotide
ccaggcagcgggcctggcctttt

SEQ ID NO: 176733 - DNA, 24 bp, Artificial Sequence
  Description of Artificial Sequence: Synthetic oligonucleotide
caggcagcgggcctggccttttct

SEQ ID NO: 176734 - DNA, 26 bp, Artificial Sequence
  Description of Artificial Sequence: Synthetic oligonucleotide
aggcagcgggcctggccttttctgat

SEQ ID NO: 176735 - DNA, 25 bp, Artificial Sequence
  Description of Artificial Sequence: Synthetic oligonucleotide
ggcagcgggcctggccttttctgat

SEQ ID NO: 176736 - DNA, 25 bp, Artificial Sequence
  Description of Artificial Sequence: Synthetic oligonucleotide
gcagcgggcctggccttttctgatg

SEQ ID NO: 176737 - DNA, 26 bp, Artificial Sequence
  Description of Artificial Sequence: Synthetic oligonucleotide
cagcgggcctggccttttctgatgga

SEQ ID NO: 176738 - DNA, 27 bp, Artificial Sequence
  Description of Artificial Sequence: Synthetic oligonucleotide
agcgggcctggccttttctgatggaga

SEQ ID NO: 176739 - DNA, 26 bp, Artificial Sequence
  Description of Artificial Sequence: Synthetic oligonucleotide
gcgggcctggccttttctgatggaga

SEQ ID NO: 176740 - DNA, 26 bp, Artificial Sequence
  Description of Artificial Sequence: Synthetic oligonucleotide
cgggcctggccttttctgatggagac

SEQ ID NO: 176741 - DNA, 27 bp, Artificial Sequence
  Description of Artificial Sequence: Synthetic oligonucleotide
gggcctggccttttctgatggagacca

SEQ ID NO: 176742 - DNA, 27 bp, Artificial Sequence
  Description of Artificial Sequence: Synthetic oligonucleotide
ggcctggccttttctgatggagaccag

SEQ ID NO: 176743 - DNA, 28 bp, Artificial Sequence
  Description of Artificial Sequence: Synthetic oligonucleotide
gcctggccttttctgatggagaccagtg

SEQ ID NO: 176744 - DNA, 28 bp, Artificial Sequence
  Description of Artificial Sequence: Synthetic oligonucleotide
cctggccttttctgatggagaccagtgg

SEQ ID NO: 176745 - DNA, 29 bp, Artificial Sequence
  Description of Artificial Sequence: Synthetic oligonucleotide
ctggccttttctgatggagaccagtggac

SEQ ID NO: 176746 - DNA, 29 bp, Artificial Sequence
  Description of Artificial Sequence: Synthetic oligonucleotide
tggccttttctgatggagaccagtggacc

SEQ ID NO: 176747 - DNA, 28 bp, Artificial Sequence
  Description of Artificial Sequence: Synthetic oligonucleotide
ggccttttctgatggagaccagtggacc

SEQ ID NO: 176748 - DNA, 32 bp, Artificial Sequence
  Description of Artificial Sequence: Synthetic oligonucleotide
gccttttctgatggagaccagtggaccttatc

SEQ ID NO: 176749 - DNA, 32 bp, Artificial Sequence
  Description of Artificial Sequence: Synthetic oligonucleotide
ccttttctgatggagaccagtggaccttatcc

SEQ ID NO: 176750 - DNA, 33 bp, Artificial Sequence
  Description of Artificial Sequence: Synthetic oligonucleotide
cttttctgatggagaccagtggaccttatccag

SEQ ID NO: 176751 - DNA, 36 bp, Artificial Sequence
  Description of Artificial Sequence: Synthetic oligonucleotide
ttttctgatggagaccagtggaccttatccagaaag

SEQ ID NO: 176752 - DNA, 35 bp, Artificial Sequence
  Description of Artificial Sequence: Synthetic oligonucleotide
tttctgatggagaccagtggaccttatccagaaag

SEQ ID NO: 176753 - DNA, 34 bp, Artificial Sequence
  Description of Artificial Sequence: Synthetic oligonucleotide
ttctgatggagaccagtggaccttatccagaaag

SEQ ID NO: 176754 - DNA, 33 bp, Artificial Sequence
  Description of Artificial Sequence: Synthetic oligonucleotide
tctgatggagaccagtggaccttatccagaaag

SEQ ID NO: 176755 - DNA, 32 bp, Artificial Sequence
  Description of Artificial Sequence: Synthetic oligonucleotide
ctgatggagaccagtggaccttatccagaaag

SEQ ID NO: 176756 - DNA, 33 bp, Artificial Sequence
  Description of Artificial Sequence: Synthetic oligonucleotide
tgatggagaccagtggaccttatccagaaagag

SEQ ID NO: 176757 - DNA, 32 bp, Artificial Sequence
  Description of Artificial Sequence: Synthetic oligonucleotide
gatggagaccagtggaccttatccagaaagag

SEQ ID NO: 176758 - DNA, 33 bp, Artificial Sequence
  Description of Artificial Sequence: Synthetic oligonucleotide
atggagaccagtggaccttatccagaaagagac

SEQ ID NO: 176759 - DNA, 32 bp, Artificial Sequence
  Description of Artificial Sequence: Synthetic oligonucleotide
tggagaccagtggaccttatccagaaagagac

SEQ ID NO: 176760 - DNA, 31 bp, Artificial Sequence
  Description of Artificial Sequence: Synthetic oligonucleotide
ggagaccagtggaccttatccagaaagagac

SEQ ID NO: 176761 - DNA, 34 bp, Artificial Sequence
  Description of Artificial Sequence: Synthetic oligonucleotide
gagaccagtggaccttatccagaaagagactaag

SEQ ID NO: 176762 - DNA, 34 bp, Artificial Sequence
  Description of Artificial Sequence: Synthetic oligonucleotide
agaccagtggaccttatccagaaagagactaagc

SEQ ID NO: 176763 - DNA, 33 bp, Artificial Sequence
  Description of Artificial Sequence: Synthetic oligonucleotide
gaccagtggaccttatccagaaagagactaagc

SEQ ID NO: 176764 - DNA, 34 bp, Artificial Sequence
  Description of Artificial Sequence: Synthetic oligonucleotide
accagtggaccttatccagaaagagactaagctg

SEQ ID NO: 176765 - DNA, 33 bp, Artificial Sequence
  Description of Artificial Sequence: Synthetic oligonucleotide
ccagtggaccttatccagaaagagactaagctg

SEQ ID NO: 176766 - DNA, 34 bp, Artificial Sequence
  Description of Artificial Sequence: Synthetic oligonucleotide
cagtggaccttatccagaaagagactaagctgtc

SEQ ID NO: 176767 - DNA, 34 bp, Artificial Sequence
  Description of Artificial Sequence: Synthetic oligonucleotide
agtggaccttatccagaaagagactaagctgtcc

SEQ ID NO: 176768 - DNA, 33 bp, Artificial Sequence
  Description of Artificial Sequence: Synthetic oligonucleotide
gtggaccttatccagaaagagactaagctgtcc

SEQ ID NO: 176769 - DNA, 33 bp, Artificial Sequence
  Description of Artificial Sequence: Synthetic oligonucleotide
tggaccttatccagaaagagactaagctgtccc

SEQ ID NO: 176770 - DNA, 32 bp, Artificial Sequence
  Description of Artificial Sequence: Synthetic oligonucleotide
ggaccttatccagaaagagactaagctgtccc

SEQ ID NO: 176771 - DNA, 34 bp, Artificial Sequence
  Description of Artificial Sequence: Synthetic oligonucleotide
gaccttatccagaaagagactaagctgtcccaag

SEQ ID NO: 176772 - DNA, 34 bp, Artificial Sequence
  Description of Artificial Sequence: Synthetic oligonucleotide
accttatccagaaagagactaagctgtcccaagg

SEQ ID NO: 176773 - DNA, 33 bp, Artificial Sequence
  Description of Artificial Sequence: Synthetic oligonucleotide
ccttatccagaaagagactaagctgtcccaagg

SEQ ID NO: 176774 - DNA, 34 bp, Artificial Sequence
  Description of Artificial Sequence: Synthetic oligonucleotide
cttatccagaaagagactaagctgtcccaaggag

SEQ ID NO: 176775 - DNA, 36 bp, Artificial Sequence
  Description of Artificial Sequence: Synthetic oligonucleotide
ttatccagaaagagactaagctgtcccaaggagaag

SEQ ID NO: 176776 - DNA, 35 bp, Artificial Sequence
  Description of Artificial Sequence: Synthetic oligonucleotide
tatccagaaagagactaagctgtcccaaggagaag

SEQ ID NO: 176777 - DNA, 34 bp, Artificial Sequence
  Description of Artificial Sequence: Synthetic oligonucleotide
atccagaaagagactaagctgtcccaaggagaag

SEQ ID NO: 176778 - DNA, 33 bp, Artificial Sequence
  Description of Artificial Sequence: Synthetic oligonucleotide
tccagaaagagactaagctgtcccaaggagaag

SEQ ID NO: 176779 - DNA, 32 bp, Artificial Sequence
  Description of Artificial Sequence: Synthetic oligonucleotide
ccagaaagagactaagctgtcccaaggagaag

SEQ ID NO: 176780 - DNA, 33 bp, Artificial Sequence
  Description of Artificial Sequence: Synthetic oligonucleotide
cagaaagagactaagctgtcccaaggagaagac

SEQ ID NO: 176781 - DNA, 35 bp, Artificial Sequence
  Description of Artificial Sequence: Synthetic oligonucleotide
agaaagagactaagctgtcccaaggagaagacaac

SEQ ID NO: 176782 - DNA, 34 bp, Artificial Sequence
  Description of Artificial Sequence: Synthetic oligonucleotide
gaaagagactaagctgtcccaaggagaagacaac

SEQ ID NO: 176783 - DNA, 34 bp, Artificial Sequence
  Description of Artificial Sequence: Synthetic oligonucleotide
aaagagactaagctgtcccaaggagaagacaacc

SEQ ID NO: 176784 - DNA, 33 bp, Artificial Sequence
  Description of Artificial Sequence: Synthetic oligonucleotide
aagagactaagctgtcccaaggagaagacaacc

SEQ ID NO: 176785 - DNA, 32 bp, Artificial Sequence
  Description of Artificial Sequence: Synthetic oligonucleotide
agagactaagctgtcccaaggagaagacaacc

SEQ ID NO: 176786 - DNA, 31 bp, Artificial Sequence
  Description of Artificial Sequence: Synthetic oligonucleotide
gagactaagctgtcccaaggagaagacaacc

SEQ ID NO: 176787 - DNA, 31 bp, Artificial Sequence
  Description of Artificial Sequence: Synthetic oligonucleotide
agactaagctgtcccaaggagaagacaaccc

SEQ ID NO: 176788 - DNA, 30 bp, Artificial Sequence
  Description of Artificial Sequence: Synthetic oligonucleotide
gactaagctgtcccaaggagaagacaaccc

SEQ ID NO: 176789 - DNA, 30 bp, Artificial Sequence
  Description of Artificial Sequence: Synthetic oligonucleotide
actaagctgtcccaaggagaagacaacccg

SEQ ID NO: 176790 - DNA, 29 bp, Artificial Sequence
  Description of Artificial Sequence: Synthetic oligonucleotide
ctaagctgtcccaaggagaagacaacccg

SEQ ID NO: 176791 - DNA, 29 bp, Artificial Sequence
  Description of Artificial Sequence: Synthetic oligonucleotide
taagctgtcccaaggagaagacaacccgg

SEQ ID NO: 176792 - DNA, 28 bp, Artificial Sequence
  Description of Artificial Sequence: Synthetic oligonucleotide
aagctgtcccaaggagaagacaacccgg

SEQ ID NO: 176793 - DNA, 27 bp, Artificial Sequence
  Description of Artificial Sequence: Synthetic oligonucleotide
agctgtcccaaggagaagacaacccgg

SEQ ID NO: 176794 - DNA, 27 bp, Artificial Sequence
  Description of Artificial Sequence: Synthetic oligonucleotide
gctgtcccaaggagaagacaacccgga

SEQ ID NO: 176795 - DNA, 31 bp, Artificial Sequence
  Description of Artificial Sequence: Synthetic oligonucleotide
ctgtcccaaggagaagacaacccggaaaaag

SEQ ID NO: 176796 - DNA, 32 bp, Artificial Sequence
  Description of Artificial Sequence: Synthetic oligonucleotide
tgtcccaaggagaagacaacccggaaaaagag

SEQ ID NO: 176797 - DNA, 31 bp, Artificial Sequence
  Description of Artificial Sequence: Synthetic oligonucleotide
gtcccaaggagaagacaacccggaaaaagag

SEQ ID NO: 176798 - DNA, 34 bp, Artificial Sequence
  Description of Artificial Sequence: Synthetic oligonucleotide
tcccaaggagaagacaacccggaaaaagagaaac

SEQ ID NO: 176799 - DNA, 33 bp, Artificial Sequence
  Description of Artificial Sequence: Synthetic oligonucleotide
cccaaggagaagacaacccggaaaaagagaaac

SEQ ID NO: 176800 - DNA, 33 bp, Artificial Sequence
  Description of Artificial Sequence: Synthetic oligonucleotide
ccaaggagaagacaacccggaaaaagagaaacg

SEQ ID NO: 176801 - DNA, 34 bp, Artificial Sequence
  Description of Artificial Sequence: Synthetic oligonucleotide
caaggagaagacaacccggaaaaagagaaacgtg

SEQ ID NO: 176802 - DNA, 36 bp, Artificial Sequence
  Description of Artificial Sequence: Synthetic oligonucleotide
aaggagaagacaacccggaaaaagagaaacgtgaac

SEQ ID NO: 176803 - DNA, 35 bp, Artificial Sequence
  Description of Artificial Sequence: Synthetic oligonucleotide
aggagaagacaacccggaaaaagagaaacgtgaac

SEQ ID NO: 176804 - DNA, 34 bp, Artificial Sequence
  Description of Artificial Sequence: Synthetic oligonucleotide
ggagaagacaacccggaaaaagagaaacgtgaac

SEQ ID NO: 176805 - DNA, 36 bp, Artificial Sequence
  Description of Artificial Sequence: Synthetic oligonucleotide
gagaagacaacccggaaaaagagaaacgtgaacttc

SEQ ID NO: 176806 - DNA, 36 bp, Artificial Sequence
  Description of Artificial Sequence: Synthetic oligonucleotide
agaagacaacccggaaaaagagaaacgtgaacttcc

SEQ ID NO: 176807 - DNA, 35 bp, Artificial Sequence
  Description of Artificial Sequence: Synthetic oligonucleotide
gaagacaacccggaaaaagagaaacgtgaacttcc

SEQ ID NO: 176808 - DNA, 39 bp, Artificial Sequence
  Description of Artificial Sequence: Synthetic oligonucleotide
aagacaacccggaaaaagagaaacgtgaacttccaaaag

SEQ ID NO: 176809 - DNA, 38 bp, Artificial Sequence
  Description of Artificial Sequence: Synthetic oligonucleotide
agacaacccggaaaaagagaaacgtgaacttccaaaag

SEQ ID NO: 176810 - DNA, 37 bp, Artificial Sequence
  Description of Artificial Sequence: Synthetic oligonucleotide
gacaacccggaaaaagagaaacgtgaacttccaaaag

SEQ ID NO: 176811 - DNA, 37 bp, Artificial Sequence
  Description of Artificial Sequence: Synthetic oligonucleotide
acaacccggaaaaagagaaacgtgaacttccaaaagg

SEQ ID NO: 176812 - DNA, 36 bp, Artificial Sequence
  Description of Artificial Sequence: Synthetic oligonucleotide
caacccggaaaaagagaaacgtgaacttccaaaagg

SEQ ID NO: 176813 - DNA, 36 bp, Artificial Sequence
  Description of Artificial Sequence: Synthetic oligonucleotide
aacccggaaaaagagaaacgtgaacttccaaaaggc

SEQ ID NO: 176814 - DNA, 35 bp, Artificial Sequence
  Description of Artificial Sequence: Synthetic oligonucleotide
acccggaaaaagagaaacgtgaacttccaaaaggc

SEQ ID NO: 176815 - DNA, 34 bp, Artificial Sequence
  Description of Artificial Sequence: Synthetic oligonucleotide
cccggaaaaagagaaacgtgaacttccaaaaggc

SEQ ID NO: 176816 - DNA, 34 bp, Artificial Sequence
  Description of Artificial Sequence: Synthetic oligonucleotide
ccggaaaaagagaaacgtgaacttccaaaaggcg

SEQ ID NO: 176817 - DNA, 40 bp, Artificial Sequence
  Description of Artificial Sequence: Synthetic oligonucleotide
cggaaaaagagaaacgtgaacttccaaaaggcgattaatg

SEQ ID NO: 176818 - DNA, 41 bp, Artificial Sequence
  Description of Artificial Sequence: Synthetic oligonucleotide
ggaaaaagagaaacgtgaacttccaaaaggcgattaatgag

SEQ ID NO: 176819 - DNA, 46 bp, Artificial Sequence
  Description of Artificial Sequence: Synthetic oligonucleotide
gaaaaagagaaacgtgaacttccaaaaggcgattaatgagaaattg

SEQ ID NO: 176820 - DNA, 46 bp, Artificial Sequence
  Description of Artificial Sequence: Synthetic oligonucleotide
aaaaagagaaacgtgaacttccaaaaggcgattaatgagaaattgg

SEQ ID NO: 176821 - DNA, 45 bp, Artificial Sequence
  Description of Artificial Sequence: Synthetic oligonucleotide
aaaagagaaacgtgaacttccaaaaggcgattaatgagaaattgg

SEQ ID NO: 176822 - DNA, 44 bp, Artificial Sequence
  Description of Artificial Sequence: Synthetic oligonucleotide
aaagagaaacgtgaacttccaaaaggcgattaatgagaaattgg

SEQ ID NO: 176823 - DNA, 43 bp, Artificial Sequence
  Description of Artificial Sequence: Synthetic oligonucleotide
aagagaaacgtgaacttccaaaaggcgattaatgagaaattgg

SEQ ID NO: 176824 - DNA, 42 bp, Artificial Sequence
  Description of Artificial Sequence: Synthetic oligonucleotide
agagaaacgtgaacttccaaaaggcgattaatgagaaattgg

SEQ ID NO: 176825 - DNA, 41 bp, Artificial Sequence
  Description of Artificial Sequence: Synthetic oligonucleotide
gagaaacgtgaacttccaaaaggcgattaatgagaaattgg

SEQ ID NO: 176826 - DNA, 41 bp, Artificial Sequence
  Description of Artificial Sequence: Synthetic oligonucleotide
agaaacgtgaacttccaaaaggcgattaatgagaaattggg

SEQ ID NO: 176827 - DNA, 40 bp, Artificial Sequence
  Description of Artificial Sequence: Synthetic oligonucleotide
gaaacgtgaacttccaaaaggcgattaatgagaaattggg

SEQ ID NO: 176828 - DNA, 41 bp, Artificial Sequence
  Description of Artificial Sequence: Synthetic oligonucleotide
aaacgtgaacttccaaaaggcgattaatgagaaattgggtc

SEQ ID NO: 176829 - DNA, 40 bp, Artificial Sequence
  Description of Artificial Sequence: Synthetic oligonucleotide
aacgtgaacttccaaaaggcgattaatgagaaattgggtc

SEQ ID NO: 176830 - DNA, 39 bp, Artificial Sequence
  Description of Artificial Sequence: Synthetic oligonucleotide
acgtgaacttccaaaaggcgattaatgagaaattgggtc

SEQ ID NO: 176831 - DNA, 38 bp, Artificial Sequence
  Description of Artificial Sequence: Synthetic oligonucleotide
cgtgaacttccaaaaggcgattaatgagaaattgggtc

SEQ ID NO: 176832 - DNA, 39 bp, Artificial Sequence
  Description of Artificial Sequence: Synthetic oligonucleotide
gtgaacttccaaaaggcgattaatgagaaattgggtcag

SEQ ID NO: 176833 - DNA, 42 bp, Artificial Sequence
  Description of Artificial Sequence: Synthetic oligonucleotide
tgaacttccaaaaggcgattaatgagaaattgggtcagtatg

SEQ ID NO: 176834 - DNA, 41 bp, Artificial Sequence
  Description of Artificial Sequence: Synthetic oligonucleotide
gaacttccaaaaggcgattaatgagaaattgggtcagtatg

SEQ ID NO: 176835 - DNA, 41 bp, Artificial Sequence
  Description of Artificial Sequence: Synthetic oligonucleotide
aacttccaaaaggcgattaatgagaaattgggtcagtatgc

SEQ ID NO: 176836 - DNA, 40 bp, Artificial Sequence
  Description of Artificial Sequence: Synthetic oligonucleotide
acttccaaaaggcgattaatgagaaattgggtcagtatgc

SEQ ID NO: 176837 - DNA, 39 bp, Artificial Sequence
  Description of Artificial Sequence: Synthetic oligonucleotide
cttccaaaaggcgattaatgagaaattgggtcagtatgc

SEQ ID NO: 176838 - DNA, 41 bp, Artificial Sequence
  Description of Artificial Sequence: Synthetic oligonucleotide
ttccaaaaggcgattaatgagaaattgggtcagtatgcttc

SEQ ID NO: 176839 - DNA, 40 bp, Artificial Sequence
  Description of Artificial Sequence: Synthetic oligonucleotide
tccaaaaggcgattaatgagaaattgggtcagtatgcttc

SEQ ID NO: 176840 - DNA, 39 bp, Artificial Sequence
  Description of Artificial Sequence: Synthetic oligonucleotide
ccaaaaggcgattaatgagaaattgggtcagtatgcttc

SEQ ID NO: 176841 - DNA, 39 bp, Artificial Sequence
  Description of Artificial Sequence: Synthetic oligonucleotide
caaaaggcgattaatgagaaattgggtcagtatgcttcc

SEQ ID NO: 176842 - DNA, 39 bp, Artificial Sequence
  Description of Artificial Sequence: Synthetic oligonucleotide
aaaaggcgattaatgagaaattgggtcagtatgcttccc

SEQ ID NO: 176843 - DNA, 38 bp, Artificial Sequence
  Description of Artificial Sequence: Synthetic oligonucleotide
aaaggcgattaatgagaaattgggtcagtatgcttccc

SEQ ID NO: 176844 - DNA, 37 bp, Artificial Sequence
  Description of Artificial Sequence: Synthetic oligonucleotide
aaggcgattaatgagaaattgggtcagtatgcttccc

SEQ ID NO: 176845 - DNA, 36 bp, Artificial Sequence
  Description of Artificial Sequence: Synthetic oligonucleotide
aggcgattaatgagaaattgggtcagtatgcttccc

SEQ ID NO: 176846 - DNA, 35 bp, Artificial Sequence
  Description of Artificial Sequence: Synthetic oligonucleotide
ggcgattaatgagaaattgggtcagtatgcttccc

SEQ ID NO: 176847 - DNA, 35 bp, Artificial Sequence
  Description of Artificial Sequence: Synthetic oligonucleotide
gcgattaatgagaaattgggtcagtatgcttcccc

SEQ ID NO: 176848 - DNA, 35 bp, Artificial Sequence
  Description of Artificial Sequence: Synthetic oligonucleotide
cgattaatgagaaattgggtcagtatgcttccccg

SEQ ID NO: 176849 - DNA, 36 bp, Artificial Sequence
  Description of Artificial Sequence: Synthetic oligonucleotide
gattaatgagaaattgggtcagtatgcttccccgac

SEQ ID NO: 176850 - DNA, 37 bp, Artificial Sequence
  Description of Artificial Sequence: Synthetic oligonucleotide
attaatgagaaattgggtcagtatgcttccccgacag

SEQ ID NO: 176851 - DNA, 36 bp, Artificial Sequence
  Description of Artificial Sequence: Synthetic oligonucleotide
ttaatgagaaattgggtcagtatgcttccccgacag

SEQ ID NO: 176852 - DNA, 35 bp, Artificial Sequence
  Description of Artificial Sequence: Synthetic oligonucleotide
taatgagaaattgggtcagtatgcttccccgacag

SEQ ID NO: 176853 - DNA, 34 bp, Artificial Sequence
  Description of Artificial Sequence: Synthetic oligonucleotide
aatgagaaattgggtcagtatgcttccccgacag

SEQ ID NO: 176854 - DNA, 33 bp, Artificial Sequence
  Description of Artificial Sequence: Synthetic oligonucleotide
atgagaaattgggtcagtatgcttccccgacag

SEQ ID NO: 176855 - DNA, 32 bp, Artificial Sequence
  Description of Artificial Sequence: Synthetic oligonucleotide
tgagaaattgggtcagtatgcttccccgacag

SEQ ID NO: 176856 - DNA, 31 bp, Artificial Sequence
  Description of Artificial Sequence: Synthetic oligonucleotide
gagaaattgggtcagtatgcttccccgacag

SEQ ID NO: 176857 - DNA, 31 bp, Artificial Sequence
  Description of Artificial Sequence: Synthetic oligonucleotide
agaaattgggtcagtatgcttccccgacagc

SEQ ID NO: 176858 - DNA, 30 bp, Artificial Sequence
  Description of Artificial Sequence: Synthetic oligonucleotide
gaaattgggtcagtatgcttccccgacagc

SEQ ID NO: 176859 - DNA, 30 bp, Artificial Sequence
  Description of Artificial Sequence: Synthetic oligonucleotide
aaattgggtcagtatgcttccccgacagcc

SEQ ID NO: 176860 - DNA, 29 bp, Artificial Sequence
  Description of Artificial Sequence: Synthetic oligonucleotide
aattgggtcagtatgcttccccgacagcc

SEQ ID NO: 176861 - DNA, 28 bp, Artificial Sequence
  Description of Artificial Sequence: Synthetic oligonucleotide
attgggtcagtatgcttccccgacagcc

SEQ ID NO: 176862 - DNA, 27 bp, Artificial Sequence
  Description of Artificial Sequence: Synthetic oligonucleotide
ttgggtcagtatgcttccccgacagcc

SEQ ID NO: 176863 - DNA, 25 bp, Artificial Sequence
  Description of Artificial Sequence: Synthetic oligonucleotide
aggctgacggctcgttccaggacct

SEQ ID NO: 176864 - DNA, 24 bp, Artificial Sequence
  Description of Artificial Sequence: Synthetic oligonucleotide
ggctgacggctcgttccaggacct

SEQ ID NO: 176865 - DNA, 25 bp, Artificial Sequence
  Description of Artificial Sequence: Synthetic oligonucleotide
gctgacggctcgttccaggacctct

SEQ ID NO: 176866 - DNA, 26 bp, Artificial Sequence
  Description of Artificial Sequence: Synthetic oligonucleotide
ctgacggctcgttccaggacctctct

SEQ ID NO: 176867 - DNA, 26 bp, Artificial Sequence
  Description of Artificial Sequence: Synthetic oligonucleotide
tgacggctcgttccaggacctctctc

SEQ ID NO: 176868 - DNA, 25 bp, Artificial Sequence
  Description of Artificial Sequence: Synthetic oligonucleotide
gacggctcgttccaggacctctctc

SEQ ID NO: 176869 - DNA, 26 bp, Artificial Sequence
  Description of Artificial Sequence: Synthetic oligonucleotide
acggctcgttccaggacctctctcca

SEQ ID NO: 176870 - DNA, 25 bp, Artificial Sequence
  Description of Artificial Sequence: Synthetic oligonucleotide
cggctcgttccaggacctctctcca

SEQ ID NO: 176871 - DNA, 26 bp, Artificial Sequence
  Description of Artificial Sequence: Synthetic oligonucleotide
ggctcgttccaggacctctctccagt

SEQ ID NO: 176872 - DNA, 27 bp, Artificial Sequence
  Description of Artificial Sequence: Synthetic oligonucleotide
gctcgttccaggacctctctccagtga

SEQ ID NO: 176873 - DNA, 29 bp, Artificial Sequence
  Description of Artificial Sequence: Synthetic oligonucleotide
ctcgttccaggacctctctccagtgatac

SEQ ID NO: 176874 - DNA, 32 bp, Artificial Sequence
  Description of Artificial Sequence: Synthetic oligonucleotide
tcgttccaggacctctctccagtgatacatag

SEQ ID NO: 176875 - DNA, 31 bp, Artificial Sequence
  Description of Artificial Sequence: Synthetic oligonucleotide
cgttccaggacctctctccagtgatacatag

SEQ ID NO: 176876 - DNA, 31 bp, Artificial Sequence
  Description of Artificial Sequence: Synthetic oligonucleotide
gttccaggacctctctccagtgatacatagg

SEQ ID NO: 176877 - DNA, 32 bp, Artificial Sequence
  Description of Artificial Sequence: Synthetic oligonucleotide
ttccaggacctctctccagtgatacataggag

SEQ ID NO: 176878 - DNA, 31 bp, Artificial Sequence
  Description of Artificial Sequence: Synthetic oligonucleotide
tccaggacctctctccagtgatacataggag

SEQ ID NO: 176879 - DNA, 30 bp, Artificial Sequence
  Description of Artificial Sequence: Synthetic oligonucleotide
ccaggacctctctccagtgatacataggag

SEQ ID NO: 176880 - DNA, 30 bp, Artificial Sequence
  Description of Artificial Sequence: Synthetic oligonucleotide
caggacctctctccagtgatacataggagc

SEQ ID NO: 176881 - DNA, 32 bp, Artificial Sequence
  Description of Artificial Sequence: Synthetic oligonucleotide
aggacctctctccagtgatacataggagcatg

SEQ ID NO: 176882 - DNA, 31 bp, Artificial Sequence
  Description of Artificial Sequence: Synthetic oligonucleotide
ggacctctctccagtgatacataggagcatg

SEQ ID NO: 176883 - DNA, 31 bp, Artificial Sequence
  Description of Artificial Sequence: Synthetic oligonucleotide
gacctctctccagtgatacataggagcatgc

SEQ ID NO: 176884 - DNA, 32 bp, Artificial Sequence
  Description of Artificial Sequence: Synthetic oligonucleotide
acctctctccagtgatacataggagcatgcag

SEQ ID NO: 176885 - DNA, 31 bp, Artificial Sequence
  Description of Artificial Sequence: Synthetic oligonucleotide
cctctctccagtgatacataggagcatgcag

SEQ ID NO: 176886 - DNA, 31 bp, Artificial Sequence
  Description of Artificial Sequence: Synthetic oligonucleotide
ctctctccagtgatacataggagcatgcagg

SEQ ID NO: 176887 - DNA, 31 bp, Artificial Sequence
  Description of Artificial Sequence: Synthetic oligonucleotide
tctctccagtgatacataggagcatgcaggg

SEQ ID NO: 176888 - DNA, 30 bp, Artificial Sequence
  Description of Artificial Sequence: Synthetic oligonucleotide
ctctccagtgatacataggagcatgcaggg

SEQ ID NO: 176889 - DNA, 30 bp, Artificial Sequence
  Description of Artificial Sequence: Synthetic oligonucleotide
tctccagtgatacataggagcatgcagggg

SEQ ID NO: 176890 - DNA, 29 bp, Artificial Sequence
  Description of Artificial Sequence: Synthetic oligonucleotide
ctccagtgatacataggagcatgcagggg

SEQ ID NO: 176891 - DNA, 29 bp, Artificial Sequence
  Description of Artificial Sequence: Synthetic oligonucleotide
tccagtgatacataggagcatgcaggggg

SEQ ID NO: 176892 - DNA, 28 bp, Artificial Sequence
  Description of Artificial Sequence: Synthetic oligonucleotide
ccagtgatacataggagcatgcaggggg

SEQ ID NO: 176893 - DNA, 28 bp, Artificial Sequence
  Description of Artificial Sequence: Synthetic oligonucleotide
cagtgatacataggagcatgcagggggg

SEQ ID NO: 176894 - DNA, 31 bp, Artificial Sequence
  Description of Artificial Sequence: Synthetic oligonucleotide
agtgatacataggagcatgcaggggggtttg

SEQ ID NO: 176895 - DNA, 30 bp, Artificial Sequence
  Description of Artificial Sequence: Synthetic oligonucleotide
gtgatacataggagcatgcaggggggtttg

SEQ ID NO: 176896 - DNA, 30 bp, Artificial Sequence
  Description of Artificial Sequence: Synthetic oligonucleotide
tgatacataggagcatgcaggggggtttgg

SEQ ID NO: 176897 - DNA, 29 bp, Artificial Sequence
  Description of Artificial Sequence: Synthetic oligonucleotide
gatacataggagcatgcaggggggtttgg

SEQ ID NO: 176898 - DNA, 30 bp, Artificial Sequence
  Description of Artificial Sequence: Synthetic oligonucleotide
atacataggagcatgcaggggggtttggtg

SEQ ID NO: 176899 - DNA, 29 bp, Artificial Sequence
  Description of Artificial Sequence: Synthetic oligonucleotide
tacataggagcatgcaggggggtttggtg

SEQ ID NO: 176900 - DNA, 28 bp, Artificial Sequence
  Description of Artificial Sequence: Synthetic oligonucleotide
acataggagcatgcaggggggtttggtg

SEQ ID NO: 176901 - DNA, 27 bp, Artificial Sequence
  Description of Artificial Sequence: Synthetic oligonucleotide
cataggagcatgcaggggggtttggtg

SEQ ID NO: 176902 - DNA, 27 bp, Artificial Sequence
  Description of Artificial Sequence: Synthetic oligonucleotide
ataggagcatgcaggggggtttggtgg

SEQ ID NO: 176903 - DNA, 26 bp, Artificial Sequence
  Description of Artificial Sequence: Synthetic oligonucleotide
taggagcatgcaggggggtttggtgg

SEQ ID NO: 176904 - DNA, 27 bp, Artificial Sequence
  Description of Artificial Sequence: Synthetic oligonucleotide
catggcaatggcccaggagactggaga

SEQ ID NO: 176905 - DNA, 30 bp, Artificial Sequence
  Description of Artificial Sequence: Synthetic oligonucleotide
atggcaatggcccaggagactggagataac

SEQ ID NO: 176906 - DNA, 29 bp, Artificial Sequence
  Description of Artificial Sequence: Synthetic oligonucleotide
tggcaatggcccaggagactggagataac

SEQ ID NO: 176907 - DNA, 28 bp, Artificial Sequence
  Description of Artificial Sequence: Synthetic oligonucleotide
ggcaatggcccaggagactggagataac

SEQ ID NO: 176908 - DNA, 28 bp, Artificial Sequence
  Description of Artificial Sequence: Synthetic oligonucleotide
gcaatggcccaggagactggagataacc

SEQ ID NO: 176909 - DNA, 29 bp, Artificial Sequence
  Description of Artificial Sequence: Synthetic oligonucleotide
caatggcccaggagactggagataacctg

SEQ ID NO: 176910 - DNA, 31 bp, Artificial Sequence
  Description of Artificial Sequence: Synthetic oligonucleotide
aatggcccaggagactggagataacctgtac

SEQ ID NO: 176911 - DNA, 30 bp, Artificial Sequence
  Description of Artificial Sequence: Synthetic oligonucleotide
atggcccaggagactggagataacctgtac

SEQ ID NO: 176912 - DNA, 29 bp, Artificial Sequence
  Description of Artificial Sequence: Synthetic oligonucleotide
tggcccaggagactggagataacctgtac

SEQ ID NO: 176913 - DNA, 28 bp, Artificial Sequence
  Description of Artificial Sequence: Synthetic oligonucleotide
ggcccaggagactggagataacctgtac

SEQ ID NO: 176914 - DNA, 29 bp, Artificial Sequence
  Description of Artificial Sequence: Synthetic oligonucleotide
gcccaggagactggagataacctgtactg

SEQ ID NO: 176915 - DNA, 29 bp, Artificial Sequence
  Description of Artificial Sequence: Synthetic oligonucleotide
cccaggagactggagataacctgtactgg

SEQ ID NO: 176916 - DNA, 29 bp, Artificial Sequence
  Description of Artificial Sequence: Synthetic oligonucleotide
ccaggagactggagataacctgtactggg

SEQ ID NO: 176917 - DNA, 29 bp, Artificial Sequence
  Description of Artificial Sequence: Synthetic oligonucleotide
caggagactggagataacctgtactgggg

SEQ ID NO: 176918 - DNA, 29 bp, Artificial Sequence
  Description of Artificial Sequence: Synthetic oligonucleotide
aggagactggagataacctgtactggggc

SEQ ID NO: 176919 - DNA, 28 bp, Artificial Sequence
  Description of Artificial Sequence: Synthetic oligonucleotide
ggagactggagataacctgtactggggc

SEQ ID NO: 176920 - DNA, 29 bp, Artificial Sequence
  Description of Artificial Sequence: Synthetic oligonucleotide
gagactggagataacctgtactggggctc

SEQ ID NO: 176921 - DNA, 30 bp, Artificial Sequence
  Description of Artificial Sequence: Synthetic oligonucleotide
agactggagataacctgtactggggctcag

SEQ ID NO: 176922 - DNA, 29 bp, Artificial Sequence
  Description of Artificial Sequence: Synthetic oligonucleotide
gactggagataacctgtactggggctcag

SEQ ID NO: 176923 - DNA, 30 bp, Artificial Sequence
  Description of Artificial Sequence: Synthetic oligonucleotide
actggagataacctgtactggggctcagtc

SEQ ID NO: 176924 - DNA, 29 bp, Artificial Sequence
  Description of Artificial Sequence: Synthetic oligonucleotide
ctggagataacctgtactggggctcagtc

SEQ ID NO: 176925 - DNA, 30 bp, Artificial Sequence
  Description of Artificial Sequence: Synthetic oligonucleotide
tggagataacctgtactggggctcagtcac

SEQ ID NO: 176926 - DNA, 29 bp, Artificial Sequence
  Description of Artificial Sequence: Synthetic oligonucleotide
ggagataacctgtactggggctcagtcac

SEQ ID NO: 176927 - DNA, 30 bp, Artificial Sequence
  Description of Artificial Sequence: Synthetic oligonucleotide
gagataacctgtactggggctcagtcactg

SEQ ID NO: 176928 - DNA, 30 bp, Artificial Sequence
  Description of Artificial Sequence: Synthetic oligonucleotide
agataacctgtactggggctcagtcactgg

SEQ ID NO: 176929 - DNA, 29 bp, Artificial Sequence
  Description of Artificial Sequence: Synthetic oligonucleotide
gataacctgtactggggctcagtcactgg

SEQ ID NO: 176930 - DNA, 31 bp, Artificial Sequence
  Description of Artificial Sequence: Synthetic oligonucleotide
ataacctgtactggggctcagtcactggttc

SEQ ID NO: 176931 - DNA, 30 bp, Artificial Sequence
  Description of Artificial Sequence: Synthetic oligonucleotide
taacctgtactggggctcagtcactggttc

SEQ ID NO: 176932 - DNA, 29 bp, Artificial Sequence
  Description of Artificial Sequence: Synthetic oligonucleotide
aacctgtactggggctcagtcactggttc

SEQ ID NO: 176933 - DNA, 28 bp, Artificial Sequence
  Description of Artificial Sequence: Synthetic oligonucleotide
acctgtactggggctcagtcactggttc

SEQ ID NO: 176934 - DNA, 27 bp, Artificial Sequence
  Description of Artificial Sequence: Synthetic oligonucleotide
cctgtactggggctcagtcactggttc

SEQ ID NO: 176935 - DNA, 28 bp, Artificial Sequence
  Description of Artificial Sequence: Synthetic oligonucleotide
ctgtactggggctcagtcactggttctc

SEQ ID NO: 176936 - DNA, 29 bp, Artificial Sequence
  Description of Artificial Sequence: Synthetic oligonucleotide
tgtactggggctcagtcactggttctcag

SEQ ID NO: 176937 - DNA, 28 bp, Artificial Sequence
  Description of Artificial Sequence: Synthetic oligonucleotide
gtactggggctcagtcactggttctcag

SEQ ID NO: 176938 - DNA, 29 bp, Artificial Sequence
  Description of Artificial Sequence: Synthetic oligonucleotide
tactggggctcagtcactggttctcagag

SEQ ID NO: 176939 - DNA, 28 bp, Artificial Sequence
  Description of Artificial Sequence: Synthetic oligonucleotide
actggggctcagtcactggttctcagag

SEQ ID NO: 176940 - DNA, 27 bp, Artificial Sequence
  Description of Artificial Sequence: Synthetic oligonucleotide
ctggggctcagtcactggttctcagag

SEQ ID NO: 176941 - DNA, 27 bp, Artificial Sequence
  Description of Artificial Sequence: Synthetic oligonucleotide
tggggctcagtcactggttctcagagc

SEQ ID NO: 176942 - DNA, 27 bp, Artificial Sequence
  Description of Artificial Sequence: Synthetic oligonucleotide
ggggctcagtcactggttctcagagca

SEQ ID NO: 176943 - DNA, 29 bp, Artificial Sequence
  Description of Artificial Sequence: Synthetic oligonucleotide
gggctcagtcactggttctcagagcaatg

SEQ ID NO: 176944 - DNA, 29 bp, Artificial Sequence
  Description of Artificial Sequence: Synthetic oligonucleotide
ggctcagtcactggttctcagagcaatgc

SEQ ID NO: 176945 - DNA, 29 bp, Artificial Sequence
  Description of Artificial Sequence: Synthetic oligonucleotide
gctcagtcactggttctcagagcaatgcc

SEQ ID NO: 176946 - DNA, 29 bp, Artificial Sequence
  Description of Artificial Sequence: Synthetic oligonucleotide
ctcagtcactggttctcagagcaatgccg

SEQ ID NO: 176947 - DNA, 30 bp, Artificial Sequence
  Description of Artificial Sequence: Synthetic oligonucleotide
tcagtcactggttctcagagcaatgccgtg

SEQ ID NO: 176948 - DNA, 29 bp, Artificial Sequence
  Description of Artificial Sequence: Synthetic oligonucleotide
cagtcactggttctcagagcaatgccgtg

SEQ ID NO: 176949 - DNA, 30 bp, Artificial Sequence
  Description of Artificial Sequence: Synthetic oligonucleotide
agtcactggttctcagagcaatgccgtgtc

SEQ ID NO: 176950 - DNA, 29 bp, Artificial Sequence
  Description of Artificial Sequence: Synthetic oligonucleotide
gtcactggttctcagagcaatgccgtgtc

SEQ ID NO: 176951 - DNA, 29 bp, Artificial Sequence
  Description of Artificial Sequence: Synthetic oligonucleotide
tcactggttctcagagcaatgccgtgtcg

SEQ ID NO: 176952 - DNA, 28 bp, Artificial Sequence
  Description of Artificial Sequence: Synthetic oligonucleotide
cactggttctcagagcaatgccgtgtcg

SEQ ID NO: 176953 - DNA, 28 bp, Artificial Sequence
  Description of Artificial Sequence: Synthetic oligonucleotide
actggttctcagagcaatgccgtgtcgc

SEQ ID NO: 176954 - DNA, 27 bp, Artificial Sequence
  Description of Artificial Sequence: Synthetic oligonucleotide
ctggttctcagagcaatgccgtgtcgc

SEQ ID NO: 176955 - DNA, 27 bp, Artificial Sequence
  Description of Artificial Sequence: Synthetic oligonucleotide
tggttctcagagcaatgccgtgtcgcc

SEQ ID NO: 176956 - DNA, 26 bp, Artificial Sequence
  Description of Artificial Sequence: Synthetic oligonucleotide
ggttctcagagcaatgccgtgtcgcc

SEQ ID NO: 176957 - DNA, 27 bp, Artificial Sequence
  Description of Artificial Sequence: Synthetic oligonucleotide
gttctcagagcaatgccgtgtcgccca

SEQ ID NO: 176958 - DNA, 27 bp, Artificial Sequence
  Description of Artificial Sequence: Synthetic oligonucleotide
ttctcagagcaatgccgtgtcgcccac

SEQ ID NO: 176959 - DNA, 26 bp, Artificial Sequence
  Description of Artificial Sequence: Synthetic oligonucleotide
tctcagagcaatgccgtgtcgcccac

SEQ ID NO: 176960 - DNA, 25 bp, Artificial Sequence
  Description of Artificial Sequence: Synthetic oligonucleotide
ctcagagcaatgccgtgtcgcccac

SEQ ID NO: 176961 - DNA, 25 bp, Artificial Sequence
  Description of Artificial Sequence: Synthetic oligonucleotide
tcagagcaatgccgtgtcgcccacc

SEQ ID NO: 176962 - DNA, 24 bp, Artificial Sequence
  Description of Artificial Sequence: Synthetic oligonucleotide
cagagcaatgccgtgtcgcccacc

SEQ ID NO: 176963 - DNA, 24 bp, Artificial Sequence
  Description of Artificial Sequence: Synthetic oligonucleotide
agagcaatgccgtgtcgcccaccc

SEQ ID NO: 176964 - DNA, 23 bp, Artificial Sequence
  Description of Artificial Sequence: Synthetic oligonucleotide
gagcaatgccgtgtcgcccaccc

SEQ ID NO: 176965 - DNA, 23 bp, Artificial Sequence
  Description of Artificial Sequence: Synthetic oligonucleotide
agcaatgccgtgtcgcccacccc

SEQ ID NO: 176966 - DNA, 22 bp, Artificial Sequence
  Description of Artificial Sequence: Synthetic oligonucleotide
gcaatgccgtgtcgcccacccc

SEQ ID NO: 176967 - DNA, 22 bp, Artificial Sequence
  Description of Artificial Sequence: Synthetic oligonucleotide
caatgccgtgtcgcccaccccg

SEQ ID NO: 176968 - DNA, 22 bp, Artificial Sequence
  Description of Artificial Sequence: Synthetic oligonucleotide
aatgccgtgtcgcccaccccgg

SEQ ID NO: 176969 - DNA, 21 bp, Artificial Sequence
  Description of Artificial Sequence: Synthetic oligonucleotide
atgccgtgtcgcccaccccgg

SEQ ID NO: 176970 - DNA, 20 bp, Artificial Sequence
  Description of Artificial Sequence: Synthetic oligonucleotide
tgccgtgtcgcccaccccgg

SEQ ID NO: 176971 - DNA, 20 bp, Artificial Sequence
  Description of Artificial Sequence: Synthetic oligonucleotide
gccgtgtcgcccaccccggt

SEQ ID NO: 176972 - DNA, 20 bp, Artificial Sequence
  Description of Artificial Sequence: Synthetic oligonucleotide
ccgtgtcgcccaccccggct

SEQ ID NO: 176973 - DNA, 20 bp, Artificial Sequence
  Description of Artificial Sequence: Synthetic oligonucleotide
cgtgtcgcccaccccggctc

SEQ ID NO: 176974 - DNA, 21 bp, Artificial Sequence
  Description of Artificial Sequence: Synthetic oligonucleotide
gtgtcgcccaccccggctcct

SEQ ID NO: 176975 - DNA, 21 bp, Artificial Sequence
  Description of Artificial Sequence: Synthetic oligonucleotide
tgtcgcccaccccggctcctc

SEQ ID NO: 176976 - DNA, 20 bp, Artificial Sequence
  Description of Artificial Sequence: Synthetic oligonucleotide
gtcgcccaccccggctcctc

SEQ ID NO: 176977 - DNA, 20 bp, Artificial Sequence
  Description of Artificial Sequence: Synthetic oligonucleotide
tcgcccaccccggctcctcg

SEQ ID NO: 176978 - DNA, 20 bp, Artificial Sequence
  Description of Artificial Sequence: Synthetic oligonucleotide
cgcccaccccggctcctcgt

SEQ ID NO: 176979 - DNA, 21 bp, Artificial Sequence
  Description of Artificial Sequence: Synthetic oligonucleotide
gcccaccccggctcctcgcaa

SEQ ID NO: 176980 - DNA, 21 bp, Artificial Sequence
  Description of Artificial Sequence: Synthetic oligonucleotide
cccaccccggctcctcgcaac

SEQ ID NO: 176981 - DNA, 21 bp, Artificial Sequence
  Description of Artificial Sequence: Synthetic oligonucleotide
ccaccccggctcctcgcaacc

SEQ ID NO: 176982 - DNA, 23 bp, Artificial Sequence
  Description of Artificial Sequence: Synthetic oligonucleotide
caccccggctcctcgcaacccat

SEQ ID NO: 176983 - DNA, 23 bp, Artificial Sequence
  Description of Artificial Sequence: Synthetic oligonucleotide
accccggctcctcgcaacccatc

SEQ ID NO: 176984 - DNA, 22 bp, Artificial Sequence
  Description of Artificial Sequence: Synthetic oligonucleotide
ccccggctcctcgcaacccatc

SEQ ID NO: 176985 - DNA, 22 bp, Artificial Sequence
  Description of Artificial Sequence: Synthetic oligonucleotide
cccggctcctcgcaacccatcc

SEQ ID NO: 176986 - DNA, 23 bp, Artificial Sequence
  Description of Artificial Sequence: Synthetic oligonucleotide
ccggctcctcgcaacccatccga

SEQ ID NO: 176987 - DNA, 23 bp, Artificial Sequence
  Description of Artificial Sequence: Synthetic oligonucleotide
cggctcctcgcaacccatccgac

SEQ ID NO: 176988 - DNA, 23 bp, Artificial Sequence
  Description of Artificial Sequence: Synthetic oligonucleotide
ggctcctcgcaacccatccgacc

SEQ ID NO: 176989 - DNA, 23 bp, Artificial Sequence
  Description of Artificial Sequence: Synthetic oligonucleotide
gctcctcgcaacccatccgaccc

SEQ ID NO: 176990 - DNA, 25 bp, Artificial Sequence
  Description of Artificial Sequence: Synthetic oligonucleotide
ctcctcgcaacccatccgaccccat

SEQ ID NO: 176991 - DNA, 25 bp, Artificial Sequence
  Description of Artificial Sequence: Synthetic oligonucleotide
tcctcgcaacccatccgaccccatg

SEQ ID NO: 176992 - DNA, 24 bp, Artificial Sequence
  Description of Artificial Sequence: Synthetic oligonucleotide
cctcgcaacccatccgaccccatg

SEQ ID NO: 176993 - DNA, 24 bp, Artificial Sequence
  Description of Artificial Sequence: Synthetic oligonucleotide
ctcgcaacccatccgaccccatgc

SEQ ID NO: 176994 - DNA, 24 bp, Artificial Sequence
  Description of Artificial Sequence: Synthetic oligonucleotide
tcgcaacccatccgaccccatgcc

SEQ ID NO: 176995 - DNA, 23 bp, Artificial Sequence
  Description of Artificial Sequence: Synthetic oligonucleotide
cgcaacccatccgaccccatgcc

SEQ ID NO: 176996 - DNA, 23 bp, Artificial Sequence
  Description of Artificial Sequence: Synthetic oligonucleotide
gcaacccatccgaccccatgccc

SEQ ID NO: 176997 - DNA, 24 bp, Artificial Sequence
  Description of Artificial Sequence: Synthetic oligonucleotide
caacccatccgaccccatgcccca

SEQ ID NO: 176998 - DNA, 24 bp, Artificial Sequence
  Description of Artificial Sequence: Synthetic oligonucleotide
aacccatccgaccccatgccccag

SEQ ID NO: 176999 - DNA, 23 bp, Artificial Sequence
  Description of Artificial Sequence: Synthetic oligonucleotide
acccatccgaccccatgccccag

SEQ ID NO: 177000 - DNA, 22 bp, Artificial Sequence
  Description of Artificial Sequence: Synthetic oligonucleotide
cccatccgaccccatgccccag

SEQ ID NO: 177001 - DNA, 22 bp, Artificial Sequence
  Description of Artificial Sequence: Synthetic oligonucleotide
ccatccgaccccatgccccagg

SEQ ID NO: 177002 - DNA, 22 bp, Artificial Sequence
  Description of Artificial Sequence: Synthetic oligonucleotide
catccgaccccatgccccaggc

SEQ ID NO: 177003 - DNA, 22 bp, Artificial Sequence
  Description of Artificial Sequence: Synthetic oligonucleotide
atccgaccccatgccccaggcc

SEQ ID NO: 177004 - DNA, 21 bp, Artificial Sequence
  Description of Artificial Sequence: Synthetic oligonucleotide
tccgaccccatgccccaggcc

SEQ ID NO: 177005 - DNA, 20 bp, Artificial Sequence
  Description of Artificial Sequence: Synthetic oligonucleotide
ccgaccccatgccccaggcc

SEQ ID NO: 177006 - DNA, 20 bp, Artificial Sequence
  Description of Artificial Sequence: Synthetic oligonucleotide
cgaccccatgccccaggccc

SEQ ID NO: 177007 - DNA, 21 bp, Artificial Sequence
  Description of Artificial Sequence: Synthetic oligonucleotide
gaccccatgccccaggcccca

SEQ ID NO: 177008 - DNA, 21 bp, Artificial Sequence
  Description of Artificial Sequence: Synthetic oligonucleotide
accccatgccccaggccccag

SEQ ID NO: 177009 - DNA, 20 bp, Artificial Sequence
  Description of Artificial Sequence: Synthetic oligonucleotide
ccccatgccccaggccccag

SEQ ID NO: 177010 - DNA, 20 bp, Artificial Sequence
  Description of Artificial Sequence: Synthetic oligonucleotide
cccatgccccaggccccagc

SEQ ID NO: 177011 - DNA, 20 bp, Artificial Sequence
  Description of Artificial Sequence: Synthetic oligonucleotide
ccatgccccaggccccagcc

SEQ ID NO: 177012 - DNA, 21 bp, Artificial Sequence
  Description of Artificial Sequence: Synthetic oligonucleotide
catgccccaggccccagccct

SEQ ID NO: 177013 - DNA, 22 bp, Artificial Sequence
  Description of Artificial Sequence: Synthetic oligonucleotide
atgccccaggccccagccctgt

SEQ ID NO: 177014 - DNA, 21 bp, Artificial Sequence
  Description of Artificial Sequence: Synthetic oligonucleotide
tgccccaggccccagccctgt

SEQ ID NO: 177015 - DNA, 20 bp, Artificial Sequence
  Description of Artificial Sequence: Synthetic oligonucleotide
gccccaggccccagccctgt

SEQ ID NO: 177016 - DNA, 20 bp, Artificial Sequence
  Description of Artificial Sequence: Synthetic oligonucleotide
ccccaggccccagccctgtg

SEQ ID NO: 177017 - DNA, 23 bp, Artificial Sequence
  Description of Artificial Sequence: Synthetic oligonucleotide
cccaggccccagccctgtggatt

SEQ ID NO: 177018 - DNA, 26 bp, Artificial Sequence
  Description of Artificial Sequence: Synthetic oligonucleotide
ccaggccccagccctgtggattgaaa

SEQ ID NO: 177019 - DNA, 26 bp, Artificial Sequence
  Description of Artificial Sequence: Synthetic oligonucleotide
caggccccagccctgtggattgaaac

SEQ ID NO: 177020 - DNA, 27 bp, Artificial Sequence
  Description of Artificial Sequence: Synthetic oligonucleotide
aggccccagccctgtggattgaaacca

SEQ ID NO: 177021 - DNA, 26 bp, Artificial Sequence
  Description of Artificial Sequence: Synthetic oligonucleotide
ggccccagccctgtggattgaaacca

SEQ ID NO: 177022 - DNA, 27 bp, Artificial Sequence
  Description of Artificial Sequence: Synthetic oligonucleotide
gccccagccctgtggattgaaaccaca

SEQ ID NO: 177023 - DNA, 27 bp, Artificial Sequence
  Description of Artificial Sequence: Synthetic oligonucleotide
ccccagccctgtggattgaaaccacag

SEQ ID NO: 177024 - DNA, 27 bp, Artificial Sequence
  Description of Artificial Sequence: Synthetic oligonucleotide
cccagccctgtggattgaaaccacagc

SEQ ID NO: 177025 - DNA, 27 bp, Artificial Sequence
  Description of Artificial Sequence: Synthetic oligonucleotide
ccagccctgtggattgaaaccacagcc

SEQ ID NO: 177026 - DNA, 29 bp, Artificial Sequence
  Description of Artificial Sequence: Synthetic oligonucleotide
cagccctgtggattgaaaccacagcctac

SEQ ID NO: 177027 - DNA, 29 bp, Artificial Sequence
  Description of Artificial Sequence: Synthetic oligonucleotide
agccctgtggattgaaaccacagcctacg

SEQ ID NO: 177028 - DNA, 28 bp, Artificial Sequence
  Description of Artificial Sequence: Synthetic oligonucleotide
gccctgtggattgaaaccacagcctacg

SEQ ID NO: 177029 - DNA, 28 bp, Artificial Sequence
  Description of Artificial Sequence: Synthetic oligonucleotide
ccctgtggattgaaaccacagcctacgc

SEQ ID NO: 177030 - DNA, 28 bp, Artificial Sequence
  Description of Artificial Sequence: Synthetic oligonucleotide
cctgtggattgaaaccacagcctacgcc

SEQ ID NO: 177031 - DNA, 28 bp, Artificial Sequence
  Description of Artificial Sequence: Synthetic oligonucleotide
ctgtggattgaaaccacagcctacgccc

SEQ ID NO: 177032 - DNA, 29 bp, Artificial Sequence
  Description of Artificial Sequence: Synthetic oligonucleotide
tgtggattgaaaccacagcctacgccctg

SEQ ID NO: 177033 - DNA, 28 bp, Artificial Sequence
  Description of Artificial Sequence: Synthetic oligonucleotide
gtggattgaaaccacagcctacgccctg

SEQ ID NO: 177034 - DNA, 28 bp, Artificial Sequence
  Description of Artificial Sequence: Synthetic oligonucleotide
tggattgaaaccacagcctacgccctgc

SEQ ID NO: 177035 - DNA, 27 bp, Artificial Sequence
  Description of Artificial Sequence: Synthetic oligonucleotide
ggattgaaaccacagcctacgccctgc

SEQ ID NO: 177036 - DNA, 28 bp, Artificial Sequence
  Description of Artificial Sequence: Synthetic oligonucleotide
gattgaaaccacagcctacgccctgctg

SEQ ID NO: 177037 - DNA, 28 bp, Artificial Sequence
  Description of Artificial Sequence: Synthetic oligonucleotide
attgaaaccacagcctacgccctgctgc

SEQ ID NO: 177038 - DNA, 27 bp, Artificial Sequence
  Description of Artificial Sequence: Synthetic oligonucleotide
ttgaaaccacagcctacgccctgctgc

SEQ ID NO: 177039 - DNA, 27 bp, Artificial Sequence
  Description of Artificial Sequence: Synthetic oligonucleotide
tgaaaccacagcctacgccctgctgca

SEQ ID NO: 177040 - DNA, 26 bp, Artificial Sequence
  Description of Artificial Sequence: Synthetic oligonucleotide
gaaaccacagcctacgccctgctgca

SEQ ID NO: 177041 - DNA, 26 bp, Artificial Sequence
  Description of Artificial Sequence: Synthetic oligonucleotide
aaaccacagcctacgccctgctgcac

SEQ ID NO: 177042 - DNA, 25 bp, Artificial Sequence
  Description of Artificial Sequence: Synthetic oligonucleotide
aaccacagcctacgccctgctgcac

SEQ ID NO: 177043 - DNA, 24 bp, Artificial Sequence
  Description of Artificial Sequence: Synthetic oligonucleotide
accacagcctacgccctgctgcac

SEQ ID NO: 177044 - DNA, 23 bp, Artificial Sequence
  Description of Artificial Sequence: Synthetic oligonucleotide
ccacagcctacgccctgctgcac

SEQ ID NO: 177045 - DNA, 24 bp, Artificial Sequence
  Description of Artificial Sequence: Synthetic oligonucleotide
cacagcctacgccctgctgcacct

SEQ ID NO: 177046 - DNA, 24 bp, Artificial Sequence
  Description of Artificial Sequence: Synthetic oligonucleotide
acagcctacgccctgctgcacctc

SEQ ID NO: 177047 - DNA, 23 bp, Artificial Sequence
  Description of Artificial Sequence: Synthetic oligonucleotide
cagcctacgccctgctgcacctc

SEQ ID NO: 177048 - DNA, 24 bp, Artificial Sequence
  Description of Artificial Sequence: Synthetic oligonucleotide
agcctacgccctgctgcacctcct

SEQ ID NO: 177049 - DNA, 23 bp, Artificial Sequence
  Description of Artificial Sequence: Synthetic oligonucleotide
gcctacgccctgctgcacctcct

SEQ ID NO: 177050 - DNA, 23 bp, Artificial Sequence
  Description of Artificial Sequence: Synthetic oligonucleotide
cctacgccctgctgcacctcctg

SEQ ID NO: 177051 - DNA, 25 bp, Artificial Sequence
  Description of Artificial Sequence: Synthetic oligonucleotide
ctacgccctgctgcacctcctgctt

SEQ ID NO: 177052 - DNA, 26 bp, Artificial Sequence
  Description of Artificial Sequence: Synthetic oligonucleotide
tacgccctgctgcacctcctgcttca

SEQ ID NO: 177053 - DNA, 25 bp, Artificial Sequence
  Description of Artificial Sequence: Synthetic oligonucleotide
acgccctgctgcacctcctgcttca

SEQ ID NO: 177054 - DNA, 24 bp, Artificial Sequence
  Description of Artificial Sequence: Synthetic oligonucleotide
cgccctgctgcacctcctgcttca

SEQ ID NO: 177055 - DNA, 24 bp, Artificial Sequence
  Description of Artificial Sequence: Synthetic oligonucleotide
gccctgctgcacctcctgcttcac

SEQ ID NO: 177056 - DNA, 25 bp, Artificial Sequence
  Description of Artificial Sequence: Synthetic oligonucleotide
ccctgctgcacctcctgcttcacga

SEQ ID NO: 177057 - DNA, 25 bp, Artificial Sequence
  Description of Artificial Sequence: Synthetic oligonucleotide
cctgctgcacctcctgcttcacgag

SEQ ID NO: 177058 - DNA, 25 bp, Artificial Sequence
  Description of Artificial Sequence: Synthetic oligonucleotide
ctgctgcacctcctgcttcacgagg

SEQ ID NO: 177059 - DNA, 25 bp, Artificial Sequence
  Description of Artificial Sequence: Synthetic oligonucleotide
tgctgcacctcctgcttcacgaggg

SEQ ID NO: 177060 - DNA, 24 bp, Artificial Sequence
  Description of Artificial Sequence: Synthetic oligonucleotide
gctgcacctcctgcttcacgaggg

SEQ ID NO: 177061 - DNA, 27 bp, Artificial Sequence
  Description of Artificial Sequence: Synthetic oligonucleotide
ctgcacctcctgcttcacgagggcaaa

SEQ ID NO: 177062 - DNA, 27 bp, Artificial Sequence
  Description of Artificial Sequence: Synthetic oligonucleotide
tgcacctcctgcttcacgagggcaaag

SEQ ID NO: 177063 - DNA, 26 bp, Artificial Sequence
  Description of Artificial Sequence: Synthetic oligonucleotide
gcacctcctgcttcacgagggcaaag

SEQ ID NO: 177064 - DNA, 27 bp, Artificial Sequence
  Description of Artificial Sequence: Synthetic oligonucleotide
cacctcctgcttcacgagggcaaagca

SEQ ID NO: 177065 - DNA, 27 bp, Artificial Sequence
  Description of Artificial Sequence: Synthetic oligonucleotide
acctcctgcttcacgagggcaaagcag

SEQ ID NO: 177066 - DNA, 27 bp, Artificial Sequence
  Description of Artificial Sequence: Synthetic oligonucleotide
cctcctgcttcacgagggcaaagcaga

SEQ ID NO: 177067 - DNA, 27 bp, Artificial Sequence
  Description of Artificial Sequence: Synthetic oligonucleotide
ctcctgcttcacgagggcaaagcagag

SEQ ID NO: 177068 - DNA, 29 bp, Artificial Sequence
  Description of Artificial Sequence: Synthetic oligonucleotide
tcctgcttcacgagggcaaagcagagatg

SEQ ID NO: 177069 - DNA, 28 bp, Artificial Sequence
  Description of Artificial Sequence: Synthetic oligonucleotide
cctgcttcacgagggcaaagcagagatg

SEQ ID NO: 177070 - DNA, 28 bp, Artificial Sequence
  Description of Artificial Sequence: Synthetic oligonucleotide
ctgcttcacgagggcaaagcagagatgg

SEQ ID NO: 177071 - DNA, 28 bp, Artificial Sequence
  Description of Artificial Sequence: Synthetic oligonucleotide
tgcttcacgagggcaaagcagagatggc

SEQ ID NO: 177072 - DNA, 27 bp, Artificial Sequence
  Description of Artificial Sequence: Synthetic oligonucleotide
gcttcacgagggcaaagcagagatggc

SEQ ID NO: 177073 - DNA, 28 bp, Artificial Sequence
  Description of Artificial Sequence: Synthetic oligonucleotide
cttcacgagggcaaagcagagatggcag

SEQ ID NO: 177074 - DNA, 29 bp, Artificial Sequence
  Description of Artificial Sequence: Synthetic oligonucleotide
ttcacgagggcaaagcagagatggcagac

SEQ ID NO: 177075 - DNA, 28 bp, Artificial Sequence
  Description of Artificial Sequence: Synthetic oligonucleotide
tcacgagggcaaagcagagatggcagac

SEQ ID NO: 177076 - DNA, 27 bp, Artificial Sequence
  Description of Artificial Sequence: Synthetic oligonucleotide
cacgagggcaaagcagagatggcagac

SEQ ID NO: 177077 - DNA, 27 bp, Artificial Sequence
  Description of Artificial Sequence: Synthetic oligonucleotide
acgagggcaaagcagagatggcagacc

SEQ ID NO: 177078 - DNA, 27 bp, Artificial Sequence
  Description of Artificial Sequence: Synthetic oligonucleotide
cgagggcaaagcagagatggcagacca

SEQ ID NO: 177079 - DNA, 27 bp, Artificial Sequence
  Description of Artificial Sequence: Synthetic oligonucleotide
gagggcaaagcagagatggcagaccag

SEQ ID NO: 177080 - DNA, 27 bp, Artificial Sequence
  Description of Artificial Sequence: Synthetic oligonucleotide
agggcaaagcagagatggcagaccagg

SEQ ID NO: 177081 - DNA, 26 bp, Artificial Sequence
  Description of Artificial Sequence: Synthetic oligonucleotide
gggcaaagcagagatggcagaccagg

SEQ ID NO: 177082 - DNA, 27 bp, Artificial Sequence
  Description of Artificial Sequence: Synthetic oligonucleotide
ggcaaagcagagatggcagaccaggct

SEQ ID NO: 177083 - DNA, 27 bp, Artificial Sequence
  Description of Artificial Sequence: Synthetic oligonucleotide
gcaaagcagagatggcagaccaggctg

SEQ ID NO: 177084 - DNA, 27 bp, Artificial Sequence
  Description of Artificial Sequence: Synthetic oligonucleotide
caaagcagagatggcagaccaggctgc

SEQ ID NO: 177085 - DNA, 27 bp, Artificial Sequence
  Description of Artificial Sequence: Synthetic oligonucleotide
aaagcagagatggcagaccaggctgcg

SEQ ID NO: 177086 - DNA, 26 bp, Artificial Sequence
  Description of Artificial Sequence: Synthetic oligonucleotide
aagcagagatggcagaccaggctgcg

SEQ ID NO: 177087 - DNA, 25 bp, Artificial Sequence
  Description of Artificial Sequence: Synthetic oligonucleotide
agcagagatggcagaccaggctgcg

SEQ ID NO: 177088 - DNA, 24 bp, Artificial Sequence
  Description of Artificial Sequence: Synthetic oligonucleotide
gcagagatggcagaccaggctgcg

SEQ ID NO: 177089 - DNA, 24 bp, Artificial Sequence
  Description of Artificial Sequence: Synthetic oligonucleotide
cagagatggcagaccaggctgcgg

SEQ ID NO: 177090 - DNA, 24 bp, Artificial Sequence
  Description of Artificial Sequence: Synthetic oligonucleotide
agagatggcagaccaggctgcggc

SEQ ID NO: 177091 - DNA, 23 bp, Artificial Sequence
  Description of Artificial Sequence: Synthetic oligonucleotide
gagatggcagaccaggctgcggc

SEQ ID NO: 177092 - DNA, 24 bp, Artificial Sequence
  Description of Artificial Sequence: Synthetic oligonucleotide
agatggcagaccaggctgcggcct

SEQ ID NO: 177093 - DNA, 23 bp, Artificial Sequence
  Description of Artificial Sequence: Synthetic oligonucleotide
gatggcagaccaggctgcggcct

SEQ ID NO: 177094 - DNA, 23 bp, Artificial Sequence
  Description of Artificial Sequence: Synthetic oligonucleotide
atggcagaccaggctgcggcctg

SEQ ID NO: 177095 - DNA, 22 bp, Artificial Sequence
  Description of Artificial Sequence: Synthetic oligonucleotide
tggcagaccaggctgcggcctg

SEQ ID NO: 177096 - DNA, 21 bp, Artificial Sequence
  Description of Artificial Sequence: Synthetic oligonucleotide
ggcagaccaggctgcggcctg

SEQ ID NO: 177097 - DNA, 21 bp, Artificial Sequence
  Description of Artificial Sequence: Synthetic oligonucleotide
gcagaccaggctgcggcctgg

SEQ ID NO: 177098 - DNA, 22 bp, Artificial Sequence
  Description of Artificial Sequence: Synthetic oligonucleotide
cagaccaggctgcggcctggct

SEQ ID NO: 177099 - DNA, 23 bp, Artificial Sequence
  Description of Artificial Sequence: Synthetic oligonucleotide
agaccaggctgcggcctggctca

SEQ ID NO: 177100 - DNA, 22 bp, Artificial Sequence
  Description of Artificial Sequence: Synthetic oligonucleotide
gaccaggctgcggcctggctca

SEQ ID NO: 177101 - DNA, 22 bp, Artificial Sequence
  Description of Artificial Sequence: Synthetic oligonucleotide
accaggctgcggcctggctcac

SEQ ID NO: 177102 - DNA, 21 bp, Artificial Sequence
  Description of Artificial Sequence: Synthetic oligonucleotide
ccaggctgcggcctggctcac

SEQ ID NO: 177103 - DNA, 21 bp, Artificial Sequence
  Description of Artificial Sequence: Synthetic oligonucleotide
caggctgcggcctggctcacc

SEQ ID NO: 177104 - DNA, 21 bp, Artificial Sequence
  Description of Artificial Sequence: Synthetic oligonucleotide
aggctgcggcctggctcaccc

SEQ ID NO: 177105 - DNA, 20 bp, Artificial Sequence
  Description of Artificial Sequence: Synthetic oligonucleotide
ggctgcggcctggctcaccc

SEQ ID NO: 177106 - DNA, 21 bp, Artificial Sequence
  Description of Artificial Sequence: Synthetic oligonucleotide
gctgcggcctggctcacccgt

SEQ ID NO: 177107 - DNA, 22 bp, Artificial Sequence
  Description of Artificial Sequence: Synthetic oligonucleotide
ctgcggcctggctcacccgtca

SEQ ID NO: 177108 - DNA, 22 bp, Artificial Sequence
  Description of Artificial Sequence: Synthetic oligonucleotide
tgcggcctggctcacccgtcag

SEQ ID NO: 177109 - DNA, 21 bp, Artificial Sequence
  Description of Artificial Sequence: Synthetic oligonucleotide
gcggcctggctcacccgtcag

SEQ ID NO: 177110 - DNA, 21 bp, Artificial Sequence
  Description of Artificial Sequence: Synthetic oligonucleotide
cggcctggctcacccgtcagg

SEQ ID NO: 177111 - DNA, 21 bp, Artificial Sequence
  Description of Artificial Sequence: Synthetic oligonucleotide
ggcctggctcacccgtcaggg

SEQ ID NO: 177112 - DNA, 22 bp, Artificial Sequence
  Description of Artificial Sequence: Synthetic oligonucleotide
gcctggctcacccgtcagggca

SEQ ID NO: 177113 - DNA, 22 bp, Artificial Sequence
  Description of Artificial Sequence: Synthetic oligonucleotide
cctggctcacccgtcagggcag

SEQ ID NO: 177114 - DNA, 24 bp, Artificial Sequence
  Description of Artificial Sequence: Synthetic oligonucleotide
ctggctcacccgtcagggcagctt

SEQ ID NO: 177115 - DNA, 24 bp, Artificial Sequence
  Description of Artificial Sequence: Synthetic oligonucleotide
tggctcacccgtcagggcagcttc

SEQ ID NO: 177116 - DNA, 23 bp, Artificial Sequence
  Description of Artificial Sequence: Synthetic oligonucleotide
ggctcacccgtcagggcagcttc

SEQ ID NO: 177117 - DNA, 25 bp, Artificial Sequence
  Description of Artificial Sequence: Synthetic oligonucleotide
gctcacccgtcagggcagcttccaa

SEQ ID NO: 177118 - DNA, 25 bp, Artificial Sequence
  Description of Artificial Sequence: Synthetic oligonucleotide
ctcacccgtcagggcagcttccaag

SEQ ID NO: 177119 - DNA, 25 bp, Artificial Sequence
  Description of Artificial Sequence: Synthetic oligonucleotide
tcacccgtcagggcagcttccaagg

SEQ ID NO: 177120 - DNA, 24 bp, Artificial Sequence
  Description of Artificial Sequence: Synthetic oligonucleotide
cacccgtcagggcagcttccaagg

SEQ ID NO: 177121 - DNA, 24 bp, Artificial Sequence
  Description of Artificial Sequence: Synthetic oligonucleotide
acccgtcagggcagcttccaaggg

SEQ ID NO: 177122 - DNA, 23 bp, Artificial Sequence
  Description of Artificial Sequence: Synthetic oligonucleotide
cccgtcagggcagcttccaaggg

SEQ ID NO: 177123 - DNA, 23 bp, Artificial Sequence
  Description of Artificial Sequence: Synthetic oligonucleotide
ccgtcagggcagcttccaagggg

SEQ ID NO: 177124 - DNA, 26 bp, Artificial Sequence
  Description of Artificial Sequence: Synthetic oligonucleotide
cgtcagggcagcttccaagggggatt

SEQ ID NO: 177125 - DNA, 26 bp, Artificial Sequence
  Description of Artificial Sequence: Synthetic oligonucleotide
gtcagggcagcttccaagggggattc

SEQ ID NO: 177126 - DNA, 26 bp, Artificial Sequence
  Description of Artificial Sequence: Synthetic oligonucleotide
tcagggcagcttccaagggggattcc

SEQ ID NO: 177127 - DNA, 25 bp, Artificial Sequence
  Description of Artificial Sequence: Synthetic oligonucleotide
cagggcagcttccaagggggattcc

SEQ ID NO: 177128 - DNA, 25 bp, Artificial Sequence
  Description of Artificial Sequence: Synthetic oligonucleotide
agggcagcttccaagggggattccg

SEQ ID NO: 177129 - DNA, 24 bp, Artificial Sequence
  Description of Artificial Sequence: Synthetic oligonucleotide
gggcagcttccaagggggattccg

SEQ ID NO: 177130 - DNA, 25 bp, Artificial Sequence
  Description of Artificial Sequence: Synthetic oligonucleotide
ggcagcttccaagggggattccgca

SEQ ID NO: 177131 - DNA, 27 bp, Artificial Sequence
  Description of Artificial Sequence: Synthetic oligonucleotide
gcagcttccaagggggattccgcagta

SEQ ID NO: 177132 - DNA, 27 bp, Artificial Sequence
  Description of Artificial Sequence: Synthetic oligonucleotide
cagcttccaagggggattccgcagtac

SEQ ID NO: 177133 - DNA, 27 bp, Artificial Sequence
  Description of Artificial Sequence: Synthetic oligonucleotide
agcttccaagggggattccgcagtacc

SEQ ID NO: 177134 - DNA, 26 bp, Artificial Sequence
  Description of Artificial Sequence: Synthetic oligonucleotide
gcttccaagggggattccgcagtacc

SEQ ID NO: 177135 - DNA, 27 bp, Artificial Sequence
  Description of Artificial Sequence: Synthetic oligonucleotide
cttccaagggggattccgcagtaccca

SEQ ID NO: 177136 - DNA, 28 bp, Artificial Sequence
  Description of Artificial Sequence: Synthetic oligonucleotide
ttccaagggggattccgcagtacccaag

SEQ ID NO: 177137 - DNA, 27 bp, Artificial Sequence
  Description of Artificial Sequence: Synthetic oligonucleotide
tccaagggggattccgcagtacccaag

SEQ ID NO: 177138 - DNA, 27 bp, Artificial Sequence
  Description of Artificial Sequence: Synthetic oligonucleotide
ccaagggggattccgcagtacccaaga

SEQ ID NO: 177139 - DNA, 27 bp, Artificial Sequence
  Description of Artificial Sequence: Synthetic oligonucleotide
caagggggattccgcagtacccaagac

SEQ ID NO: 177140 - DNA, 28 bp, Artificial Sequence
  Description of Artificial Sequence: Synthetic oligonucleotide
aagggggattccgcagtacccaagacac

SEQ ID NO: 177141 - DNA, 27 bp, Artificial Sequence
  Description of Artificial Sequence: Synthetic oligonucleotide
agggggattccgcagtacccaagacac

SEQ ID NO: 177142 - DNA, 26 bp, Artificial Sequence
  Description of Artificial Sequence: Synthetic oligonucleotide
gggggattccgcagtacccaagacac

SEQ ID NO: 177143 - DNA, 26 bp, Artificial Sequence
  Description of Artificial Sequence: Synthetic oligonucleotide
ggggattccgcagtacccaagacacg

SEQ ID NO: 177144 - DNA, 27 bp, Artificial Sequence
  Description of Artificial Sequence: Synthetic oligonucleotide
gggattccgcagtacccaagacacggt

SEQ ID NO: 177145 - DNA, 27 bp, Artificial Sequence
  Description of Artificial Sequence: Synthetic oligonucleotide
ggattccgcagtacccaagacacggtg

SEQ ID NO: 177146 - DNA, 30 bp, Artificial Sequence
  Description of Artificial Sequence: Synthetic oligonucleotide
gattccgcagtacccaagacacggtgattg

SEQ ID NO: 177147 - DNA, 30 bp, Artificial Sequence
  Description of Artificial Sequence: Synthetic oligonucleotide
attccgcagtacccaagacacggtgattgc

SEQ ID NO: 177148 - DNA, 29 bp, Artificial Sequence
  Description of Artificial Sequence: Synthetic oligonucleotide
ttccgcagtacccaagacacggtgattgc

SEQ ID NO: 177149 - DNA, 28 bp, Artificial Sequence
  Description of Artificial Sequence: Synthetic oligonucleotide
tccgcagtacccaagacacggtgattgc

SEQ ID NO: 177150 - DNA, 27 bp, Artificial Sequence
  Description of Artificial Sequence: Synthetic oligonucleotide
ccgcagtacccaagacacggtgattgc

SEQ ID NO: 177151 - DNA, 27 bp, Artificial Sequence
  Description of Artificial Sequence: Synthetic oligonucleotide
cgcagtacccaagacacggtgattgcc

SEQ ID NO: 177152 - DNA, 27 bp, Artificial Sequence
  Description of Artificial Sequence: Synthetic oligonucleotide
gcagtacccaagacacggtgattgccc

SEQ ID NO: 177153 - DNA, 28 bp, Artificial Sequence
  Description of Artificial Sequence: Synthetic oligonucleotide
cagtacccaagacacggtgattgccctg

SEQ ID NO: 177154 - DNA, 28 bp, Artificial Sequence
  Description of Artificial Sequence: Synthetic oligonucleotide
agtacccaagacacggtgattgccctgg

SEQ ID NO: 177155 - DNA, 27 bp, Artificial Sequence
  Description of Artificial Sequence: Synthetic oligonucleotide
gtacccaagacacggtgattgccctgg

SEQ ID NO: 177156 - DNA, 29 bp, Artificial Sequence
  Description of Artificial Sequence: Synthetic oligonucleotide
tacccaagacacggtgattgccctggatg

SEQ ID NO: 177157 - DNA, 28 bp, Artificial Sequence
  Description of Artificial Sequence: Synthetic oligonucleotide
acccaagacacggtgattgccctggatg

SEQ ID NO: 177158 - DNA, 27 bp, Artificial Sequence
  Description of Artificial Sequence: Synthetic oligonucleotide
cccaagacacggtgattgccctggatg

SEQ ID NO: 177159 - DNA, 27 bp, Artificial Sequence
  Description of Artificial Sequence: Synthetic oligonucleotide
ccaagacacggtgattgccctggatgc

SEQ ID NO: 177160 - DNA, 27 bp, Artificial Sequence
  Description of Artificial Sequence: Synthetic oligonucleotide
caagacacggtgattgccctggatgcc

SEQ ID NO: 177161 - DNA, 27 bp, Artificial Sequence
  Description of Artificial Sequence: Synthetic oligonucleotide
aagacacggtgattgccctggatgccc

SEQ ID NO: 177162 - DNA, 27 bp, Artificial Sequence
  Description of Artificial Sequence: Synthetic oligonucleotide
agacacggtgattgccctggatgccct

SEQ ID NO: 177163 - DNA, 26 bp, Artificial Sequence
  Description of Artificial Sequence: Synthetic oligonucleotide
gacacggtgattgccctggatgccct

SEQ ID NO: 177164 - DNA, 27 bp, Artificial Sequence
  Description of Artificial Sequence: Synthetic oligonucleotide
acacggtgattgccctggatgccctgt

SEQ ID NO: 177165 - DNA, 26 bp, Artificial Sequence
  Description of Artificial Sequence: Synthetic oligonucleotide
cacggtgattgccctggatgccctgt

SEQ ID NO: 177166 - DNA, 27 bp, Artificial Sequence
  Description of Artificial Sequence: Synthetic oligonucleotide
acggtgattgccctggatgccctgtct

SEQ ID NO: 177167 - DNA, 26 bp, Artificial Sequence
  Description of Artificial Sequence: Synthetic oligonucleotide
cggtgattgccctggatgccctgtct

SEQ ID NO: 177168 - DNA, 26 bp, Artificial Sequence
  Description of Artificial Sequence: Synthetic oligonucleotide
ggtgattgccctggatgccctgtctg

SEQ ID NO: 177169 - DNA, 26 bp, Artificial Sequence
  Description of Artificial Sequence: Synthetic oligonucleotide
gtgattgccctggatgccctgtctgc

SEQ ID NO: 177170 - DNA, 27 bp, Artificial Sequence
  Description of Artificial Sequence: Synthetic oligonucleotide
tgattgccctggatgccctgtctgcct

SEQ ID NO: 177171 - DNA, 27 bp, Artificial Sequence
  Description of Artificial Sequence: Synthetic oligonucleotide
gattgccctggatgccctgtctgccta

SEQ ID NO: 177172 - DNA, 27 bp, Artificial Sequence
  Description of Artificial Sequence: Synthetic oligonucleotide
attgccctggatgccctgtctgcctac

SEQ ID NO: 177173 - DNA, 27 bp, Artificial Sequence
  Description of Artificial Sequence: Synthetic oligonucleotide
ttgccctggatgccctgtctgcctact

SEQ ID NO: 177174 - DNA, 26 bp, Artificial Sequence
  Description of Artificial Sequence: Synthetic oligonucleotide
tgccctggatgccctgtctgcctact

SEQ ID NO: 177175 - DNA, 25 bp, Artificial Sequence
  Description of Artificial Sequence: Synthetic oligonucleotide
gccctggatgccctgtctgcctact

SEQ ID NO: 177176 - DNA, 25 bp, Artificial Sequence
  Description of Artificial Sequence: Synthetic oligonucleotide
ccctggatgccctgtctgcctactg

SEQ ID NO: 177177 - DNA, 27 bp, Artificial Sequence
  Description of Artificial Sequence: Synthetic oligonucleotide
cctggatgccctgtctgcctactggat

SEQ ID NO: 177178 - DNA, 28 bp, Artificial Sequence
  Description of Artificial Sequence: Synthetic oligonucleotide
ctggatgccctgtctgcctactggattg

SEQ ID NO: 177179 - DNA, 28 bp, Artificial Sequence
  Description of Artificial Sequence: Synthetic oligonucleotide
tggatgccctgtctgcctactggattgc

SEQ ID NO: 177180 - DNA, 27 bp, Artificial Sequence
  Description of Artificial Sequence: Synthetic oligonucleotide
ggatgccctgtctgcctactggattgc

SEQ ID NO: 177181 - DNA, 27 bp, Artificial Sequence
  Description of Artificial Sequence: Synthetic oligonucleotide
gatgccctgtctgcctactggattgcc

SEQ ID NO: 177182 - DNA, 28 bp, Artificial Sequence
  Description of Artificial Sequence: Synthetic oligonucleotide
atgccctgtctgcctactggattgcctc

SEQ ID NO: 177183 - DNA, 27 bp, Artificial Sequence
  Description of Artificial Sequence: Synthetic oligonucleotide
tgccctgtctgcctactggattgcctc

SEQ ID NO: 177184 - DNA, 26 bp, Artificial Sequence
  Description of Artificial Sequence: Synthetic oligonucleotide
gccctgtctgcctactggattgcctc

SEQ ID NO: 177185 - DNA, 26 bp, Artificial Sequence
  Description of Artificial Sequence: Synthetic oligonucleotide
ccctgtctgcctactggattgcctcc

SEQ ID NO: 177186 - DNA, 27 bp, Artificial Sequence
  Description of Artificial Sequence: Synthetic oligonucleotide
cctgtctgcctactggattgcctccca

SEQ ID NO: 177187 - DNA, 27 bp, Artificial Sequence
  Description of Artificial Sequence: Synthetic oligonucleotide
ctgtctgcctactggattgcctcccac

SEQ ID NO: 177188 - DNA, 28 bp, Artificial Sequence
  Description of Artificial Sequence: Synthetic oligonucleotide
tgtctgcctactggattgcctcccacac

SEQ ID NO: 177189 - DNA, 27 bp, Artificial Sequence
  Description of Artificial Sequence: Synthetic oligonucleotide
gtctgcctactggattgcctcccacac

SEQ ID NO: 177190 - DNA, 27 bp, Artificial Sequence
  Description of Artificial Sequence: Synthetic oligonucleotide
tctgcctactggattgcctcccacacc

SEQ ID NO: 177191 - DNA, 27 bp, Artificial Sequence
  Description of Artificial Sequence: Synthetic oligonucleotide
ctgcctactggattgcctcccacacca

SEQ ID NO: 177192 - DNA, 27 bp, Artificial Sequence
  Description of Artificial Sequence: Synthetic oligonucleotide
tgcctactggattgcctcccacaccac

SEQ ID NO: 177193 - DNA, 27 bp, Artificial Sequence
  Description of Artificial Sequence: Synthetic oligonucleotide
gcctactggattgcctcccacaccact

SEQ ID NO: 177194 - DNA, 27 bp, Artificial Sequence
  Description of Artificial Sequence: Synthetic oligonucleotide
cctactggattgcctcccacaccactg

SEQ ID NO: 177195 - DNA, 28 bp, Artificial Sequence
  Description of Artificial Sequence: Synthetic oligonucleotide
ctactggattgcctcccacaccactgag

SEQ ID NO: 177196 - DNA, 28 bp, Artificial Sequence
  Description of Artificial Sequence: Synthetic oligonucleotide
tactggattgcctcccacaccactgagg

SEQ ID NO: 177197 - DNA, 27 bp, Artificial Sequence
  Description of Artificial Sequence: Synthetic oligonucleotide
actggattgcctcccacaccactgagg

SEQ ID NO: 177198 - DNA, 27 bp, Artificial Sequence
  Description of Artificial Sequence: Synthetic oligonucleotide
ctggattgcctcccacaccactgagga

SEQ ID NO: 177199 - DNA, 27 bp, Artificial Sequence
  Description of Artificial Sequence: Synthetic oligonucleotide
tggattgcctcccacaccactgaggag

SEQ ID NO: 177200 - DNA, 27 bp, Artificial Sequence
  Description of Artificial Sequence: Synthetic oligonucleotide
ggattgcctcccacaccactgaggaga

SEQ ID NO: 177201 - DNA, 27 bp, Artificial Sequence
  Description of Artificial Sequence: Synthetic oligonucleotide
gattgcctcccacaccactgaggagag

SEQ ID NO: 177202 - DNA, 27 bp, Artificial Sequence
  Description of Artificial Sequence: Synthetic oligonucleotide
attgcctcccacaccactgaggagagg

SEQ ID NO: 177203 - DNA, 26 bp, Artificial Sequence
  Description of Artificial Sequence: Synthetic oligonucleotide
ttgcctcccacaccactgaggagagg

SEQ ID NO: 177204 - DNA, 25 bp, Artificial Sequence
  Description of Artificial Sequence: Synthetic oligonucleotide
tgcctcccacaccactgaggagagg

SEQ ID NO: 177205 - DNA, 24 bp, Artificial Sequence
  Description of Artificial Sequence: Synthetic oligonucleotide
gcctcccacaccactgaggagagg

SEQ ID NO: 177206 - DNA, 24 bp, Artificial Sequence
  Description of Artificial Sequence: Synthetic oligonucleotide
cctcccacaccactgaggagaggg

SEQ ID NO: 177207 - DNA, 25 bp, Artificial Sequence
  Description of Artificial Sequence: Synthetic oligonucleotide
ctcccacaccactgaggagaggggt

SEQ ID NO: 177208 - DNA, 26 bp, Artificial Sequence
  Description of Artificial Sequence: Synthetic oligonucleotide
tcccacaccactgaggagaggggtct

SEQ ID NO: 177209 - DNA, 25 bp, Artificial Sequence
  Description of Artificial Sequence: Synthetic oligonucleotide
cccacaccactgaggagaggggtct

SEQ ID NO: 177210 - DNA, 27 bp, Artificial Sequence
  Description of Artificial Sequence: Synthetic oligonucleotide
ccacaccactgaggagaggggtctcaa

SEQ ID NO: 177211 - DNA, 28 bp, Artificial Sequence
  Description of Artificial Sequence: Synthetic oligonucleotide
cacaccactgaggagaggggtctcaatg

SEQ ID NO: 177212 - DNA, 29 bp, Artificial Sequence
  Description of Artificial Sequence: Synthetic oligonucleotide
acaccactgaggagaggggtctcaatgtg

SEQ ID NO: 177213 - DNA, 28 bp, Artificial Sequence
  Description of Artificial Sequence: Synthetic oligonucleotide
caccactgaggagaggggtctcaatgtg

SEQ ID NO: 177214 - DNA, 29 bp, Artificial Sequence
  Description of Artificial Sequence: Synthetic oligonucleotide
accactgaggagaggggtctcaatgtgac

SEQ ID NO: 177215 - DNA, 28 bp, Artificial Sequence
  Description of Artificial Sequence: Synthetic oligonucleotide
ccactgaggagaggggtctcaatgtgac

SEQ ID NO: 177216 - DNA, 29 bp, Artificial Sequence
  Description of Artificial Sequence: Synthetic oligonucleotide
cactgaggagaggggtctcaatgtgactc

SEQ ID NO: 177217 - DNA, 30 bp, Artificial Sequence
  Description of Artificial Sequence: Synthetic oligonucleotide
actgaggagaggggtctcaatgtgactctc

SEQ ID NO: 177218 - DNA, 29 bp, Artificial Sequence
  Description of Artificial Sequence: Synthetic oligonucleotide
ctgaggagaggggtctcaatgtgactctc

SEQ ID NO: 177219 - DNA, 30 bp, Artificial Sequence
  Description of Artificial Sequence: Synthetic oligonucleotide
tgaggagaggggtctcaatgtgactctcag

SEQ ID NO: 177220 - DNA, 29 bp, Artificial Sequence
  Description of Artificial Sequence: Synthetic oligonucleotide
gaggagaggggtctcaatgtgactctcag

SEQ ID NO: 177221 - DNA, 29 bp, Artificial Sequence
  Description of Artificial Sequence: Synthetic oligonucleotide
aggagaggggtctcaatgtgactctcagc

SEQ ID NO: 177222 - DNA, 28 bp, Artificial Sequence
  Description of Artificial Sequence: Synthetic oligonucleotide
ggagaggggtctcaatgtgactctcagc

SEQ ID NO: 177223 - DNA, 29 bp, Artificial Sequence
  Description of Artificial Sequence: Synthetic oligonucleotide
gagaggggtctcaatgtgactctcagctc

SEQ ID NO: 177224 - DNA, 29 bp, Artificial Sequence
  Description of Artificial Sequence: Synthetic oligonucleotide
agaggggtctcaatgtgactctcagctcc

SEQ ID NO: 177225 - DNA, 28 bp, Artificial Sequence
  Description of Artificial Sequence: Synthetic oligonucleotide
gaggggtctcaatgtgactctcagctcc

SEQ ID NO: 177226 - DNA, 29 bp, Artificial Sequence
  Description of Artificial Sequence: Synthetic oligonucleotide
aggggtctcaatgtgactctcagctccac

SEQ ID NO: 177227 - DNA, 28 bp, Artificial Sequence
  Description of Artificial Sequence: Synthetic oligonucleotide
ggggtctcaatgtgactctcagctccac

SEQ ID NO: 177228 - DNA, 29 bp, Artificial Sequence
  Description of Artificial Sequence: Synthetic oligonucleotide
gggtctcaatgtgactctcagctccacag

SEQ ID NO: 177229 - DNA, 29 bp, Artificial Sequence
  Description of Artificial Sequence: Synthetic oligonucleotide
ggtctcaatgtgactctcagctccacagg

SEQ ID NO: 177230 - DNA, 29 bp, Artificial Sequence
  Description of Artificial Sequence: Synthetic oligonucleotide
gtctcaatgtgactctcagctccacaggc

SEQ ID NO: 177231 - DNA, 29 bp, Artificial Sequence
  Description of Artificial Sequence: Synthetic oligonucleotide
tctcaatgtgactctcagctccacaggcc

SEQ ID NO: 177232 - DNA, 28 bp, Artificial Sequence
  Description of Artificial Sequence: Synthetic oligonucleotide
ctcaatgtgactctcagctccacaggcc

SEQ ID NO: 177233 - DNA, 28 bp, Artificial Sequence
  Description of Artificial Sequence: Synthetic oligonucleotide
tcaatgtgactctcagctccacaggccg

SEQ ID NO: 177234 - DNA, 27 bp, Artificial Sequence
  Description of Artificial Sequence: Synthetic oligonucleotide
caatgtgactctcagctccacaggccg

SEQ ID NO: 177235 - DNA, 27 bp, Artificial Sequence
  Description of Artificial Sequence: Synthetic oligonucleotide
aatgtgactctcagctccacaggccgg

SEQ ID NO: 177236 - DNA, 27 bp, Artificial Sequence
  Description of Artificial Sequence: Synthetic oligonucleotide
atgtgactctcagctccacaggccgga

SEQ ID NO: 177237 - DNA, 27 bp, Artificial Sequence
  Description of Artificial Sequence: Synthetic oligonucleotide
tgtgactctcagctccacaggccggaa

SEQ ID NO: 177238 - DNA, 27 bp, Artificial Sequence
  Description of Artificial Sequence: Synthetic oligonucleotide
gtgactctcagctccacaggccggaat

SEQ ID NO: 177239 - DNA, 27 bp, Artificial Sequence
  Description of Artificial Sequence: Synthetic oligonucleotide
tgactctcagctccacaggccggaatg

SEQ ID NO: 177240 - DNA, 26 bp, Artificial Sequence
  Description of Artificial Sequence: Synthetic oligonucleotide
gactctcagctccacaggccggaatg

SEQ ID NO: 177241 - DNA, 26 bp, Artificial Sequence
  Description of Artificial Sequence: Synthetic oligonucleotide
actctcagctccacaggccggaatgg

SEQ ID NO: 177242 - DNA, 25 bp, Artificial Sequence
  Description of Artificial Sequence: Synthetic oligonucleotide
ctctcagctccacaggccggaatgg

SEQ ID NO: 177243 - DNA, 27 bp, Artificial Sequence
  Description of Artificial Sequence: Synthetic oligonucleotide
tctcagctccacaggccggaatgggtt

SEQ ID NO: 177244 - DNA, 26 bp, Artificial Sequence
  Description of Artificial Sequence: Synthetic oligonucleotide
ctcagctccacaggccggaatgggtt

SEQ ID NO: 177245 - DNA, 27 bp, Artificial Sequence
  Description of Artificial Sequence: Synthetic oligonucleotide
tcagctccacaggccggaatgggttca

SEQ ID NO: 177246 - DNA, 27 bp, Artificial Sequence
  Description of Artificial Sequence: Synthetic oligonucleotide
cagctccacaggccggaatgggttcaa

SEQ ID NO: 177247 - DNA, 27 bp, Artificial Sequence
  Description of Artificial Sequence: Synthetic oligonucleotide
agctccacaggccggaatgggttcaag

SEQ ID NO: 177248 - DNA, 27 bp, Artificial Sequence
  Description of Artificial Sequence: Synthetic oligonucleotide
gctccacaggccggaatgggttcaagt

SEQ ID NO: 177249 - DNA, 27 bp, Artificial Sequence
  Description of Artificial Sequence: Synthetic oligonucleotide
ctccacaggccggaatgggttcaagtc

SEQ ID NO: 177250 - DNA, 27 bp, Artificial Sequence
  Description of Artificial Sequence: Synthetic oligonucleotide
tccacaggccggaatgggttcaagtcc

SEQ ID NO: 177251 - DNA, 26 bp, Artificial Sequence
  Description of Artificial Sequence: Synthetic oligonucleotide
ccacaggccggaatgggttcaagtcc

SEQ ID NO: 177252 - DNA, 27 bp, Artificial Sequence
  Description of Artificial Sequence: Synthetic oligonucleotide
cacaggccggaatgggttcaagtccca

SEQ ID NO: 177253 - DNA, 27 bp, Artificial Sequence
  Description of Artificial Sequence: Synthetic oligonucleotide
acaggccggaatgggttcaagtcccac

SEQ ID NO: 177254 - DNA, 26 bp, Artificial Sequence
  Description of Artificial Sequence: Synthetic oligonucleotide
caggccggaatgggttcaagtcccac

SEQ ID NO: 177255 - DNA, 26 bp, Artificial Sequence
  Description of Artificial Sequence: Synthetic oligonucleotide
aggccggaatgggttcaagtcccacg

SEQ ID NO: 177256 - DNA, 25 bp, Artificial Sequence
  Description of Artificial Sequence: Synthetic oligonucleotide
ggccggaatgggttcaagtcccacg

SEQ ID NO: 177257 - DNA, 25 bp, Artificial Sequence
  Description of Artificial Sequence: Synthetic oligonucleotide
gccggaatgggttcaagtcccacgc

SEQ ID NO: 177258 - DNA, 25 bp, Artificial Sequence
  Description of Artificial Sequence: Synthetic oligonucleotide
ccggaatgggttcaagtcccacgcg

SEQ ID NO: 177259 - DNA, 26 bp, Artificial Sequence
  Description of Artificial Sequence: Synthetic oligonucleotide
cggaatgggttcaagtcccacgcgct

SEQ ID NO: 177260 - DNA, 26 bp, Artificial Sequence
  Description of Artificial Sequence: Synthetic oligonucleotide
ggaatgggttcaagtcccacgcgctg

SEQ ID NO: 177261 - DNA, 27 bp, Artificial Sequence
  Description of Artificial Sequence: Synthetic oligonucleotide
gaatgggttcaagtcccacgcgctgca

SEQ ID NO: 177262 - DNA, 27 bp, Artificial Sequence
  Description of Artificial Sequence: Synthetic oligonucleotide
aatgggttcaagtcccacgcgctgcag

SEQ ID NO: 177263 - DNA, 26 bp, Artificial Sequence
  Description of Artificial Sequence: Synthetic oligonucleotide
atgggttcaagtcccacgcgctgcag

SEQ ID NO: 177264 - DNA, 25 bp, Artificial Sequence
  Description of Artificial Sequence: Synthetic oligonucleotide
tgggttcaagtcccacgcgctgcag

SEQ ID NO: 177265 - DNA, 24 bp, Artificial Sequence
  Description of Artificial Sequence: Synthetic oligonucleotide
gggttcaagtcccacgcgctgcag

SEQ ID NO: 177266 - DNA, 25 bp, Artificial Sequence
  Description of Artificial Sequence: Synthetic oligonucleotide
ggttcaagtcccacgcgctgcagct

SEQ ID NO: 177267 - DNA, 27 bp, Artificial Sequence
  Description of Artificial Sequence: Synthetic oligonucleotide
gttcaagtcccacgcgctgcagctgaa

SEQ ID NO: 177268 - DNA, 27 bp, Artificial Sequence
  Description of Artificial Sequence: Synthetic oligonucleotide
ttcaagtcccacgcgctgcagctgaac

SEQ ID NO: 177269 - DNA, 27 bp, Artificial Sequence
  Description of Artificial Sequence: Synthetic oligonucleotide
tcaagtcccacgcgctgcagctgaaca

SEQ ID NO: 177270 - DNA, 27 bp, Artificial Sequence
  Description of Artificial Sequence: Synthetic oligonucleotide
caagtcccacgcgctgcagctgaacaa

SEQ ID NO: 177271 - DNA, 27 bp, Artificial Sequence
  Description of Artificial Sequence: Synthetic oligonucleotide
aagtcccacgcgctgcagctgaacaac

SEQ ID NO: 177272 - DNA, 26 bp, Artificial Sequence
  Description of Artificial Sequence: Synthetic oligonucleotide
agtcccacgcgctgcagctgaacaac

SEQ ID NO: 177273 - DNA, 25 bp, Artificial Sequence
  Description of Artificial Sequence: Synthetic oligonucleotide
gtcccacgcgctgcagctgaacaac

SEQ ID NO: 177274 - DNA, 25 bp, Artificial Sequence
  Description of Artificial Sequence: Synthetic oligonucleotide
tcccacgcgctgcagctgaacaacc

SEQ ID NO: 177275 - DNA, 24 bp, Artificial Sequence
  Description of Artificial Sequence: Synthetic oligonucleotide
cccacgcgctgcagctgaacaacc

SEQ ID NO: 177276 - DNA, 24 bp, Artificial Sequence
  Description of Artificial Sequence: Synthetic oligonucleotide
ccacgcgctgcagctgaacaaccg

SEQ ID NO: 177277 - DNA, 24 bp, Artificial Sequence
  Description of Artificial Sequence: Synthetic oligonucleotide
cacgcgctgcagctgaacaaccgc

SEQ ID NO: 177278 - DNA, 25 bp, Artificial Sequence
  Description of Artificial Sequence: Synthetic oligonucleotide
acgcgctgcagctgaacaaccgcca

SEQ ID NO: 177279 - DNA, 24 bp, Artificial Sequence
  Description of Artificial Sequence: Synthetic oligonucleotide
cgcgctgcagctgaacaaccgcca

SEQ ID NO: 177280 - DNA, 27 bp, Artificial Sequence
  Description of Artificial Sequence: Synthetic oligonucleotide
gcgctgcagctgaacaaccgccagatt

SEQ ID NO: 177281 - DNA, 27 bp, Artificial Sequence
  Description of Artificial Sequence: Synthetic oligonucleotide
cgctgcagctgaacaaccgccagattc

SEQ ID NO: 177282 - DNA, 27 bp, Artificial Sequence
  Description of Artificial Sequence: Synthetic oligonucleotide
gctgcagctgaacaaccgccagattcg

SEQ ID NO: 177283 - DNA, 27 bp, Artificial Sequence
  Description of Artificial Sequence: Synthetic oligonucleotide
ctgcagctgaacaaccgccagattcgc

SEQ ID NO: 177284 - DNA, 27 bp, Artificial Sequence
  Description of Artificial Sequence: Synthetic oligonucleotide
tgcagctgaacaaccgccagattcgcg

SEQ ID NO: 177285 - DNA, 26 bp, Artificial Sequence
  Description of Artificial Sequence: Synthetic oligonucleotide
gcagctgaacaaccgccagattcgcg

SEQ ID NO: 177286 - DNA, 26 bp, Artificial Sequence
  Description of Artificial Sequence: Synthetic oligonucleotide
cagctgaacaaccgccagattcgcgg

SEQ ID NO: 177287 - DNA, 26 bp, Artificial Sequence
  Description of Artificial Sequence: Synthetic oligonucleotide
agctgaacaaccgccagattcgcggc

SEQ ID NO: 177288 - DNA, 25 bp, Artificial Sequence
  Description of Artificial Sequence: Synthetic oligonucleotide
gctgaacaaccgccagattcgcggc

SEQ ID NO: 177289 - DNA, 26 bp, Artificial Sequence
  Description of Artificial Sequence: Synthetic oligonucleotide
ctgaacaaccgccagattcgcggcct

SEQ ID NO: 177290 - DNA, 26 bp, Artificial Sequence
  Description of Artificial Sequence: Synthetic oligonucleotide
tgaacaaccgccagattcgcggcctg

SEQ ID NO: 177291 - DNA, 25 bp, Artificial Sequence
  Description of Artificial Sequence: Synthetic oligonucleotide
gaacaaccgccagattcgcggcctg

SEQ ID NO: 177292 - DNA, 26 bp, Artificial Sequence
  Description of Artificial Sequence: Synthetic oligonucleotide
aacaaccgccagattcgcggcctgga

SEQ ID NO: 177293 - DNA, 25 bp, Artificial Sequence
  Description of Artificial Sequence: Synthetic oligonucleotide
acaaccgccagattcgcggcctgga

SEQ ID NO: 177294 - DNA, 24 bp, Artificial Sequence
  Description of Artificial Sequence: Synthetic oligonucleotide
caaccgccagattcgcggcctgga

SEQ ID NO: 177295 - DNA, 24 bp, Artificial Sequence
  Description of Artificial Sequence: Synthetic oligonucleotide
aaccgccagattcgcggcctggag

SEQ ID NO: 177296 - DNA, 23 bp, Artificial Sequence
  Description of Artificial Sequence: Synthetic oligonucleotide
accgccagattcgcggcctggag

SEQ ID NO: 177297 - DNA, 22 bp, Artificial Sequence
  Description of Artificial Sequence: Synthetic oligonucleotide
ccgccagattcgcggcctggag

SEQ ID NO: 177298 - DNA, 23 bp, Artificial Sequence
  Description of Artificial Sequence: Synthetic oligonucleotide
cgccagattcgcggcctggagga

SEQ ID NO: 177299 - DNA, 23 bp, Artificial Sequence
  Description of Artificial Sequence: Synthetic oligonucleotide
gccagattcgcggcctggaggag

SEQ ID NO: 177300 - DNA, 24 bp, Artificial Sequence
  Description of Artificial Sequence: Synthetic oligonucleotide
ccagattcgcggcctggaggagga

SEQ ID NO: 177301 - DNA, 24 bp, Artificial Sequence
  Description of Artificial Sequence: Synthetic oligonucleotide
cagattcgcggcctggaggaggag

SEQ ID NO: 177302 - DNA, 25 bp, Artificial Sequence
  Description of Artificial Sequence: Synthetic oligonucleotide
agattcgcggcctggaggaggagct

SEQ ID NO: 177303 - DNA, 24 bp, Artificial Sequence
  Description of Artificial Sequence: Synthetic oligonucleotide
gattcgcggcctggaggaggagct

SEQ ID NO: 177304 - DNA, 24 bp, Artificial Sequence
  Description of Artificial Sequence: Synthetic oligonucleotide
attcgcggcctggaggaggagctg

SEQ ID NO: 177305 - DNA, 23 bp, Artificial Sequence
  Description of Artificial Sequence: Synthetic oligonucleotide
ttcgcggcctggaggaggagctg

SEQ ID NO: 177306 - DNA, 22 bp, Artificial Sequence
  Description of Artificial Sequence: Synthetic oligonucleotide
tcgcggcctggaggaggagctg

SEQ ID NO: 177307 - DNA, 21 bp, Artificial Sequence
  Description of Artificial Sequence: Synthetic oligonucleotide
cgcggcctggaggaggagctg

SEQ ID NO: 177308 - DNA, 22 bp, Artificial Sequence
  Description of Artificial Sequence: Synthetic oligonucleotide
gcggcctggaggaggagctgca

SEQ ID NO: 177309 - DNA, 26 bp, Artificial Sequence
  Description of Artificial Sequence: Synthetic oligonucleotide
cggcctggaggaggagctgcagtttt

SEQ ID NO: 177310 - DNA, 26 bp, Artificial Sequence
  Description of Artificial Sequence: Synthetic oligonucleotide
ggcctggaggaggagctgcagttttc

SEQ ID NO: 177311 - DNA, 27 bp, Artificial Sequence
  Description of Artificial Sequence: Synthetic oligonucleotide
gcctggaggaggagctgcagttttcct

SEQ ID NO: 177312 - DNA, 28 bp, Artificial Sequence
  Description of Artificial Sequence: Synthetic oligonucleotide
cctggaggaggagctgcagttttccttg

SEQ ID NO: 177313 - DNA, 28 bp, Artificial Sequence
  Description of Artificial Sequence: Synthetic oligonucleotide
ctggaggaggagctgcagttttccttgg

SEQ ID NO: 177314 - DNA, 28 bp, Artificial Sequence
  Description of Artificial Sequence: Synthetic oligonucleotide
tggaggaggagctgcagttttccttggg

SEQ ID NO: 177315 - DNA, 27 bp, Artificial Sequence
  Description of Artificial Sequence: Synthetic oligonucleotide
ggaggaggagctgcagttttccttggg

SEQ ID NO: 177316 - DNA, 27 bp, Artificial Sequence
  Description of Artificial Sequence: Synthetic oligonucleotide
gaggaggagctgcagttttccttgggc

SEQ ID NO: 177317 - DNA, 28 bp, Artificial Sequence
  Description of Artificial Sequence: Synthetic oligonucleotide
aggaggagctgcagttttccttgggcag

SEQ ID NO: 177318 - DNA, 27 bp, Artificial Sequence
  Description of Artificial Sequence: Synthetic oligonucleotide
ggaggagctgcagttttccttgggcag

SEQ ID NO: 177319 - DNA, 27 bp, Artificial Sequence
  Description of Artificial Sequence: Synthetic oligonucleotide
gaggagctgcagttttccttgggcagc

SEQ ID NO: 177320 - DNA, 29 bp, Artificial Sequence
  Description of Artificial Sequence: Synthetic oligonucleotide
aggagctgcagttttccttgggcagcaag

SEQ ID NO: 177321 - DNA, 28 bp, Artificial Sequence
  Description of Artificial Sequence: Synthetic oligonucleotide
ggagctgcagttttccttgggcagcaag

SEQ ID NO: 177322 - DNA, 30 bp, Artificial Sequence
  Description of Artificial Sequence: Synthetic oligonucleotide
gagctgcagttttccttgggcagcaagatc

SEQ ID NO: 177323 - DNA, 33 bp, Artificial Sequence
  Description of Artificial Sequence: Synthetic oligonucleotide
agctgcagttttccttgggcagcaagatcaatg

SEQ ID NO: 177324 - DNA, 32 bp, Artificial Sequence
  Description of Artificial Sequence: Synthetic oligonucleotide
gctgcagttttccttgggcagcaagatcaatg

SEQ ID NO: 177325 - DNA, 33 bp, Artificial Sequence
  Description of Artificial Sequence: Synthetic oligonucleotide
ctgcagttttccttgggcagcaagatcaatgtg

SEQ ID NO: 177326 - DNA, 35 bp, Artificial Sequence
  Description of Artificial Sequence: Synthetic oligonucleotide
tgcagttttccttgggcagcaagatcaatgtgaag

SEQ ID NO: 177327 - DNA, 34 bp, Artificial Sequence
  Description of Artificial Sequence: Synthetic oligonucleotide
gcagttttccttgggcagcaagatcaatgtgaag

SEQ ID NO: 177328 - DNA, 34 bp, Artificial Sequence
  Description of Artificial Sequence: Synthetic oligonucleotide
cagttttccttgggcagcaagatcaatgtgaagg

SEQ ID NO: 177329 - DNA, 35 bp, Artificial Sequence
  Description of Artificial Sequence: Synthetic oligonucleotide
agttttccttgggcagcaagatcaatgtgaaggtg

SEQ ID NO: 177330 - DNA, 34 bp, Artificial Sequence
  Description of Artificial Sequence: Synthetic oligonucleotide
gttttccttgggcagcaagatcaatgtgaaggtg

SEQ ID NO: 177331 - DNA, 34 bp, Artificial Sequence
  Description of Artificial Sequence: Synthetic oligonucleotide
ttttccttgggcagcaagatcaatgtgaaggtgg

SEQ ID NO: 177332 - DNA, 33 bp, Artificial Sequence
  Description of Artificial Sequence: Synthetic oligonucleotide
tttccttgggcagcaagatcaatgtgaaggtgg

SEQ ID NO: 177333 - DNA, 32 bp, Artificial Sequence
  Description of Artificial Sequence: Synthetic oligonucleotide
ttccttgggcagcaagatcaatgtgaaggtgg

SEQ ID NO: 177334 - DNA, 31 bp, Artificial Sequence
  Description of Artificial Sequence: Synthetic oligonucleotide
tccttgggcagcaagatcaatgtgaaggtgg

SEQ ID NO: 177335 - DNA, 30 bp, Artificial Sequence
  Description of Artificial Sequence: Synthetic oligonucleotide
ccttgggcagcaagatcaatgtgaaggtgg

SEQ ID NO: 177336 - DNA, 30 bp, Artificial Sequence
  Description of Artificial Sequence: Synthetic oligonucleotide
cttgggcagcaagatcaatgtgaaggtggg

SEQ ID NO: 177337 - DNA, 31 bp, Artificial Sequence
  Description of Artificial Sequence: Synthetic oligonucleotide
ttgggcagcaagatcaatgtgaaggtgggag

SEQ ID NO: 177338 - DNA, 30 bp, Artificial Sequence
  Description of Artificial Sequence: Synthetic oligonucleotide
tgggcagcaagatcaatgtgaaggtgggag

SEQ ID NO: 177339 - DNA, 29 bp, Artificial Sequence
  Description of Artificial Sequence: Synthetic oligonucleotide
gggcagcaagatcaatgtgaaggtgggag

SEQ ID NO: 177340 - DNA, 29 bp, Artificial Sequence
  Description of Artificial Sequence: Synthetic oligonucleotide
ggcagcaagatcaatgtgaaggtgggagg

SEQ ID NO: 177341 - DNA, 32 bp, Artificial Sequence
  Description of Artificial Sequence: Synthetic oligonucleotide
gcagcaagatcaatgtgaaggtgggaggaaac

SEQ ID NO: 177342 - DNA, 33 bp, Artificial Sequence
  Description of Artificial Sequence: Synthetic oligonucleotide
cagcaagatcaatgtgaaggtgggaggaaacag

SEQ ID NO: 177343 - DNA, 33 bp, Artificial Sequence
  Description of Artificial Sequence: Synthetic oligonucleotide
agcaagatcaatgtgaaggtgggaggaaacagc

SEQ ID NO: 177344 - DNA, 32 bp, Artificial Sequence
  Description of Artificial Sequence: Synthetic oligonucleotide
gcaagatcaatgtgaaggtgggaggaaacagc

SEQ ID NO: 177345 - DNA, 35 bp, Artificial Sequence
  Description of Artificial Sequence: Synthetic oligonucleotide
caagatcaatgtgaaggtgggaggaaacagcaaag

SEQ ID NO: 177346 - DNA, 35 bp, Artificial Sequence
  Description of Artificial Sequence: Synthetic oligonucleotide
aagatcaatgtgaaggtgggaggaaacagcaaagg

SEQ ID NO: 177347 - DNA, 34 bp, Artificial Sequence
  Description of Artificial Sequence: Synthetic oligonucleotide
agatcaatgtgaaggtgggaggaaacagcaaagg

SEQ ID NO: 177348 - DNA, 33 bp, Artificial Sequence
  Description of Artificial Sequence: Synthetic oligonucleotide
gatcaatgtgaaggtgggaggaaacagcaaagg

SEQ ID NO: 177349 - DNA, 35 bp, Artificial Sequence
  Description of Artificial Sequence: Synthetic oligonucleotide
atcaatgtgaaggtgggaggaaacagcaaaggaac

SEQ ID NO: 177350 - DNA, 34 bp, Artificial Sequence
  Description of Artificial Sequence: Synthetic oligonucleotide
tcaatgtgaaggtgggaggaaacagcaaaggaac

SEQ ID NO: 177351 - DNA, 33 bp, Artificial Sequence
  Description of Artificial Sequence: Synthetic oligonucleotide
caatgtgaaggtgggaggaaacagcaaaggaac

SEQ ID NO: 177352 - DNA, 33 bp, Artificial Sequence
  Description of Artificial Sequence: Synthetic oligonucleotide
aatgtgaaggtgggaggaaacagcaaaggaacc

SEQ ID NO: 177353 - DNA, 32 bp, Artificial Sequence
  Description of Artificial Sequence: Synthetic oligonucleotide
atgtgaaggtgggaggaaacagcaaaggaacc

SEQ ID NO: 177354 - DNA, 31 bp, Artificial Sequence
  Description of Artificial Sequence: Synthetic oligonucleotide
tgtgaaggtgggaggaaacagcaaaggaacc

SEQ ID NO: 177355 - DNA, 30 bp, Artificial Sequence
  Description of Artificial Sequence: Synthetic oligonucleotide
gtgaaggtgggaggaaacagcaaaggaacc

SEQ ID NO: 177356 - DNA, 30 bp, Artificial Sequence
  Description of Artificial Sequence: Synthetic oligonucleotide
tgaaggtgggaggaaacagcaaaggaaccc

SEQ ID NO: 177357 - DNA, 29 bp, Artificial Sequence
  Description of Artificial Sequence: Synthetic oligonucleotide
gaaggtgggaggaaacagcaaaggaaccc

SEQ ID NO: 177358 - DNA, 30 bp, Artificial Sequence
  Description of Artificial Sequence: Synthetic oligonucleotide
aaggtgggaggaaacagcaaaggaaccctg

SEQ ID NO: 177359 - DNA, 29 bp, Artificial Sequence
  Description of Artificial Sequence: Synthetic oligonucleotide
aggtgggaggaaacagcaaaggaaccctg

SEQ ID NO: 177360 - DNA, 28 bp, Artificial Sequence
  Description of Artificial Sequence: Synthetic oligonucleotide
ggtgggaggaaacagcaaaggaaccctg

SEQ ID NO: 177361 - DNA, 30 bp, Artificial Sequence
  Description of Artificial Sequence: Synthetic oligonucleotide
gtgggaggaaacagcaaaggaaccctgaag

SEQ ID NO: 177362 - DNA, 30 bp, Artificial Sequence
  Description of Artificial Sequence: Synthetic oligonucleotide
tgggaggaaacagcaaaggaaccctgaagg

SEQ ID NO: 177363 - DNA, 29 bp, Artificial Sequence
  Description of Artificial Sequence: Synthetic oligonucleotide
gggaggaaacagcaaaggaaccctgaagg

SEQ ID NO: 177364 - DNA, 30 bp, Artificial Sequence
  Description of Artificial Sequence: Synthetic oligonucleotide
ggaggaaacagcaaaggaaccctgaaggtc

SEQ ID NO: 177365 - DNA, 30 bp, Artificial Sequence
  Description of Artificial Sequence: Synthetic oligonucleotide
gaggaaacagcaaaggaaccctgaaggtcc

SEQ ID NO: 177366 - DNA, 32 bp, Artificial Sequence
  Description of Artificial Sequence: Synthetic oligonucleotide
aggaaacagcaaaggaaccctgaaggtccttc

SEQ ID NO: 177367 - DNA, 31 bp, Artificial Sequence
  Description of Artificial Sequence: Synthetic oligonucleotide
ggaaacagcaaaggaaccctgaaggtccttc

SEQ ID NO: 177368 - DNA, 31 bp, Artificial Sequence
  Description of Artificial Sequence: Synthetic oligonucleotide
gaaacagcaaaggaaccctgaaggtccttcg

SEQ ID NO: 177369 - DNA, 33 bp, Artificial Sequence
  Description of Artificial Sequence: Synthetic oligonucleotide
aaacagcaaaggaaccctgaaggtccttcgtac

SEQ ID NO: 177370 - DNA, 32 bp, Artificial Sequence
  Description of Artificial Sequence: Synthetic oligonucleotide
aacagcaaaggaaccctgaaggtccttcgtac

SEQ ID NO: 177371 - DNA, 31 bp, Artificial Sequence
  Description of Artificial Sequence: Synthetic oligonucleotide
acagcaaaggaaccctgaaggtccttcgtac

SEQ ID NO: 177372 - DNA, 30 bp, Artificial Sequence
  Description of Artificial Sequence: Synthetic oligonucleotide
cagcaaaggaaccctgaaggtccttcgtac

SEQ ID NO: 177373 - DNA, 30 bp, Artificial Sequence
  Description of Artificial Sequence: Synthetic oligonucleotide
agcaaaggaaccctgaaggtccttcgtacc

SEQ ID NO: 177374 - DNA, 29 bp, Artificial Sequence
  Description of Artificial Sequence: Synthetic oligonucleotide
gcaaaggaaccctgaaggtccttcgtacc

SEQ ID NO: 177375 - DNA, 31 bp, Artificial Sequence
  Description of Artificial Sequence: Synthetic oligonucleotide
caaaggaaccctgaaggtccttcgtacctac

SEQ ID NO: 177376 - DNA, 34 bp, Artificial Sequence
  Description of Artificial Sequence: Synthetic oligonucleotide
aaaggaaccctgaaggtccttcgtacctacaatg

SEQ ID NO: 177377 - DNA, 33 bp, Artificial Sequence
  Description of Artificial Sequence: Synthetic oligonucleotide
aaggaaccctgaaggtccttcgtacctacaatg

SEQ ID NO: 177378 - DNA, 32 bp, Artificial Sequence
  Description of Artificial Sequence: Synthetic oligonucleotide
aggaaccctgaaggtccttcgtacctacaatg

SEQ ID NO: 177379 - DNA, 31 bp, Artificial Sequence
  Description of Artificial Sequence: Synthetic oligonucleotide
ggaaccctgaaggtccttcgtacctacaatg

SEQ ID NO: 177380 - DNA, 32 bp, Artificial Sequence
  Description of Artificial Sequence: Synthetic oligonucleotide
gaaccctgaaggtccttcgtacctacaatgtc

SEQ ID NO: 177381 - DNA, 32 bp, Artificial Sequence
  Description of Artificial Sequence: Synthetic oligonucleotide
aaccctgaaggtccttcgtacctacaatgtcc

SEQ ID NO: 177382 - DNA, 31 bp, Artificial Sequence
  Description of Artificial Sequence: Synthetic oligonucleotide
accctgaaggtccttcgtacctacaatgtcc

SEQ ID NO: 177383 - DNA, 30 bp, Artificial Sequence
  Description of Artificial Sequence: Synthetic oligonucleotide
ccctgaaggtccttcgtacctacaatgtcc

SEQ ID NO: 177384 - DNA, 31 bp, Artificial Sequence
  Description of Artificial Sequence: Synthetic oligonucleotide
cctgaaggtccttcgtacctacaatgtcctg

SEQ ID NO: 177385 - DNA, 31 bp, Artificial Sequence
  Description of Artificial Sequence: Synthetic oligonucleotide
ctgaaggtccttcgtacctacaatgtcctgg

SEQ ID NO: 177386 - DNA, 32 bp, Artificial Sequence
  Description of Artificial Sequence: Synthetic oligonucleotide
tgaaggtccttcgtacctacaatgtcctggac

SEQ ID NO: 177387 - DNA, 31 bp, Artificial Sequence
  Description of Artificial Sequence: Synthetic oligonucleotide
gaaggtccttcgtacctacaatgtcctggac

SEQ ID NO: 177388 - DNA, 33 bp, Artificial Sequence
  Description of Artificial Sequence: Synthetic oligonucleotide
aaggtccttcgtacctacaatgtcctggacatg

SEQ ID NO: 177389 - DNA, 32 bp, Artificial Sequence
  Description of Artificial Sequence: Synthetic oligonucleotide
aggtccttcgtacctacaatgtcctggacatg

SEQ ID NO: 177390 - DNA, 31 bp, Artificial Sequence
  Description of Artificial Sequence: Synthetic oligonucleotide
ggtccttcgtacctacaatgtcctggacatg

SEQ ID NO: 177391 - DNA, 33 bp, Artificial Sequence
  Description of Artificial Sequence: Synthetic oligonucleotide
gtccttcgtacctacaatgtcctggacatgaag

SEQ ID NO: 177392 - DNA, 35 bp, Artificial Sequence
  Description of Artificial Sequence: Synthetic oligonucleotide
tccttcgtacctacaatgtcctggacatgaagaac

SEQ ID NO: 177393 - DNA, 34 bp, Artificial Sequence
  Description of Artificial Sequence: Synthetic oligonucleotide
ccttcgtacctacaatgtcctggacatgaagaac

SEQ ID NO: 177394 - DNA, 35 bp, Artificial Sequence
  Description of Artificial Sequence: Synthetic oligonucleotide
cttcgtacctacaatgtcctggacatgaagaacac

SEQ ID NO: 177395 - DNA, 35 bp, Artificial Sequence
  Description of Artificial Sequence: Synthetic oligonucleotide
ttcgtacctacaatgtcctggacatgaagaacacg

SEQ ID NO: 177396 - DNA, 34 bp, Artificial Sequence
  Description of Artificial Sequence: Synthetic oligonucleotide
tcgtacctacaatgtcctggacatgaagaacacg

SEQ ID NO: 177397 - DNA, 33 bp, Artificial Sequence
  Description of Artificial Sequence: Synthetic oligonucleotide
cgtacctacaatgtcctggacatgaagaacacg

SEQ ID NO: 177398 - DNA, 34 bp, Artificial Sequence
  Description of Artificial Sequence: Synthetic oligonucleotide
gtacctacaatgtcctggacatgaagaacacgac

SEQ ID NO: 177399 - DNA, 34 bp, Artificial Sequence
  Description of Artificial Sequence: Synthetic oligonucleotide
tacctacaatgtcctggacatgaagaacacgacc

SEQ ID NO: 177400 - DNA, 33 bp, Artificial Sequence
  Description of Artificial Sequence: Synthetic oligonucleotide
acctacaatgtcctggacatgaagaacacgacc

SEQ ID NO: 177401 - DNA, 32 bp, Artificial Sequence
  Description of Artificial Sequence: Synthetic oligonucleotide
cctacaatgtcctggacatgaagaacacgacc

SEQ ID NO: 177402 - DNA, 33 bp, Artificial Sequence
  Description of Artificial Sequence: Synthetic oligonucleotide
ctacaatgtcctggacatgaagaacacgacctg

SEQ ID NO: 177403 - DNA, 33 bp, Artificial Sequence
  Description of Artificial Sequence: Synthetic oligonucleotide
tacaatgtcctggacatgaagaacacgacctgc

SEQ ID NO: 177404 - DNA, 32 bp, Artificial Sequence
  Description of Artificial Sequence: Synthetic oligonucleotide
acaatgtcctggacatgaagaacacgacctgc

SEQ ID NO: 177405 - DNA, 31 bp, Artificial Sequence
  Description of Artificial Sequence: Synthetic oligonucleotide
caatgtcctggacatgaagaacacgacctgc

SEQ ID NO: 177406 - DNA, 31 bp, Artificial Sequence
  Description of Artificial Sequence: Synthetic oligonucleotide
aatgtcctggacatgaagaacacgacctgcc

SEQ ID NO: 177407 - DNA, 30 bp, Artificial Sequence
  Description of Artificial Sequence: Synthetic oligonucleotide
atgtcctggacatgaagaacacgacctgcc

SEQ ID NO: 177408 - DNA, 29 bp, Artificial Sequence
  Description of Artificial Sequence: Synthetic oligonucleotide
tgtcctggacatgaagaacacgacctgcc

SEQ ID NO: 177409 - DNA, 28 bp, Artificial Sequence
  Description of Artificial Sequence: Synthetic oligonucleotide
gtcctggacatgaagaacacgacctgcc

SEQ ID NO: 177410 - DNA, 29 bp, Artificial Sequence
  Description of Artificial Sequence: Synthetic oligonucleotide
tcctggacatgaagaacacgacctgccag

SEQ ID NO: 177411 - DNA, 28 bp, Artificial Sequence
  Description of Artificial Sequence: Synthetic oligonucleotide
cctggacatgaagaacacgacctgccag

SEQ ID NO: 177412 - DNA, 28 bp, Artificial Sequence
  Description of Artificial Sequence: Synthetic oligonucleotide
ctggacatgaagaacacgacctgccagg

SEQ ID NO: 177413 - DNA, 29 bp, Artificial Sequence
  Description of Artificial Sequence: Synthetic oligonucleotide
tggacatgaagaacacgacctgccaggac

SEQ ID NO: 177414 - DNA, 28 bp, Artificial Sequence
  Description of Artificial Sequence: Synthetic oligonucleotide
ggacatgaagaacacgacctgccaggac

SEQ ID NO: 177415 - DNA, 28 bp, Artificial Sequence
  Description of Artificial Sequence: Synthetic oligonucleotide
gacatgaagaacacgacctgccaggacc

SEQ ID NO: 177416 - DNA, 30 bp, Artificial Sequence
  Description of Artificial Sequence: Synthetic oligonucleotide
acatgaagaacacgacctgccaggacctac

SEQ ID NO: 177417 - DNA, 29 bp, Artificial Sequence
  Description of Artificial Sequence: Synthetic oligonucleotide
catgaagaacacgacctgccaggacctac

SEQ ID NO: 177418 - DNA, 30 bp, Artificial Sequence
  Description of Artificial Sequence: Synthetic oligonucleotide
atgaagaacacgacctgccaggacctacag

SEQ ID NO: 177419 - DNA, 29 bp, Artificial Sequence
  Description of Artificial Sequence: Synthetic oligonucleotide
tgaagaacacgacctgccaggacctacag

SEQ ID NO: 177420 - DNA, 28 bp, Artificial Sequence
  Description of Artificial Sequence: Synthetic oligonucleotide
gaagaacacgacctgccaggacctacag

SEQ ID NO: 177421 - DNA, 31 bp, Artificial Sequence
  Description of Artificial Sequence: Synthetic oligonucleotide
aagaacacgacctgccaggacctacagatag

SEQ ID NO: 177422 - DNA, 30 bp, Artificial Sequence
  Description of Artificial Sequence: Synthetic oligonucleotide
agaacacgacctgccaggacctacagatag

SEQ ID NO: 177423 - DNA, 29 bp, Artificial Sequence
  Description of Artificial Sequence: Synthetic oligonucleotide
gaacacgacctgccaggacctacagatag

SEQ ID NO: 177424 - DNA, 31 bp, Artificial Sequence
  Description of Artificial Sequence: Synthetic oligonucleotide
aacacgacctgccaggacctacagatagaag

SEQ ID NO: 177425 - DNA, 30 bp, Artificial Sequence
  Description of Artificial Sequence: Synthetic oligonucleotide
acacgacctgccaggacctacagatagaag

SEQ ID NO: 177426 - DNA, 29 bp, Artificial Sequence
  Description of Artificial Sequence: Synthetic oligonucleotide
cacgacctgccaggacctacagatagaag

SEQ ID NO: 177427 - DNA, 30 bp, Artificial Sequence
  Description of Artificial Sequence: Synthetic oligonucleotide
acgacctgccaggacctacagatagaagtg

SEQ ID NO: 177428 - DNA, 29 bp, Artificial Sequence
  Description of Artificial Sequence: Synthetic oligonucleotide
cgacctgccaggacctacagatagaagtg

SEQ ID NO: 177429 - DNA, 30 bp, Artificial Sequence
  Description of Artificial Sequence: Synthetic oligonucleotide
gacctgccaggacctacagatagaagtgac

SEQ ID NO: 177430 - DNA, 31 bp, Artificial Sequence
  Description of Artificial Sequence: Synthetic oligonucleotide
acctgccaggacctacagatagaagtgacag

SEQ ID NO: 177431 - DNA, 30 bp, Artificial Sequence
  Description of Artificial Sequence: Synthetic oligonucleotide
cctgccaggacctacagatagaagtgacag

SEQ ID NO: 177432 - DNA, 31 bp, Artificial Sequence
  Description of Artificial Sequence: Synthetic oligonucleotide
ctgccaggacctacagatagaagtgacagtc

SEQ ID NO: 177433 - DNA, 34 bp, Artificial Sequence
  Description of Artificial Sequence: Synthetic oligonucleotide
tgccaggacctacagatagaagtgacagtcaaag

SEQ ID NO: 177434 - DNA, 33 bp, Artificial Sequence
  Description of Artificial Sequence: Synthetic oligonucleotide
gccaggacctacagatagaagtgacagtcaaag

SEQ ID NO: 177435 - DNA, 33 bp, Artificial Sequence
  Description of Artificial Sequence: Synthetic oligonucleotide
ccaggacctacagatagaagtgacagtcaaagg

SEQ ID NO: 177436 - DNA, 33 bp, Artificial Sequence
  Description of Artificial Sequence: Synthetic oligonucleotide
caggacctacagatagaagtgacagtcaaaggc

SEQ ID NO: 177437 - DNA, 33 bp, Artificial Sequence
  Description of Artificial Sequence: Synthetic oligonucleotide
aggacctacagatagaagtgacagtcaaaggcc

SEQ ID NO: 177438 - DNA, 32 bp, Artificial Sequence
  Description of Artificial Sequence: Synthetic oligonucleotide
ggacctacagatagaagtgacagtcaaaggcc

SEQ ID NO: 177439 - DNA, 33 bp, Artificial Sequence
  Description of Artificial Sequence: Synthetic oligonucleotide
gacctacagatagaagtgacagtcaaaggccac

SEQ ID NO: 177440 - DNA, 33 bp, Artificial Sequence
  Description of Artificial Sequence: Synthetic oligonucleotide
acctacagatagaagtgacagtcaaaggccacg

SEQ ID NO: 177441 - DNA, 32 bp, Artificial Sequence
  Description of Artificial Sequence: Synthetic oligonucleotide
cctacagatagaagtgacagtcaaaggccacg

SEQ ID NO: 177442 - DNA, 33 bp, Artificial Sequence
  Description of Artificial Sequence: Synthetic oligonucleotide
ctacagatagaagtgacagtcaaaggccacgtc

SEQ ID NO: 177443 - DNA, 33 bp, Artificial Sequence
  Description of Artificial Sequence: Synthetic oligonucleotide
tacagatagaagtgacagtcaaaggccacgtcg

SEQ ID NO: 177444 - DNA, 32 bp, Artificial Sequence
  Description of Artificial Sequence: Synthetic oligonucleotide
acagatagaagtgacagtcaaaggccacgtcg

SEQ ID NO: 177445 - DNA, 31 bp, Artificial Sequence
  Description of Artificial Sequence: Synthetic oligonucleotide
cagatagaagtgacagtcaaaggccacgtcg

SEQ ID NO: 177446 - DNA, 32 bp, Artificial Sequence
  Description of Artificial Sequence: Synthetic oligonucleotide
agatagaagtgacagtcaaaggccacgtcgag

SEQ ID NO: 177447 - DNA, 31 bp, Artificial Sequence
  Description of Artificial Sequence: Synthetic oligonucleotide
gatagaagtgacagtcaaaggccacgtcgag

SEQ ID NO: 177448 - DNA, 33 bp, Artificial Sequence
  Description of Artificial Sequence: Synthetic oligonucleotide
atagaagtgacagtcaaaggccacgtcgagtac

SEQ ID NO: 177449 - DNA, 32 bp, Artificial Sequence
  Description of Artificial Sequence: Synthetic oligonucleotide
tagaagtgacagtcaaaggccacgtcgagtac

SEQ ID NO: 177450 - DNA, 31 bp, Artificial Sequence
  Description of Artificial Sequence: Synthetic oligonucleotide
agaagtgacagtcaaaggccacgtcgagtac

SEQ ID NO: 177451 - DNA, 30 bp, Artificial Sequence
  Description of Artificial Sequence: Synthetic oligonucleotide
gaagtgacagtcaaaggccacgtcgagtac

SEQ ID NO: 177452 - DNA, 31 bp, Artificial Sequence
  Description of Artificial Sequence: Synthetic oligonucleotide
aagtgacagtcaaaggccacgtcgagtacac

SEQ ID NO: 177453 - DNA, 30 bp, Artificial Sequence
  Description of Artificial Sequence: Synthetic oligonucleotide
agtgacagtcaaaggccacgtcgagtacac

SEQ ID NO: 177454 - DNA, 29 bp, Artificial Sequence
  Description of Artificial Sequence: Synthetic oligonucleotide
gtgacagtcaaaggccacgtcgagtacac

SEQ ID NO: 177455 - DNA, 29 bp, Artificial Sequence
  Description of Artificial Sequence: Synthetic oligonucleotide
tgacagtcaaaggccacgtcgagtacacg

SEQ ID NO: 177456 - DNA, 28 bp, Artificial Sequence
  Description of Artificial Sequence: Synthetic oligonucleotide
gacagtcaaaggccacgtcgagtacacg

SEQ ID NO: 177457 - DNA, 30 bp, Artificial Sequence
  Description of Artificial Sequence: Synthetic oligonucleotide
acagtcaaaggccacgtcgagtacacgatg

SEQ ID NO: 177458 - DNA, 29 bp, Artificial Sequence
  Description of Artificial Sequence: Synthetic oligonucleotide
cagtcaaaggccacgtcgagtacacgatg

SEQ ID NO: 177459 - DNA, 29 bp, Artificial Sequence
  Description of Artificial Sequence: Synthetic oligonucleotide
agtcaaaggccacgtcgagtacacgatgg

SEQ ID NO: 177460 - DNA, 28 bp, Artificial Sequence
  Description of Artificial Sequence: Synthetic oligonucleotide
gtcaaaggccacgtcgagtacacgatgg

SEQ ID NO: 177461 - DNA, 30 bp, Artificial Sequence
  Description of Artificial Sequence: Synthetic oligonucleotide
tcaaaggccacgtcgagtacacgatggaag

SEQ ID NO: 177462 - DNA, 29 bp, Artificial Sequence
  Description of Artificial Sequence: Synthetic oligonucleotide
caaaggccacgtcgagtacacgatggaag

SEQ ID NO: 177463 - DNA, 29 bp, Artificial Sequence
  Description of Artificial Sequence: Synthetic oligonucleotide
aaaggccacgtcgagtacacgatggaagc

SEQ ID NO: 177464 - DNA, 28 bp, Artificial Sequence
  Description of Artificial Sequence: Synthetic oligonucleotide
aaggccacgtcgagtacacgatggaagc

SEQ ID NO: 177465 - DNA, 27 bp, Artificial Sequence
  Description of Artificial Sequence: Synthetic oligonucleotide
aggccacgtcgagtacacgatggaagc

SEQ ID NO: 177466 - DNA, 27 bp, Artificial Sequence
  Description of Artificial Sequence: Synthetic oligonucleotide
ggccacgtcgagtacacgatggaagca

SEQ ID NO: 177467 - DNA, 29 bp, Artificial Sequence
  Description of Artificial Sequence: Synthetic oligonucleotide
gccacgtcgagtacacgatggaagcaaac

SEQ ID NO: 177468 - DNA, 29 bp, Artificial Sequence
  Description of Artificial Sequence: Synthetic oligonucleotide
ccacgtcgagtacacgatggaagcaaacg

SEQ ID NO: 177469 - DNA, 30 bp, Artificial Sequence
  Description of Artificial Sequence: Synthetic oligonucleotide
cacgtcgagtacacgatggaagcaaacgag

SEQ ID NO: 177470 - DNA, 30 bp, Artificial Sequence
  Description of Artificial Sequence: Synthetic oligonucleotide
acgtcgagtacacgatggaagcaaacgagg

SEQ ID NO: 177471 - DNA, 29 bp, Artificial Sequence
  Description of Artificial Sequence: Synthetic oligonucleotide
cgtcgagtacacgatggaagcaaacgagg

SEQ ID NO: 177472 - DNA, 30 bp, Artificial Sequence
  Description of Artificial Sequence: Synthetic oligonucleotide
gtcgagtacacgatggaagcaaacgaggac

SEQ ID NO: 177473 - DNA, 33 bp, Artificial Sequence
  Description of Artificial Sequence: Synthetic oligonucleotide
tcgagtacacgatggaagcaaacgaggactatg

SEQ ID NO: 177474 - DNA, 32 bp, Artificial Sequence
  Description of Artificial Sequence: Synthetic oligonucleotide
cgagtacacgatggaagcaaacgaggactatg

SEQ ID NO: 177475 - DNA, 33 bp, Artificial Sequence
  Description of Artificial Sequence: Synthetic oligonucleotide
gagtacacgatggaagcaaacgaggactatgag

SEQ ID NO: 177476 - DNA, 33 bp, Artificial Sequence
  Description of Artificial Sequence: Synthetic oligonucleotide
agtacacgatggaagcaaacgaggactatgagg

SEQ ID NO: 177477 - DNA, 32 bp, Artificial Sequence
  Description of Artificial Sequence: Synthetic oligonucleotide
gtacacgatggaagcaaacgaggactatgagg

SEQ ID NO: 177478 - DNA, 33 bp, Artificial Sequence
  Description of Artificial Sequence: Synthetic oligonucleotide
tacacgatggaagcaaacgaggactatgaggac

SEQ ID NO: 177479 - DNA, 32 bp, Artificial Sequence
  Description of Artificial Sequence: Synthetic oligonucleotide
acacgatggaagcaaacgaggactatgaggac

SEQ ID NO: 177480 - DNA, 31 bp, Artificial Sequence
  Description of Artificial Sequence: Synthetic oligonucleotide
cacgatggaagcaaacgaggactatgaggac

SEQ ID NO: 177481 - DNA, 34 bp, Artificial Sequence
  Description of Artificial Sequence: Synthetic oligonucleotide
acgatggaagcaaacgaggactatgaggactatg

SEQ ID NO: 177482 - DNA, 33 bp, Artificial Sequence
  Description of Artificial Sequence: Synthetic oligonucleotide
cgatggaagcaaacgaggactatgaggactatg

SEQ ID NO: 177483 - DNA, 34 bp, Artificial Sequence
  Description of Artificial Sequence: Synthetic oligonucleotide
gatggaagcaaacgaggactatgaggactatgag

SEQ ID NO: 177484 - DNA, 36 bp, Artificial Sequence
  Description of Artificial Sequence: Synthetic oligonucleotide
atggaagcaaacgaggactatgaggactatgagtac

SEQ ID NO: 177485 - DNA, 35 bp, Artificial Sequence
  Description of Artificial Sequence: Synthetic oligonucleotide
tggaagcaaacgaggactatgaggactatgagtac

SEQ ID NO: 177486 - DNA, 34 bp, Artificial Sequence
  Description of Artificial Sequence: Synthetic oligonucleotide
ggaagcaaacgaggactatgaggactatgagtac

SEQ ID NO: 177487 - DNA, 34 bp, Artificial Sequence
  Description of Artificial Sequence: Synthetic oligonucleotide
gaagcaaacgaggactatgaggactatgagtacg

SEQ ID NO: 177488 - DNA, 36 bp, Artificial Sequence
  Description of Artificial Sequence: Synthetic oligonucleotide
aagcaaacgaggactatgaggactatgagtacgatg

SEQ ID NO: 177489 - DNA, 35 bp, Artificial Sequence
  Description of Artificial Sequence: Synthetic oligonucleotide
agcaaacgaggactatgaggactatgagtacgatg

SEQ ID NO: 177490 - DNA, 34 bp, Artificial Sequence
  Description of Artificial Sequence: Synthetic oligonucleotide
gcaaacgaggactatgaggactatgagtacgatg

SEQ ID NO: 177491 - DNA, 35 bp, Artificial Sequence
  Description of Artificial Sequence: Synthetic oligonucleotide
caaacgaggactatgaggactatgagtacgatgag

SEQ ID NO: 177492 - DNA, 35 bp, Artificial Sequence
  Description of Artificial Sequence: Synthetic oligonucleotide
aaacgaggactatgaggactatgagtacgatgagc

SEQ ID NO: 177493 - DNA, 34 bp, Artificial Sequence
  Description of Artificial Sequence: Synthetic oligonucleotide
aacgaggactatgaggactatgagtacgatgagc

SEQ ID NO: 177494 - DNA, 33 bp, Artificial Sequence
  Description of Artificial Sequence: Synthetic oligonucleotide
acgaggactatgaggactatgagtacgatgagc

SEQ ID NO: 177495 - DNA, 32 bp, Artificial Sequence
  Description of Artificial Sequence: Synthetic oligonucleotide
cgaggactatgaggactatgagtacgatgagc

SEQ ID NO: 177496 - DNA, 34 bp, Artificial Sequence
  Description of Artificial Sequence: Synthetic oligonucleotide
gaggactatgaggactatgagtacgatgagcttc

SEQ ID NO: 177497 - DNA, 34 bp, Artificial Sequence
  Description of Artificial Sequence: Synthetic oligonucleotide
aggactatgaggactatgagtacgatgagcttcc

SEQ ID NO: 177498 - DNA, 33 bp, Artificial Sequence
  Description of Artificial Sequence: Synthetic oligonucleotide
ggactatgaggactatgagtacgatgagcttcc

SEQ ID NO: 177499 - DNA, 34 bp, Artificial Sequence
  Description of Artificial Sequence: Synthetic oligonucleotide
gactatgaggactatgagtacgatgagcttccag

SEQ ID NO: 177500 - DNA, 34 bp, Artificial Sequence
  Description of Artificial Sequence: Synthetic oligonucleotide
actatgaggactatgagtacgatgagcttccagc

SEQ ID NO: 177501 - DNA, 33 bp, Artificial Sequence
  Description of Artificial Sequence: Synthetic oligonucleotide
ctatgaggactatgagtacgatgagcttccagc

SEQ ID NO: 177502 - DNA, 33 bp, Artificial Sequence
  Description of Artificial Sequence: Synthetic oligonucleotide
tatgaggactatgagtacgatgagcttccagcc

SEQ ID NO: 177503 - DNA, 32 bp, Artificial Sequence
  Description of Artificial Sequence: Synthetic oligonucleotide
atgaggactatgagtacgatgagcttccagcc

SEQ ID NO: 177504 - DNA, 31 bp, Artificial Sequence
  Description of Artificial Sequence: Synthetic oligonucleotide
tgaggactatgagtacgatgagcttccagcc

SEQ ID NO: 177505 - DNA, 30 bp, Artificial Sequence
  Description of Artificial Sequence: Synthetic oligonucleotide
gaggactatgagtacgatgagcttccagcc

SEQ ID NO: 177506 - DNA, 32 bp, Artificial Sequence
  Description of Artificial Sequence: Synthetic oligonucleotide
aggactatgagtacgatgagcttccagccaag

SEQ ID NO: 177507 - DNA, 31 bp, Artificial Sequence
  Description of Artificial Sequence: Synthetic oligonucleotide
ggactatgagtacgatgagcttccagccaag

SEQ ID NO: 177508 - DNA, 31 bp, Artificial Sequence
  Description of Artificial Sequence: Synthetic oligonucleotide
gactatgagtacgatgagcttccagccaagg

SEQ ID NO: 177509 - DNA, 33 bp, Artificial Sequence
  Description of Artificial Sequence: Synthetic oligonucleotide
actatgagtacgatgagcttccagccaaggatg

SEQ ID NO: 177510 - DNA, 32 bp, Artificial Sequence
  Description of Artificial Sequence: Synthetic oligonucleotide
ctatgagtacgatgagcttccagccaaggatg

SEQ ID NO: 177511 - DNA, 33 bp, Artificial Sequence
  Description of Artificial Sequence: Synthetic oligonucleotide
tatgagtacgatgagcttccagccaaggatgac

SEQ ID NO: 177512 - DNA, 32 bp, Artificial Sequence
  Description of Artificial Sequence: Synthetic oligonucleotide
atgagtacgatgagcttccagccaaggatgac

SEQ ID NO: 177513 - DNA, 31 bp, Artificial Sequence
  Description of Artificial Sequence: Synthetic oligonucleotide
tgagtacgatgagcttccagccaaggatgac

SEQ ID NO: 177514 - DNA, 30 bp, Artificial Sequence
  Description of Artificial Sequence: Synthetic oligonucleotide
gagtacgatgagcttccagccaaggatgac

SEQ ID NO: 177515 - DNA, 30 bp, Artificial Sequence
  Description of Artificial Sequence: Synthetic oligonucleotide
agtacgatgagcttccagccaaggatgacc

SEQ ID NO: 177516 - DNA, 29 bp, Artificial Sequence
  Description of Artificial Sequence: Synthetic oligonucleotide
gtacgatgagcttccagccaaggatgacc

SEQ ID NO: 177517 - DNA, 29 bp, Artificial Sequence
  Description of Artificial Sequence: Synthetic oligonucleotide
tacgatgagcttccagccaaggatgaccc

SEQ ID NO: 177518 - DNA, 28 bp, Artificial Sequence
  Description of Artificial Sequence: Synthetic oligonucleotide
acgatgagcttccagccaaggatgaccc

SEQ ID NO: 177519 - DNA, 27 bp, Artificial Sequence
  Description of Artificial Sequence: Synthetic oligonucleotide
cgatgagcttccagccaaggatgaccc

SEQ ID NO: 177520 - DNA, 28 bp, Artificial Sequence
  Description of Artificial Sequence: Synthetic oligonucleotide
gatgagcttccagccaaggatgacccag

SEQ ID NO: 177521 - DNA, 30 bp, Artificial Sequence
  Description of Artificial Sequence: Synthetic oligonucleotide
atgagcttccagccaaggatgacccagatg

SEQ ID NO: 177522 - DNA, 29 bp, Artificial Sequence
  Description of Artificial Sequence: Synthetic oligonucleotide
tgagcttccagccaaggatgacccagatg

SEQ ID NO: 177523 - DNA, 28 bp, Artificial Sequence
  Description of Artificial Sequence: Synthetic oligonucleotide
gagcttccagccaaggatgacccagatg

SEQ ID NO: 177524 - DNA, 28 bp, Artificial Sequence
  Description of Artificial Sequence: Synthetic oligonucleotide
agcttccagccaaggatgacccagatgc

SEQ ID NO: 177525 - DNA, 27 bp, Artificial Sequence
  Description of Artificial Sequence: Synthetic oligonucleotide
gcttccagccaaggatgacccagatgc

SEQ ID NO: 177526 - DNA, 27 bp, Artificial Sequence
  Description of Artificial Sequence: Synthetic oligonucleotide
cttccagccaaggatgacccagatgcc

SEQ ID NO: 177527 - DNA, 27 bp, Artificial Sequence
  Description of Artificial Sequence: Synthetic oligonucleotide
ttccagccaaggatgacccagatgccc

SEQ ID NO: 177528 - DNA, 26 bp, Artificial Sequence
  Description of Artificial Sequence: Synthetic oligonucleotide
tccagccaaggatgacccagatgccc

SEQ ID NO: 177529 - DNA, 25 bp, Artificial Sequence
  Description of Artificial Sequence: Synthetic oligonucleotide
ccagccaaggatgacccagatgccc

SEQ ID NO: 177530 - DNA, 26 bp, Artificial Sequence
  Description of Artificial Sequence: Synthetic oligonucleotide
cagccaaggatgacccagatgcccct

SEQ ID NO: 177531 - DNA, 27 bp, Artificial Sequence
  Description of Artificial Sequence: Synthetic oligonucleotide
agccaaggatgacccagatgcccctct

SEQ ID NO: 177532 - DNA, 26 bp, Artificial Sequence
  Description of Artificial Sequence: Synthetic oligonucleotide
gccaaggatgacccagatgcccctct

SEQ ID NO: 177533 - DNA, 26 bp, Artificial Sequence
  Description of Artificial Sequence: Synthetic oligonucleotide
ccaaggatgacccagatgcccctctg

SEQ ID NO: 177534 - DNA, 27 bp, Artificial Sequence
  Description of Artificial Sequence: Synthetic oligonucleotide
caaggatgacccagatgcccctctgca

SEQ ID NO: 177535 - DNA, 27 bp, Artificial Sequence
  Description of Artificial Sequence: Synthetic oligonucleotide
aaggatgacccagatgcccctctgcag

SEQ ID NO: 177536 - DNA, 26 bp, Artificial Sequence
  Description of Artificial Sequence: Synthetic oligonucleotide
aggatgacccagatgcccctctgcag

SEQ ID NO: 177537 - DNA, 25 bp, Artificial Sequence
  Description of Artificial Sequence: Synthetic oligonucleotide
ggatgacccagatgcccctctgcag

SEQ ID NO: 177538 - DNA, 25 bp, Artificial Sequence
  Description of Artificial Sequence: Synthetic oligonucleotide
gatgacccagatgcccctctgcagc

SEQ ID NO: 177539 - DNA, 25 bp, Artificial Sequence
  Description of Artificial Sequence: Synthetic oligonucleotide
atgacccagatgcccctctgcagcc

SEQ ID NO: 177540 - DNA, 24 bp, Artificial Sequence
  Description of Artificial Sequence: Synthetic oligonucleotide
tgacccagatgcccctctgcagcc

SEQ ID NO: 177541 - DNA, 23 bp, Artificial Sequence
  Description of Artificial Sequence: Synthetic oligonucleotide
gacccagatgcccctctgcagcc

SEQ ID NO: 177542 - DNA, 23 bp, Artificial Sequence
  Description of Artificial Sequence: Synthetic oligonucleotide
acccagatgcccctctgcagccc

SEQ ID NO: 177543 - DNA, 22 bp, Artificial Sequence
  Description of Artificial Sequence: Synthetic oligonucleotide
cccagatgcccctctgcagccc

SEQ ID NO: 177544 - DNA, 23 bp, Artificial Sequence
  Description of Artificial Sequence: Synthetic oligonucleotide
ccagatgcccctctgcagcccgt

SEQ ID NO: 177545 - DNA, 24 bp, Artificial Sequence
  Description of Artificial Sequence: Synthetic oligonucleotide
cagatgcccctctgcagcccgtga

SEQ ID NO: 177546 - DNA, 25 bp, Artificial Sequence
  Description of Artificial Sequence: Synthetic oligonucleotide
agatgcccctctgcagcccgtgaca

SEQ ID NO: 177547 - DNA, 24 bp, Artificial Sequence
  Description of Artificial Sequence: Synthetic oligonucleotide
gatgcccctctgcagcccgtgaca

SEQ ID NO: 177548 - DNA, 24 bp, Artificial Sequence
  Description of Artificial Sequence: Synthetic oligonucleotide
atgcccctctgcagcccgtgacac

SEQ ID NO: 177549 - DNA, 23 bp, Artificial Sequence
  Description of Artificial Sequence: Synthetic oligonucleotide
tgcccctctgcagcccgtgacac

SEQ ID NO: 177550 - DNA, 22 bp, Artificial Sequence
  Description of Artificial Sequence: Synthetic oligonucleotide
gcccctctgcagcccgtgacac

SEQ ID NO: 177551 - DNA, 22 bp, Artificial Sequence
  Description of Artificial Sequence: Synthetic oligonucleotide
cccctctgcagcccgtgacacc

SEQ ID NO: 177552 - DNA, 22 bp, Artificial Sequence
  Description of Artificial Sequence: Synthetic oligonucleotide
ccctctgcagcccgtgacaccc

SEQ ID NO: 177553 - DNA, 23 bp, Artificial Sequence
  Description of Artificial Sequence: Synthetic oligonucleotide
cctctgcagcccgtgacacccct

SEQ ID NO: 177554 - DNA, 23 bp, Artificial Sequence
  Description of Artificial Sequence: Synthetic oligonucleotide
ctctgcagcccgtgacacccctg

SEQ ID NO: 177555 - DNA, 24 bp, Artificial Sequence
  Description of Artificial Sequence: Synthetic oligonucleotide
tctgcagcccgtgacacccctgca

SEQ ID NO: 177556 - DNA, 23 bp, Artificial Sequence
  Description of Artificial Sequence: Synthetic oligonucleotide
ctgcagcccgtgacacccctgca

SEQ ID NO: 177557 - DNA, 23 bp, Artificial Sequence
  Description of Artificial Sequence: Synthetic oligonucleotide
tgcagcccgtgacacccctgcag

SEQ ID NO: 177558 - DNA, 22 bp, Artificial Sequence
  Description of Artificial Sequence: Synthetic oligonucleotide
gcagcccgtgacacccctgcag

SEQ ID NO: 177559 - DNA, 23 bp, Artificial Sequence
  Description of Artificial Sequence: Synthetic oligonucleotide
cagcccgtgacacccctgcagct

SEQ ID NO: 177560 - DNA, 26 bp, Artificial Sequence
  Description of Artificial Sequence: Synthetic oligonucleotide
agcccgtgacacccctgcagctgttt

SEQ ID NO: 177561 - DNA, 25 bp, Artificial Sequence
  Description of Artificial Sequence: Synthetic oligonucleotide
gcccgtgacacccctgcagctgttt

SEQ ID NO: 177562 - DNA, 26 bp, Artificial Sequence
  Description of Artificial Sequence: Synthetic oligonucleotide
cccgtgacacccctgcagctgtttga

SEQ ID NO: 177563 - DNA, 26 bp, Artificial Sequence
  Description of Artificial Sequence: Synthetic oligonucleotide
ccgtgacacccctgcagctgtttgag

SEQ ID NO: 177564 - DNA, 26 bp, Artificial Sequence
  Description of Artificial Sequence: Synthetic oligonucleotide
cgtgacacccctgcagctgtttgagg

SEQ ID NO: 177565 - DNA, 27 bp, Artificial Sequence
  Description of Artificial Sequence: Synthetic oligonucleotide
gtgacacccctgcagctgtttgagggt

SEQ ID NO: 177566 - DNA, 27 bp, Artificial Sequence
  Description of Artificial Sequence: Synthetic oligonucleotide
tgacacccctgcagctgtttgagggtc

SEQ ID NO: 177567 - DNA, 26 bp, Artificial Sequence
  Description of Artificial Sequence: Synthetic oligonucleotide
gacacccctgcagctgtttgagggtc

SEQ ID NO: 177568 - DNA, 26 bp, Artificial Sequence
  Description of Artificial Sequence: Synthetic oligonucleotide
acacccctgcagctgtttgagggtcg

SEQ ID NO: 177569 - DNA, 25 bp, Artificial Sequence
  Description of Artificial Sequence: Synthetic oligonucleotide
cacccctgcagctgtttgagggtcg

SEQ ID NO: 177570 - DNA, 26 bp, Artificial Sequence
  Description of Artificial Sequence: Synthetic oligonucleotide
acccctgcagctgtttgagggtcgga

SEQ ID NO: 177571 - DNA, 25 bp, Artificial Sequence
  Description of Artificial Sequence: Synthetic oligonucleotide
cccctgcagctgtttgagggtcgga

SEQ ID NO: 177572 - DNA, 25 bp, Artificial Sequence
  Description of Artificial Sequence: Synthetic oligonucleotide
ccctgcagctgtttgagggtcggag

SEQ ID NO: 177573 - DNA, 27 bp, Artificial Sequence
  Description of Artificial Sequence: Synthetic oligonucleotide
cctgcagctgtttgagggtcggaggaa

SEQ ID NO: 177574 - DNA, 27 bp, Artificial Sequence
  Description of Artificial Sequence: Synthetic oligonucleotide
ctgcagctgtttgagggtcggaggaac

SEQ ID NO: 177575 - DNA, 27 bp, Artificial Sequence
  Description of Artificial Sequence: Synthetic oligonucleotide
tgcagctgtttgagggtcggaggaacc

SEQ ID NO: 177576 - DNA, 26 bp, Artificial Sequence
  Description of Artificial Sequence: Synthetic oligonucleotide
gcagctgtttgagggtcggaggaacc

SEQ ID NO: 177577 - DNA, 26 bp, Artificial Sequence
  Description of Artificial Sequence: Synthetic oligonucleotide
cagctgtttgagggtcggaggaaccg

SEQ ID NO: 177578 - DNA, 26 bp, Artificial Sequence
  Description of Artificial Sequence: Synthetic oligonucleotide
agctgtttgagggtcggaggaaccgc

SEQ ID NO: 177579 - DNA, 25 bp, Artificial Sequence
  Description of Artificial Sequence: Synthetic oligonucleotide
gctgtttgagggtcggaggaaccgc

SEQ ID NO: 177580 - DNA, 25 bp, Artificial Sequence
  Description of Artificial Sequence: Synthetic oligonucleotide
ctgtttgagggtcggaggaaccgcc

SEQ ID NO: 177581 - DNA, 25 bp, Artificial Sequence
  Description of Artificial Sequence: Synthetic oligonucleotide
tgtttgagggtcggaggaaccgccg

SEQ ID NO: 177582 - DNA, 24 bp, Artificial Sequence
  Description of Artificial Sequence: Synthetic oligonucleotide
gtttgagggtcggaggaaccgccg

SEQ ID NO: 177583 - DNA, 25 bp, Artificial Sequence
  Description of Artificial Sequence: Synthetic oligonucleotide
tttgagggtcggaggaaccgccgca

SEQ ID NO: 177584 - DNA, 24 bp, Artificial Sequence
  Description of Artificial Sequence: Synthetic oligonucleotide
ttgagggtcggaggaaccgccgca

SEQ ID NO: 177585 - DNA, 23 bp, Artificial Sequence
  Description of Artificial Sequence: Synthetic oligonucleotide
tgagggtcggaggaaccgccgca

SEQ ID NO: 177586 - DNA, 22 bp, Artificial Sequence
  Description of Artificial Sequence: Synthetic oligonucleotide
gagggtcggaggaaccgccgca

SEQ ID NO: 177587 - DNA, 22 bp, Artificial Sequence
  Description of Artificial Sequence: Synthetic oligonucleotide
agggtcggaggaaccgccgcag

SEQ ID NO: 177588 - DNA, 21 bp, Artificial Sequence
  Description of Artificial Sequence: Synthetic oligonucleotide
gggtcggaggaaccgccgcag

SEQ ID NO: 177589 - DNA, 22 bp, Artificial Sequence
  Description of Artificial Sequence: Synthetic oligonucleotide
ggtcggaggaaccgccgcagga

SEQ ID NO: 177590 - DNA, 22 bp, Artificial Sequence
  Description of Artificial Sequence: Synthetic oligonucleotide
gtcggaggaaccgccgcaggag

SEQ ID NO: 177591 - DNA, 22 bp, Artificial Sequence
  Description of Artificial Sequence: Synthetic oligonucleotide
tcggaggaaccgccgcaggagg

SEQ ID NO: 177592 - DNA, 21 bp, Artificial Sequence
  Description of Artificial Sequence: Synthetic oligonucleotide
cggaggaaccgccgcaggagg

SEQ ID NO: 177593 - DNA, 22 bp, Artificial Sequence
  Description of Artificial Sequence: Synthetic oligonucleotide
ggaggaaccgccgcaggaggga

SEQ ID NO: 177594 - DNA, 22 bp, Artificial Sequence
  Description of Artificial Sequence: Synthetic oligonucleotide
gaggaaccgccgcaggagggag

SEQ ID NO: 177595 - DNA, 22 bp, Artificial Sequence
  Description of Artificial Sequence: Synthetic oligonucleotide
aggaaccgccgcaggagggagg

SEQ ID NO: 177596 - DNA, 21 bp, Artificial Sequence
  Description of Artificial Sequence: Synthetic oligonucleotide
ggaaccgccgcaggagggagg

SEQ ID NO: 177597 - DNA, 21 bp, Artificial Sequence
  Description of Artificial Sequence: Synthetic oligonucleotide
gaaccgccgcaggagggaggc

SEQ ID NO: 177598 - DNA, 21 bp, Artificial Sequence
  Description of Artificial Sequence: Synthetic oligonucleotide
aaccgccgcaggagggaggcg

SEQ ID NO: 177599 - DNA, 20 bp, Artificial Sequence
  Description of Artificial Sequence: Synthetic oligonucleotide
accgccgcaggagggaggcg

SEQ ID NO: 177600 - DNA, 20 bp, Artificial Sequence
  Description of Artificial Sequence: Synthetic oligonucleotide
ccgccgcaggagggaggcgt

SEQ ID NO: 177601 - DNA, 20 bp, Artificial Sequence
  Description of Artificial Sequence: Synthetic oligonucleotide
cgccgcaggagggaggcgct

SEQ ID NO: 177602 - DNA, 20 bp, Artificial Sequence
  Description of Artificial Sequence: Synthetic oligonucleotide
gccgcaggagggaggcgcct

SEQ ID NO: 177603 - DNA, 21 bp, Artificial Sequence
  Description of Artificial Sequence: Synthetic oligonucleotide
ccgcaggagggaggcgcccaa

SEQ ID NO: 177604 - DNA, 21 bp, Artificial Sequence
  Description of Artificial Sequence: Synthetic oligonucleotide
cgcaggagggaggcgcccaag

SEQ ID NO: 177605 - DNA, 22 bp, Artificial Sequence
  Description of Artificial Sequence: Synthetic oligonucleotide
gcaggagggaggcgcccaaggt

SEQ ID NO: 177606 - DNA, 22 bp, Artificial Sequence
  Description of Artificial Sequence: Synthetic oligonucleotide
caggagggaggcgcccaaggtg

SEQ ID NO: 177607 - DNA, 23 bp, Artificial Sequence
  Description of Artificial Sequence: Synthetic oligonucleotide
aggagggaggcgcccaaggtggt

SEQ ID NO: 177608 - DNA, 22 bp, Artificial Sequence
  Description of Artificial Sequence: Synthetic oligonucleotide
ggagggaggcgcccaaggtggt

SEQ ID NO: 177609 - DNA, 22 bp, Artificial Sequence
  Description of Artificial Sequence: Synthetic oligonucleotide
gagggaggcgcccaaggtggtg

SEQ ID NO: 177610 - DNA, 23 bp, Artificial Sequence
  Description of Artificial Sequence: Synthetic oligonucleotide
agggaggcgcccaaggtggtgga

SEQ ID NO: 177611 - DNA, 22 bp, Artificial Sequence
  Description of Artificial Sequence: Synthetic oligonucleotide
gggaggcgcccaaggtggtgga

SEQ ID NO: 177612 - DNA, 22 bp, Artificial Sequence
  Description of Artificial Sequence: Synthetic oligonucleotide
ggaggcgcccaaggtggtggag

SEQ ID NO: 177613 - DNA, 23 bp, Artificial Sequence
  Description of Artificial Sequence: Synthetic oligonucleotide
gaggcgcccaaggtggtggagga

SEQ ID NO: 177614 - DNA, 23 bp, Artificial Sequence
  Description of Artificial Sequence: Synthetic oligonucleotide
aggcgcccaaggtggtggaggag

SEQ ID NO: 177615 - DNA, 22 bp, Artificial Sequence
  Description of Artificial Sequence: Synthetic oligonucleotide
ggcgcccaaggtggtggaggag

SEQ ID NO: 177616 - DNA, 23 bp, Artificial Sequence
  Description of Artificial Sequence: Synthetic oligonucleotide
gcgcccaaggtggtggaggagca

SEQ ID NO: 177617 - DNA, 23 bp, Artificial Sequence
  Description of Artificial Sequence: Synthetic oligonucleotide
cgcccaaggtggtggaggagcag

SEQ ID NO: 177618 - DNA, 24 bp, Artificial Sequence
  Description of Artificial Sequence: Synthetic oligonucleotide
gcccaaggtggtggaggagcagga

SEQ ID NO: 177619 - DNA, 25 bp, Artificial Sequence
  Description of Artificial Sequence: Synthetic oligonucleotide
cccaaggtggtggaggagcaggagt

SEQ ID NO: 177620 - DNA, 25 bp, Artificial Sequence
  Description of Artificial Sequence: Synthetic oligonucleotide
ccaaggtggtggaggagcaggagtc

SEQ ID NO: 177621 - DNA, 26 bp, Artificial Sequence
  Description of Artificial Sequence: Synthetic oligonucleotide
caaggtggtggaggagcaggagtcca

SEQ ID NO: 177622 - DNA, 26 bp, Artificial Sequence
  Description of Artificial Sequence: Synthetic oligonucleotide
aaggtggtggaggagcaggagtccag

SEQ ID NO: 177623 - DNA, 25 bp, Artificial Sequence
  Description of Artificial Sequence: Synthetic oligonucleotide
aggtggtggaggagcaggagtccag

SEQ ID NO: 177624 - DNA, 24 bp, Artificial Sequence
  Description of Artificial Sequence: Synthetic oligonucleotide
ggtggtggaggagcaggagtccag

SEQ ID NO: 177625 - DNA, 24 bp, Artificial Sequence
  Description of Artificial Sequence: Synthetic oligonucleotide
gtggtggaggagcaggagtccagg

SEQ ID NO: 177626 - DNA, 25 bp, Artificial Sequence
  Description of Artificial Sequence: Synthetic oligonucleotide
tggtggaggagcaggagtccagggt

SEQ ID NO: 177627 - DNA, 24 bp, Artificial Sequence
  Description of Artificial Sequence: Synthetic oligonucleotide
ggtggaggagcaggagtccagggt

SEQ ID NO: 177628 - DNA, 24 bp, Artificial Sequence
  Description of Artificial Sequence: Synthetic oligonucleotide
gtggaggagcaggagtccagggtg

SEQ ID NO: 177629 - DNA, 25 bp, Artificial Sequence
  Description of Artificial Sequence: Synthetic oligonucleotide
tggaggagcaggagtccagggtgca

SEQ ID NO: 177630 - DNA, 24 bp, Artificial Sequence
  Description of Artificial Sequence: Synthetic oligonucleotide
ggaggagcaggagtccagggtgca

SEQ ID NO: 177631 - DNA, 26 bp, Artificial Sequence
  Description of Artificial Sequence: Synthetic oligonucleotide
gaggagcaggagtccagggtgcacta

SEQ ID NO: 177632 - DNA, 27 bp, Artificial Sequence
  Description of Artificial Sequence: Synthetic oligonucleotide
aggagcaggagtccagggtgcactaca

SEQ ID NO: 177633 - DNA, 26 bp, Artificial Sequence
  Description of Artificial Sequence: Synthetic oligonucleotide
ggagcaggagtccagggtgcactaca

SEQ ID NO: 177634 - DNA, 26 bp, Artificial Sequence
  Description of Artificial Sequence: Synthetic oligonucleotide
gagcaggagtccagggtgcactacac

SEQ ID NO: 177635 - DNA, 26 bp, Artificial Sequence
  Description of Artificial Sequence: Synthetic oligonucleotide
agcaggagtccagggtgcactacacc

SEQ ID NO: 177636 - DNA, 25 bp, Artificial Sequence
  Description of Artificial Sequence: Synthetic oligonucleotide
gcaggagtccagggtgcactacacc

SEQ ID NO: 177637 - DNA, 26 bp, Artificial Sequence
  Description of Artificial Sequence: Synthetic oligonucleotide
caggagtccagggtgcactacaccgt

SEQ ID NO: 177638 - DNA, 27 bp, Artificial Sequence
  Description of Artificial Sequence: Synthetic oligonucleotide
aggagtccagggtgcactacaccgtgt

SEQ ID NO: 177639 - DNA, 26 bp, Artificial Sequence
  Description of Artificial Sequence: Synthetic oligonucleotide
ggagtccagggtgcactacaccgtgt

SEQ ID NO: 177640 - DNA, 26 bp, Artificial Sequence
  Description of Artificial Sequence: Synthetic oligonucleotide
gagtccagggtgcactacaccgtgtg

SEQ ID NO: 177641 - DNA, 27 bp, Artificial Sequence
  Description of Artificial Sequence: Synthetic oligonucleotide
agtccagggtgcactacaccgtgtgca

SEQ ID NO: 177642 - DNA, 27 bp, Artificial Sequence
  Description of Artificial Sequence: Synthetic oligonucleotide
gtccagggtgcactacaccgtgtgcat

SEQ ID NO: 177643 - DNA, 27 bp, Artificial Sequence
  Description of Artificial Sequence: Synthetic oligonucleotide
tccagggtgcactacaccgtgtgcatc

SEQ ID NO: 177644 - DNA, 27 bp, Artificial Sequence
  Description of Artificial Sequence: Synthetic oligonucleotide
ccagggtgcactacaccgtgtgcatct

SEQ ID NO: 177645 - DNA, 27 bp, Artificial Sequence
  Description of Artificial Sequence: Synthetic oligonucleotide
cagggtgcactacaccgtgtgcatctg

SEQ ID NO: 177646 - DNA, 27 bp, Artificial Sequence
  Description of Artificial Sequence: Synthetic oligonucleotide
agggtgcactacaccgtgtgcatctgg

SEQ ID NO: 177647 - DNA, 26 bp, Artificial Sequence
  Description of Artificial Sequence: Synthetic oligonucleotide
gggtgcactacaccgtgtgcatctgg

SEQ ID NO: 177648 - DNA, 26 bp, Artificial Sequence
  Description of Artificial Sequence: Synthetic oligonucleotide
ggtgcactacaccgtgtgcatctggc

SEQ ID NO: 177649 - DNA, 26 bp, Artificial Sequence
  Description of Artificial Sequence: Synthetic oligonucleotide
gtgcactacaccgtgtgcatctggcg

SEQ ID NO: 177650 - DNA, 27 bp, Artificial Sequence
  Description of Artificial Sequence: Synthetic oligonucleotide
tgcactacaccgtgtgcatctggcgga

SEQ ID NO: 177651 - DNA, 27 bp, Artificial Sequence
  Description of Artificial Sequence: Synthetic oligonucleotide
gcactacaccgtgtgcatctggcggaa

SEQ ID NO: 177652 - DNA, 27 bp, Artificial Sequence
  Description of Artificial Sequence: Synthetic oligonucleotide
cactacaccgtgtgcatctggcggaac

SEQ ID NO: 177653 - DNA, 27 bp, Artificial Sequence
  Description of Artificial Sequence: Synthetic oligonucleotide
actacaccgtgtgcatctggcggaacg

SEQ ID NO: 177654 - DNA, 26 bp, Artificial Sequence
  Description of Artificial Sequence: Synthetic oligonucleotide
ctacaccgtgtgcatctggcggaacg

SEQ ID NO: 177655 - DNA, 26 bp, Artificial Sequence
  Description of Artificial Sequence: Synthetic oligonucleotide
tacaccgtgtgcatctggcggaacgg

SEQ ID NO: 177656 - DNA, 25 bp, Artificial Sequence
  Description of Artificial Sequence: Synthetic oligonucleotide
acaccgtgtgcatctggcggaacgg

SEQ ID NO: 177657 - DNA, 24 bp, Artificial Sequence
  Description of Artificial Sequence: Synthetic oligonucleotide
caccgtgtgcatctggcggaacgg

SEQ ID NO: 177658 - DNA, 26 bp, Artificial Sequence
  Description of Artificial Sequence: Synthetic oligonucleotide
accgtgtgcatctggcggaacggcaa

SEQ ID NO: 177659 - DNA, 25 bp, Artificial Sequence
  Description of Artificial Sequence: Synthetic oligonucleotide
ccgtgtgcatctggcggaacggcaa

SEQ ID NO: 177660 - DNA, 25 bp, Artificial Sequence
  Description of Artificial Sequence: Synthetic oligonucleotide
cgtgtgcatctggcggaacggcaag

SEQ ID NO: 177661 - DNA, 26 bp, Artificial Sequence
  Description of Artificial Sequence: Synthetic oligonucleotide
gtgtgcatctggcggaacggcaaggt

SEQ ID NO: 177662 - DNA, 26 bp, Artificial Sequence
  Description of Artificial Sequence: Synthetic oligonucleotide
tgtgcatctggcggaacggcaaggtg

SEQ ID NO: 177663 - DNA, 25 bp, Artificial Sequence
  Description of Artificial Sequence: Synthetic oligonucleotide
gtgcatctggcggaacggcaaggtg

SEQ ID NO: 177664 - DNA, 25 bp, Artificial Sequence
  Description of Artificial Sequence: Synthetic oligonucleotide
tgcatctggcggaacggcaaggtgg

SEQ ID NO: 177665 - DNA, 24 bp, Artificial Sequence
  Description of Artificial Sequence: Synthetic oligonucleotide
gcatctggcggaacggcaaggtgg

SEQ ID NO: 177666 - DNA, 24 bp, Artificial Sequence
  Description of Artificial Sequence: Synthetic oligonucleotide
catctggcggaacggcaaggtggg

SEQ ID NO: 177667 - DNA, 24 bp, Artificial Sequence
  Description of Artificial Sequence: Synthetic oligonucleotide
atctggcggaacggcaaggtgggg

SEQ ID NO: 177668 - DNA, 23 bp, Artificial Sequence
  Description of Artificial Sequence: Synthetic oligonucleotide
tctggcggaacggcaaggtgggg

SEQ ID NO: 177669 - DNA, 22 bp, Artificial Sequence
  Description of Artificial Sequence: Synthetic oligonucleotide
ctggcggaacggcaaggtgggg

SEQ ID NO: 177670 - DNA, 23 bp, Artificial Sequence
  Description of Artificial Sequence: Synthetic oligonucleotide
tggcggaacggcaaggtggggct

SEQ ID NO: 177671 - DNA, 22 bp, Artificial Sequence
  Description of Artificial Sequence: Synthetic oligonucleotide
ggcggaacggcaaggtggggct

SEQ ID NO: 177672 - DNA, 23 bp, Artificial Sequence
  Description of Artificial Sequence: Synthetic oligonucleotide
gcggaacggcaaggtggggctgt

SEQ ID NO: 177673 - DNA, 24 bp, Artificial Sequence
  Description of Artificial Sequence: Synthetic oligonucleotide
cggaacggcaaggtggggctgtct

SEQ ID NO: 177674 - DNA, 24 bp, Artificial Sequence
  Description of Artificial Sequence: Synthetic oligonucleotide
ggaacggcaaggtggggctgtctg

SEQ ID NO: 177675 - DNA, 24 bp, Artificial Sequence
  Description of Artificial Sequence: Synthetic oligonucleotide
gaacggcaaggtggggctgtctgg

SEQ ID NO: 177676 - DNA, 26 bp, Artificial Sequence
  Description of Artificial Sequence: Synthetic oligonucleotide
aacggcaaggtggggctgtctggcat

SEQ ID NO: 177677 - DNA, 25 bp, Artificial Sequence
  Description of Artificial Sequence: Synthetic oligonucleotide
acggcaaggtggggctgtctggcat

SEQ ID NO: 177678 - DNA, 24 bp, Artificial Sequence
  Description of Artificial Sequence: Synthetic oligonucleotide
cggcaaggtggggctgtctggcat

SEQ ID NO: 177679 - DNA, 24 bp, Artificial Sequence
  Description of Artificial Sequence: Synthetic oligonucleotide
ggcaaggtggggctgtctggcatg

SEQ ID NO: 177680 - DNA, 24 bp, Artificial Sequence
  Description of Artificial Sequence: Synthetic oligonucleotide
gcaaggtggggctgtctggcatgg

SEQ ID NO: 177681 - DNA, 24 bp, Artificial Sequence
  Description of Artificial Sequence: Synthetic oligonucleotide
caaggtggggctgtctggcatggc

SEQ ID NO: 177682 - DNA, 26 bp, Artificial Sequence
  Description of Artificial Sequence: Synthetic oligonucleotide
aaggtggggctgtctggcatggccat

SEQ ID NO: 177683 - DNA, 25 bp, Artificial Sequence
  Description of Artificial Sequence: Synthetic oligonucleotide
aggtggggctgtctggcatggccat

SEQ ID NO: 177684 - DNA, 24 bp, Artificial Sequence
  Description of Artificial Sequence: Synthetic oligonucleotide
ggtggggctgtctggcatggccat

SEQ ID NO: 177685 - DNA, 24 bp, Artificial Sequence
  Description of Artificial Sequence: Synthetic oligonucleotide
gtggggctgtctggcatggccatc

SEQ ID NO: 177686 - DNA, 24 bp, Artificial Sequence
  Description of Artificial Sequence: Synthetic oligonucleotide
tggggctgtctggcatggccatcg

SEQ ID NO: 177687 - DNA, 23 bp, Artificial Sequence
  Description of Artificial Sequence: Synthetic oligonucleotide
ggggctgtctggcatggccatcg

SEQ ID NO: 177688 - DNA, 23 bp, Artificial Sequence
  Description of Artificial Sequence: Synthetic oligonucleotide
gggctgtctggcatggccatcgc

SEQ ID NO: 177689 - DNA, 23 bp, Artificial Sequence
  Description of Artificial Sequence: Synthetic oligonucleotide
ggctgtctggcatggccatcgcg

SEQ ID NO: 177690 - DNA, 24 bp, Artificial Sequence
  Description of Artificial Sequence: Synthetic oligonucleotide
gctgtctggcatggccatcgcgga

SEQ ID NO: 177691 - DNA, 24 bp, Artificial Sequence
  Description of Artificial Sequence: Synthetic oligonucleotide
ctgtctggcatggccatcgcggac

SEQ ID NO: 177692 - DNA, 25 bp, Artificial Sequence
  Description of Artificial Sequence: Synthetic oligonucleotide
tgtctggcatggccatcgcggacgt

SEQ ID NO: 177693 - DNA, 24 bp, Artificial Sequence
  Description of Artificial Sequence: Synthetic oligonucleotide
gtctggcatggccatcgcggacgt

SEQ ID NO: 177694 - DNA, 25 bp, Artificial Sequence
  Description of Artificial Sequence: Synthetic oligonucleotide
tctggcatggccatcgcggacgtca

SEQ ID NO: 177695 - DNA, 24 bp, Artificial Sequence
  Description of Artificial Sequence: Synthetic oligonucleotide
ctggcatggccatcgcggacgtca

SEQ ID NO: 177696 - DNA, 24 bp, Artificial Sequence
  Description of Artificial Sequence: Synthetic oligonucleotide
tggcatggccatcgcggacgtcac

SEQ ID NO: 177697 - DNA, 23 bp, Artificial Sequence
  Description of Artificial Sequence: Synthetic oligonucleotide
ggcatggccatcgcggacgtcac

SEQ ID NO: 177698 - DNA, 23 bp, Artificial Sequence
  Description of Artificial Sequence: Synthetic oligonucleotide
gcatggccatcgcggacgtcacc

SEQ ID NO: 177699 - DNA, 24 bp, Artificial Sequence
  Description of Artificial Sequence: Synthetic oligonucleotide
catggccatcgcggacgtcaccct

SEQ ID NO: 177700 - DNA, 24 bp, Artificial Sequence
  Description of Artificial Sequence: Synthetic oligonucleotide
atggccatcgcggacgtcaccctc

SEQ ID NO: 177701 - DNA, 23 bp, Artificial Sequence
  Description of Artificial Sequence: Synthetic oligonucleotide
tggccatcgcggacgtcaccctc

SEQ ID NO: 177702 - DNA, 22 bp, Artificial Sequence
  Description of Artificial Sequence: Synthetic oligonucleotide
ggccatcgcggacgtcaccctc

SEQ ID NO: 177703 - DNA, 23 bp, Artificial Sequence
  Description of Artificial Sequence: Synthetic oligonucleotide
gccatcgcggacgtcaccctcct

SEQ ID NO: 177704 - DNA, 24 bp, Artificial Sequence
  Description of Artificial Sequence: Synthetic oligonucleotide
ccatcgcggacgtcaccctcctga

SEQ ID NO: 177705 - DNA, 25 bp, Artificial Sequence
  Description of Artificial Sequence: Synthetic oligonucleotide
catcgcggacgtcaccctcctgagt

SEQ ID NO: 177706 - DNA, 25 bp, Artificial Sequence
  Description of Artificial Sequence: Synthetic oligonucleotide
atcgcggacgtcaccctcctgagtg

SEQ ID NO: 177707 - DNA, 24 bp, Artificial Sequence
  Description of Artificial Sequence: Synthetic oligonucleotide
tcgcggacgtcaccctcctgagtg

SEQ ID NO: 177708 - DNA, 23 bp, Artificial Sequence
  Description of Artificial Sequence: Synthetic oligonucleotide
cgcggacgtcaccctcctgagtg

SEQ ID NO: 177709 - DNA, 26 bp, Artificial Sequence
  Description of Artificial Sequence: Synthetic oligonucleotide
gcggacgtcaccctcctgagtggatt

SEQ ID NO: 177710 - DNA, 26 bp, Artificial Sequence
  Description of Artificial Sequence: Synthetic oligonucleotide
cggacgtcaccctcctgagtggattc

SEQ ID NO: 177711 - DNA, 27 bp, Artificial Sequence
  Description of Artificial Sequence: Synthetic oligonucleotide
ggacgtcaccctcctgagtggattcca

SEQ ID NO: 177712 - DNA, 27 bp, Artificial Sequence
  Description of Artificial Sequence: Synthetic oligonucleotide
gacgtcaccctcctgagtggattccac

SEQ ID NO: 177713 - DNA, 27 bp, Artificial Sequence
  Description of Artificial Sequence: Synthetic oligonucleotide
acgtcaccctcctgagtggattccacg

SEQ ID NO: 177714 - DNA, 26 bp, Artificial Sequence
  Description of Artificial Sequence: Synthetic oligonucleotide
cgtcaccctcctgagtggattccacg

SEQ ID NO: 177715 - DNA, 26 bp, Artificial Sequence
  Description of Artificial Sequence: Synthetic oligonucleotide
gtcaccctcctgagtggattccacgc

SEQ ID NO: 177716 - DNA, 26 bp, Artificial Sequence
  Description of Artificial Sequence: Synthetic oligonucleotide
tcaccctcctgagtggattccacgcc

SEQ ID NO: 177717 - DNA, 25 bp, Artificial Sequence
  Description of Artificial Sequence: Synthetic oligonucleotide
caccctcctgagtggattccacgcc

SEQ ID NO: 177718 - DNA, 26 bp, Artificial Sequence
  Description of Artificial Sequence: Synthetic oligonucleotide
accctcctgagtggattccacgccct

SEQ ID NO: 177719 - DNA, 25 bp, Artificial Sequence
  Description of Artificial Sequence: Synthetic oligonucleotide
ccctcctgagtggattccacgccct

SEQ ID NO: 177720 - DNA, 25 bp, Artificial Sequence
  Description of Artificial Sequence: Synthetic oligonucleotide
cctcctgagtggattccacgccctg

SEQ ID NO: 177721 - DNA, 25 bp, Artificial Sequence
  Description of Artificial Sequence: Synthetic oligonucleotide
ctcctgagtggattccacgccctgc

SEQ ID NO: 177722 - DNA, 26 bp, Artificial Sequence
  Description of Artificial Sequence: Synthetic oligonucleotide
tcctgagtggattccacgccctgcgt

SEQ ID NO: 177723 - DNA, 25 bp, Artificial Sequence
  Description of Artificial Sequence: Synthetic oligonucleotide
cctgagtggattccacgccctgcgt

SEQ ID NO: 177724 - DNA, 25 bp, Artificial Sequence
  Description of Artificial Sequence: Synthetic oligonucleotide
ctgagtggattccacgccctgcgtg

SEQ ID NO: 177725 - DNA, 26 bp, Artificial Sequence
  Description of Artificial Sequence: Synthetic oligonucleotide
tgagtggattccacgccctgcgtgct

SEQ ID NO: 177726 - DNA, 25 bp, Artificial Sequence
  Description of Artificial Sequence: Synthetic oligonucleotide
gagtggattccacgccctgcgtgct

SEQ ID NO: 177727 - DNA, 26 bp, Artificial Sequence
  Description of Artificial Sequence: Synthetic oligonucleotide
agtggattccacgccctgcgtgctga

SEQ ID NO: 177728 - DNA, 25 bp, Artificial Sequence
  Description of Artificial Sequence: Synthetic oligonucleotide
gtggattccacgccctgcgtgctga

SEQ ID NO: 177729 - DNA, 25 bp, Artificial Sequence
  Description of Artificial Sequence: Synthetic oligonucleotide
tggattccacgccctgcgtgctgac

SEQ ID NO: 177730 - DNA, 24 bp, Artificial Sequence
  Description of Artificial Sequence: Synthetic oligonucleotide
ggattccacgccctgcgtgctgac

SEQ ID NO: 177731 - DNA, 25 bp, Artificial Sequence
  Description of Artificial Sequence: Synthetic oligonucleotide
gattccacgccctgcgtgctgacct

SEQ ID NO: 177732 - DNA, 25 bp, Artificial Sequence
  Description of Artificial Sequence: Synthetic oligonucleotide
attccacgccctgcgtgctgacctg

SEQ ID NO: 177733 - DNA, 24 bp, Artificial Sequence
  Description of Artificial Sequence: Synthetic oligonucleotide
ttccacgccctgcgtgctgacctg

SEQ ID NO: 177734 - DNA, 23 bp, Artificial Sequence
  Description of Artificial Sequence: Synthetic oligonucleotide
tccacgccctgcgtgctgacctg

SEQ ID NO: 177735 - DNA, 22 bp, Artificial Sequence
  Description of Artificial Sequence: Synthetic oligonucleotide
ccacgccctgcgtgctgacctg

SEQ ID NO: 177736 - DNA, 23 bp, Artificial Sequence
  Description of Artificial Sequence: Synthetic oligonucleotide
cacgccctgcgtgctgacctgga

SEQ ID NO: 177737 - DNA, 25 bp, Artificial Sequence
  Description of Artificial Sequence: Synthetic oligonucleotide
acgccctgcgtgctgacctggagaa

SEQ ID NO: 177738 - DNA, 24 bp, Artificial Sequence
  Description of Artificial Sequence: Synthetic oligonucleotide
cgccctgcgtgctgacctggagaa

SEQ ID NO: 177739 - DNA, 24 bp, Artificial Sequence
  Description of Artificial Sequence: Synthetic oligonucleotide
gccctgcgtgctgacctggagaag

SEQ ID NO: 177740 - DNA, 25 bp, Artificial Sequence
  Description of Artificial Sequence: Synthetic oligonucleotide
ccctgcgtgctgacctggagaagct

SEQ ID NO: 177741 - DNA, 26 bp, Artificial Sequence
  Description of Artificial Sequence: Synthetic oligonucleotide
cctgcgtgctgacctggagaagctga

SEQ ID NO: 177742 - DNA, 26 bp, Artificial Sequence
  Description of Artificial Sequence: Synthetic oligonucleotide
ctgcgtgctgacctggagaagctgac

SEQ ID NO: 177743 - DNA, 27 bp, Artificial Sequence
  Description of Artificial Sequence: Synthetic oligonucleotide
tgcgtgctgacctggagaagctgacct

SEQ ID NO: 177744 - DNA, 26 bp, Artificial Sequence
  Description of Artificial Sequence: Synthetic oligonucleotide
gcgtgctgacctggagaagctgacct

SEQ ID NO: 177745 - DNA, 26 bp, Artificial Sequence
  Description of Artificial Sequence: Synthetic oligonucleotide
cgtgctgacctggagaagctgacctc

SEQ ID NO: 177746 - DNA, 26 bp, Artificial Sequence
  Description of Artificial Sequence: Synthetic oligonucleotide
gtgctgacctggagaagctgacctcc

SEQ ID NO: 177747 - DNA, 27 bp, Artificial Sequence
  Description of Artificial Sequence: Synthetic oligonucleotide
tgctgacctggagaagctgacctccct

SEQ ID NO: 177748 - DNA, 26 bp, Artificial Sequence
  Description of Artificial Sequence: Synthetic oligonucleotide
gctgacctggagaagctgacctccct

SEQ ID NO: 177749 - DNA, 27 bp, Artificial Sequence
  Description of Artificial Sequence: Synthetic oligonucleotide
ctgacctggagaagctgacctccctct

SEQ ID NO: 177750 - DNA, 27 bp, Artificial Sequence
  Description of Artificial Sequence: Synthetic oligonucleotide
tgacctggagaagctgacctccctctc

SEQ ID NO: 177751 - DNA, 27 bp, Artificial Sequence
  Description of Artificial Sequence: Synthetic oligonucleotide
gacctggagaagctgacctccctctct

SEQ ID NO: 177752 - DNA, 27 bp, Artificial Sequence
  Description of Artificial Sequence: Synthetic oligonucleotide
acctggagaagctgacctccctctctg

SEQ ID NO: 177753 - DNA, 27 bp, Artificial Sequence
  Description of Artificial Sequence: Synthetic oligonucleotide
cctggagaagctgacctccctctctga

SEQ ID NO: 177754 - DNA, 27 bp, Artificial Sequence
  Description of Artificial Sequence: Synthetic oligonucleotide
ctggagaagctgacctccctctctgac

SEQ ID NO: 177755 - DNA, 27 bp, Artificial Sequence
  Description of Artificial Sequence: Synthetic oligonucleotide
tggagaagctgacctccctctctgacc

SEQ ID NO: 177756 - DNA, 26 bp, Artificial Sequence
  Description of Artificial Sequence: Synthetic oligonucleotide
ggagaagctgacctccctctctgacc

SEQ ID NO: 177757 - DNA, 27 bp, Artificial Sequence
  Description of Artificial Sequence: Synthetic oligonucleotide
gagaagctgacctccctctctgaccgt

SEQ ID NO: 177758 - DNA, 29 bp, Artificial Sequence
  Description of Artificial Sequence: Synthetic oligonucleotide
agaagctgacctccctctctgaccgttac

SEQ ID NO: 177759 - DNA, 28 bp, Artificial Sequence
  Description of Artificial Sequence: Synthetic oligonucleotide
gaagctgacctccctctctgaccgttac

SEQ ID NO: 177760 - DNA, 28 bp, Artificial Sequence
  Description of Artificial Sequence: Synthetic oligonucleotide
aagctgacctccctctctgaccgttacg

SEQ ID NO: 177761 - DNA, 27 bp, Artificial Sequence
  Description of Artificial Sequence: Synthetic oligonucleotide
agctgacctccctctctgaccgttacg

SEQ ID NO: 177762 - DNA, 27 bp, Artificial Sequence
  Description of Artificial Sequence: Synthetic oligonucleotide
gctgacctccctctctgaccgttacgt

SEQ ID NO: 177763 - DNA, 27 bp, Artificial Sequence
  Description of Artificial Sequence: Synthetic oligonucleotide
ctgacctccctctctgaccgttacgtg

SEQ ID NO: 177764 - DNA, 28 bp, Artificial Sequence
  Description of Artificial Sequence: Synthetic oligonucleotide
tgacctccctctctgaccgttacgtgag

SEQ ID NO: 177765 - DNA, 27 bp, Artificial Sequence
  Description of Artificial Sequence: Synthetic oligonucleotide
gacctccctctctgaccgttacgtgag

SEQ ID NO: 177766 - DNA, 28 bp, Artificial Sequence
  Description of Artificial Sequence: Synthetic oligonucleotide
acctccctctctgaccgttacgtgagtc

SEQ ID NO: 177767 - DNA, 27 bp, Artificial Sequence
  Description of Artificial Sequence: Synthetic oligonucleotide
cctccctctctgaccgttacgtgagtc

SEQ ID NO: 177768 - DNA, 28 bp, Artificial Sequence
  Description of Artificial Sequence: Synthetic oligonucleotide
ctccctctctgaccgttacgtgagtcac

SEQ ID NO: 177769 - DNA, 31 bp, Artificial Sequence
  Description of Artificial Sequence: Synthetic oligonucleotide
tccctctctgaccgttacgtgagtcactttg

SEQ ID NO: 177770 - DNA, 30 bp, Artificial Sequence
  Description of Artificial Sequence: Synthetic oligonucleotide
ccctctctgaccgttacgtgagtcactttg

SEQ ID NO: 177771 - DNA, 31 bp, Artificial Sequence
  Description of Artificial Sequence: Synthetic oligonucleotide
cctctctgaccgttacgtgagtcactttgag

SEQ ID NO: 177772 - DNA, 32 bp, Artificial Sequence
  Description of Artificial Sequence: Synthetic oligonucleotide
ctctctgaccgttacgtgagtcactttgagac

SEQ ID NO: 177773 - DNA, 32 bp, Artificial Sequence
  Description of Artificial Sequence: Synthetic oligonucleotide
tctctgaccgttacgtgagtcactttgagacc

SEQ ID NO: 177774 - DNA, 31 bp, Artificial Sequence
  Description of Artificial Sequence: Synthetic oligonucleotide
ctctgaccgttacgtgagtcactttgagacc

SEQ ID NO: 177775 - DNA, 31 bp, Artificial Sequence
  Description of Artificial Sequence: Synthetic oligonucleotide
tctgaccgttacgtgagtcactttgagaccg

SEQ ID NO: 177776 - DNA, 30 bp, Artificial Sequence
  Description of Artificial Sequence: Synthetic oligonucleotide
ctgaccgttacgtgagtcactttgagaccg

SEQ ID NO: 177777 - DNA, 31 bp, Artificial Sequence
  Description of Artificial Sequence: Synthetic oligonucleotide
tgaccgttacgtgagtcactttgagaccgag

SEQ ID NO: 177778 - DNA, 30 bp, Artificial Sequence
  Description of Artificial Sequence: Synthetic oligonucleotide
gaccgttacgtgagtcactttgagaccgag

SEQ ID NO: 177779 - DNA, 30 bp, Artificial Sequence
  Description of Artificial Sequence: Synthetic oligonucleotide
accgttacgtgagtcactttgagaccgagg

SEQ ID NO: 177780 - DNA, 29 bp, Artificial Sequence
  Description of Artificial Sequence: Synthetic oligonucleotide
ccgttacgtgagtcactttgagaccgagg

SEQ ID NO: 177781 - DNA, 29 bp, Artificial Sequence
  Description of Artificial Sequence: Synthetic oligonucleotide
cgttacgtgagtcactttgagaccgaggg

SEQ ID NO: 177782 - DNA, 29 bp, Artificial Sequence
  Description of Artificial Sequence: Synthetic oligonucleotide
gttacgtgagtcactttgagaccgagggg

SEQ ID NO: 177783 - DNA, 29 bp, Artificial Sequence
  Description of Artificial Sequence: Synthetic oligonucleotide
ttacgtgagtcactttgagaccgaggggc

SEQ ID NO: 177784 - DNA, 28 bp, Artificial Sequence
  Description of Artificial Sequence: Synthetic oligonucleotide
tacgtgagtcactttgagaccgaggggc

SEQ ID NO: 177785 - DNA, 27 bp, Artificial Sequence
  Description of Artificial Sequence: Synthetic oligonucleotide
acgtgagtcactttgagaccgaggggc

SEQ ID NO: 177786 - DNA, 26 bp, Artificial Sequence
  Description of Artificial Sequence: Synthetic oligonucleotide
cgtgagtcactttgagaccgaggggc

SEQ ID NO: 177787 - DNA, 26 bp, Artificial Sequence
  Description of Artificial Sequence: Synthetic oligonucleotide
gtgagtcactttgagaccgaggggcc

SEQ ID NO: 177788 - DNA, 26 bp, Artificial Sequence
  Description of Artificial Sequence: Synthetic oligonucleotide
tgagtcactttgagaccgaggggccc

SEQ ID NO: 177789 - DNA, 25 bp, Artificial Sequence
  Description of Artificial Sequence: Synthetic oligonucleotide
gagtcactttgagaccgaggggccc

SEQ ID NO: 177790 - DNA, 26 bp, Artificial Sequence
  Description of Artificial Sequence: Synthetic oligonucleotide
agtcactttgagaccgaggggcccca

SEQ ID NO: 177791 - DNA, 25 bp, Artificial Sequence
  Description of Artificial Sequence: Synthetic oligonucleotide
gtcactttgagaccgaggggcccca

SEQ ID NO: 177792 - DNA, 25 bp, Artificial Sequence
  Description of Artificial Sequence: Synthetic oligonucleotide
tcactttgagaccgaggggccccac

SEQ ID NO: 177793 - DNA, 24 bp, Artificial Sequence
  Description of Artificial Sequence: Synthetic oligonucleotide
cactttgagaccgaggggccccac

SEQ ID NO: 177794 - DNA, 25 bp, Artificial Sequence
  Description of Artificial Sequence: Synthetic oligonucleotide
actttgagaccgaggggccccacgt

SEQ ID NO: 177795 - DNA, 24 bp, Artificial Sequence
  Description of Artificial Sequence: Synthetic oligonucleotide
ctttgagaccgaggggccccacgt

SEQ ID NO: 177796 - DNA, 24 bp, Artificial Sequence
  Description of Artificial Sequence: Synthetic oligonucleotide
tttgagaccgaggggccccacgtc

SEQ ID NO: 177797 - DNA, 23 bp, Artificial Sequence
  Description of Artificial Sequence: Synthetic oligonucleotide
ttgagaccgaggggccccacgtc

SEQ ID NO: 177798 - DNA, 22 bp, Artificial Sequence
  Description of Artificial Sequence: Synthetic oligonucleotide
tgagaccgaggggccccacgtc

SEQ ID NO: 177799 - DNA, 21 bp, Artificial Sequence
  Description of Artificial Sequence: Synthetic oligonucleotide
gagaccgaggggccccacgtc

SEQ ID NO: 177800 - DNA, 22 bp, Artificial Sequence
  Description of Artificial Sequence: Synthetic oligonucleotide
agaccgaggggccccacgtcct

SEQ ID NO: 177801 - DNA, 21 bp, Artificial Sequence
  Description of Artificial Sequence: Synthetic oligonucleotide
gaccgaggggccccacgtcct

SEQ ID NO: 177802 - DNA, 21 bp, Artificial Sequence
  Description of Artificial Sequence: Synthetic oligonucleotide
accgaggggccccacgtcctg

SEQ ID NO: 177803 - DNA, 20 bp, Artificial Sequence
  Description of Artificial Sequence: Synthetic oligonucleotide
ccgaggggccccacgtcctg

SEQ ID NO: 177804 - DNA, 21 bp, Artificial Sequence
  Description of Artificial Sequence: Synthetic oligonucleotide
cgaggggccccacgtcctgct

SEQ ID NO: 177805 - DNA, 27 bp, Artificial Sequence
  Description of Artificial Sequence: Synthetic oligonucleotide
gaggggccccacgtcctgctgtatttt

SEQ ID NO: 177806 - DNA, 27 bp, Artificial Sequence
  Description of Artificial Sequence: Synthetic oligonucleotide
aggggccccacgtcctgctgtattttg

SEQ ID NO: 177807 - DNA, 27 bp, Artificial Sequence
  Description of Artificial Sequence: Synthetic oligonucleotide
ggggccccacgtcctgctgtattttga

SEQ ID NO: 177808 - DNA, 27 bp, Artificial Sequence
  Description of Artificial Sequence: Synthetic oligonucleotide
gggccccacgtcctgctgtattttgac

SEQ ID NO: 177809 - DNA, 28 bp, Artificial Sequence
  Description of Artificial Sequence: Synthetic oligonucleotide
ggccccacgtcctgctgtattttgactc

SEQ ID NO: 177810 - DNA, 28 bp, Artificial Sequence
  Description of Artificial Sequence: Synthetic oligonucleotide
gccccacgtcctgctgtattttgactcg

SEQ ID NO: 177811 - DNA, 28 bp, Artificial Sequence
  Description of Artificial Sequence: Synthetic oligonucleotide
ccccacgtcctgctgtattttgactcgg

SEQ ID NO: 177812 - DNA, 29 bp, Artificial Sequence
  Description of Artificial Sequence: Synthetic oligonucleotide
cccacgtcctgctgtattttgactcggtc

SEQ ID NO: 177813 - DNA, 29 bp, Artificial Sequence
  Description of Artificial Sequence: Synthetic oligonucleotide
ccacgtcctgctgtattttgactcggtcc

SEQ ID NO: 177814 - DNA, 29 bp, Artificial Sequence
  Description of Artificial Sequence: Synthetic oligonucleotide
cacgtcctgctgtattttgactcggtccc

SEQ ID NO: 177815 - DNA, 29 bp, Artificial Sequence
  Description of Artificial Sequence: Synthetic oligonucleotide
acgtcctgctgtattttgactcggtcccc

SEQ ID NO: 177816 - DNA, 28 bp, Artificial Sequence
  Description of Artificial Sequence: Synthetic oligonucleotide
cgtcctgctgtattttgactcggtcccc

SEQ ID NO: 177817 - DNA, 29 bp, Artificial Sequence
  Description of Artificial Sequence: Synthetic oligonucleotide
gtcctgctgtattttgactcggtccccac

SEQ ID NO: 177818 - DNA, 29 bp, Artificial Sequence
  Description of Artificial Sequence: Synthetic oligonucleotide
tcctgctgtattttgactcggtccccacc

SEQ ID NO: 177819 - DNA, 28 bp, Artificial Sequence
  Description of Artificial Sequence: Synthetic oligonucleotide
cctgctgtattttgactcggtccccacc

SEQ ID NO: 177820 - DNA, 29 bp, Artificial Sequence
  Description of Artificial Sequence: Synthetic oligonucleotide
ctgctgtattttgactcggtccccacctc

SEQ ID NO: 177821 - DNA, 29 bp, Artificial Sequence
  Description of Artificial Sequence: Synthetic oligonucleotide
tgctgtattttgactcggtccccacctcc

SEQ ID NO: 177822 - DNA, 28 bp, Artificial Sequence
  Description of Artificial Sequence: Synthetic oligonucleotide
gctgtattttgactcggtccccacctcc

SEQ ID NO: 177823 - DNA, 28 bp, Artificial Sequence
  Description of Artificial Sequence: Synthetic oligonucleotide
ctgtattttgactcggtccccacctccc

SEQ ID NO: 177824 - DNA, 28 bp, Artificial Sequence
  Description of Artificial Sequence: Synthetic oligonucleotide
tgtattttgactcggtccccacctcccg

SEQ ID NO: 177825 - DNA, 27 bp, Artificial Sequence
  Description of Artificial Sequence: Synthetic oligonucleotide
gtattttgactcggtccccacctcccg

SEQ ID NO: 177826 - DNA, 27 bp, Artificial Sequence
  Description of Artificial Sequence: Synthetic oligonucleotide
tattttgactcggtccccacctcccgg

SEQ ID NO: 177827 - DNA, 26 bp, Artificial Sequence
  Description of Artificial Sequence: Synthetic oligonucleotide
attttgactcggtccccacctcccgg

SEQ ID NO: 177828 - DNA, 25 bp, Artificial Sequence
  Description of Artificial Sequence: Synthetic oligonucleotide
ttttgactcggtccccacctcccgg

SEQ ID NO: 177829 - DNA, 24 bp, Artificial Sequence
  Description of Artificial Sequence: Synthetic oligonucleotide
tttgactcggtccccacctcccgg

SEQ ID NO: 177830 - DNA, 23 bp, Artificial Sequence
  Description of Artificial Sequence: Synthetic oligonucleotide
ttgactcggtccccacctcccgg

SEQ ID NO: 177831 - DNA, 22 bp, Artificial Sequence
  Description of Artificial Sequence: Synthetic oligonucleotide
tgactcggtccccacctcccgg

SEQ ID NO: 177832 - DNA, 21 bp, Artificial Sequence
  Description of Artificial Sequence: Synthetic oligonucleotide
gactcggtccccacctcccgg

SEQ ID NO: 177833 - DNA, 22 bp, Artificial Sequence
  Description of Artificial Sequence: Synthetic oligonucleotide
actcggtccccacctcccggga

SEQ ID NO: 177834 - DNA, 21 bp, Artificial Sequence
  Description of Artificial Sequence: Synthetic oligonucleotide
ctcggtccccacctcccggga

SEQ ID NO: 177835 - DNA, 22 bp, Artificial Sequence
  Description of Artificial Sequence: Synthetic oligonucleotide
tcggtccccacctcccgggagt

SEQ ID NO: 177836 - DNA, 21 bp, Artificial Sequence
  Description of Artificial Sequence: Synthetic oligonucleotide
cggtccccacctcccgggagt

SEQ ID NO: 177837 - DNA, 21 bp, Artificial Sequence
  Description of Artificial Sequence: Synthetic oligonucleotide
ggtccccacctcccgggagtg

SEQ ID NO: 177838 - DNA, 21 bp, Artificial Sequence
  Description of Artificial Sequence: Synthetic oligonucleotide
gtccccacctcccgggagtgc

SEQ ID NO: 177839 - DNA, 22 bp, Artificial Sequence
  Description of Artificial Sequence: Synthetic oligonucleotide
tccccacctcccgggagtgcgt

SEQ ID NO: 177840 - DNA, 21 bp, Artificial Sequence
  Description of Artificial Sequence: Synthetic oligonucleotide
ccccacctcccgggagtgcgt

SEQ ID NO: 177841 - DNA, 21 bp, Artificial Sequence
  Description of Artificial Sequence: Synthetic oligonucleotide
cccacctcccgggagtgcgtg

SEQ ID NO: 177842 - DNA, 21 bp, Artificial Sequence
  Description of Artificial Sequence: Synthetic oligonucleotide
ccacctcccgggagtgcgtgg

SEQ ID NO: 177843 - DNA, 21 bp, Artificial Sequence
  Description of Artificial Sequence: Synthetic oligonucleotide
cacctcccgggagtgcgtggg

SEQ ID NO: 177844 - DNA, 24 bp, Artificial Sequence
  Description of Artificial Sequence: Synthetic oligonucleotide
acctcccgggagtgcgtgggcttt

SEQ ID NO: 177845 - DNA, 23 bp, Artificial Sequence
  Description of Artificial Sequence: Synthetic oligonucleotide
cctcccgggagtgcgtgggcttt

SEQ ID NO: 177846 - DNA, 24 bp, Artificial Sequence
  Description of Artificial Sequence: Synthetic oligonucleotide
ctcccgggagtgcgtgggctttga

SEQ ID NO: 177847 - DNA, 24 bp, Artificial Sequence
  Description of Artificial Sequence: Synthetic oligonucleotide
tcccgggagtgcgtgggctttgag

SEQ ID NO: 177848 - DNA, 23 bp, Artificial Sequence
  Description of Artificial Sequence: Synthetic oligonucleotide
cccgggagtgcgtgggctttgag

SEQ ID NO: 177849 - DNA, 23 bp, Artificial Sequence
  Description of Artificial Sequence: Synthetic oligonucleotide
ccgggagtgcgtgggctttgagg

SEQ ID NO: 177850 - DNA, 24 bp, Artificial Sequence
  Description of Artificial Sequence: Synthetic oligonucleotide
cgggagtgcgtgggctttgaggct

SEQ ID NO: 177851 - DNA, 25 bp, Artificial Sequence
  Description of Artificial Sequence: Synthetic oligonucleotide
gggagtgcgtgggctttgaggctgt

SEQ ID NO: 177852 - DNA, 25 bp, Artificial Sequence
  Description of Artificial Sequence: Synthetic oligonucleotide
ggagtgcgtgggctttgaggctgtg

SEQ ID NO: 177853 - DNA, 26 bp, Artificial Sequence
  Description of Artificial Sequence: Synthetic oligonucleotide
gagtgcgtgggctttgaggctgtgca

SEQ ID NO: 177854 - DNA, 26 bp, Artificial Sequence
  Description of Artificial Sequence: Synthetic oligonucleotide
agtgcgtgggctttgaggctgtgcag

SEQ ID NO: 177855 - DNA, 25 bp, Artificial Sequence
  Description of Artificial Sequence: Synthetic oligonucleotide
gtgcgtgggctttgaggctgtgcag

SEQ ID NO: 177856 - DNA, 27 bp, Artificial Sequence
  Description of Artificial Sequence: Synthetic oligonucleotide
tgcgtgggctttgaggctgtgcaggaa

SEQ ID NO: 177857 - DNA, 26 bp, Artificial Sequence
  Description of Artificial Sequence: Synthetic oligonucleotide
gcgtgggctttgaggctgtgcaggaa

SEQ ID NO: 177858 - DNA, 27 bp, Artificial Sequence
  Description of Artificial Sequence: Synthetic oligonucleotide
cgtgggctttgaggctgtgcaggaagt

SEQ ID NO: 177859 - DNA, 27 bp, Artificial Sequence
  Description of Artificial Sequence: Synthetic oligonucleotide
gtgggctttgaggctgtgcaggaagtg

SEQ ID NO: 177860 - DNA, 27 bp, Artificial Sequence
  Description of Artificial Sequence: Synthetic oligonucleotide
tgggctttgaggctgtgcaggaagtgc

SEQ ID NO: 177861 - DNA, 26 bp, Artificial Sequence
  Description of Artificial Sequence: Synthetic oligonucleotide
gggctttgaggctgtgcaggaagtgc

SEQ ID NO: 177862 - DNA, 26 bp, Artificial Sequence
  Description of Artificial Sequence: Synthetic oligonucleotide
ggctttgaggctgtgcaggaagtgcc

SEQ ID NO: 177863 - DNA, 26 bp, Artificial Sequence
  Description of Artificial Sequence: Synthetic oligonucleotide
gctttgaggctgtgcaggaagtgccg

SEQ ID NO: 177864 - DNA, 27 bp, Artificial Sequence
  Description of Artificial Sequence: Synthetic oligonucleotide
ctttgaggctgtgcaggaagtgccggt

SEQ ID NO: 177865 - DNA, 27 bp, Artificial Sequence
  Description of Artificial Sequence: Synthetic oligonucleotide
tttgaggctgtgcaggaagtgccggtg

SEQ ID NO: 177866 - DNA, 26 bp, Artificial Sequence
  Description of Artificial Sequence: Synthetic oligonucleotide
ttgaggctgtgcaggaagtgccggtg

SEQ ID NO: 177867 - DNA, 25 bp, Artificial Sequence
  Description of Artificial Sequence: Synthetic oligonucleotide
tgaggctgtgcaggaagtgccggtg

SEQ ID NO: 177868 - DNA, 24 bp, Artificial Sequence
  Description of Artificial Sequence: Synthetic oligonucleotide
gaggctgtgcaggaagtgccggtg

SEQ ID NO: 177869 - DNA, 24 bp, Artificial Sequence
  Description of Artificial Sequence: Synthetic oligonucleotide
aggctgtgcaggaagtgccggtgg

SEQ ID NO: 177870 - DNA, 23 bp, Artificial Sequence
  Description of Artificial Sequence: Synthetic oligonucleotide
ggctgtgcaggaagtgccggtgg

SEQ ID NO: 177871 - DNA, 23 bp, Artificial Sequence
  Description of Artificial Sequence: Synthetic oligonucleotide
gctgtgcaggaagtgccggtggg

SEQ ID NO: 177872 - DNA, 23 bp, Artificial Sequence
  Description of Artificial Sequence: Synthetic oligonucleotide
ctgtgcaggaagtgccggtgggg

SEQ ID NO: 177873 - DNA, 24 bp, Artificial Sequence
  Description of Artificial Sequence: Synthetic oligonucleotide
tgtgcaggaagtgccggtggggct

SEQ ID NO: 177874 - DNA, 23 bp, Artificial Sequence
  Description of Artificial Sequence: Synthetic oligonucleotide
gtgcaggaagtgccggtggggct

SEQ ID NO: 177875 - DNA, 23 bp, Artificial Sequence
  Description of Artificial Sequence: Synthetic oligonucleotide
tgcaggaagtgccggtggggctg

SEQ ID NO: 177876 - DNA, 22 bp, Artificial Sequence
  Description of Artificial Sequence: Synthetic oligonucleotide
gcaggaagtgccggtggggctg

SEQ ID NO: 177877 - DNA, 23 bp, Artificial Sequence
  Description of Artificial Sequence: Synthetic oligonucleotide
caggaagtgccggtggggctggt

SEQ ID NO: 177878 - DNA, 23 bp, Artificial Sequence
  Description of Artificial Sequence: Synthetic oligonucleotide
aggaagtgccggtggggctggtg

SEQ ID NO: 177879 - DNA, 22 bp, Artificial Sequence
  Description of Artificial Sequence: Synthetic oligonucleotide
ggaagtgccggtggggctggtg

SEQ ID NO: 177880 - DNA, 23 bp, Artificial Sequence
  Description of Artificial Sequence: Synthetic oligonucleotide
gaagtgccggtggggctggtgca

SEQ ID NO: 177881 - DNA, 23 bp, Artificial Sequence
  Description of Artificial Sequence: Synthetic oligonucleotide
aagtgccggtggggctggtgcag

SEQ ID NO: 177882 - DNA, 22 bp, Artificial Sequence
  Description of Artificial Sequence: Synthetic oligonucleotide
agtgccggtggggctggtgcag

SEQ ID NO: 177883 - DNA, 21 bp, Artificial Sequence
  Description of Artificial Sequence: Synthetic oligonucleotide
gtgccggtggggctggtgcag

SEQ ID NO: 177884 - DNA, 21 bp, Artificial Sequence
  Description of Artificial Sequence: Synthetic oligonucleotide
tgccggtggggctggtgcagc

SEQ ID NO: 177885 - DNA, 20 bp, Artificial Sequence
  Description of Artificial Sequence: Synthetic oligonucleotide
gccggtggggctggtgcagc

SEQ ID NO: 177886 - DNA, 20 bp, Artificial Sequence
  Description of Artificial Sequence: Synthetic oligonucleotide
ccggtggggctggtgcagcc

SEQ ID NO: 177887 - DNA, 20 bp, Artificial Sequence
  Description of Artificial Sequence: Synthetic oligonucleotide
cggtggggctggtgcagccg

SEQ ID NO: 177888 - DNA, 20 bp, Artificial Sequence
  Description of Artificial Sequence: Synthetic oligonucleotide
ggtggggctggtgcagccgg

SEQ ID NO: 177889 - DNA, 20 bp, Artificial Sequence
  Description of Artificial Sequence: Synthetic oligonucleotide
gtggggctggtgcagccggc

SEQ ID NO: 177890 - DNA, 21 bp, Artificial Sequence
  Description of Artificial Sequence: Synthetic oligonucleotide
tggggctggtgcagccggcca

SEQ ID NO: 177891 - DNA, 20 bp, Artificial Sequence
  Description of Artificial Sequence: Synthetic oligonucleotide
ggggctggtgcagccggcca

SEQ ID NO: 177892 - DNA, 20 bp, Artificial Sequence
  Description of Artificial Sequence: Synthetic oligonucleotide
gggctggtgcagccggccag

SEQ ID NO: 177893 - DNA, 20 bp, Artificial Sequence
  Description of Artificial Sequence: Synthetic oligonucleotide
ggctggtgcagccggccagc

SEQ ID NO: 177894 - DNA, 20 bp, Artificial Sequence
  Description of Artificial Sequence: Synthetic oligonucleotide
gctggtgcagccggccagcg

SEQ ID NO: 177895 - DNA, 22 bp, Artificial Sequence
  Description of Artificial Sequence: Synthetic oligonucleotide
ctggtgcagccggccagcgcaa

SEQ ID NO: 177896 - DNA, 22 bp, Artificial Sequence
  Description of Artificial Sequence: Synthetic oligonucleotide
tggtgcagccggccagcgcaac

SEQ ID NO: 177897 - DNA, 21 bp, Artificial Sequence
  Description of Artificial Sequence: Synthetic oligonucleotide
ggtgcagccggccagcgcaac

SEQ ID NO: 177898 - DNA, 21 bp, Artificial Sequence
  Description of Artificial Sequence: Synthetic oligonucleotide
gtgcagccggccagcgcaacc

SEQ ID NO: 177899 - DNA, 22 bp, Artificial Sequence
  Description of Artificial Sequence: Synthetic oligonucleotide
tgcagccggccagcgcaaccct

SEQ ID NO: 177900 - DNA, 21 bp, Artificial Sequence
  Description of Artificial Sequence: Synthetic oligonucleotide
gcagccggccagcgcaaccct

SEQ ID NO: 177901 - DNA, 23 bp, Artificial Sequence
  Description of Artificial Sequence: Synthetic oligonucleotide
cagccggccagcgcaaccctgta

SEQ ID NO: 177902 - DNA, 23 bp, Artificial Sequence
  Description of Artificial Sequence: Synthetic oligonucleotide
agccggccagcgcaaccctgtac

SEQ ID NO: 177903 - DNA, 22 bp, Artificial Sequence
  Description of Artificial Sequence: Synthetic oligonucleotide
gccggccagcgcaaccctgtac

SEQ ID NO: 177904 - DNA, 23 bp, Artificial Sequence
  Description of Artificial Sequence: Synthetic oligonucleotide
ccggccagcgcaaccctgtacga

SEQ ID NO: 177905 - DNA, 25 bp, Artificial Sequence
  Description of Artificial Sequence: Synthetic oligonucleotide
cggccagcgcaaccctgtacgacta

SEQ ID NO: 177906 - DNA, 27 bp, Artificial Sequence
  Description of Artificial Sequence: Synthetic oligonucleotide
ggccagcgcaaccctgtacgactacta

SEQ ID NO: 177907 - DNA, 27 bp, Artificial Sequence
  Description of Artificial Sequence: Synthetic oligonucleotide
gccagcgcaaccctgtacgactactac

SEQ ID NO: 177908 - DNA, 29 bp, Artificial Sequence
  Description of Artificial Sequence: Synthetic oligonucleotide
ccagcgcaaccctgtacgactactacaac

SEQ ID NO: 177909 - DNA, 29 bp, Artificial Sequence
  Description of Artificial Sequence: Synthetic oligonucleotide
cagcgcaaccctgtacgactactacaacc

SEQ ID NO: 177910 - DNA, 29 bp, Artificial Sequence
  Description of Artificial Sequence: Synthetic oligonucleotide
agcgcaaccctgtacgactactacaaccc

SEQ ID NO: 177911 - DNA, 28 bp, Artificial Sequence
  Description of Artificial Sequence: Synthetic oligonucleotide
gcgcaaccctgtacgactactacaaccc

SEQ ID NO: 177912 - DNA, 28 bp, Artificial Sequence
  Description of Artificial Sequence: Synthetic oligonucleotide
cgcaaccctgtacgactactacaacccc

SEQ ID NO: 177913 - DNA, 28 bp, Artificial Sequence
  Description of Artificial Sequence: Synthetic oligonucleotide
gcaaccctgtacgactactacaaccccg

SEQ ID NO: 177914 - DNA, 29 bp, Artificial Sequence
  Description of Artificial Sequence: Synthetic oligonucleotide
caaccctgtacgactactacaaccccgag

SEQ ID NO: 177915 - DNA, 29 bp, Artificial Sequence
  Description of Artificial Sequence: Synthetic oligonucleotide
aaccctgtacgactactacaaccccgagc

SEQ ID NO: 177916 - DNA, 28 bp, Artificial Sequence
  Description of Artificial Sequence: Synthetic oligonucleotide
accctgtacgactactacaaccccgagc

SEQ ID NO: 177917 - DNA, 27 bp, Artificial Sequence
  Description of Artificial Sequence: Synthetic oligonucleotide
ccctgtacgactactacaaccccgagc

SEQ ID NO: 177918 - DNA, 27 bp, Artificial Sequence
  Description of Artificial Sequence: Synthetic oligonucleotide
cctgtacgactactacaaccccgagcg

SEQ ID NO: 177919 - DNA, 27 bp, Artificial Sequence
  Description of Artificial Sequence: Synthetic oligonucleotide
ctgtacgactactacaaccccgagcgc

SEQ ID NO: 177920 - DNA, 28 bp, Artificial Sequence
  Description of Artificial Sequence: Synthetic oligonucleotide
tgtacgactactacaaccccgagcgcag

SEQ ID NO: 177921 - DNA, 27 bp, Artificial Sequence
  Description of Artificial Sequence: Synthetic oligonucleotide
gtacgactactacaaccccgagcgcag

SEQ ID NO: 177922 - DNA, 29 bp, Artificial Sequence
  Description of Artificial Sequence: Synthetic oligonucleotide
tacgactactacaaccccgagcgcagatg

SEQ ID NO: 177923 - DNA, 28 bp, Artificial Sequence
  Description of Artificial Sequence: Synthetic oligonucleotide
acgactactacaaccccgagcgcagatg

SEQ ID NO: 177924 - DNA, 27 bp, Artificial Sequence
  Description of Artificial Sequence: Synthetic oligonucleotide
cgactactacaaccccgagcgcagatg

SEQ ID NO: 177925 - DNA, 29 bp, Artificial Sequence
  Description of Artificial Sequence: Synthetic oligonucleotide
gactactacaaccccgagcgcagatgttc

SEQ ID NO: 177926 - DNA, 30 bp, Artificial Sequence
  Description of Artificial Sequence: Synthetic oligonucleotide
actactacaaccccgagcgcagatgttctg

SEQ ID NO: 177927 - DNA, 29 bp, Artificial Sequence
  Description of Artificial Sequence: Synthetic oligonucleotide
ctactacaaccccgagcgcagatgttctg

SEQ ID NO: 177928 - DNA, 30 bp, Artificial Sequence
  Description of Artificial Sequence: Synthetic oligonucleotide
tactacaaccccgagcgcagatgttctgtg

SEQ ID NO: 177929 - DNA, 29 bp, Artificial Sequence
  Description of Artificial Sequence: Synthetic oligonucleotide
actacaaccccgagcgcagatgttctgtg

SEQ ID NO: 177930 - DNA, 28 bp, Artificial Sequence
  Description of Artificial Sequence: Synthetic oligonucleotide
ctacaaccccgagcgcagatgttctgtg

SEQ ID NO: 177931 - DNA, 33 bp, Artificial Sequence
  Description of Artificial Sequence: Synthetic oligonucleotide
tacaaccccgagcgcagatgttctgtgttttac

SEQ ID NO: 177932 - DNA, 32 bp, Artificial Sequence
  Description of Artificial Sequence: Synthetic oligonucleotide
acaaccccgagcgcagatgttctgtgttttac

SEQ ID NO: 177933 - DNA, 31 bp, Artificial Sequence
  Description of Artificial Sequence: Synthetic oligonucleotide
caaccccgagcgcagatgttctgtgttttac

SEQ ID NO: 177934 - DNA, 31 bp, Artificial Sequence
  Description of Artificial Sequence: Synthetic oligonucleotide
aaccccgagcgcagatgttctgtgttttacg

SEQ ID NO: 177935 - DNA, 30 bp, Artificial Sequence
  Description of Artificial Sequence: Synthetic oligonucleotide
accccgagcgcagatgttctgtgttttacg

SEQ ID NO: 177936 - DNA, 29 bp, Artificial Sequence
  Description of Artificial Sequence: Synthetic oligonucleotide
ccccgagcgcagatgttctgtgttttacg

SEQ ID NO: 177937 - DNA, 29 bp, Artificial Sequence
  Description of Artificial Sequence: Synthetic oligonucleotide
cccgagcgcagatgttctgtgttttacgg

SEQ ID NO: 177938 - DNA, 29 bp, Artificial Sequence
  Description of Artificial Sequence: Synthetic oligonucleotide
ccgagcgcagatgttctgtgttttacggg

SEQ ID NO: 177939 - DNA, 29 bp, Artificial Sequence
  Description of Artificial Sequence: Synthetic oligonucleotide
cgagcgcagatgttctgtgttttacgggg

SEQ ID NO: 177940 - DNA, 29 bp, Artificial Sequence
  Description of Artificial Sequence: Synthetic oligonucleotide
gagcgcagatgttctgtgttttacggggc

SEQ ID NO: 177941 - DNA, 30 bp, Artificial Sequence
  Description of Artificial Sequence: Synthetic oligonucleotide
agcgcagatgttctgtgttttacggggcac

SEQ ID NO: 177942 - DNA, 29 bp, Artificial Sequence
  Description of Artificial Sequence: Synthetic oligonucleotide
gcgcagatgttctgtgttttacggggcac

SEQ ID NO: 177943 - DNA, 29 bp, Artificial Sequence
  Description of Artificial Sequence: Synthetic oligonucleotide
cgcagatgttctgtgttttacggggcacc

SEQ ID NO: 177944 - DNA, 31 bp, Artificial Sequence
  Description of Artificial Sequence: Synthetic oligonucleotide
gcagatgttctgtgttttacggggcaccaag

SEQ ID NO: 177945 - DNA, 34 bp, Artificial Sequence
  Description of Artificial Sequence: Synthetic oligonucleotide
cagatgttctgtgttttacggggcaccaagtaag

SEQ ID NO: 177946 - DNA, 35 bp, Artificial Sequence
  Description of Artificial Sequence: Synthetic oligonucleotide
agatgttctgtgttttacggggcaccaagtaagag

SEQ ID NO: 177947 - DNA, 34 bp, Artificial Sequence
  Description of Artificial Sequence: Synthetic oligonucleotide
gatgttctgtgttttacggggcaccaagtaagag

SEQ ID NO: 177948 - DNA, 34 bp, Artificial Sequence
  Description of Artificial Sequence: Synthetic oligonucleotide
atgttctgtgttttacggggcaccaagtaagagc

SEQ ID NO: 177949 - DNA, 33 bp, Artificial Sequence
  Description of Artificial Sequence: Synthetic oligonucleotide
tgttctgtgttttacggggcaccaagtaagagc

SEQ ID NO: 177950 - DNA, 32 bp, Artificial Sequence
  Description of Artificial Sequence: Synthetic oligonucleotide
gttctgtgttttacggggcaccaagtaagagc

SEQ ID NO: 177951 - DNA, 33 bp, Artificial Sequence
  Description of Artificial Sequence: Synthetic oligonucleotide
ttctgtgttttacggggcaccaagtaagagcag

SEQ ID NO: 177952 - DNA, 32 bp, Artificial Sequence
  Description of Artificial Sequence: Synthetic oligonucleotide
tctgtgttttacggggcaccaagtaagagcag

SEQ ID NO: 177953 - DNA, 31 bp, Artificial Sequence
  Description of Artificial Sequence: Synthetic oligonucleotide
ctgtgttttacggggcaccaagtaagagcag

SEQ ID NO: 177954 - DNA, 32 bp, Artificial Sequence
  Description of Artificial Sequence: Synthetic oligonucleotide
tgtgttttacggggcaccaagtaagagcagac

SEQ ID NO: 177955 - DNA, 31 bp, Artificial Sequence
  Description of Artificial Sequence: Synthetic oligonucleotide
gtgttttacggggcaccaagtaagagcagac

SEQ ID NO: 177956 - DNA, 32 bp, Artificial Sequence
  Description of Artificial Sequence: Synthetic oligonucleotide
tgttttacggggcaccaagtaagagcagactc

SEQ ID NO: 177957 - DNA, 31 bp, Artificial Sequence
  Description of Artificial Sequence: Synthetic oligonucleotide
gttttacggggcaccaagtaagagcagactc

SEQ ID NO: 177958 - DNA, 33 bp, Artificial Sequence
  Description of Artificial Sequence: Synthetic oligonucleotide
ttttacggggcaccaagtaagagcagactcttg

SEQ ID NO: 177959 - DNA, 32 bp, Artificial Sequence
  Description of Artificial Sequence: Synthetic oligonucleotide
tttacggggcaccaagtaagagcagactcttg

SEQ ID NO: 177960 - DNA, 31 bp, Artificial Sequence
  Description of Artificial Sequence: Synthetic oligonucleotide
ttacggggcaccaagtaagagcagactcttg

SEQ ID NO: 177961 - DNA, 30 bp, Artificial Sequence
  Description of Artificial Sequence: Synthetic oligonucleotide
tacggggcaccaagtaagagcagactcttg

SEQ ID NO: 177962 - DNA, 29 bp, Artificial Sequence
  Description of Artificial Sequence: Synthetic oligonucleotide
acggggcaccaagtaagagcagactcttg

SEQ ID NO: 177963 - DNA, 28 bp, Artificial Sequence
  Description of Artificial Sequence: Synthetic oligonucleotide
cggggcaccaagtaagagcagactcttg

SEQ ID NO: 177964 - DNA, 28 bp, Artificial Sequence
  Description of Artificial Sequence: Synthetic oligonucleotide
ggggcaccaagtaagagcagactcttgg

SEQ ID NO: 177965 - DNA, 28 bp, Artificial Sequence
  Description of Artificial Sequence: Synthetic oligonucleotide
gggcaccaagtaagagcagactcttggc

SEQ ID NO: 177966 - DNA, 28 bp, Artificial Sequence
  Description of Artificial Sequence: Synthetic oligonucleotide
ggcaccaagtaagagcagactcttggcc

SEQ ID NO: 177967 - DNA, 29 bp, Artificial Sequence
  Description of Artificial Sequence: Synthetic oligonucleotide
gcaccaagtaagagcagactcttggccac

SEQ ID NO: 177968 - DNA, 29 bp, Artificial Sequence
  Description of Artificial Sequence: Synthetic oligonucleotide
caccaagtaagagcagactcttggccacc

SEQ ID NO: 177969 - DNA, 31 bp, Artificial Sequence
  Description of Artificial Sequence: Synthetic oligonucleotide
accaagtaagagcagactcttggccaccttg

SEQ ID NO: 177970 - DNA, 30 bp, Artificial Sequence
  Description of Artificial Sequence: Synthetic oligonucleotide
ccaagtaagagcagactcttggccaccttg

SEQ ID NO: 177971 - DNA, 31 bp, Artificial Sequence
  Description of Artificial Sequence: Synthetic oligonucleotide
caagtaagagcagactcttggccaccttgtg

SEQ ID NO: 177972 - DNA, 33 bp, Artificial Sequence
  Description of Artificial Sequence: Synthetic oligonucleotide
aagtaagagcagactcttggccaccttgtgttc

SEQ ID NO: 177973 - DNA, 32 bp, Artificial Sequence
  Description of Artificial Sequence: Synthetic oligonucleotide
agtaagagcagactcttggccaccttgtgttc

SEQ ID NO: 177974 - DNA, 31 bp, Artificial Sequence
  Description of Artificial Sequence: Synthetic oligonucleotide
gtaagagcagactcttggccaccttgtgttc

SEQ ID NO: 177975 - DNA, 32 bp, Artificial Sequence
  Description of Artificial Sequence: Synthetic oligonucleotide
taagagcagactcttggccaccttgtgttctg

SEQ ID NO: 177976 - DNA, 31 bp, Artificial Sequence
  Description of Artificial Sequence: Synthetic oligonucleotide
aagagcagactcttggccaccttgtgttctg

SEQ ID NO: 177977 - DNA, 30 bp, Artificial Sequence
  Description of Artificial Sequence: Synthetic oligonucleotide
agagcagactcttggccaccttgtgttctg

SEQ ID NO: 177978 - DNA, 29 bp, Artificial Sequence
  Description of Artificial Sequence: Synthetic oligonucleotide
gagcagactcttggccaccttgtgttctg

SEQ ID NO: 177979 - DNA, 29 bp, Artificial Sequence
  Description of Artificial Sequence: Synthetic oligonucleotide
agcagactcttggccaccttgtgttctgc

SEQ ID NO: 177980 - DNA, 28 bp, Artificial Sequence
  Description of Artificial Sequence: Synthetic oligonucleotide
gcagactcttggccaccttgtgttctgc

SEQ ID NO: 177981 - DNA, 29 bp, Artificial Sequence
  Description of Artificial Sequence: Synthetic oligonucleotide
cagactcttggccaccttgtgttctgctg

SEQ ID NO: 177982 - DNA, 31 bp, Artificial Sequence
  Description of Artificial Sequence: Synthetic oligonucleotide
agactcttggccaccttgtgttctgctgaag

SEQ ID NO: 177983 - DNA, 30 bp, Artificial Sequence
  Description of Artificial Sequence: Synthetic oligonucleotide
gactcttggccaccttgtgttctgctgaag

SEQ ID NO: 177984 - DNA, 31 bp, Artificial Sequence
  Description of Artificial Sequence: Synthetic oligonucleotide
actcttggccaccttgtgttctgctgaagtc

SEQ ID NO: 177985 - DNA, 30 bp, Artificial Sequence
  Description of Artificial Sequence: Synthetic oligonucleotide
ctcttggccaccttgtgttctgctgaagtc

SEQ ID NO: 177986 - DNA, 31 bp, Artificial Sequence
  Description of Artificial Sequence: Synthetic oligonucleotide
tcttggccaccttgtgttctgctgaagtctg

SEQ ID NO: 177987 - DNA, 30 bp, Artificial Sequence
  Description of Artificial Sequence: Synthetic oligonucleotide
cttggccaccttgtgttctgctgaagtctg

SEQ ID NO: 177988 - DNA, 30 bp, Artificial Sequence
  Description of Artificial Sequence: Synthetic oligonucleotide
ttggccaccttgtgttctgctgaagtctgc

SEQ ID NO: 177989 - DNA, 29 bp, Artificial Sequence
  Description of Artificial Sequence: Synthetic oligonucleotide
tggccaccttgtgttctgctgaagtctgc

SEQ ID NO: 177990 - DNA, 28 bp, Artificial Sequence
  Description of Artificial Sequence: Synthetic oligonucleotide
ggccaccttgtgttctgctgaagtctgc

SEQ ID NO: 177991 - DNA, 28 bp, Artificial Sequence
  Description of Artificial Sequence: Synthetic oligonucleotide
gccaccttgtgttctgctgaagtctgcc

SEQ ID NO: 177992 - DNA, 29 bp, Artificial Sequence
  Description of Artificial Sequence: Synthetic oligonucleotide
ccaccttgtgttctgctgaagtctgccag

SEQ ID NO: 177993 - DNA, 30 bp, Artificial Sequence
  Description of Artificial Sequence: Synthetic oligonucleotide
caccttgtgttctgctgaagtctgccagtg

SEQ ID NO: 177994 - DNA, 31 bp, Artificial Sequence
  Description of Artificial Sequence: Synthetic oligonucleotide
accttgtgttctgctgaagtctgccagtgtg

SEQ ID NO: 177995 - DNA, 30 bp, Artificial Sequence
  Description of Artificial Sequence: Synthetic oligonucleotide
ccttgtgttctgctgaagtctgccagtgtg

SEQ ID NO: 177996 - DNA, 30 bp, Artificial Sequence
  Description of Artificial Sequence: Synthetic oligonucleotide
cttgtgttctgctgaagtctgccagtgtgc

SEQ ID NO: 177997 - DNA, 31 bp, Artificial Sequence
  Description of Artificial Sequence: Synthetic oligonucleotide
ttgtgttctgctgaagtctgccagtgtgctg

SEQ ID NO: 177998 - DNA, 30 bp, Artificial Sequence
  Description of Artificial Sequence: Synthetic oligonucleotide
tgtgttctgctgaagtctgccagtgtgctg

SEQ ID NO: 177999 - DNA, 29 bp, Artificial Sequence
  Description of Artificial Sequence: Synthetic oligonucleotide
gtgttctgctgaagtctgccagtgtgctg

SEQ ID NO: 178000 - DNA, 30 bp, Artificial Sequence
  Description of Artificial Sequence: Synthetic oligonucleotide
tgttctgctgaagtctgccagtgtgctgag

SEQ ID NO: 178001 - DNA, 29 bp, Artificial Sequence
  Description of Artificial Sequence: Synthetic oligonucleotide
gttctgctgaagtctgccagtgtgctgag

SEQ ID NO: 178002 - DNA, 29 bp, Artificial Sequence
  Description of Artificial Sequence: Synthetic oligonucleotide
ttctgctgaagtctgccagtgtgctgagg

SEQ ID NO: 178003 - DNA, 28 bp, Artificial Sequence
  Description of Artificial Sequence: Synthetic oligonucleotide
tctgctgaagtctgccagtgtgctgagg

SEQ ID NO: 178004 - DNA, 27 bp, Artificial Sequence
  Description of Artificial Sequence: Synthetic oligonucleotide
ctgctgaagtctgccagtgtgctgagg

SEQ ID NO: 178005 - DNA, 27 bp, Artificial Sequence
  Description of Artificial Sequence: Synthetic oligonucleotide
tgctgaagtctgccagtgtgctgaggg

SEQ ID NO: 178006 - DNA, 26 bp, Artificial Sequence
  Description of Artificial Sequence: Synthetic oligonucleotide
gctgaagtctgccagtgtgctgaggg

SEQ ID NO: 178007 - DNA, 27 bp, Artificial Sequence
  Description of Artificial Sequence: Synthetic oligonucleotide
ctgaagtctgccagtgtgctgagggga

SEQ ID NO: 178008 - DNA, 28 bp, Artificial Sequence
  Description of Artificial Sequence: Synthetic oligonucleotide
tgaagtctgccagtgtgctgaggggaag

SEQ ID NO: 178009 - DNA, 27 bp, Artificial Sequence
  Description of Artificial Sequence: Synthetic oligonucleotide
gaagtctgccagtgtgctgaggggaag

SEQ ID NO: 178010 - DNA, 28 bp, Artificial Sequence
  Description of Artificial Sequence: Synthetic oligonucleotide
aagtctgccagtgtgctgaggggaagtg

SEQ ID NO: 178011 - DNA, 27 bp, Artificial Sequence
  Description of Artificial Sequence: Synthetic oligonucleotide
agtctgccagtgtgctgaggggaagtg

SEQ ID NO: 178012 - DNA, 26 bp, Artificial Sequence
  Description of Artificial Sequence: Synthetic oligonucleotide
gtctgccagtgtgctgaggggaagtg

SEQ ID NO: 178013 - DNA, 26 bp, Artificial Sequence
  Description of Artificial Sequence: Synthetic oligonucleotide
tctgccagtgtgctgaggggaagtgc

SEQ ID NO: 178014 - DNA, 25 bp, Artificial Sequence
  Description of Artificial Sequence: Synthetic oligonucleotide
ctgccagtgtgctgaggggaagtgc

SEQ ID NO: 178015 - DNA, 25 bp, Artificial Sequence
  Description of Artificial Sequence: Synthetic oligonucleotide
tgccagtgtgctgaggggaagtgcc

SEQ ID NO: 178016 - DNA, 24 bp, Artificial Sequence
  Description of Artificial Sequence: Synthetic oligonucleotide
gccagtgtgctgaggggaagtgcc

SEQ ID NO: 178017 - DNA, 25 bp, Artificial Sequence
  Description of Artificial Sequence: Synthetic oligonucleotide
ccagtgtgctgaggggaagtgccct

SEQ ID NO: 178018 - DNA, 25 bp, Artificial Sequence
  Description of Artificial Sequence: Synthetic oligonucleotide
cagtgtgctgaggggaagtgccctc

SEQ ID NO: 178019 - DNA, 25 bp, Artificial Sequence
  Description of Artificial Sequence: Synthetic oligonucleotide
agtgtgctgaggggaagtgccctcg

SEQ ID NO: 178020 - DNA, 24 bp, Artificial Sequence
  Description of Artificial Sequence: Synthetic oligonucleotide
gtgtgctgaggggaagtgccctcg

SEQ ID NO: 178021 - DNA, 24 bp, Artificial Sequence
  Description of Artificial Sequence: Synthetic oligonucleotide
tgtgctgaggggaagtgccctcgc

SEQ ID NO: 178022 - DNA, 23 bp, Artificial Sequence
  Description of Artificial Sequence: Synthetic oligonucleotide
gtgctgaggggaagtgccctcgc

SEQ ID NO: 178023 - DNA, 24 bp, Artificial Sequence
  Description of Artificial Sequence: Synthetic oligonucleotide
tgctgaggggaagtgccctcgcca

SEQ ID NO: 178024 - DNA, 23 bp, Artificial Sequence
  Description of Artificial Sequence: Synthetic oligonucleotide
gctgaggggaagtgccctcgcca

SEQ ID NO: 178025 - DNA, 23 bp, Artificial Sequence
  Description of Artificial Sequence: Synthetic oligonucleotide
ctgaggggaagtgccctcgccag

SEQ ID NO: 178026 - DNA, 23 bp, Artificial Sequence
  Description of Artificial Sequence: Synthetic oligonucleotide
tgaggggaagtgccctcgccagc

SEQ ID NO: 178027 - DNA, 22 bp, Artificial Sequence
  Description of Artificial Sequence: Synthetic oligonucleotide
gaggggaagtgccctcgccagc

SEQ ID NO: 178028 - DNA, 23 bp, Artificial Sequence
  Description of Artificial Sequence: Synthetic oligonucleotide
aggggaagtgccctcgccagcgt

SEQ ID NO: 178029 - DNA, 22 bp, Artificial Sequence
  Description of Artificial Sequence: Synthetic oligonucleotide
ggggaagtgccctcgccagcgt

SEQ ID NO: 178030 - DNA, 22 bp, Artificial Sequence
  Description of Artificial Sequence: Synthetic oligonucleotide
gggaagtgccctcgccagcgtc

SEQ ID NO: 178031 - DNA, 22 bp, Artificial Sequence
  Description of Artificial Sequence: Synthetic oligonucleotide
ggaagtgccctcgccagcgtcg

SEQ ID NO: 178032 - DNA, 22 bp, Artificial Sequence
  Description of Artificial Sequence: Synthetic oligonucleotide
gaagtgccctcgccagcgtcgc

SEQ ID NO: 178033 - DNA, 22 bp, Artificial Sequence
  Description of Artificial Sequence: Synthetic oligonucleotide
aagtgccctcgccagcgtcgcg

SEQ ID NO: 178034 - DNA, 21 bp, Artificial Sequence
  Description of Artificial Sequence: Synthetic oligonucleotide
agtgccctcgccagcgtcgcg

SEQ ID NO: 178035 - DNA, 20 bp, Artificial Sequence
  Description of Artificial Sequence: Synthetic oligonucleotide
gtgccctcgccagcgtcgcg

SEQ ID NO: 178036 - DNA, 20 bp, Artificial Sequence
  Description of Artificial Sequence: Synthetic oligonucleotide
tgccctcgccagcgtcgcgc

SEQ ID NO: 178037 - DNA, 20 bp, Artificial Sequence
  Description of Artificial Sequence: Synthetic oligonucleotide
gccctcgccagcgtcgcgct

SEQ ID NO: 178038 - DNA, 20 bp, Artificial Sequence
  Description of Artificial Sequence: Synthetic oligonucleotide
ccctcgccagcgtcgcgcct

SEQ ID NO: 178039 - DNA, 20 bp, Artificial Sequence
  Description of Artificial Sequence: Synthetic oligonucleotide
cctcgccagcgtcgcgccct

SEQ ID NO: 178040 - DNA, 20 bp, Artificial Sequence
  Description of Artificial Sequence: Synthetic oligonucleotide
ctcgccagcgtcgcgccctg

SEQ ID NO: 178041 - DNA, 21 bp, Artificial Sequence
  Description of Artificial Sequence: Synthetic oligonucleotide
tcgccagcgtcgcgccctgga

SEQ ID NO: 178042 - DNA, 20 bp, Artificial Sequence
  Description of Artificial Sequence: Synthetic oligonucleotide
cgccagcgtcgcgccctgga

SEQ ID NO: 178043 - DNA, 20 bp, Artificial Sequence
  Description of Artificial Sequence: Synthetic oligonucleotide
gccagcgtcgcgccctggag

SEQ ID NO: 178044 - DNA, 20 bp, Artificial Sequence
  Description of Artificial Sequence: Synthetic oligonucleotide
ccagcgtcgcgccctggagc

SEQ ID NO: 178045 - DNA, 20 bp, Artificial Sequence
  Description of Artificial Sequence: Synthetic oligonucleotide
cagcgtcgcgccctggagcg

SEQ ID NO: 178046 - DNA, 20 bp, Artificial Sequence
  Description of Artificial Sequence: Synthetic oligonucleotide
agcgtcgcgccctggagcgg

SEQ ID NO: 178047 - DNA, 20 bp, Artificial Sequence
  Description of Artificial Sequence: Synthetic oligonucleotide
gcgtcgcgccctggagcggt

SEQ ID NO: 178048 - DNA, 20 bp, Artificial Sequence
  Description of Artificial Sequence: Synthetic oligonucleotide
cgtcgcgccctggagcgggt

SEQ ID NO: 178049 - DNA, 20 bp, Artificial Sequence
  Description of Artificial Sequence: Synthetic oligonucleotide
gtcgcgccctggagcggggt

SEQ ID NO: 178050 - DNA, 21 bp, Artificial Sequence
  Description of Artificial Sequence: Synthetic oligonucleotide
tcgcgccctggagcggggtct

SEQ ID NO: 178051 - DNA, 20 bp, Artificial Sequence
  Description of Artificial Sequence: Synthetic oligonucleotide
cgcgccctggagcggggtct

SEQ ID NO: 178052 - DNA, 20 bp, Artificial Sequence
  Description of Artificial Sequence: Synthetic oligonucleotide
gcgccctggagcggggtctg

SEQ ID NO: 178053 - DNA, 21 bp, Artificial Sequence
  Description of Artificial Sequence: Synthetic oligonucleotide
cgccctggagcggggtctgca

SEQ ID NO: 178054 - DNA, 21 bp, Artificial Sequence
  Description of Artificial Sequence: Synthetic oligonucleotide
gccctggagcggggtctgcag

SEQ ID NO: 178055 - DNA, 22 bp, Artificial Sequence
  Description of Artificial Sequence: Synthetic oligonucleotide
ccctggagcggggtctgcagga

SEQ ID NO: 178056 - DNA, 22 bp, Artificial Sequence
  Description of Artificial Sequence: Synthetic oligonucleotide
cctggagcggggtctgcaggac

SEQ ID NO: 178057 - DNA, 23 bp, Artificial Sequence
  Description of Artificial Sequence: Synthetic oligonucleotide
ctggagcggggtctgcaggacga

SEQ ID NO: 178058 - DNA, 23 bp, Artificial Sequence
  Description of Artificial Sequence: Synthetic oligonucleotide
tggagcggggtctgcaggacgag

SEQ ID NO: 178059 - DNA, 22 bp, Artificial Sequence
  Description of Artificial Sequence: Synthetic oligonucleotide
ggagcggggtctgcaggacgag

SEQ ID NO: 178060 - DNA, 24 bp, Artificial Sequence
  Description of Artificial Sequence: Synthetic oligonucleotide
gagcggggtctgcaggacgaggat

SEQ ID NO: 178061 - DNA, 24 bp, Artificial Sequence
  Description of Artificial Sequence: Synthetic oligonucleotide
agcggggtctgcaggacgaggatg

SEQ ID NO: 178062 - DNA, 23 bp, Artificial Sequence
  Description of Artificial Sequence: Synthetic oligonucleotide
gcggggtctgcaggacgaggatg

SEQ ID NO: 178063 - DNA, 23 bp, Artificial Sequence
  Description of Artificial Sequence: Synthetic oligonucleotide
cggggtctgcaggacgaggatgg

SEQ ID NO: 178064 - DNA, 25 bp, Artificial Sequence
  Description of Artificial Sequence: Synthetic oligonucleotide
ggggtctgcaggacgaggatggcta

SEQ ID NO: 178065 - DNA, 26 bp, Artificial Sequence
  Description of Artificial Sequence: Synthetic oligonucleotide
gggtctgcaggacgaggatggctaca

SEQ ID NO: 178066 - DNA, 26 bp, Artificial Sequence
  Description of Artificial Sequence: Synthetic oligonucleotide
ggtctgcaggacgaggatggctacag

SEQ ID NO: 178067 - DNA, 27 bp, Artificial Sequence
  Description of Artificial Sequence: Synthetic oligonucleotide
gtctgcaggacgaggatggctacagga

SEQ ID NO: 178068 - DNA, 28 bp, Artificial Sequence
  Description of Artificial Sequence: Synthetic oligonucleotide
tctgcaggacgaggatggctacaggatg

SEQ ID NO: 178069 - DNA, 27 bp, Artificial Sequence
  Description of Artificial Sequence: Synthetic oligonucleotide
ctgcaggacgaggatggctacaggatg

SEQ ID NO: 178070 - DNA, 29 bp, Artificial Sequence
  Description of Artificial Sequence: Synthetic oligonucleotide
tgcaggacgaggatggctacaggatgaag

SEQ ID NO: 178071 - DNA, 28 bp, Artificial Sequence
  Description of Artificial Sequence: Synthetic oligonucleotide
gcaggacgaggatggctacaggatgaag

SEQ ID NO: 178072 - DNA, 31 bp, Artificial Sequence
  Description of Artificial Sequence: Synthetic oligonucleotide
caggacgaggatggctacaggatgaagtttg

SEQ ID NO: 178073 - DNA, 31 bp, Artificial Sequence
  Description of Artificial Sequence: Synthetic oligonucleotide
aggacgaggatggctacaggatgaagtttgc

SEQ ID NO: 178074 - DNA, 30 bp, Artificial Sequence
  Description of Artificial Sequence: Synthetic oligonucleotide
ggacgaggatggctacaggatgaagtttgc

SEQ ID NO: 178075 - DNA, 30 bp, Artificial Sequence
  Description of Artificial Sequence: Synthetic oligonucleotide
gacgaggatggctacaggatgaagtttgcc

SEQ ID NO: 178076 - DNA, 31 bp, Artificial Sequence
  Description of Artificial Sequence: Synthetic oligonucleotide
acgaggatggctacaggatgaagtttgcctg

SEQ ID NO: 178077 - DNA, 30 bp, Artificial Sequence
  Description of Artificial Sequence: Synthetic oligonucleotide
cgaggatggctacaggatgaagtttgcctg

SEQ ID NO: 178078 - DNA, 30 bp, Artificial Sequence
  Description of Artificial Sequence: Synthetic oligonucleotide
gaggatggctacaggatgaagtttgcctgc

SEQ ID NO: 178079 - DNA, 32 bp, Artificial Sequence
  Description of Artificial Sequence: Synthetic oligonucleotide
aggatggctacaggatgaagtttgcctgctac

SEQ ID NO: 178080 - DNA, 31 bp, Artificial Sequence
  Description of Artificial Sequence: Synthetic oligonucleotide
ggatggctacaggatgaagtttgcctgctac

SEQ ID NO: 178081 - DNA, 33 bp, Artificial Sequence
  Description of Artificial Sequence: Synthetic oligonucleotide
gatggctacaggatgaagtttgcctgctactac

SEQ ID NO: 178082 - DNA, 33 bp, Artificial Sequence
  Description of Artificial Sequence: Synthetic oligonucleotide
atggctacaggatgaagtttgcctgctactacc

SEQ ID NO: 178083 - DNA, 32 bp, Artificial Sequence
  Description of Artificial Sequence: Synthetic oligonucleotide
tggctacaggatgaagtttgcctgctactacc

SEQ ID NO: 178084 - DNA, 31 bp, Artificial Sequence
  Description of Artificial Sequence: Synthetic oligonucleotide
ggctacaggatgaagtttgcctgctactacc

SEQ ID NO: 178085 - DNA, 31 bp, Artificial Sequence
  Description of Artificial Sequence: Synthetic oligonucleotide
gctacaggatgaagtttgcctgctactaccc

SEQ ID NO: 178086 - DNA, 31 bp, Artificial Sequence
  Description of Artificial Sequence: Synthetic oligonucleotide
ctacaggatgaagtttgcctgctactacccc

SEQ ID NO: 178087 - DNA, 31 bp, Artificial Sequence
  Description of Artificial Sequence: Synthetic oligonucleotide
tacaggatgaagtttgcctgctactaccccc

SEQ ID NO: 178088 - DNA, 30 bp, Artificial Sequence
  Description of Artificial Sequence: Synthetic oligonucleotide
acaggatgaagtttgcctgctactaccccc

SEQ ID NO: 178089 - DNA, 29 bp, Artificial Sequence
  Description of Artificial Sequence: Synthetic oligonucleotide
caggatgaagtttgcctgctactaccccc

SEQ ID NO: 178090 - DNA, 29 bp, Artificial Sequence
  Description of Artificial Sequence: Synthetic oligonucleotide
aggatgaagtttgcctgctactacccccg

SEQ ID NO: 178091 - DNA, 28 bp, Artificial Sequence
  Description of Artificial Sequence: Synthetic oligonucleotide
ggatgaagtttgcctgctactacccccg

SEQ ID NO: 178092 - DNA, 29 bp, Artificial Sequence
  Description of Artificial Sequence: Synthetic oligonucleotide
gatgaagtttgcctgctactacccccgtg

SEQ ID NO: 178093 - DNA, 30 bp, Artificial Sequence
  Description of Artificial Sequence: Synthetic oligonucleotide
atgaagtttgcctgctactacccccgtgtg

SEQ ID NO: 178094 - DNA, 29 bp, Artificial Sequence
  Description of Artificial Sequence: Synthetic oligonucleotide
tgaagtttgcctgctactacccccgtgtg

SEQ ID NO: 178095 - DNA, 28 bp, Artificial Sequence
  Description of Artificial Sequence: Synthetic oligonucleotide
gaagtttgcctgctactacccccgtgtg

SEQ ID NO: 178096 - DNA, 28 bp, Artificial Sequence
  Description of Artificial Sequence: Synthetic oligonucleotide
aagtttgcctgctactacccccgtgtgg

SEQ ID NO: 178097 - DNA, 27 bp, Artificial Sequence
  Description of Artificial Sequence: Synthetic oligonucleotide
agtttgcctgctactacccccgtgtgg

SEQ ID NO: 178098 - DNA, 27 bp, Artificial Sequence
  Description of Artificial Sequence: Synthetic oligonucleotide
gtttgcctgctactacccccgtgtgga

SEQ ID NO: 178099 - DNA, 27 bp, Artificial Sequence
  Description of Artificial Sequence: Synthetic oligonucleotide
tttgcctgctactacccccgtgtggag

SEQ ID NO: 178100 - DNA, 27 bp, Artificial Sequence
  Description of Artificial Sequence: Synthetic oligonucleotide
ttgcctgctactacccccgtgtggagt

SEQ ID NO: 178101 - DNA, 27 bp, Artificial Sequence
  Description of Artificial Sequence: Synthetic oligonucleotide
tgcctgctactacccccgtgtggagta

SEQ ID NO: 178102 - DNA, 26 bp, Artificial Sequence
  Description of Artificial Sequence: Synthetic oligonucleotide
gcctgctactacccccgtgtggagta

SEQ ID NO: 178103 - DNA, 26 bp, Artificial Sequence
  Description of Artificial Sequence: Synthetic oligonucleotide
cctgctactacccccgtgtggagtac

SEQ ID NO: 178104 - DNA, 26 bp, Artificial Sequence
  Description of Artificial Sequence: Synthetic oligonucleotide
ctgctactacccccgtgtggagtacg

SEQ ID NO: 178105 - DNA, 26 bp, Artificial Sequence
  Description of Artificial Sequence: Synthetic oligonucleotide
tgctactacccccgtgtggagtacgg

SEQ ID NO: 178106 - DNA, 25 bp, Artificial Sequence
  Description of Artificial Sequence: Synthetic oligonucleotide
gctactacccccgtgtggagtacgg

SEQ ID NO: 178107 - DNA, 27 bp, Artificial Sequence
  Description of Artificial Sequence: Synthetic oligonucleotide
ctactacccccgtgtggagtacggctt

SEQ ID NO: 178108 - DNA, 27 bp, Artificial Sequence
  Description of Artificial Sequence: Synthetic oligonucleotide
tactacccccgtgtggagtacggcttc

SEQ ID NO: 178109 - DNA, 26 bp, Artificial Sequence
  Description of Artificial Sequence: Synthetic oligonucleotide
actacccccgtgtggagtacggcttc

SEQ ID NO: 178110 - DNA, 25 bp, Artificial Sequence
  Description of Artificial Sequence: Synthetic oligonucleotide
ctacccccgtgtggagtacggcttc

SEQ ID NO: 178111 - DNA, 26 bp, Artificial Sequence
  Description of Artificial Sequence: Synthetic oligonucleotide
tacccccgtgtggagtacggcttcca

SEQ ID NO: 178112 - DNA, 25 bp, Artificial Sequence
  Description of Artificial Sequence: Synthetic oligonucleotide
acccccgtgtggagtacggcttcca

SEQ ID NO: 178113 - DNA, 24 bp, Artificial Sequence
  Description of Artificial Sequence: Synthetic oligonucleotide
cccccgtgtggagtacggcttcca

SEQ ID NO: 178114 - DNA, 24 bp, Artificial Sequence
  Description of Artificial Sequence: Synthetic oligonucleotide
ccccgtgtggagtacggcttccag

SEQ ID NO: 178115 - DNA, 27 bp, Artificial Sequence
  Description of Artificial Sequence: Synthetic oligonucleotide
cccgtgtggagtacggcttccaggtta

SEQ ID NO: 178116 - DNA, 28 bp, Artificial Sequence
  Description of Artificial Sequence: Synthetic oligonucleotide
ccgtgtggagtacggcttccaggttaag

SEQ ID NO: 178117 - DNA, 28 bp, Artificial Sequence
  Description of Artificial Sequence: Synthetic oligonucleotide
cgtgtggagtacggcttccaggttaagg

SEQ ID NO: 178118 - DNA, 30 bp, Artificial Sequence
  Description of Artificial Sequence: Synthetic oligonucleotide
gtgtggagtacggcttccaggttaaggttc

SEQ ID NO: 178119 - DNA, 31 bp, Artificial Sequence
  Description of Artificial Sequence: Synthetic oligonucleotide
tgtggagtacggcttccaggttaaggttctc

SEQ ID NO: 178120 - DNA, 30 bp, Artificial Sequence
  Description of Artificial Sequence: Synthetic oligonucleotide
gtggagtacggcttccaggttaaggttctc

SEQ ID NO: 178121 - DNA, 30 bp, Artificial Sequence
  Description of Artificial Sequence: Synthetic oligonucleotide
tggagtacggcttccaggttaaggttctcc

SEQ ID NO: 178122 - DNA, 29 bp, Artificial Sequence
  Description of Artificial Sequence: Synthetic oligonucleotide
ggagtacggcttccaggttaaggttctcc

SEQ ID NO: 178123 - DNA, 29 bp, Artificial Sequence
  Description of Artificial Sequence: Synthetic oligonucleotide
gagtacggcttccaggttaaggttctccg

SEQ ID NO: 178124 - DNA, 30 bp, Artificial Sequence
  Description of Artificial Sequence: Synthetic oligonucleotide
agtacggcttccaggttaaggttctccgag

SEQ ID NO: 178125 - DNA, 29 bp, Artificial Sequence
  Description of Artificial Sequence: Synthetic oligonucleotide
gtacggcttccaggttaaggttctccgag

SEQ ID NO: 178126 - DNA, 31 bp, Artificial Sequence
  Description of Artificial Sequence: Synthetic oligonucleotide
tacggcttccaggttaaggttctccgagaag

SEQ ID NO: 178127 - DNA, 30 bp, Artificial Sequence
  Description of Artificial Sequence: Synthetic oligonucleotide
acggcttccaggttaaggttctccgagaag

SEQ ID NO: 178128 - DNA, 29 bp, Artificial Sequence
  Description of Artificial Sequence: Synthetic oligonucleotide
cggcttccaggttaaggttctccgagaag

SEQ ID NO: 178129 - DNA, 30 bp, Artificial Sequence
  Description of Artificial Sequence: Synthetic oligonucleotide
ggcttccaggttaaggttctccgagaagac

SEQ ID NO: 178130 - DNA, 31 bp, Artificial Sequence
  Description of Artificial Sequence: Synthetic oligonucleotide
gcttccaggttaaggttctccgagaagacag

SEQ ID NO: 178131 - DNA, 31 bp, Artificial Sequence
  Description of Artificial Sequence: Synthetic oligonucleotide
cttccaggttaaggttctccgagaagacagc

SEQ ID NO: 178132 - DNA, 32 bp, Artificial Sequence
  Description of Artificial Sequence: Synthetic oligonucleotide
ttccaggttaaggttctccgagaagacagcag

SEQ ID NO: 178133 - DNA, 31 bp, Artificial Sequence
  Description of Artificial Sequence: Synthetic oligonucleotide
tccaggttaaggttctccgagaagacagcag

SEQ ID NO: 178134 - DNA, 30 bp, Artificial Sequence
  Description of Artificial Sequence: Synthetic oligonucleotide
ccaggttaaggttctccgagaagacagcag

SEQ ID NO: 178135 - DNA, 31 bp, Artificial Sequence
  Description of Artificial Sequence: Synthetic oligonucleotide
caggttaaggttctccgagaagacagcagag

SEQ ID NO: 178136 - DNA, 31 bp, Artificial Sequence
  Description of Artificial Sequence: Synthetic oligonucleotide
aggttaaggttctccgagaagacagcagagc

SEQ ID NO: 178137 - DNA, 30 bp, Artificial Sequence
  Description of Artificial Sequence: Synthetic oligonucleotide
ggttaaggttctccgagaagacagcagagc

SEQ ID NO: 178138 - DNA, 31 bp, Artificial Sequence
  Description of Artificial Sequence: Synthetic oligonucleotide
gttaaggttctccgagaagacagcagagctg

SEQ ID NO: 178139 - DNA, 31 bp, Artificial Sequence
  Description of Artificial Sequence: Synthetic oligonucleotide
ttaaggttctccgagaagacagcagagctgc

SEQ ID NO: 178140 - DNA, 30 bp, Artificial Sequence
  Description of Artificial Sequence: Synthetic oligonucleotide
taaggttctccgagaagacagcagagctgc

SEQ ID NO: 178141 - DNA, 29 bp, Artificial Sequence
  Description of Artificial Sequence: Synthetic oligonucleotide
aaggttctccgagaagacagcagagctgc

SEQ ID NO: 178142 - DNA, 28 bp, Artificial Sequence
  Description of Artificial Sequence: Synthetic oligonucleotide
aggttctccgagaagacagcagagctgc

SEQ ID NO: 178143 - DNA, 27 bp, Artificial Sequence
  Description of Artificial Sequence: Synthetic oligonucleotide
ggttctccgagaagacagcagagctgc

SEQ ID NO: 178144 - DNA, 30 bp, Artificial Sequence
  Description of Artificial Sequence: Synthetic oligonucleotide
gttctccgagaagacagcagagctgctttc

SEQ ID NO: 178145 - DNA, 30 bp, Artificial Sequence
  Description of Artificial Sequence: Synthetic oligonucleotide
ttctccgagaagacagcagagctgctttcc

SEQ ID NO: 178146 - DNA, 29 bp, Artificial Sequence
  Description of Artificial Sequence: Synthetic oligonucleotide
tctccgagaagacagcagagctgctttcc

SEQ ID NO: 178147 - DNA, 28 bp, Artificial Sequence
  Description of Artificial Sequence: Synthetic oligonucleotide
ctccgagaagacagcagagctgctttcc

SEQ ID NO: 178148 - DNA, 28 bp, Artificial Sequence
  Description of Artificial Sequence: Synthetic oligonucleotide
tccgagaagacagcagagctgctttccg

SEQ ID NO: 178149 - DNA, 27 bp, Artificial Sequence
  Description of Artificial Sequence: Synthetic oligonucleotide
ccgagaagacagcagagctgctttccg

SEQ ID NO: 178150 - DNA, 27 bp, Artificial Sequence
  Description of Artificial Sequence: Synthetic oligonucleotide
cgagaagacagcagagctgctttccgc

SEQ ID NO: 178151 - DNA, 27 bp, Artificial Sequence
  Description of Artificial Sequence: Synthetic oligonucleotide
gagaagacagcagagctgctttccgcc

SEQ ID NO: 178152 - DNA, 28 bp, Artificial Sequence
  Description of Artificial Sequence: Synthetic oligonucleotide
agaagacagcagagctgctttccgcctc

SEQ ID NO: 178153 - DNA, 27 bp, Artificial Sequence
  Description of Artificial Sequence: Synthetic oligonucleotide
gaagacagcagagctgctttccgcctc

SEQ ID NO: 178154 - DNA, 30 bp, Artificial Sequence
  Description of Artificial Sequence: Synthetic oligonucleotide
aagacagcagagctgctttccgcctctttg

SEQ ID NO: 178155 - DNA, 29 bp, Artificial Sequence
  Description of Artificial Sequence: Synthetic oligonucleotide
agacagcagagctgctttccgcctctttg

SEQ ID NO: 178156 - DNA, 28 bp, Artificial Sequence
  Description of Artificial Sequence: Synthetic oligonucleotide
gacagcagagctgctttccgcctctttg

SEQ ID NO: 178157 - DNA, 29 bp, Artificial Sequence
  Description of Artificial Sequence: Synthetic oligonucleotide
acagcagagctgctttccgcctctttgag

SEQ ID NO: 178158 - DNA, 28 bp, Artificial Sequence
  Description of Artificial Sequence: Synthetic oligonucleotide
cagcagagctgctttccgcctctttgag

SEQ ID NO: 178159 - DNA, 29 bp, Artificial Sequence
  Description of Artificial Sequence: Synthetic oligonucleotide
agcagagctgctttccgcctctttgagac

SEQ ID NO: 178160 - DNA, 28 bp, Artificial Sequence
  Description of Artificial Sequence: Synthetic oligonucleotide
gcagagctgctttccgcctctttgagac

SEQ ID NO: 178161 - DNA, 28 bp, Artificial Sequence
  Description of Artificial Sequence: Synthetic oligonucleotide
cagagctgctttccgcctctttgagacc

SEQ ID NO: 178162 - DNA, 30 bp, Artificial Sequence
  Description of Artificial Sequence: Synthetic oligonucleotide
agagctgctttccgcctctttgagaccaag

SEQ ID NO: 178163 - DNA, 29 bp, Artificial Sequence
  Description of Artificial Sequence: Synthetic oligonucleotide
gagctgctttccgcctctttgagaccaag

SEQ ID NO: 178164 - DNA, 31 bp, Artificial Sequence
  Description of Artificial Sequence: Synthetic oligonucleotide
agctgctttccgcctctttgagaccaagatc

SEQ ID NO: 178165 - DNA, 30 bp, Artificial Sequence
  Description of Artificial Sequence: Synthetic oligonucleotide
gctgctttccgcctctttgagaccaagatc

SEQ ID NO: 178166 - DNA, 31 bp, Artificial Sequence
  Description of Artificial Sequence: Synthetic oligonucleotide
ctgctttccgcctctttgagaccaagatcac

SEQ ID NO: 178167 - DNA, 31 bp, Artificial Sequence
  Description of Artificial Sequence: Synthetic oligonucleotide
tgctttccgcctctttgagaccaagatcacc

SEQ ID NO: 178168 - DNA, 30 bp, Artificial Sequence
  Description of Artificial Sequence: Synthetic oligonucleotide
gctttccgcctctttgagaccaagatcacc

SEQ ID NO: 178169 - DNA, 30 bp, Artificial Sequence
  Description of Artificial Sequence: Synthetic oligonucleotide
ctttccgcctctttgagaccaagatcaccc

SEQ ID NO: 178170 - DNA, 32 bp, Artificial Sequence
  Description of Artificial Sequence: Synthetic oligonucleotide
tttccgcctctttgagaccaagatcacccaag

SEQ ID NO: 178171 - DNA, 31 bp, Artificial Sequence
  Description of Artificial Sequence: Synthetic oligonucleotide
ttccgcctctttgagaccaagatcacccaag

SEQ ID NO: 178172 - DNA, 30 bp, Artificial Sequence
  Description of Artificial Sequence: Synthetic oligonucleotide
tccgcctctttgagaccaagatcacccaag

SEQ ID NO: 178173 - DNA, 29 bp, Artificial Sequence
  Description of Artificial Sequence: Synthetic oligonucleotide
ccgcctctttgagaccaagatcacccaag

SEQ ID NO: 178174 - DNA, 30 bp, Artificial Sequence
  Description of Artificial Sequence: Synthetic oligonucleotide
cgcctctttgagaccaagatcacccaagtc

SEQ ID NO: 178175 - DNA, 30 bp, Artificial Sequence
  Description of Artificial Sequence: Synthetic oligonucleotide
gcctctttgagaccaagatcacccaagtcc

SEQ ID NO: 178176 - DNA, 31 bp, Artificial Sequence
  Description of Artificial Sequence: Synthetic oligonucleotide
cctctttgagaccaagatcacccaagtcctg

SEQ ID NO: 178177 - DNA, 31 bp, Artificial Sequence
  Description of Artificial Sequence: Synthetic oligonucleotide
ctctttgagaccaagatcacccaagtcctgc

SEQ ID NO: 178178 - DNA, 32 bp, Artificial Sequence
  Description of Artificial Sequence: Synthetic oligonucleotide
tctttgagaccaagatcacccaagtcctgcac

SEQ ID NO: 178179 - DNA, 31 bp, Artificial Sequence
  Description of Artificial Sequence: Synthetic oligonucleotide
ctttgagaccaagatcacccaagtcctgcac

SEQ ID NO: 178180 - DNA, 33 bp, Artificial Sequence
  Description of Artificial Sequence: Synthetic oligonucleotide
tttgagaccaagatcacccaagtcctgcacttc

SEQ ID NO: 178181 - DNA, 32 bp, Artificial Sequence
  Description of Artificial Sequence: Synthetic oligonucleotide
ttgagaccaagatcacccaagtcctgcacttc

SEQ ID NO: 178182 - DNA, 31 bp, Artificial Sequence
  Description of Artificial Sequence: Synthetic oligonucleotide
tgagaccaagatcacccaagtcctgcacttc

SEQ ID NO: 178183 - DNA, 30 bp, Artificial Sequence
  Description of Artificial Sequence: Synthetic oligonucleotide
gagaccaagatcacccaagtcctgcacttc

SEQ ID NO: 178184 - DNA, 31 bp, Artificial Sequence
  Description of Artificial Sequence: Synthetic oligonucleotide
agaccaagatcacccaagtcctgcacttcac

SEQ ID NO: 178185 - DNA, 30 bp, Artificial Sequence
  Description of Artificial Sequence: Synthetic oligonucleotide
gaccaagatcacccaagtcctgcacttcac

SEQ ID NO: 178186 - DNA, 30 bp, Artificial Sequence
  Description of Artificial Sequence: Synthetic oligonucleotide
accaagatcacccaagtcctgcacttcacc

SEQ ID NO: 178187 - DNA, 29 bp, Artificial Sequence
  Description of Artificial Sequence: Synthetic oligonucleotide
ccaagatcacccaagtcctgcacttcacc

SEQ ID NO: 178188 - DNA, 31 bp, Artificial Sequence
  Description of Artificial Sequence: Synthetic oligonucleotide
caagatcacccaagtcctgcacttcaccaag

SEQ ID NO: 178189 - DNA, 31 bp, Artificial Sequence
  Description of Artificial Sequence: Synthetic oligonucleotide
aagatcacccaagtcctgcacttcaccaagg

SEQ ID NO: 178190 - DNA, 30 bp, Artificial Sequence
  Description of Artificial Sequence: Synthetic oligonucleotide
agatcacccaagtcctgcacttcaccaagg

SEQ ID NO: 178191 - DNA, 29 bp, Artificial Sequence
  Description of Artificial Sequence: Synthetic oligonucleotide
gatcacccaagtcctgcacttcaccaagg

SEQ ID NO: 178192 - DNA, 31 bp, Artificial Sequence
  Description of Artificial Sequence: Synthetic oligonucleotide
atcacccaagtcctgcacttcaccaaggatg

SEQ ID NO: 178193 - DNA, 30 bp, Artificial Sequence
  Description of Artificial Sequence: Synthetic oligonucleotide
tcacccaagtcctgcacttcaccaaggatg

SEQ ID NO: 178194 - DNA, 29 bp, Artificial Sequence
  Description of Artificial Sequence: Synthetic oligonucleotide
cacccaagtcctgcacttcaccaaggatg

SEQ ID NO: 178195 - DNA, 30 bp, Artificial Sequence
  Description of Artificial Sequence: Synthetic oligonucleotide
acccaagtcctgcacttcaccaaggatgtc

SEQ ID NO: 178196 - DNA, 29 bp, Artificial Sequence
  Description of Artificial Sequence: Synthetic oligonucleotide
cccaagtcctgcacttcaccaaggatgtc

SEQ ID NO: 178197 - DNA, 31 bp, Artificial Sequence
  Description of Artificial Sequence: Synthetic oligonucleotide
ccaagtcctgcacttcaccaaggatgtcaag

SEQ ID NO: 178198 - DNA, 31 bp, Artificial Sequence
  Description of Artificial Sequence: Synthetic oligonucleotide
caagtcctgcacttcaccaaggatgtcaagg

SEQ ID NO: 178199 - DNA, 31 bp, Artificial Sequence
  Description of Artificial Sequence: Synthetic oligonucleotide
aagtcctgcacttcaccaaggatgtcaaggc

SEQ ID NO: 178200 - DNA, 30 bp, Artificial Sequence
  Description of Artificial Sequence: Synthetic oligonucleotide
agtcctgcacttcaccaaggatgtcaaggc

SEQ ID NO: 178201 - DNA, 29 bp, Artificial Sequence
  Description of Artificial Sequence: Synthetic oligonucleotide
gtcctgcacttcaccaaggatgtcaaggc

SEQ ID NO: 178202 - DNA, 29 bp, Artificial Sequence
  Description of Artificial Sequence: Synthetic oligonucleotide
tcctgcacttcaccaaggatgtcaaggcc

SEQ ID NO: 178203 - DNA, 28 bp, Artificial Sequence
  Description of Artificial Sequence: Synthetic oligonucleotide
cctgcacttcaccaaggatgtcaaggcc

SEQ ID NO: 178204 - DNA, 28 bp, Artificial Sequence
  Description of Artificial Sequence: Synthetic oligonucleotide
ctgcacttcaccaaggatgtcaaggccg

SEQ ID NO: 178205 - DNA, 28 bp, Artificial Sequence
  Description of Artificial Sequence: Synthetic oligonucleotide
tgcacttcaccaaggatgtcaaggccgc

SEQ ID NO: 178206 - DNA, 27 bp, Artificial Sequence
  Description of Artificial Sequence: Synthetic oligonucleotide
gcacttcaccaaggatgtcaaggccgc

SEQ ID NO: 178207 - DNA, 28 bp, Artificial Sequence
  Description of Artificial Sequence: Synthetic oligonucleotide
cacttcaccaaggatgtcaaggccgctg

SEQ ID NO: 178208 - DNA, 28 bp, Artificial Sequence
  Description of Artificial Sequence: Synthetic oligonucleotide
acttcaccaaggatgtcaaggccgctgc

SEQ ID NO: 178209 - DNA, 27 bp, Artificial Sequence
  Description of Artificial Sequence: Synthetic oligonucleotide
cttcaccaaggatgtcaaggccgctgc

SEQ ID NO: 178210 - DNA, 31 bp, Artificial Sequence
  Description of Artificial Sequence: Synthetic oligonucleotide
ttcaccaaggatgtcaaggccgctgctaatc

SEQ ID NO: 178211 - DNA, 30 bp, Artificial Sequence
  Description of Artificial Sequence: Synthetic oligonucleotide
tcaccaaggatgtcaaggccgctgctaatc

SEQ ID NO: 178212 - DNA, 29 bp, Artificial Sequence
  Description of Artificial Sequence: Synthetic oligonucleotide
caccaaggatgtcaaggccgctgctaatc

SEQ ID NO: 178213 - DNA, 30 bp, Artificial Sequence
  Description of Artificial Sequence: Synthetic oligonucleotide
accaaggatgtcaaggccgctgctaatcag

SEQ ID NO: 178214 - DNA, 29 bp, Artificial Sequence
  Description of Artificial Sequence: Synthetic oligonucleotide
ccaaggatgtcaaggccgctgctaatcag

SEQ ID NO: 178215 - DNA, 31 bp, Artificial Sequence
  Description of Artificial Sequence: Synthetic oligonucleotide
caaggatgtcaaggccgctgctaatcagatg

SEQ ID NO: 178216 - DNA, 31 bp, Artificial Sequence
  Description of Artificial Sequence: Synthetic oligonucleotide
aaggatgtcaaggccgctgctaatcagatgc

SEQ ID NO: 178217 - DNA, 30 bp, Artificial Sequence
  Description of Artificial Sequence: Synthetic oligonucleotide
aggatgtcaaggccgctgctaatcagatgc

SEQ ID NO: 178218 - DNA, 29 bp, Artificial Sequence
  Description of Artificial Sequence: Synthetic oligonucleotide
ggatgtcaaggccgctgctaatcagatgc

SEQ ID NO: 178219 - DNA, 29 bp, Artificial Sequence
  Description of Artificial Sequence: Synthetic oligonucleotide
gatgtcaaggccgctgctaatcagatgcg

SEQ ID NO: 178220 - DNA, 29 bp, Artificial Sequence
  Description of Artificial Sequence: Synthetic oligonucleotide
atgtcaaggccgctgctaatcagatgcgc

SEQ ID NO: 178221 - DNA, 28 bp, Artificial Sequence
  Description of Artificial Sequence: Synthetic oligonucleotide
tgtcaaggccgctgctaatcagatgcgc

SEQ ID NO: 178222 - DNA, 27 bp, Artificial Sequence
  Description of Artificial Sequence: Synthetic oligonucleotide
gtcaaggccgctgctaatcagatgcgc

SEQ ID NO: 178223 - DNA, 29 bp, Artificial Sequence
  Description of Artificial Sequence: Synthetic oligonucleotide
tcaaggccgctgctaatcagatgcgcaac

SEQ ID NO: 178224 - DNA, 28 bp, Artificial Sequence
  Description of Artificial Sequence: Synthetic oligonucleotide
caaggccgctgctaatcagatgcgcaac

SEQ ID NO: 178225 - DNA, 30 bp, Artificial Sequence
  Description of Artificial Sequence: Synthetic oligonucleotide
aaggccgctgctaatcagatgcgcaacttc

SEQ ID NO: 178226 - DNA, 29 bp, Artificial Sequence
  Description of Artificial Sequence: Synthetic oligonucleotide
aggccgctgctaatcagatgcgcaacttc

SEQ ID NO: 178227 - DNA, 28 bp, Artificial Sequence
  Description of Artificial Sequence: Synthetic oligonucleotide
ggccgctgctaatcagatgcgcaacttc

SEQ ID NO: 178228 - DNA, 28 bp, Artificial Sequence
  Description of Artificial Sequence: Synthetic oligonucleotide
gccgctgctaatcagatgcgcaacttcc

SEQ ID NO: 178229 - DNA, 29 bp, Artificial Sequence
  Description of Artificial Sequence: Synthetic oligonucleotide
ccgctgctaatcagatgcgcaacttcctg

SEQ ID NO: 178230 - DNA, 29 bp, Artificial Sequence
  Description of Artificial Sequence: Synthetic oligonucleotide
cgctgctaatcagatgcgcaacttcctgg

SEQ ID NO: 178231 - DNA, 31 bp, Artificial Sequence
  Description of Artificial Sequence: Synthetic oligonucleotide
gctgctaatcagatgcgcaacttcctggttc

SEQ ID NO: 178232 - DNA, 31 bp, Artificial Sequence
  Description of Artificial Sequence: Synthetic oligonucleotide
ctgctaatcagatgcgcaacttcctggttcg

SEQ ID NO: 178233 - DNA, 32 bp, Artificial Sequence
  Description of Artificial Sequence: Synthetic oligonucleotide
tgctaatcagatgcgcaacttcctggttcgag

SEQ ID NO: 178234 - DNA, 31 bp, Artificial Sequence
  Description of Artificial Sequence: Synthetic oligonucleotide
gctaatcagatgcgcaacttcctggttcgag

SEQ ID NO: 178235 - DNA, 31 bp, Artificial Sequence
  Description of Artificial Sequence: Synthetic oligonucleotide
ctaatcagatgcgcaacttcctggttcgagc

SEQ ID NO: 178236 - DNA, 31 bp, Artificial Sequence
  Description of Artificial Sequence: Synthetic oligonucleotide
taatcagatgcgcaacttcctggttcgagcc

SEQ ID NO: 178237 - DNA, 30 bp, Artificial Sequence
  Description of Artificial Sequence: Synthetic oligonucleotide
aatcagatgcgcaacttcctggttcgagcc

SEQ ID NO: 178238 - DNA, 29 bp, Artificial Sequence
  Description of Artificial Sequence: Synthetic oligonucleotide
atcagatgcgcaacttcctggttcgagcc

SEQ ID NO: 178239 - DNA, 28 bp, Artificial Sequence
  Description of Artificial Sequence: Synthetic oligonucleotide
tcagatgcgcaacttcctggttcgagcc

SEQ ID NO: 178240 - DNA, 27 bp, Artificial Sequence
  Description of Artificial Sequence: Synthetic oligonucleotide
cagatgcgcaacttcctggttcgagcc

SEQ ID NO: 178241 - DNA, 28 bp, Artificial Sequence
  Description of Artificial Sequence: Synthetic oligonucleotide
agatgcgcaacttcctggttcgagcctc

SEQ ID NO: 178242 - DNA, 27 bp, Artificial Sequence
  Description of Artificial Sequence: Synthetic oligonucleotide
gatgcgcaacttcctggttcgagcctc

SEQ ID NO: 178243 - DNA, 27 bp, Artificial Sequence
  Description of Artificial Sequence: Synthetic oligonucleotide
atgcgcaacttcctggttcgagcctcc

SEQ ID NO: 178244 - DNA, 27 bp, Artificial Sequence
  Description of Artificial Sequence: Synthetic oligonucleotide
tgcgcaacttcctggttcgagcctcct

SEQ ID NO: 178245 - DNA, 26 bp, Artificial Sequence
  Description of Artificial Sequence: Synthetic oligonucleotide
gcgcaacttcctggttcgagcctcct

SEQ ID NO: 178246 - DNA, 26 bp, Artificial Sequence
  Description of Artificial Sequence: Synthetic oligonucleotide
cgcaacttcctggttcgagcctcctg

SEQ ID NO: 178247 - DNA, 26 bp, Artificial Sequence
  Description of Artificial Sequence: Synthetic oligonucleotide
gcaacttcctggttcgagcctcctgc

SEQ ID NO: 178248 - DNA, 26 bp, Artificial Sequence
  Description of Artificial Sequence: Synthetic oligonucleotide
caacttcctggttcgagcctcctgcc

SEQ ID NO: 178249 - DNA, 26 bp, Artificial Sequence
  Description of Artificial Sequence: Synthetic oligonucleotide
aacttcctggttcgagcctcctgccg

SEQ ID NO: 178250 - DNA, 25 bp, Artificial Sequence
  Description of Artificial Sequence: Synthetic oligonucleotide
acttcctggttcgagcctcctgccg

SEQ ID NO: 178251 - DNA, 24 bp, Artificial Sequence
  Description of Artificial Sequence: Synthetic oligonucleotide
cttcctggttcgagcctcctgccg

SEQ ID NO: 178252 - DNA, 24 bp, Artificial Sequence
  Description of Artificial Sequence: Synthetic oligonucleotide
ttcctggttcgagcctcctgccgc

SEQ ID NO: 178253 - DNA, 23 bp, Artificial Sequence
  Description of Artificial Sequence: Synthetic oligonucleotide
tcctggttcgagcctcctgccgc

SEQ ID NO: 178254 - DNA, 22 bp, Artificial Sequence
  Description of Artificial Sequence: Synthetic oligonucleotide
cctggttcgagcctcctgccgc

SEQ ID NO: 178255 - DNA, 24 bp, Artificial Sequence
  Description of Artificial Sequence: Synthetic oligonucleotide
ctggttcgagcctcctgccgcctt

SEQ ID NO: 178256 - DNA, 24 bp, Artificial Sequence
  Description of Artificial Sequence: Synthetic oligonucleotide
tggttcgagcctcctgccgccttc

SEQ ID NO: 178257 - DNA, 23 bp, Artificial Sequence
  Description of Artificial Sequence: Synthetic oligonucleotide
ggttcgagcctcctgccgccttc

SEQ ID NO: 178258 - DNA, 23 bp, Artificial Sequence
  Description of Artificial Sequence: Synthetic oligonucleotide
gttcgagcctcctgccgccttcg

SEQ ID NO: 178259 - DNA, 25 bp, Artificial Sequence
  Description of Artificial Sequence: Synthetic oligonucleotide
ttcgagcctcctgccgccttcgctt

SEQ ID NO: 178260 - DNA, 24 bp, Artificial Sequence
  Description of Artificial Sequence: Synthetic oligonucleotide
tcgagcctcctgccgccttcgctt

SEQ ID NO: 178261 - DNA, 23 bp, Artificial Sequence
  Description of Artificial Sequence: Synthetic oligonucleotide
cgagcctcctgccgccttcgctt

SEQ ID NO: 178262 - DNA, 23 bp, Artificial Sequence
  Description of Artificial Sequence: Synthetic oligonucleotide
gagcctcctgccgccttcgcttg

SEQ ID NO: 178263 - DNA, 25 bp, Artificial Sequence
  Description of Artificial Sequence: Synthetic oligonucleotide
agcctcctgccgccttcgcttggaa

SEQ ID NO: 178264 - DNA, 24 bp, Artificial Sequence
  Description of Artificial Sequence: Synthetic oligonucleotide
gcctcctgccgccttcgcttggaa

SEQ ID NO: 178265 - DNA, 24 bp, Artificial Sequence
  Description of Artificial Sequence: Synthetic oligonucleotide
cctcctgccgccttcgcttggaac

SEQ ID NO: 178266 - DNA, 25 bp, Artificial Sequence
  Description of Artificial Sequence: Synthetic oligonucleotide
ctcctgccgccttcgcttggaacct

SEQ ID NO: 178267 - DNA, 25 bp, Artificial Sequence
  Description of Artificial Sequence: Synthetic oligonucleotide
tcctgccgccttcgcttggaacctg

SEQ ID NO: 178268 - DNA, 24 bp, Artificial Sequence
  Description of Artificial Sequence: Synthetic oligonucleotide
cctgccgccttcgcttggaacctg

SEQ ID NO: 178269 - DNA, 24 bp, Artificial Sequence
  Description of Artificial Sequence: Synthetic oligonucleotide
ctgccgccttcgcttggaacctgg

SEQ ID NO: 178270 - DNA, 27 bp, Artificial Sequence
  Description of Artificial Sequence: Synthetic oligonucleotide
tgccgccttcgcttggaacctgggaaa

SEQ ID NO: 178271 - DNA, 26 bp, Artificial Sequence
  Description of Artificial Sequence: Synthetic oligonucleotide
gccgccttcgcttggaacctgggaaa

SEQ ID NO: 178272 - DNA, 27 bp, Artificial Sequence
  Description of Artificial Sequence: Synthetic oligonucleotide
ccgccttcgcttggaacctgggaaaga

SEQ ID NO: 178273 - DNA, 33 bp, Artificial Sequence
  Description of Artificial Sequence: Synthetic oligonucleotide
cgccttcgcttggaacctgggaaagaatatttg

SEQ ID NO: 178274 - DNA, 35 bp, Artificial Sequence
  Description of Artificial Sequence: Synthetic oligonucleotide
gccttcgcttggaacctgggaaagaatatttgatc

SEQ ID NO: 178275 - DNA, 37 bp, Artificial Sequence
  Description of Artificial Sequence: Synthetic oligonucleotide
ccttcgcttggaacctgggaaagaatatttgatcatg

SEQ ID NO: 178276 - DNA, 37 bp, Artificial Sequence
  Description of Artificial Sequence: Synthetic oligonucleotide
cttcgcttggaacctgggaaagaatatttgatcatgg

SEQ ID NO: 178277 - DNA, 37 bp, Artificial Sequence
  Description of Artificial Sequence: Synthetic oligonucleotide
ttcgcttggaacctgggaaagaatatttgatcatggg

SEQ ID NO: 178278 - DNA, 36 bp, Artificial Sequence
  Description of Artificial Sequence: Synthetic oligonucleotide
tcgcttggaacctgggaaagaatatttgatcatggg

SEQ ID NO: 178279 - DNA, 35 bp, Artificial Sequence
  Description of Artificial Sequence: Synthetic oligonucleotide
cgcttggaacctgggaaagaatatttgatcatggg

SEQ ID NO: 178280 - DNA, 36 bp, Artificial Sequence
  Description of Artificial Sequence: Synthetic oligonucleotide
gcttggaacctgggaaagaatatttgatcatgggtc

SEQ ID NO: 178281 - DNA, 37 bp, Artificial Sequence
  Description of Artificial Sequence: Synthetic oligonucleotide
cttggaacctgggaaagaatatttgatcatgggtctg

SEQ ID NO: 178282 - DNA, 37 bp, Artificial Sequence
  Description of Artificial Sequence: Synthetic oligonucleotide
ttggaacctgggaaagaatatttgatcatgggtctgg

SEQ ID NO: 178283 - DNA, 36 bp, Artificial Sequence
  Description of Artificial Sequence: Synthetic oligonucleotide
tggaacctgggaaagaatatttgatcatgggtctgg

SEQ ID NO: 178284 - DNA, 35 bp, Artificial Sequence
  Description of Artificial Sequence: Synthetic oligonucleotide
ggaacctgggaaagaatatttgatcatgggtctgg

SEQ ID NO: 178285 - DNA, 37 bp, Artificial Sequence
  Description of Artificial Sequence: Synthetic oligonucleotide
gaacctgggaaagaatatttgatcatgggtctggatg

SEQ ID NO: 178286 - DNA, 37 bp, Artificial Sequence
  Description of Artificial Sequence: Synthetic oligonucleotide
aacctgggaaagaatatttgatcatgggtctggatgg

SEQ ID NO: 178287 - DNA, 36 bp, Artificial Sequence
  Description of Artificial Sequence: Synthetic oligonucleotide
acctgggaaagaatatttgatcatgggtctggatgg

SEQ ID NO: 178288 - DNA, 35 bp, Artificial Sequence
  Description of Artificial Sequence: Synthetic oligonucleotide
cctgggaaagaatatttgatcatgggtctggatgg

SEQ ID NO: 178289 - DNA, 35 bp, Artificial Sequence
  Description of Artificial Sequence: Synthetic oligonucleotide
ctgggaaagaatatttgatcatgggtctggatggg

SEQ ID NO: 178290 - DNA, 35 bp, Artificial Sequence
  Description of Artificial Sequence: Synthetic oligonucleotide
tgggaaagaatatttgatcatgggtctggatgggg

SEQ ID NO: 178291 - DNA, 34 bp, Artificial Sequence
  Description of Artificial Sequence: Synthetic oligonucleotide
gggaaagaatatttgatcatgggtctggatgggg

SEQ ID NO: 178292 - DNA, 34 bp, Artificial Sequence
  Description of Artificial Sequence: Synthetic oligonucleotide
ggaaagaatatttgatcatgggtctggatggggc

SEQ ID NO: 178293 - DNA, 34 bp, Artificial Sequence
  Description of Artificial Sequence: Synthetic oligonucleotide
gaaagaatatttgatcatgggtctggatggggcc

SEQ ID NO: 178294 - DNA, 35 bp, Artificial Sequence
  Description of Artificial Sequence: Synthetic oligonucleotide
aaagaatatttgatcatgggtctggatggggccac

SEQ ID NO: 178295 - DNA, 34 bp, Artificial Sequence
  Description of Artificial Sequence: Synthetic oligonucleotide
aagaatatttgatcatgggtctggatggggccac

SEQ ID NO: 178296 - DNA, 33 bp, Artificial Sequence
  Description of Artificial Sequence: Synthetic oligonucleotide
agaatatttgatcatgggtctggatggggccac

SEQ ID NO: 178297 - DNA, 32 bp, Artificial Sequence
  Description of Artificial Sequence: Synthetic oligonucleotide
gaatatttgatcatgggtctggatggggccac

SEQ ID NO: 178298 - DNA, 32 bp, Artificial Sequence
  Description of Artificial Sequence: Synthetic oligonucleotide
aatatttgatcatgggtctggatggggccacc

SEQ ID NO: 178299 - DNA, 31 bp, Artificial Sequence
  Description of Artificial Sequence: Synthetic oligonucleotide
atatttgatcatgggtctggatggggccacc

SEQ ID NO: 178300 - DNA, 30 bp, Artificial Sequence
  Description of Artificial Sequence: Synthetic oligonucleotide
tatttgatcatgggtctggatggggccacc

SEQ ID NO: 178301 - DNA, 29 bp, Artificial Sequence
  Description of Artificial Sequence: Synthetic oligonucleotide
atttgatcatgggtctggatggggccacc

SEQ ID NO: 178302 - DNA, 28 bp, Artificial Sequence
  Description of Artificial Sequence: Synthetic oligonucleotide
tttgatcatgggtctggatggggccacc

SEQ ID NO: 178303 - DNA, 27 bp, Artificial Sequence
  Description of Artificial Sequence: Synthetic oligonucleotide
ttgatcatgggtctggatggggccacc

SEQ ID NO: 178304 - DNA, 27 bp, Artificial Sequence
  Description of Artificial Sequence: Synthetic oligonucleotide
tgatcatgggtctggatggggccacct

SEQ ID NO: 178305 - DNA, 27 bp, Artificial Sequence
  Description of Artificial Sequence: Synthetic oligonucleotide
gatcatgggtctggatggggccaccta

SEQ ID NO: 178306 - DNA, 28 bp, Artificial Sequence
  Description of Artificial Sequence: Synthetic oligonucleotide
atcatgggtctggatggggccacctatg

SEQ ID NO: 178307 - DNA, 27 bp, Artificial Sequence
  Description of Artificial Sequence: Synthetic oligonucleotide
tcatgggtctggatggggccacctatg

SEQ ID NO: 178308 - DNA, 27 bp, Artificial Sequence
  Description of Artificial Sequence: Synthetic oligonucleotide
catgggtctggatggggccacctatga

SEQ ID NO: 178309 - DNA, 27 bp, Artificial Sequence
  Description of Artificial Sequence: Synthetic oligonucleotide
atgggtctggatggggccacctatgac

SEQ ID NO: 178310 - DNA, 26 bp, Artificial Sequence
  Description of Artificial Sequence: Synthetic oligonucleotide
tgggtctggatggggccacctatgac

SEQ ID NO: 178311 - DNA, 25 bp, Artificial Sequence
  Description of Artificial Sequence: Synthetic oligonucleotide
gggtctggatggggccacctatgac

SEQ ID NO: 178312 - DNA, 26 bp, Artificial Sequence
  Description of Artificial Sequence: Synthetic oligonucleotide
ggtctggatggggccacctatgacct

SEQ ID NO: 178313 - DNA, 26 bp, Artificial Sequence
  Description of Artificial Sequence: Synthetic oligonucleotide
gtctggatggggccacctatgacctc

SEQ ID NO: 178314 - DNA, 27 bp, Artificial Sequence
  Description of Artificial Sequence: Synthetic oligonucleotide
tctggatggggccacctatgacctcga

SEQ ID NO: 178315 - DNA, 26 bp, Artificial Sequence
  Description of Artificial Sequence: Synthetic oligonucleotide
ctggatggggccacctatgacctcga

SEQ ID NO: 178316 - DNA, 26 bp, Artificial Sequence
  Description of Artificial Sequence: Synthetic oligonucleotide
tggatggggccacctatgacctcgag

SEQ ID NO: 178317 - DNA, 25 bp, Artificial Sequence
  Description of Artificial Sequence: Synthetic oligonucleotide
ggatggggccacctatgacctcgag

SEQ ID NO: 178318 - DNA, 25 bp, Artificial Sequence
  Description of Artificial Sequence: Synthetic oligonucleotide
gatggggccacctatgacctcgagg

SEQ ID NO: 178319 - DNA, 26 bp, Artificial Sequence
  Description of Artificial Sequence: Synthetic oligonucleotide
atggggccacctatgacctcgaggga

SEQ ID NO: 178320 - DNA, 25 bp, Artificial Sequence
  Description of Artificial Sequence: Synthetic oligonucleotide
tggggccacctatgacctcgaggga

SEQ ID NO: 178321 - DNA, 24 bp, Artificial Sequence
  Description of Artificial Sequence: Synthetic oligonucleotide
ggggccacctatgacctcgaggga

SEQ ID NO: 178322 - DNA, 25 bp, Artificial Sequence
  Description of Artificial Sequence: Synthetic oligonucleotide
gggccacctatgacctcgagggaca

SEQ ID NO: 178323 - DNA, 25 bp, Artificial Sequence
  Description of Artificial Sequence: Synthetic oligonucleotide
ggccacctatgacctcgagggacac

SEQ ID NO: 178324 - DNA, 25 bp, Artificial Sequence
  Description of Artificial Sequence: Synthetic oligonucleotide
gccacctatgacctcgagggacacc

SEQ ID NO: 178325 - DNA, 25 bp, Artificial Sequence
  Description of Artificial Sequence: Synthetic oligonucleotide
ccacctatgacctcgagggacaccc

SEQ ID NO: 178326 - DNA, 25 bp, Artificial Sequence
  Description of Artificial Sequence: Synthetic oligonucleotide
cacctatgacctcgagggacacccc

SEQ ID NO: 178327 - DNA, 26 bp, Artificial Sequence
  Description of Artificial Sequence: Synthetic oligonucleotide
acctatgacctcgagggacaccccca

SEQ ID NO: 178328 - DNA, 25 bp, Artificial Sequence
  Description of Artificial Sequence: Synthetic oligonucleotide
cctatgacctcgagggacaccccca

SEQ ID NO: 178329 - DNA, 27 bp, Artificial Sequence
  Description of Artificial Sequence: Synthetic oligonucleotide
ctatgacctcgagggacacccccagta

SEQ ID NO: 178330 - DNA, 27 bp, Artificial Sequence
  Description of Artificial Sequence: Synthetic oligonucleotide
tatgacctcgagggacacccccagtac

SEQ ID NO: 178331 - DNA, 26 bp, Artificial Sequence
  Description of Artificial Sequence: Synthetic oligonucleotide
atgacctcgagggacacccccagtac

SEQ ID NO: 178332 - DNA, 25 bp, Artificial Sequence
  Description of Artificial Sequence: Synthetic oligonucleotide
tgacctcgagggacacccccagtac

SEQ ID NO: 178333 - DNA, 24 bp, Artificial Sequence
  Description of Artificial Sequence: Synthetic oligonucleotide
gacctcgagggacacccccagtac

SEQ ID NO: 178334 - DNA, 25 bp, Artificial Sequence
  Description of Artificial Sequence: Synthetic oligonucleotide
acctcgagggacacccccagtacct

SEQ ID NO: 178335 - DNA, 24 bp, Artificial Sequence
  Description of Artificial Sequence: Synthetic oligonucleotide
cctcgagggacacccccagtacct

SEQ ID NO: 178336 - DNA, 24 bp, Artificial Sequence
  Description of Artificial Sequence: Synthetic oligonucleotide
ctcgagggacacccccagtacctg

SEQ ID NO: 178337 - DNA, 25 bp, Artificial Sequence
  Description of Artificial Sequence: Synthetic oligonucleotide
tcgagggacacccccagtacctgct

SEQ ID NO: 178338 - DNA, 24 bp, Artificial Sequence
  Description of Artificial Sequence: Synthetic oligonucleotide
cgagggacacccccagtacctgct

SEQ ID NO: 178339 - DNA, 24 bp, Artificial Sequence
  Description of Artificial Sequence: Synthetic oligonucleotide
gagggacacccccagtacctgctg

SEQ ID NO: 178340 - DNA, 25 bp, Artificial Sequence
  Description of Artificial Sequence: Synthetic oligonucleotide
agggacacccccagtacctgctgga

SEQ ID NO: 178341 - DNA, 24 bp, Artificial Sequence
  Description of Artificial Sequence: Synthetic oligonucleotide
gggacacccccagtacctgctgga

SEQ ID NO: 178342 - DNA, 25 bp, Artificial Sequence
  Description of Artificial Sequence: Synthetic oligonucleotide
ggacacccccagtacctgctggact

SEQ ID NO: 178343 - DNA, 25 bp, Artificial Sequence
  Description of Artificial Sequence: Synthetic oligonucleotide
gacacccccagtacctgctggactc

SEQ ID NO: 178344 - DNA, 27 bp, Artificial Sequence
  Description of Artificial Sequence: Synthetic oligonucleotide
acacccccagtacctgctggactcgaa

SEQ ID NO: 178345 - DNA, 27 bp, Artificial Sequence
  Description of Artificial Sequence: Synthetic oligonucleotide
cacccccagtacctgctggactcgaat

SEQ ID NO: 178346 - DNA, 28 bp, Artificial Sequence
  Description of Artificial Sequence: Synthetic oligonucleotide
acccccagtacctgctggactcgaatag

SEQ ID NO: 178347 - DNA, 27 bp, Artificial Sequence
  Description of Artificial Sequence: Synthetic oligonucleotide
cccccagtacctgctggactcgaatag

SEQ ID NO: 178348 - DNA, 27 bp, Artificial Sequence
  Description of Artificial Sequence: Synthetic oligonucleotide
ccccagtacctgctggactcgaatagc

SEQ ID NO: 178349 - DNA, 28 bp, Artificial Sequence
  Description of Artificial Sequence: Synthetic oligonucleotide
cccagtacctgctggactcgaatagctg

SEQ ID NO: 178350 - DNA, 28 bp, Artificial Sequence
  Description of Artificial Sequence: Synthetic oligonucleotide
ccagtacctgctggactcgaatagctgg

SEQ ID NO: 178351 - DNA, 30 bp, Artificial Sequence
  Description of Artificial Sequence: Synthetic oligonucleotide
cagtacctgctggactcgaatagctggatc

SEQ ID NO: 178352 - DNA, 30 bp, Artificial Sequence
  Description of Artificial Sequence: Synthetic oligonucleotide
agtacctgctggactcgaatagctggatcg

SEQ ID NO: 178353 - DNA, 29 bp, Artificial Sequence
  Description of Artificial Sequence: Synthetic oligonucleotide
gtacctgctggactcgaatagctggatcg

SEQ ID NO: 178354 - DNA, 30 bp, Artificial Sequence
  Description of Artificial Sequence: Synthetic oligonucleotide
tacctgctggactcgaatagctggatcgag

SEQ ID NO: 178355 - DNA, 29 bp, Artificial Sequence
  Description of Artificial Sequence: Synthetic oligonucleotide
acctgctggactcgaatagctggatcgag

SEQ ID NO: 178356 - DNA, 28 bp, Artificial Sequence
  Description of Artificial Sequence: Synthetic oligonucleotide
cctgctggactcgaatagctggatcgag

SEQ ID NO: 178357 - DNA, 28 bp, Artificial Sequence
  Description of Artificial Sequence: Synthetic oligonucleotide
ctgctggactcgaatagctggatcgagg

SEQ ID NO: 178358 - DNA, 29 bp, Artificial Sequence
  Description of Artificial Sequence: Synthetic oligonucleotide
tgctggactcgaatagctggatcgaggag

SEQ ID NO: 178359 - DNA, 28 bp, Artificial Sequence
  Description of Artificial Sequence: Synthetic oligonucleotide
gctggactcgaatagctggatcgaggag

SEQ ID NO: 178360 - DNA, 30 bp, Artificial Sequence
  Description of Artificial Sequence: Synthetic oligonucleotide
ctggactcgaatagctggatcgaggagatg

SEQ ID NO: 178361 - DNA, 30 bp, Artificial Sequence
  Description of Artificial Sequence: Synthetic oligonucleotide
tggactcgaatagctggatcgaggagatgc

SEQ ID NO: 178362 - DNA, 29 bp, Artificial Sequence
  Description of Artificial Sequence: Synthetic oligonucleotide
ggactcgaatagctggatcgaggagatgc

SEQ ID NO: 178363 - DNA, 29 bp, Artificial Sequence
  Description of Artificial Sequence: Synthetic oligonucleotide
gactcgaatagctggatcgaggagatgcc

SEQ ID NO: 178364 - DNA, 29 bp, Artificial Sequence
  Description of Artificial Sequence: Synthetic oligonucleotide
actcgaatagctggatcgaggagatgccc

SEQ ID NO: 178365 - DNA, 28 bp, Artificial Sequence
  Description of Artificial Sequence: Synthetic oligonucleotide
ctcgaatagctggatcgaggagatgccc

SEQ ID NO: 178366 - DNA, 29 bp, Artificial Sequence
  Description of Artificial Sequence: Synthetic oligonucleotide
tcgaatagctggatcgaggagatgccctc

SEQ ID NO: 178367 - DNA, 28 bp, Artificial Sequence
  Description of Artificial Sequence: Synthetic oligonucleotide
cgaatagctggatcgaggagatgccctc

SEQ ID NO: 178368 - DNA, 29 bp, Artificial Sequence
  Description of Artificial Sequence: Synthetic oligonucleotide
gaatagctggatcgaggagatgccctctg

SEQ ID NO: 178369 - DNA, 31 bp, Artificial Sequence
  Description of Artificial Sequence: Synthetic oligonucleotide
aatagctggatcgaggagatgccctctgaac

SEQ ID NO: 178370 - DNA, 30 bp, Artificial Sequence
  Description of Artificial Sequence: Synthetic oligonucleotide
atagctggatcgaggagatgccctctgaac

SEQ ID NO: 178371 - DNA, 29 bp, Artificial Sequence
  Description of Artificial Sequence: Synthetic oligonucleotide
tagctggatcgaggagatgccctctgaac

SEQ ID NO: 178372 - DNA, 28 bp, Artificial Sequence
  Description of Artificial Sequence: Synthetic oligonucleotide
agctggatcgaggagatgccctctgaac

SEQ ID NO: 178373 - DNA, 27 bp, Artificial Sequence
  Description of Artificial Sequence: Synthetic oligonucleotide
gctggatcgaggagatgccctctgaac

SEQ ID NO: 178374 - DNA, 27 bp, Artificial Sequence
  Description of Artificial Sequence: Synthetic oligonucleotide
ctggatcgaggagatgccctctgaacg

SEQ ID NO: 178375 - DNA, 27 bp, Artificial Sequence
  Description of Artificial Sequence: Synthetic oligonucleotide
tggatcgaggagatgccctctgaacgc

SEQ ID NO: 178376 - DNA, 26 bp, Artificial Sequence
  Description of Artificial Sequence: Synthetic oligonucleotide
ggatcgaggagatgccctctgaacgc

SEQ ID NO: 178377 - DNA, 27 bp, Artificial Sequence
  Description of Artificial Sequence: Synthetic oligonucleotide
gatcgaggagatgccctctgaacgcct

SEQ ID NO: 178378 - DNA, 27 bp, Artificial Sequence
  Description of Artificial Sequence: Synthetic oligonucleotide
atcgaggagatgccctctgaacgcctg

SEQ ID NO: 178379 - DNA, 27 bp, Artificial Sequence
  Description of Artificial Sequence: Synthetic oligonucleotide
tcgaggagatgccctctgaacgcctgt

SEQ ID NO: 178380 - DNA, 26 bp, Artificial Sequence
  Description of Artificial Sequence: Synthetic oligonucleotide
cgaggagatgccctctgaacgcctgt

SEQ ID NO: 178381 - DNA, 26 bp, Artificial Sequence
  Description of Artificial Sequence: Synthetic oligonucleotide
gaggagatgccctctgaacgcctgtg

SEQ ID NO: 178382 - DNA, 26 bp, Artificial Sequence
  Description of Artificial Sequence: Synthetic oligonucleotide
aggagatgccctctgaacgcctgtgc

SEQ ID NO: 178383 - DNA, 25 bp, Artificial Sequence
  Description of Artificial Sequence: Synthetic oligonucleotide
ggagatgccctctgaacgcctgtgc

SEQ ID NO: 178384 - DNA, 25 bp, Artificial Sequence
  Description of Artificial Sequence: Synthetic oligonucleotide
gagatgccctctgaacgcctgtgcc

SEQ ID NO: 178385 - DNA, 25 bp, Artificial Sequence
  Description of Artificial Sequence: Synthetic oligonucleotide
agatgccctctgaacgcctgtgccg

SEQ ID NO: 178386 - DNA, 24 bp, Artificial Sequence
  Description of Artificial Sequence: Synthetic oligonucleotide
gatgccctctgaacgcctgtgccg

SEQ ID NO: 178387 - DNA, 25 bp, Artificial Sequence
  Description of Artificial Sequence: Synthetic oligonucleotide
atgccctctgaacgcctgtgccgga

SEQ ID NO: 178388 - DNA, 24 bp, Artificial Sequence
  Description of Artificial Sequence: Synthetic oligonucleotide
tgccctctgaacgcctgtgccgga

SEQ ID NO: 178389 - DNA, 23 bp, Artificial Sequence
  Description of Artificial Sequence: Synthetic oligonucleotide
gccctctgaacgcctgtgccgga

SEQ ID NO: 178390 - DNA, 23 bp, Artificial Sequence
  Description of Artificial Sequence: Synthetic oligonucleotide
ccctctgaacgcctgtgccggag

SEQ ID NO: 178391 - DNA, 24 bp, Artificial Sequence
  Description of Artificial Sequence: Synthetic oligonucleotide
cctctgaacgcctgtgccggagca

SEQ ID NO: 178392 - DNA, 24 bp, Artificial Sequence
  Description of Artificial Sequence: Synthetic oligonucleotide
ctctgaacgcctgtgccggagcac

SEQ ID NO: 178393 - DNA, 24 bp, Artificial Sequence
  Description of Artificial Sequence: Synthetic oligonucleotide
tctgaacgcctgtgccggagcacc

SEQ ID NO: 178394 - DNA, 23 bp, Artificial Sequence
  Description of Artificial Sequence: Synthetic oligonucleotide
ctgaacgcctgtgccggagcacc

SEQ ID NO: 178395 - DNA, 23 bp, Artificial Sequence
  Description of Artificial Sequence: Synthetic oligonucleotide
tgaacgcctgtgccggagcaccc

SEQ ID NO: 178396 - DNA, 22 bp, Artificial Sequence
  Description of Artificial Sequence: Synthetic oligonucleotide
gaacgcctgtgccggagcaccc

SEQ ID NO: 178397 - DNA, 22 bp, Artificial Sequence
  Description of Artificial Sequence: Synthetic oligonucleotide
aacgcctgtgccggagcacccg

SEQ ID NO: 178398 - DNA, 21 bp, Artificial Sequence
  Description of Artificial Sequence: Synthetic oligonucleotide
acgcctgtgccggagcacccg

SEQ ID NO: 178399 - DNA, 20 bp, Artificial Sequence
  Description of Artificial Sequence: Synthetic oligonucleotide
cgcctgtgccggagcacccg

SEQ ID NO: 178400 - DNA, 20 bp, Artificial Sequence
  Description of Artificial Sequence: Synthetic oligonucleotide
gcctgtgccggagcacccgc

SEQ ID NO: 178401 - DNA, 21 bp, Artificial Sequence
  Description of Artificial Sequence: Synthetic oligonucleotide
cctgtgccggagcacccgcca

SEQ ID NO: 178402 - DNA, 21 bp, Artificial Sequence
  Description of Artificial Sequence: Synthetic oligonucleotide
ctgtgccggagcacccgccag

SEQ ID NO: 178403 - DNA, 21 bp, Artificial Sequence
  Description of Artificial Sequence: Synthetic oligonucleotide
tgtgccggagcacccgccagc

SEQ ID NO: 178404 - DNA, 20 bp, Artificial Sequence
  Description of Artificial Sequence: Synthetic oligonucleotide
gtgccggagcacccgccagc

SEQ ID NO: 178405 - DNA, 20 bp, Artificial Sequence
  Description of Artificial Sequence: Synthetic oligonucleotide
tgccggagcacccgccagcg

SEQ ID NO: 178406 - DNA, 20 bp, Artificial Sequence
  Description of Artificial Sequence: Synthetic oligonucleotide
gccggagcacccgccagcgt

SEQ ID NO: 178407 - DNA, 20 bp, Artificial Sequence
  Description of Artificial Sequence: Synthetic oligonucleotide
ccggagcacccgccagcggt

SEQ ID NO: 178408 - DNA, 20 bp, Artificial Sequence
  Description of Artificial Sequence: Synthetic oligonucleotide
cggagcacccgccagcgggt

SEQ ID NO: 178409 - DNA, 20 bp, Artificial Sequence
  Description of Artificial Sequence: Synthetic oligonucleotide
ggagcacccgccagcgggca

SEQ ID NO: 178410 - DNA, 20 bp, Artificial Sequence
  Description of Artificial Sequence: Synthetic oligonucleotide
gagcacccgccagcgggcag

SEQ ID NO: 178411 - DNA, 20 bp, Artificial Sequence
  Description of Artificial Sequence: Synthetic oligonucleotide
agcacccgccagcgggcagc

SEQ ID NO: 178412 - DNA, 20 bp, Artificial Sequence
  Description of Artificial Sequence: Synthetic oligonucleotide
gcacccgccagcgggcagct

SEQ ID NO: 178413 - DNA, 20 bp, Artificial Sequence
  Description of Artificial Sequence: Synthetic oligonucleotide
cacccgccagcgggcagcct

SEQ ID NO: 178414 - DNA, 21 bp, Artificial Sequence
  Description of Artificial Sequence: Synthetic oligonucleotide
acccgccagcgggcagcctgt

SEQ ID NO: 178415 - DNA, 20 bp, Artificial Sequence
  Description of Artificial Sequence: Synthetic oligonucleotide
cccgccagcgggcagcctgt

SEQ ID NO: 178416 - DNA, 20 bp, Artificial Sequence
  Description of Artificial Sequence: Synthetic oligonucleotide
ccgccagcgggcagcctgtg

SEQ ID NO: 178417 - DNA, 20 bp, Artificial Sequence
  Description of Artificial Sequence: Synthetic oligonucleotide
cgccagcgggcagcctgtgc

SEQ ID NO: 178418 - DNA, 20 bp, Artificial Sequence
  Description of Artificial Sequence: Synthetic oligonucleotide
gccagcgggcagcctgtgcc

SEQ ID NO: 178419 - DNA, 21 bp, Artificial Sequence
  Description of Artificial Sequence: Synthetic oligonucleotide
ccagcgggcagcctgtgccca

SEQ ID NO: 178420 - DNA, 21 bp, Artificial Sequence
  Description of Artificial Sequence: Synthetic oligonucleotide
cagcgggcagcctgtgcccag

SEQ ID NO: 178421 - DNA, 22 bp, Artificial Sequence
  Description of Artificial Sequence: Synthetic oligonucleotide
agcgggcagcctgtgcccagct

SEQ ID NO: 178422 - DNA, 21 bp, Artificial Sequence
  Description of Artificial Sequence: Synthetic oligonucleotide
gcgggcagcctgtgcccagct

SEQ ID NO: 178423 - DNA, 23 bp, Artificial Sequence
  Description of Artificial Sequence: Synthetic oligonucleotide
cgggcagcctgtgcccagctcaa

SEQ ID NO: 178424 - DNA, 23 bp, Artificial Sequence
  Description of Artificial Sequence: Synthetic oligonucleotide
gggcagcctgtgcccagctcaac

SEQ ID NO: 178425 - DNA, 24 bp, Artificial Sequence
  Description of Artificial Sequence: Synthetic oligonucleotide
ggcagcctgtgcccagctcaacga

SEQ ID NO: 178426 - DNA, 26 bp, Artificial Sequence
  Description of Artificial Sequence: Synthetic oligonucleotide
gcagcctgtgcccagctcaacgactt

SEQ ID NO: 178427 - DNA, 26 bp, Artificial Sequence
  Description of Artificial Sequence: Synthetic oligonucleotide
cagcctgtgcccagctcaacgacttc

SEQ ID NO: 178428 - DNA, 27 bp, Artificial Sequence
  Description of Artificial Sequence: Synthetic oligonucleotide
agcctgtgcccagctcaacgacttcct

SEQ ID NO: 178429 - DNA, 26 bp, Artificial Sequence
  Description of Artificial Sequence: Synthetic oligonucleotide
gcctgtgcccagctcaacgacttcct

SEQ ID NO: 178430 - DNA, 26 bp, Artificial Sequence
  Description of Artificial Sequence: Synthetic oligonucleotide
cctgtgcccagctcaacgacttcctc

SEQ ID NO: 178431 - DNA, 27 bp, Artificial Sequence
  Description of Artificial Sequence: Synthetic oligonucleotide
ctgtgcccagctcaacgacttcctcca

SEQ ID NO: 178432 - DNA, 27 bp, Artificial Sequence
  Description of Artificial Sequence: Synthetic oligonucleotide
tgtgcccagctcaacgacttcctccag

SEQ ID NO: 178433 - DNA, 26 bp, Artificial Sequence
  Description of Artificial Sequence: Synthetic oligonucleotide
gtgcccagctcaacgacttcctccag

SEQ ID NO: 178434 - DNA, 27 bp, Artificial Sequence
  Description of Artificial Sequence: Synthetic oligonucleotide
tgcccagctcaacgacttcctccagga

SEQ ID NO: 178435 - DNA, 26 bp, Artificial Sequence
  Description of Artificial Sequence: Synthetic oligonucleotide
gcccagctcaacgacttcctccagga

SEQ ID NO: 178436 - DNA, 27 bp, Artificial Sequence
  Description of Artificial Sequence: Synthetic oligonucleotide
cccagctcaacgacttcctccaggagt

SEQ ID NO: 178437 - DNA, 29 bp, Artificial Sequence
  Description of Artificial Sequence: Synthetic oligonucleotide
ccagctcaacgacttcctccaggagtatg

SEQ ID NO: 178438 - DNA, 29 bp, Artificial Sequence
  Description of Artificial Sequence: Synthetic oligonucleotide
cagctcaacgacttcctccaggagtatgg

SEQ ID NO: 178439 - DNA, 29 bp, Artificial Sequence
  Description of Artificial Sequence: Synthetic oligonucleotide
agctcaacgacttcctccaggagtatggc

SEQ ID NO: 178440 - DNA, 28 bp, Artificial Sequence
  Description of Artificial Sequence: Synthetic oligonucleotide
gctcaacgacttcctccaggagtatggc

SEQ ID NO: 178441 - DNA, 29 bp, Artificial Sequence
  Description of Artificial Sequence: Synthetic oligonucleotide
ctcaacgacttcctccaggagtatggcac

SEQ ID NO: 178442 - DNA, 30 bp, Artificial Sequence
  Description of Artificial Sequence: Synthetic oligonucleotide
tcaacgacttcctccaggagtatggcactc

SEQ ID NO: 178443 - DNA, 29 bp, Artificial Sequence
  Description of Artificial Sequence: Synthetic oligonucleotide
caacgacttcctccaggagtatggcactc

SEQ ID NO: 178444 - DNA, 30 bp, Artificial Sequence
  Description of Artificial Sequence: Synthetic oligonucleotide
aacgacttcctccaggagtatggcactcag

SEQ ID NO: 178445 - DNA, 29 bp, Artificial Sequence
  Description of Artificial Sequence: Synthetic oligonucleotide
acgacttcctccaggagtatggcactcag

SEQ ID NO: 178446 - DNA, 28 bp, Artificial Sequence
  Description of Artificial Sequence: Synthetic oligonucleotide
cgacttcctccaggagtatggcactcag

SEQ ID NO: 178447 - DNA, 28 bp, Artificial Sequence
  Description of Artificial Sequence: Synthetic oligonucleotide
gacttcctccaggagtatggcactcagg

SEQ ID NO: 178448 - DNA, 28 bp, Artificial Sequence
  Description of Artificial Sequence: Synthetic oligonucleotide
acttcctccaggagtatggcactcaggg

SEQ ID NO: 178449 - DNA, 27 bp, Artificial Sequence
  Description of Artificial Sequence: Synthetic oligonucleotide
cttcctccaggagtatggcactcaggg

SEQ ID NO: 178450 - DNA, 27 bp, Artificial Sequence
  Description of Artificial Sequence: Synthetic oligonucleotide
ttcctccaggagtatggcactcagggg

SEQ ID NO: 178451 - DNA, 27 bp, Artificial Sequence
  Description of Artificial Sequence: Synthetic oligonucleotide
tcctccaggagtatggcactcaggggt

SEQ ID NO: 178452 - DNA, 26 bp, Artificial Sequence
  Description of Artificial Sequence: Synthetic oligonucleotide
cctccaggagtatggcactcaggggt

SEQ ID NO: 178453 - DNA, 26 bp, Artificial Sequence
  Description of Artificial Sequence: Synthetic oligonucleotide
ctccaggagtatggcactcaggggtg

SEQ ID NO: 178454 - DNA, 26 bp, Artificial Sequence
  Description of Artificial Sequence: Synthetic oligonucleotide
tccaggagtatggcactcaggggtgc

SEQ ID NO: 178455 - DNA, 25 bp, Artificial Sequence
  Description of Artificial Sequence: Synthetic oligonucleotide
ccaggagtatggcactcaggggtgc

SEQ ID NO: 178456 - DNA, 26 bp, Artificial Sequence
  Description of Artificial Sequence: Synthetic oligonucleotide
caggagtatggcactcaggggtgcca

SEQ ID NO: 178457 - DNA, 26 bp, Artificial Sequence
  Description of Artificial Sequence: Synthetic oligonucleotide
aggagtatggcactcaggggtgccag

SEQ ID NO: 178458 - DNA, 25 bp, Artificial Sequence
  Description of Artificial Sequence: Synthetic oligonucleotide
ggagtatggcactcaggggtgccag

SEQ ID NO: 178459 - DNA, 26 bp, Artificial Sequence
  Description of Artificial Sequence: Synthetic oligonucleotide
gagtatggcactcaggggtgccaggt

SEQ ID NO: 178460 - DNA, 27 bp, Artificial Sequence
  Description of Artificial Sequence: Synthetic oligonucleotide
agtatggcactcaggggtgccaggtgt

SEQ ID NO: 178461 - DNA, 26 bp, Artificial Sequence
  Description of Artificial Sequence: Synthetic oligonucleotide
gtatggcactcaggggtgccaggtgt

SEQ ID NO: 178462 - DNA, 27 bp, Artificial Sequence
  Description of Artificial Sequence: Synthetic oligonucleotide
tatggcactcaggggtgccaggtgtga

SEQ ID NO: 178463 - DNA, 24 bp, Artificial Sequence
  Description of Artificial Sequence: Synthetic oligonucleotide
aggctgacggctcgttccaggacc

SEQ ID NO: 178464 - DNA, 23 bp, Artificial Sequence
  Description of Artificial Sequence: Synthetic oligonucleotide
ggctgacggctcgttccaggacc

SEQ ID NO: 178465 - DNA, 23 bp, Artificial Sequence
  Description of Artificial Sequence: Synthetic oligonucleotide
gctgacggctcgttccaggaccc

SEQ ID NO: 178466 - DNA, 24 bp, Artificial Sequence
  Description of Artificial Sequence: Synthetic oligonucleotide
ctgacggctcgttccaggacccct

SEQ ID NO: 178467 - DNA, 25 bp, Artificial Sequence
  Description of Artificial Sequence: Synthetic oligonucleotide
tgacggctcgttccaggacccctgt

SEQ ID NO: 178468 - DNA, 24 bp, Artificial Sequence
  Description of Artificial Sequence: Synthetic oligonucleotide
gacggctcgttccaggacccctgt

SEQ ID NO: 178469 - DNA, 24 bp, Artificial Sequence
  Description of Artificial Sequence: Synthetic oligonucleotide
acggctcgttccaggacccctgtc

SEQ ID NO: 178470 - DNA, 23 bp, Artificial Sequence
  Description of Artificial Sequence: Synthetic oligonucleotide
cggctcgttccaggacccctgtc

SEQ ID NO: 178471 - DNA, 24 bp, Artificial Sequence
  Description of Artificial Sequence: Synthetic oligonucleotide
ggctcgttccaggacccctgtcca

SEQ ID NO: 178472 - DNA, 25 bp, Artificial Sequence
  Description of Artificial Sequence: Synthetic oligonucleotide
gctcgttccaggacccctgtccagt

SEQ ID NO: 178473 - DNA, 27 bp, Artificial Sequence
  Description of Artificial Sequence: Synthetic oligonucleotide
ctcgttccaggacccctgtccagtgtt

SEQ ID NO: 178474 - DNA, 28 bp, Artificial Sequence
  Description of Artificial Sequence: Synthetic oligonucleotide
tcgttccaggacccctgtccagtgttag

SEQ ID NO: 178475 - DNA, 27 bp, Artificial Sequence
  Description of Artificial Sequence: Synthetic oligonucleotide
cgttccaggacccctgtccagtgttag

SEQ ID NO: 178476 - DNA, 28 bp, Artificial Sequence
  Description of Artificial Sequence: Synthetic oligonucleotide
gttccaggacccctgtccagtgttagac

SEQ ID NO: 178477 - DNA, 29 bp, Artificial Sequence
  Description of Artificial Sequence: Synthetic oligonucleotide
ttccaggacccctgtccagtgttagacag

SEQ ID NO: 178478 - DNA, 28 bp, Artificial Sequence
  Description of Artificial Sequence: Synthetic oligonucleotide
tccaggacccctgtccagtgttagacag

SEQ ID NO: 178479 - DNA, 27 bp, Artificial Sequence
  Description of Artificial Sequence: Synthetic oligonucleotide
ccaggacccctgtccagtgttagacag

SEQ ID NO: 178480 - DNA, 27 bp, Artificial Sequence
  Description of Artificial Sequence: Synthetic oligonucleotide
caggacccctgtccagtgttagacagg

SEQ ID NO: 178481 - DNA, 28 bp, Artificial Sequence
  Description of Artificial Sequence: Synthetic oligonucleotide
aggacccctgtccagtgttagacaggag

SEQ ID NO: 178482 - DNA, 27 bp, Artificial Sequence
  Description of Artificial Sequence: Synthetic oligonucleotide
ggacccctgtccagtgttagacaggag

SEQ ID NO: 178483 - DNA, 27 bp, Artificial Sequence
  Description of Artificial Sequence: Synthetic oligonucleotide
gacccctgtccagtgttagacaggagc

SEQ ID NO: 178484 - DNA, 29 bp, Artificial Sequence
  Description of Artificial Sequence: Synthetic oligonucleotide
acccctgtccagtgttagacaggagcatg

SEQ ID NO: 178485 - DNA, 28 bp, Artificial Sequence
  Description of Artificial Sequence: Synthetic oligonucleotide
cccctgtccagtgttagacaggagcatg

SEQ ID NO: 178486 - DNA, 28 bp, Artificial Sequence
  Description of Artificial Sequence: Synthetic oligonucleotide
ccctgtccagtgttagacaggagcatgc

SEQ ID NO: 178487 - DNA, 29 bp, Artificial Sequence
  Description of Artificial Sequence: Synthetic oligonucleotide
cctgtccagtgttagacaggagcatgcag

SEQ ID NO: 178488 - DNA, 29 bp, Artificial Sequence
  Description of Artificial Sequence: Synthetic oligonucleotide
ctgtccagtgttagacaggagcatgcagg

SEQ ID NO: 178489 - DNA, 29 bp, Artificial Sequence
  Description of Artificial Sequence: Synthetic oligonucleotide
tgtccagtgttagacaggagcatgcaggg

SEQ ID NO: 178490 - DNA, 28 bp, Artificial Sequence
  Description of Artificial Sequence: Synthetic oligonucleotide
gtccagtgttagacaggagcatgcaggg

SEQ ID NO: 178491 - DNA, 28 bp, Artificial Sequence
  Description of Artificial Sequence: Synthetic oligonucleotide
tccagtgttagacaggagcatgcagggg

SEQ ID NO: 178492 - DNA, 27 bp, Artificial Sequence
  Description of Artificial Sequence: Synthetic oligonucleotide
ccagtgttagacaggagcatgcagggg

SEQ ID NO: 178493 - DNA, 27 bp, Artificial Sequence
  Description of Artificial Sequence: Synthetic oligonucleotide
cagtgttagacaggagcatgcaggggg

SEQ ID NO: 178494 - DNA, 27 bp, Artificial Sequence
  Description of Artificial Sequence: Synthetic oligonucleotide
agtgttagacaggagcatgcagggggg

SEQ ID NO: 178495 - DNA, 27 bp, Artificial Sequence
  Description of Artificial Sequence: Synthetic oligonucleotide
gtgttagacaggagcatgcaggggggt

SEQ ID NO: 178496 - DNA, 29 bp, Artificial Sequence
  Description of Artificial Sequence: Synthetic oligonucleotide
tgttagacaggagcatgcaggggggtttg

SEQ ID NO: 178497 - DNA, 28 bp, Artificial Sequence
  Description of Artificial Sequence: Synthetic oligonucleotide
gttagacaggagcatgcaggggggtttg

SEQ ID NO: 178498 - DNA, 28 bp, Artificial Sequence
  Description of Artificial Sequence: Synthetic oligonucleotide
ttagacaggagcatgcaggggggtttgg

SEQ ID NO: 178499 - DNA, 27 bp, Artificial Sequence
  Description of Artificial Sequence: Synthetic oligonucleotide
tagacaggagcatgcaggggggtttgg

SEQ ID NO: 178500 - DNA, 27 bp, Artificial Sequence
  Description of Artificial Sequence: Synthetic oligonucleotide
agacaggagcatgcaggggggtttggt

SEQ ID NO: 178501 - DNA, 26 bp, Artificial Sequence
  Description of Artificial Sequence: Synthetic oligonucleotide
gacaggagcatgcaggggggtttggt

SEQ ID NO: 178502 - DNA, 26 bp, Artificial Sequence
  Description of Artificial Sequence: Synthetic oligonucleotide
acaggagcatgcaggggggtttggtg

SEQ ID NO: 178503 - DNA, 27 bp, Artificial Sequence
  Description of Artificial Sequence: Synthetic oligonucleotide
tgtggctccccgactctctgaccacat

SEQ ID NO: 178504 - DNA, 26 bp, Artificial Sequence
  Description of Artificial Sequence: Synthetic oligonucleotide
gtggctccccgactctctgaccacat

SEQ ID NO: 178505 - DNA, 26 bp, Artificial Sequence
  Description of Artificial Sequence: Synthetic oligonucleotide
tggctccccgactctctgaccacatg

SEQ ID NO: 178506 - DNA, 25 bp, Artificial Sequence
  Description of Artificial Sequence: Synthetic oligonucleotide
ggctccccgactctctgaccacatg

SEQ ID NO: 178507 - DNA, 25 bp, Artificial Sequence
  Description of Artificial Sequence: Synthetic oligonucleotide
gctccccgactctctgaccacatgg

SEQ ID NO: 178508 - DNA, 26 bp, Artificial Sequence
  Description of Artificial Sequence: Synthetic oligonucleotide
ctccccgactctctgaccacatggga

SEQ ID NO: 178509 - DNA, 27 bp, Artificial Sequence
  Description of Artificial Sequence: Synthetic oligonucleotide
tccccgactctctgaccacatgggaga

SEQ ID NO: 178510 - DNA, 27 bp, Artificial Sequence
  Description of Artificial Sequence: Synthetic oligonucleotide
ccccgactctctgaccacatgggagat

SEQ ID NO: 178511 - DNA, 27 bp, Artificial Sequence
  Description of Artificial Sequence: Synthetic oligonucleotide
cccgactctctgaccacatgggagatc

SEQ ID NO: 178512 - DNA, 27 bp, Artificial Sequence
  Description of Artificial Sequence: Synthetic oligonucleotide
ccgactctctgaccacatgggagatcc

SEQ ID NO: 178513 - DNA, 29 bp, Artificial Sequence
  Description of Artificial Sequence: Synthetic oligonucleotide
cgactctctgaccacatgggagatccatg

SEQ ID NO: 178514 - DNA, 29 bp, Artificial Sequence
  Description of Artificial Sequence: Synthetic oligonucleotide
gactctctgaccacatgggagatccatgg

SEQ ID NO: 178515 - DNA, 29 bp, Artificial Sequence
  Description of Artificial Sequence: Synthetic oligonucleotide
actctctgaccacatgggagatccatggc

SEQ ID NO: 178516 - DNA, 28 bp, Artificial Sequence
  Description of Artificial Sequence: Synthetic oligonucleotide
ctctctgaccacatgggagatccatggc

SEQ ID NO: 178517 - DNA, 28 bp, Artificial Sequence
  Description of Artificial Sequence: Synthetic oligonucleotide
tctctgaccacatgggagatccatggcc

SEQ ID NO: 178518 - DNA, 27 bp, Artificial Sequence
  Description of Artificial Sequence: Synthetic oligonucleotide
ctctgaccacatgggagatccatggcc

SEQ ID NO: 178519 - DNA, 28 bp, Artificial Sequence
  Description of Artificial Sequence: Synthetic oligonucleotide
tctgaccacatgggagatccatggcctg

SEQ ID NO: 178520 - DNA, 27 bp, Artificial Sequence
  Description of Artificial Sequence: Synthetic oligonucleotide
ctgaccacatgggagatccatggcctg

SEQ ID NO: 178521 - DNA, 28 bp, Artificial Sequence
  Description of Artificial Sequence: Synthetic oligonucleotide
tgaccacatgggagatccatggcctgag

SEQ ID NO: 178522 - DNA, 27 bp, Artificial Sequence
  Description of Artificial Sequence: Synthetic oligonucleotide
gaccacatgggagatccatggcctgag

SEQ ID NO: 178523 - DNA, 27 bp, Artificial Sequence
  Description of Artificial Sequence: Synthetic oligonucleotide
accacatgggagatccatggcctgagc

SEQ ID NO: 178524 - DNA, 26 bp, Artificial Sequence
  Description of Artificial Sequence: Synthetic oligonucleotide
ccacatgggagatccatggcctgagc

SEQ ID NO: 178525 - DNA, 27 bp, Artificial Sequence
  Description of Artificial Sequence: Synthetic oligonucleotide
cacatgggagatccatggcctgagcct

SEQ ID NO: 178526 - DNA, 27 bp, Artificial Sequence
  Description of Artificial Sequence: Synthetic oligonucleotide
acatgggagatccatggcctgagcctg

SEQ ID NO: 178527 - DNA, 27 bp, Artificial Sequence
  Description of Artificial Sequence: Synthetic oligonucleotide
catgggagatccatggcctgagcctgt

SEQ ID NO: 178528 - DNA, 27 bp, Artificial Sequence
  Description of Artificial Sequence: Synthetic oligonucleotide
atgggagatccatggcctgagcctgtc

SEQ ID NO: 178529 - DNA, 28 bp, Artificial Sequence
  Description of Artificial Sequence: Synthetic oligonucleotide
caggatgtgccccgaggacaggtagtsa

SEQ ID NO: 178530 - DNA, 30 bp, Artificial Sequence
  Description of Artificial Sequence: Synthetic oligonucleotide
aggatgtgccccgaggacaggtagtsaaag

SEQ ID NO: 178531 - DNA, 29 bp, Artificial Sequence
  Description of Artificial Sequence: Synthetic oligonucleotide
ggatgtgccccgaggacaggtagtsaaag

SEQ ID NO: 178532 - DNA, 29 bp, Artificial Sequence
  Description of Artificial Sequence: Synthetic oligonucleotide
gatgtgccccgaggacaggtagtsaaagg

SEQ ID NO: 178533 - DNA, 31 bp, Artificial Sequence
  Description of Artificial Sequence: Synthetic oligonucleotide
atgtgccccgaggacaggtagtsaaaggatc

SEQ ID NO: 178534 - DNA, 30 bp, Artificial Sequence
  Description of Artificial Sequence: Synthetic oligonucleotide
tgtgccccgaggacaggtagtsaaaggatc

SEQ ID NO: 178535 - DNA, 29 bp, Artificial Sequence
  Description of Artificial Sequence: Synthetic oligonucleotide
gtgccccgaggacaggtagtsaaaggatc

SEQ ID NO: 178536 - DNA, 30 bp, Artificial Sequence
  Description of Artificial Sequence: Synthetic oligonucleotide
tgccccgaggacaggtagtsaaaggatcag

SEQ ID NO: 178537 - DNA, 29 bp, Artificial Sequence
  Description of Artificial Sequence: Synthetic oligonucleotide
gccccgaggacaggtagtsaaaggatcag

SEQ ID NO: 178538 - DNA, 30 bp, Artificial Sequence
  Description of Artificial Sequence: Synthetic oligonucleotide
ccccgaggacaggtagtsaaaggatcagtg

SEQ ID NO: 178539 - DNA, 32 bp, Artificial Sequence
  Description of Artificial Sequence: Synthetic oligonucleotide
cccgaggacaggtagtsaaaggatcagtgttc

SEQ ID NO: 178540 - DNA, 32 bp, Artificial Sequence
  Description of Artificial Sequence: Synthetic oligonucleotide
ccgaggacaggtagtsaaaggatcagtgttcc

SEQ ID NO: 178541 - DNA, 33 bp, Artificial Sequence
  Description of Artificial Sequence: Synthetic oligonucleotide
cgaggacaggtagtsaaaggatcagtgttcctg

SEQ ID NO: 178542 - DNA, 34 bp, Artificial Sequence
  Description of Artificial Sequence: Synthetic oligonucleotide
gaggacaggtagtsaaaggatcagtgttcctgag

SEQ ID NO: 178543 - DNA, 37 bp, Artificial Sequence
  Description of Artificial Sequence: Synthetic oligonucleotide
aggacaggtagtsaaaggatcagtgttcctgagaaac

SEQ ID NO: 178544 - DNA, 36 bp, Artificial Sequence
  Description of Artificial Sequence: Synthetic oligonucleotide
ggacaggtagtsaaaggatcagtgttcctgagaaac

SEQ ID NO: 178545 - DNA, 36 bp, Artificial Sequence
  Description of Artificial Sequence: Synthetic oligonucleotide
gacaggtagtsaaaggatcagtgttcctgagaaacc

SEQ ID NO: 178546 - DNA, 36 bp, Artificial Sequence
  Description of Artificial Sequence: Synthetic oligonucleotide
acaggtagtsaaaggatcagtgttcctgagaaaccc

SEQ ID NO: 178547 - DNA, 35 bp, Artificial Sequence
  Description of Artificial Sequence: Synthetic oligonucleotide
caggtagtsaaaggatcagtgttcctgagaaaccc

SEQ ID NO: 178548 - DNA, 37 bp, Artificial Sequence
  Description of Artificial Sequence: Synthetic oligonucleotide
aggtagtsaaaggatcagtgttcctgagaaacccatc

SEQ ID NO: 178549 - DNA, 36 bp, Artificial Sequence
  Description of Artificial Sequence: Synthetic oligonucleotide
ggtagtsaaaggatcagtgttcctgagaaacccatc

SEQ ID NO: 178550 - DNA, 37 bp, Artificial Sequence
  Description of Artificial Sequence: Synthetic oligonucleotide
gtagtsaaaggatcagtgttcctgagaaacccatctc

SEQ ID NO: 178551 - DNA, 37 bp, Artificial Sequence
  Description of Artificial Sequence: Synthetic oligonucleotide
tagtsaaaggatcagtgttcctgagaaacccatctcg

SEQ ID NO: 178552 - DNA, 36 bp, Artificial Sequence
  Description of Artificial Sequence: Synthetic oligonucleotide
agtsaaaggatcagtgttcctgagaaacccatctcg

SEQ ID NO: 178553 - DNA, 35 bp, Artificial Sequence
  Description of Artificial Sequence: Synthetic oligonucleotide
gtsaaaggatcagtgttcctgagaaacccatctcg

SEQ ID NO: 178554 - DNA, 42 bp, Artificial Sequence
  Description of Artificial Sequence: Synthetic oligonucleotide
tsaaaggatcagtgttcctgagaaacccatctcgtaataatg

SEQ ID NO: 178555 - DNA, 41 bp, Artificial Sequence
  Description of Artificial Sequence: Synthetic oligonucleotide
saaaggatcagtgttcctgagaaacccatctcgtaataatg

SEQ ID NO: 178556 - DNA, 32 bp, Artificial Sequence
  Description of Artificial Sequence: Synthetic oligonucleotide
cctctacgttgctgcagccatcattgagtatc

SEQ ID NO: 178557 - DNA, 32 bp, Artificial Sequence
  Description of Artificial Sequence: Synthetic oligonucleotide
ctctacgttgctgcagccatcattgagtatcc

SEQ ID NO: 178558 - DNA, 33 bp, Artificial Sequence
  Description of Artificial Sequence: Synthetic oligonucleotide
tctacgttgctgcagccatcattgagtatccag

SEQ ID NO: 178559 - DNA, 32 bp, Artificial Sequence
  Description of Artificial Sequence: Synthetic oligonucleotide
ctacgttgctgcagccatcattgagtatccag

SEQ ID NO: 178560 - DNA, 32 bp, Artificial Sequence
  Description of Artificial Sequence: Synthetic oligonucleotide
tacgttgctgcagccatcattgagtatccagg

SEQ ID NO: 178561 - DNA, 31 bp, Artificial Sequence
  Description of Artificial Sequence: Synthetic oligonucleotide
acgttgctgcagccatcattgagtatccagg

SEQ ID NO: 178562 - DNA, 30 bp, Artificial Sequence
  Description of Artificial Sequence: Synthetic oligonucleotide
cgttgctgcagccatcattgagtatccagg

SEQ ID NO: 178563 - DNA, 31 bp, Artificial Sequence
  Description of Artificial Sequence: Synthetic oligonucleotide
gttgctgcagccatcattgagtatccaggtg

SEQ ID NO: 178564 - DNA, 31 bp, Artificial Sequence
  Description of Artificial Sequence: Synthetic oligonucleotide
ttgctgcagccatcattgagtatccaggtgg

SEQ ID NO: 178565 - DNA, 30 bp, Artificial Sequence
  Description of Artificial Sequence: Synthetic oligonucleotide
tgctgcagccatcattgagtatccaggtgg

SEQ ID NO: 178566 - DNA, 29 bp, Artificial Sequence
  Description of Artificial Sequence: Synthetic oligonucleotide
gctgcagccatcattgagtatccaggtgg

SEQ ID NO: 178567 - DNA, 29 bp, Artificial Sequence
  Description of Artificial Sequence: Synthetic oligonucleotide
ctgcagccatcattgagtatccaggtggg

SEQ ID NO: 178568 - DNA, 29 bp, Artificial Sequence
  Description of Artificial Sequence: Synthetic oligonucleotide
tgcagccatcattgagtatccaggtgggg

SEQ ID NO: 178569 - DNA, 28 bp, Artificial Sequence
  Description of Artificial Sequence: Synthetic oligonucleotide
gcagccatcattgagtatccaggtgggg

SEQ ID NO: 178570 - DNA, 29 bp, Artificial Sequence
  Description of Artificial Sequence: Synthetic oligonucleotide
cagccatcattgagtatccaggtggggag

SEQ ID NO: 178571 - DNA, 31 bp, Artificial Sequence
  Description of Artificial Sequence: Synthetic oligonucleotide
agccatcattgagtatccaggtggggagatg

SEQ ID NO: 178572 - DNA, 30 bp, Artificial Sequence
  Description of Artificial Sequence: Synthetic oligonucleotide
gccatcattgagtatccaggtggggagatg

SEQ ID NO: 178573 - DNA, 30 bp, Artificial Sequence
  Description of Artificial Sequence: Synthetic oligonucleotide
ccatcattgagtatccaggtggggagatgg

SEQ ID NO: 178574 - DNA, 31 bp, Artificial Sequence
  Description of Artificial Sequence: Synthetic oligonucleotide
catcattgagtatccaggtggggagatggag

SEQ ID NO: 178575 - DNA, 31 bp, Artificial Sequence
  Description of Artificial Sequence: Synthetic oligonucleotide
atcattgagtatccaggtggggagatggagg

SEQ ID NO: 178576 - DNA, 30 bp, Artificial Sequence
  Description of Artificial Sequence: Synthetic oligonucleotide
tcattgagtatccaggtggggagatggagg

SEQ ID NO: 178577 - DNA, 29 bp, Artificial Sequence
  Description of Artificial Sequence: Synthetic oligonucleotide
cattgagtatccaggtggggagatggagg

SEQ ID NO: 178578 - DNA, 30 bp, Artificial Sequence
  Description of Artificial Sequence: Synthetic oligonucleotide
attgagtatccaggtggggagatggaggag

SEQ ID NO: 178579 - DNA, 29 bp, Artificial Sequence
  Description of Artificial Sequence: Synthetic oligonucleotide
ttgagtatccaggtggggagatggaggag

SEQ ID NO: 178580 - DNA, 28 bp, Artificial Sequence
  Description of Artificial Sequence: Synthetic oligonucleotide
tgagtatccaggtggggagatggaggag

SEQ ID NO: 178581 - DNA, 27 bp, Artificial Sequence
  Description of Artificial Sequence: Synthetic oligonucleotide
gagtatccaggtggggagatggaggag

SEQ ID NO: 178582 - DNA, 27 bp, Artificial Sequence
  Description of Artificial Sequence: Synthetic oligonucleotide
agtatccaggtggggagatggaggagg

SEQ ID NO: 178583 - DNA, 26 bp, Artificial Sequence
  Description of Artificial Sequence: Synthetic oligonucleotide
gtatccaggtggggagatggaggagg

SEQ ID NO: 178584 - DNA, 27 bp, Artificial Sequence
  Description of Artificial Sequence: Synthetic oligonucleotide
tatccaggtggggagatggaggaggca

SEQ ID NO: 178585 - DNA, 26 bp, Artificial Sequence
  Description of Artificial Sequence: Synthetic oligonucleotide
atccaggtggggagatggaggaggca

SEQ ID NO: 178586 - DNA, 24 bp, Artificial Sequence
  Description of Artificial Sequence: Synthetic oligonucleotide
agcaatgccgtgtcgcccacccca

SEQ ID NO: 178587 - DNA, 23 bp, Artificial Sequence
  Description of Artificial Sequence: Synthetic oligonucleotide
gcaatgccgtgtcgcccacccca

SEQ ID NO: 178588 - DNA, 23 bp, Artificial Sequence
  Description of Artificial Sequence: Synthetic oligonucleotide
caatgccgtgtcgcccaccccag

SEQ ID NO: 178589 - DNA, 24 bp, Artificial Sequence
  Description of Artificial Sequence: Synthetic oligonucleotide
aatgccgtgtcgcccaccccagct

SEQ ID NO: 178590 - DNA, 23 bp, Artificial Sequence
  Description of Artificial Sequence: Synthetic oligonucleotide
atgccgtgtcgcccaccccagct

SEQ ID NO: 178591 - DNA, 22 bp, Artificial Sequence
  Description of Artificial Sequence: Synthetic oligonucleotide
tgccgtgtcgcccaccccagct

SEQ ID NO: 178592 - DNA, 21 bp, Artificial Sequence
  Description of Artificial Sequence: Synthetic oligonucleotide
gccgtgtcgcccaccccagct

SEQ ID NO: 178593 - DNA, 21 bp, Artificial Sequence
  Description of Artificial Sequence: Synthetic oligonucleotide
ccgtgtcgcccaccccagctc

SEQ ID NO: 178594 - DNA, 22 bp, Artificial Sequence
  Description of Artificial Sequence: Synthetic oligonucleotide
cgtgtcgcccaccccagctcct

SEQ ID NO: 178595 - DNA, 22 bp, Artificial Sequence
  Description of Artificial Sequence: Synthetic oligonucleotide
gtgtcgcccaccccagctcctc

SEQ ID NO: 178596 - DNA, 22 bp, Artificial Sequence
  Description of Artificial Sequence: Synthetic oligonucleotide
tgtcgcccaccccagctcctcg

SEQ ID NO: 178597 - DNA, 21 bp, Artificial Sequence
  Description of Artificial Sequence: Synthetic oligonucleotide
gtcgcccaccccagctcctcg

SEQ ID NO: 178598 - DNA, 23 bp, Artificial Sequence
  Description of Artificial Sequence: Synthetic oligonucleotide
tcgcccaccccagctcctcgcaa

SEQ ID NO: 178599 - DNA, 22 bp, Artificial Sequence
  Description of Artificial Sequence: Synthetic oligonucleotide
cgcccaccccagctcctcgcaa

SEQ ID NO: 178600 - DNA, 22 bp, Artificial Sequence
  Description of Artificial Sequence: Synthetic oligonucleotide
gcccaccccagctcctcgcaac

SEQ ID NO: 178601 - DNA, 22 bp, Artificial Sequence
  Description of Artificial Sequence: Synthetic oligonucleotide
cccaccccagctcctcgcaacc

SEQ ID NO: 178602 - DNA, 24 bp, Artificial Sequence
  Description of Artificial Sequence: Synthetic oligonucleotide
ccaccccagctcctcgcaacccat

SEQ ID NO: 178603 - DNA, 24 bp, Artificial Sequence
  Description of Artificial Sequence: Synthetic oligonucleotide
caccccagctcctcgcaacccatc

SEQ ID NO: 178604 - DNA, 24 bp, Artificial Sequence
  Description of Artificial Sequence: Synthetic oligonucleotide
accccagctcctcgcaacccatcc

SEQ ID NO: 178605 - DNA, 23 bp, Artificial Sequence
  Description of Artificial Sequence: Synthetic oligonucleotide
ccccagctcctcgcaacccatcc

SEQ ID NO: 178606 - DNA, 24 bp, Artificial Sequence
  Description of Artificial Sequence: Synthetic oligonucleotide
cccagctcctcgcaacccatccga

SEQ ID NO: 178607 - DNA, 24 bp, Artificial Sequence
  Description of Artificial Sequence: Synthetic oligonucleotide
ccagctcctcgcaacccatccgac

SEQ ID NO: 178608 - DNA, 24 bp, Artificial Sequence
  Description of Artificial Sequence: Synthetic oligonucleotide
cagctcctcgcaacccatccgacc

SEQ ID NO: 178609 - DNA, 24 bp, Artificial Sequence
  Description of Artificial Sequence: Synthetic oligonucleotide
agctcctcgcaacccatccgaccc

SEQ ID NO: 178610 - DNA, 38 bp, Artificial Sequence
  Description of Artificial Sequence: Synthetic oligonucleotide
cttggaacctgggaaagaatatttgatcatgggtctag

SEQ ID NO: 178611 - DNA, 40 bp, Artificial Sequence
  Description of Artificial Sequence: Synthetic oligonucleotide
ttggaacctgggaaagaatatttgatcatgggtctagatg

SEQ ID NO: 178612 - DNA, 39 bp, Artificial Sequence
  Description of Artificial Sequence: Synthetic oligonucleotide
tggaacctgggaaagaatatttgatcatgggtctagatg

SEQ ID NO: 178613 - DNA, 38 bp, Artificial Sequence
  Description of Artificial Sequence: Synthetic oligonucleotide
ggaacctgggaaagaatatttgatcatgggtctagatg

SEQ ID NO: 178614 - DNA, 38 bp, Artificial Sequence
  Description of Artificial Sequence: Synthetic oligonucleotide
gaacctgggaaagaatatttgatcatgggtctagatgg

SEQ ID NO: 178615 - DNA, 38 bp, Artificial Sequence
  Description of Artificial Sequence: Synthetic oligonucleotide
aacctgggaaagaatatttgatcatgggtctagatggg

SEQ ID NO: 178616 - DNA, 37 bp, Artificial Sequence
  Description of Artificial Sequence: Synthetic oligonucleotide
acctgggaaagaatatttgatcatgggtctagatggg

SEQ ID NO: 178617 - DNA, 36 bp, Artificial Sequence
  Description of Artificial Sequence: Synthetic oligonucleotide
cctgggaaagaatatttgatcatgggtctagatggg

SEQ ID NO: 178618 - DNA, 36 bp, Artificial Sequence
  Description of Artificial Sequence: Synthetic oligonucleotide
ctgggaaagaatatttgatcatgggtctagatgggg

SEQ ID NO: 178619 - DNA, 36 bp, Artificial Sequence
  Description of Artificial Sequence: Synthetic oligonucleotide
tgggaaagaatatttgatcatgggtctagatggggc

SEQ ID NO: 178620 - DNA, 35 bp, Artificial Sequence
  Description of Artificial Sequence: Synthetic oligonucleotide
gggaaagaatatttgatcatgggtctagatggggc

SEQ ID NO: 178621 - DNA, 35 bp, Artificial Sequence
  Description of Artificial Sequence: Synthetic oligonucleotide
ggaaagaatatttgatcatgggtctagatggggcc

SEQ ID NO: 178622 - DNA, 36 bp, Artificial Sequence
  Description of Artificial Sequence: Synthetic oligonucleotide
gaaagaatatttgatcatgggtctagatggggccac

SEQ ID NO: 178623 - DNA, 36 bp, Artificial Sequence
  Description of Artificial Sequence: Synthetic oligonucleotide
aaagaatatttgatcatgggtctagatggggccacc

SEQ ID NO: 178624 - DNA, 35 bp, Artificial Sequence
  Description of Artificial Sequence: Synthetic oligonucleotide
aagaatatttgatcatgggtctagatggggccacc

SEQ ID NO: 178625 - DNA, 34 bp, Artificial Sequence
  Description of Artificial Sequence: Synthetic oligonucleotide
agaatatttgatcatgggtctagatggggccacc

SEQ ID NO: 178626 - DNA, 33 bp, Artificial Sequence
  Description of Artificial Sequence: Synthetic oligonucleotide
gaatatttgatcatgggtctagatggggccacc

SEQ ID NO: 178627 - DNA, 36 bp, Artificial Sequence
  Description of Artificial Sequence: Synthetic oligonucleotide
aatatttgatcatgggtctagatggggccacctatg

SEQ ID NO: 178628 - DNA, 35 bp, Artificial Sequence
  Description of Artificial Sequence: Synthetic oligonucleotide
atatttgatcatgggtctagatggggccacctatg

SEQ ID NO: 178629 - DNA, 34 bp, Artificial Sequence
  Description of Artificial Sequence: Synthetic oligonucleotide
tatttgatcatgggtctagatggggccacctatg

SEQ ID NO: 178630 - DNA, 33 bp, Artificial Sequence
  Description of Artificial Sequence: Synthetic oligonucleotide
atttgatcatgggtctagatggggccacctatg

SEQ ID NO: 178631 - DNA, 32 bp, Artificial Sequence
  Description of Artificial Sequence: Synthetic oligonucleotide
tttgatcatgggtctagatggggccacctatg

SEQ ID NO: 178632 - DNA, 31 bp, Artificial Sequence
  Description of Artificial Sequence: Synthetic oligonucleotide
ttgatcatgggtctagatggggccacctatg

SEQ ID NO: 178633 - DNA, 30 bp, Artificial Sequence
  Description of Artificial Sequence: Synthetic oligonucleotide
tgatcatgggtctagatggggccacctatg

SEQ ID NO: 178634 - DNA, 29 bp, Artificial Sequence
  Description of Artificial Sequence: Synthetic oligonucleotide
gatcatgggtctagatggggccacctatg

SEQ ID NO: 178635 - DNA, 30 bp, Artificial Sequence
  Description of Artificial Sequence: Synthetic oligonucleotide
atcatgggtctagatggggccacctatgac

SEQ ID NO: 178636 - DNA, 29 bp, Artificial Sequence
  Description of Artificial Sequence: Synthetic oligonucleotide
tcatgggtctagatggggccacctatgac

SEQ ID NO: 178637 - DNA, 28 bp, Artificial Sequence
  Description of Artificial Sequence: Synthetic oligonucleotide
catgggtctagatggggccacctatgac

SEQ ID NO: 178638 - DNA, 28 bp, Artificial Sequence
  Description of Artificial Sequence: Synthetic oligonucleotide
atgggtctagatggggccacctatgacc

SEQ ID NO: 178639 - DNA, 27 bp, Artificial Sequence
  Description of Artificial Sequence: Synthetic oligonucleotide
tgggtctagatggggccacctatgacc

SEQ ID NO: 178640 - DNA, 27 bp, Artificial Sequence
  Description of Artificial Sequence: Synthetic oligonucleotide
gggtctagatggggccacctatgacct

SEQ ID NO: 178641 - DNA, 27 bp, Artificial Sequence
  Description of Artificial Sequence: Synthetic oligonucleotide
ggtctagatggggccacctatgacctc

SEQ ID NO: 178642 - DNA, 27 bp, Artificial Sequence
  Description of Artificial Sequence: Synthetic oligonucleotide
gtctagatggggccacctatgacctcg

SEQ ID NO: 178643 - DNA, 28 bp, Artificial Sequence
  Description of Artificial Sequence: Synthetic oligonucleotide
tctagatggggccacctatgacctcgag

SEQ ID NO: 178644 - DNA, 27 bp, Artificial Sequence
  Description of Artificial Sequence: Synthetic oligonucleotide
ctagatggggccacctatgacctcgag

SEQ ID NO: 178645 - DNA, 27 bp, Artificial Sequence
  Description of Artificial Sequence: Synthetic oligonucleotide
tagatggggccacctatgacctcgagg

SEQ ID NO: 178646 - DNA, 26 bp, Artificial Sequence
  Description of Artificial Sequence: Synthetic oligonucleotide
agatggggccacctatgacctcgagg

SEQ ID NO: 178647 - DNA, 34 bp, Artificial Sequence
  Description of Artificial Sequence: Synthetic oligonucleotide
gtggacttcacccttagctcagaaagagactttg

SEQ ID NO: 178648 - DNA, 34 bp, Artificial Sequence
  Description of Artificial Sequence: Synthetic oligonucleotide
tggacttcacccttagctcagaaagagactttgc

SEQ ID NO: 178649 - DNA, 33 bp, Artificial Sequence
  Description of Artificial Sequence: Synthetic oligonucleotide
ggacttcacccttagctcagaaagagactttgc

SEQ ID NO: 178650 - DNA, 34 bp, Artificial Sequence
  Description of Artificial Sequence: Synthetic oligonucleotide
gacttcacccttagctcagaaagagactttgcac

SEQ ID NO: 178651 - DNA, 35 bp, Artificial Sequence
  Description of Artificial Sequence: Synthetic oligonucleotide
acttcacccttagctcagaaagagactttgcactc

SEQ ID NO: 178652 - DNA, 34 bp, Artificial Sequence
  Description of Artificial Sequence: Synthetic oligonucleotide
cttcacccttagctcagaaagagactttgcactc

SEQ ID NO: 178653 - DNA, 34 bp, Artificial Sequence
  Description of Artificial Sequence: Synthetic oligonucleotide
ttcacccttagctcagaaagagactttgcactcc

SEQ ID NO: 178654 - DNA, 33 bp, Artificial Sequence
  Description of Artificial Sequence: Synthetic oligonucleotide
tcacccttagctcagaaagagactttgcactcc

SEQ ID NO: 178655 - DNA, 32 bp, Artificial Sequence
  Description of Artificial Sequence: Synthetic oligonucleotide
cacccttagctcagaaagagactttgcactcc

SEQ ID NO: 178656 - DNA, 33 bp, Artificial Sequence
  Description of Artificial Sequence: Synthetic oligonucleotide
acccttagctcagaaagagactttgcactcctc

SEQ ID NO: 178657 - DNA, 32 bp, Artificial Sequence
  Description of Artificial Sequence: Synthetic oligonucleotide
cccttagctcagaaagagactttgcactcctc

SEQ ID NO: 178658 - DNA, 33 bp, Artificial Sequence
  Description of Artificial Sequence: Synthetic oligonucleotide
ccttagctcagaaagagactttgcactcctcag

SEQ ID NO: 178659 - DNA, 34 bp, Artificial Sequence
  Description of Artificial Sequence: Synthetic oligonucleotide
cttagctcagaaagagactttgcactcctcagtc

SEQ ID NO: 178660 - DNA, 35 bp, Artificial Sequence
  Description of Artificial Sequence: Synthetic oligonucleotide
ttagctcagaaagagactttgcactcctcagtctc

SEQ ID NO: 178661 - DNA, 34 bp, Artificial Sequence
  Description of Artificial Sequence: Synthetic oligonucleotide
tagctcagaaagagactttgcactcctcagtctc

SEQ ID NO: 178662 - DNA, 33 bp, Artificial Sequence
  Description of Artificial Sequence: Synthetic oligonucleotide
agctcagaaagagactttgcactcctcagtctc

SEQ ID NO: 178663 - DNA, 32 bp, Artificial Sequence
  Description of Artificial Sequence: Synthetic oligonucleotide
gctcagaaagagactttgcactcctcagtctc

SEQ ID NO: 178664 - DNA, 32 bp, Artificial Sequence
  Description of Artificial Sequence: Synthetic oligonucleotide
ctcagaaagagactttgcactcctcagtctcc

SEQ ID NO: 178665 - DNA, 33 bp, Artificial Sequence
  Description of Artificial Sequence: Synthetic oligonucleotide
tcagaaagagactttgcactcctcagtctccag

SEQ ID NO: 178666 - DNA, 32 bp, Artificial Sequence
  Description of Artificial Sequence: Synthetic oligonucleotide
cagaaagagactttgcactcctcagtctccag

SEQ ID NO: 178667 - DNA, 32 bp, Artificial Sequence
  Description of Artificial Sequence: Synthetic oligonucleotide
agaaagagactttgcactcctcagtctccagg

SEQ ID NO: 178668 - DNA, 31 bp, Artificial Sequence
  Description of Artificial Sequence: Synthetic oligonucleotide
gaaagagactttgcactcctcagtctccagg

SEQ ID NO: 178669 - DNA, 32 bp, Artificial Sequence
  Description of Artificial Sequence: Synthetic oligonucleotide
aaagagactttgcactcctcagtctccaggtg

SEQ ID NO: 178670 - DNA, 31 bp, Artificial Sequence
  Description of Artificial Sequence: Synthetic oligonucleotide
aagagactttgcactcctcagtctccaggtg

SEQ ID NO: 178671 - DNA, 30 bp, Artificial Sequence
  Description of Artificial Sequence: Synthetic oligonucleotide
agagactttgcactcctcagtctccaggtg

SEQ ID NO: 178672 - DNA, 29 bp, Artificial Sequence
  Description of Artificial Sequence: Synthetic oligonucleotide
gagactttgcactcctcagtctccaggtg

SEQ ID NO: 178673 - DNA, 29 bp, Artificial Sequence
  Description of Artificial Sequence: Synthetic oligonucleotide
agactttgcactcctcagtctccaggtgc

SEQ ID NO: 178674 - DNA, 28 bp, Artificial Sequence
  Description of Artificial Sequence: Synthetic oligonucleotide
gactttgcactcctcagtctccaggtgc

SEQ ID NO: 178675 - DNA, 28 bp, Artificial Sequence
  Description of Artificial Sequence: Synthetic oligonucleotide
actttgcactcctcagtctccaggtgcc

SEQ ID NO: 178676 - DNA, 27 bp, Artificial Sequence
  Description of Artificial Sequence: Synthetic oligonucleotide
ctttgcactcctcagtctccaggtgcc

SEQ ID NO: 178677 - DNA, 27 bp, Artificial Sequence
  Description of Artificial Sequence: Synthetic oligonucleotide
tttgcactcctcagtctccaggtgccc

SEQ ID NO: 178678 - DNA, 27 bp, Artificial Sequence
  Description of Artificial Sequence: Synthetic oligonucleotide
ttgcactcctcagtctccaggtgccct

SEQ ID NO: 178679 - DNA, 27 bp, Artificial Sequence
  Description of Artificial Sequence: Synthetic oligonucleotide
tgcactcctcagtctccaggtgccctt

SEQ ID NO: 178680 - DNA, 32 bp, Artificial Sequence
  Description of Artificial Sequence: Synthetic oligonucleotide
agagagtggaagcctccatctcaaaggcaaac

SEQ ID NO: 178681 - DNA, 31 bp, Artificial Sequence
  Description of Artificial Sequence: Synthetic oligonucleotide
gagagtggaagcctccatctcaaaggcaaac

SEQ ID NO: 178682 - DNA, 32 bp, Artificial Sequence
  Description of Artificial Sequence: Synthetic oligonucleotide
agagtggaagcctccatctcaaaggcaaactc

SEQ ID NO: 178683 - DNA, 31 bp, Artificial Sequence
  Description of Artificial Sequence: Synthetic oligonucleotide
gagtggaagcctccatctcaaaggcaaactc

SEQ ID NO: 178684 - DNA, 37 bp, Artificial Sequence
  Description of Artificial Sequence: Synthetic oligonucleotide
agtggaagcctccatctcaaaggcaaactcatttttg

SEQ ID NO: 178685 - DNA, 36 bp, Artificial Sequence
  Description of Artificial Sequence: Synthetic oligonucleotide
gtggaagcctccatctcaaaggcaaactcatttttg

SEQ ID NO: 178686 - DNA, 36 bp, Artificial Sequence
  Description of Artificial Sequence: Synthetic oligonucleotide
tggaagcctccatctcaaaggcaaactcatttttgg

SEQ ID NO: 178687 - DNA, 35 bp, Artificial Sequence
  Description of Artificial Sequence: Synthetic oligonucleotide
ggaagcctccatctcaaaggcaaactcatttttgg

SEQ ID NO: 178688 - DNA, 35 bp, Artificial Sequence
  Description of Artificial Sequence: Synthetic oligonucleotide
gaagcctccatctcaaaggcaaactcatttttggg

SEQ ID NO: 178689 - DNA, 35 bp, Artificial Sequence
  Description of Artificial Sequence: Synthetic oligonucleotide
aagcctccatctcaaaggcaaactcatttttgggg

SEQ ID NO: 178690 - DNA, 34 bp, Artificial Sequence
  Description of Artificial Sequence: Synthetic oligonucleotide
agcctccatctcaaaggcaaactcatttttgggg

SEQ ID NO: 178691 - DNA, 33 bp, Artificial Sequence
  Description of Artificial Sequence: Synthetic oligonucleotide
gcctccatctcaaaggcaaactcatttttgggg

SEQ ID NO: 178692 - DNA, 33 bp, Artificial Sequence
  Description of Artificial Sequence: Synthetic oligonucleotide
cctccatctcaaaggcaaactcatttttggggg

SEQ ID NO: 178693 - DNA, 34 bp, Artificial Sequence
  Description of Artificial Sequence: Synthetic oligonucleotide
ctccatctcaaaggcaaactcatttttgggggag

SEQ ID NO: 178694 - DNA, 37 bp, Artificial Sequence
  Description of Artificial Sequence: Synthetic oligonucleotide
tccatctcaaaggcaaactcatttttgggggagaaag

SEQ ID NO: 178695 - DNA, 36 bp, Artificial Sequence
  Description of Artificial Sequence: Synthetic oligonucleotide
ccatctcaaaggcaaactcatttttgggggagaaag

SEQ ID NO: 178696 - DNA, 36 bp, Artificial Sequence
  Description of Artificial Sequence: Synthetic oligonucleotide
catctcaaaggcaaactcatttttgggggagaaagc

SEQ ID NO: 178697 - DNA, 38 bp, Artificial Sequence
  Description of Artificial Sequence: Synthetic oligonucleotide
atctcaaaggcaaactcatttttgggggagaaagcaag

SEQ ID NO: 178698 - DNA, 37 bp, Artificial Sequence
  Description of Artificial Sequence: Synthetic oligonucleotide
tctcaaaggcaaactcatttttgggggagaaagcaag

SEQ ID NO: 178699 - DNA, 36 bp, Artificial Sequence
  Description of Artificial Sequence: Synthetic oligonucleotide
ctcaaaggcaaactcatttttgggggagaaagcaag

SEQ ID NO: 178700 - DNA, 37 bp, Artificial Sequence
  Description of Artificial Sequence: Synthetic oligonucleotide
tcaaaggcaaactcatttttgggggagaaagcaagtg

SEQ ID NO: 178701 - DNA, 36 bp, Artificial Sequence
  Description of Artificial Sequence: Synthetic oligonucleotide
caaaggcaaactcatttttgggggagaaagcaagtg

SEQ ID NO: 178702 - DNA, 36 bp, Artificial Sequence
  Description of Artificial Sequence: Synthetic oligonucleotide
aaaggcaaactcatttttgggggagaaagcaagtgc

SEQ ID NO: 178703 - DNA, 35 bp, Artificial Sequence
  Description of Artificial Sequence: Synthetic oligonucleotide
aaggcaaactcatttttgggggagaaagcaagtgc

SEQ ID NO: 178704 - DNA, 34 bp, Artificial Sequence
  Description of Artificial Sequence: Synthetic oligonucleotide
aggcaaactcatttttgggggagaaagcaagtgc

SEQ ID NO: 178705 - DNA, 33 bp, Artificial Sequence
  Description of Artificial Sequence: Synthetic oligonucleotide
ggcaaactcatttttgggggagaaagcaagtgc

SEQ ID NO: 178706 - DNA, 34 bp, Artificial Sequence
  Description of Artificial Sequence: Synthetic oligonucleotide
gcaaactcatttttgggggagaaagcaagtgctg

SEQ ID NO: 178707 - DNA, 34 bp, Artificial Sequence
  Description of Artificial Sequence: Synthetic oligonucleotide
caaactcatttttgggggagaaagcaagtgctgg

SEQ ID NO: 178708 - DNA, 34 bp, Artificial Sequence
  Description of Artificial Sequence: Synthetic oligonucleotide
aaactcatttttgggggagaaagcaagtgctggg

SEQ ID NO: 178709 - DNA, 33 bp, Artificial Sequence
  Description of Artificial Sequence: Synthetic oligonucleotide
aactcatttttgggggagaaagcaagtgctggg

SEQ ID NO: 178710 - DNA, 32 bp, Artificial Sequence
  Description of Artificial Sequence: Synthetic oligonucleotide
actcatttttgggggagaaagcaagtgctggg

SEQ ID NO: 178711 - DNA, 27 bp, Artificial Sequence
  Description of Artificial Sequence: Synthetic oligonucleotide
agtttggcccaggagcaggtaggagga

SEQ ID NO: 178712 - DNA, 27 bp, Artificial Sequence
  Description of Artificial Sequence: Synthetic oligonucleotide
gtttggcccaggagcaggtaggaggat

SEQ ID NO: 178713 - DNA, 27 bp, Artificial Sequence
  Description of Artificial Sequence: Synthetic oligonucleotide
tttggcccaggagcaggtaggaggatc

SEQ ID NO: 178714 - DNA, 26 bp, Artificial Sequence
  Description of Artificial Sequence: Synthetic oligonucleotide
ttggcccaggagcaggtaggaggatc

SEQ ID NO: 178715 - DNA, 25 bp, Artificial Sequence
  Description of Artificial Sequence: Synthetic oligonucleotide
tggcccaggagcaggtaggaggatc

SEQ ID NO: 178716 - DNA, 24 bp, Artificial Sequence
  Description of Artificial Sequence: Synthetic oligonucleotide
ggcccaggagcaggtaggaggatc

SEQ ID NO: 178717 - DNA, 24 bp, Artificial Sequence
  Description of Artificial Sequence: Synthetic oligonucleotide
gcccaggagcaggtaggaggatcg

SEQ ID NO: 178718 - DNA, 24 bp, Artificial Sequence
  Description of Artificial Sequence: Synthetic oligonucleotide
cccaggagcaggtaggaggatcgc

SEQ ID NO: 178719 - DNA, 25 bp, Artificial Sequence
  Description of Artificial Sequence: Synthetic oligonucleotide
ccaggagcaggtaggaggatcgcct

SEQ ID NO: 178720 - DNA, 26 bp, Artificial Sequence
  Description of Artificial Sequence: Synthetic oligonucleotide
caggagcaggtaggaggatcgcctga

SEQ ID NO: 178721 - DNA, 27 bp, Artificial Sequence
  Description of Artificial Sequence: Synthetic oligonucleotide
aggagcaggtaggaggatcgcctgaga

SEQ ID NO: 178722 - DNA, 27 bp, Artificial Sequence
  Description of Artificial Sequence: Synthetic oligonucleotide
ggagcaggtaggaggatcgcctgagaa

SEQ ID NO: 178723 - DNA, 28 bp, Artificial Sequence
  Description of Artificial Sequence: Synthetic oligonucleotide
gagcaggtaggaggatcgcctgagaaac

SEQ ID NO: 178724 - DNA, 29 bp, Artificial Sequence
  Description of Artificial Sequence: Synthetic oligonucleotide
agcaggtaggaggatcgcctgagaaactg

SEQ ID NO: 178725 - DNA, 28 bp, Artificial Sequence
  Description of Artificial Sequence: Synthetic oligonucleotide
gcaggtaggaggatcgcctgagaaactg

SEQ ID NO: 178726 - DNA, 28 bp, Artificial Sequence
  Description of Artificial Sequence: Synthetic oligonucleotide
caggtaggaggatcgcctgagaaactgc

SEQ ID NO: 178727 - DNA, 29 bp, Artificial Sequence
  Description of Artificial Sequence: Synthetic oligonucleotide
aggtaggaggatcgcctgagaaactgcag

SEQ ID NO: 178728 - DNA, 28 bp, Artificial Sequence
  Description of Artificial Sequence: Synthetic oligonucleotide
ggtaggaggatcgcctgagaaactgcag

SEQ ID NO: 178729 - DNA, 28 bp, Artificial Sequence
  Description of Artificial Sequence: Synthetic oligonucleotide
gtaggaggatcgcctgagaaactgcagg

SEQ ID NO: 178730 - DNA, 29 bp, Artificial Sequence
  Description of Artificial Sequence: Synthetic oligonucleotide
taggaggatcgcctgagaaactgcaggag

SEQ ID NO: 178731 - DNA, 28 bp, Artificial Sequence
  Description of Artificial Sequence: Synthetic oligonucleotide
aggaggatcgcctgagaaactgcaggag

SEQ ID NO: 178732 - DNA, 27 bp, Artificial Sequence
  Description of Artificial Sequence: Synthetic oligonucleotide
ggaggatcgcctgagaaactgcaggag

SEQ ID NO: 178733 - DNA, 28 bp, Artificial Sequence
  Description of Artificial Sequence: Synthetic oligonucleotide
gaggatcgcctgagaaactgcaggagac

SEQ ID NO: 178734 - DNA, 30 bp, Artificial Sequence
  Description of Artificial Sequence: Synthetic oligonucleotide
aggatcgcctgagaaactgcaggagacatc

SEQ ID NO: 178735 - DNA, 29 bp, Artificial Sequence
  Description of Artificial Sequence: Synthetic oligonucleotide
ggatcgcctgagaaactgcaggagacatc

SEQ ID NO: 178736 - DNA, 32 bp, Artificial Sequence
  Description of Artificial Sequence: Synthetic oligonucleotide
gatcgcctgagaaactgcaggagacatctaac

SEQ ID NO: 178737 - DNA, 33 bp, Artificial Sequence
  Description of Artificial Sequence: Synthetic oligonucleotide
atcgcctgagaaactgcaggagacatctaactg

SEQ ID NO: 178738 - DNA, 26 bp, Artificial Sequence
  Description of Artificial Sequence: Synthetic oligonucleotide
cagcgggttcggtaccgggtctttgt

SEQ ID NO: 178739 - DNA, 27 bp, Artificial Sequence
  Description of Artificial Sequence: Synthetic oligonucleotide
agcgggttcggtaccgggtctttgtct

SEQ ID NO: 178740 - DNA, 26 bp, Artificial Sequence
  Description of Artificial Sequence: Synthetic oligonucleotide
gcgggttcggtaccgggtctttgtct

SEQ ID NO: 178741 - DNA, 26 bp, Artificial Sequence
  Description of Artificial Sequence: Synthetic oligonucleotide
cgggttcggtaccgggtctttgtctg

SEQ ID NO: 178742 - DNA, 27 bp, Artificial Sequence
  Description of Artificial Sequence: Synthetic oligonucleotide
gggttcggtaccgggtctttgtctgga

SEQ ID NO: 178743 - DNA, 28 bp, Artificial Sequence
  Description of Artificial Sequence: Synthetic oligonucleotide
ggttcggtaccgggtctttgtctggatc

SEQ ID NO: 178744 - DNA, 29 bp, Artificial Sequence
  Description of Artificial Sequence: Synthetic oligonucleotide
gttcggtaccgggtctttgtctggatcag

SEQ ID NO: 178745 - DNA, 31 bp, Artificial Sequence
  Description of Artificial Sequence: Synthetic oligonucleotide
ttcggtaccgggtctttgtctggatcagaag

SEQ ID NO: 178746 - DNA, 30 bp, Artificial Sequence
  Description of Artificial Sequence: Synthetic oligonucleotide
tcggtaccgggtctttgtctggatcagaag

SEQ ID NO: 178747 - DNA, 29 bp, Artificial Sequence
  Description of Artificial Sequence: Synthetic oligonucleotide
cggtaccgggtctttgtctggatcagaag

SEQ ID NO: 178748 - DNA, 31 bp, Artificial Sequence
  Description of Artificial Sequence: Synthetic oligonucleotide
ggtaccgggtctttgtctggatcagaagatg

SEQ ID NO: 178749 - DNA, 31 bp, Artificial Sequence
  Description of Artificial Sequence: Synthetic oligonucleotide
gtaccgggtctttgtctggatcagaagatgc

SEQ ID NO: 178750 - DNA, 31 bp, Artificial Sequence
  Description of Artificial Sequence: Synthetic oligonucleotide
taccgggtctttgtctggatcagaagatgcg

SEQ ID NO: 178751 - DNA, 30 bp, Artificial Sequence
  Description of Artificial Sequence: Synthetic oligonucleotide
accgggtctttgtctggatcagaagatgcg

SEQ ID NO: 178752 - DNA, 29 bp, Artificial Sequence
  Description of Artificial Sequence: Synthetic oligonucleotide
ccgggtctttgtctggatcagaagatgcg

SEQ ID NO: 178753 - DNA, 29 bp, Artificial Sequence
  Description of Artificial Sequence: Synthetic oligonucleotide
cgggtctttgtctggatcagaagatgcgc

SEQ ID NO: 178754 - DNA, 29 bp, Artificial Sequence
  Description of Artificial Sequence: Synthetic oligonucleotide
gggtctttgtctggatcagaagatgcgcc

SEQ ID NO: 178755 - DNA, 29 bp, Artificial Sequence
  Description of Artificial Sequence: Synthetic oligonucleotide
ggtctttgtctggatcagaagatgcgccc

SEQ ID NO: 178756 - DNA, 29 bp, Artificial Sequence
  Description of Artificial Sequence: Synthetic oligonucleotide
gtctttgtctggatcagaagatgcgcccg

SEQ ID NO: 178757 - DNA, 30 bp, Artificial Sequence
  Description of Artificial Sequence: Synthetic oligonucleotide
tctttgtctggatcagaagatgcgcccgag

SEQ ID NO: 178758 - DNA, 29 bp, Artificial Sequence
  Description of Artificial Sequence: Synthetic oligonucleotide
ctttgtctggatcagaagatgcgcccgag

SEQ ID NO: 178759 - DNA, 29 bp, Artificial Sequence
  Description of Artificial Sequence: Synthetic oligonucleotide
tttgtctggatcagaagatgcgcccgagc

SEQ ID NO: 178760 - DNA, 28 bp, Artificial Sequence
  Description of Artificial Sequence: Synthetic oligonucleotide
ttgtctggatcagaagatgcgcccgagc

SEQ ID NO: 178761 - DNA, 27 bp, Artificial Sequence
  Description of Artificial Sequence: Synthetic oligonucleotide
tgtctggatcagaagatgcgcccgagc

SEQ ID NO: 178762 - DNA, 27 bp, Artificial Sequence
  Description of Artificial Sequence: Synthetic oligonucleotide
gtctggatcagaagatgcgcccgagca

SEQ ID NO: 178763 - DNA, 39 bp, Artificial Sequence
  Description of Artificial Sequence: Synthetic oligonucleotide
aatccaacagcagcacccagtttgaggtgaaraaatatg

SEQ ID NO: 178764 - DNA, 38 bp, Artificial Sequence
  Description of Artificial Sequence: Synthetic oligonucleotide
atccaacagcagcacccagtttgaggtgaaraaatatg

SEQ ID NO: 178765 - DNA, 37 bp, Artificial Sequence
  Description of Artificial Sequence: Synthetic oligonucleotide
tccaacagcagcacccagtttgaggtgaaraaatatg

SEQ ID NO: 178766 - DNA, 36 bp, Artificial Sequence
  Description of Artificial Sequence: Synthetic oligonucleotide
ccaacagcagcacccagtttgaggtgaaraaatatg

SEQ ID NO: 178767 - DNA, 37 bp, Artificial Sequence
  Description of Artificial Sequence: Synthetic oligonucleotide
caacagcagcacccagtttgaggtgaaraaatatgtc

SEQ ID NO: 178768 - DNA, 37 bp, Artificial Sequence
  Description of Artificial Sequence: Synthetic oligonucleotide
aacagcagcacccagtttgaggtgaaraaatatgtcc

SEQ ID NO: 178769 - DNA, 36 bp, Artificial Sequence
  Description of Artificial Sequence: Synthetic oligonucleotide
acagcagcacccagtttgaggtgaaraaatatgtcc

SEQ ID NO: 178770 - DNA, 35 bp, Artificial Sequence
  Description of Artificial Sequence: Synthetic oligonucleotide
cagcagcacccagtttgaggtgaaraaatatgtcc

SEQ ID NO: 178771 - DNA, 37 bp, Artificial Sequence
  Description of Artificial Sequence: Synthetic oligonucleotide
agcagcacccagtttgaggtgaaraaatatgtccttc

SEQ ID NO: 178772 - DNA, 36 bp, Artificial Sequence
  Description of Artificial Sequence: Synthetic oligonucleotide
gcagcacccagtttgaggtgaaraaatatgtccttc

SEQ ID NO: 178773 - DNA, 36 bp, Artificial Sequence
  Description of Artificial Sequence: Synthetic oligonucleotide
cagcacccagtttgaggtgaaraaatatgtccttcc

SEQ ID NO: 178774 - DNA, 36 bp, Artificial Sequence
  Description of Artificial Sequence: Synthetic oligonucleotide
agcacccagtttgaggtgaaraaatatgtccttccc

SEQ ID NO: 178775 - DNA, 35 bp, Artificial Sequence
  Description of Artificial Sequence: Synthetic oligonucleotide
gcacccagtttgaggtgaaraaatatgtccttccc

SEQ ID NO: 178776 - DNA, 37 bp, Artificial Sequence
  Description of Artificial Sequence: Synthetic oligonucleotide
cacccagtttgaggtgaaraaatatgtccttcccaac

SEQ ID NO: 178777 - DNA, 40 bp, Artificial Sequence
  Description of Artificial Sequence: Synthetic oligonucleotide
acccagtttgaggtgaaraaatatgtccttcccaactttg

SEQ ID NO: 178778 - DNA, 39 bp, Artificial Sequence
  Description of Artificial Sequence: Synthetic oligonucleotide
cccagtttgaggtgaaraaatatgtccttcccaactttg

SEQ ID NO: 178779 - DNA, 40 bp, Artificial Sequence
  Description of Artificial Sequence: Synthetic oligonucleotide
ccagtttgaggtgaaraaatatgtccttcccaactttgag

SEQ ID NO: 178780 - DNA, 40 bp, Artificial Sequence
  Description of Artificial Sequence: Synthetic oligonucleotide
cagtttgaggtgaaraaatatgtccttcccaactttgagg

SEQ ID NO: 178781 - DNA, 41 bp, Artificial Sequence
  Description of Artificial Sequence: Synthetic oligonucleotide
agtttgaggtgaaraaatatgtccttcccaactttgaggtg

SEQ ID NO: 178782 - DNA, 40 bp, Artificial Sequence
  Description of Artificial Sequence: Synthetic oligonucleotide
gtttgaggtgaaraaatatgtccttcccaactttgaggtg

SEQ ID NO: 178783 - DNA, 42 bp, Artificial Sequence
  Description of Artificial Sequence: Synthetic oligonucleotide
tttgaggtgaaraaatatgtccttcccaactttgaggtgaag

SEQ ID NO: 178784 - DNA, 41 bp, Artificial Sequence
  Description of Artificial Sequence: Synthetic oligonucleotide
ttgaggtgaaraaatatgtccttcccaactttgaggtgaag

SEQ ID NO: 178785 - DNA, 40 bp, Artificial Sequence
  Description of Artificial Sequence: Synthetic oligonucleotide
tgaggtgaaraaatatgtccttcccaactttgaggtgaag

SEQ ID NO: 178786 - DNA, 39 bp, Artificial Sequence
  Description of Artificial Sequence: Synthetic oligonucleotide
gaggtgaaraaatatgtccttcccaactttgaggtgaag

SEQ ID NO: 178787 - DNA, 41 bp, Artificial Sequence
  Description of Artificial Sequence: Synthetic oligonucleotide
aggtgaaraaatatgtccttcccaactttgaggtgaagatc

SEQ ID NO: 178788 - DNA, 40 bp, Artificial Sequence
  Description of Artificial Sequence: Synthetic oligonucleotide
ggtgaaraaatatgtccttcccaactttgaggtgaagatc

SEQ ID NO: 178789 - DNA, 41 bp, Artificial Sequence
  Description of Artificial Sequence: Synthetic oligonucleotide
gtgaaraaatatgtccttcccaactttgaggtgaagatcac

SEQ ID NO: 178790 - DNA, 41 bp, Artificial Sequence
  Description of Artificial Sequence: Synthetic oligonucleotide
tgaaraaatatgtccttcccaactttgaggtgaagatcacc

SEQ ID NO: 178791 - DNA, 40 bp, Artificial Sequence
  Description of Artificial Sequence: Synthetic oligonucleotide
gaaraaatatgtccttcccaactttgaggtgaagatcacc

SEQ ID NO: 178792 - DNA, 40 bp, Artificial Sequence
  Description of Artificial Sequence: Synthetic oligonucleotide
aaraaatatgtccttcccaactttgaggtgaagatcaccc

SEQ ID NO: 178793 - DNA, 39 bp, Artificial Sequence
  Description of Artificial Sequence: Synthetic oligonucleotide
araaatatgtccttcccaactttgaggtgaagatcaccc

SEQ ID NO: 178794 - DNA, 38 bp, Artificial Sequence
  Description of Artificial Sequence: Synthetic oligonucleotide
raaatatgtccttcccaactttgaggtgaagatcaccc

SEQ ID NO: 178795 - DNA, 27 bp, Artificial Sequence
  Description of Artificial Sequence: Synthetic oligonucleotide
aaagccctacatcctgacggtgccagc

SEQ ID NO: 178796 - DNA, 26 bp, Artificial Sequence
  Description of Artificial Sequence: Synthetic oligonucleotide
aagccctacatcctgacggtgccagc

SEQ ID NO: 178797 - DNA, 25 bp, Artificial Sequence
  Description of Artificial Sequence: Synthetic oligonucleotide
agccctacatcctgacggtgccagc

SEQ ID NO: 178798 - DNA, 24 bp, Artificial Sequence
  Description of Artificial Sequence: Synthetic oligonucleotide
gccctacatcctgacggtgccagc

SEQ ID NO: 178799 - DNA, 26 bp, Artificial Sequence
  Description of Artificial Sequence: Synthetic oligonucleotide
ccctacatcctgacggtgccagccat

SEQ ID NO: 178800 - DNA, 27 bp, Artificial Sequence
  Description of Artificial Sequence: Synthetic oligonucleotide
cctacatcctgacggtgccagccatct

SEQ ID NO: 178801 - DNA, 28 bp, Artificial Sequence
  Description of Artificial Sequence: Synthetic oligonucleotide
ctacatcctgacggtgccagccatcttg

SEQ ID NO: 178802 - DNA, 30 bp, Artificial Sequence
  Description of Artificial Sequence: Synthetic oligonucleotide
tacatcctgacggtgccagccatcttgatg

SEQ ID NO: 178803 - DNA, 29 bp, Artificial Sequence
  Description of Artificial Sequence: Synthetic oligonucleotide
acatcctgacggtgccagccatcttgatg

SEQ ID NO: 178804 - DNA, 28 bp, Artificial Sequence
  Description of Artificial Sequence: Synthetic oligonucleotide
catcctgacggtgccagccatcttgatg

SEQ ID NO: 178805 - DNA, 32 bp, Artificial Sequence
  Description of Artificial Sequence: Synthetic oligonucleotide
atcctgacggtgccagccatcttgatgaaatg

SEQ ID NO: 178806 - DNA, 31 bp, Artificial Sequence
  Description of Artificial Sequence: Synthetic oligonucleotide
tcctgacggtgccagccatcttgatgaaatg

SEQ ID NO: 178807 - DNA, 30 bp, Artificial Sequence
  Description of Artificial Sequence: Synthetic oligonucleotide
cctgacggtgccagccatcttgatgaaatg

SEQ ID NO: 178808 - DNA, 30 bp, Artificial Sequence
  Description of Artificial Sequence: Synthetic oligonucleotide
ctgacggtgccagccatcttgatgaaatgc

SEQ ID NO: 178809 - DNA, 31 bp, Artificial Sequence
  Description of Artificial Sequence: Synthetic oligonucleotide
tgacggtgccagccatcttgatgaaatgcag

SEQ ID NO: 178810 - DNA, 30 bp, Artificial Sequence
  Description of Artificial Sequence: Synthetic oligonucleotide
gacggtgccagccatcttgatgaaatgcag

SEQ ID NO: 178811 - DNA, 33 bp, Artificial Sequence
  Description of Artificial Sequence: Synthetic oligonucleotide
acggtgccagccatcttgatgaaatgcagttag

SEQ ID NO: 178812 - DNA, 32 bp, Artificial Sequence
  Description of Artificial Sequence: Synthetic oligonucleotide
cggtgccagccatcttgatgaaatgcagttag

SEQ ID NO: 178813 - DNA, 33 bp, Artificial Sequence
  Description of Artificial Sequence: Synthetic oligonucleotide
ggtgccagccatcttgatgaaatgcagttagac

SEQ ID NO: 178814 - DNA, 35 bp, Artificial Sequence
  Description of Artificial Sequence: Synthetic oligonucleotide
gtgccagccatcttgatgaaatgcagttagacatc

SEQ ID NO: 178815 - DNA, 35 bp, Artificial Sequence
  Description of Artificial Sequence: Synthetic oligonucleotide
tgccagccatcttgatgaaatgcagttagacatcc

SEQ ID NO: 178816 - DNA, 34 bp, Artificial Sequence
  Description of Artificial Sequence: Synthetic oligonucleotide
gccagccatcttgatgaaatgcagttagacatcc

SEQ ID NO: 178817 - DNA, 35 bp, Artificial Sequence
  Description of Artificial Sequence: Synthetic oligonucleotide
ccagccatcttgatgaaatgcagttagacatccag

SEQ ID NO: 178818 - DNA, 35 bp, Artificial Sequence
  Description of Artificial Sequence: Synthetic oligonucleotide
cagccatcttgatgaaatgcagttagacatccagg

SEQ ID NO: 178819 - DNA, 35 bp, Artificial Sequence
  Description of Artificial Sequence: Synthetic oligonucleotide
agccatcttgatgaaatgcagttagacatccaggc

SEQ ID NO: 178820 - DNA, 26 bp, Artificial Sequence
  Description of Artificial Sequence: Synthetic oligonucleotide
tctccaggtggggagatggaggagca

SEQ ID NO: 178821 - DNA, 25 bp, Artificial Sequence
  Description of Artificial Sequence: Synthetic oligonucleotide
ctccaggtggggagatggaggagca

SEQ ID NO: 178822 - DNA, 26 bp, Artificial Sequence
  Description of Artificial Sequence: Synthetic oligonucleotide
tccaggtggggagatggaggagcaga

SEQ ID NO: 178823 - DNA, 25 bp, Artificial Sequence
  Description of Artificial Sequence: Synthetic oligonucleotide
ccaggtggggagatggaggagcaga

SEQ ID NO: 178824 - DNA, 25 bp, Artificial Sequence
  Description of Artificial Sequence: Synthetic oligonucleotide
caggtggggagatggaggagcagag

SEQ ID NO: 178825 - DNA, 26 bp, Artificial Sequence
  Description of Artificial Sequence: Synthetic oligonucleotide
aggtggggagatggaggagcagagct

SEQ ID NO: 178826 - DNA, 25 bp, Artificial Sequence
  Description of Artificial Sequence: Synthetic oligonucleotide
ggtggggagatggaggagcagagct

SEQ ID NO: 178827 - DNA, 26 bp, Artificial Sequence
  Description of Artificial Sequence: Synthetic oligonucleotide
gtggggagatggaggagcagagctca

SEQ ID NO: 178828 - DNA, 27 bp, Artificial Sequence
  Description of Artificial Sequence: Synthetic oligonucleotide
tggggagatggaggagcagagctcaca

SEQ ID NO: 178829 - DNA, 27 bp, Artificial Sequence
  Description of Artificial Sequence: Synthetic oligonucleotide
ggggagatggaggagcagagctcacat

SEQ ID NO: 178830 - DNA, 27 bp, Artificial Sequence
  Description of Artificial Sequence: Synthetic oligonucleotide
gggagatggaggagcagagctcacatc

SEQ ID NO: 178831 - DNA, 27 bp, Artificial Sequence
  Description of Artificial Sequence: Synthetic oligonucleotide
ggagatggaggagcagagctcacatcc

SEQ ID NO: 178832 - DNA, 28 bp, Artificial Sequence
  Description of Artificial Sequence: Synthetic oligonucleotide
gagatggaggagcagagctcacatcctg

SEQ ID NO: 178833 - DNA, 28 bp, Artificial Sequence
  Description of Artificial Sequence: Synthetic oligonucleotide
agatggaggagcagagctcacatcctgg

SEQ ID NO: 178834 - DNA, 27 bp, Artificial Sequence
  Description of Artificial Sequence: Synthetic oligonucleotide
gatggaggagcagagctcacatcctgg

SEQ ID NO: 178835 - DNA, 33 bp, Artificial Sequence
  Description of Artificial Sequence: Synthetic oligonucleotide
atggaggagcagagctcacatcctggtattttg

SEQ ID NO: 178836 - DNA, 32 bp, Artificial Sequence
  Description of Artificial Sequence: Synthetic oligonucleotide
tggaggagcagagctcacatcctggtattttg

SEQ ID NO: 178837 - DNA, 31 bp, Artificial Sequence
  Description of Artificial Sequence: Synthetic oligonucleotide
ggaggagcagagctcacatcctggtattttg

SEQ ID NO: 178838 - DNA, 32 bp, Artificial Sequence
  Description of Artificial Sequence: Synthetic oligonucleotide
gaggagcagagctcacatcctggtattttgtg

SEQ ID NO: 178839 - DNA, 33 bp, Artificial Sequence
  Description of Artificial Sequence: Synthetic oligonucleotide
aggagcagagctcacatcctggtattttgtgtc

SEQ ID NO: 178840 - DNA, 32 bp, Artificial Sequence
  Description of Artificial Sequence: Synthetic oligonucleotide
ggagcagagctcacatcctggtattttgtgtc

SEQ ID NO: 178841 - DNA, 34 bp, Artificial Sequence
  Description of Artificial Sequence: Synthetic oligonucleotide
gagcagagctcacatcctggtattttgtgtcatc

SEQ ID NO: 178842 - DNA, 35 bp, Artificial Sequence
  Description of Artificial Sequence: Synthetic oligonucleotide
agcagagctcacatcctggtattttgtgtcatctc

SEQ ID NO: 178843 - DNA, 38 bp, Artificial Sequence
  Description of Artificial Sequence: Synthetic oligonucleotide
tggtattttgtgtcatctcccttctccttggatcttac

SEQ ID NO: 178844 - DNA, 37 bp, Artificial Sequence
  Description of Artificial Sequence: Synthetic oligonucleotide
ggtattttgtgtcatctcccttctccttggatcttac

SEQ ID NO: 178845 - DNA, 39 bp, Artificial Sequence
  Description of Artificial Sequence: Synthetic oligonucleotide
gtattttgtgtcatctcccttctccttggatcttacaag

SEQ ID NO: 178846 - DNA, 40 bp, Artificial Sequence
  Description of Artificial Sequence: Synthetic oligonucleotide
tattttgtgtcatctcccttctccttggatcttacaagac

SEQ ID NO: 178847 - DNA, 39 bp, Artificial Sequence
  Description of Artificial Sequence: Synthetic oligonucleotide
attttgtgtcatctcccttctccttggatcttacaagac

SEQ ID NO: 178848 - DNA, 38 bp, Artificial Sequence
  Description of Artificial Sequence: Synthetic oligonucleotide
ttttgtgtcatctcccttctccttggatcttacaagac

SEQ ID NO: 178849 - DNA, 37 bp, Artificial Sequence
  Description of Artificial Sequence: Synthetic oligonucleotide
tttgtgtcatctcccttctccttggatcttacaagac

SEQ ID NO: 178850 - DNA, 36 bp, Artificial Sequence
  Description of Artificial Sequence: Synthetic oligonucleotide
ttgtgtcatctcccttctccttggatcttacaagac

SEQ ID NO: 178851 - DNA, 35 bp, Artificial Sequence
  Description of Artificial Sequence: Synthetic oligonucleotide
tgtgtcatctcccttctccttggatcttacaagac

SEQ ID NO: 178852 - DNA, 34 bp, Artificial Sequence
  Description of Artificial Sequence: Synthetic oligonucleotide
gtgtcatctcccttctccttggatcttacaagac

SEQ ID NO: 178853 - DNA, 34 bp, Artificial Sequence
  Description of Artificial Sequence: Synthetic oligonucleotide
tgtcatctcccttctccttggatcttacaagacc

SEQ ID NO: 178854 - DNA, 33 bp, Artificial Sequence
  Description of Artificial Sequence: Synthetic oligonucleotide
gtcatctcccttctccttggatcttacaagacc

SEQ ID NO: 178855 - DNA, 35 bp, Artificial Sequence
  Description of Artificial Sequence: Synthetic oligonucleotide
tcatctcccttctccttggatcttacaagaccaag

SEQ ID NO: 178856 - DNA, 34 bp, Artificial Sequence
  Description of Artificial Sequence: Synthetic oligonucleotide
catctcccttctccttggatcttacaagaccaag

SEQ ID NO: 178857 - DNA, 34 bp, Artificial Sequence
  Description of Artificial Sequence: Synthetic oligonucleotide
atctcccttctccttggatcttacaagaccaagc

SEQ ID NO: 178858 - DNA, 33 bp, Artificial Sequence
  Description of Artificial Sequence: Synthetic oligonucleotide
tctcccttctccttggatcttacaagaccaagc

SEQ ID NO: 178859 - DNA, 32 bp, Artificial Sequence
  Description of Artificial Sequence: Synthetic oligonucleotide
ctcccttctccttggatcttacaagaccaagc

SEQ ID NO: 178860 - DNA, 32 bp, Artificial Sequence
  Description of Artificial Sequence: Synthetic oligonucleotide
tcccttctccttggatcttacaagaccaagcg

SEQ ID NO: 178861 - DNA, 31 bp, Artificial Sequence
  Description of Artificial Sequence: Synthetic oligonucleotide
cccttctccttggatcttacaagaccaagcg

SEQ ID NO: 178862 - DNA, 32 bp, Artificial Sequence
  Description of Artificial Sequence: Synthetic oligonucleotide
ccttctccttggatcttacaagaccaagcgac

SEQ ID NO: 178863 - DNA, 33 bp, Artificial Sequence
  Description of Artificial Sequence: Synthetic oligonucleotide
cttctccttggatcttacaagaccaagcgacac

SEQ ID NO: 178864 - DNA, 33 bp, Artificial Sequence
  Description of Artificial Sequence: Synthetic oligonucleotide
ttctccttggatcttacaagaccaagcgacacc

SEQ ID NO: 178865 - DNA, 32 bp, Artificial Sequence
  Description of Artificial Sequence: Synthetic oligonucleotide
tctccttggatcttacaagaccaagcgacacc

SEQ ID NO: 178866 - DNA, 31 bp, Artificial Sequence
  Description of Artificial Sequence: Synthetic oligonucleotide
ctccttggatcttacaagaccaagcgacacc

SEQ ID NO: 178867 - DNA, 33 bp, Artificial Sequence
  Description of Artificial Sequence: Synthetic oligonucleotide
tccttggatcttacaagaccaagcgacaccttg

SEQ ID NO: 178868 - DNA, 32 bp, Artificial Sequence
  Description of Artificial Sequence: Synthetic oligonucleotide
ccttggatcttacaagaccaagcgacaccttg

SEQ ID NO: 178869 - DNA, 33 bp, Artificial Sequence
  Description of Artificial Sequence: Synthetic oligonucleotide
cttggatcttacaagaccaagcgacaccttgtg

SEQ ID NO: 178870 - DNA, 33 bp, Artificial Sequence
  Description of Artificial Sequence: Synthetic oligonucleotide
ttggatcttacaagaccaagcgacaccttgtgc

SEQ ID NO: 178871 - DNA, 32 bp, Artificial Sequence
  Description of Artificial Sequence: Synthetic oligonucleotide
tggatcttacaagaccaagcgacaccttgtgc

SEQ ID NO: 178872 - DNA, 31 bp, Artificial Sequence
  Description of Artificial Sequence: Synthetic oligonucleotide
ggatcttacaagaccaagcgacaccttgtgc

SEQ ID NO: 178873 - DNA, 31 bp, Artificial Sequence
  Description of Artificial Sequence: Synthetic oligonucleotide
gatcttacaagaccaagcgacaccttgtgcc

SEQ ID NO: 178874 - DNA, 32 bp, Artificial Sequence
  Description of Artificial Sequence: Synthetic oligonucleotide
atcttacaagaccaagcgacaccttgtgcctg

SEQ ID NO: 178875 - DNA, 31 bp, Artificial Sequence
  Description of Artificial Sequence: Synthetic oligonucleotide
tcttacaagaccaagcgacaccttgtgcctg

SEQ ID NO: 178876 - DNA, 30 bp, Artificial Sequence
  Description of Artificial Sequence: Synthetic oligonucleotide
cttacaagaccaagcgacaccttgtgcctg

SEQ ID NO: 178877 - DNA, 30 bp, Artificial Sequence
  Description of Artificial Sequence: Synthetic oligonucleotide
ttacaagaccaagcgacaccttgtgcctgg

SEQ ID NO: 178878 - DNA, 29 bp, Artificial Sequence
  Description of Artificial Sequence: Synthetic oligonucleotide
tacaagaccaagcgacaccttgtgcctgg

SEQ ID NO: 178879 - DNA, 28 bp, Artificial Sequence
  Description of Artificial Sequence: Synthetic oligonucleotide
acaagaccaagcgacaccttgtgcctgg

SEQ ID NO: 178880 - DNA, 23 bp, Artificial Sequence
  Description of Artificial Sequence: Synthetic oligonucleotide
ggcccccttcctgctgcaggctt

SEQ ID NO: 178881 - DNA, 23 bp, Artificial Sequence
  Description of Artificial Sequence: Synthetic oligonucleotide
gcccccttcctgctgcaggcttg

SEQ ID NO: 178882 - DNA, 24 bp, Artificial Sequence
  Description of Artificial Sequence: Synthetic oligonucleotide
cccccttcctgctgcaggcttggt

SEQ ID NO: 178883 - DNA, 24 bp, Artificial Sequence
  Description of Artificial Sequence: Synthetic oligonucleotide
ccccttcctgctgcaggcttggtc

SEQ ID NO: 178884 - DNA, 24 bp, Artificial Sequence
  Description of Artificial Sequence: Synthetic oligonucleotide
cccttcctgctgcaggcttggtcc

SEQ ID NO: 178885 - DNA, 25 bp, Artificial Sequence
  Description of Artificial Sequence: Synthetic oligonucleotide
ccttcctgctgcaggcttggtccgt

SEQ ID NO: 178886 - DNA, 26 bp, Artificial Sequence
  Description of Artificial Sequence: Synthetic oligonucleotide
cttcctgctgcaggcttggtccgtga

SEQ ID NO: 178887 - DNA, 27 bp, Artificial Sequence
  Description of Artificial Sequence: Synthetic oligonucleotide
ttcctgctgcaggcttggtccgtgaga

SEQ ID NO: 178888 - DNA, 27 bp, Artificial Sequence
  Description of Artificial Sequence: Synthetic oligonucleotide
tcctgctgcaggcttggtccgtgagat

SEQ ID NO: 178889 - DNA, 26 bp, Artificial Sequence
  Description of Artificial Sequence: Synthetic oligonucleotide
cctgctgcaggcttggtccgtgagat

SEQ ID NO: 178890 - DNA, 27 bp, Artificial Sequence
  Description of Artificial Sequence: Synthetic oligonucleotide
ctgctgcaggcttggtccgtgagatgt

SEQ ID NO: 178891 - DNA, 27 bp, Artificial Sequence
  Description of Artificial Sequence: Synthetic oligonucleotide
tgctgcaggcttggtccgtgagatgtc

SEQ ID NO: 178892 - DNA, 27 bp, Artificial Sequence
  Description of Artificial Sequence: Synthetic oligonucleotide
gctgcaggcttggtccgtgagatgtca

SEQ ID NO: 178893 - DNA, 27 bp, Artificial Sequence
  Description of Artificial Sequence: Synthetic oligonucleotide
ctgcaggcttggtccgtgagatgtcag

SEQ ID NO: 178894 - DNA, 27 bp, Artificial Sequence
  Description of Artificial Sequence: Synthetic oligonucleotide
tgcaggcttggtccgtgagatgtcagg

SEQ ID NO: 178895 - DNA, 26 bp, Artificial Sequence
  Description of Artificial Sequence: Synthetic oligonucleotide
gcaggcttggtccgtgagatgtcagg

SEQ ID NO: 178896 - DNA, 27 bp, Artificial Sequence
  Description of Artificial Sequence: Synthetic oligonucleotide
caggcttggtccgtgagatgtcaggct

SEQ ID NO: 178897 - DNA, 27 bp, Artificial Sequence
  Description of Artificial Sequence: Synthetic oligonucleotide
aggcttggtccgtgagatgtcaggctc

SEQ ID NO: 178898 - DNA, 26 bp, Artificial Sequence
  Description of Artificial Sequence: Synthetic oligonucleotide
ggcttggtccgtgagatgtcaggctc

SEQ ID NO: 178899 - DNA, 26 bp, Artificial Sequence
  Description of Artificial Sequence: Synthetic oligonucleotide
gcttggtccgtgagatgtcaggctcc

SEQ ID NO: 178900 - DNA, 33 bp, Artificial Sequence
  Description of Artificial Sequence: Synthetic oligonucleotide
tactacatgatcctatcccgagggcagatcktg

SEQ ID NO: 178901 - DNA, 32 bp, Artificial Sequence
  Description of Artificial Sequence: Synthetic oligonucleotide
actacatgatcctatcccgagggcagatcktg

SEQ ID NO: 178902 - DNA, 31 bp, Artificial Sequence
  Description of Artificial Sequence: Synthetic oligonucleotide
ctacatgatcctatcccgagggcagatcktg

SEQ ID NO: 178903 - DNA, 33 bp, Artificial Sequence
  Description of Artificial Sequence: Synthetic oligonucleotide
tacatgatcctatcccgagggcagatcktgttc

SEQ ID NO: 178904 - DNA, 32 bp, Artificial Sequence
  Description of Artificial Sequence: Synthetic oligonucleotide
acatgatcctatcccgagggcagatcktgttc

SEQ ID NO: 178905 - DNA, 31 bp, Artificial Sequence
  Description of Artificial Sequence: Synthetic oligonucleotide
catgatcctatcccgagggcagatcktgttc

SEQ ID NO: 178906 - DNA, 33 bp, Artificial Sequence
  Description of Artificial Sequence: Synthetic oligonucleotide
atgatcctatcccgagggcagatcktgttcatg

SEQ ID NO: 178907 - DNA, 32 bp, Artificial Sequence
  Description of Artificial Sequence: Synthetic oligonucleotide
tgatcctatcccgagggcagatcktgttcatg

SEQ ID NO: 178908 - DNA, 31 bp, Artificial Sequence
  Description of Artificial Sequence: Synthetic oligonucleotide
gatcctatcccgagggcagatcktgttcatg

SEQ ID NO: 178909 - DNA, 34 bp, Artificial Sequence
  Description of Artificial Sequence: Synthetic oligonucleotide
atcctatcccgagggcagatcktgttcatgaatc

SEQ ID NO: 178910 - DNA, 33 bp, Artificial Sequence
  Description of Artificial Sequence: Synthetic oligonucleotide
tcctatcccgagggcagatcktgttcatgaatc

SEQ ID NO: 178911 - DNA, 32 bp, Artificial Sequence
  Description of Artificial Sequence: Synthetic oligonucleotide
cctatcccgagggcagatcktgttcatgaatc

SEQ ID NO: 178912 - DNA, 32 bp, Artificial Sequence
  Description of Artificial Sequence: Synthetic oligonucleotide
ctatcccgagggcagatcktgttcatgaatcg

SEQ ID NO: 178913 - DNA, 33 bp, Artificial Sequence
  Description of Artificial Sequence: Synthetic oligonucleotide
tatcccgagggcagatcktgttcatgaatcgag

SEQ ID NO: 178914 - DNA, 32 bp, Artificial Sequence
  Description of Artificial Sequence: Synthetic oligonucleotide
atcccgagggcagatcktgttcatgaatcgag

SEQ ID NO: 178915 - DNA, 31 bp, Artificial Sequence
  Description of Artificial Sequence: Synthetic oligonucleotide
tcccgagggcagatcktgttcatgaatcgag

SEQ ID NO: 178916 - DNA, 30 bp, Artificial Sequence
  Description of Artificial Sequence: Synthetic oligonucleotide
cccgagggcagatcktgttcatgaatcgag

SEQ ID NO: 178917 - DNA, 31 bp, Artificial Sequence
  Description of Artificial Sequence: Synthetic oligonucleotide
ccgagggcagatcktgttcatgaatcgagag

SEQ ID NO: 178918 - DNA, 31 bp, Artificial Sequence
  Description of Artificial Sequence: Synthetic oligonucleotide
cgagggcagatcktgttcatgaatcgagagc

SEQ ID NO: 178919 - DNA, 31 bp, Artificial Sequence
  Description of Artificial Sequence: Synthetic oligonucleotide
gagggcagatcktgttcatgaatcgagagcc

SEQ ID NO: 178920 - DNA, 31 bp, Artificial Sequence
  Description of Artificial Sequence: Synthetic oligonucleotide
agggcagatcktgttcatgaatcgagagccc

SEQ ID NO: 178921 - DNA, 30 bp, Artificial Sequence
  Description of Artificial Sequence: Synthetic oligonucleotide
gggcagatcktgttcatgaatcgagagccc

SEQ ID NO: 178922 - DNA, 32 bp, Artificial Sequence
  Description of Artificial Sequence: Synthetic oligonucleotide
ggcagatcktgttcatgaatcgagagcccaag

SEQ ID NO: 178923 - DNA, 33 bp, Artificial Sequence
  Description of Artificial Sequence: Synthetic oligonucleotide
gcagatcktgttcatgaatcgagagcccaagag

SEQ ID NO: 178924 - DNA, 33 bp, Artificial Sequence
  Description of Artificial Sequence: Synthetic oligonucleotide
cagatcktgttcatgaatcgagagcccaagagg

SEQ ID NO: 178925 - DNA, 34 bp, Artificial Sequence
  Description of Artificial Sequence: Synthetic oligonucleotide
agatcktgttcatgaatcgagagcccaagaggac

SEQ ID NO: 178926 - DNA, 33 bp, Artificial Sequence
  Description of Artificial Sequence: Synthetic oligonucleotide
gatcktgttcatgaatcgagagcccaagaggac

SEQ ID NO: 178927 - DNA, 33 bp, Artificial Sequence
  Description of Artificial Sequence: Synthetic oligonucleotide
atcktgttcatgaatcgagagcccaagaggacc

SEQ ID NO: 178928 - DNA, 32 bp, Artificial Sequence
  Description of Artificial Sequence: Synthetic oligonucleotide
tcktgttcatgaatcgagagcccaagaggacc

SEQ ID NO: 178929 - DNA, 31 bp, Artificial Sequence
  Description of Artificial Sequence: Synthetic oligonucleotide
cktgttcatgaatcgagagcccaagaggacc

SEQ ID NO: 178930 - DNA, 31 bp, Artificial Sequence
  Description of Artificial Sequence: Synthetic oligonucleotide
ktgttcatgaatcgagagcccaagaggaccc

SEQ ID NO: 178931 - DNA, 26 bp, Artificial Sequence
  Description of Artificial Sequence: Synthetic oligonucleotide
agtgcccttcaggtgttccaggcagg

SEQ ID NO: 178932 - DNA, 25 bp, Artificial Sequence
  Description of Artificial Sequence: Synthetic oligonucleotide
gtgcccttcaggtgttccaggcagg

SEQ ID NO: 178933 - DNA, 25 bp, Artificial Sequence
  Description of Artificial Sequence: Synthetic oligonucleotide
tgcccttcaggtgttccaggcaggg

SEQ ID NO: 178934 - DNA, 24 bp, Artificial Sequence
  Description of Artificial Sequence: Synthetic oligonucleotide
gcccttcaggtgttccaggcaggg

SEQ ID NO: 178935 - DNA, 24 bp, Artificial Sequence
  Description of Artificial Sequence: Synthetic oligonucleotide
cccttcaggtgttccaggcagggg

SEQ ID NO: 178936 - DNA, 24 bp, Artificial Sequence
  Description of Artificial Sequence: Synthetic oligonucleotide
ccttcaggtgttccaggcaggggc

SEQ ID NO: 178937 - DNA, 25 bp, Artificial Sequence
  Description of Artificial Sequence: Synthetic oligonucleotide
cttcaggtgttccaggcaggggcct

SEQ ID NO: 178938 - DNA, 25 bp, Artificial Sequence
  Description of Artificial Sequence: Synthetic oligonucleotide
ttcaggtgttccaggcaggggcctg

SEQ ID NO: 178939 - DNA, 24 bp, Artificial Sequence
  Description of Artificial Sequence: Synthetic oligonucleotide
tcaggtgttccaggcaggggcctg

SEQ ID NO: 178940 - DNA, 23 bp, Artificial Sequence
  Description of Artificial Sequence: Synthetic oligonucleotide
caggtgttccaggcaggggcctg

SEQ ID NO: 178941 - DNA, 24 bp, Artificial Sequence
  Description of Artificial Sequence: Synthetic oligonucleotide
aggtgttccaggcaggggcctggs

SEQ ID NO: 178942 - DNA, 23 bp, Artificial Sequence
  Description of Artificial Sequence: Synthetic oligonucleotide
ggtgttccaggcaggggcctggs

SEQ ID NO: 178943 - DNA, 27 bp, Artificial Sequence
  Description of Artificial Sequence: Synthetic oligonucleotide
gtgttccaggcaggggcctggsctttt

SEQ ID NO: 178944 - DNA, 28 bp, Artificial Sequence
  Description of Artificial Sequence: Synthetic oligonucleotide
tgttccaggcaggggcctggscttttct

SEQ ID NO: 178945 - DNA, 27 bp, Artificial Sequence
  Description of Artificial Sequence: Synthetic oligonucleotide
gttccaggcaggggcctggscttttct

SEQ ID NO: 178946 - DNA, 28 bp, Artificial Sequence
  Description of Artificial Sequence: Synthetic oligonucleotide
ttccaggcaggggcctggscttttctga

SEQ ID NO: 178947 - DNA, 28 bp, Artificial Sequence
  Description of Artificial Sequence: Synthetic oligonucleotide
tccaggcaggggcctggscttttctgat

SEQ ID NO: 178948 - DNA, 27 bp, Artificial Sequence
  Description of Artificial Sequence: Synthetic oligonucleotide
ccaggcaggggcctggscttttctgat

SEQ ID NO: 178949 - DNA, 27 bp, Artificial Sequence
  Description of Artificial Sequence: Synthetic oligonucleotide
caggcaggggcctggscttttctgatg

SEQ ID NO: 178950 - DNA, 28 bp, Artificial Sequence
  Description of Artificial Sequence: Synthetic oligonucleotide
aggcaggggcctggscttttctgatgga

SEQ ID NO: 178951 - DNA, 27 bp, Artificial Sequence
  Description of Artificial Sequence: Synthetic oligonucleotide
ggcaggggcctggscttttctgatgga

SEQ ID NO: 178952 - DNA, 28 bp, Artificial Sequence
  Description of Artificial Sequence: Synthetic oligonucleotide
gcaggggcctggscttttctgatggaga

SEQ ID NO: 178953 - DNA, 28 bp, Artificial Sequence
  Description of Artificial Sequence: Synthetic oligonucleotide
caggggcctggscttttctgatggagac

SEQ ID NO: 178954 - DNA, 28 bp, Artificial Sequence
  Description of Artificial Sequence: Synthetic oligonucleotide
aggggcctggscttttctgatggagacc

SEQ ID NO: 178955 - DNA, 28 bp, Artificial Sequence
  Description of Artificial Sequence: Synthetic oligonucleotide
ggggcctggscttttctgatggagacca

SEQ ID NO: 178956 - DNA, 28 bp, Artificial Sequence
  Description of Artificial Sequence: Synthetic oligonucleotide
gggcctggscttttctgatggagaccag

SEQ ID NO: 178957 - DNA, 29 bp, Artificial Sequence
  Description of Artificial Sequence: Synthetic oligonucleotide
ggcctggscttttctgatggagaccagtg

SEQ ID NO: 178958 - DNA, 29 bp, Artificial Sequence
  Description of Artificial Sequence: Synthetic oligonucleotide
gcctggscttttctgatggagaccagtgg

SEQ ID NO: 178959 - DNA, 30 bp, Artificial Sequence
  Description of Artificial Sequence: Synthetic oligonucleotide
cctggscttttctgatggagaccagtggac

SEQ ID NO: 178960 - DNA, 30 bp, Artificial Sequence
  Description of Artificial Sequence: Synthetic oligonucleotide
ctggscttttctgatggagaccagtggacc

SEQ ID NO: 178961 - DNA, 34 bp, Artificial Sequence
  Description of Artificial Sequence: Synthetic oligonucleotide
tggscttttctgatggagaccagtggaccttatc

SEQ ID NO: 178962 - DNA, 33 bp, Artificial Sequence
  Description of Artificial Sequence: Synthetic oligonucleotide
ggscttttctgatggagaccagtggaccttatc

SEQ ID NO: 178963 - DNA, 33 bp, Artificial Sequence
  Description of Artificial Sequence: Synthetic oligonucleotide
gscttttctgatggagaccagtggaccttatcc

SEQ ID NO: 178964 - DNA, 34 bp, Artificial Sequence
  Description of Artificial Sequence: Synthetic oligonucleotide
scttttctgatggagaccagtggaccttatccag

SEQ ID NO: 178965 - DNA, 27 bp, Artificial Sequence
  Description of Artificial Sequence: Synthetic oligonucleotide
tctgcgcaagaagagcagggacaaggc

SEQ ID NO: 178966 - DNA, 26 bp, Artificial Sequence
  Description of Artificial Sequence: Synthetic oligonucleotide
ctgcgcaagaagagcagggacaaggc

SEQ ID NO: 178967 - DNA, 27 bp, Artificial Sequence
  Description of Artificial Sequence: Synthetic oligonucleotide
tgcgcaagaagagcagggacaaggcca

SEQ ID NO: 178968 - DNA, 26 bp, Artificial Sequence
  Description of Artificial Sequence: Synthetic oligonucleotide
gcgcaagaagagcagggacaaggcca

SEQ ID NO: 178969 - DNA, 26 bp, Artificial Sequence
  Description of Artificial Sequence: Synthetic oligonucleotide
cgcaagaagagcagggacaaggccag

SEQ ID NO: 178970 - DNA, 26 bp, Artificial Sequence
  Description of Artificial Sequence: Synthetic oligonucleotide
gcaagaagagcagggacaaggccagc

SEQ ID NO: 178971 - DNA, 26 bp, Artificial Sequence
  Description of Artificial Sequence: Synthetic oligonucleotide
caagaagagcagggacaaggccagcg

SEQ ID NO: 178972 - DNA, 26 bp, Artificial Sequence
  Description of Artificial Sequence: Synthetic oligonucleotide
aagaagagcagggacaaggccagcgg

SEQ ID NO: 178973 - DNA, 25 bp, Artificial Sequence
  Description of Artificial Sequence: Synthetic oligonucleotide
agaagagcagggacaaggccagcgg

SEQ ID NO: 178974 - DNA, 24 bp, Artificial Sequence
  Description of Artificial Sequence: Synthetic oligonucleotide
gaagagcagggacaaggccagcgg

SEQ ID NO: 178975 - DNA, 24 bp, Artificial Sequence
  Description of Artificial Sequence: Synthetic oligonucleotide
aagagcagggacaaggccagcggc

SEQ ID NO: 178976 - DNA, 23 bp, Artificial Sequence
  Description of Artificial Sequence: Synthetic oligonucleotide
agagcagggacaaggccagcggc

SEQ ID NO: 178977 - DNA, 22 bp, Artificial Sequence
  Description of Artificial Sequence: Synthetic oligonucleotide
gagcagggacaaggccagcggc

SEQ ID NO: 178978 - DNA, 23 bp, Artificial Sequence
  Description of Artificial Sequence: Synthetic oligonucleotide
agcagggacaaggccagcggcct

SEQ ID NO: 178979 - DNA, 22 bp, Artificial Sequence
  Description of Artificial Sequence: Synthetic oligonucleotide
gcagggacaaggccagcggcct

SEQ ID NO: 178980 - DNA, 22 bp, Artificial Sequence
  Description of Artificial Sequence: Synthetic oligonucleotide
cagggacaaggccagcggcctc

SEQ ID NO: 178981 - DNA, 24 bp, Artificial Sequence
  Description of Artificial Sequence: Synthetic oligonucleotide
agggacaaggccagcggcctccaa

SEQ ID NO: 178982 - DNA, 23 bp, Artificial Sequence
  Description of Artificial Sequence: Synthetic oligonucleotide
gggacaaggccagcggcctccaa

SEQ ID NO: 178983 - DNA, 23 bp, Artificial Sequence
  Description of Artificial Sequence: Synthetic oligonucleotide
ggacaaggccagcggcctccaac

SEQ ID NO: 178984 - DNA, 24 bp, Artificial Sequence
  Description of Artificial Sequence: Synthetic oligonucleotide
gacaaggccagcggcctccaacga

SEQ ID NO: 178985 - DNA, 24 bp, Artificial Sequence
  Description of Artificial Sequence: Synthetic oligonucleotide
acaaggccagcggcctccaacgag

SEQ ID NO: 178986 - DNA, 23 bp, Artificial Sequence
  Description of Artificial Sequence: Synthetic oligonucleotide
caaggccagcggcctccaacgag

SEQ ID NO: 178987 - DNA, 23 bp, Artificial Sequence
  Description of Artificial Sequence: Synthetic oligonucleotide
aaggccagcggcctccaacgagc

SEQ ID NO: 178988 - DNA, 22 bp, Artificial Sequence
  Description of Artificial Sequence: Synthetic oligonucleotide
aggccagcggcctccaacgagc

SEQ ID NO: 178989 - DNA, 21 bp, Artificial Sequence
  Description of Artificial Sequence: Synthetic oligonucleotide
ggccagcggcctccaacgagc

SEQ ID NO: 178990 - DNA, 21 bp, Artificial Sequence
  Description of Artificial Sequence: Synthetic oligonucleotide
gccagcggcctccaacgagcc

SEQ ID NO: 178991 - DNA, 22 bp, Artificial Sequence
  Description of Artificial Sequence: Synthetic oligonucleotide
ccagcggcctccaacgagccct

SEQ ID NO: 178992 - DNA, 22 bp, Artificial Sequence
  Description of Artificial Sequence: Synthetic oligonucleotide
cagcggcctccaacgagccctg

SEQ ID NO: 178993 - DNA, 23 bp, Artificial Sequence
  Description of Artificial Sequence: Synthetic oligonucleotide
agcggcctccaacgagccctgga

SEQ ID NO: 178994 - DNA, 22 bp, Artificial Sequence
  Description of Artificial Sequence: Synthetic oligonucleotide
gcggcctccaacgagccctgga

SEQ ID NO: 178995 - DNA, 24 bp, Artificial Sequence
  Description of Artificial Sequence: Synthetic oligonucleotide
cggcctccaacgagccctggagat

SEQ ID NO: 178996 - DNA, 21 bp, Artificial Sequence
  Description of Artificial Sequence: Synthetic oligonucleotide
tgcctggctgggggcggaggt

SEQ ID NO: 178997 - DNA, 21 bp, Artificial Sequence
  Description of Artificial Sequence: Synthetic oligonucleotide
cctggctgggggcggaggtct

SEQ ID NO: 178998 - DNA, 21 bp, Artificial Sequence
  Description of Artificial Sequence: Synthetic oligonucleotide
ctggctgggggcggaggtctg

SEQ ID NO: 178999 - DNA, 21 bp, Artificial Sequence
  Description of Artificial Sequence: Synthetic oligonucleotide
tggctgggggcggaggtctgc

SEQ ID NO: 179000 - DNA, 20 bp, Artificial Sequence
  Description of Artificial Sequence: Synthetic oligonucleotide
ggctgggggcggaggtctgc

SEQ ID NO: 179001 - DNA, 20 bp, Artificial Sequence
  Description of Artificial Sequence: Synthetic oligonucleotide
gctgggggcggaggtctgcc

SEQ ID NO: 179002 - DNA, 21 bp, Artificial Sequence
  Description of Artificial Sequence: Synthetic oligonucleotide
ctgggggcggaggtctgccca

SEQ ID NO: 179003 - DNA, 22 bp, Artificial Sequence
  Description of Artificial Sequence: Synthetic oligonucleotide
tgggggcggaggtctgcccaca

SEQ ID NO: 179004 - DNA, 21 bp, Artificial Sequence
  Description of Artificial Sequence: Synthetic oligonucleotide
gggggcggaggtctgcccaca

SEQ ID NO: 179005 - DNA, 21 bp, Artificial Sequence
  Description of Artificial Sequence: Synthetic oligonucleotide
ggggcggaggtctgcccacag

SEQ ID NO: 179006 - DNA, 22 bp, Artificial Sequence
  Description of Artificial Sequence: Synthetic oligonucleotide
gggcggaggtctgcccacaggt

SEQ ID NO: 179007 - DNA, 22 bp, Artificial Sequence
  Description of Artificial Sequence: Synthetic oligonucleotide
ggcggaggtctgcccacaggtg

SEQ ID NO: 179008 - DNA, 23 bp, Artificial Sequence
  Description of Artificial Sequence: Synthetic oligonucleotide
gcggaggtctgcccacaggtgct

SEQ ID NO: 179009 - DNA, 23 bp, Artificial Sequence
  Description of Artificial Sequence: Synthetic oligonucleotide
cggaggtctgcccacaggtgctg

SEQ ID NO: 179010 - DNA, 24 bp, Artificial Sequence
  Description of Artificial Sequence: Synthetic oligonucleotide
ggaggtctgcccacaggtgctggt

SEQ ID NO: 179011 - DNA, 24 bp, Artificial Sequence
  Description of Artificial Sequence: Synthetic oligonucleotide
gaggtctgcccacaggtgctggtg

SEQ ID NO: 179012 - DNA, 24 bp, Artificial Sequence
  Description of Artificial Sequence: Synthetic oligonucleotide
aggtctgcccacaggtgctggtgc

SEQ ID NO: 179013 - DNA, 23 bp, Artificial Sequence
  Description of Artificial Sequence: Synthetic oligonucleotide
ggtctgcccacaggtgctggtgc

SEQ ID NO: 179014 - DNA, 24 bp, Artificial Sequence
  Description of Artificial Sequence: Synthetic oligonucleotide
gtctgcccacaggtgctggtgcct

SEQ ID NO: 179015 - DNA, 24 bp, Artificial Sequence
  Description of Artificial Sequence: Synthetic oligonucleotide
tctgcccacaggtgctggtgcctg

SEQ ID NO: 179016 - DNA, 23 bp, Artificial Sequence
  Description of Artificial Sequence: Synthetic oligonucleotide
ctgcccacaggtgctggtgcctg

SEQ ID NO: 179017 - DNA, 23 bp, Artificial Sequence
  Description of Artificial Sequence: Synthetic oligonucleotide
tgcccacaggtgctggtgcctgc

SEQ ID NO: 179018 - DNA, 22 bp, Artificial Sequence
  Description of Artificial Sequence: Synthetic oligonucleotide
gcccacaggtgctggtgcctgc

SEQ ID NO: 179019 - DNA, 22 bp, Artificial Sequence
  Description of Artificial Sequence: Synthetic oligonucleotide
cccacaggtgctggtgcctgcg

SEQ ID NO: 179020 - DNA, 22 bp, Artificial Sequence
  Description of Artificial Sequence: Synthetic oligonucleotide
ccacaggtgctggtgcctgcgg

SEQ ID NO: 179021 - DNA, 22 bp, Artificial Sequence
  Description of Artificial Sequence: Synthetic oligonucleotide
cacaggtgctggtgcctgcggg

SEQ ID NO: 179022 - DNA, 23 bp, Artificial Sequence
  Description of Artificial Sequence: Synthetic oligonucleotide
acaggtgctggtgcctgcgggct

SEQ ID NO: 179023 - DNA, 24 bp, Artificial Sequence
  Description of Artificial Sequence: Synthetic oligonucleotide
ccttctctgtggtgcccacggcac

SEQ ID NO: 179024 - DNA, 25 bp, Artificial Sequence
  Description of Artificial Sequence: Synthetic oligonucleotide
cttctctgtggtgcccacggcacca

SEQ ID NO: 179025 - DNA, 25 bp, Artificial Sequence
  Description of Artificial Sequence: Synthetic oligonucleotide
ttctctgtggtgcccacggcaccac

SEQ ID NO: 179026 - DNA, 24 bp, Artificial Sequence
  Description of Artificial Sequence: Synthetic oligonucleotide
tctctgtggtgcccacggcaccac

SEQ ID NO: 179027 - DNA, 23 bp, Artificial Sequence
  Description of Artificial Sequence: Synthetic oligonucleotide
ctctgtggtgcccacggcaccac

SEQ ID NO: 179028 - DNA, 23 bp, Artificial Sequence
  Description of Artificial Sequence: Synthetic oligonucleotide
tctgtggtgcccacggcaccacc

SEQ ID NO: 179029 - DNA, 22 bp, Artificial Sequence
  Description of Artificial Sequence: Synthetic oligonucleotide
ctgtggtgcccacggcaccacc

SEQ ID NO: 179030 - DNA, 23 bp, Artificial Sequence
  Description of Artificial Sequence: Synthetic oligonucleotide
tgtggtgcccacggcaccaccct

SEQ ID NO: 179031 - DNA, 22 bp, Artificial Sequence
  Description of Artificial Sequence: Synthetic oligonucleotide
gtggtgcccacggcaccaccct

SEQ ID NO: 179032 - DNA, 23 bp, Artificial Sequence
  Description of Artificial Sequence: Synthetic oligonucleotide
tggtgcccacggcaccaccctgt

SEQ ID NO: 179033 - DNA, 22 bp, Artificial Sequence
  Description of Artificial Sequence: Synthetic oligonucleotide
ggtgcccacggcaccaccctgt

SEQ ID NO: 179034 - DNA, 23 bp, Artificial Sequence
  Description of Artificial Sequence: Synthetic oligonucleotide
gtgcccacggcaccaccctgtgt

SEQ ID NO: 179035 - DNA, 24 bp, Artificial Sequence
  Description of Artificial Sequence: Synthetic oligonucleotide
tgcccacggcaccaccctgtgtct

SEQ ID NO: 179036 - DNA, 23 bp, Artificial Sequence
  Description of Artificial Sequence: Synthetic oligonucleotide
gcccacggcaccaccctgtgtct

SEQ ID NO: 179037 - DNA, 24 bp, Artificial Sequence
  Description of Artificial Sequence: Synthetic oligonucleotide
cccacggcaccaccctgtgtctct

SEQ ID NO: 179038 - DNA, 26 bp, Artificial Sequence
  Description of Artificial Sequence: Synthetic oligonucleotide
ccacggcaccaccctgtgtctctgaa

SEQ ID NO: 179039 - DNA, 26 bp, Artificial Sequence
  Description of Artificial Sequence: Synthetic oligonucleotide
cacggcaccaccctgtgtctctgaag

SEQ ID NO: 179040 - DNA, 27 bp, Artificial Sequence
  Description of Artificial Sequence: Synthetic oligonucleotide
acggcaccaccctgtgtctctgaaggt

SEQ ID NO: 179041 - DNA, 26 bp, Artificial Sequence
  Description of Artificial Sequence: Synthetic oligonucleotide
cggcaccaccctgtgtctctgaaggt

SEQ ID NO: 179042 - DNA, 26 bp, Artificial Sequence
  Description of Artificial Sequence: Synthetic oligonucleotide
ggcaccaccctgtgtctctgaaggtg

SEQ ID NO: 179043 - DNA, 27 bp, Artificial Sequence
  Description of Artificial Sequence: Synthetic oligonucleotide
gcaccaccctgtgtctctgaaggtggt

SEQ ID NO: 179044 - DNA, 27 bp, Artificial Sequence
  Description of Artificial Sequence: Synthetic oligonucleotide
caccaccctgtgtctctgaaggtggtg

SEQ ID NO: 179045 - DNA, 27 bp, Artificial Sequence
  Description of Artificial Sequence: Synthetic oligonucleotide
accaccctgtgtctctgaaggtggtgg

SEQ ID NO: 179046 - DNA, 26 bp, Artificial Sequence
  Description of Artificial Sequence: Synthetic oligonucleotide
ccaccctgtgtctctgaaggtggtgg

SEQ ID NO: 179047 - DNA, 27 bp, Artificial Sequence
  Description of Artificial Sequence: Synthetic oligonucleotide
caccctgtgtctctgaaggtggtggct

SEQ ID NO: 179048 - DNA, 27 bp, Artificial Sequence
  Description of Artificial Sequence: Synthetic oligonucleotide
accctgtgtctctgaaggtggtggctc

SEQ ID NO: 179049 - DNA, 26 bp, Artificial Sequence
  Description of Artificial Sequence: Synthetic oligonucleotide
ccctgtgtctctgaaggtggtggctc

SEQ ID NO: 179050 - DNA, 27 bp, Artificial Sequence
  Description of Artificial Sequence: Synthetic oligonucleotide
cctgtgtctctgaaggtggtggctcga

SEQ ID NO: 179051 - DNA, 33 bp, Artificial Sequence
  Description of Artificial Sequence: Synthetic oligonucleotide
ctgatggggactttaacagctacgtcaggttac

SEQ ID NO: 179052 - DNA, 34 bp, Artificial Sequence
  Description of Artificial Sequence: Synthetic oligonucleotide
tgatggggactttaacagctacgtcaggttacag

SEQ ID NO: 179053 - DNA, 33 bp, Artificial Sequence
  Description of Artificial Sequence: Synthetic oligonucleotide
gatggggactttaacagctacgtcaggttacag

SEQ ID NO: 179054 - DNA, 33 bp, Artificial Sequence
  Description of Artificial Sequence: Synthetic oligonucleotide
atggggactttaacagctacgtcaggttacagc

SEQ ID NO: 179055 - DNA, 32 bp, Artificial Sequence
  Description of Artificial Sequence: Synthetic oligonucleotide
tggggactttaacagctacgtcaggttacagc

SEQ ID NO: 179056 - DNA, 31 bp, Artificial Sequence
  Description of Artificial Sequence: Synthetic oligonucleotide
ggggactttaacagctacgtcaggttacagc

SEQ ID NO: 179057 - DNA, 31 bp, Artificial Sequence
  Description of Artificial Sequence: Synthetic oligonucleotide
gggactttaacagctacgtcaggttacagcc

SEQ ID NO: 179058 - DNA, 34 bp, Artificial Sequence
  Description of Artificial Sequence: Synthetic oligonucleotide
ggactttaacagctacgtcaggttacagcctmag

SEQ ID NO: 179059 - DNA, 36 bp, Artificial Sequence
  Description of Artificial Sequence: Synthetic oligonucleotide
gactttaacagctacgtcaggttacagcctmagatc

SEQ ID NO: 179060 - DNA, 36 bp, Artificial Sequence
  Description of Artificial Sequence: Synthetic oligonucleotide
actttaacagctacgtcaggttacagcctmagatcc

SEQ ID NO: 179061 - DNA, 35 bp, Artificial Sequence
  Description of Artificial Sequence: Synthetic oligonucleotide
ctttaacagctacgtcaggttacagcctmagatcc

SEQ ID NO: 179062 - DNA, 38 bp, Artificial Sequence
  Description of Artificial Sequence: Synthetic oligonucleotide
tttaacagctacgtcaggttacagcctmagatccattg

SEQ ID NO: 179063 - DNA, 37 bp, Artificial Sequence
  Description of Artificial Sequence: Synthetic oligonucleotide
ttaacagctacgtcaggttacagcctmagatccattg

SEQ ID NO: 179064 - DNA, 36 bp, Artificial Sequence
  Description of Artificial Sequence: Synthetic oligonucleotide
taacagctacgtcaggttacagcctmagatccattg

SEQ ID NO: 179065 - DNA, 35 bp, Artificial Sequence
  Description of Artificial Sequence: Synthetic oligonucleotide
aacagctacgtcaggttacagcctmagatccattg

SEQ ID NO: 179066 - DNA, 34 bp, Artificial Sequence
  Description of Artificial Sequence: Synthetic oligonucleotide
acagctacgtcaggttacagcctmagatccattg

SEQ ID NO: 179067 - DNA, 33 bp, Artificial Sequence
  Description of Artificial Sequence: Synthetic oligonucleotide
cagctacgtcaggttacagcctmagatccattg

SEQ ID NO: 179068 - DNA, 33 bp, Artificial Sequence
  Description of Artificial Sequence: Synthetic oligonucleotide
agctacgtcaggttacagcctmagatccattgg

SEQ ID NO: 179069 - DNA, 32 bp, Artificial Sequence
  Description of Artificial Sequence: Synthetic oligonucleotide
gctacgtcaggttacagcctmagatccattgg

SEQ ID NO: 179070 - DNA, 33 bp, Artificial Sequence
  Description of Artificial Sequence: Synthetic oligonucleotide
ctacgtcaggttacagcctmagatccattggac

SEQ ID NO: 179071 - DNA, 34 bp, Artificial Sequence
  Description of Artificial Sequence: Synthetic oligonucleotide
tacgtcaggttacagcctmagatccattggacac

SEQ ID NO: 179072 - DNA, 33 bp, Artificial Sequence
  Description of Artificial Sequence: Synthetic oligonucleotide
acgtcaggttacagcctmagatccattggacac

SEQ ID NO: 179073 - DNA, 32 bp, Artificial Sequence
  Description of Artificial Sequence: Synthetic oligonucleotide
cgtcaggttacagcctmagatccattggacac

SEQ ID NO: 179074 - DNA, 36 bp, Artificial Sequence
  Description of Artificial Sequence: Synthetic oligonucleotide
gtcaggttacagcctmagatccattggacactttag

SEQ ID NO: 179075 - DNA, 36 bp, Artificial Sequence
  Description of Artificial Sequence: Synthetic oligonucleotide
tcaggttacagcctmagatccattggacactttagg

SEQ ID NO: 179076 - DNA, 35 bp, Artificial Sequence
  Description of Artificial Sequence: Synthetic oligonucleotide
caggttacagcctmagatccattggacactttagg

SEQ ID NO: 179077 - DNA, 35 bp, Artificial Sequence
  Description of Artificial Sequence: Synthetic oligonucleotide
aggttacagcctmagatccattggacactttaggc

SEQ ID NO: 179078 - DNA, 34 bp, Artificial Sequence
  Description of Artificial Sequence: Synthetic oligonucleotide
ggttacagcctmagatccattggacactttaggc

SEQ ID NO: 179079 - DNA, 35 bp, Artificial Sequence
  Description of Artificial Sequence: Synthetic oligonucleotide
gttacagcctmagatccattggacactttaggctc

SEQ ID NO: 179080 - DNA, 36 bp, Artificial Sequence
  Description of Artificial Sequence: Synthetic oligonucleotide
ttacagcctmagatccattggacactttaggctctg

SEQ ID NO: 179081 - DNA, 35 bp, Artificial Sequence
  Description of Artificial Sequence: Synthetic oligonucleotide
tacagcctmagatccattggacactttaggctctg

SEQ ID NO: 179082 - DNA, 34 bp, Artificial Sequence
  Description of Artificial Sequence: Synthetic oligonucleotide
acagcctmagatccattggacactttaggctctg

SEQ ID NO: 179083 - DNA, 33 bp, Artificial Sequence
  Description of Artificial Sequence: Synthetic oligonucleotide
cagcctmagatccattggacactttaggctctg

SEQ ID NO: 179084 - DNA, 34 bp, Artificial Sequence
  Description of Artificial Sequence: Synthetic oligonucleotide
agcctmagatccattggacactttaggctctgag

SEQ ID NO: 179085 - DNA, 33 bp, Artificial Sequence
  Description of Artificial Sequence: Synthetic oligonucleotide
gcctmagatccattggacactttaggctctgag

SEQ ID NO: 179086 - DNA, 33 bp, Artificial Sequence
  Description of Artificial Sequence: Synthetic oligonucleotide
cctmagatccattggacactttaggctctgagg

SEQ ID NO: 179087 - DNA, 33 bp, Artificial Sequence
  Description of Artificial Sequence: Synthetic oligonucleotide
ctmagatccattggacactttaggctctgaggg

SEQ ID NO: 179088 - DNA, 33 bp, Artificial Sequence
  Description of Artificial Sequence: Synthetic oligonucleotide
tmagatccattggacactttaggctctgagggg

SEQ ID NO: 179089 - DNA, 32 bp, Artificial Sequence
  Description of Artificial Sequence: Synthetic oligonucleotide
magatccattggacactttaggctctgagggg

SEQ ID NO: 179090 - DNA, 24 bp, Artificial Sequence
  Description of Artificial Sequence: Synthetic oligonucleotide
gggccttgtcaccaggaggcgtgs

SEQ ID NO: 179091 - DNA, 24 bp, Artificial Sequence
  Description of Artificial Sequence: Synthetic oligonucleotide
ggccttgtcaccaggaggcgtgsc

SEQ ID NO: 179092 - DNA, 25 bp, Artificial Sequence
  Description of Artificial Sequence: Synthetic oligonucleotide
gccttgtcaccaggaggcgtgscct

SEQ ID NO: 179093 - DNA, 25 bp, Artificial Sequence
  Description of Artificial Sequence: Synthetic oligonucleotide
ccttgtcaccaggaggcgtgscctc

SEQ ID NO: 179094 - DNA, 25 bp, Artificial Sequence
  Description of Artificial Sequence: Synthetic oligonucleotide
cttgtcaccaggaggcgtgscctcc

SEQ ID NO: 179095 - DNA, 26 bp, Artificial Sequence
  Description of Artificial Sequence: Synthetic oligonucleotide
ttgtcaccaggaggcgtgscctccct

SEQ ID NO: 179096 - DNA, 25 bp, Artificial Sequence
  Description of Artificial Sequence: Synthetic oligonucleotide
tgtcaccaggaggcgtgscctccct

SEQ ID NO: 179097 - DNA, 24 bp, Artificial Sequence
  Description of Artificial Sequence: Synthetic oligonucleotide
gtcaccaggaggcgtgscctccct

SEQ ID NO: 179098 - DNA, 26 bp, Artificial Sequence
  Description of Artificial Sequence: Synthetic oligonucleotide
tcaccaggaggcgtgscctccctctt

SEQ ID NO: 179099 - DNA, 25 bp, Artificial Sequence
  Description of Artificial Sequence: Synthetic oligonucleotide
caccaggaggcgtgscctccctctt

SEQ ID NO: 179100 - DNA, 26 bp, Artificial Sequence
  Description of Artificial Sequence: Synthetic oligonucleotide
accaggaggcgtgscctccctcttga

SEQ ID NO: 179101 - DNA, 25 bp, Artificial Sequence
  Description of Artificial Sequence: Synthetic oligonucleotide
ccaggaggcgtgscctccctcttga

SEQ ID NO: 179102 - DNA, 25 bp, Artificial Sequence
  Description of Artificial Sequence: Synthetic oligonucleotide
caggaggcgtgscctccctcttgag

SEQ ID NO: 179103 - DNA, 25 bp, Artificial Sequence
  Description of Artificial Sequence: Synthetic oligonucleotide
aggaggcgtgscctccctcttgagg

SEQ ID NO: 179104 - DNA, 24 bp, Artificial Sequence
  Description of Artificial Sequence: Synthetic oligonucleotide
ggaggcgtgscctccctcttgagg

SEQ ID NO: 179105 - DNA, 26 bp, Artificial Sequence
  Description of Artificial Sequence: Synthetic oligonucleotide
gaggcgtgscctccctcttgaggctt

SEQ ID NO: 179106 - DNA, 26 bp, Artificial Sequence
  Description of Artificial Sequence: Synthetic oligonucleotide
aggcgtgscctccctcttgaggcttc

SEQ ID NO: 179107 - DNA, 25 bp, Artificial Sequence
  Description of Artificial Sequence: Synthetic oligonucleotide
ggcgtgscctccctcttgaggcttc

SEQ ID NO: 179108 - DNA, 26 bp, Artificial Sequence
  Description of Artificial Sequence: Synthetic oligonucleotide
gcgtgscctccctcttgaggcttcct

SEQ ID NO: 179109 - DNA, 26 bp, Artificial Sequence
  Description of Artificial Sequence: Synthetic oligonucleotide
cgtgscctccctcttgaggcttcctc

SEQ ID NO: 179110 - DNA, 27 bp, Artificial Sequence
  Description of Artificial Sequence: Synthetic oligonucleotide
gtgscctccctcttgaggcttcctcga

SEQ ID NO: 179111 - DNA, 28 bp, Artificial Sequence
  Description of Artificial Sequence: Synthetic oligonucleotide
tgscctccctcttgaggcttcctcgagk

SEQ ID NO: 179112 - DNA, 27 bp, Artificial Sequence
  Description of Artificial Sequence: Synthetic oligonucleotide
gscctccctcttgaggcttcctcgagk

SEQ ID NO: 179113 - DNA, 28 bp, Artificial Sequence
  Description of Artificial Sequence: Synthetic oligonucleotide
scctccctcttgaggcttcctcgagkct

SEQ ID NO: 179114 - DNA, 27 bp, Artificial Sequence
  Description of Artificial Sequence: Synthetic oligonucleotide
cctccctcttgaggcttcctcgagkct

SEQ ID NO: 179115 - DNA, 28 bp, Artificial Sequence
  Description of Artificial Sequence: Synthetic oligonucleotide
ctccctcttgaggcttcctcgagkctgt

SEQ ID NO: 179116 - DNA, 28 bp, Artificial Sequence
  Description of Artificial Sequence: Synthetic oligonucleotide
tccctcttgaggcttcctcgagkctgtg

SEQ ID NO: 179117 - DNA, 27 bp, Artificial Sequence
  Description of Artificial Sequence: Synthetic oligonucleotide
ccctcttgaggcttcctcgagkctgtg

SEQ ID NO: 179118 - DNA, 27 bp, Artificial Sequence
  Description of Artificial Sequence: Synthetic oligonucleotide
cctcttgaggcttcctcgagkctgtgg

SEQ ID NO: 179119 - DNA, 27 bp, Artificial Sequence
  Description of Artificial Sequence: Synthetic oligonucleotide
ctcttgaggcttcctcgagkctgtggg

SEQ ID NO: 179120 - DNA, 28 bp, Artificial Sequence
  Description of Artificial Sequence: Synthetic oligonucleotide
tcttgaggcttcctcgagkctgtgggga

SEQ ID NO: 179121 - DNA, 27 bp, Artificial Sequence
  Description of Artificial Sequence: Synthetic oligonucleotide
cttgaggcttcctcgagkctgtgggga

SEQ ID NO: 179122 - DNA, 27 bp, Artificial Sequence
  Description of Artificial Sequence: Synthetic oligonucleotide
ttgaggcttcctcgagkctgtggggag

SEQ ID NO: 179123 - DNA, 26 bp, Artificial Sequence
  Description of Artificial Sequence: Synthetic oligonucleotide
tgaggcttcctcgagkctgtggggag

SEQ ID NO: 179124 - DNA, 25 bp, Artificial Sequence
  Description of Artificial Sequence: Synthetic oligonucleotide
gaggcttcctcgagkctgtggggag

SEQ ID NO: 179125 - DNA, 28 bp, Artificial Sequence
  Description of Artificial Sequence: Synthetic oligonucleotide
aggcttcctcgagkctgtggggagcaaa

SEQ ID NO: 179126 - DNA, 27 bp, Artificial Sequence
  Description of Artificial Sequence: Synthetic oligonucleotide
ggcttcctcgagkctgtggggagcaaa

SEQ ID NO: 179127 - DNA, 27 bp, Artificial Sequence
  Description of Artificial Sequence: Synthetic oligonucleotide
gcttcctcgagkctgtggggagcaaac

SEQ ID NO: 179128 - DNA, 28 bp, Artificial Sequence
  Description of Artificial Sequence: Synthetic oligonucleotide
cttcctcgagkctgtggggagcaaacca

SEQ ID NO: 179129 - DNA, 29 bp, Artificial Sequence
  Description of Artificial Sequence: Synthetic oligonucleotide
ttcctcgagkctgtggggagcaaaccatg

SEQ ID NO: 179130 - DNA, 28 bp, Artificial Sequence
  Description of Artificial Sequence: Synthetic oligonucleotide
tcctcgagkctgtggggagcaaaccatg

SEQ ID NO: 179131 - DNA, 28 bp, Artificial Sequence
  Description of Artificial Sequence: Synthetic oligonucleotide
cctcgagkctgtggggagcaaaccatga

SEQ ID NO: 179132 - DNA, 29 bp, Artificial Sequence
  Description of Artificial Sequence: Synthetic oligonucleotide
ctcgagkctgtggggagcaaaccatgatc

SEQ ID NO: 179133 - DNA, 31 bp, Artificial Sequence
  Description of Artificial Sequence: Synthetic oligonucleotide
tcgagkctgtggggagcaaaccatgatctac

SEQ ID NO: 179134 - DNA, 30 bp, Artificial Sequence
  Description of Artificial Sequence: Synthetic oligonucleotide
cgagkctgtggggagcaaaccatgatctac

SEQ ID NO: 179135 - DNA, 32 bp, Artificial Sequence
  Description of Artificial Sequence: Synthetic oligonucleotide
gagkctgtggggagcaaaccatgatctacttg

SEQ ID NO: 179136 - DNA, 32 bp, Artificial Sequence
  Description of Artificial Sequence: Synthetic oligonucleotide
agkctgtggggagcaaaccatgatctacttgg

SEQ ID NO: 179137 - DNA, 31 bp, Artificial Sequence
  Description of Artificial Sequence: Synthetic oligonucleotide
gkctgtggggagcaaaccatgatctacttgg

SEQ ID NO: 179138 - DNA, 31 bp, Artificial Sequence
  Description of Artificial Sequence: Synthetic oligonucleotide
kctgtggggagcaaaccatgatctacttggc

SEQ ID NO: 179139 - DNA, 28 bp, Artificial Sequence
  Description of Artificial Sequence: Synthetic oligonucleotide
tgcttcccgctacctggacaagacagac

SEQ ID NO: 179140 - DNA, 27 bp, Artificial Sequence
  Description of Artificial Sequence: Synthetic oligonucleotide
gcttcccgctacctggacaagacagac

SEQ ID NO: 179141 - DNA, 28 bp, Artificial Sequence
  Description of Artificial Sequence: Synthetic oligonucleotide
cttcccgctacctggacaagacagacag

SEQ ID NO: 179142 - DNA, 29 bp, Artificial Sequence
  Description of Artificial Sequence: Synthetic oligonucleotide
ttcccgctacctggacaagacagacagtg

SEQ ID NO: 179143 - DNA, 28 bp, Artificial Sequence
  Description of Artificial Sequence: Synthetic oligonucleotide
tcccgctacctggacaagacagacagtg

SEQ ID NO: 179144 - DNA, 27 bp, Artificial Sequence
  Description of Artificial Sequence: Synthetic oligonucleotide
cccgctacctggacaagacagacagtg

SEQ ID NO: 179145 - DNA, 27 bp, Artificial Sequence
  Description of Artificial Sequence: Synthetic oligonucleotide
ccgctacctggacaagacagacagtgg

SEQ ID NO: 179146 - DNA, 28 bp, Artificial Sequence
  Description of Artificial Sequence: Synthetic oligonucleotide
cgctacctggacaagacagacagtggag

SEQ ID NO: 179147 - DNA, 28 bp, Artificial Sequence
  Description of Artificial Sequence: Synthetic oligonucleotide
gctacctggacaagacagacagtggagc

SEQ ID NO: 179148 - DNA, 29 bp, Artificial Sequence
  Description of Artificial Sequence: Synthetic oligonucleotide
ctacctggacaagacagacagtggagcac

SEQ ID NO: 179149 - DNA, 30 bp, Artificial Sequence
  Description of Artificial Sequence: Synthetic oligonucleotide
tacctggacaagacagacagtggagcacac

SEQ ID NO: 179150 - DNA, 29 bp, Artificial Sequence
  Description of Artificial Sequence: Synthetic oligonucleotide
acctggacaagacagacagtggagcacac

SEQ ID NO: 179151 - DNA, 28 bp, Artificial Sequence
  Description of Artificial Sequence: Synthetic oligonucleotide
cctggacaagacagacagtggagcacac

SEQ ID NO: 179152 - DNA, 30 bp, Artificial Sequence
  Description of Artificial Sequence: Synthetic oligonucleotide
ctggacaagacagacagtggagcacacttc

SEQ ID NO: 179153 - DNA, 30 bp, Artificial Sequence
  Description of Artificial Sequence: Synthetic oligonucleotide
tggacaagacagacagtggagcacacttcc

SEQ ID NO: 179154 - DNA, 29 bp, Artificial Sequence
  Description of Artificial Sequence: Synthetic oligonucleotide
ggacaagacagacagtggagcacacttcc

SEQ ID NO: 179155 - DNA, 30 bp, Artificial Sequence
  Description of Artificial Sequence: Synthetic oligonucleotide
gacaagacagacagtggagcacacttcctc

SEQ ID NO: 179156 - DNA, 30 bp, Artificial Sequence
  Description of Artificial Sequence: Synthetic oligonucleotide
acaagacagacagtggagcacacttcctcc

SEQ ID NO: 179157 - DNA, 29 bp, Artificial Sequence
  Description of Artificial Sequence: Synthetic oligonucleotide
caagacagacagtggagcacacttcctcc

SEQ ID NO: 179158 - DNA, 29 bp, Artificial Sequence
  Description of Artificial Sequence: Synthetic oligonucleotide
aagacagacagtggagcacacttcctccc

SEQ ID NO: 179159 - DNA, 28 bp, Artificial Sequence
  Description of Artificial Sequence: Synthetic oligonucleotide
agacagacagtggagcacacttcctccc

SEQ ID NO: 179160 - DNA, 27 bp, Artificial Sequence
  Description of Artificial Sequence: Synthetic oligonucleotide
gacagacagtggagcacacttcctccc

SEQ ID NO: 179161 - DNA, 27 bp, Artificial Sequence
  Description of Artificial Sequence: Synthetic oligonucleotide
acagacagtggagcacacttcctcccg

SEQ ID NO: 179162 - DNA, 27 bp, Artificial Sequence
  Description of Artificial Sequence: Synthetic oligonucleotide
cagacagtggagcacacttcctcccga

SEQ ID NO: 179163 - DNA, 27 bp, Artificial Sequence
  Description of Artificial Sequence: Synthetic oligonucleotide
agacagtggagcacacttcctcccgag

SEQ ID NO: 179164 - DNA, 27 bp, Artificial Sequence
  Description of Artificial Sequence: Synthetic oligonucleotide
gacagtggagcacacttcctcccgaga

SEQ ID NO: 179165 - DNA, 27 bp, Artificial Sequence
  Description of Artificial Sequence: Synthetic oligonucleotide
acagtggagcacacttcctcccgagac

SEQ ID NO: 179166 - DNA, 26 bp, Artificial Sequence
  Description of Artificial Sequence: Synthetic oligonucleotide
cagtggagcacacttcctcccgagac

SEQ ID NO: 179167 - DNA, 27 bp, Artificial Sequence
  Description of Artificial Sequence: Synthetic oligonucleotide
agtggagcacacttcctcccgagacca

SEQ ID NO: 179168 - DNA, 27 bp, Artificial Sequence
  Description of Artificial Sequence: Synthetic oligonucleotide
gtggagcacacttcctcccgagaccaa

SEQ ID NO: 179169 - DNA, 27 bp, Artificial Sequence
  Description of Artificial Sequence: Synthetic oligonucleotide
tggagcacacttcctcccgagaccaag

SEQ ID NO: 179170 - DNA, 26 bp, Artificial Sequence
  Description of Artificial Sequence: Synthetic oligonucleotide
ggagcacacttcctcccgagaccaag

SEQ ID NO: 179171 - DNA, 27 bp, Artificial Sequence
  Description of Artificial Sequence: Synthetic oligonucleotide
gagcacacttcctcccgagaccaagga

SEQ ID NO: 179172 - DNA, 27 bp, Artificial Sequence
  Description of Artificial Sequence: Synthetic oligonucleotide
agcacacttcctcccgagaccaaggac

SEQ ID NO: 179173 - DNA, 26 bp, Artificial Sequence
  Description of Artificial Sequence: Synthetic oligonucleotide
gcacacttcctcccgagaccaaggac

SEQ ID NO: 179174 - DNA, 27 bp, Artificial Sequence
  Description of Artificial Sequence: Synthetic oligonucleotide
cacacttcctcccgagaccaaggacca

SEQ ID NO: 179175 - DNA, 27 bp, Artificial Sequence
  Description of Artificial Sequence: Synthetic oligonucleotide
acacttcctcccgagaccaaggaccac

SEQ ID NO: 179176 - DNA, 26 bp, Artificial Sequence
  Description of Artificial Sequence: Synthetic oligonucleotide
cacttcctcccgagaccaaggaccac

SEQ ID NO: 179177 - DNA, 26 bp, Artificial Sequence
  Description of Artificial Sequence: Synthetic oligonucleotide
acttcctcccgagaccaaggaccacg

SEQ ID NO: 179178 - DNA, 25 bp, Artificial Sequence
  Description of Artificial Sequence: Synthetic oligonucleotide
cttcctcccgagaccaaggaccacg

SEQ ID NO: 179179 - DNA, 25 bp, Artificial Sequence
  Description of Artificial Sequence: Synthetic oligonucleotide
ttcctcccgagaccaaggaccacgc

SEQ ID NO: 179180 - DNA, 24 bp, Artificial Sequence
  Description of Artificial Sequence: Synthetic oligonucleotide
tcctcccgagaccaaggaccacgc

SEQ ID NO: 179181 - DNA, 22 bp, Artificial Sequence
  Description of Artificial Sequence: Synthetic oligonucleotide
ggctcctgggtgcccacgcagt

SEQ ID NO: 179182 - DNA, 22 bp, Artificial Sequence
  Description of Artificial Sequence: Synthetic oligonucleotide
gctcctgggtgcccacgcagtg

SEQ ID NO: 179183 - DNA, 22 bp, Artificial Sequence
  Description of Artificial Sequence: Synthetic oligonucleotide
ctcctgggtgcccacgcagtgc

SEQ ID NO: 179184 - DNA, 24 bp, Artificial Sequence
  Description of Artificial Sequence: Synthetic oligonucleotide
tcctgggtgcccacgcagtgccat

SEQ ID NO: 179185 - DNA, 23 bp, Artificial Sequence
  Description of Artificial Sequence: Synthetic oligonucleotide
cctgggtgcccacgcagtgccat

SEQ ID NO: 179186 - DNA, 24 bp, Artificial Sequence
  Description of Artificial Sequence: Synthetic oligonucleotide
ctgggtgcccacgcagtgccatca

SEQ ID NO: 179187 - DNA, 24 bp, Artificial Sequence
  Description of Artificial Sequence: Synthetic oligonucleotide
tgggtgcccacgcagtgccatcac

SEQ ID NO: 179188 - DNA, 23 bp, Artificial Sequence
  Description of Artificial Sequence: Synthetic oligonucleotide
gggtgcccacgcagtgccatcac

SEQ ID NO: 179189 - DNA, 23 bp, Artificial Sequence
  Description of Artificial Sequence: Synthetic oligonucleotide
ggtgcccacgcagtgccatcacg

SEQ ID NO: 179190 - DNA, 23 bp, Artificial Sequence
  Description of Artificial Sequence: Synthetic oligonucleotide
gtgcccacgcagtgccatcacgg

SEQ ID NO: 179191 - DNA, 26 bp, Artificial Sequence
  Description of Artificial Sequence: Synthetic oligonucleotide
tgcccacgcagtgccatcacggctat

SEQ ID NO: 179192 - DNA, 25 bp, Artificial Sequence
  Description of Artificial Sequence: Synthetic oligonucleotide
gcccacgcagtgccatcacggctat

SEQ ID NO: 179193 - DNA, 25 bp, Artificial Sequence
  Description of Artificial Sequence: Synthetic oligonucleotide
cccacgcagtgccatcacggctatg

SEQ ID NO: 179194 - DNA, 25 bp, Artificial Sequence
  Description of Artificial Sequence: Synthetic oligonucleotide
ccacgcagtgccatcacggctatgc

SEQ ID NO: 179195 - DNA, 25 bp, Artificial Sequence
  Description of Artificial Sequence: Synthetic oligonucleotide
cacgcagtgccatcacggctatgcc

SEQ ID NO: 179196 - DNA, 26 bp, Artificial Sequence
  Description of Artificial Sequence: Synthetic oligonucleotide
acgcagtgccatcacggctatgccct

SEQ ID NO: 179197 - DNA, 25 bp, Artificial Sequence
  Description of Artificial Sequence: Synthetic oligonucleotide
cgcagtgccatcacggctatgccct

SEQ ID NO: 179198 - DNA, 26 bp, Artificial Sequence
  Description of Artificial Sequence: Synthetic oligonucleotide
gcagtgccatcacggctatgccctga

SEQ ID NO: 179199 - DNA, 27 bp, Artificial Sequence
  Description of Artificial Sequence: Synthetic oligonucleotide
cagtgccatcacggctatgccctgaca

SEQ ID NO: 179200 - DNA, 27 bp, Artificial Sequence
  Description of Artificial Sequence: Synthetic oligonucleotide
agtgccatcacggctatgccctgacac

SEQ ID NO: 179201 - DNA, 27 bp, Artificial Sequence
  Description of Artificial Sequence: Synthetic oligonucleotide
gtgccatcacggctatgccctgacact

SEQ ID NO: 179202 - DNA, 27 bp, Artificial Sequence
  Description of Artificial Sequence: Synthetic oligonucleotide
tgccatcacggctatgccctgacactg

SEQ ID NO: 179203 - DNA, 27 bp, Artificial Sequence
  Description of Artificial Sequence: Synthetic oligonucleotide
gccatcacggctatgccctgacactga

SEQ ID NO: 179204 - DNA, 27 bp, Artificial Sequence
  Description of Artificial Sequence: Synthetic oligonucleotide
ccatcacggctatgccctgacactgac

SEQ ID NO: 179205 - DNA, 27 bp, Artificial Sequence
  Description of Artificial Sequence: Synthetic oligonucleotide
catcacggctatgccctgacactgacc

SEQ ID NO: 179206 - DNA, 29 bp, Artificial Sequence
  Description of Artificial Sequence: Synthetic oligonucleotide
atcacggctatgccctgacactgaccaag

SEQ ID NO: 179207 - DNA, 28 bp, Artificial Sequence
  Description of Artificial Sequence: Synthetic oligonucleotide
tcacggctatgccctgacactgaccaag

SEQ ID NO: 179208 - DNA, 27 bp, Artificial Sequence
  Description of Artificial Sequence: Synthetic oligonucleotide
cacggctatgccctgacactgaccaag

SEQ ID NO: 179209 - DNA, 27 bp, Artificial Sequence
  Description of Artificial Sequence: Synthetic oligonucleotide
acggctatgccctgacactgaccaagg

SEQ ID NO: 179210 - DNA, 26 bp, Artificial Sequence
  Description of Artificial Sequence: Synthetic oligonucleotide
cggctatgccctgacactgaccaagg

SEQ ID NO: 179211 - DNA, 26 bp, Artificial Sequence
  Description of Artificial Sequence: Synthetic oligonucleotide
ggctatgccctgacactgaccaaggc

SEQ ID NO: 179212 - DNA, 26 bp, Artificial Sequence
  Description of Artificial Sequence: Synthetic oligonucleotide
gctatgccctgacactgaccaaggcc

SEQ ID NO: 179213 - DNA, 27 bp, Artificial Sequence
  Description of Artificial Sequence: Synthetic oligonucleotide
cctggatgccctgtctgcctactggtt

SEQ ID NO: 179214 - DNA, 28 bp, Artificial Sequence
  Description of Artificial Sequence: Synthetic oligonucleotide
ctggatgccctgtctgcctactggtttg

SEQ ID NO: 179215 - DNA, 28 bp, Artificial Sequence
  Description of Artificial Sequence: Synthetic oligonucleotide
tggatgccctgtctgcctactggtttgc

SEQ ID NO: 179216 - DNA, 27 bp, Artificial Sequence
  Description of Artificial Sequence: Synthetic oligonucleotide
ggatgccctgtctgcctactggtttgc

SEQ ID NO: 179217 - DNA, 27 bp, Artificial Sequence
  Description of Artificial Sequence: Synthetic oligonucleotide
gatgccctgtctgcctactggtttgcc

SEQ ID NO: 179218 - DNA, 28 bp, Artificial Sequence
  Description of Artificial Sequence: Synthetic oligonucleotide
atgccctgtctgcctactggtttgcctc

SEQ ID NO: 179219 - DNA, 27 bp, Artificial Sequence
  Description of Artificial Sequence: Synthetic oligonucleotide
tgccctgtctgcctactggtttgcctc

SEQ ID NO: 179220 - DNA, 26 bp, Artificial Sequence
  Description of Artificial Sequence: Synthetic oligonucleotide
gccctgtctgcctactggtttgcctc

SEQ ID NO: 179221 - DNA, 26 bp, Artificial Sequence
  Description of Artificial Sequence: Synthetic oligonucleotide
ccctgtctgcctactggtttgcctcc

SEQ ID NO: 179222 - DNA, 27 bp, Artificial Sequence
  Description of Artificial Sequence: Synthetic oligonucleotide
cctgtctgcctactggtttgcctccca

SEQ ID NO: 179223 - DNA, 27 bp, Artificial Sequence
  Description of Artificial Sequence: Synthetic oligonucleotide
ctgtctgcctactggtttgcctcccac

SEQ ID NO: 179224 - DNA, 28 bp, Artificial Sequence
  Description of Artificial Sequence: Synthetic oligonucleotide
tgtctgcctactggtttgcctcccacac

SEQ ID NO: 179225 - DNA, 27 bp, Artificial Sequence
  Description of Artificial Sequence: Synthetic oligonucleotide
gtctgcctactggtttgcctcccacac

SEQ ID NO: 179226 - DNA, 27 bp, Artificial Sequence
  Description of Artificial Sequence: Synthetic oligonucleotide
tctgcctactggtttgcctcccacacc

SEQ ID NO: 179227 - DNA, 27 bp, Artificial Sequence
  Description of Artificial Sequence: Synthetic oligonucleotide
ctgcctactggtttgcctcccacacca

SEQ ID NO: 179228 - DNA, 27 bp, Artificial Sequence
  Description of Artificial Sequence: Synthetic oligonucleotide
tgcctactggtttgcctcccacaccac

SEQ ID NO: 179229 - DNA, 27 bp, Artificial Sequence
  Description of Artificial Sequence: Synthetic oligonucleotide
gcctactggtttgcctcccacaccact

SEQ ID NO: 179230 - DNA, 27 bp, Artificial Sequence
  Description of Artificial Sequence: Synthetic oligonucleotide
cctactggtttgcctcccacaccactg

SEQ ID NO: 179231 - DNA, 28 bp, Artificial Sequence
  Description of Artificial Sequence: Synthetic oligonucleotide
ctactggtttgcctcccacaccactgag

SEQ ID NO: 179232 - DNA, 28 bp, Artificial Sequence
  Description of Artificial Sequence: Synthetic oligonucleotide
tactggtttgcctcccacaccactgagg

SEQ ID NO: 179233 - DNA, 27 bp, Artificial Sequence
  Description of Artificial Sequence: Synthetic oligonucleotide
actggtttgcctcccacaccactgagg

SEQ ID NO: 179234 - DNA, 27 bp, Artificial Sequence
  Description of Artificial Sequence: Synthetic oligonucleotide
ctggtttgcctcccacaccactgagga

SEQ ID NO: 179235 - DNA, 27 bp, Artificial Sequence
  Description of Artificial Sequence: Synthetic oligonucleotide
tggtttgcctcccacaccactgaggag

SEQ ID NO: 179236 - DNA, 27 bp, Artificial Sequence
  Description of Artificial Sequence: Synthetic oligonucleotide
ggtttgcctcccacaccactgaggaga

SEQ ID NO: 179237 - DNA, 27 bp, Artificial Sequence
  Description of Artificial Sequence: Synthetic oligonucleotide
gtttgcctcccacaccactgaggagag

SEQ ID NO: 179238 - DNA, 27 bp, Artificial Sequence
  Description of Artificial Sequence: Synthetic oligonucleotide
tttgcctcccacaccactgaggagagg

SEQ ID NO: 179239 - DNA, 36 bp, Artificial Sequence
  Description of Artificial Sequence: Synthetic oligonucleotide
agcaagatcaatgtgaaggtgggaggaaacagaaag

SEQ ID NO: 179240 - DNA, 35 bp, Artificial Sequence
  Description of Artificial Sequence: Synthetic oligonucleotide
gcaagatcaatgtgaaggtgggaggaaacagaaag

SEQ ID NO: 179241 - DNA, 35 bp, Artificial Sequence
  Description of Artificial Sequence: Synthetic oligonucleotide
caagatcaatgtgaaggtgggaggaaacagaaagg

SEQ ID NO: 179242 - DNA, 37 bp, Artificial Sequence
  Description of Artificial Sequence: Synthetic oligonucleotide
aagatcaatgtgaaggtgggaggaaacagaaaggaac

SEQ ID NO: 179243 - DNA, 36 bp, Artificial Sequence
  Description of Artificial Sequence: Synthetic oligonucleotide
agatcaatgtgaaggtgggaggaaacagaaaggaac

SEQ ID NO: 179244 - DNA, 35 bp, Artificial Sequence
  Description of Artificial Sequence: Synthetic oligonucleotide
gatcaatgtgaaggtgggaggaaacagaaaggaac

SEQ ID NO: 179245 - DNA, 35 bp, Artificial Sequence
  Description of Artificial Sequence: Synthetic oligonucleotide
atcaatgtgaaggtgggaggaaacagaaaggaacc

SEQ ID NO: 179246 - DNA, 34 bp, Artificial Sequence
  Description of Artificial Sequence: Synthetic oligonucleotide
tcaatgtgaaggtgggaggaaacagaaaggaacc

SEQ ID NO: 179247 - DNA, 33 bp, Artificial Sequence
  Description of Artificial Sequence: Synthetic oligonucleotide
caatgtgaaggtgggaggaaacagaaaggaacc

SEQ ID NO: 179248 - DNA, 33 bp, Artificial Sequence
  Description of Artificial Sequence: Synthetic oligonucleotide
aatgtgaaggtgggaggaaacagaaaggaaccc

SEQ ID NO: 179249 - DNA, 32 bp, Artificial Sequence
  Description of Artificial Sequence: Synthetic oligonucleotide
atgtgaaggtgggaggaaacagaaaggaaccc

SEQ ID NO: 179250 - DNA, 31 bp, Artificial Sequence
  Description of Artificial Sequence: Synthetic oligonucleotide
tgtgaaggtgggaggaaacagaaaggaaccc

SEQ ID NO: 179251 - DNA, 30 bp, Artificial Sequence
  Description of Artificial Sequence: Synthetic oligonucleotide
gtgaaggtgggaggaaacagaaaggaaccc

SEQ ID NO: 179252 - DNA, 31 bp, Artificial Sequence
  Description of Artificial Sequence: Synthetic oligonucleotide
tgaaggtgggaggaaacagaaaggaaccctg

SEQ ID NO: 179253 - DNA, 30 bp, Artificial Sequence
  Description of Artificial Sequence: Synthetic oligonucleotide
gaaggtgggaggaaacagaaaggaaccctg

SEQ ID NO: 179254 - DNA, 32 bp, Artificial Sequence
  Description of Artificial Sequence: Synthetic oligonucleotide
aaggtgggaggaaacagaaaggaaccctgaag

SEQ ID NO: 179255 - DNA, 31 bp, Artificial Sequence
  Description of Artificial Sequence: Synthetic oligonucleotide
aggtgggaggaaacagaaaggaaccctgaag

SEQ ID NO: 179256 - DNA, 30 bp, Artificial Sequence
  Description of Artificial Sequence: Synthetic oligonucleotide
ggtgggaggaaacagaaaggaaccctgaag

SEQ ID NO: 179257 - DNA, 30 bp, Artificial Sequence
  Description of Artificial Sequence: Synthetic oligonucleotide
gtgggaggaaacagaaaggaaccctgaagg

SEQ ID NO: 179258 - DNA, 31 bp, Artificial Sequence
  Description of Artificial Sequence: Synthetic oligonucleotide
tgggaggaaacagaaaggaaccctgaaggtc

SEQ ID NO: 179259 - DNA, 30 bp, Artificial Sequence
  Description of Artificial Sequence: Synthetic oligonucleotide
gggaggaaacagaaaggaaccctgaaggtc

SEQ ID NO: 179260 - DNA, 30 bp, Artificial Sequence
  Description of Artificial Sequence: Synthetic oligonucleotide
ggaggaaacagaaaggaaccctgaaggtcc

SEQ ID NO: 179261 - DNA, 32 bp, Artificial Sequence
  Description of Artificial Sequence: Synthetic oligonucleotide
gaggaaacagaaaggaaccctgaaggtccttc

SEQ ID NO: 179262 - DNA, 32 bp, Artificial Sequence
  Description of Artificial Sequence: Synthetic oligonucleotide
aggaaacagaaaggaaccctgaaggtccttcg

SEQ ID NO: 179263 - DNA, 31 bp, Artificial Sequence
  Description of Artificial Sequence: Synthetic oligonucleotide
ggaaacagaaaggaaccctgaaggtccttcg

SEQ ID NO: 179264 - DNA, 33 bp, Artificial Sequence
  Description of Artificial Sequence: Synthetic oligonucleotide
gaaacagaaaggaaccctgaaggtccttcgtac

SEQ ID NO: 179265 - DNA, 33 bp, Artificial Sequence
  Description of Artificial Sequence: Synthetic oligonucleotide
aaacagaaaggaaccctgaaggtccttcgtacc

SEQ ID NO: 179266 - DNA, 32 bp, Artificial Sequence
  Description of Artificial Sequence: Synthetic oligonucleotide
aacagaaaggaaccctgaaggtccttcgtacc

SEQ ID NO: 179267 - DNA, 31 bp, Artificial Sequence
  Description of Artificial Sequence: Synthetic oligonucleotide
acagaaaggaaccctgaaggtccttcgtacc

SEQ ID NO: 179268 - DNA, 30 bp, Artificial Sequence
  Description of Artificial Sequence: Synthetic oligonucleotide
cagaaaggaaccctgaaggtccttcgtacc

SEQ ID NO: 179269 - DNA, 32 bp, Artificial Sequence
  Description of Artificial Sequence: Synthetic oligonucleotide
agaaaggaaccctgaaggtccttcgtacctac

SEQ ID NO: 179270 - DNA, 31 bp, Artificial Sequence
  Description of Artificial Sequence: Synthetic oligonucleotide
gaaaggaaccctgaaggtccttcgtacctac

SEQ ID NO: 179271 - DNA, 22 bp, Artificial Sequence
  Description of Artificial Sequence: Synthetic oligonucleotide
ccacctcccgggagtgcgtggs

SEQ ID NO: 179272 - DNA, 25 bp, Artificial Sequence
  Description of Artificial Sequence: Synthetic oligonucleotide
cacctcccgggagtgcgtggscttt

SEQ ID NO: 179273 - DNA, 26 bp, Artificial Sequence
  Description of Artificial Sequence: Synthetic oligonucleotide
acctcccgggagtgcgtggsctttga

SEQ ID NO: 179274 - DNA, 25 bp, Artificial Sequence
  Description of Artificial Sequence: Synthetic oligonucleotide
cctcccgggagtgcgtggsctttga

SEQ ID NO: 179275 - DNA, 25 bp, Artificial Sequence
  Description of Artificial Sequence: Synthetic oligonucleotide
ctcccgggagtgcgtggsctttgag

SEQ ID NO: 179276 - DNA, 25 bp, Artificial Sequence
  Description of Artificial Sequence: Synthetic oligonucleotide
tcccgggagtgcgtggsctttgagg

SEQ ID NO: 179277 - DNA, 24 bp, Artificial Sequence
  Description of Artificial Sequence: Synthetic oligonucleotide
cccgggagtgcgtggsctttgagg

SEQ ID NO: 179278 - DNA, 25 bp, Artificial Sequence
  Description of Artificial Sequence: Synthetic oligonucleotide
ccgggagtgcgtggsctttgaggct

SEQ ID NO: 179279 - DNA, 26 bp, Artificial Sequence
  Description of Artificial Sequence: Synthetic oligonucleotide
cgggagtgcgtggsctttgaggctgt

SEQ ID NO: 179280 - DNA, 26 bp, Artificial Sequence
  Description of Artificial Sequence: Synthetic oligonucleotide
gggagtgcgtggsctttgaggctgtg

SEQ ID NO: 179281 - DNA, 27 bp, Artificial Sequence
  Description of Artificial Sequence: Synthetic oligonucleotide
ggagtgcgtggsctttgaggctgtgca

SEQ ID NO: 179282 - DNA, 27 bp, Artificial Sequence
  Description of Artificial Sequence: Synthetic oligonucleotide
gagtgcgtggsctttgaggctgtgcag

SEQ ID NO: 179283 - DNA, 28 bp, Artificial Sequence
  Description of Artificial Sequence: Synthetic oligonucleotide
agtgcgtggsctttgaggctgtgcagga

SEQ ID NO: 179284 - DNA, 28 bp, Artificial Sequence
  Description of Artificial Sequence: Synthetic oligonucleotide
gtgcgtggsctttgaggctgtgcaggaa

SEQ ID NO: 179285 - DNA, 28 bp, Artificial Sequence
  Description of Artificial Sequence: Synthetic oligonucleotide
tgcgtggsctttgaggctgtgcaggaag

SEQ ID NO: 179286 - DNA, 28 bp, Artificial Sequence
  Description of Artificial Sequence: Synthetic oligonucleotide
gcgtggsctttgaggctgtgcaggaagt

SEQ ID NO: 179287 - DNA, 28 bp, Artificial Sequence
  Description of Artificial Sequence: Synthetic oligonucleotide
cgtggsctttgaggctgtgcaggaagtg

SEQ ID NO: 179288 - DNA, 28 bp, Artificial Sequence
  Description of Artificial Sequence: Synthetic oligonucleotide
gtggsctttgaggctgtgcaggaagtgc

SEQ ID NO: 179289 - DNA, 28 bp, Artificial Sequence
  Description of Artificial Sequence: Synthetic oligonucleotide
tggsctttgaggctgtgcaggaagtgcc

SEQ ID NO: 179290 - DNA, 27 bp, Artificial Sequence
  Description of Artificial Sequence: Synthetic oligonucleotide
ggsctttgaggctgtgcaggaagtgcc

SEQ ID NO: 179291 - DNA, 27 bp, Artificial Sequence
  Description of Artificial Sequence: Synthetic oligonucleotide
gsctttgaggctgtgcaggaagtgccg

SEQ ID NO: 179292 - DNA, 28 bp, Artificial Sequence
  Description of Artificial Sequence: Synthetic oligonucleotide
sctttgaggctgtgcaggaagtgccggt

SEQ ID NO: 179293 - DNA, 21 bp, Artificial Sequence
  Description of Artificial Sequence: Synthetic oligonucleotide
ggctggtgcagccggccagck

SEQ ID NO: 179294 - DNA, 23 bp, Artificial Sequence
  Description of Artificial Sequence: Synthetic oligonucleotide
gctggtgcagccggccagckcaa

SEQ ID NO: 179295 - DNA, 23 bp, Artificial Sequence
  Description of Artificial Sequence: Synthetic oligonucleotide
ctggtgcagccggccagckcaac

SEQ ID NO: 179296 - DNA, 23 bp, Artificial Sequence
  Description of Artificial Sequence: Synthetic oligonucleotide
tggtgcagccggccagckcaacc

SEQ ID NO: 179297 - DNA, 22 bp, Artificial Sequence
  Description of Artificial Sequence: Synthetic oligonucleotide
ggtgcagccggccagckcaacc

SEQ ID NO: 179298 - DNA, 23 bp, Artificial Sequence
  Description of Artificial Sequence: Synthetic oligonucleotide
gtgcagccggccagckcaaccct

SEQ ID NO: 179299 - DNA, 25 bp, Artificial Sequence
  Description of Artificial Sequence: Synthetic oligonucleotide
tgcagccggccagckcaaccctgta

SEQ ID NO: 179300 - DNA, 24 bp, Artificial Sequence
  Description of Artificial Sequence: Synthetic oligonucleotide
gcagccggccagckcaaccctgta

SEQ ID NO: 179301 - DNA, 24 bp, Artificial Sequence
  Description of Artificial Sequence: Synthetic oligonucleotide
cagccggccagckcaaccctgtac

SEQ ID NO: 179302 - DNA, 25 bp, Artificial Sequence
  Description of Artificial Sequence: Synthetic oligonucleotide
agccggccagckcaaccctgtacga

SEQ ID NO: 179303 - DNA, 24 bp, Artificial Sequence
  Description of Artificial Sequence: Synthetic oligonucleotide
gccggccagckcaaccctgtacga

SEQ ID NO: 179304 - DNA, 26 bp, Artificial Sequence
  Description of Artificial Sequence: Synthetic oligonucleotide
ccggccagckcaaccctgtacgacta

SEQ ID NO: 179305 - DNA, 28 bp, Artificial Sequence
  Description of Artificial Sequence: Synthetic oligonucleotide
cggccagckcaaccctgtacgactacta

SEQ ID NO: 179306 - DNA, 28 bp, Artificial Sequence
  Description of Artificial Sequence: Synthetic oligonucleotide
ggccagckcaaccctgtacgactactac

SEQ ID NO: 179307 - DNA, 30 bp, Artificial Sequence
  Description of Artificial Sequence: Synthetic oligonucleotide
gccagckcaaccctgtacgactactacaac

SEQ ID NO: 179308 - DNA, 30 bp, Artificial Sequence
  Description of Artificial Sequence: Synthetic oligonucleotide
ccagckcaaccctgtacgactactacaacc

SEQ ID NO: 179309 - DNA, 30 bp, Artificial Sequence
  Description of Artificial Sequence: Synthetic oligonucleotide
cagckcaaccctgtacgactactacaaccc

SEQ ID NO: 179310 - DNA, 30 bp, Artificial Sequence
  Description of Artificial Sequence: Synthetic oligonucleotide
agckcaaccctgtacgactactacaacccc

SEQ ID NO: 179311 - DNA, 29 bp, Artificial Sequence
  Description of Artificial Sequence: Synthetic oligonucleotide
gckcaaccctgtacgactactacaacccc

SEQ ID NO: 179312 - DNA, 29 bp, Artificial Sequence
  Description of Artificial Sequence: Synthetic oligonucleotide
ckcaaccctgtacgactactacaaccccg

SEQ ID NO: 179313 - DNA, 30 bp, Artificial Sequence
  Description of Artificial Sequence: Synthetic oligonucleotide
kcaaccctgtacgactactacaaccccgac

SEQ ID NO: 179314 - DNA, 29 bp, Artificial Sequence
  Description of Artificial Sequence: Synthetic oligonucleotide
caaccctgtacgactactacaaccccgac

SEQ ID NO: 179315 - DNA, 29 bp, Artificial Sequence
  Description of Artificial Sequence: Synthetic oligonucleotide
aaccctgtacgactactacaaccccgacg

SEQ ID NO: 179316 - DNA, 28 bp, Artificial Sequence
  Description of Artificial Sequence: Synthetic oligonucleotide
accctgtacgactactacaaccccgacg

SEQ ID NO: 179317 - DNA, 27 bp, Artificial Sequence
  Description of Artificial Sequence: Synthetic oligonucleotide
ccctgtacgactactacaaccccgacg

SEQ ID NO: 179318 - DNA, 27 bp, Artificial Sequence
  Description of Artificial Sequence: Synthetic oligonucleotide
cctgtacgactactacaaccccgacgc

SEQ ID NO: 179319 - DNA, 28 bp, Artificial Sequence
  Description of Artificial Sequence: Synthetic oligonucleotide
ctgtacgactactacaaccccgacgcag

SEQ ID NO: 179320 - DNA, 30 bp, Artificial Sequence
  Description of Artificial Sequence: Synthetic oligonucleotide
tgtacgactactacaaccccgacgcagatg

SEQ ID NO: 179321 - DNA, 29 bp, Artificial Sequence
  Description of Artificial Sequence: Synthetic oligonucleotide
gtacgactactacaaccccgacgcagatg

SEQ ID NO: 179322 - DNA, 31 bp, Artificial Sequence
  Description of Artificial Sequence: Synthetic oligonucleotide
tacgactactacaaccccgacgcagatgttc

SEQ ID NO: 179323 - DNA, 30 bp, Artificial Sequence
  Description of Artificial Sequence: Synthetic oligonucleotide
acgactactacaaccccgacgcagatgttc

SEQ ID NO: 179324 - DNA, 29 bp, Artificial Sequence
  Description of Artificial Sequence: Synthetic oligonucleotide
cgactactacaaccccgacgcagatgttc

SEQ ID NO: 179325 - DNA, 30 bp, Artificial Sequence
  Description of Artificial Sequence: Synthetic oligonucleotide
gactactacaaccccgacgcagatgttctg

SEQ ID NO: 179326 - DNA, 31 bp, Artificial Sequence
  Description of Artificial Sequence: Synthetic oligonucleotide
actactacaaccccgacgcagatgttctgtg

SEQ ID NO: 179327 - DNA, 30 bp, Artificial Sequence
  Description of Artificial Sequence: Synthetic oligonucleotide
ctactacaaccccgacgcagatgttctgtg

SEQ ID NO: 179328 - DNA, 35 bp, Artificial Sequence
  Description of Artificial Sequence: Synthetic oligonucleotide
tactacaaccccgacgcagatgttctgtgttttac

SEQ ID NO: 179329 - DNA, 34 bp, Artificial Sequence
  Description of Artificial Sequence: Synthetic oligonucleotide
actacaaccccgacgcagatgttctgtgttttac

SEQ ID NO: 179330 - DNA, 33 bp, Artificial Sequence
  Description of Artificial Sequence: Synthetic oligonucleotide
ctacaaccccgacgcagatgttctgtgttttac

SEQ ID NO: 179331 - DNA, 33 bp, Artificial Sequence
  Description of Artificial Sequence: Synthetic oligonucleotide
tacaaccccgacgcagatgttctgtgttttacg

SEQ ID NO: 179332 - DNA, 32 bp, Artificial Sequence
  Description of Artificial Sequence: Synthetic oligonucleotide
acaaccccgacgcagatgttctgtgttttacg

SEQ ID NO: 179333 - DNA, 31 bp, Artificial Sequence
  Description of Artificial Sequence: Synthetic oligonucleotide
caaccccgacgcagatgttctgtgttttacg

SEQ ID NO: 179334 - DNA, 31 bp, Artificial Sequence
  Description of Artificial Sequence: Synthetic oligonucleotide
aaccccgacgcagatgttctgtgttttacgg

SEQ ID NO: 179335 - DNA, 30 bp, Artificial Sequence
  Description of Artificial Sequence: Synthetic oligonucleotide
accccgacgcagatgttctgtgttttacgg

SEQ ID NO: 179336 - DNA, 29 bp, Artificial Sequence
  Description of Artificial Sequence: Synthetic oligonucleotide
ccccgacgcagatgttctgtgttttacgg

SEQ ID NO: 179337 - DNA, 29 bp, Artificial Sequence
  Description of Artificial Sequence: Synthetic oligonucleotide
cccgacgcagatgttctgtgttttacggg

SEQ ID NO: 179338 - DNA, 29 bp, Artificial Sequence
  Description of Artificial Sequence: Synthetic oligonucleotide
ccgacgcagatgttctgtgttttacgggg

SEQ ID NO: 179339 - DNA, 29 bp, Artificial Sequence
  Description of Artificial Sequence: Synthetic oligonucleotide
cgacgcagatgttctgtgttttacggggc

SEQ ID NO: 179340 - DNA, 30 bp, Artificial Sequence
  Description of Artificial Sequence: Synthetic oligonucleotide
gacgcagatgttctgtgttttacggggcac

SEQ ID NO: 179341 - DNA, 30 bp, Artificial Sequence
  Description of Artificial Sequence: Synthetic oligonucleotide
acgcagatgttctgtgttttacggggcacc

SEQ ID NO: 179342 - DNA, 24 bp, Artificial Sequence
  Description of Artificial Sequence: Synthetic oligonucleotide
tgaggggaagtgccctcgccagct

SEQ ID NO: 179343 - DNA, 23 bp, Artificial Sequence
  Description of Artificial Sequence: Synthetic oligonucleotide
gaggggaagtgccctcgccagct

SEQ ID NO: 179344 - DNA, 23 bp, Artificial Sequence
  Description of Artificial Sequence: Synthetic oligonucleotide
aggggaagtgccctcgccagctc

SEQ ID NO: 179345 - DNA, 22 bp, Artificial Sequence
  Description of Artificial Sequence: Synthetic oligonucleotide
ggggaagtgccctcgccagctc

SEQ ID NO: 179346 - DNA, 22 bp, Artificial Sequence
  Description of Artificial Sequence: Synthetic oligonucleotide
gggaagtgccctcgccagctcg

SEQ ID NO: 179347 - DNA, 22 bp, Artificial Sequence
  Description of Artificial Sequence: Synthetic oligonucleotide
ggaagtgccctcgccagctcgc

SEQ ID NO: 179348 - DNA, 22 bp, Artificial Sequence
  Description of Artificial Sequence: Synthetic oligonucleotide
gaagtgccctcgccagctcgcg

SEQ ID NO: 179349 - DNA, 22 bp, Artificial Sequence
  Description of Artificial Sequence: Synthetic oligonucleotide
aagtgccctcgccagctcgcgc

SEQ ID NO: 179350 - DNA, 21 bp, Artificial Sequence
  Description of Artificial Sequence: Synthetic oligonucleotide
agtgccctcgccagctcgcgc

SEQ ID NO: 179351 - DNA, 20 bp, Artificial Sequence
  Description of Artificial Sequence: Synthetic oligonucleotide
gtgccctcgccagctcgcgc

SEQ ID NO: 179352 - DNA, 20 bp, Artificial Sequence
  Description of Artificial Sequence: Synthetic oligonucleotide
tgccctcgccagctcgcgcc

SEQ ID NO: 179353 - DNA, 20 bp, Artificial Sequence
  Description of Artificial Sequence: Synthetic oligonucleotide
gccctcgccagctcgcgcct

SEQ ID NO: 179354 - DNA, 20 bp, Artificial Sequence
  Description of Artificial Sequence: Synthetic oligonucleotide
ccctcgccagctcgcgccct

SEQ ID NO: 179355 - DNA, 20 bp, Artificial Sequence
  Description of Artificial Sequence: Synthetic oligonucleotide
cctcgccagctcgcgccctg

SEQ ID NO: 179356 - DNA, 21 bp, Artificial Sequence
  Description of Artificial Sequence: Synthetic oligonucleotide
ctcgccagctcgcgccctgga

SEQ ID NO: 179357 - DNA, 21 bp, Artificial Sequence
  Description of Artificial Sequence: Synthetic oligonucleotide
tcgccagctcgcgccctggag

SEQ ID NO: 179358 - DNA, 20 bp, Artificial Sequence
  Description of Artificial Sequence: Synthetic oligonucleotide
cgccagctcgcgccctggag

SEQ ID NO: 179359 - DNA, 20 bp, Artificial Sequence
  Description of Artificial Sequence: Synthetic oligonucleotide
gccagctcgcgccctggagc

SEQ ID NO: 179360 - DNA, 20 bp, Artificial Sequence
  Description of Artificial Sequence: Synthetic oligonucleotide
ccagctcgcgccctggagcg

SEQ ID NO: 179361 - DNA, 20 bp, Artificial Sequence
  Description of Artificial Sequence: Synthetic oligonucleotide
cagctcgcgccctggagcgg

SEQ ID NO: 179362 - DNA, 20 bp, Artificial Sequence
  Description of Artificial Sequence: Synthetic oligonucleotide
agctcgcgccctggagcggg

SEQ ID NO: 179363 - DNA, 20 bp, Artificial Sequence
  Description of Artificial Sequence: Synthetic oligonucleotide
gctcgcgccctggagcgggt

SEQ ID NO: 179364 - DNA, 20 bp, Artificial Sequence
  Description of Artificial Sequence: Synthetic oligonucleotide
ctcgcgccctggagcggggt

SEQ ID NO: 179365 - DNA, 32 bp, Artificial Sequence
  Description of Artificial Sequence: Synthetic oligonucleotide
aggatggctacaggatgaagtttgcctgcwac

SEQ ID NO: 179366 - DNA, 31 bp, Artificial Sequence
  Description of Artificial Sequence: Synthetic oligonucleotide
ggatggctacaggatgaagtttgcctgcwac

SEQ ID NO: 179367 - DNA, 33 bp, Artificial Sequence
  Description of Artificial Sequence: Synthetic oligonucleotide
gatggctacaggatgaagtttgcctgcwactac

SEQ ID NO: 179368 - DNA, 33 bp, Artificial Sequence
  Description of Artificial Sequence: Synthetic oligonucleotide
atggctacaggatgaagtttgcctgcwactacc

SEQ ID NO: 179369 - DNA, 32 bp, Artificial Sequence
  Description of Artificial Sequence: Synthetic oligonucleotide
tggctacaggatgaagtttgcctgcwactacc

SEQ ID NO: 179370 - DNA, 31 bp, Artificial Sequence
  Description of Artificial Sequence: Synthetic oligonucleotide
ggctacaggatgaagtttgcctgcwactacc

SEQ ID NO: 179371 - DNA, 31 bp, Artificial Sequence
  Description of Artificial Sequence: Synthetic oligonucleotide
gctacaggatgaagtttgcctgcwactaccc

SEQ ID NO: 179372 - DNA, 31 bp, Artificial Sequence
  Description of Artificial Sequence: Synthetic oligonucleotide
ctacaggatgaagtttgcctgcwactacccc

SEQ ID NO: 179373 - DNA, 31 bp, Artificial Sequence
  Description of Artificial Sequence: Synthetic oligonucleotide
tacaggatgaagtttgcctgcwactaccccc

SEQ ID NO: 179374 - DNA, 30 bp, Artificial Sequence
  Description of Artificial Sequence: Synthetic oligonucleotide
acaggatgaagtttgcctgcwactaccccc

SEQ ID NO: 179375 - DNA, 29 bp, Artificial Sequence
  Description of Artificial Sequence: Synthetic oligonucleotide
caggatgaagtttgcctgcwactaccccc

SEQ ID NO: 179376 - DNA, 29 bp, Artificial Sequence
  Description of Artificial Sequence: Synthetic oligonucleotide
aggatgaagtttgcctgcwactacccccg

SEQ ID NO: 179377 - DNA, 28 bp, Artificial Sequence
  Description of Artificial Sequence: Synthetic oligonucleotide
ggatgaagtttgcctgcwactacccccg

SEQ ID NO: 179378 - DNA, 29 bp, Artificial Sequence
  Description of Artificial Sequence: Synthetic oligonucleotide
gatgaagtttgcctgcwactacccccgtg

SEQ ID NO: 179379 - DNA, 30 bp, Artificial Sequence
  Description of Artificial Sequence: Synthetic oligonucleotide
atgaagtttgcctgcwactacccccgtgtg

SEQ ID NO: 179380 - DNA, 29 bp, Artificial Sequence
  Description of Artificial Sequence: Synthetic oligonucleotide
tgaagtttgcctgcwactacccccgtgtg

SEQ ID NO: 179381 - DNA, 28 bp, Artificial Sequence
  Description of Artificial Sequence: Synthetic oligonucleotide
gaagtttgcctgcwactacccccgtgtg

SEQ ID NO: 179382 - DNA, 28 bp, Artificial Sequence
  Description of Artificial Sequence: Synthetic oligonucleotide
aagtttgcctgcwactacccccgtgtgg

SEQ ID NO: 179383 - DNA, 28 bp, Artificial Sequence
  Description of Artificial Sequence: Synthetic oligonucleotide
agtttgcctgcwactacccccgtgtgga

SEQ ID NO: 179384 - DNA, 27 bp, Artificial Sequence
  Description of Artificial Sequence: Synthetic oligonucleotide
gtttgcctgcwactacccccgtgtgga

SEQ ID NO: 179385 - DNA, 28 bp, Artificial Sequence
  Description of Artificial Sequence: Synthetic oligonucleotide
tttgcctgcwactacccccgtgtggagt

SEQ ID NO: 179386 - DNA, 28 bp, Artificial Sequence
  Description of Artificial Sequence: Synthetic oligonucleotide
ttgcctgcwactacccccgtgtggagta

SEQ ID NO: 179387 - DNA, 27 bp, Artificial Sequence
  Description of Artificial Sequence: Synthetic oligonucleotide
tgcctgcwactacccccgtgtggagta

SEQ ID NO: 179388 - DNA, 26 bp, Artificial Sequence
  Description of Artificial Sequence: Synthetic oligonucleotide
gcctgcwactacccccgtgtggagta

SEQ ID NO: 179389 - DNA, 26 bp, Artificial Sequence
  Description of Artificial Sequence: Synthetic oligonucleotide
cctgcwactacccccgtgtggagtac

SEQ ID NO: 179390 - DNA, 26 bp, Artificial Sequence
  Description of Artificial Sequence: Synthetic oligonucleotide
ctgcwactacccccgtgtggagtacg

SEQ ID NO: 179391 - DNA, 26 bp, Artificial Sequence
  Description of Artificial Sequence: Synthetic oligonucleotide
tgcwactacccccgtgtggagtacgg

SEQ ID NO: 179392 - DNA, 25 bp, Artificial Sequence
  Description of Artificial Sequence: Synthetic oligonucleotide
gcwactacccccgtgtggagtacgg

SEQ ID NO: 179393 - DNA, 27 bp, Artificial Sequence
  Description of Artificial Sequence: Synthetic oligonucleotide
cwactacccccgtgtggagtacggctt

SEQ ID NO: 179394 - DNA, 27 bp, Artificial Sequence
  Description of Artificial Sequence: Synthetic oligonucleotide
wactacccccgtgtggagtacggcttc

SEQ ID NO: 179395 - DNA, 26 bp, Artificial Sequence
  Description of Artificial Sequence: Synthetic oligonucleotide
cacctatgacctcgagggacacccca

SEQ ID NO: 179396 - DNA, 27 bp, Artificial Sequence
  Description of Artificial Sequence: Synthetic oligonucleotide
acctatgacctcgagggacaccccagt

SEQ ID NO: 179397 - DNA, 27 bp, Artificial Sequence
  Description of Artificial Sequence: Synthetic oligonucleotide
cctatgacctcgagggacaccccagta

SEQ ID NO: 179398 - DNA, 27 bp, Artificial Sequence
  Description of Artificial Sequence: Synthetic oligonucleotide
ctatgacctcgagggacaccccagtac

SEQ ID NO: 179399 - DNA, 27 bp, Artificial Sequence
  Description of Artificial Sequence: Synthetic oligonucleotide
tatgacctcgagggacaccccagtacc

SEQ ID NO: 179400 - DNA, 27 bp, Artificial Sequence
  Description of Artificial Sequence: Synthetic oligonucleotide
atgacctcgagggacaccccagtacct

SEQ ID NO: 179401 - DNA, 26 bp, Artificial Sequence
  Description of Artificial Sequence: Synthetic oligonucleotide
tgacctcgagggacaccccagtacct

SEQ ID NO: 179402 - DNA, 25 bp, Artificial Sequence
  Description of Artificial Sequence: Synthetic oligonucleotide
gacctcgagggacaccccagtacct

SEQ ID NO: 179403 - DNA, 25 bp, Artificial Sequence
  Description of Artificial Sequence: Synthetic oligonucleotide
acctcgagggacaccccagtacctg

SEQ ID NO: 179404 - DNA, 24 bp, Artificial Sequence
  Description of Artificial Sequence: Synthetic oligonucleotide
cctcgagggacaccccagtacctg

SEQ ID NO: 179405 - DNA, 25 bp, Artificial Sequence
  Description of Artificial Sequence: Synthetic oligonucleotide
ctcgagggacaccccagtacctgct

SEQ ID NO: 179406 - DNA, 25 bp, Artificial Sequence
  Description of Artificial Sequence: Synthetic oligonucleotide
tcgagggacaccccagtacctgctg

SEQ ID NO: 179407 - DNA, 24 bp, Artificial Sequence
  Description of Artificial Sequence: Synthetic oligonucleotide
cgagggacaccccagtacctgctg

SEQ ID NO: 179408 - DNA, 25 bp, Artificial Sequence
  Description of Artificial Sequence: Synthetic oligonucleotide
gagggacaccccagtacctgctgga

SEQ ID NO: 179409 - DNA, 26 bp, Artificial Sequence
  Description of Artificial Sequence: Synthetic oligonucleotide
agggacaccccagtacctgctggact

SEQ ID NO: 179410 - DNA, 25 bp, Artificial Sequence
  Description of Artificial Sequence: Synthetic oligonucleotide
gggacaccccagtacctgctggact

SEQ ID NO: 179411 - DNA, 25 bp, Artificial Sequence
  Description of Artificial Sequence: Synthetic oligonucleotide
ggacaccccagtacctgctggactc

SEQ ID NO: 179412 - DNA, 27 bp, Artificial Sequence
  Description of Artificial Sequence: Synthetic oligonucleotide
gacaccccagtacctgctggactcgaa

SEQ ID NO: 179413 - DNA, 29 bp, Artificial Sequence
  Description of Artificial Sequence: Synthetic oligonucleotide
acaccccagtacctgctggactcgaatag

SEQ ID NO: 179414 - DNA, 28 bp, Artificial Sequence
  Description of Artificial Sequence: Synthetic oligonucleotide
caccccagtacctgctggactcgaatag

SEQ ID NO: 179415 - DNA, 28 bp, Artificial Sequence
  Description of Artificial Sequence: Synthetic oligonucleotide
accccagtacctgctggactcgaatagc

SEQ ID NO: 179416 - DNA, 21 bp, Artificial Sequence
  Description of Artificial Sequence: Synthetic oligonucleotide
agcacccgccagcgggcagct

SEQ ID NO: 179417 - DNA, 21 bp, Artificial Sequence
  Description of Artificial Sequence: Synthetic oligonucleotide
cacccgccagcgggcagctgt

SEQ ID NO: 179418 - DNA, 21 bp, Artificial Sequence
  Description of Artificial Sequence: Synthetic oligonucleotide
acccgccagcgggcagctgtg

SEQ ID NO: 179419 - DNA, 20 bp, Artificial Sequence
  Description of Artificial Sequence: Synthetic oligonucleotide
cccgccagcgggcagctgtg

SEQ ID NO: 179420 - DNA, 20 bp, Artificial Sequence
  Description of Artificial Sequence: Synthetic oligonucleotide
ccgccagcgggcagctgtgc

SEQ ID NO: 179421 - DNA, 20 bp, Artificial Sequence
  Description of Artificial Sequence: Synthetic oligonucleotide
cgccagcgggcagctgtgcc

SEQ ID NO: 179422 - DNA, 21 bp, Artificial Sequence
  Description of Artificial Sequence: Synthetic oligonucleotide
gccagcgggcagctgtgccca

SEQ ID NO: 179423 - DNA, 21 bp, Artificial Sequence
  Description of Artificial Sequence: Synthetic oligonucleotide
ccagcgggcagctgtgcccag

SEQ ID NO: 179424 - DNA, 22 bp, Artificial Sequence
  Description of Artificial Sequence: Synthetic oligonucleotide
cagcgggcagctgtgcccagct

SEQ ID NO: 179425 - DNA, 24 bp, Artificial Sequence
  Description of Artificial Sequence: Synthetic oligonucleotide
agcgggcagctgtgcccagctcaa

SEQ ID NO: 179426 - DNA, 23 bp, Artificial Sequence
  Description of Artificial Sequence: Synthetic oligonucleotide
gcgggcagctgtgcccagctcaa

SEQ ID NO: 179427 - DNA, 23 bp, Artificial Sequence
  Description of Artificial Sequence: Synthetic oligonucleotide
cgggcagctgtgcccagctcaac

SEQ ID NO: 179428 - DNA, 24 bp, Artificial Sequence
  Description of Artificial Sequence: Synthetic oligonucleotide
gggcagctgtgcccagctcaacga

SEQ ID NO: 179429 - DNA, 26 bp, Artificial Sequence
  Description of Artificial Sequence: Synthetic oligonucleotide
ggcagctgtgcccagctcaacgactt

SEQ ID NO: 179430 - DNA, 26 bp, Artificial Sequence
  Description of Artificial Sequence: Synthetic oligonucleotide
gcagctgtgcccagctcaacgacttc

SEQ ID NO: 179431 - DNA, 27 bp, Artificial Sequence
  Description of Artificial Sequence: Synthetic oligonucleotide
cagctgtgcccagctcaacgacttcct

SEQ ID NO: 179432 - DNA, 27 bp, Artificial Sequence
  Description of Artificial Sequence: Synthetic oligonucleotide
agctgtgcccagctcaacgacttcctc

SEQ ID NO: 179433 - DNA, 26 bp, Artificial Sequence
  Description of Artificial Sequence: Synthetic oligonucleotide
gctgtgcccagctcaacgacttcctc

SEQ ID NO: 179434 - DNA, 32 bp, Artificial Sequence
  Description of Artificial Sequence: Synthetic oligonucleotide
atggccagcgagttcaagaagaagctcttctg

SEQ ID NO: 179435 - DNA, 31 bp, Artificial Sequence
  Description of Artificial Sequence: Synthetic oligonucleotide
tggccagcgagttcaagaagaagctcttctg

SEQ ID NO: 179436 - DNA, 30 bp, Artificial Sequence
  Description of Artificial Sequence: Synthetic oligonucleotide
ggccagcgagttcaagaagaagctcttctg

SEQ ID NO: 179437 - DNA, 30 bp, Artificial Sequence
  Description of Artificial Sequence: Synthetic oligonucleotide
gccagcgagttcaagaagaagctcttctgg

SEQ ID NO: 179438 - DNA, 31 bp, Artificial Sequence
  Description of Artificial Sequence: Synthetic oligonucleotide
ccagcgagttcaagaagaagctcttctggag

SEQ ID NO: 179439 - DNA, 31 bp, Artificial Sequence
  Description of Artificial Sequence: Synthetic oligonucleotide
cagcgagttcaagaagaagctcttctggagg

SEQ ID NO: 179440 - DNA, 31 bp, Artificial Sequence
  Description of Artificial Sequence: Synthetic oligonucleotide
agcgagttcaagaagaagctcttctggaggg

SEQ ID NO: 179441 - DNA, 30 bp, Artificial Sequence
  Description of Artificial Sequence: Synthetic oligonucleotide
gcgagttcaagaagaagctcttctggaggg

SEQ ID NO: 179442 - DNA, 30 bp, Artificial Sequence
  Description of Artificial Sequence: Synthetic oligonucleotide
cgagttcaagaagaagctcttctggagggc

SEQ ID NO: 179443 - DNA, 31 bp, Artificial Sequence
  Description of Artificial Sequence: Synthetic oligonucleotide
gagttcaagaagaagctcttctggagggcag

SEQ ID NO: 179444 - DNA, 32 bp, Artificial Sequence
  Description of Artificial Sequence: Synthetic oligonucleotide
agttcaagaagaagctcttctggagggcagtg

SEQ ID NO: 179445 - DNA, 31 bp, Artificial Sequence
  Description of Artificial Sequence: Synthetic oligonucleotide
gttcaagaagaagctcttctggagggcagtg

SEQ ID NO: 179446 - DNA, 31 bp, Artificial Sequence
  Description of Artificial Sequence: Synthetic oligonucleotide
ttcaagaagaagctcttctggagggcagtgg

SEQ ID NO: 179447 - DNA, 30 bp, Artificial Sequence
  Description of Artificial Sequence: Synthetic oligonucleotide
tcaagaagaagctcttctggagggcagtgg

SEQ ID NO: 179448 - DNA, 29 bp, Artificial Sequence
  Description of Artificial Sequence: Synthetic oligonucleotide
caagaagaagctcttctggagggcagtgg

SEQ ID NO: 179449 - DNA, 30 bp, Artificial Sequence
  Description of Artificial Sequence: Synthetic oligonucleotide
aagaagaagctcttctggagggcagtggtg

SEQ ID NO: 179450 - DNA, 29 bp, Artificial Sequence
  Description of Artificial Sequence: Synthetic oligonucleotide
agaagaagctcttctggagggcagtggtg

SEQ ID NO: 179451 - DNA, 28 bp, Artificial Sequence
  Description of Artificial Sequence: Synthetic oligonucleotide
gaagaagctcttctggagggcagtggtg

SEQ ID NO: 179452 - DNA, 28 bp, Artificial Sequence
  Description of Artificial Sequence: Synthetic oligonucleotide
aagaagctcttctggagggcagtggtgg

SEQ ID NO: 179453 - DNA, 27 bp, Artificial Sequence
  Description of Artificial Sequence: Synthetic oligonucleotide
agaagctcttctggagggcagtggtgg

SEQ ID NO: 179454 - DNA, 26 bp, Artificial Sequence
  Description of Artificial Sequence: Synthetic oligonucleotide
gaagctcttctggagggcagtggtgg

SEQ ID NO: 179455 - DNA, 26 bp, Artificial Sequence
  Description of Artificial Sequence: Synthetic oligonucleotide
aagctcttctggagggcagtggtggc

SEQ ID NO: 179456 - DNA, 25 bp, Artificial Sequence
  Description of Artificial Sequence: Synthetic oligonucleotide
agctcttctggagggcagtggtggc

SEQ ID NO: 179457 - DNA, 24 bp, Artificial Sequence
  Description of Artificial Sequence: Synthetic oligonucleotide
gctcttctggagggcagtggtggc

SEQ ID NO: 179458 - DNA, 24 bp, Artificial Sequence
  Description of Artificial Sequence: Synthetic oligonucleotide
ctcttctggagggcagtggtggcc

SEQ ID NO: 179459 - DNA, 25 bp, Artificial Sequence
  Description of Artificial Sequence: Synthetic oligonucleotide
tcttctggagggcagtggtggccga

SEQ ID NO: 179460 - DNA, 24 bp, Artificial Sequence
  Description of Artificial Sequence: Synthetic oligonucleotide
cttctggagggcagtggtggccga

SEQ ID NO: 179461 - DNA, 26 bp, Artificial Sequence
  Description of Artificial Sequence: Synthetic oligonucleotide
ttctggagggcagtggtggccgagtt

SEQ ID NO: 179462 - DNA, 25 bp, Artificial Sequence
  Description of Artificial Sequence: Synthetic oligonucleotide
tctggagggcagtggtggccgagtt

SEQ ID NO: 179463 - DNA, 24 bp, Artificial Sequence
  Description of Artificial Sequence: Synthetic oligonucleotide
ctggagggcagtggtggccgagtt

SEQ ID NO: 179464 - DNA, 24 bp, Artificial Sequence
  Description of Artificial Sequence: Synthetic oligonucleotide
tggagggcagtggtggccgagttc

SEQ ID NO: 179465 - DNA, 23 bp, Artificial Sequence
  Description of Artificial Sequence: Synthetic oligonucleotide
ggagggcagtggtggccgagttc

SEQ ID NO: 179466 - DNA, 24 bp, Artificial Sequence
  Description of Artificial Sequence: Synthetic oligonucleotide
gagggcagtggtggccgagttcct

SEQ ID NO: 179467 - DNA, 24 bp, Artificial Sequence
  Description of Artificial Sequence: Synthetic oligonucleotide
agggcagtggtggccgagttcctg

SEQ ID NO: 179468 - DNA, 23 bp, Artificial Sequence
  Description of Artificial Sequence: Synthetic oligonucleotide
gggcagtggtggccgagttcctg

SEQ ID NO: 179469 - DNA, 23 bp, Artificial Sequence
  Description of Artificial Sequence: Synthetic oligonucleotide
ggcagtggtggccgagttcctgg

SEQ ID NO: 179470 - DNA, 23 bp, Artificial Sequence
  Description of Artificial Sequence: Synthetic oligonucleotide
gcagtggtggccgagttcctggc

SEQ ID NO: 179471 - DNA, 24 bp, Artificial Sequence
  Description of Artificial Sequence: Synthetic oligonucleotide
cagtggtggccgagttcctggcca

SEQ ID NO: 179472 - DNA, 24 bp, Artificial Sequence
  Description of Artificial Sequence: Synthetic oligonucleotide
agtggtggccgagttcctggccac

SEQ ID NO: 179473 - DNA, 23 bp, Artificial Sequence
  Description of Artificial Sequence: Synthetic oligonucleotide
gtggtggccgagttcctggccac

SEQ ID NO: 179474 - DNA, 24 bp, Artificial Sequence
  Description of Artificial Sequence: Synthetic oligonucleotide
tggtggccgagttcctggccacga

SEQ ID NO: 179475 - DNA, 23 bp, Artificial Sequence
  Description of Artificial Sequence: Synthetic oligonucleotide
ggtggccgagttcctggccacga

SEQ ID NO: 179476 - DNA, 23 bp, Artificial Sequence
  Description of Artificial Sequence: Synthetic oligonucleotide
gtggccgagttcctggccacgac

SEQ ID NO: 179477 - DNA, 23 bp, Artificial Sequence
  Description of Artificial Sequence: Synthetic oligonucleotide
tggccgagttcctggccacgacc

SEQ ID NO: 179478 - DNA, 22 bp, Artificial Sequence
  Description of Artificial Sequence: Synthetic oligonucleotide
ggccgagttcctggccacgacc

SEQ ID NO: 179479 - DNA, 23 bp, Artificial Sequence
  Description of Artificial Sequence: Synthetic oligonucleotide
gccgagttcctggccacgaccct

SEQ ID NO: 179480 - DNA, 26 bp, Artificial Sequence
  Description of Artificial Sequence: Synthetic oligonucleotide
ccgagttcctggccacgaccctcttt

SEQ ID NO: 179481 - DNA, 27 bp, Artificial Sequence
  Description of Artificial Sequence: Synthetic oligonucleotide
cgagttcctggccacgaccctctttgt

SEQ ID NO: 179482 - DNA, 27 bp, Artificial Sequence
  Description of Artificial Sequence: Synthetic oligonucleotide
gagttcctggccacgaccctctttgtc

SEQ ID NO: 179483 - DNA, 29 bp, Artificial Sequence
  Description of Artificial Sequence: Synthetic oligonucleotide
agttcctggccacgaccctctttgtcttc

SEQ ID NO: 179484 - DNA, 28 bp, Artificial Sequence
  Description of Artificial Sequence: Synthetic oligonucleotide
gttcctggccacgaccctctttgtcttc

SEQ ID NO: 179485 - DNA, 30 bp, Artificial Sequence
  Description of Artificial Sequence: Synthetic oligonucleotide
ttcctggccacgaccctctttgtcttcatc

SEQ ID NO: 179486 - DNA, 29 bp, Artificial Sequence
  Description of Artificial Sequence: Synthetic oligonucleotide
tcctggccacgaccctctttgtcttcatc

SEQ ID NO: 179487 - DNA, 28 bp, Artificial Sequence
  Description of Artificial Sequence: Synthetic oligonucleotide
cctggccacgaccctctttgtcttcatc

SEQ ID NO: 179488 - DNA, 29 bp, Artificial Sequence
  Description of Artificial Sequence: Synthetic oligonucleotide
ctggccacgaccctctttgtcttcatcag

SEQ ID NO: 179489 - DNA, 29 bp, Artificial Sequence
  Description of Artificial Sequence: Synthetic oligonucleotide
tggccacgaccctctttgtcttcatcagc

SEQ ID NO: 179490 - DNA, 28 bp, Artificial Sequence
  Description of Artificial Sequence: Synthetic oligonucleotide
ggccacgaccctctttgtcttcatcagc

SEQ ID NO: 179491 - DNA, 30 bp, Artificial Sequence
  Description of Artificial Sequence: Synthetic oligonucleotide
gccacgaccctctttgtcttcatcagcatc

SEQ ID NO: 179492 - DNA, 30 bp, Artificial Sequence
  Description of Artificial Sequence: Synthetic oligonucleotide
ccacgaccctctttgtcttcatcagcatcg

SEQ ID NO: 179493 - DNA, 30 bp, Artificial Sequence
  Description of Artificial Sequence: Synthetic oligonucleotide
cacgaccctctttgtcttcatcagcatcgg

SEQ ID NO: 179494 - DNA, 32 bp, Artificial Sequence
  Description of Artificial Sequence: Synthetic oligonucleotide
acgaccctctttgtcttcatcagcatcggttc

SEQ ID NO: 179495 - DNA, 31 bp, Artificial Sequence
  Description of Artificial Sequence: Synthetic oligonucleotide
cgaccctctttgtcttcatcagcatcggttc

SEQ ID NO: 179496 - DNA, 32 bp, Artificial Sequence
  Description of Artificial Sequence: Synthetic oligonucleotide
gaccctctttgtcttcatcagcatcggttctg

SEQ ID NO: 179497 - DNA, 32 bp, Artificial Sequence
  Description of Artificial Sequence: Synthetic oligonucleotide
accctctttgtcttcatcagcatcggttctgc

SEQ ID NO: 179498 - DNA, 31 bp, Artificial Sequence
  Description of Artificial Sequence: Synthetic oligonucleotide
ccctctttgtcttcatcagcatcggttctgc

SEQ ID NO: 179499 - DNA, 31 bp, Artificial Sequence
  Description of Artificial Sequence: Synthetic oligonucleotide
cctctttgtcttcatcagcatcggttctgcc

SEQ ID NO: 179500 - DNA, 31 bp, Artificial Sequence
  Description of Artificial Sequence: Synthetic oligonucleotide
ctctttgtcttcatcagcatcggttctgccc

SEQ ID NO: 179501 - DNA, 32 bp, Artificial Sequence
  Description of Artificial Sequence: Synthetic oligonucleotide
tctttgtcttcatcagcatcggttctgccctg

SEQ ID NO: 179502 - DNA, 31 bp, Artificial Sequence
  Description of Artificial Sequence: Synthetic oligonucleotide
ctttgtcttcatcagcatcggttctgccctg

SEQ ID NO: 179503 - DNA, 31 bp, Artificial Sequence
  Description of Artificial Sequence: Synthetic oligonucleotide
tttgtcttcatcagcatcggttctgccctgg

SEQ ID NO: 179504 - DNA, 30 bp, Artificial Sequence
  Description of Artificial Sequence: Synthetic oligonucleotide
ttgtcttcatcagcatcggttctgccctgg

SEQ ID NO: 179505 - DNA, 29 bp, Artificial Sequence
  Description of Artificial Sequence: Synthetic oligonucleotide
tgtcttcatcagcatcggttctgccctgg

SEQ ID NO: 179506 - DNA, 28 bp, Artificial Sequence
  Description of Artificial Sequence: Synthetic oligonucleotide
gtcttcatcagcatcggttctgccctgg

SEQ ID NO: 179507 - DNA, 28 bp, Artificial Sequence
  Description of Artificial Sequence: Synthetic oligonucleotide
tcttcatcagcatcggttctgccctggg

SEQ ID NO: 179508 - DNA, 27 bp, Artificial Sequence
  Description of Artificial Sequence: Synthetic oligonucleotide
cttcatcagcatcggttctgccctggg

SEQ ID NO: 179509 - DNA, 27 bp, Artificial Sequence
  Description of Artificial Sequence: Synthetic oligonucleotide
ttcatcagcatcggttctgccctgggc

SEQ ID NO: 179510 - DNA, 27 bp, Artificial Sequence
  Description of Artificial Sequence: Synthetic oligonucleotide
tcatcagcatcggttctgccctgggct

SEQ ID NO: 179511 - DNA, 27 bp, Artificial Sequence
  Description of Artificial Sequence: Synthetic oligonucleotide
catcagcatcggttctgccctgggctt

SEQ ID NO: 179512 - DNA, 27 bp, Artificial Sequence
  Description of Artificial Sequence: Synthetic oligonucleotide
atcagcatcggttctgccctgggcttc

SEQ ID NO: 179513 - DNA, 27 bp, Artificial Sequence
  Description of Artificial Sequence: Synthetic oligonucleotide
tcagcatcggttctgccctgggcttca

SEQ ID NO: 179514 - DNA, 27 bp, Artificial Sequence
  Description of Artificial Sequence: Synthetic oligonucleotide
cagcatcggttctgccctgggcttcaa

SEQ ID NO: 179515 - DNA, 30 bp, Artificial Sequence
  Description of Artificial Sequence: Synthetic oligonucleotide
agcatcggttctgccctgggcttcaaatac

SEQ ID NO: 179516 - DNA, 29 bp, Artificial Sequence
  Description of Artificial Sequence: Synthetic oligonucleotide
gcatcggttctgccctgggcttcaaatac

SEQ ID NO: 179517 - DNA, 29 bp, Artificial Sequence
  Description of Artificial Sequence: Synthetic oligonucleotide
catcggttctgccctgggcttcaaatacc

SEQ ID NO: 179518 - DNA, 29 bp, Artificial Sequence
  Description of Artificial Sequence: Synthetic oligonucleotide
atcggttctgccctgggcttcaaataccc

SEQ ID NO: 179519 - DNA, 28 bp, Artificial Sequence
  Description of Artificial Sequence: Synthetic oligonucleotide
tcggttctgccctgggcttcaaataccc

SEQ ID NO: 179520 - DNA, 27 bp, Artificial Sequence
  Description of Artificial Sequence: Synthetic oligonucleotide
cggttctgccctgggcttcaaataccc

SEQ ID NO: 179521 - DNA, 27 bp, Artificial Sequence
  Description of Artificial Sequence: Synthetic oligonucleotide
ggttctgccctgggcttcaaatacccg

SEQ ID NO: 179522 - DNA, 27 bp, Artificial Sequence
  Description of Artificial Sequence: Synthetic oligonucleotide
gttctgccctgggcttcaaatacccgg

SEQ ID NO: 179523 - DNA, 28 bp, Artificial Sequence
  Description of Artificial Sequence: Synthetic oligonucleotide
ttctgccctgggcttcaaatacccggtg

SEQ ID NO: 179524 - DNA, 27 bp, Artificial Sequence
  Description of Artificial Sequence: Synthetic oligonucleotide
tctgccctgggcttcaaatacccggtg

SEQ ID NO: 179525 - DNA, 26 bp, Artificial Sequence
  Description of Artificial Sequence: Synthetic oligonucleotide
ctgccctgggcttcaaatacccggtg

SEQ ID NO: 179526 - DNA, 26 bp, Artificial Sequence
  Description of Artificial Sequence: Synthetic oligonucleotide
tgccctgggcttcaaatacccggtgg

SEQ ID NO: 179527 - DNA, 25 bp, Artificial Sequence
  Description of Artificial Sequence: Synthetic oligonucleotide
gccctgggcttcaaatacccggtgg

SEQ ID NO: 179528 - DNA, 25 bp, Artificial Sequence
  Description of Artificial Sequence: Synthetic oligonucleotide
ccctgggcttcaaatacccggtggg

SEQ ID NO: 179529 - DNA, 27 bp, Artificial Sequence
  Description of Artificial Sequence: Synthetic oligonucleotide
cctgggcttcaaatacccggtggggaa

SEQ ID NO: 179530 - DNA, 27 bp, Artificial Sequence
  Description of Artificial Sequence: Synthetic oligonucleotide
ctgggcttcaaatacccggtggggaac

SEQ ID NO: 179531 - DNA, 29 bp, Artificial Sequence
  Description of Artificial Sequence: Synthetic oligonucleotide
tgggcttcaaatacccggtggggaacaac

SEQ ID NO: 179532 - DNA, 28 bp, Artificial Sequence
  Description of Artificial Sequence: Synthetic oligonucleotide
gggcttcaaatacccggtggggaacaac

SEQ ID NO: 179533 - DNA, 28 bp, Artificial Sequence
  Description of Artificial Sequence: Synthetic oligonucleotide
ggcttcaaatacccggtggggaacaacc

SEQ ID NO: 179534 - DNA, 29 bp, Artificial Sequence
  Description of Artificial Sequence: Synthetic oligonucleotide
gcttcaaatacccggtggggaacaaccag

SEQ ID NO: 179535 - DNA, 30 bp, Artificial Sequence
  Description of Artificial Sequence: Synthetic oligonucleotide
cttcaaatacccggtggggaacaaccagac

SEQ ID NO: 179536 - DNA, 30 bp, Artificial Sequence
  Description of Artificial Sequence: Synthetic oligonucleotide
ttcaaatacccggtggggaacaaccagacg

SEQ ID NO: 179537 - DNA, 29 bp, Artificial Sequence
  Description of Artificial Sequence: Synthetic oligonucleotide
tcaaatacccggtggggaacaaccagacg

SEQ ID NO: 179538 - DNA, 28 bp, Artificial Sequence
  Description of Artificial Sequence: Synthetic oligonucleotide
caaatacccggtggggaacaaccagacg

SEQ ID NO: 179539 - DNA, 28 bp, Artificial Sequence
  Description of Artificial Sequence: Synthetic oligonucleotide
aaatacccggtggggaacaaccagacgg

SEQ ID NO: 179540 - DNA, 27 bp, Artificial Sequence
  Description of Artificial Sequence: Synthetic oligonucleotide
aatacccggtggggaacaaccagacgg

SEQ ID NO: 179541 - DNA, 26 bp, Artificial Sequence
  Description of Artificial Sequence: Synthetic oligonucleotide
atacccggtggggaacaaccagacgg

SEQ ID NO: 179542 - DNA, 25 bp, Artificial Sequence
  Description of Artificial Sequence: Synthetic oligonucleotide
tacccggtggggaacaaccagacgg

SEQ ID NO: 179543 - DNA, 24 bp, Artificial Sequence
  Description of Artificial Sequence: Synthetic oligonucleotide
acccggtggggaacaaccagacgg

SEQ ID NO: 179544 - DNA, 23 bp, Artificial Sequence
  Description of Artificial Sequence: Synthetic oligonucleotide
cccggtggggaacaaccagacgg

SEQ ID NO: 179545 - DNA, 23 bp, Artificial Sequence
  Description of Artificial Sequence: Synthetic oligonucleotide
ccggtggggaacaaccagacggc

SEQ ID NO: 179546 - DNA, 23 bp, Artificial Sequence
  Description of Artificial Sequence: Synthetic oligonucleotide
cggtggggaacaaccagacggcg

SEQ ID NO: 179547 - DNA, 24 bp, Artificial Sequence
  Description of Artificial Sequence: Synthetic oligonucleotide
ggtggggaacaaccagacggcggt

SEQ ID NO: 179548 - DNA, 24 bp, Artificial Sequence
  Description of Artificial Sequence: Synthetic oligonucleotide
gtggggaacaaccagacggcggtc

SEQ ID NO: 179549 - DNA, 25 bp, Artificial Sequence
  Description of Artificial Sequence: Synthetic oligonucleotide
tggggaacaaccagacggcggtcca

SEQ ID NO: 179550 - DNA, 24 bp, Artificial Sequence
  Description of Artificial Sequence: Synthetic oligonucleotide
ggggaacaaccagacggcggtcca

SEQ ID NO: 179551 - DNA, 24 bp, Artificial Sequence
  Description of Artificial Sequence: Synthetic oligonucleotide
gggaacaaccagacggcggtccag

SEQ ID NO: 179552 - DNA, 25 bp, Artificial Sequence
  Description of Artificial Sequence: Synthetic oligonucleotide
ggaacaaccagacggcggtccagga

SEQ ID NO: 179553 - DNA, 27 bp, Artificial Sequence
  Description of Artificial Sequence: Synthetic oligonucleotide
gaacaaccagacggcggtccaggacaa

SEQ ID NO: 179554 - DNA, 27 bp, Artificial Sequence
  Description of Artificial Sequence: Synthetic oligonucleotide
aacaaccagacggcggtccaggacaac

SEQ ID NO: 179555 - DNA, 26 bp, Artificial Sequence
  Description of Artificial Sequence: Synthetic oligonucleotide
acaaccagacggcggtccaggacaac

SEQ ID NO: 179556 - DNA, 25 bp, Artificial Sequence
  Description of Artificial Sequence: Synthetic oligonucleotide
caaccagacggcggtccaggacaac

SEQ ID NO: 179557 - DNA, 26 bp, Artificial Sequence
  Description of Artificial Sequence: Synthetic oligonucleotide
aaccagacggcggtccaggacaacgt

SEQ ID NO: 179558 - DNA, 25 bp, Artificial Sequence
  Description of Artificial Sequence: Synthetic oligonucleotide
accagacggcggtccaggacaacgt

SEQ ID NO: 179559 - DNA, 24 bp, Artificial Sequence
  Description of Artificial Sequence: Synthetic oligonucleotide
ccagacggcggtccaggacaacgt

SEQ ID NO: 179560 - DNA, 26 bp, Artificial Sequence
  Description of Artificial Sequence: Synthetic oligonucleotide
cagacggcggtccaggacaacgtgaa

SEQ ID NO: 179561 - DNA, 26 bp, Artificial Sequence
  Description of Artificial Sequence: Synthetic oligonucleotide
agacggcggtccaggacaacgtgaag

SEQ ID NO: 179562 - DNA, 25 bp, Artificial Sequence
  Description of Artificial Sequence: Synthetic oligonucleotide
gacggcggtccaggacaacgtgaag

SEQ ID NO: 179563 - DNA, 26 bp, Artificial Sequence
  Description of Artificial Sequence: Synthetic oligonucleotide
acggcggtccaggacaacgtgaaggt

SEQ ID NO: 179564 - DNA, 25 bp, Artificial Sequence
  Description of Artificial Sequence: Synthetic oligonucleotide
cggcggtccaggacaacgtgaaggt

SEQ ID NO: 179565 - DNA, 26 bp, Artificial Sequence
  Description of Artificial Sequence: Synthetic oligonucleotide
ggcggtccaggacaacgtgaaggtgt

SEQ ID NO: 179566 - DNA, 26 bp, Artificial Sequence
  Description of Artificial Sequence: Synthetic oligonucleotide
gcggtccaggacaacgtgaaggtgtc

SEQ ID NO: 179567 - DNA, 26 bp, Artificial Sequence
  Description of Artificial Sequence: Synthetic oligonucleotide
cggtccaggacaacgtgaaggtgtcg

SEQ ID NO: 179568 - DNA, 27 bp, Artificial Sequence
  Description of Artificial Sequence: Synthetic oligonucleotide
ggtccaggacaacgtgaaggtgtcgct

SEQ ID NO: 179569 - DNA, 27 bp, Artificial Sequence
  Description of Artificial Sequence: Synthetic oligonucleotide
gtccaggacaacgtgaaggtgtcgctg

SEQ ID NO: 179570 - DNA, 27 bp, Artificial Sequence
  Description of Artificial Sequence: Synthetic oligonucleotide
tccaggacaacgtgaaggtgtcgctgg

SEQ ID NO: 179571 - DNA, 26 bp, Artificial Sequence
  Description of Artificial Sequence: Synthetic oligonucleotide
ccaggacaacgtgaaggtgtcgctgg

SEQ ID NO: 179572 - DNA, 26 bp, Artificial Sequence
  Description of Artificial Sequence: Synthetic oligonucleotide
caggacaacgtgaaggtgtcgctggc

SEQ ID NO: 179573 - DNA, 27 bp, Artificial Sequence
  Description of Artificial Sequence: Synthetic oligonucleotide
aggacaacgtgaaggtgtcgctggcct

SEQ ID NO: 179574 - DNA, 27 bp, Artificial Sequence
  Description of Artificial Sequence: Synthetic oligonucleotide
ggacaacgtgaaggtgtcgctggcctt

SEQ ID NO: 179575 - DNA, 27 bp, Artificial Sequence
  Description of Artificial Sequence: Synthetic oligonucleotide
gacaacgtgaaggtgtcgctggccttc

SEQ ID NO: 179576 - DNA, 27 bp, Artificial Sequence
  Description of Artificial Sequence: Synthetic oligonucleotide
acaacgtgaaggtgtcgctggccttcg

SEQ ID NO: 179577 - DNA, 26 bp, Artificial Sequence
  Description of Artificial Sequence: Synthetic oligonucleotide
caacgtgaaggtgtcgctggccttcg

SEQ ID NO: 179578 - DNA, 26 bp, Artificial Sequence
  Description of Artificial Sequence: Synthetic oligonucleotide
aacgtgaaggtgtcgctggccttcgg

SEQ ID NO: 179579 - DNA, 25 bp, Artificial Sequence
  Description of Artificial Sequence: Synthetic oligonucleotide
acgtgaaggtgtcgctggccttcgg

SEQ ID NO: 179580 - DNA, 24 bp, Artificial Sequence
  Description of Artificial Sequence: Synthetic oligonucleotide
cgtgaaggtgtcgctggccttcgg

SEQ ID NO: 179581 - DNA, 24 bp, Artificial Sequence
  Description of Artificial Sequence: Synthetic oligonucleotide
gtgaaggtgtcgctggccttcggg

SEQ ID NO: 179582 - DNA, 25 bp, Artificial Sequence
  Description of Artificial Sequence: Synthetic oligonucleotide
tgaaggtgtcgctggccttcgggct

SEQ ID NO: 179583 - DNA, 24 bp, Artificial Sequence
  Description of Artificial Sequence: Synthetic oligonucleotide
gaaggtgtcgctggccttcgggct

SEQ ID NO: 179584 - DNA, 25 bp, Artificial Sequence
  Description of Artificial Sequence: Synthetic oligonucleotide
aaggtgtcgctggccttcgggctga

SEQ ID NO: 179585 - DNA, 24 bp, Artificial Sequence
  Description of Artificial Sequence: Synthetic oligonucleotide
aggtgtcgctggccttcgggctga

SEQ ID NO: 179586 - DNA, 23 bp, Artificial Sequence
  Description of Artificial Sequence: Synthetic oligonucleotide
ggtgtcgctggccttcgggctga

SEQ ID NO: 179587 - DNA, 23 bp, Artificial Sequence
  Description of Artificial Sequence: Synthetic oligonucleotide
gtgtcgctggccttcgggctgag

SEQ ID NO: 179588 - DNA, 25 bp, Artificial Sequence
  Description of Artificial Sequence: Synthetic oligonucleotide
tgtcgctggccttcgggctgagcat

SEQ ID NO: 179589 - DNA, 24 bp, Artificial Sequence
  Description of Artificial Sequence: Synthetic oligonucleotide
gtcgctggccttcgggctgagcat

SEQ ID NO: 179590 - DNA, 24 bp, Artificial Sequence
  Description of Artificial Sequence: Synthetic oligonucleotide
tcgctggccttcgggctgagcatc

SEQ ID NO: 179591 - DNA, 23 bp, Artificial Sequence
  Description of Artificial Sequence: Synthetic oligonucleotide
cgctggccttcgggctgagcatc

SEQ ID NO: 179592 - DNA, 23 bp, Artificial Sequence
  Description of Artificial Sequence: Synthetic oligonucleotide
gctggccttcgggctgagcatcg

SEQ ID NO: 179593 - DNA, 23 bp, Artificial Sequence
  Description of Artificial Sequence: Synthetic oligonucleotide
ctggccttcgggctgagcatcgc

SEQ ID NO: 179594 - DNA, 24 bp, Artificial Sequence
  Description of Artificial Sequence: Synthetic oligonucleotide
tggccttcgggctgagcatcgcca

SEQ ID NO: 179595 - DNA, 23 bp, Artificial Sequence
  Description of Artificial Sequence: Synthetic oligonucleotide
ggccttcgggctgagcatcgcca

SEQ ID NO: 179596 - DNA, 23 bp, Artificial Sequence
  Description of Artificial Sequence: Synthetic oligonucleotide
gccttcgggctgagcatcgccac

SEQ ID NO: 179597 - DNA, 23 bp, Artificial Sequence
  Description of Artificial Sequence: Synthetic oligonucleotide
ccttcgggctgagcatcgccacg

SEQ ID NO: 179598 - DNA, 24 bp, Artificial Sequence
  Description of Artificial Sequence: Synthetic oligonucleotide
cttcgggctgagcatcgccacgct

SEQ ID NO: 179599 - DNA, 24 bp, Artificial Sequence
  Description of Artificial Sequence: Synthetic oligonucleotide
ttcgggctgagcatcgccacgctg

SEQ ID NO: 179600 - DNA, 23 bp, Artificial Sequence
  Description of Artificial Sequence: Synthetic oligonucleotide
tcgggctgagcatcgccacgctg

SEQ ID NO: 179601 - DNA, 22 bp, Artificial Sequence
  Description of Artificial Sequence: Synthetic oligonucleotide
cgggctgagcatcgccacgctg

SEQ ID NO: 179602 - DNA, 22 bp, Artificial Sequence
  Description of Artificial Sequence: Synthetic oligonucleotide
gggctgagcatcgccacgctgg

SEQ ID NO: 179603 - DNA, 22 bp, Artificial Sequence
  Description of Artificial Sequence: Synthetic oligonucleotide
ggctgagcatcgccacgctggc

SEQ ID NO: 179604 - DNA, 22 bp, Artificial Sequence
  Description of Artificial Sequence: Synthetic oligonucleotide
gctgagcatcgccacgctggcg

SEQ ID NO: 179605 - DNA, 23 bp, Artificial Sequence
  Description of Artificial Sequence: Synthetic oligonucleotide
ctgagcatcgccacgctggcgca

SEQ ID NO: 179606 - DNA, 24 bp, Artificial Sequence
  Description of Artificial Sequence: Synthetic oligonucleotide
tgagcatcgccacgctggcgcaga

SEQ ID NO: 179607 - DNA, 23 bp, Artificial Sequence
  Description of Artificial Sequence: Synthetic oligonucleotide
gagcatcgccacgctggcgcaga

SEQ ID NO: 179608 - DNA, 24 bp, Artificial Sequence
  Description of Artificial Sequence: Synthetic oligonucleotide
agcatcgccacgctggcgcagagt

SEQ ID NO: 179609 - DNA, 23 bp, Artificial Sequence
  Description of Artificial Sequence: Synthetic oligonucleotide
gcatcgccacgctggcgcagagt

SEQ ID NO: 179610 - DNA, 24 bp, Artificial Sequence
  Description of Artificial Sequence: Synthetic oligonucleotide
catcgccacgctggcgcagagtgt

SEQ ID NO: 179611 - DNA, 24 bp, Artificial Sequence
  Description of Artificial Sequence: Synthetic oligonucleotide
atcgccacgctggcgcagagtgtg

SEQ ID NO: 179612 - DNA, 23 bp, Artificial Sequence
  Description of Artificial Sequence: Synthetic oligonucleotide
tcgccacgctggcgcagagtgtg

SEQ ID NO: 179613 - DNA, 22 bp, Artificial Sequence
  Description of Artificial Sequence: Synthetic oligonucleotide
cgccacgctggcgcagagtgtg

SEQ ID NO: 179614 - DNA, 22 bp, Artificial Sequence
  Description of Artificial Sequence: Synthetic oligonucleotide
gccacgctggcgcagagtgtgg

SEQ ID NO: 179615 - DNA, 22 bp, Artificial Sequence
  Description of Artificial Sequence: Synthetic oligonucleotide
ccacgctggcgcagagtgtggg

SEQ ID NO: 179616 - DNA, 22 bp, Artificial Sequence
  Description of Artificial Sequence: Synthetic oligonucleotide
cacgctggcgcagagtgtgggc

SEQ ID NO: 179617 - DNA, 23 bp, Artificial Sequence
  Description of Artificial Sequence: Synthetic oligonucleotide
acgctggcgcagagtgtgggcca

SEQ ID NO: 179618 - DNA, 22 bp, Artificial Sequence
  Description of Artificial Sequence: Synthetic oligonucleotide
cgctggcgcagagtgtgggcca

SEQ ID NO: 179619 - DNA, 24 bp, Artificial Sequence
  Description of Artificial Sequence: Synthetic oligonucleotide
gctggcgcagagtgtgggccacat

SEQ ID NO: 179620 - DNA, 25 bp, Artificial Sequence
  Description of Artificial Sequence: Synthetic oligonucleotide
ctggcgcagagtgtgggccacatca

SEQ ID NO: 179621 - DNA, 25 bp, Artificial Sequence
  Description of Artificial Sequence: Synthetic oligonucleotide
tggcgcagagtgtgggccacatcag

SEQ ID NO: 179622 - DNA, 24 bp, Artificial Sequence
  Description of Artificial Sequence: Synthetic oligonucleotide
ggcgcagagtgtgggccacatcag

SEQ ID NO: 179623 - DNA, 24 bp, Artificial Sequence
  Description of Artificial Sequence: Synthetic oligonucleotide
gcgcagagtgtgggccacatcagc

SEQ ID NO: 179624 - DNA, 24 bp, Artificial Sequence
  Description of Artificial Sequence: Synthetic oligonucleotide
cgcagagtgtgggccacatcagcg

SEQ ID NO: 179625 - DNA, 24 bp, Artificial Sequence
  Description of Artificial Sequence: Synthetic oligonucleotide
gcagagtgtgggccacatcagcgg

SEQ ID NO: 179626 - DNA, 24 bp, Artificial Sequence
  Description of Artificial Sequence: Synthetic oligonucleotide
cagagtgtgggccacatcagcggc

SEQ ID NO: 179627 - DNA, 24 bp, Artificial Sequence
  Description of Artificial Sequence: Synthetic oligonucleotide
agagtgtgggccacatcagcggcg

SEQ ID NO: 179628 - DNA, 23 bp, Artificial Sequence
  Description of Artificial Sequence: Synthetic oligonucleotide
gagtgtgggccacatcagcggcg

SEQ ID NO: 179629 - DNA, 23 bp, Artificial Sequence
  Description of Artificial Sequence: Synthetic oligonucleotide
agtgtgggccacatcagcggcgc

SEQ ID NO: 179630 - DNA, 22 bp, Artificial Sequence
  Description of Artificial Sequence: Synthetic oligonucleotide
gtgtgggccacatcagcggcgc

SEQ ID NO: 179631 - DNA, 22 bp, Artificial Sequence
  Description of Artificial Sequence: Synthetic oligonucleotide
tgtgggccacatcagcggcgcc

SEQ ID NO: 179632 - DNA, 21 bp, Artificial Sequence
  Description of Artificial Sequence: Synthetic oligonucleotide
gtgggccacatcagcggcgcc

SEQ ID NO: 179633 - DNA, 22 bp, Artificial Sequence
  Description of Artificial Sequence: Synthetic oligonucleotide
tgggccacatcagcggcgccca

SEQ ID NO: 179634 - DNA, 21 bp, Artificial Sequence
  Description of Artificial Sequence: Synthetic oligonucleotide
gggccacatcagcggcgccca

SEQ ID NO: 179635 - DNA, 21 bp, Artificial Sequence
  Description of Artificial Sequence: Synthetic oligonucleotide
ggccacatcagcggcgcccac

SEQ ID NO: 179636 - DNA, 22 bp, Artificial Sequence
  Description of Artificial Sequence: Synthetic oligonucleotide
gccacatcagcggcgcccacct

SEQ ID NO: 179637 - DNA, 24 bp, Artificial Sequence
  Description of Artificial Sequence: Synthetic oligonucleotide
ccacatcagcggcgcccacctcaa

SEQ ID NO: 179638 - DNA, 24 bp, Artificial Sequence
  Description of Artificial Sequence: Synthetic oligonucleotide
cacatcagcggcgcccacctcaac

SEQ ID NO: 179639 - DNA, 24 bp, Artificial Sequence
  Description of Artificial Sequence: Synthetic oligonucleotide
acatcagcggcgcccacctcaacc

SEQ ID NO: 179640 - DNA, 23 bp, Artificial Sequence
  Description of Artificial Sequence: Synthetic oligonucleotide
catcagcggcgcccacctcaacc

SEQ ID NO: 179641 - DNA, 23 bp, Artificial Sequence
  Description of Artificial Sequence: Synthetic oligonucleotide
atcagcggcgcccacctcaaccc

SEQ ID NO: 179642 - DNA, 22 bp, Artificial Sequence
  Description of Artificial Sequence: Synthetic oligonucleotide
tcagcggcgcccacctcaaccc

SEQ ID NO: 179643 - DNA, 21 bp, Artificial Sequence
  Description of Artificial Sequence: Synthetic oligonucleotide
cagcggcgcccacctcaaccc

SEQ ID NO: 179644 - DNA, 21 bp, Artificial Sequence
  Description of Artificial Sequence: Synthetic oligonucleotide
agcggcgcccacctcaacccg

SEQ ID NO: 179645 - DNA, 20 bp, Artificial Sequence
  Description of Artificial Sequence: Synthetic oligonucleotide
gcggcgcccacctcaacccg

SEQ ID NO: 179646 - DNA, 20 bp, Artificial Sequence
  Description of Artificial Sequence: Synthetic oligonucleotide
cggcgcccacctcaacccgg

SEQ ID NO: 179647 - DNA, 21 bp, Artificial Sequence
  Description of Artificial Sequence: Synthetic oligonucleotide
ggcgcccacctcaacccggct

SEQ ID NO: 179648 - DNA, 22 bp, Artificial Sequence
  Description of Artificial Sequence: Synthetic oligonucleotide
gcgcccacctcaacccggctgt

SEQ ID NO: 179649 - DNA, 23 bp, Artificial Sequence
  Description of Artificial Sequence: Synthetic oligonucleotide
cgcccacctcaacccggctgtca

SEQ ID NO: 179650 - DNA, 24 bp, Artificial Sequence
  Description of Artificial Sequence: Synthetic oligonucleotide
gcccacctcaacccggctgtcaca

SEQ ID NO: 179651 - DNA, 25 bp, Artificial Sequence
  Description of Artificial Sequence: Synthetic oligonucleotide
cccacctcaacccggctgtcacact

SEQ ID NO: 179652 - DNA, 25 bp, Artificial Sequence
  Description of Artificial Sequence: Synthetic oligonucleotide
ccacctcaacccggctgtcacactg

SEQ ID NO: 179653 - DNA, 25 bp, Artificial Sequence
  Description of Artificial Sequence: Synthetic oligonucleotide
cacctcaacccggctgtcacactgg

SEQ ID NO: 179654 - DNA, 25 bp, Artificial Sequence
  Description of Artificial Sequence: Synthetic oligonucleotide
acctcaacccggctgtcacactggg

SEQ ID NO: 179655 - DNA, 24 bp, Artificial Sequence
  Description of Artificial Sequence: Synthetic oligonucleotide
cctcaacccggctgtcacactggg

SEQ ID NO: 179656 - DNA, 24 bp, Artificial Sequence
  Description of Artificial Sequence: Synthetic oligonucleotide
ctcaacccggctgtcacactgggg

SEQ ID NO: 179657 - DNA, 25 bp, Artificial Sequence
  Description of Artificial Sequence: Synthetic oligonucleotide
tcaacccggctgtcacactggggct

SEQ ID NO: 179658 - DNA, 24 bp, Artificial Sequence
  Description of Artificial Sequence: Synthetic oligonucleotide
caacccggctgtcacactggggct

SEQ ID NO: 179659 - DNA, 24 bp, Artificial Sequence
  Description of Artificial Sequence: Synthetic oligonucleotide
aacccggctgtcacactggggctg

SEQ ID NO: 179660 - DNA, 23 bp, Artificial Sequence
  Description of Artificial Sequence: Synthetic oligonucleotide
acccggctgtcacactggggctg

SEQ ID NO: 179661 - DNA, 22 bp, Artificial Sequence
  Description of Artificial Sequence: Synthetic oligonucleotide
cccggctgtcacactggggctg

SEQ ID NO: 179662 - DNA, 23 bp, Artificial Sequence
  Description of Artificial Sequence: Synthetic oligonucleotide
ccggctgtcacactggggctgct

SEQ ID NO: 179663 - DNA, 23 bp, Artificial Sequence
  Description of Artificial Sequence: Synthetic oligonucleotide
cggctgtcacactggggctgctg

SEQ ID NO: 179664 - DNA, 24 bp, Artificial Sequence
  Description of Artificial Sequence: Synthetic oligonucleotide
ggctgtcacactggggctgctgct

SEQ ID NO: 179665 - DNA, 25 bp, Artificial Sequence
  Description of Artificial Sequence: Synthetic oligonucleotide
gctgtcacactggggctgctgctca

SEQ ID NO: 179666 - DNA, 25 bp, Artificial Sequence
  Description of Artificial Sequence: Synthetic oligonucleotide
ctgtcacactggggctgctgctcag

SEQ ID NO: 179667 - DNA, 26 bp, Artificial Sequence
  Description of Artificial Sequence: Synthetic oligonucleotide
tgtcacactggggctgctgctcagct

SEQ ID NO: 179668 - DNA, 25 bp, Artificial Sequence
  Description of Artificial Sequence: Synthetic oligonucleotide
gtcacactggggctgctgctcagct

SEQ ID NO: 179669 - DNA, 25 bp, Artificial Sequence
  Description of Artificial Sequence: Synthetic oligonucleotide
tcacactggggctgctgctcagctg

SEQ ID NO: 179670 - DNA, 24 bp, Artificial Sequence
  Description of Artificial Sequence: Synthetic oligonucleotide
cacactggggctgctgctcagctg

SEQ ID NO: 179671 - DNA, 24 bp, Artificial Sequence
  Description of Artificial Sequence: Synthetic oligonucleotide
acactggggctgctgctcagctgc

SEQ ID NO: 179672 - DNA, 23 bp, Artificial Sequence
  Description of Artificial Sequence: Synthetic oligonucleotide
cactggggctgctgctcagctgc

SEQ ID NO: 179673 - DNA, 24 bp, Artificial Sequence
  Description of Artificial Sequence: Synthetic oligonucleotide
actggggctgctgctcagctgcca

SEQ ID NO: 179674 - DNA, 23 bp, Artificial Sequence
  Description of Artificial Sequence: Synthetic oligonucleotide
ctggggctgctgctcagctgcca

SEQ ID NO: 179675 - DNA, 25 bp, Artificial Sequence
  Description of Artificial Sequence: Synthetic oligonucleotide
tggggctgctgctcagctgccagat

SEQ ID NO: 179676 - DNA, 24 bp, Artificial Sequence
  Description of Artificial Sequence: Synthetic oligonucleotide
ggggctgctgctcagctgccagat

SEQ ID NO: 179677 - DNA, 25 bp, Artificial Sequence
  Description of Artificial Sequence: Synthetic oligonucleotide
gggctgctgctcagctgccagatca

SEQ ID NO: 179678 - DNA, 25 bp, Artificial Sequence
  Description of Artificial Sequence: Synthetic oligonucleotide
ggctgctgctcagctgccagatcag

SEQ ID NO: 179679 - DNA, 27 bp, Artificial Sequence
  Description of Artificial Sequence: Synthetic oligonucleotide
gctgctgctcagctgccagatcagcat

SEQ ID NO: 179680 - DNA, 27 bp, Artificial Sequence
  Description of Artificial Sequence: Synthetic oligonucleotide
ctgctgctcagctgccagatcagcatc

SEQ ID NO: 179681 - DNA, 29 bp, Artificial Sequence
  Description of Artificial Sequence: Synthetic oligonucleotide
tgctgctcagctgccagatcagcatcttc

SEQ ID NO: 179682 - DNA, 28 bp, Artificial Sequence
  Description of Artificial Sequence: Synthetic oligonucleotide
gctgctcagctgccagatcagcatcttc

SEQ ID NO: 179683 - DNA, 28 bp, Artificial Sequence
  Description of Artificial Sequence: Synthetic oligonucleotide
ctgctcagctgccagatcagcatcttcc

SEQ ID NO: 179684 - DNA, 28 bp, Artificial Sequence
  Description of Artificial Sequence: Synthetic oligonucleotide
tgctcagctgccagatcagcatcttccg

SEQ ID NO: 179685 - DNA, 27 bp, Artificial Sequence
  Description of Artificial Sequence: Synthetic oligonucleotide
gctcagctgccagatcagcatcttccg

SEQ ID NO: 179686 - DNA, 28 bp, Artificial Sequence
  Description of Artificial Sequence: Synthetic oligonucleotide
ctcagctgccagatcagcatcttccgtg

SEQ ID NO: 179687 - DNA, 28 bp, Artificial Sequence
  Description of Artificial Sequence: Synthetic oligonucleotide
tcagctgccagatcagcatcttccgtgc

SEQ ID NO: 179688 - DNA, 27 bp, Artificial Sequence
  Description of Artificial Sequence: Synthetic oligonucleotide
cagctgccagatcagcatcttccgtgc

SEQ ID NO: 179689 - DNA, 27 bp, Artificial Sequence
  Description of Artificial Sequence: Synthetic oligonucleotide
agctgccagatcagcatcttccgtgcc

SEQ ID NO: 179690 - DNA, 26 bp, Artificial Sequence
  Description of Artificial Sequence: Synthetic oligonucleotide
gctgccagatcagcatcttccgtgcc

SEQ ID NO: 179691 - DNA, 27 bp, Artificial Sequence
  Description of Artificial Sequence: Synthetic oligonucleotide
ctgccagatcagcatcttccgtgccct

SEQ ID NO: 179692 - DNA, 27 bp, Artificial Sequence
  Description of Artificial Sequence: Synthetic oligonucleotide
tgccagatcagcatcttccgtgccctc

SEQ ID NO: 179693 - DNA, 27 bp, Artificial Sequence
  Description of Artificial Sequence: Synthetic oligonucleotide
gccagatcagcatcttccgtgccctca

SEQ ID NO: 179694 - DNA, 28 bp, Artificial Sequence
  Description of Artificial Sequence: Synthetic oligonucleotide
ccagatcagcatcttccgtgccctcatg

SEQ ID NO: 179695 - DNA, 30 bp, Artificial Sequence
  Description of Artificial Sequence: Synthetic oligonucleotide
cagatcagcatcttccgtgccctcatgtac

SEQ ID NO: 179696 - DNA, 32 bp, Artificial Sequence
  Description of Artificial Sequence: Synthetic oligonucleotide
agatcagcatcttccgtgccctcatgtacatc

SEQ ID NO: 179697 - DNA, 31 bp, Artificial Sequence
  Description of Artificial Sequence: Synthetic oligonucleotide
gatcagcatcttccgtgccctcatgtacatc

SEQ ID NO: 179698 - DNA, 33 bp, Artificial Sequence
  Description of Artificial Sequence: Synthetic oligonucleotide
atcagcatcttccgtgccctcatgtacatcatc

SEQ ID NO: 179699 - DNA, 32 bp, Artificial Sequence
  Description of Artificial Sequence: Synthetic oligonucleotide
tcagcatcttccgtgccctcatgtacatcatc

SEQ ID NO: 179700 - DNA, 31 bp, Artificial Sequence
  Description of Artificial Sequence: Synthetic oligonucleotide
cagcatcttccgtgccctcatgtacatcatc

SEQ ID NO: 179701 - DNA, 31 bp, Artificial Sequence
  Description of Artificial Sequence: Synthetic oligonucleotide
agcatcttccgtgccctcatgtacatcatcg

SEQ ID NO: 179702 - DNA, 30 bp, Artificial Sequence
  Description of Artificial Sequence: Synthetic oligonucleotide
gcatcttccgtgccctcatgtacatcatcg

SEQ ID NO: 179703 - DNA, 30 bp, Artificial Sequence
  Description of Artificial Sequence: Synthetic oligonucleotide
catcttccgtgccctcatgtacatcatcgc

SEQ ID NO: 179704 - DNA, 30 bp, Artificial Sequence
  Description of Artificial Sequence: Synthetic oligonucleotide
atcttccgtgccctcatgtacatcatcgcc

SEQ ID NO: 179705 - DNA, 29 bp, Artificial Sequence
  Description of Artificial Sequence: Synthetic oligonucleotide
tcttccgtgccctcatgtacatcatcgcc

SEQ ID NO: 179706 - DNA, 28 bp, Artificial Sequence
  Description of Artificial Sequence: Synthetic oligonucleotide
cttccgtgccctcatgtacatcatcgcc

SEQ ID NO: 179707 - DNA, 28 bp, Artificial Sequence
  Description of Artificial Sequence: Synthetic oligonucleotide
ttccgtgccctcatgtacatcatcgccc

SEQ ID NO: 179708 - DNA, 27 bp, Artificial Sequence
  Description of Artificial Sequence: Synthetic oligonucleotide
tccgtgccctcatgtacatcatcgccc

SEQ ID NO: 179709 - DNA, 27 bp, Artificial Sequence
  Description of Artificial Sequence: Synthetic oligonucleotide
ccgtgccctcatgtacatcatcgccca

SEQ ID NO: 179710 - DNA, 27 bp, Artificial Sequence
  Description of Artificial Sequence: Synthetic oligonucleotide
cgtgccctcatgtacatcatcgcccag

SEQ ID NO: 179711 - DNA, 28 bp, Artificial Sequence
  Description of Artificial Sequence: Synthetic oligonucleotide
gtgccctcatgtacatcatcgcccagtg

SEQ ID NO: 179712 - DNA, 28 bp, Artificial Sequence
  Description of Artificial Sequence: Synthetic oligonucleotide
tgccctcatgtacatcatcgcccagtgc

SEQ ID NO: 179713 - DNA, 27 bp, Artificial Sequence
  Description of Artificial Sequence: Synthetic oligonucleotide
gccctcatgtacatcatcgcccagtgc

SEQ ID NO: 179714 - DNA, 27 bp, Artificial Sequence
  Description of Artificial Sequence: Synthetic oligonucleotide
ccctcatgtacatcatcgcccagtgcg

SEQ ID NO: 179715 - DNA, 28 bp, Artificial Sequence
  Description of Artificial Sequence: Synthetic oligonucleotide
cctcatgtacatcatcgcccagtgcgtg

SEQ ID NO: 179716 - DNA, 28 bp, Artificial Sequence
  Description of Artificial Sequence: Synthetic oligonucleotide
ctcatgtacatcatcgcccagtgcgtgg

SEQ ID NO: 179717 - DNA, 28 bp, Artificial Sequence
  Description of Artificial Sequence: Synthetic oligonucleotide
tcatgtacatcatcgcccagtgcgtggg

SEQ ID NO: 179718 - DNA, 27 bp, Artificial Sequence
  Description of Artificial Sequence: Synthetic oligonucleotide
catgtacatcatcgcccagtgcgtggg

SEQ ID NO: 179719 - DNA, 27 bp, Artificial Sequence
  Description of Artificial Sequence: Synthetic oligonucleotide
atgtacatcatcgcccagtgcgtgggg

SEQ ID NO: 179720 - DNA, 26 bp, Artificial Sequence
  Description of Artificial Sequence: Synthetic oligonucleotide
tgtacatcatcgcccagtgcgtgggg

SEQ ID NO: 179721 - DNA, 25 bp, Artificial Sequence
  Description of Artificial Sequence: Synthetic oligonucleotide
gtacatcatcgcccagtgcgtgggg

SEQ ID NO: 179722 - DNA, 25 bp, Artificial Sequence
  Description of Artificial Sequence: Synthetic oligonucleotide
tacatcatcgcccagtgcgtggggg

SEQ ID NO: 179723 - DNA, 24 bp, Artificial Sequence
  Description of Artificial Sequence: Synthetic oligonucleotide
acatcatcgcccagtgcgtggggg

SEQ ID NO: 179724 - DNA, 23 bp, Artificial Sequence
  Description of Artificial Sequence: Synthetic oligonucleotide
catcatcgcccagtgcgtggggg

SEQ ID NO: 179725 - DNA, 23 bp, Artificial Sequence
  Description of Artificial Sequence: Synthetic oligonucleotide
atcatcgcccagtgcgtgggggc

SEQ ID NO: 179726 - DNA, 22 bp, Artificial Sequence
  Description of Artificial Sequence: Synthetic oligonucleotide
tcatcgcccagtgcgtgggggc

SEQ ID NO: 179727 - DNA, 21 bp, Artificial Sequence
  Description of Artificial Sequence: Synthetic oligonucleotide
catcgcccagtgcgtgggggc

SEQ ID NO: 179728 - DNA, 23 bp, Artificial Sequence
  Description of Artificial Sequence: Synthetic oligonucleotide
atcgcccagtgcgtgggggccat

SEQ ID NO: 179729 - DNA, 22 bp, Artificial Sequence
  Description of Artificial Sequence: Synthetic oligonucleotide
tcgcccagtgcgtgggggccat

SEQ ID NO: 179730 - DNA, 21 bp, Artificial Sequence
  Description of Artificial Sequence: Synthetic oligonucleotide
cgcccagtgcgtgggggccat

SEQ ID NO: 179731 - DNA, 21 bp, Artificial Sequence
  Description of Artificial Sequence: Synthetic oligonucleotide
gcccagtgcgtgggggccatc

SEQ ID NO: 179732 - DNA, 22 bp, Artificial Sequence
  Description of Artificial Sequence: Synthetic oligonucleotide
cccagtgcgtgggggccatcgt

SEQ ID NO: 179733 - DNA, 22 bp, Artificial Sequence
  Description of Artificial Sequence: Synthetic oligonucleotide
ccagtgcgtgggggccatcgtc

SEQ ID NO: 179734 - DNA, 22 bp, Artificial Sequence
  Description of Artificial Sequence: Synthetic oligonucleotide
cagtgcgtgggggccatcgtcg

SEQ ID NO: 179735 - DNA, 22 bp, Artificial Sequence
  Description of Artificial Sequence: Synthetic oligonucleotide
agtgcgtgggggccatcgtcgc

SEQ ID NO: 179736 - DNA, 21 bp, Artificial Sequence
  Description of Artificial Sequence: Synthetic oligonucleotide
gtgcgtgggggccatcgtcgc

SEQ ID NO: 179737 - DNA, 22 bp, Artificial Sequence
  Description of Artificial Sequence: Synthetic oligonucleotide
tgcgtgggggccatcgtcgcca

SEQ ID NO: 179738 - DNA, 21 bp, Artificial Sequence
  Description of Artificial Sequence: Synthetic oligonucleotide
gcgtgggggccatcgtcgcca

SEQ ID NO: 179739 - DNA, 21 bp, Artificial Sequence
  Description of Artificial Sequence: Synthetic oligonucleotide
cgtgggggccatcgtcgccac

SEQ ID NO: 179740 - DNA, 21 bp, Artificial Sequence
  Description of Artificial Sequence: Synthetic oligonucleotide
gtgggggccatcgtcgccacc

SEQ ID NO: 179741 - DNA, 21 bp, Artificial Sequence
  Description of Artificial Sequence: Synthetic oligonucleotide
tgggggccatcgtcgccaccg

SEQ ID NO: 179742 - DNA, 20 bp, Artificial Sequence
  Description of Artificial Sequence: Synthetic oligonucleotide
gggggccatcgtcgccaccg

SEQ ID NO: 179743 - DNA, 20 bp, Artificial Sequence
  Description of Artificial Sequence: Synthetic oligonucleotide
ggggccatcgtcgccaccgc

SEQ ID NO: 179744 - DNA, 22 bp, Artificial Sequence
  Description of Artificial Sequence: Synthetic oligonucleotide
gggccatcgtcgccaccgccat

SEQ ID NO: 179745 - DNA, 22 bp, Artificial Sequence
  Description of Artificial Sequence: Synthetic oligonucleotide
ggccatcgtcgccaccgccatc

SEQ ID NO: 179746 - DNA, 23 bp, Artificial Sequence
  Description of Artificial Sequence: Synthetic oligonucleotide
gccatcgtcgccaccgccatcct

SEQ ID NO: 179747 - DNA, 24 bp, Artificial Sequence
  Description of Artificial Sequence: Synthetic oligonucleotide
ccatcgtcgccaccgccatcctct

SEQ ID NO: 179748 - DNA, 25 bp, Artificial Sequence
  Description of Artificial Sequence: Synthetic oligonucleotide
catcgtcgccaccgccatcctctca

SEQ ID NO: 179749 - DNA, 25 bp, Artificial Sequence
  Description of Artificial Sequence: Synthetic oligonucleotide
atcgtcgccaccgccatcctctcag

SEQ ID NO: 179750 - DNA, 24 bp, Artificial Sequence
  Description of Artificial Sequence: Synthetic oligonucleotide
tcgtcgccaccgccatcctctcag

SEQ ID NO: 179751 - DNA, 23 bp, Artificial Sequence
  Description of Artificial Sequence: Synthetic oligonucleotide
cgtcgccaccgccatcctctcag

SEQ ID NO: 179752 - DNA, 23 bp, Artificial Sequence
  Description of Artificial Sequence: Synthetic oligonucleotide
gtcgccaccgccatcctctcagg

SEQ ID NO: 179753 - DNA, 25 bp, Artificial Sequence
  Description of Artificial Sequence: Synthetic oligonucleotide
tcgccaccgccatcctctcaggcat

SEQ ID NO: 179754 - DNA, 24 bp, Artificial Sequence
  Description of Artificial Sequence: Synthetic oligonucleotide
cgccaccgccatcctctcaggcat

SEQ ID NO: 179755 - DNA, 25 bp, Artificial Sequence
  Description of Artificial Sequence: Synthetic oligonucleotide
gccaccgccatcctctcaggcatca

SEQ ID NO: 179756 - DNA, 25 bp, Artificial Sequence
  Description of Artificial Sequence: Synthetic oligonucleotide
ccaccgccatcctctcaggcatcac

SEQ ID NO: 179757 - DNA, 26 bp, Artificial Sequence
  Description of Artificial Sequence: Synthetic oligonucleotide
caccgccatcctctcaggcatcacct

SEQ ID NO: 179758 - DNA, 26 bp, Artificial Sequence
  Description of Artificial Sequence: Synthetic oligonucleotide
accgccatcctctcaggcatcacctc

SEQ ID NO: 179759 - DNA, 25 bp, Artificial Sequence
  Description of Artificial Sequence: Synthetic oligonucleotide
ccgccatcctctcaggcatcacctc

SEQ ID NO: 179760 - DNA, 26 bp, Artificial Sequence
  Description of Artificial Sequence: Synthetic oligonucleotide
cgccatcctctcaggcatcacctcct

SEQ ID NO: 179761 - DNA, 26 bp, Artificial Sequence
  Description of Artificial Sequence: Synthetic oligonucleotide
gccatcctctcaggcatcacctcctc

SEQ ID NO: 179762 - DNA, 26 bp, Artificial Sequence
  Description of Artificial Sequence: Synthetic oligonucleotide
ccatcctctcaggcatcacctcctcc

SEQ ID NO: 179763 - DNA, 27 bp, Artificial Sequence
  Description of Artificial Sequence: Synthetic oligonucleotide
catcctctcaggcatcacctcctccct

SEQ ID NO: 179764 - DNA, 27 bp, Artificial Sequence
  Description of Artificial Sequence: Synthetic oligonucleotide
atcctctcaggcatcacctcctccctg

SEQ ID NO: 179765 - DNA, 27 bp, Artificial Sequence
  Description of Artificial Sequence: Synthetic oligonucleotide
tcctctcaggcatcacctcctccctga

SEQ ID NO: 179766 - DNA, 26 bp, Artificial Sequence
  Description of Artificial Sequence: Synthetic oligonucleotide
cctctcaggcatcacctcctccctga

SEQ ID NO: 179767 - DNA, 27 bp, Artificial Sequence
  Description of Artificial Sequence: Synthetic oligonucleotide
ctctcaggcatcacctcctccctgact

SEQ ID NO: 179768 - DNA, 27 bp, Artificial Sequence
  Description of Artificial Sequence: Synthetic oligonucleotide
tctcaggcatcacctcctccctgactg

SEQ ID NO: 179769 - DNA, 26 bp, Artificial Sequence
  Description of Artificial Sequence: Synthetic oligonucleotide
ctcaggcatcacctcctccctgactg

SEQ ID NO: 179770 - DNA, 26 bp, Artificial Sequence
  Description of Artificial Sequence: Synthetic oligonucleotide
tcaggcatcacctcctccctgactgg

SEQ ID NO: 179771 - DNA, 25 bp, Artificial Sequence
  Description of Artificial Sequence: Synthetic oligonucleotide
caggcatcacctcctccctgactgg

SEQ ID NO: 179772 - DNA, 27 bp, Artificial Sequence
  Description of Artificial Sequence: Synthetic oligonucleotide
aggcatcacctcctccctgactgggaa

SEQ ID NO: 179773 - DNA, 26 bp, Artificial Sequence
  Description of Artificial Sequence: Synthetic oligonucleotide
ggcatcacctcctccctgactgggaa

SEQ ID NO: 179774 - DNA, 27 bp, Artificial Sequence
  Description of Artificial Sequence: Synthetic oligonucleotide
gcatcacctcctccctgactgggaact

SEQ ID NO: 179775 - DNA, 27 bp, Artificial Sequence
  Description of Artificial Sequence: Synthetic oligonucleotide
catcacctcctccctgactgggaactc

SEQ ID NO: 179776 - DNA, 27 bp, Artificial Sequence
  Description of Artificial Sequence: Synthetic oligonucleotide
atcacctcctccctgactgggaactcg

SEQ ID NO: 179777 - DNA, 26 bp, Artificial Sequence
  Description of Artificial Sequence: Synthetic oligonucleotide
tcacctcctccctgactgggaactcg

SEQ ID NO: 179778 - DNA, 25 bp, Artificial Sequence
  Description of Artificial Sequence: Synthetic oligonucleotide
cacctcctccctgactgggaactcg

SEQ ID NO: 179779 - DNA, 27 bp, Artificial Sequence
  Description of Artificial Sequence: Synthetic oligonucleotide
acctcctccctgactgggaactcgctt

SEQ ID NO: 179780 - DNA, 26 bp, Artificial Sequence
  Description of Artificial Sequence: Synthetic oligonucleotide
cctcctccctgactgggaactcgctt

SEQ ID NO: 179781 - DNA, 26 bp, Artificial Sequence
  Description of Artificial Sequence: Synthetic oligonucleotide
ctcctccctgactgggaactcgcttg

SEQ ID NO: 179782 - DNA, 26 bp, Artificial Sequence
  Description of Artificial Sequence: Synthetic oligonucleotide
tcctccctgactgggaactcgcttgg

SEQ ID NO: 179783 - DNA, 25 bp, Artificial Sequence
  Description of Artificial Sequence: Synthetic oligonucleotide
cctccctgactgggaactcgcttgg

SEQ ID NO: 179784 - DNA, 25 bp, Artificial Sequence
  Description of Artificial Sequence: Synthetic oligonucleotide
ctccctgactgggaactcgcttggc

SEQ ID NO: 179785 - DNA, 25 bp, Artificial Sequence
  Description of Artificial Sequence: Synthetic oligonucleotide
tccctgactgggaactcgcttggcc

SEQ ID NO: 179786 - DNA, 24 bp, Artificial Sequence
  Description of Artificial Sequence: Synthetic oligonucleotide
ccctgactgggaactcgcttggcc

SEQ ID NO: 179787 - DNA, 24 bp, Artificial Sequence
  Description of Artificial Sequence: Synthetic oligonucleotide
cctgactgggaactcgcttggccg

SEQ ID NO: 179788 - DNA, 27 bp, Artificial Sequence
  Description of Artificial Sequence: Synthetic oligonucleotide
ctgactgggaactcgcttggccgcaat

SEQ ID NO: 179789 - DNA, 27 bp, Artificial Sequence
  Description of Artificial Sequence: Synthetic oligonucleotide
tgactgggaactcgcttggccgcaatg

SEQ ID NO: 179790 - DNA, 27 bp, Artificial Sequence
  Description of Artificial Sequence: Synthetic oligonucleotide
gactgggaactcgcttggccgcaatga

SEQ ID NO: 179791 - DNA, 27 bp, Artificial Sequence
  Description of Artificial Sequence: Synthetic oligonucleotide
actgggaactcgcttggccgcaatgac

SEQ ID NO: 179792 - DNA, 26 bp, Artificial Sequence
  Description of Artificial Sequence: Synthetic oligonucleotide
ctgggaactcgcttggccgcaatgac

SEQ ID NO: 179793 - DNA, 27 bp, Artificial Sequence
  Description of Artificial Sequence: Synthetic oligonucleotide
tgggaactcgcttggccgcaatgacct

SEQ ID NO: 179794 - DNA, 26 bp, Artificial Sequence
  Description of Artificial Sequence: Synthetic oligonucleotide
gggaactcgcttggccgcaatgacct

SEQ ID NO: 179795 - DNA, 26 bp, Artificial Sequence
  Description of Artificial Sequence: Synthetic oligonucleotide
ggaactcgcttggccgcaatgacctg

SEQ ID NO: 179796 - DNA, 26 bp, Artificial Sequence
  Description of Artificial Sequence: Synthetic oligonucleotide
gaactcgcttggccgcaatgacctgg

SEQ ID NO: 179797 - DNA, 27 bp, Artificial Sequence
  Description of Artificial Sequence: Synthetic oligonucleotide
aactcgcttggccgcaatgacctggct

SEQ ID NO: 179798 - DNA, 26 bp, Artificial Sequence
  Description of Artificial Sequence: Synthetic oligonucleotide
actcgcttggccgcaatgacctggct

SEQ ID NO: 179799 - DNA, 25 bp, Artificial Sequence
  Description of Artificial Sequence: Synthetic oligonucleotide
ctcgcttggccgcaatgacctggct

SEQ ID NO: 179800 - DNA, 27 bp, Artificial Sequence
  Description of Artificial Sequence: Synthetic oligonucleotide
tcgcttggccgcaatgacctggctgat

SEQ ID NO: 179801 - DNA, 26 bp, Artificial Sequence
  Description of Artificial Sequence: Synthetic oligonucleotide
cgcttggccgcaatgacctggctgat

SEQ ID NO: 179802 - DNA, 26 bp, Artificial Sequence
  Description of Artificial Sequence: Synthetic oligonucleotide
gcttggccgcaatgacctggctgatg

SEQ ID NO: 179803 - DNA, 27 bp, Artificial Sequence
  Description of Artificial Sequence: Synthetic oligonucleotide
cttggccgcaatgacctggctgatggt

SEQ ID NO: 179804 - DNA, 27 bp, Artificial Sequence
  Description of Artificial Sequence: Synthetic oligonucleotide
ttggccgcaatgacctggctgatggtg

SEQ ID NO: 179805 - DNA, 27 bp, Artificial Sequence
  Description of Artificial Sequence: Synthetic oligonucleotide
tggccgcaatgacctggctgatggtgt

SEQ ID NO: 179806 - DNA, 26 bp, Artificial Sequence
  Description of Artificial Sequence: Synthetic oligonucleotide
ggccgcaatgacctggctgatggtgt

SEQ ID NO: 179807 - DNA, 27 bp, Artificial Sequence
  Description of Artificial Sequence: Synthetic oligonucleotide
gccgcaatgacctggctgatggtgtga

SEQ ID NO: 179808 - DNA, 28 bp, Artificial Sequence
  Description of Artificial Sequence: Synthetic oligonucleotide
ccgcaatgacctggctgatggtgtgaac

SEQ ID NO: 179809 - DNA, 29 bp, Artificial Sequence
  Description of Artificial Sequence: Synthetic oligonucleotide
cgcaatgacctggctgatggtgtgaactc

SEQ ID NO: 179810 - DNA, 29 bp, Artificial Sequence
  Description of Artificial Sequence: Synthetic oligonucleotide
gcaatgacctggctgatggtgtgaactcg

SEQ ID NO: 179811 - DNA, 29 bp, Artificial Sequence
  Description of Artificial Sequence: Synthetic oligonucleotide
caatgacctggctgatggtgtgaactcgg

SEQ ID NO: 179812 - DNA, 29 bp, Artificial Sequence
  Description of Artificial Sequence: Synthetic oligonucleotide
aatgacctggctgatggtgtgaactcggg

SEQ ID NO: 179813 - DNA, 28 bp, Artificial Sequence
  Description of Artificial Sequence: Synthetic oligonucleotide
atgacctggctgatggtgtgaactcggg

SEQ ID NO: 179814 - DNA, 27 bp, Artificial Sequence
  Description of Artificial Sequence: Synthetic oligonucleotide
tgacctggctgatggtgtgaactcggg

SEQ ID NO: 179815 - DNA, 26 bp, Artificial Sequence
  Description of Artificial Sequence: Synthetic oligonucleotide
gacctggctgatggtgtgaactcggg

SEQ ID NO: 179816 - DNA, 26 bp, Artificial Sequence
  Description of Artificial Sequence: Synthetic oligonucleotide
acctggctgatggtgtgaactcgggc

SEQ ID NO: 179817 - DNA, 25 bp, Artificial Sequence
  Description of Artificial Sequence: Synthetic oligonucleotide
cctggctgatggtgtgaactcgggc

SEQ ID NO: 179818 - DNA, 26 bp, Artificial Sequence
  Description of Artificial Sequence: Synthetic oligonucleotide
ctggctgatggtgtgaactcgggcca

SEQ ID NO: 179819 - DNA, 26 bp, Artificial Sequence
  Description of Artificial Sequence: Synthetic oligonucleotide
tggctgatggtgtgaactcgggccag

SEQ ID NO: 179820 - DNA, 25 bp, Artificial Sequence
  Description of Artificial Sequence: Synthetic oligonucleotide
ggctgatggtgtgaactcgggccag

SEQ ID NO: 179821 - DNA, 25 bp, Artificial Sequence
  Description of Artificial Sequence: Synthetic oligonucleotide
gctgatggtgtgaactcgggccagg

SEQ ID NO: 179822 - DNA, 25 bp, Artificial Sequence
  Description of Artificial Sequence: Synthetic oligonucleotide
ctgatggtgtgaactcgggccaggg

SEQ ID NO: 179823 - DNA, 25 bp, Artificial Sequence
  Description of Artificial Sequence: Synthetic oligonucleotide
tgatggtgtgaactcgggccagggc

SEQ ID NO: 179824 - DNA, 24 bp, Artificial Sequence
  Description of Artificial Sequence: Synthetic oligonucleotide
gatggtgtgaactcgggccagggc

SEQ ID NO: 179825 - DNA, 25 bp, Artificial Sequence
  Description of Artificial Sequence: Synthetic oligonucleotide
atggtgtgaactcgggccagggcct

SEQ ID NO: 179826 - DNA, 24 bp, Artificial Sequence
  Description of Artificial Sequence: Synthetic oligonucleotide
tggtgtgaactcgggccagggcct

SEQ ID NO: 179827 - DNA, 23 bp, Artificial Sequence
  Description of Artificial Sequence: Synthetic oligonucleotide
ggtgtgaactcgggccagggcct

SEQ ID NO: 179828 - DNA, 23 bp, Artificial Sequence
  Description of Artificial Sequence: Synthetic oligonucleotide
gtgtgaactcgggccagggcctg

SEQ ID NO: 179829 - DNA, 23 bp, Artificial Sequence
  Description of Artificial Sequence: Synthetic oligonucleotide
tgtgaactcgggccagggcctgg

SEQ ID NO: 179830 - DNA, 22 bp, Artificial Sequence
  Description of Artificial Sequence: Synthetic oligonucleotide
gtgaactcgggccagggcctgg

SEQ ID NO: 179831 - DNA, 22 bp, Artificial Sequence
  Description of Artificial Sequence: Synthetic oligonucleotide
tgaactcgggccagggcctggg

SEQ ID NO: 179832 - DNA, 21 bp, Artificial Sequence
  Description of Artificial Sequence: Synthetic oligonucleotide
gaactcgggccagggcctggg

SEQ ID NO: 179833 - DNA, 23 bp, Artificial Sequence
  Description of Artificial Sequence: Synthetic oligonucleotide
aactcgggccagggcctgggcat

SEQ ID NO: 179834 - DNA, 22 bp, Artificial Sequence
  Description of Artificial Sequence: Synthetic oligonucleotide
actcgggccagggcctgggcat

SEQ ID NO: 179835 - DNA, 21 bp, Artificial Sequence
  Description of Artificial Sequence: Synthetic oligonucleotide
ctcgggccagggcctgggcat

SEQ ID NO: 179836 - DNA, 21 bp, Artificial Sequence
  Description of Artificial Sequence: Synthetic oligonucleotide
tcgggccagggcctgggcatc

SEQ ID NO: 179837 - DNA, 20 bp, Artificial Sequence
  Description of Artificial Sequence: Synthetic oligonucleotide
cgggccagggcctgggcatc

SEQ ID NO: 179838 - DNA, 21 bp, Artificial Sequence
  Description of Artificial Sequence: Synthetic oligonucleotide
gggccagggcctgggcatcga

SEQ ID NO: 179839 - DNA, 23 bp, Artificial Sequence
  Description of Artificial Sequence: Synthetic oligonucleotide
ggccagggcctgggcatcgagat

SEQ ID NO: 179840 - DNA, 25 bp, Artificial Sequence
  Description of Artificial Sequence: Synthetic oligonucleotide
gccagggcctgggcatcgagatcat

SEQ ID NO: 179841 - DNA, 25 bp, Artificial Sequence
  Description of Artificial Sequence: Synthetic oligonucleotide
ccagggcctgggcatcgagatcatc

SEQ ID NO: 179842 - DNA, 25 bp, Artificial Sequence
  Description of Artificial Sequence: Synthetic oligonucleotide
cagggcctgggcatcgagatcatcg

SEQ ID NO: 179843 - DNA, 25 bp, Artificial Sequence
  Description of Artificial Sequence: Synthetic oligonucleotide
agggcctgggcatcgagatcatcgg

SEQ ID NO: 179844 - DNA, 24 bp, Artificial Sequence
  Description of Artificial Sequence: Synthetic oligonucleotide
gggcctgggcatcgagatcatcgg

SEQ ID NO: 179845 - DNA, 25 bp, Artificial Sequence
  Description of Artificial Sequence: Synthetic oligonucleotide
ggcctgggcatcgagatcatcggga

SEQ ID NO: 179846 - DNA, 25 bp, Artificial Sequence
  Description of Artificial Sequence: Synthetic oligonucleotide
gcctgggcatcgagatcatcgggac

SEQ ID NO: 179847 - DNA, 25 bp, Artificial Sequence
  Description of Artificial Sequence: Synthetic oligonucleotide
cctgggcatcgagatcatcgggacc

SEQ ID NO: 179848 - DNA, 26 bp, Artificial Sequence
  Description of Artificial Sequence: Synthetic oligonucleotide
ctgggcatcgagatcatcgggaccct

SEQ ID NO: 179849 - DNA, 26 bp, Artificial Sequence
  Description of Artificial Sequence: Synthetic oligonucleotide
tgggcatcgagatcatcgggaccctc

SEQ ID NO: 179850 - DNA, 25 bp, Artificial Sequence
  Description of Artificial Sequence: Synthetic oligonucleotide
gggcatcgagatcatcgggaccctc

SEQ ID NO: 179851 - DNA, 26 bp, Artificial Sequence
  Description of Artificial Sequence: Synthetic oligonucleotide
ggcatcgagatcatcgggaccctcca

SEQ ID NO: 179852 - DNA, 26 bp, Artificial Sequence
  Description of Artificial Sequence: Synthetic oligonucleotide
gcatcgagatcatcgggaccctccag

SEQ ID NO: 179853 - DNA, 27 bp, Artificial Sequence
  Description of Artificial Sequence: Synthetic oligonucleotide
catcgagatcatcgggaccctccagct

SEQ ID NO: 179854 - DNA, 27 bp, Artificial Sequence
  Description of Artificial Sequence: Synthetic oligonucleotide
atcgagatcatcgggaccctccagctg

SEQ ID NO: 179855 - DNA, 26 bp, Artificial Sequence
  Description of Artificial Sequence: Synthetic oligonucleotide
tcgagatcatcgggaccctccagctg

SEQ ID NO: 179856 - DNA, 25 bp, Artificial Sequence
  Description of Artificial Sequence: Synthetic oligonucleotide
cgagatcatcgggaccctccagctg

SEQ ID NO: 179857 - DNA, 26 bp, Artificial Sequence
  Description of Artificial Sequence: Synthetic oligonucleotide
gagatcatcgggaccctccagctggt

SEQ ID NO: 179858 - DNA, 26 bp, Artificial Sequence
  Description of Artificial Sequence: Synthetic oligonucleotide
agatcatcgggaccctccagctggtg

SEQ ID NO: 179859 - DNA, 25 bp, Artificial Sequence
  Description of Artificial Sequence: Synthetic oligonucleotide
gatcatcgggaccctccagctggtg

SEQ ID NO: 179860 - DNA, 27 bp, Artificial Sequence
  Description of Artificial Sequence: Synthetic oligonucleotide
atcatcgggaccctccagctggtgcta

SEQ ID NO: 179861 - DNA, 27 bp, Artificial Sequence
  Description of Artificial Sequence: Synthetic oligonucleotide
tcatcgggaccctccagctggtgctat

SEQ ID NO: 179862 - DNA, 26 bp, Artificial Sequence
  Description of Artificial Sequence: Synthetic oligonucleotide
catcgggaccctccagctggtgctat

SEQ ID NO: 179863 - DNA, 26 bp, Artificial Sequence
  Description of Artificial Sequence: Synthetic oligonucleotide
atcgggaccctccagctggtgctatg

SEQ ID NO: 179864 - DNA, 25 bp, Artificial Sequence
  Description of Artificial Sequence: Synthetic oligonucleotide
tcgggaccctccagctggtgctatg

SEQ ID NO: 179865 - DNA, 24 bp, Artificial Sequence
  Description of Artificial Sequence: Synthetic oligonucleotide
cgggaccctccagctggtgctatg

SEQ ID NO: 179866 - DNA, 24 bp, Artificial Sequence
  Description of Artificial Sequence: Synthetic oligonucleotide
gggaccctccagctggtgctatgc

SEQ ID NO: 179867 - DNA, 25 bp, Artificial Sequence
  Description of Artificial Sequence: Synthetic oligonucleotide
ggaccctccagctggtgctatgcgt

SEQ ID NO: 179868 - DNA, 25 bp, Artificial Sequence
  Description of Artificial Sequence: Synthetic oligonucleotide
gaccctccagctggtgctatgcgtg

SEQ ID NO: 179869 - DNA, 26 bp, Artificial Sequence
  Description of Artificial Sequence: Synthetic oligonucleotide
accctccagctggtgctatgcgtgct

SEQ ID NO: 179870 - DNA, 25 bp, Artificial Sequence
  Description of Artificial Sequence: Synthetic oligonucleotide
ccctccagctggtgctatgcgtgct

SEQ ID NO: 179871 - DNA, 25 bp, Artificial Sequence
  Description of Artificial Sequence: Synthetic oligonucleotide
cctccagctggtgctatgcgtgctg

SEQ ID NO: 179872 - DNA, 25 bp, Artificial Sequence
  Description of Artificial Sequence: Synthetic oligonucleotide
ctccagctggtgctatgcgtgctgg

SEQ ID NO: 179873 - DNA, 27 bp, Artificial Sequence
  Description of Artificial Sequence: Synthetic oligonucleotide
tccagctggtgctatgcgtgctggcta

SEQ ID NO: 179874 - DNA, 26 bp, Artificial Sequence
  Description of Artificial Sequence: Synthetic oligonucleotide
ccagctggtgctatgcgtgctggcta

SEQ ID NO: 179875 - DNA, 27 bp, Artificial Sequence
  Description of Artificial Sequence: Synthetic oligonucleotide
cagctggtgctatgcgtgctggctact

SEQ ID NO: 179876 - DNA, 28 bp, Artificial Sequence
  Description of Artificial Sequence: Synthetic oligonucleotide
agctggtgctatgcgtgctggctactac

SEQ ID NO: 179877 - DNA, 27 bp, Artificial Sequence
  Description of Artificial Sequence: Synthetic oligonucleotide
gctggtgctatgcgtgctggctactac

SEQ ID NO: 179878 - DNA, 27 bp, Artificial Sequence
  Description of Artificial Sequence: Synthetic oligonucleotide
ctggtgctatgcgtgctggctactacc

SEQ ID NO: 179879 - DNA, 27 bp, Artificial Sequence
  Description of Artificial Sequence: Synthetic oligonucleotide
tggtgctatgcgtgctggctactaccg

SEQ ID NO: 179880 - DNA, 27 bp, Artificial Sequence
  Description of Artificial Sequence: Synthetic oligonucleotide
ggtgctatgcgtgctggctactaccga

SEQ ID NO: 179881 - DNA, 27 bp, Artificial Sequence
  Description of Artificial Sequence: Synthetic oligonucleotide
gtgctatgcgtgctggctactaccgac

SEQ ID NO: 179882 - DNA, 27 bp, Artificial Sequence
  Description of Artificial Sequence: Synthetic oligonucleotide
tgctatgcgtgctggctactaccgacc

SEQ ID NO: 179883 - DNA, 26 bp, Artificial Sequence
  Description of Artificial Sequence: Synthetic oligonucleotide
gctatgcgtgctggctactaccgacc

SEQ ID NO: 179884 - DNA, 26 bp, Artificial Sequence
  Description of Artificial Sequence: Synthetic oligonucleotide
ctatgcgtgctggctactaccgaccg

SEQ ID NO: 179885 - DNA, 27 bp, Artificial Sequence
  Description of Artificial Sequence: Synthetic oligonucleotide
tatgcgtgctggctactaccgaccgga

SEQ ID NO: 179886 - DNA, 26 bp, Artificial Sequence
  Description of Artificial Sequence: Synthetic oligonucleotide
atgcgtgctggctactaccgaccgga

SEQ ID NO: 179887 - DNA, 25 bp, Artificial Sequence
  Description of Artificial Sequence: Synthetic oligonucleotide
tgcgtgctggctactaccgaccgga

SEQ ID NO: 179888 - DNA, 24 bp, Artificial Sequence
  Description of Artificial Sequence: Synthetic oligonucleotide
gcgtgctggctactaccgaccgga

SEQ ID NO: 179889 - DNA, 24 bp, Artificial Sequence
  Description of Artificial Sequence: Synthetic oligonucleotide
cgtgctggctactaccgaccggag

SEQ ID NO: 179890 - DNA, 24 bp, Artificial Sequence
  Description of Artificial Sequence: Synthetic oligonucleotide
gtgctggctactaccgaccggagg

SEQ ID NO: 179891 - DNA, 24 bp, Artificial Sequence
  Description of Artificial Sequence: Synthetic oligonucleotide
tgctggctactaccgaccggaggc

SEQ ID NO: 179892 - DNA, 23 bp, Artificial Sequence
  Description of Artificial Sequence: Synthetic oligonucleotide
gctggctactaccgaccggaggc

SEQ ID NO: 179893 - DNA, 23 bp, Artificial Sequence
  Description of Artificial Sequence: Synthetic oligonucleotide
ctggctactaccgaccggaggcg

SEQ ID NO: 179894 - DNA, 23 bp, Artificial Sequence
  Description of Artificial Sequence: Synthetic oligonucleotide
tggctactaccgaccggaggcgc

SEQ ID NO: 179895 - DNA, 22 bp, Artificial Sequence
  Description of Artificial Sequence: Synthetic oligonucleotide
ggctactaccgaccggaggcgc

SEQ ID NO: 179896 - DNA, 22 bp, Artificial Sequence
  Description of Artificial Sequence: Synthetic oligonucleotide
gctactaccgaccggaggcgcc

SEQ ID NO: 179897 - DNA, 23 bp, Artificial Sequence
  Description of Artificial Sequence: Synthetic oligonucleotide
ctactaccgaccggaggcgccgt

SEQ ID NO: 179898 - DNA, 24 bp, Artificial Sequence
  Description of Artificial Sequence: Synthetic oligonucleotide
tactaccgaccggaggcgccgtga

SEQ ID NO: 179899 - DNA, 23 bp, Artificial Sequence
  Description of Artificial Sequence: Synthetic oligonucleotide
actaccgaccggaggcgccgtga

SEQ ID NO: 179900 - DNA, 22 bp, Artificial Sequence
  Description of Artificial Sequence: Synthetic oligonucleotide
ctaccgaccggaggcgccgtga

SEQ ID NO: 179901 - DNA, 22 bp, Artificial Sequence
  Description of Artificial Sequence: Synthetic oligonucleotide
taccgaccggaggcgccgtgac

SEQ ID NO: 179902 - DNA, 21 bp, Artificial Sequence
  Description of Artificial Sequence: Synthetic oligonucleotide
accgaccggaggcgccgtgac

SEQ ID NO: 179903 - DNA, 20 bp, Artificial Sequence
  Description of Artificial Sequence: Synthetic oligonucleotide
ccgaccggaggcgccgtgac

SEQ ID NO: 179904 - DNA, 22 bp, Artificial Sequence
  Description of Artificial Sequence: Synthetic oligonucleotide
cgaccggaggcgccgtgacctt

SEQ ID NO: 179905 - DNA, 22 bp, Artificial Sequence
  Description of Artificial Sequence: Synthetic oligonucleotide
gaccggaggcgccgtgaccttg

SEQ ID NO: 179906 - DNA, 23 bp, Artificial Sequence
  Description of Artificial Sequence: Synthetic oligonucleotide
accggaggcgccgtgaccttggt

SEQ ID NO: 179907 - DNA, 22 bp, Artificial Sequence
  Description of Artificial Sequence: Synthetic oligonucleotide
ccggaggcgccgtgaccttggt

SEQ ID NO: 179908 - DNA, 22 bp, Artificial Sequence
  Description of Artificial Sequence: Synthetic oligonucleotide
cggaggcgccgtgaccttggtg

SEQ ID NO: 179909 - DNA, 22 bp, Artificial Sequence
  Description of Artificial Sequence: Synthetic oligonucleotide
ggaggcgccgtgaccttggtgg

SEQ ID NO: 179910 - DNA, 23 bp, Artificial Sequence
  Description of Artificial Sequence: Synthetic oligonucleotide
gaggcgccgtgaccttggtggct

SEQ ID NO: 179911 - DNA, 24 bp, Artificial Sequence
  Description of Artificial Sequence: Synthetic oligonucleotide
aggcgccgtgaccttggtggctca

SEQ ID NO: 179912 - DNA, 23 bp, Artificial Sequence
  Description of Artificial Sequence: Synthetic oligonucleotide
ggcgccgtgaccttggtggctca

SEQ ID NO: 179913 - DNA, 23 bp, Artificial Sequence
  Description of Artificial Sequence: Synthetic oligonucleotide
gcgccgtgaccttggtggctcag

SEQ ID NO: 179914 - DNA, 23 bp, Artificial Sequence
  Description of Artificial Sequence: Synthetic oligonucleotide
cgccgtgaccttggtggctcagc

SEQ ID NO: 179915 - DNA, 23 bp, Artificial Sequence
  Description of Artificial Sequence: Synthetic oligonucleotide
gccgtgaccttggtggctcagcc

SEQ ID NO: 179916 - DNA, 23 bp, Artificial Sequence
  Description of Artificial Sequence: Synthetic oligonucleotide
ccgtgaccttggtggctcagccc

SEQ ID NO: 179917 - DNA, 23 bp, Artificial Sequence
  Description of Artificial Sequence: Synthetic oligonucleotide
cgtgaccttggtggctcagcccc

SEQ ID NO: 179918 - DNA, 23 bp, Artificial Sequence
  Description of Artificial Sequence: Synthetic oligonucleotide
gtgaccttggtggctcagccccc

SEQ ID NO: 179919 - DNA, 25 bp, Artificial Sequence
  Description of Artificial Sequence: Synthetic oligonucleotide
tgaccttggtggctcagcccccctt

SEQ ID NO: 179920 - DNA, 24 bp, Artificial Sequence
  Description of Artificial Sequence: Synthetic oligonucleotide
gaccttggtggctcagcccccctt

SEQ ID NO: 179921 - DNA, 24 bp, Artificial Sequence
  Description of Artificial Sequence: Synthetic oligonucleotide
accttggtggctcagccccccttg

SEQ ID NO: 179922 - DNA, 23 bp, Artificial Sequence
  Description of Artificial Sequence: Synthetic oligonucleotide
ccttggtggctcagccccccttg

SEQ ID NO: 179923 - DNA, 23 bp, Artificial Sequence
  Description of Artificial Sequence: Synthetic oligonucleotide
cttggtggctcagccccccttgc

SEQ ID NO: 179924 - DNA, 25 bp, Artificial Sequence
  Description of Artificial Sequence: Synthetic oligonucleotide
ttggtggctcagccccccttgccat

SEQ ID NO: 179925 - DNA, 24 bp, Artificial Sequence
  Description of Artificial Sequence: Synthetic oligonucleotide
tggtggctcagccccccttgccat

SEQ ID NO: 179926 - DNA, 23 bp, Artificial Sequence
  Description of Artificial Sequence: Synthetic oligonucleotide
ggtggctcagccccccttgccat

SEQ ID NO: 179927 - DNA, 23 bp, Artificial Sequence
  Description of Artificial Sequence: Synthetic oligonucleotide
gtggctcagccccccttgccatc

SEQ ID NO: 179928 - DNA, 23 bp, Artificial Sequence
  Description of Artificial Sequence: Synthetic oligonucleotide
tggctcagccccccttgccatcg

SEQ ID NO: 179929 - DNA, 22 bp, Artificial Sequence
  Description of Artificial Sequence: Synthetic oligonucleotide
ggctcagccccccttgccatcg

SEQ ID NO: 179930 - DNA, 22 bp, Artificial Sequence
  Description of Artificial Sequence: Synthetic oligonucleotide
gctcagccccccttgccatcgg

SEQ ID NO: 179931 - DNA, 22 bp, Artificial Sequence
  Description of Artificial Sequence: Synthetic oligonucleotide
ctcagccccccttgccatcggc

SEQ ID NO: 179932 - DNA, 23 bp, Artificial Sequence
  Description of Artificial Sequence: Synthetic oligonucleotide
tcagccccccttgccatcggcct

SEQ ID NO: 179933 - DNA, 22 bp, Artificial Sequence
  Description of Artificial Sequence: Synthetic oligonucleotide
cagccccccttgccatcggcct

SEQ ID NO: 179934 - DNA, 23 bp, Artificial Sequence
  Description of Artificial Sequence: Synthetic oligonucleotide
agccccccttgccatcggcctct

SEQ ID NO: 179935 - DNA, 22 bp, Artificial Sequence
  Description of Artificial Sequence: Synthetic oligonucleotide
gccccccttgccatcggcctct

SEQ ID NO: 179936 - DNA, 23 bp, Artificial Sequence
  Description of Artificial Sequence: Synthetic oligonucleotide
ccccccttgccatcggcctctct

SEQ ID NO: 179937 - DNA, 25 bp, Artificial Sequence
  Description of Artificial Sequence: Synthetic oligonucleotide
cccccttgccatcggcctctctgta

SEQ ID NO: 179938 - DNA, 25 bp, Artificial Sequence
  Description of Artificial Sequence: Synthetic oligonucleotide
ccccttgccatcggcctctctgtag

SEQ ID NO: 179939 - DNA, 25 bp, Artificial Sequence
  Description of Artificial Sequence: Synthetic oligonucleotide
cccttgccatcggcctctctgtagc

SEQ ID NO: 179940 - DNA, 25 bp, Artificial Sequence
  Description of Artificial Sequence: Synthetic oligonucleotide
ccttgccatcggcctctctgtagcc

SEQ ID NO: 179941 - DNA, 27 bp, Artificial Sequence
  Description of Artificial Sequence: Synthetic oligonucleotide
cttgccatcggcctctctgtagccctt

SEQ ID NO: 179942 - DNA, 27 bp, Artificial Sequence
  Description of Artificial Sequence: Synthetic oligonucleotide
ttgccatcggcctctctgtagcccttg

SEQ ID NO: 179943 - DNA, 26 bp, Artificial Sequence
  Description of Artificial Sequence: Synthetic oligonucleotide
tgccatcggcctctctgtagcccttg

SEQ ID NO: 179944 - DNA, 25 bp, Artificial Sequence
  Description of Artificial Sequence: Synthetic oligonucleotide
gccatcggcctctctgtagcccttg

SEQ ID NO: 179945 - DNA, 26 bp, Artificial Sequence
  Description of Artificial Sequence: Synthetic oligonucleotide
ccatcggcctctctgtagcccttgga

SEQ ID NO: 179946 - DNA, 27 bp, Artificial Sequence
  Description of Artificial Sequence: Synthetic oligonucleotide
catcggcctctctgtagcccttggaca

SEQ ID NO: 179947 - DNA, 27 bp, Artificial Sequence
  Description of Artificial Sequence: Synthetic oligonucleotide
atcggcctctctgtagcccttggacac

SEQ ID NO: 179948 - DNA, 26 bp, Artificial Sequence
  Description of Artificial Sequence: Synthetic oligonucleotide
tcggcctctctgtagcccttggacac

SEQ ID NO: 179949 - DNA, 25 bp, Artificial Sequence
  Description of Artificial Sequence: Synthetic oligonucleotide
cggcctctctgtagcccttggacac

SEQ ID NO: 179950 - DNA, 26 bp, Artificial Sequence
  Description of Artificial Sequence: Synthetic oligonucleotide
ggcctctctgtagcccttggacacct

SEQ ID NO: 179951 - DNA, 26 bp, Artificial Sequence
  Description of Artificial Sequence: Synthetic oligonucleotide
gcctctctgtagcccttggacacctc

SEQ ID NO: 179952 - DNA, 27 bp, Artificial Sequence
  Description of Artificial Sequence: Synthetic oligonucleotide
cctctctgtagcccttggacacctcct

SEQ ID NO: 179953 - DNA, 27 bp, Artificial Sequence
  Description of Artificial Sequence: Synthetic oligonucleotide
ctctctgtagcccttggacacctcctg

SEQ ID NO: 179954 - DNA, 27 bp, Artificial Sequence
  Description of Artificial Sequence: Synthetic oligonucleotide
tctctgtagcccttggacacctcctgg

SEQ ID NO: 179955 - DNA, 26 bp, Artificial Sequence
  Description of Artificial Sequence: Synthetic oligonucleotide
ctctgtagcccttggacacctcctgg

SEQ ID NO: 179956 - DNA, 27 bp, Artificial Sequence
  Description of Artificial Sequence: Synthetic oligonucleotide
tctgtagcccttggacacctcctggct

SEQ ID NO: 179957 - DNA, 27 bp, Artificial Sequence
  Description of Artificial Sequence: Synthetic oligonucleotide
ctgtagcccttggacacctcctggcta

SEQ ID NO: 179958 - DNA, 29 bp, Artificial Sequence
  Description of Artificial Sequence: Synthetic oligonucleotide
tgtagcccttggacacctcctggctattg

SEQ ID NO: 179959 - DNA, 28 bp, Artificial Sequence
  Description of Artificial Sequence: Synthetic oligonucleotide
gtagcccttggacacctcctggctattg

SEQ ID NO: 179960 - DNA, 29 bp, Artificial Sequence
  Description of Artificial Sequence: Synthetic oligonucleotide
tagcccttggacacctcctggctattgac

SEQ ID NO: 179961 - DNA, 28 bp, Artificial Sequence
  Description of Artificial Sequence: Synthetic oligonucleotide
agcccttggacacctcctggctattgac

SEQ ID NO: 179962 - DNA, 27 bp, Artificial Sequence
  Description of Artificial Sequence: Synthetic oligonucleotide
gcccttggacacctcctggctattgac

SEQ ID NO: 179963 - DNA, 29 bp, Artificial Sequence
  Description of Artificial Sequence: Synthetic oligonucleotide
cccttggacacctcctggctattgactac

SEQ ID NO: 179964 - DNA, 30 bp, Artificial Sequence
  Description of Artificial Sequence: Synthetic oligonucleotide
ccttggacacctcctggctattgactacac

SEQ ID NO: 179965 - DNA, 31 bp, Artificial Sequence
  Description of Artificial Sequence: Synthetic oligonucleotide
cttggacacctcctggctattgactacactg

SEQ ID NO: 179966 - DNA, 31 bp, Artificial Sequence
  Description of Artificial Sequence: Synthetic oligonucleotide
ttggacacctcctggctattgactacactgg

SEQ ID NO: 179967 - DNA, 30 bp, Artificial Sequence
  Description of Artificial Sequence: Synthetic oligonucleotide
tggacacctcctggctattgactacactgg

SEQ ID NO: 179968 - DNA, 29 bp, Artificial Sequence
  Description of Artificial Sequence: Synthetic oligonucleotide
ggacacctcctggctattgactacactgg

SEQ ID NO: 179969 - DNA, 29 bp, Artificial Sequence
  Description of Artificial Sequence: Synthetic oligonucleotide
gacacctcctggctattgactacactggc

SEQ ID NO: 179970 - DNA, 30 bp, Artificial Sequence
  Description of Artificial Sequence: Synthetic oligonucleotide
acacctcctggctattgactacactggctg

SEQ ID NO: 179971 - DNA, 29 bp, Artificial Sequence
  Description of Artificial Sequence: Synthetic oligonucleotide
cacctcctggctattgactacactggctg

SEQ ID NO: 179972 - DNA, 30 bp, Artificial Sequence
  Description of Artificial Sequence: Synthetic oligonucleotide
acctcctggctattgactacactggctgtg

SEQ ID NO: 179973 - DNA, 29 bp, Artificial Sequence
  Description of Artificial Sequence: Synthetic oligonucleotide
cctcctggctattgactacactggctgtg

SEQ ID NO: 179974 - DNA, 29 bp, Artificial Sequence
  Description of Artificial Sequence: Synthetic oligonucleotide
ctcctggctattgactacactggctgtgg

SEQ ID NO: 179975 - DNA, 29 bp, Artificial Sequence
  Description of Artificial Sequence: Synthetic oligonucleotide
tcctggctattgactacactggctgtggg

SEQ ID NO: 179976 - DNA, 28 bp, Artificial Sequence
  Description of Artificial Sequence: Synthetic oligonucleotide
cctggctattgactacactggctgtggg

SEQ ID NO: 179977 - DNA, 33 bp, Artificial Sequence
  Description of Artificial Sequence: Synthetic oligonucleotide
ctggctattgactacactggctgtgggattaac

SEQ ID NO: 179978 - DNA, 33 bp, Artificial Sequence
  Description of Artificial Sequence: Synthetic oligonucleotide
tggctattgactacactggctgtgggattaacc

SEQ ID NO: 179979 - DNA, 32 bp, Artificial Sequence
  Description of Artificial Sequence: Synthetic oligonucleotide
ggctattgactacactggctgtgggattaacc

SEQ ID NO: 179980 - DNA, 32 bp, Artificial Sequence
  Description of Artificial Sequence: Synthetic oligonucleotide
gctattgactacactggctgtgggattaaccc

SEQ ID NO: 179981 - DNA, 33 bp, Artificial Sequence
  Description of Artificial Sequence: Synthetic oligonucleotide
ctattgactacactggctgtgggattaaccctg

SEQ ID NO: 179982 - DNA, 33 bp, Artificial Sequence
  Description of Artificial Sequence: Synthetic oligonucleotide
tattgactacactggctgtgggattaaccctgc

SEQ ID NO: 179983 - DNA, 32 bp, Artificial Sequence
  Description of Artificial Sequence: Synthetic oligonucleotide
attgactacactggctgtgggattaaccctgc

SEQ ID NO: 179984 - DNA, 31 bp, Artificial Sequence
  Description of Artificial Sequence: Synthetic oligonucleotide
ttgactacactggctgtgggattaaccctgc

SEQ ID NO: 179985 - DNA, 30 bp, Artificial Sequence
  Description of Artificial Sequence: Synthetic oligonucleotide
tgactacactggctgtgggattaaccctgc

SEQ ID NO: 179986 - DNA, 29 bp, Artificial Sequence
  Description of Artificial Sequence: Synthetic oligonucleotide
gactacactggctgtgggattaaccctgc

SEQ ID NO: 179987 - DNA, 30 bp, Artificial Sequence
  Description of Artificial Sequence: Synthetic oligonucleotide
actacactggctgtgggattaaccctgctc

SEQ ID NO: 179988 - DNA, 29 bp, Artificial Sequence
  Description of Artificial Sequence: Synthetic oligonucleotide
ctacactggctgtgggattaaccctgctc

SEQ ID NO: 179989 - DNA, 29 bp, Artificial Sequence
  Description of Artificial Sequence: Synthetic oligonucleotide
tacactggctgtgggattaaccctgctcg

SEQ ID NO: 179990 - DNA, 28 bp, Artificial Sequence
  Description of Artificial Sequence: Synthetic oligonucleotide
acactggctgtgggattaaccctgctcg

SEQ ID NO: 179991 - DNA, 27 bp, Artificial Sequence
  Description of Artificial Sequence: Synthetic oligonucleotide
cactggctgtgggattaaccctgctcg

SEQ ID NO: 179992 - DNA, 27 bp, Artificial Sequence
  Description of Artificial Sequence: Synthetic oligonucleotide
actggctgtgggattaaccctgctcgg

SEQ ID NO: 179993 - DNA, 27 bp, Artificial Sequence
  Description of Artificial Sequence: Synthetic oligonucleotide
ctggctgtgggattaaccctgctcggt

SEQ ID NO: 179994 - DNA, 27 bp, Artificial Sequence
  Description of Artificial Sequence: Synthetic oligonucleotide
tggctgtgggattaaccctgctcggtc

SEQ ID NO: 179995 - DNA, 26 bp, Artificial Sequence
  Description of Artificial Sequence: Synthetic oligonucleotide
ggctgtgggattaaccctgctcggtc

SEQ ID NO: 179996 - DNA, 27 bp, Artificial Sequence
  Description of Artificial Sequence: Synthetic oligonucleotide
gctgtgggattaaccctgctcggtcct

SEQ ID NO: 179997 - DNA, 29 bp, Artificial Sequence
  Description of Artificial Sequence: Synthetic oligonucleotide
ctgtgggattaaccctgctcggtcctttg

SEQ ID NO: 179998 - DNA, 29 bp, Artificial Sequence
  Description of Artificial Sequence: Synthetic oligonucleotide
tgtgggattaaccctgctcggtcctttgg

SEQ ID NO: 179999 - DNA, 28 bp, Artificial Sequence
  Description of Artificial Sequence: Synthetic oligonucleotide
gtgggattaaccctgctcggtcctttgg

SEQ ID NO: 180000 - DNA, 28 bp, Artificial Sequence
  Description of Artificial Sequence: Synthetic oligonucleotide
tgggattaaccctgctcggtcctttggc

SEQ ID NO: 180001 - DNA, 27 bp, Artificial Sequence
  Description of Artificial Sequence: Synthetic oligonucleotide
gggattaaccctgctcggtcctttggc

SEQ ID NO: 180002 - DNA, 28 bp, Artificial Sequence
  Description of Artificial Sequence: Synthetic oligonucleotide
ggattaaccctgctcggtcctttggctc

SEQ ID NO: 180003 - DNA, 28 bp, Artificial Sequence
  Description of Artificial Sequence: Synthetic oligonucleotide
gattaaccctgctcggtcctttggctcc

SEQ ID NO: 180004 - DNA, 28 bp, Artificial Sequence
  Description of Artificial Sequence: Synthetic oligonucleotide
attaaccctgctcggtcctttggctccg

SEQ ID NO: 180005 - DNA, 27 bp, Artificial Sequence
  Description of Artificial Sequence: Synthetic oligonucleotide
ttaaccctgctcggtcctttggctccg

SEQ ID NO: 180006 - DNA, 26 bp, Artificial Sequence
  Description of Artificial Sequence: Synthetic oligonucleotide
taaccctgctcggtcctttggctccg

SEQ ID NO: 180007 - DNA, 25 bp, Artificial Sequence
  Description of Artificial Sequence: Synthetic oligonucleotide
aaccctgctcggtcctttggctccg

SEQ ID NO: 180008 - DNA, 24 bp, Artificial Sequence
  Description of Artificial Sequence: Synthetic oligonucleotide
accctgctcggtcctttggctccg

SEQ ID NO: 180009 - DNA, 23 bp, Artificial Sequence
  Description of Artificial Sequence: Synthetic oligonucleotide
ccctgctcggtcctttggctccg

SEQ ID NO: 180010 - DNA, 23 bp, Artificial Sequence
  Description of Artificial Sequence: Synthetic oligonucleotide
cctgctcggtcctttggctccgc

SEQ ID NO: 180011 - DNA, 23 bp, Artificial Sequence
  Description of Artificial Sequence: Synthetic oligonucleotide
ctgctcggtcctttggctccgcg

SEQ ID NO: 180012 - DNA, 24 bp, Artificial Sequence
  Description of Artificial Sequence: Synthetic oligonucleotide
tgctcggtcctttggctccgcggt

SEQ ID NO: 180013 - DNA, 23 bp, Artificial Sequence
  Description of Artificial Sequence: Synthetic oligonucleotide
gctcggtcctttggctccgcggt

SEQ ID NO: 180014 - DNA, 25 bp, Artificial Sequence
  Description of Artificial Sequence: Synthetic oligonucleotide
ctcggtcctttggctccgcggtgat

SEQ ID NO: 180015 - DNA, 26 bp, Artificial Sequence
  Description of Artificial Sequence: Synthetic oligonucleotide
tcggtcctttggctccgcggtgatca

SEQ ID NO: 180016 - DNA, 25 bp, Artificial Sequence
  Description of Artificial Sequence: Synthetic oligonucleotide
cggtcctttggctccgcggtgatca

SEQ ID NO: 180017 - DNA, 26 bp, Artificial Sequence
  Description of Artificial Sequence: Synthetic oligonucleotide
ggtcctttggctccgcggtgatcaca

SEQ ID NO: 180018 - DNA, 27 bp, Artificial Sequence
  Description of Artificial Sequence: Synthetic oligonucleotide
gtcctttggctccgcggtgatcacaca

SEQ ID NO: 180019 - DNA, 27 bp, Artificial Sequence
  Description of Artificial Sequence: Synthetic oligonucleotide
tcctttggctccgcggtgatcacacac

SEQ ID NO: 180020 - DNA, 27 bp, Artificial Sequence
  Description of Artificial Sequence: Synthetic oligonucleotide
cctttggctccgcggtgatcacacaca

SEQ ID NO: 180021 - DNA, 28 bp, Artificial Sequence
  Description of Artificial Sequence: Synthetic oligonucleotide
ctttggctccgcggtgatcacacacaac

SEQ ID NO: 180022 - DNA, 30 bp, Artificial Sequence
  Description of Artificial Sequence: Synthetic oligonucleotide
tttggctccgcggtgatcacacacaacttc

SEQ ID NO: 180023 - DNA, 29 bp, Artificial Sequence
  Description of Artificial Sequence: Synthetic oligonucleotide
ttggctccgcggtgatcacacacaacttc

SEQ ID NO: 180024 - DNA, 28 bp, Artificial Sequence
  Description of Artificial Sequence: Synthetic oligonucleotide
tggctccgcggtgatcacacacaacttc

SEQ ID NO: 180025 - DNA, 27 bp, Artificial Sequence
  Description of Artificial Sequence: Synthetic oligonucleotide
ggctccgcggtgatcacacacaacttc

SEQ ID NO: 180026 - DNA, 28 bp, Artificial Sequence
  Description of Artificial Sequence: Synthetic oligonucleotide
gctccgcggtgatcacacacaacttcag

SEQ ID NO: 180027 - DNA, 28 bp, Artificial Sequence
  Description of Artificial Sequence: Synthetic oligonucleotide
ctccgcggtgatcacacacaacttcagc

SEQ ID NO: 180028 - DNA, 30 bp, Artificial Sequence
  Description of Artificial Sequence: Synthetic oligonucleotide
tccgcggtgatcacacacaacttcagcaac

SEQ ID NO: 180029 - DNA, 29 bp, Artificial Sequence
  Description of Artificial Sequence: Synthetic oligonucleotide
ccgcggtgatcacacacaacttcagcaac

SEQ ID NO: 180030 - DNA, 29 bp, Artificial Sequence
  Description of Artificial Sequence: Synthetic oligonucleotide
cgcggtgatcacacacaacttcagcaacc

SEQ ID NO: 180031 - DNA, 30 bp, Artificial Sequence
  Description of Artificial Sequence: Synthetic oligonucleotide
gcggtgatcacacacaacttcagcaaccac

SEQ ID NO: 180032 - DNA, 31 bp, Artificial Sequence
  Description of Artificial Sequence: Synthetic oligonucleotide
cggtgatcacacacaacttcagcaaccactg

SEQ ID NO: 180033 - DNA, 31 bp, Artificial Sequence
  Description of Artificial Sequence: Synthetic oligonucleotide
ggtgatcacacacaacttcagcaaccactgg

SEQ ID NO: 180034 - DNA, 36 bp, Artificial Sequence
  Description of Artificial Sequence: Synthetic oligonucleotide
gtgatcacacacaacttcagcaaccactggattttc

SEQ ID NO: 180035 - DNA, 37 bp, Artificial Sequence
  Description of Artificial Sequence: Synthetic oligonucleotide
tgatcacacacaacttcagcaaccactggattttctg

SEQ ID NO: 180036 - DNA, 36 bp, Artificial Sequence
  Description of Artificial Sequence: Synthetic oligonucleotide
gatcacacacaacttcagcaaccactggattttctg

SEQ ID NO: 180037 - DNA, 36 bp, Artificial Sequence
  Description of Artificial Sequence: Synthetic oligonucleotide
atcacacacaacttcagcaaccactggattttctgg

SEQ ID NO: 180038 - DNA, 35 bp, Artificial Sequence
  Description of Artificial Sequence: Synthetic oligonucleotide
tcacacacaacttcagcaaccactggattttctgg

SEQ ID NO: 180039 - DNA, 34 bp, Artificial Sequence
  Description of Artificial Sequence: Synthetic oligonucleotide
cacacacaacttcagcaaccactggattttctgg

SEQ ID NO: 180040 - DNA, 34 bp, Artificial Sequence
  Description of Artificial Sequence: Synthetic oligonucleotide
acacacaacttcagcaaccactggattttctggg

SEQ ID NO: 180041 - DNA, 33 bp, Artificial Sequence
  Description of Artificial Sequence: Synthetic oligonucleotide
cacacaacttcagcaaccactggattttctggg

SEQ ID NO: 180042 - DNA, 34 bp, Artificial Sequence
  Description of Artificial Sequence: Synthetic oligonucleotide
acacaacttcagcaaccactggattttctgggtg

SEQ ID NO: 180043 - DNA, 33 bp, Artificial Sequence
  Description of Artificial Sequence: Synthetic oligonucleotide
cacaacttcagcaaccactggattttctgggtg

SEQ ID NO: 180044 - DNA, 33 bp, Artificial Sequence
  Description of Artificial Sequence: Synthetic oligonucleotide
acaacttcagcaaccactggattttctgggtgg

SEQ ID NO: 180045 - DNA, 32 bp, Artificial Sequence
  Description of Artificial Sequence: Synthetic oligonucleotide
caacttcagcaaccactggattttctgggtgg

SEQ ID NO: 180046 - DNA, 32 bp, Artificial Sequence
  Description of Artificial Sequence: Synthetic oligonucleotide
aacttcagcaaccactggattttctgggtggg

SEQ ID NO: 180047 - DNA, 31 bp, Artificial Sequence
  Description of Artificial Sequence: Synthetic oligonucleotide
acttcagcaaccactggattttctgggtggg

SEQ ID NO: 180048 - DNA, 30 bp, Artificial Sequence
  Description of Artificial Sequence: Synthetic oligonucleotide
cttcagcaaccactggattttctgggtggg

SEQ ID NO: 180049 - DNA, 30 bp, Artificial Sequence
  Description of Artificial Sequence: Synthetic oligonucleotide
ttcagcaaccactggattttctgggtgggg

SEQ ID NO: 180050 - DNA, 29 bp, Artificial Sequence
  Description of Artificial Sequence: Synthetic oligonucleotide
tcagcaaccactggattttctgggtgggg

SEQ ID NO: 180051 - DNA, 28 bp, Artificial Sequence
  Description of Artificial Sequence: Synthetic oligonucleotide
cagcaaccactggattttctgggtgggg

SEQ ID NO: 180052 - DNA, 28 bp, Artificial Sequence
  Description of Artificial Sequence: Synthetic oligonucleotide
agcaaccactggattttctgggtggggc

SEQ ID NO: 180053 - DNA, 27 bp, Artificial Sequence
  Description of Artificial Sequence: Synthetic oligonucleotide
gcaaccactggattttctgggtggggc

SEQ ID NO: 180054 - DNA, 27 bp, Artificial Sequence
  Description of Artificial Sequence: Synthetic oligonucleotide
caaccactggattttctgggtggggcc

SEQ ID NO: 180055 - DNA, 30 bp, Artificial Sequence
  Description of Artificial Sequence: Synthetic oligonucleotide
aaccactggattttctgggtggggccattc

SEQ ID NO: 180056 - DNA, 29 bp, Artificial Sequence
  Description of Artificial Sequence: Synthetic oligonucleotide
accactggattttctgggtggggccattc

SEQ ID NO: 180057 - DNA, 28 bp, Artificial Sequence
  Description of Artificial Sequence: Synthetic oligonucleotide
ccactggattttctgggtggggccattc

SEQ ID NO: 180058 - DNA, 30 bp, Artificial Sequence
  Description of Artificial Sequence: Synthetic oligonucleotide
cactggattttctgggtggggccattcatc

SEQ ID NO: 180059 - DNA, 30 bp, Artificial Sequence
  Description of Artificial Sequence: Synthetic oligonucleotide
actggattttctgggtggggccattcatcg

SEQ ID NO: 180060 - DNA, 29 bp, Artificial Sequence
  Description of Artificial Sequence: Synthetic oligonucleotide
ctggattttctgggtggggccattcatcg

SEQ ID NO: 180061 - DNA, 29 bp, Artificial Sequence
  Description of Artificial Sequence: Synthetic oligonucleotide
tggattttctgggtggggccattcatcgg

SEQ ID NO: 180062 - DNA, 28 bp, Artificial Sequence
  Description of Artificial Sequence: Synthetic oligonucleotide
ggattttctgggtggggccattcatcgg

SEQ ID NO: 180063 - DNA, 28 bp, Artificial Sequence
  Description of Artificial Sequence: Synthetic oligonucleotide
gattttctgggtggggccattcatcggg

SEQ ID NO: 180064 - DNA, 28 bp, Artificial Sequence
  Description of Artificial Sequence: Synthetic oligonucleotide
attttctgggtggggccattcatcgggg

SEQ ID NO: 180065 - DNA, 27 bp, Artificial Sequence
  Description of Artificial Sequence: Synthetic oligonucleotide
ttttctgggtggggccattcatcgggg

SEQ ID NO: 180066 - DNA, 26 bp, Artificial Sequence
  Description of Artificial Sequence: Synthetic oligonucleotide
tttctgggtggggccattcatcgggg

SEQ ID NO: 180067 - DNA, 25 bp, Artificial Sequence
  Description of Artificial Sequence: Synthetic oligonucleotide
ttctgggtggggccattcatcgggg

SEQ ID NO: 180068 - DNA, 24 bp, Artificial Sequence
  Description of Artificial Sequence: Synthetic oligonucleotide
tctgggtggggccattcatcgggg

SEQ ID NO: 180069 - DNA, 23 bp, Artificial Sequence
  Description of Artificial Sequence: Synthetic oligonucleotide
ctgggtggggccattcatcgggg

SEQ ID NO: 180070 - DNA, 24 bp, Artificial Sequence
  Description of Artificial Sequence: Synthetic oligonucleotide
tgggtggggccattcatcggggga

SEQ ID NO: 180071 - DNA, 23 bp, Artificial Sequence
  Description of Artificial Sequence: Synthetic oligonucleotide
gggtggggccattcatcggggga

SEQ ID NO: 180072 - DNA, 23 bp, Artificial Sequence
  Description of Artificial Sequence: Synthetic oligonucleotide
ggtggggccattcatcgggggag

SEQ ID NO: 180073 - DNA, 23 bp, Artificial Sequence
  Description of Artificial Sequence: Synthetic oligonucleotide
gtggggccattcatcgggggagc

SEQ ID NO: 180074 - DNA, 23 bp, Artificial Sequence
  Description of Artificial Sequence: Synthetic oligonucleotide
tggggccattcatcgggggagcc

SEQ ID NO: 180075 - DNA, 22 bp, Artificial Sequence
  Description of Artificial Sequence: Synthetic oligonucleotide
ggggccattcatcgggggagcc

SEQ ID NO: 180076 - DNA, 23 bp, Artificial Sequence
  Description of Artificial Sequence: Synthetic oligonucleotide
gggccattcatcgggggagccct

SEQ ID NO: 180077 - DNA, 23 bp, Artificial Sequence
  Description of Artificial Sequence: Synthetic oligonucleotide
ggccattcatcgggggagccctg

SEQ ID NO: 180078 - DNA, 23 bp, Artificial Sequence
  Description of Artificial Sequence: Synthetic oligonucleotide
gccattcatcgggggagccctgg

SEQ ID NO: 180079 - DNA, 24 bp, Artificial Sequence
  Description of Artificial Sequence: Synthetic oligonucleotide
ccattcatcgggggagccctggct

SEQ ID NO: 180080 - DNA, 26 bp, Artificial Sequence
  Description of Artificial Sequence: Synthetic oligonucleotide
cattcatcgggggagccctggctgta

SEQ ID NO: 180081 - DNA, 27 bp, Artificial Sequence
  Description of Artificial Sequence: Synthetic oligonucleotide
attcatcgggggagccctggctgtact

SEQ ID NO: 180082 - DNA, 26 bp, Artificial Sequence
  Description of Artificial Sequence: Synthetic oligonucleotide
ttcatcgggggagccctggctgtact

SEQ ID NO: 180083 - DNA, 25 bp, Artificial Sequence
  Description of Artificial Sequence: Synthetic oligonucleotide
tcatcgggggagccctggctgtact

SEQ ID NO: 180084 - DNA, 24 bp, Artificial Sequence
  Description of Artificial Sequence: Synthetic oligonucleotide
catcgggggagccctggctgtact

SEQ ID NO: 180085 - DNA, 26 bp, Artificial Sequence
  Description of Artificial Sequence: Synthetic oligonucleotide
atcgggggagccctggctgtactcat

SEQ ID NO: 180086 - DNA, 25 bp, Artificial Sequence
  Description of Artificial Sequence: Synthetic oligonucleotide
tcgggggagccctggctgtactcat

SEQ ID NO: 180087 - DNA, 24 bp, Artificial Sequence
  Description of Artificial Sequence: Synthetic oligonucleotide
cgggggagccctggctgtactcat

SEQ ID NO: 180088 - DNA, 26 bp, Artificial Sequence
  Description of Artificial Sequence: Synthetic oligonucleotide
gggggagccctggctgtactcatcta

SEQ ID NO: 180089 - DNA, 26 bp, Artificial Sequence
  Description of Artificial Sequence: Synthetic oligonucleotide
ggggagccctggctgtactcatctac

SEQ ID NO: 180090 - DNA, 27 bp, Artificial Sequence
  Description of Artificial Sequence: Synthetic oligonucleotide
gggagccctggctgtactcatctacga

SEQ ID NO: 180091 - DNA, 27 bp, Artificial Sequence
  Description of Artificial Sequence: Synthetic oligonucleotide
ggagccctggctgtactcatctacgac

SEQ ID NO: 180092 - DNA, 29 bp, Artificial Sequence
  Description of Artificial Sequence: Synthetic oligonucleotide
gagccctggctgtactcatctacgacttc

SEQ ID NO: 180093 - DNA, 31 bp, Artificial Sequence
  Description of Artificial Sequence: Synthetic oligonucleotide
agccctggctgtactcatctacgacttcatc

SEQ ID NO: 180094 - DNA, 30 bp, Artificial Sequence
  Description of Artificial Sequence: Synthetic oligonucleotide
gccctggctgtactcatctacgacttcatc

SEQ ID NO: 180095 - DNA, 30 bp, Artificial Sequence
  Description of Artificial Sequence: Synthetic oligonucleotide
ccctggctgtactcatctacgacttcatcc

SEQ ID NO: 180096 - DNA, 31 bp, Artificial Sequence
  Description of Artificial Sequence: Synthetic oligonucleotide
cctggctgtactcatctacgacttcatcctg

SEQ ID NO: 180097 - DNA, 31 bp, Artificial Sequence
  Description of Artificial Sequence: Synthetic oligonucleotide
ctggctgtactcatctacgacttcatcctgg

SEQ ID NO: 180098 - DNA, 31 bp, Artificial Sequence
  Description of Artificial Sequence: Synthetic oligonucleotide
tggctgtactcatctacgacttcatcctggc

SEQ ID NO: 180099 - DNA, 30 bp, Artificial Sequence
  Description of Artificial Sequence: Synthetic oligonucleotide
ggctgtactcatctacgacttcatcctggc

SEQ ID NO: 180100 - DNA, 30 bp, Artificial Sequence
  Description of Artificial Sequence: Synthetic oligonucleotide
gctgtactcatctacgacttcatcctggcc

SEQ ID NO: 180101 - DNA, 30 bp, Artificial Sequence
  Description of Artificial Sequence: Synthetic oligonucleotide
ctgtactcatctacgacttcatcctggccc

SEQ ID NO: 180102 - DNA, 30 bp, Artificial Sequence
  Description of Artificial Sequence: Synthetic oligonucleotide
tgtactcatctacgacttcatcctggcccc

SEQ ID NO: 180103 - DNA, 29 bp, Artificial Sequence
  Description of Artificial Sequence: Synthetic oligonucleotide
gtactcatctacgacttcatcctggcccc

SEQ ID NO: 180104 - DNA, 30 bp, Artificial Sequence
  Description of Artificial Sequence: Synthetic oligonucleotide
tactcatctacgacttcatcctggccccac

SEQ ID NO: 180105 - DNA, 29 bp, Artificial Sequence
  Description of Artificial Sequence: Synthetic oligonucleotide
actcatctacgacttcatcctggccccac

SEQ ID NO: 180106 - DNA, 28 bp, Artificial Sequence
  Description of Artificial Sequence: Synthetic oligonucleotide
ctcatctacgacttcatcctggccccac

SEQ ID NO: 180107 - DNA, 28 bp, Artificial Sequence
  Description of Artificial Sequence: Synthetic oligonucleotide
tcatctacgacttcatcctggccccacg

SEQ ID NO: 180108 - DNA, 27 bp, Artificial Sequence
  Description of Artificial Sequence: Synthetic oligonucleotide
catctacgacttcatcctggccccacg

SEQ ID NO: 180109 - DNA, 27 bp, Artificial Sequence
  Description of Artificial Sequence: Synthetic oligonucleotide
atctacgacttcatcctggccccacgc

SEQ ID NO: 180110 - DNA, 27 bp, Artificial Sequence
  Description of Artificial Sequence: Synthetic oligonucleotide
tctacgacttcatcctggccccacgca

SEQ ID NO: 180111 - DNA, 26 bp, Artificial Sequence
  Description of Artificial Sequence: Synthetic oligonucleotide
ctacgacttcatcctggccccacgca

SEQ ID NO: 180112 - DNA, 26 bp, Artificial Sequence
  Description of Artificial Sequence: Synthetic oligonucleotide
tacgacttcatcctggccccacgcag

SEQ ID NO: 180113 - DNA, 25 bp, Artificial Sequence
  Description of Artificial Sequence: Synthetic oligonucleotide
acgacttcatcctggccccacgcag

SEQ ID NO: 180114 - DNA, 24 bp, Artificial Sequence
  Description of Artificial Sequence: Synthetic oligonucleotide
cgacttcatcctggccccacgcag

SEQ ID NO: 180115 - DNA, 25 bp, Artificial Sequence
  Description of Artificial Sequence: Synthetic oligonucleotide
gacttcatcctggccccacgcagca

SEQ ID NO: 180116 - DNA, 26 bp, Artificial Sequence
  Description of Artificial Sequence: Synthetic oligonucleotide
acttcatcctggccccacgcagcagt

SEQ ID NO: 180117 - DNA, 25 bp, Artificial Sequence
  Description of Artificial Sequence: Synthetic oligonucleotide
cttcatcctggccccacgcagcagt

SEQ ID NO: 180118 - DNA, 26 bp, Artificial Sequence
  Description of Artificial Sequence: Synthetic oligonucleotide
ttcatcctggccccacgcagcagtga

SEQ ID NO: 180119 - DNA, 25 bp, Artificial Sequence
  Description of Artificial Sequence: Synthetic oligonucleotide
tcatcctggccccacgcagcagtga

SEQ ID NO: 180120 - DNA, 24 bp, Artificial Sequence
  Description of Artificial Sequence: Synthetic oligonucleotide
catcctggccccacgcagcagtga

SEQ ID NO: 180121 - DNA, 24 bp, Artificial Sequence
  Description of Artificial Sequence: Synthetic oligonucleotide
atcctggccccacgcagcagtgac

SEQ ID NO: 180122 - DNA, 23 bp, Artificial Sequence
  Description of Artificial Sequence: Synthetic oligonucleotide
tcctggccccacgcagcagtgac

SEQ ID NO: 180123 - DNA, 22 bp, Artificial Sequence
  Description of Artificial Sequence: Synthetic oligonucleotide
cctggccccacgcagcagtgac

SEQ ID NO: 180124 - DNA, 23 bp, Artificial Sequence
  Description of Artificial Sequence: Synthetic oligonucleotide
ctggccccacgcagcagtgacct

SEQ ID NO: 180125 - DNA, 24 bp, Artificial Sequence
  Description of Artificial Sequence: Synthetic oligonucleotide
tggccccacgcagcagtgacctca

SEQ ID NO: 180126 - DNA, 23 bp, Artificial Sequence
  Description of Artificial Sequence: Synthetic oligonucleotide
ggccccacgcagcagtgacctca

SEQ ID NO: 180127 - DNA, 24 bp, Artificial Sequence
  Description of Artificial Sequence: Synthetic oligonucleotide
gccccacgcagcagtgacctcaca

SEQ ID NO: 180128 - DNA, 25 bp, Artificial Sequence
  Description of Artificial Sequence: Synthetic oligonucleotide
ccccacgcagcagtgacctcacaga

SEQ ID NO: 180129 - DNA, 25 bp, Artificial Sequence
  Description of Artificial Sequence: Synthetic oligonucleotide
cccacgcagcagtgacctcacagac

SEQ ID NO: 180130 - DNA, 25 bp, Artificial Sequence
  Description of Artificial Sequence: Synthetic oligonucleotide
ccacgcagcagtgacctcacagacc

SEQ ID NO: 180131 - DNA, 25 bp, Artificial Sequence
  Description of Artificial Sequence: Synthetic oligonucleotide
cacgcagcagtgacctcacagaccg

SEQ ID NO: 180132 - DNA, 25 bp, Artificial Sequence
  Description of Artificial Sequence: Synthetic oligonucleotide
acgcagcagtgacctcacagaccgc

SEQ ID NO: 180133 - DNA, 24 bp, Artificial Sequence
  Description of Artificial Sequence: Synthetic oligonucleotide
cgcagcagtgacctcacagaccgc

SEQ ID NO: 180134 - DNA, 25 bp, Artificial Sequence
  Description of Artificial Sequence: Synthetic oligonucleotide
gcagcagtgacctcacagaccgcgt

SEQ ID NO: 180135 - DNA, 27 bp, Artificial Sequence
  Description of Artificial Sequence: Synthetic oligonucleotide
cagcagtgacctcacagaccgcgtgaa

SEQ ID NO: 180136 - DNA, 27 bp, Artificial Sequence
  Description of Artificial Sequence: Synthetic oligonucleotide
agcagtgacctcacagaccgcgtgaag

SEQ ID NO: 180137 - DNA, 26 bp, Artificial Sequence
  Description of Artificial Sequence: Synthetic oligonucleotide
gcagtgacctcacagaccgcgtgaag

SEQ ID NO: 180138 - DNA, 27 bp, Artificial Sequence
  Description of Artificial Sequence: Synthetic oligonucleotide
cagtgacctcacagaccgcgtgaaggt

SEQ ID NO: 180139 - DNA, 27 bp, Artificial Sequence
  Description of Artificial Sequence: Synthetic oligonucleotide
agtgacctcacagaccgcgtgaaggtg

SEQ ID NO: 180140 - DNA, 27 bp, Artificial Sequence
  Description of Artificial Sequence: Synthetic oligonucleotide
gtgacctcacagaccgcgtgaaggtgt

SEQ ID NO: 180141 - DNA, 27 bp, Artificial Sequence
  Description of Artificial Sequence: Synthetic oligonucleotide
tgacctcacagaccgcgtgaaggtgtg

SEQ ID NO: 180142 - DNA, 26 bp, Artificial Sequence
  Description of Artificial Sequence: Synthetic oligonucleotide
gacctcacagaccgcgtgaaggtgtg

SEQ ID NO: 180143 - DNA, 27 bp, Artificial Sequence
  Description of Artificial Sequence: Synthetic oligonucleotide
acctcacagaccgcgtgaaggtgtgga

SEQ ID NO: 180144 - DNA, 26 bp, Artificial Sequence
  Description of Artificial Sequence: Synthetic oligonucleotide
cctcacagaccgcgtgaaggtgtgga

SEQ ID NO: 180145 - DNA, 26 bp, Artificial Sequence
  Description of Artificial Sequence: Synthetic oligonucleotide
ctcacagaccgcgtgaaggtgtggac

SEQ ID NO: 180146 - DNA, 27 bp, Artificial Sequence
  Description of Artificial Sequence: Synthetic oligonucleotide
tcacagaccgcgtgaaggtgtggacca

SEQ ID NO: 180147 - DNA, 26 bp, Artificial Sequence
  Description of Artificial Sequence: Synthetic oligonucleotide
cacagaccgcgtgaaggtgtggacca

SEQ ID NO: 180148 - DNA, 26 bp, Artificial Sequence
  Description of Artificial Sequence: Synthetic oligonucleotide
acagaccgcgtgaaggtgtggaccag

SEQ ID NO: 180149 - DNA, 25 bp, Artificial Sequence
  Description of Artificial Sequence: Synthetic oligonucleotide
cagaccgcgtgaaggtgtggaccag

SEQ ID NO: 180150 - DNA, 25 bp, Artificial Sequence
  Description of Artificial Sequence: Synthetic oligonucleotide
agaccgcgtgaaggtgtggaccagc

SEQ ID NO: 180151 - DNA, 24 bp, Artificial Sequence
  Description of Artificial Sequence: Synthetic oligonucleotide
gaccgcgtgaaggtgtggaccagc

SEQ ID NO: 180152 - DNA, 24 bp, Artificial Sequence
  Description of Artificial Sequence: Synthetic oligonucleotide
accgcgtgaaggtgtggaccagcg

SEQ ID NO: 180153 - DNA, 23 bp, Artificial Sequence
  Description of Artificial Sequence: Synthetic oligonucleotide
ccgcgtgaaggtgtggaccagcg

SEQ ID NO: 180154 - DNA, 23 bp, Artificial Sequence
  Description of Artificial Sequence: Synthetic oligonucleotide
cgcgtgaaggtgtggaccagcgg

SEQ ID NO: 180155 - DNA, 23 bp, Artificial Sequence
  Description of Artificial Sequence: Synthetic oligonucleotide
gcgtgaaggtgtggaccagcggc

SEQ ID NO: 180156 - DNA, 24 bp, Artificial Sequence
  Description of Artificial Sequence: Synthetic oligonucleotide
cgtgaaggtgtggaccagcggcca

SEQ ID NO: 180157 - DNA, 24 bp, Artificial Sequence
  Description of Artificial Sequence: Synthetic oligonucleotide
gtgaaggtgtggaccagcggccag

SEQ ID NO: 180158 - DNA, 25 bp, Artificial Sequence
  Description of Artificial Sequence: Synthetic oligonucleotide
tgaaggtgtggaccagcggccaggt

SEQ ID NO: 180159 - DNA, 24 bp, Artificial Sequence
  Description of Artificial Sequence: Synthetic oligonucleotide
gaaggtgtggaccagcggccaggt

SEQ ID NO: 180160 - DNA, 24 bp, Artificial Sequence
  Description of Artificial Sequence: Synthetic oligonucleotide
aaggtgtggaccagcggccaggtg

SEQ ID NO: 180161 - DNA, 23 bp, Artificial Sequence
  Description of Artificial Sequence: Synthetic oligonucleotide
aggtgtggaccagcggccaggtg

SEQ ID NO: 180162 - DNA, 22 bp, Artificial Sequence
  Description of Artificial Sequence: Synthetic oligonucleotide
ggtgtggaccagcggccaggtg

SEQ ID NO: 180163 - DNA, 23 bp, Artificial Sequence
  Description of Artificial Sequence: Synthetic oligonucleotide
gtgtggaccagcggccaggtgga

SEQ ID NO: 180164 - DNA, 23 bp, Artificial Sequence
  Description of Artificial Sequence: Synthetic oligonucleotide
tgtggaccagcggccaggtggag

SEQ ID NO: 180165 - DNA, 22 bp, Artificial Sequence
  Description of Artificial Sequence: Synthetic oligonucleotide
gtggaccagcggccaggtggag

SEQ ID NO: 180166 - DNA, 23 bp, Artificial Sequence
  Description of Artificial Sequence: Synthetic oligonucleotide
tggaccagcggccaggtggagga

SEQ ID NO: 180167 - DNA, 22 bp, Artificial Sequence
  Description of Artificial Sequence: Synthetic oligonucleotide
ggaccagcggccaggtggagga

SEQ ID NO: 180168 - DNA, 25 bp, Artificial Sequence
  Description of Artificial Sequence: Synthetic oligonucleotide
gaccagcggccaggtggaggagtat

SEQ ID NO: 180169 - DNA, 26 bp, Artificial Sequence
  Description of Artificial Sequence: Synthetic oligonucleotide
accagcggccaggtggaggagtatga

SEQ ID NO: 180170 - DNA, 25 bp, Artificial Sequence
  Description of Artificial Sequence: Synthetic oligonucleotide
ccagcggccaggtggaggagtatga

SEQ ID NO: 180171 - DNA, 25 bp, Artificial Sequence
  Description of Artificial Sequence: Synthetic oligonucleotide
cagcggccaggtggaggagtatgac

SEQ ID NO: 180172 - DNA, 26 bp, Artificial Sequence
  Description of Artificial Sequence: Synthetic oligonucleotide
agcggccaggtggaggagtatgacct

SEQ ID NO: 180173 - DNA, 25 bp, Artificial Sequence
  Description of Artificial Sequence: Synthetic oligonucleotide
gcggccaggtggaggagtatgacct

SEQ ID NO: 180174 - DNA, 25 bp, Artificial Sequence
  Description of Artificial Sequence: Synthetic oligonucleotide
cggccaggtggaggagtatgacctg

SEQ ID NO: 180175 - DNA, 27 bp, Artificial Sequence
  Description of Artificial Sequence: Synthetic oligonucleotide
ggccaggtggaggagtatgacctggat

SEQ ID NO: 180176 - DNA, 27 bp, Artificial Sequence
  Description of Artificial Sequence: Synthetic oligonucleotide
gccaggtggaggagtatgacctggatg

SEQ ID NO: 180177 - DNA, 27 bp, Artificial Sequence
  Description of Artificial Sequence: Synthetic oligonucleotide
ccaggtggaggagtatgacctggatgc

SEQ ID NO: 180178 - DNA, 27 bp, Artificial Sequence
  Description of Artificial Sequence: Synthetic oligonucleotide
caggtggaggagtatgacctggatgcc

SEQ ID NO: 180179 - DNA, 27 bp, Artificial Sequence
  Description of Artificial Sequence: Synthetic oligonucleotide
aggtggaggagtatgacctggatgccg

SEQ ID NO: 180180 - DNA, 27 bp, Artificial Sequence
  Description of Artificial Sequence: Synthetic oligonucleotide
ggtggaggagtatgacctggatgccga

SEQ ID NO: 180181 - DNA, 27 bp, Artificial Sequence
  Description of Artificial Sequence: Synthetic oligonucleotide
gtggaggagtatgacctggatgccgac

SEQ ID NO: 180182 - DNA, 27 bp, Artificial Sequence
  Description of Artificial Sequence: Synthetic oligonucleotide
tggaggagtatgacctggatgccgacg

SEQ ID NO: 180183 - DNA, 27 bp, Artificial Sequence
  Description of Artificial Sequence: Synthetic oligonucleotide
ggaggagtatgacctggatgccgacga

SEQ ID NO: 180184 - DNA, 27 bp, Artificial Sequence
  Description of Artificial Sequence: Synthetic oligonucleotide
gaggagtatgacctggatgccgacgac

SEQ ID NO: 180185 - DNA, 29 bp, Artificial Sequence
  Description of Artificial Sequence: Synthetic oligonucleotide
aggagtatgacctggatgccgacgacatc

SEQ ID NO: 180186 - DNA, 28 bp, Artificial Sequence
  Description of Artificial Sequence: Synthetic oligonucleotide
ggagtatgacctggatgccgacgacatc

SEQ ID NO: 180187 - DNA, 30 bp, Artificial Sequence
  Description of Artificial Sequence: Synthetic oligonucleotide
gagtatgacctggatgccgacgacatcaac

SEQ ID NO: 180188 - DNA, 31 bp, Artificial Sequence
  Description of Artificial Sequence: Synthetic oligonucleotide
agtatgacctggatgccgacgacatcaactc

SEQ ID NO: 180189 - DNA, 30 bp, Artificial Sequence
  Description of Artificial Sequence: Synthetic oligonucleotide
gtatgacctggatgccgacgacatcaactc

SEQ ID NO: 180190 - DNA, 30 bp, Artificial Sequence
  Description of Artificial Sequence: Synthetic oligonucleotide
tatgacctggatgccgacgacatcaactcc

SEQ ID NO: 180191 - DNA, 29 bp, Artificial Sequence
  Description of Artificial Sequence: Synthetic oligonucleotide
atgacctggatgccgacgacatcaactcc

SEQ ID NO: 180192 - DNA, 28 bp, Artificial Sequence
  Description of Artificial Sequence: Synthetic oligonucleotide
tgacctggatgccgacgacatcaactcc

SEQ ID NO: 180193 - DNA, 27 bp, Artificial Sequence
  Description of Artificial Sequence: Synthetic oligonucleotide
gacctggatgccgacgacatcaactcc

SEQ ID NO: 180194 - DNA, 28 bp, Artificial Sequence
  Description of Artificial Sequence: Synthetic oligonucleotide
acctggatgccgacgacatcaactccag

SEQ ID NO: 180195 - DNA, 27 bp, Artificial Sequence
  Description of Artificial Sequence: Synthetic oligonucleotide
cctggatgccgacgacatcaactccag

SEQ ID NO: 180196 - DNA, 27 bp, Artificial Sequence
  Description of Artificial Sequence: Synthetic oligonucleotide
ctggatgccgacgacatcaactccagg

SEQ ID NO: 180197 - DNA, 27 bp, Artificial Sequence
  Description of Artificial Sequence: Synthetic oligonucleotide
tggatgccgacgacatcaactccaggg

SEQ ID NO: 180198 - DNA, 27 bp, Artificial Sequence
  Description of Artificial Sequence: Synthetic oligonucleotide
ggatgccgacgacatcaactccagggt

SEQ ID NO: 180199 - DNA, 27 bp, Artificial Sequence
  Description of Artificial Sequence: Synthetic oligonucleotide
gatgccgacgacatcaactccagggtg

SEQ ID NO: 180200 - DNA, 27 bp, Artificial Sequence
  Description of Artificial Sequence: Synthetic oligonucleotide
atgccgacgacatcaactccagggtgg

SEQ ID NO: 180201 - DNA, 27 bp, Artificial Sequence
  Description of Artificial Sequence: Synthetic oligonucleotide
tgccgacgacatcaactccagggtgga

SEQ ID NO: 180202 - DNA, 26 bp, Artificial Sequence
  Description of Artificial Sequence: Synthetic oligonucleotide
gccgacgacatcaactccagggtgga

SEQ ID NO: 180203 - DNA, 27 bp, Artificial Sequence
  Description of Artificial Sequence: Synthetic oligonucleotide
ccgacgacatcaactccagggtggaga

SEQ ID NO: 180204 - DNA, 28 bp, Artificial Sequence
  Description of Artificial Sequence: Synthetic oligonucleotide
cgacgacatcaactccagggtggagatg

SEQ ID NO: 180205 - DNA, 30 bp, Artificial Sequence
  Description of Artificial Sequence: Synthetic oligonucleotide
gacgacatcaactccagggtggagatgaag

SEQ ID NO: 180206 - DNA, 30 bp, Artificial Sequence
  Description of Artificial Sequence: Synthetic oligonucleotide
acgacatcaactccagggtggagatgaagc

SEQ ID NO: 180207 - DNA, 29 bp, Artificial Sequence
  Description of Artificial Sequence: Synthetic oligonucleotide
cgacatcaactccagggtggagatgaagc

SEQ ID NO: 180208 - DNA, 29 bp, Artificial Sequence
  Description of Artificial Sequence: Synthetic oligonucleotide
gacatcaactccagggtggagatgaagcc

SEQ ID NO: 180209 - DNA, 29 bp, Artificial Sequence
  Description of Artificial Sequence: Synthetic oligonucleotide
acatcaactccagggtggagatgaagccc

SEQ ID NO: 180210 - DNA, 28 bp, Artificial Sequence
  Description of Artificial Sequence: Synthetic oligonucleotide
catcaactccagggtggagatgaagccc

SEQ ID NO: 180211 - DNA, 33 bp, Artificial Sequence
  Description of Artificial Sequence: Synthetic oligonucleotide
atcaactccagggtggagatgaagcccaaatag

SEQ ID NO: 180212 - DNA, 21 bp, Artificial Sequence
  Description of Artificial Sequence: Synthetic oligonucleotide
cggcgcccacctcaacccgct

SEQ ID NO: 180213 - DNA, 22 bp, Artificial Sequence
  Description of Artificial Sequence: Synthetic oligonucleotide
ggcgcccacctcaacccgctgt

SEQ ID NO: 180214 - DNA, 23 bp, Artificial Sequence
  Description of Artificial Sequence: Synthetic oligonucleotide
gcgcccacctcaacccgctgtca

SEQ ID NO: 180215 - DNA, 24 bp, Artificial Sequence
  Description of Artificial Sequence: Synthetic oligonucleotide
cgcccacctcaacccgctgtcaca

SEQ ID NO: 180216 - DNA, 25 bp, Artificial Sequence
  Description of Artificial Sequence: Synthetic oligonucleotide
gcccacctcaacccgctgtcacact

SEQ ID NO: 180217 - DNA, 25 bp, Artificial Sequence
  Description of Artificial Sequence: Synthetic oligonucleotide
cccacctcaacccgctgtcacactg

SEQ ID NO: 180218 - DNA, 25 bp, Artificial Sequence
  Description of Artificial Sequence: Synthetic oligonucleotide
ccacctcaacccgctgtcacactgg

SEQ ID NO: 180219 - DNA, 25 bp, Artificial Sequence
  Description of Artificial Sequence: Synthetic oligonucleotide
cacctcaacccgctgtcacactggg

SEQ ID NO: 180220 - DNA, 25 bp, Artificial Sequence
  Description of Artificial Sequence: Synthetic oligonucleotide
acctcaacccgctgtcacactgggg

SEQ ID NO: 180221 - DNA, 24 bp, Artificial Sequence
  Description of Artificial Sequence: Synthetic oligonucleotide
cctcaacccgctgtcacactgggg

SEQ ID NO: 180222 - DNA, 25 bp, Artificial Sequence
  Description of Artificial Sequence: Synthetic oligonucleotide
ctcaacccgctgtcacactggggct

SEQ ID NO: 180223 - DNA, 25 bp, Artificial Sequence
  Description of Artificial Sequence: Synthetic oligonucleotide
tcaacccgctgtcacactggggctg

SEQ ID NO: 180224 - DNA, 24 bp, Artificial Sequence
  Description of Artificial Sequence: Synthetic oligonucleotide
caacccgctgtcacactggggctg

SEQ ID NO: 180225 - DNA, 25 bp, Artificial Sequence
  Description of Artificial Sequence: Synthetic oligonucleotide
aacccgctgtcacactggggctgct

SEQ ID NO: 180226 - DNA, 24 bp, Artificial Sequence
  Description of Artificial Sequence: Synthetic oligonucleotide
acccgctgtcacactggggctgct

SEQ ID NO: 180227 - DNA, 23 bp, Artificial Sequence
  Description of Artificial Sequence: Synthetic oligonucleotide
cccgctgtcacactggggctgct

SEQ ID NO: 180228 - DNA, 23 bp, Artificial Sequence
  Description of Artificial Sequence: Synthetic oligonucleotide
ccgctgtcacactggggctgctg

SEQ ID NO: 180229 - DNA, 24 bp, Artificial Sequence
  Description of Artificial Sequence: Synthetic oligonucleotide
cgctgtcacactggggctgctgct

SEQ ID NO: 180230 - DNA, 29 bp, Artificial Sequence
  Description of Artificial Sequence: Synthetic oligonucleotide
aaatacccggtggggaacaaccagacgac

SEQ ID NO: 180231 - DNA, 28 bp, Artificial Sequence
  Description of Artificial Sequence: Synthetic oligonucleotide
aatacccggtggggaacaaccagacgac

SEQ ID NO: 180232 - DNA, 27 bp, Artificial Sequence
  Description of Artificial Sequence: Synthetic oligonucleotide
atacccggtggggaacaaccagacgac

SEQ ID NO: 180233 - DNA, 26 bp, Artificial Sequence
  Description of Artificial Sequence: Synthetic oligonucleotide
tacccggtggggaacaaccagacgac

SEQ ID NO: 180234 - DNA, 25 bp, Artificial Sequence
  Description of Artificial Sequence: Synthetic oligonucleotide
acccggtggggaacaaccagacgac

SEQ ID NO: 180235 - DNA, 24 bp, Artificial Sequence
  Description of Artificial Sequence: Synthetic oligonucleotide
cccggtggggaacaaccagacgac

SEQ ID NO: 180236 - DNA, 24 bp, Artificial Sequence
  Description of Artificial Sequence: Synthetic oligonucleotide
ccggtggggaacaaccagacgacg

SEQ ID NO: 180237 - DNA, 25 bp, Artificial Sequence
  Description of Artificial Sequence: Synthetic oligonucleotide
cggtggggaacaaccagacgacggt

SEQ ID NO: 180238 - DNA, 25 bp, Artificial Sequence
  Description of Artificial Sequence: Synthetic oligonucleotide
ggtggggaacaaccagacgacggtc

SEQ ID NO: 180239 - DNA, 26 bp, Artificial Sequence
  Description of Artificial Sequence: Synthetic oligonucleotide
gtggggaacaaccagacgacggtcca

SEQ ID NO: 180240 - DNA, 26 bp, Artificial Sequence
  Description of Artificial Sequence: Synthetic oligonucleotide
tggggaacaaccagacgacggtccag

SEQ ID NO: 180241 - DNA, 25 bp, Artificial Sequence
  Description of Artificial Sequence: Synthetic oligonucleotide
ggggaacaaccagacgacggtccag

SEQ ID NO: 180242 - DNA, 26 bp, Artificial Sequence
  Description of Artificial Sequence: Synthetic oligonucleotide
gggaacaaccagacgacggtccagga

SEQ ID NO: 180243 - DNA, 27 bp, Artificial Sequence
  Description of Artificial Sequence: Synthetic oligonucleotide
ggaacaaccagacgacggtccaggaca

SEQ ID NO: 180244 - DNA, 28 bp, Artificial Sequence
  Description of Artificial Sequence: Synthetic oligonucleotide
gaacaaccagacgacggtccaggacaac

SEQ ID NO: 180245 - DNA, 28 bp, Artificial Sequence
  Description of Artificial Sequence: Synthetic oligonucleotide
aacaaccagacgacggtccaggacaacg

SEQ ID NO: 180246 - DNA, 27 bp, Artificial Sequence
  Description of Artificial Sequence: Synthetic oligonucleotide
acaaccagacgacggtccaggacaacg

SEQ ID NO: 180247 - DNA, 27 bp, Artificial Sequence
  Description of Artificial Sequence: Synthetic oligonucleotide
caaccagacgacggtccaggacaacgt

SEQ ID NO: 180248 - DNA, 27 bp, Artificial Sequence
  Description of Artificial Sequence: Synthetic oligonucleotide
aaccagacgacggtccaggacaacgtg

SEQ ID NO: 180249 - DNA, 27 bp, Artificial Sequence
  Description of Artificial Sequence: Synthetic oligonucleotide
accagacgacggtccaggacaacgtga

SEQ ID NO: 180250 - DNA, 27 bp, Artificial Sequence
  Description of Artificial Sequence: Synthetic oligonucleotide
ccagacgacggtccaggacaacgtgaa

SEQ ID NO: 180251 - DNA, 27 bp, Artificial Sequence
  Description of Artificial Sequence: Synthetic oligonucleotide
cagacgacggtccaggacaacgtgaag

SEQ ID NO: 180252 - DNA, 27 bp, Artificial Sequence
  Description of Artificial Sequence: Synthetic oligonucleotide
agacgacggtccaggacaacgtgaagg

SEQ ID NO: 180253 - DNA, 27 bp, Artificial Sequence
  Description of Artificial Sequence: Synthetic oligonucleotide
gacgacggtccaggacaacgtgaaggt

SEQ ID NO: 180254 - DNA, 27 bp, Artificial Sequence
  Description of Artificial Sequence: Synthetic oligonucleotide
acgacggtccaggacaacgtgaaggtg

SEQ ID NO: 180255 - DNA, 27 bp, Artificial Sequence
  Description of Artificial Sequence: Synthetic oligonucleotide
cgacggtccaggacaacgtgaaggtgt

SEQ ID NO: 180256 - DNA, 27 bp, Artificial Sequence
  Description of Artificial Sequence: Synthetic oligonucleotide
gacggtccaggacaacgtgaaggtgtc

SEQ ID NO: 180257 - DNA, 27 bp, Artificial Sequence
  Description of Artificial Sequence: Synthetic oligonucleotide
acggtccaggacaacgtgaaggtgtcg

SEQ ID NO: 180258 - DNA, 27 bp, Artificial Sequence
  Description of Artificial Sequence: Synthetic oligonucleotide
atacccggtggggaacaaccagacggt

SEQ ID NO: 180259 - DNA, 26 bp, Artificial Sequence
  Description of Artificial Sequence: Synthetic oligonucleotide
tacccggtggggaacaaccagacggt

SEQ ID NO: 180260 - DNA, 25 bp, Artificial Sequence
  Description of Artificial Sequence: Synthetic oligonucleotide
acccggtggggaacaaccagacggt

SEQ ID NO: 180261 - DNA, 24 bp, Artificial Sequence
  Description of Artificial Sequence: Synthetic oligonucleotide
cccggtggggaacaaccagacggt

SEQ ID NO: 180262 - DNA, 24 bp, Artificial Sequence
  Description of Artificial Sequence: Synthetic oligonucleotide
ccggtggggaacaaccagacggtg

SEQ ID NO: 180263 - DNA, 25 bp, Artificial Sequence
  Description of Artificial Sequence: Synthetic oligonucleotide
cggtggggaacaaccagacggtggt

SEQ ID NO: 180264 - DNA, 25 bp, Artificial Sequence
  Description of Artificial Sequence: Synthetic oligonucleotide
ggtggggaacaaccagacggtggtc

SEQ ID NO: 180265 - DNA, 26 bp, Artificial Sequence
  Description of Artificial Sequence: Synthetic oligonucleotide
gtggggaacaaccagacggtggtcca

SEQ ID NO: 180266 - DNA, 26 bp, Artificial Sequence
  Description of Artificial Sequence: Synthetic oligonucleotide
tggggaacaaccagacggtggtccag

SEQ ID NO: 180267 - DNA, 25 bp, Artificial Sequence
  Description of Artificial Sequence: Synthetic oligonucleotide
ggggaacaaccagacggtggtccag

SEQ ID NO: 180268 - DNA, 26 bp, Artificial Sequence
  Description of Artificial Sequence: Synthetic oligonucleotide
gggaacaaccagacggtggtccagga

SEQ ID NO: 180269 - DNA, 27 bp, Artificial Sequence
  Description of Artificial Sequence: Synthetic oligonucleotide
ggaacaaccagacggtggtccaggaca

SEQ ID NO: 180270 - DNA, 28 bp, Artificial Sequence
  Description of Artificial Sequence: Synthetic oligonucleotide
gaacaaccagacggtggtccaggacaac

SEQ ID NO: 180271 - DNA, 28 bp, Artificial Sequence
  Description of Artificial Sequence: Synthetic oligonucleotide
aacaaccagacggtggtccaggacaacg

SEQ ID NO: 180272 - DNA, 27 bp, Artificial Sequence
  Description of Artificial Sequence: Synthetic oligonucleotide
acaaccagacggtggtccaggacaacg

SEQ ID NO: 180273 - DNA, 27 bp, Artificial Sequence
  Description of Artificial Sequence: Synthetic oligonucleotide
caaccagacggtggtccaggacaacgt

SEQ ID NO: 180274 - DNA, 27 bp, Artificial Sequence
  Description of Artificial Sequence: Synthetic oligonucleotide
aaccagacggtggtccaggacaacgtg

SEQ ID NO: 180275 - DNA, 27 bp, Artificial Sequence
  Description of Artificial Sequence: Synthetic oligonucleotide
accagacggtggtccaggacaacgtga

SEQ ID NO: 180276 - DNA, 27 bp, Artificial Sequence
  Description of Artificial Sequence: Synthetic oligonucleotide
ccagacggtggtccaggacaacgtgaa

SEQ ID NO: 180277 - DNA, 27 bp, Artificial Sequence
  Description of Artificial Sequence: Synthetic oligonucleotide
cagacggtggtccaggacaacgtgaag

SEQ ID NO: 180278 - DNA, 27 bp, Artificial Sequence
  Description of Artificial Sequence: Synthetic oligonucleotide
agacggtggtccaggacaacgtgaagg

SEQ ID NO: 180279 - DNA, 27 bp, Artificial Sequence
  Description of Artificial Sequence: Synthetic oligonucleotide
gacggtggtccaggacaacgtgaaggt

SEQ ID NO: 180280 - DNA, 27 bp, Artificial Sequence
  Description of Artificial Sequence: Synthetic oligonucleotide
acggtggtccaggacaacgtgaaggtg

SEQ ID NO: 180281 - DNA, 27 bp, Artificial Sequence
  Description of Artificial Sequence: Synthetic oligonucleotide
cggtggtccaggacaacgtgaaggtgt

SEQ ID NO: 180282 - DNA, 27 bp, Artificial Sequence
  Description of Artificial Sequence: Synthetic oligonucleotide
ggtggtccaggacaacgtgaaggtgtc

SEQ ID NO: 180283 - DNA, 27 bp, Artificial Sequence
  Description of Artificial Sequence: Synthetic oligonucleotide
gtggtccaggacaacgtgaaggtgtcg

SEQ ID NO: 180284 - DNA, 27 bp, Artificial Sequence
  Description of Artificial Sequence: Synthetic oligonucleotide
tggtccaggacaacgtgaaggtgtcgc

SEQ ID NO: 180285 - DNA, 28 bp, Artificial Sequence
  Description of Artificial Sequence: Synthetic oligonucleotide
tgtagcccttggacacctcctggctatc

SEQ ID NO: 180286 - DNA, 27 bp, Artificial Sequence
  Description of Artificial Sequence: Synthetic oligonucleotide
gtagcccttggacacctcctggctatc

SEQ ID NO: 180287 - DNA, 27 bp, Artificial Sequence
  Description of Artificial Sequence: Synthetic oligonucleotide
tagcccttggacacctcctggctatcg

SEQ ID NO: 180288 - DNA, 27 bp, Artificial Sequence
  Description of Artificial Sequence: Synthetic oligonucleotide
agcccttggacacctcctggctatcga

SEQ ID NO: 180289 - DNA, 26 bp, Artificial Sequence
  Description of Artificial Sequence: Synthetic oligonucleotide
gcccttggacacctcctggctatcga

SEQ ID NO: 180290 - DNA, 27 bp, Artificial Sequence
  Description of Artificial Sequence: Synthetic oligonucleotide
cccttggacacctcctggctatcgact

SEQ ID NO: 180291 - DNA, 28 bp, Artificial Sequence
  Description of Artificial Sequence: Synthetic oligonucleotide
ccttggacacctcctggctatcgactac

SEQ ID NO: 180292 - DNA, 29 bp, Artificial Sequence
  Description of Artificial Sequence: Synthetic oligonucleotide
cttggacacctcctggctatcgactacac

SEQ ID NO: 180293 - DNA, 30 bp, Artificial Sequence
  Description of Artificial Sequence: Synthetic oligonucleotide
ttggacacctcctggctatcgactacactg

SEQ ID NO: 180294 - DNA, 29 bp, Artificial Sequence
  Description of Artificial Sequence: Synthetic oligonucleotide
tggacacctcctggctatcgactacactg

SEQ ID NO: 180295 - DNA, 28 bp, Artificial Sequence
  Description of Artificial Sequence: Synthetic oligonucleotide
ggacacctcctggctatcgactacactg

SEQ ID NO: 180296 - DNA, 28 bp, Artificial Sequence
  Description of Artificial Sequence: Synthetic oligonucleotide
gacacctcctggctatcgactacactgg

SEQ ID NO: 180297 - DNA, 28 bp, Artificial Sequence
  Description of Artificial Sequence: Synthetic oligonucleotide
acacctcctggctatcgactacactggc

SEQ ID NO: 180298 - DNA, 27 bp, Artificial Sequence
  Description of Artificial Sequence: Synthetic oligonucleotide
cacctcctggctatcgactacactggc

SEQ ID NO: 180299 - DNA, 28 bp, Artificial Sequence
  Description of Artificial Sequence: Synthetic oligonucleotide
acctcctggctatcgactacactggctg

SEQ ID NO: 180300 - DNA, 27 bp, Artificial Sequence
  Description of Artificial Sequence: Synthetic oligonucleotide
cctcctggctatcgactacactggctg

SEQ ID NO: 180301 - DNA, 28 bp, Artificial Sequence
  Description of Artificial Sequence: Synthetic oligonucleotide
ctcctggctatcgactacactggctgtg

SEQ ID NO: 180302 - DNA, 28 bp, Artificial Sequence
  Description of Artificial Sequence: Synthetic oligonucleotide
tcctggctatcgactacactggctgtgg

SEQ ID NO: 180303 - DNA, 27 bp, Artificial Sequence
  Description of Artificial Sequence: Synthetic oligonucleotide
cctggctatcgactacactggctgtgg

SEQ ID NO: 180304 - DNA, 27 bp, Artificial Sequence
  Description of Artificial Sequence: Synthetic oligonucleotide
ctggctatcgactacactggctgtggg

SEQ ID NO: 180305 - DNA, 32 bp, Artificial Sequence
  Description of Artificial Sequence: Synthetic oligonucleotide
tggctatcgactacactggctgtgggattaac

SEQ ID NO: 180306 - DNA, 31 bp, Artificial Sequence
  Description of Artificial Sequence: Synthetic oligonucleotide
ggctatcgactacactggctgtgggattaac

SEQ ID NO: 180307 - DNA, 31 bp, Artificial Sequence
  Description of Artificial Sequence: Synthetic oligonucleotide
gctatcgactacactggctgtgggattaacc

SEQ ID NO: 180308 - DNA, 31 bp, Artificial Sequence
  Description of Artificial Sequence: Synthetic oligonucleotide
ctatcgactacactggctgtgggattaaccc

SEQ ID NO: 180309 - DNA, 32 bp, Artificial Sequence
  Description of Artificial Sequence: Synthetic oligonucleotide
tatcgactacactggctgtgggattaaccctg

SEQ ID NO: 180310 - DNA, 31 bp, Artificial Sequence
  Description of Artificial Sequence: Synthetic oligonucleotide
atcgactacactggctgtgggattaaccctg

SEQ ID NO: 180311 - DNA, 30 bp, Artificial Sequence
  Description of Artificial Sequence: Synthetic oligonucleotide
tcgactacactggctgtgggattaaccctg

SEQ ID NO: 180312 - DNA, 29 bp, Artificial Sequence
  Description of Artificial Sequence: Synthetic oligonucleotide
cgactacactggctgtgggattaaccctg

SEQ ID NO: 180313 - DNA, 21 bp, Artificial Sequence
  Description of Artificial Sequence: Synthetic oligonucleotide
atgaccgtcgcgcggccgagc

SEQ ID NO: 180314 - DNA, 20 bp, Artificial Sequence
  Description of Artificial Sequence: Synthetic oligonucleotide
tgaccgtcgcgcggccgagc

SEQ ID NO: 180315 - DNA, 20 bp, Artificial Sequence
  Description of Artificial Sequence: Synthetic oligonucleotide
gaccgtcgcgcggccgagct

SEQ ID NO: 180316 - DNA, 20 bp, Artificial Sequence
  Description of Artificial Sequence: Synthetic oligonucleotide
accgtcgcgcggccgagcgt

SEQ ID NO: 180317 - DNA, 20 bp, Artificial Sequence
  Description of Artificial Sequence: Synthetic oligonucleotide
ccgtcgcgcggccgagcgtt

SEQ ID NO: 180318 - DNA, 20 bp, Artificial Sequence
  Description of Artificial Sequence: Synthetic oligonucleotide
cgtcgcgcggccgagcgtgt

SEQ ID NO: 180319 - DNA, 20 bp, Artificial Sequence
  Description of Artificial Sequence: Synthetic oligonucleotide
gtcgcgcggccgagcgtgct

SEQ ID NO: 180320 - DNA, 20 bp, Artificial Sequence
  Description of Artificial Sequence: Synthetic oligonucleotide
tcgcgcggccgagcgtgcct

SEQ ID NO: 180321 - DNA, 20 bp, Artificial Sequence
  Description of Artificial Sequence: Synthetic oligonucleotide
cgcgcggccgagcgtgcctt

SEQ ID NO: 180322 - DNA, 20 bp, Artificial Sequence
  Description of Artificial Sequence: Synthetic oligonucleotide
gcgcggccgagcgtgccctt

SEQ ID NO: 180323 - DNA, 20 bp, Artificial Sequence
  Description of Artificial Sequence: Synthetic oligonucleotide
cgcggccgagcgtgcccgtt

SEQ ID NO: 180324 - DNA, 20 bp, Artificial Sequence
  Description of Artificial Sequence: Synthetic oligonucleotide
gcggccgagcgtgcccgctt

SEQ ID NO: 180325 - DNA, 20 bp, Artificial Sequence
  Description of Artificial Sequence: Synthetic oligonucleotide
cggccgagcgtgcccgcgtt

SEQ ID NO: 180326 - DNA, 20 bp, Artificial Sequence
  Description of Artificial Sequence: Synthetic oligonucleotide
ggccgagcgtgcccgcggtt

SEQ ID NO: 180327 - DNA, 20 bp, Artificial Sequence
  Description of Artificial Sequence: Synthetic oligonucleotide
gccgagcgtgcccgcggctt

SEQ ID NO: 180328 - DNA, 20 bp, Artificial Sequence
  Description of Artificial Sequence: Synthetic oligonucleotide
ccgagcgtgcccgcggcgtt

SEQ ID NO: 180329 - DNA, 20 bp, Artificial Sequence
  Description of Artificial Sequence: Synthetic oligonucleotide
cgagcgtgcccgcggcgctt

SEQ ID NO: 180330 - DNA, 20 bp, Artificial Sequence
  Description of Artificial Sequence: Synthetic oligonucleotide
gagcgtgcccgcggcgctgt

SEQ ID NO: 180331 - DNA, 20 bp, Artificial Sequence
  Description of Artificial Sequence: Synthetic oligonucleotide
agcgtgcccgcggcgctgct

SEQ ID NO: 180332 - DNA, 20 bp, Artificial Sequence
  Description of Artificial Sequence: Synthetic oligonucleotide
gcgtgcccgcggcgctgctt

SEQ ID NO: 180333 - DNA, 20 bp, Artificial Sequence
  Description of Artificial Sequence: Synthetic oligonucleotide
cgtgcccgcggcgctgcctt

SEQ ID NO: 180334 - DNA, 20 bp, Artificial Sequence
  Description of Artificial Sequence: Synthetic oligonucleotide
gtgcccgcggcgctgccctt

SEQ ID NO: 180335 - DNA, 20 bp, Artificial Sequence
  Description of Artificial Sequence: Synthetic oligonucleotide
tgcccgcggcgctgcccctt

SEQ ID NO: 180336 - DNA, 20 bp, Artificial Sequence
  Description of Artificial Sequence: Synthetic oligonucleotide
gcccgcggcgctgccccttt

SEQ ID NO: 180337 - DNA, 20 bp, Artificial Sequence
  Description of Artificial Sequence: Synthetic oligonucleotide
cccgcggcgctgcccctctt

SEQ ID NO: 180338 - DNA, 20 bp, Artificial Sequence
  Description of Artificial Sequence: Synthetic oligonucleotide
ccgcggcgctgcccctcctt

SEQ ID NO: 180339 - DNA, 20 bp, Artificial Sequence
  Description of Artificial Sequence: Synthetic oligonucleotide
cgcggcgctgcccctcctct

SEQ ID NO: 180340 - DNA, 20 bp, Artificial Sequence
  Description of Artificial Sequence: Synthetic oligonucleotide
gcggcgctgcccctcctcgt

SEQ ID NO: 180341 - DNA, 20 bp, Artificial Sequence
  Description of Artificial Sequence: Synthetic oligonucleotide
cggcgctgcccctcctcggt

SEQ ID NO: 180342 - DNA, 20 bp, Artificial Sequence
  Description of Artificial Sequence: Synthetic oligonucleotide
ggcgctgcccctcctcgggt

SEQ ID NO: 180343 - DNA, 20 bp, Artificial Sequence
  Description of Artificial Sequence: Synthetic oligonucleotide
gcgctgcccctcctcgggga

SEQ ID NO: 180344 - DNA, 20 bp, Artificial Sequence
  Description of Artificial Sequence: Synthetic oligonucleotide
cgctgcccctcctcggggag

SEQ ID NO: 180345 - DNA, 21 bp, Artificial Sequence
  Description of Artificial Sequence: Synthetic oligonucleotide
gctgcccctcctcggggagct

SEQ ID NO: 180346 - DNA, 21 bp, Artificial Sequence
  Description of Artificial Sequence: Synthetic oligonucleotide
ctgcccctcctcggggagctg

SEQ ID NO: 180347 - DNA, 21 bp, Artificial Sequence
  Description of Artificial Sequence: Synthetic oligonucleotide
tgcccctcctcggggagctgc

SEQ ID NO: 180348 - DNA, 20 bp, Artificial Sequence
  Description of Artificial Sequence: Synthetic oligonucleotide
gcccctcctcggggagctgc

SEQ ID NO: 180349 - DNA, 20 bp, Artificial Sequence
  Description of Artificial Sequence: Synthetic oligonucleotide
cccctcctcggggagctgcc

SEQ ID NO: 180350 - DNA, 20 bp, Artificial Sequence
  Description of Artificial Sequence: Synthetic oligonucleotide
ccctcctcggggagctgccc

SEQ ID NO: 180351 - DNA, 20 bp, Artificial Sequence
  Description of Artificial Sequence: Synthetic oligonucleotide
cctcctcggggagctgcccc

SEQ ID NO: 180352 - DNA, 20 bp, Artificial Sequence
  Description of Artificial Sequence: Synthetic oligonucleotide
ctcctcggggagctgccccg

SEQ ID NO: 180353 - DNA, 20 bp, Artificial Sequence
  Description of Artificial Sequence: Synthetic oligonucleotide
tcctcggggagctgccccgg

SEQ ID NO: 180354 - DNA, 20 bp, Artificial Sequence
  Description of Artificial Sequence: Synthetic oligonucleotide
cctcggggagctgccccggt

SEQ ID NO: 180355 - DNA, 20 bp, Artificial Sequence
  Description of Artificial Sequence: Synthetic oligonucleotide
ctcggggagctgccccggct

SEQ ID NO: 180356 - DNA, 20 bp, Artificial Sequence
  Description of Artificial Sequence: Synthetic oligonucleotide
tcggggagctgccccggctg

SEQ ID NO: 180357 - DNA, 20 bp, Artificial Sequence
  Description of Artificial Sequence: Synthetic oligonucleotide
cggggagctgccccggctgt

SEQ ID NO: 180358 - DNA, 20 bp, Artificial Sequence
  Description of Artificial Sequence: Synthetic oligonucleotide
ggggagctgccccggctgct

SEQ ID NO: 180359 - DNA, 20 bp, Artificial Sequence
  Description of Artificial Sequence: Synthetic oligonucleotide
gggagctgccccggctgctg

SEQ ID NO: 180360 - DNA, 21 bp, Artificial Sequence
  Description of Artificial Sequence: Synthetic oligonucleotide
ggagctgccccggctgctgct

SEQ ID NO: 180361 - DNA, 21 bp, Artificial Sequence
  Description of Artificial Sequence: Synthetic oligonucleotide
gagctgccccggctgctgctg

SEQ ID NO: 180362 - DNA, 22 bp, Artificial Sequence
  Description of Artificial Sequence: Synthetic oligonucleotide
agctgccccggctgctgctgct

SEQ ID NO: 180363 - DNA, 21 bp, Artificial Sequence
  Description of Artificial Sequence: Synthetic oligonucleotide
gctgccccggctgctgctgct

SEQ ID NO: 180364 - DNA, 21 bp, Artificial Sequence
  Description of Artificial Sequence: Synthetic oligonucleotide
ctgccccggctgctgctgctg

SEQ ID NO: 180365 - DNA, 22 bp, Artificial Sequence
  Description of Artificial Sequence: Synthetic oligonucleotide
tgccccggctgctgctgctggt

SEQ ID NO: 180366 - DNA, 21 bp, Artificial Sequence
  Description of Artificial Sequence: Synthetic oligonucleotide
gccccggctgctgctgctggt

SEQ ID NO: 180367 - DNA, 21 bp, Artificial Sequence
  Description of Artificial Sequence: Synthetic oligonucleotide
ccccggctgctgctgctggtg

SEQ ID NO: 180368 - DNA, 22 bp, Artificial Sequence
  Description of Artificial Sequence: Synthetic oligonucleotide
cccggctgctgctgctggtgct

SEQ ID NO: 180369 - DNA, 24 bp, Artificial Sequence
  Description of Artificial Sequence: Synthetic oligonucleotide
ccggctgctgctgctggtgctgtt

SEQ ID NO: 180370 - DNA, 25 bp, Artificial Sequence
  Description of Artificial Sequence: Synthetic oligonucleotide
cggctgctgctgctggtgctgttgt

SEQ ID NO: 180371 - DNA, 25 bp, Artificial Sequence
  Description of Artificial Sequence: Synthetic oligonucleotide
ggctgctgctgctggtgctgttgtg

SEQ ID NO: 180372 - DNA, 25 bp, Artificial Sequence
  Description of Artificial Sequence: Synthetic oligonucleotide
gctgctgctgctggtgctgttgtgc

SEQ ID NO: 180373 - DNA, 26 bp, Artificial Sequence
  Description of Artificial Sequence: Synthetic oligonucleotide
ctgctgctgctggtgctgttgtgcct

SEQ ID NO: 180374 - DNA, 26 bp, Artificial Sequence
  Description of Artificial Sequence: Synthetic oligonucleotide
tgctgctgctggtgctgttgtgcctg

SEQ ID NO: 180375 - DNA, 25 bp, Artificial Sequence
  Description of Artificial Sequence: Synthetic oligonucleotide
gctgctgctggtgctgttgtgcctg

SEQ ID NO: 180376 - DNA, 25 bp, Artificial Sequence
  Description of Artificial Sequence: Synthetic oligonucleotide
ctgctgctggtgctgttgtgcctgc

SEQ ID NO: 180377 - DNA, 25 bp, Artificial Sequence
  Description of Artificial Sequence: Synthetic oligonucleotide
tgctgctggtgctgttgtgcctgcc

SEQ ID NO: 180378 - DNA, 24 bp, Artificial Sequence
  Description of Artificial Sequence: Synthetic oligonucleotide
gctgctggtgctgttgtgcctgcc

SEQ ID NO: 180379 - DNA, 24 bp, Artificial Sequence
  Description of Artificial Sequence: Synthetic oligonucleotide
ctgctggtgctgttgtgcctgccg

SEQ ID NO: 180380 - DNA, 24 bp, Artificial Sequence
  Description of Artificial Sequence: Synthetic oligonucleotide
tgctggtgctgttgtgcctgccgg

SEQ ID NO: 180381 - DNA, 23 bp, Artificial Sequence
  Description of Artificial Sequence: Synthetic oligonucleotide
gctggtgctgttgtgcctgccgg

SEQ ID NO: 180382 - DNA, 23 bp, Artificial Sequence
  Description of Artificial Sequence: Synthetic oligonucleotide
ctggtgctgttgtgcctgccggc

SEQ ID NO: 180383 - DNA, 23 bp, Artificial Sequence
  Description of Artificial Sequence: Synthetic oligonucleotide
tggtgctgttgtgcctgccggcc

SEQ ID NO: 180384 - DNA, 22 bp, Artificial Sequence
  Description of Artificial Sequence: Synthetic oligonucleotide
ggtgctgttgtgcctgccggcc

SEQ ID NO: 180385 - DNA, 23 bp, Artificial Sequence
  Description of Artificial Sequence: Synthetic oligonucleotide
gtgctgttgtgcctgccggccgt

SEQ ID NO: 180386 - DNA, 24 bp, Artificial Sequence
  Description of Artificial Sequence: Synthetic oligonucleotide
tgctgttgtgcctgccggccgtgt

SEQ ID NO: 180387 - DNA, 23 bp, Artificial Sequence
  Description of Artificial Sequence: Synthetic oligonucleotide
gctgttgtgcctgccggccgtgt

SEQ ID NO: 180388 - DNA, 23 bp, Artificial Sequence
  Description of Artificial Sequence: Synthetic oligonucleotide
ctgttgtgcctgccggccgtgtg

SEQ ID NO: 180389 - DNA, 23 bp, Artificial Sequence
  Description of Artificial Sequence: Synthetic oligonucleotide
tgttgtgcctgccggccgtgtgg

SEQ ID NO: 180390 - DNA, 22 bp, Artificial Sequence
  Description of Artificial Sequence: Synthetic oligonucleotide
gttgtgcctgccggccgtgtgg

SEQ ID NO: 180391 - DNA, 22 bp, Artificial Sequence
  Description of Artificial Sequence: Synthetic oligonucleotide
ttgtgcctgccggccgtgtggg

SEQ ID NO: 180392 - DNA, 21 bp, Artificial Sequence
  Description of Artificial Sequence: Synthetic oligonucleotide
tgtgcctgccggccgtgtggg

SEQ ID NO: 180393 - DNA, 20 bp, Artificial Sequence
  Description of Artificial Sequence: Synthetic oligonucleotide
gtgcctgccggccgtgtggg

SEQ ID NO: 180394 - DNA, 21 bp, Artificial Sequence
  Description of Artificial Sequence: Synthetic oligonucleotide
tgcctgccggccgtgtggggt

SEQ ID NO: 180395 - DNA, 20 bp, Artificial Sequence
  Description of Artificial Sequence: Synthetic oligonucleotide
gcctgccggccgtgtggggt

SEQ ID NO: 180396 - DNA, 21 bp, Artificial Sequence
  Description of Artificial Sequence: Synthetic oligonucleotide
cctgccggccgtgtggggtga

SEQ ID NO: 180397 - DNA, 22 bp, Artificial Sequence
  Description of Artificial Sequence: Synthetic oligonucleotide
ctgccggccgtgtggggtgact

SEQ ID NO: 180398 - DNA, 23 bp, Artificial Sequence
  Description of Artificial Sequence: Synthetic oligonucleotide
tgccggccgtgtggggtgactgt

SEQ ID NO: 180399 - DNA, 22 bp, Artificial Sequence
  Description of Artificial Sequence: Synthetic oligonucleotide
gccggccgtgtggggtgactgt

SEQ ID NO: 180400 - DNA, 22 bp, Artificial Sequence
  Description of Artificial Sequence: Synthetic oligonucleotide
ccggccgtgtggggtgactgtg

SEQ ID NO: 180401 - DNA, 22 bp, Artificial Sequence
  Description of Artificial Sequence: Synthetic oligonucleotide
cggccgtgtggggtgactgtgg

SEQ ID NO: 180402 - DNA, 22 bp, Artificial Sequence
  Description of Artificial Sequence: Synthetic oligonucleotide
ggccgtgtggggtgactgtggc

SEQ ID NO: 180403 - DNA, 24 bp, Artificial Sequence
  Description of Artificial Sequence: Synthetic oligonucleotide
gccgtgtggggtgactgtggcctt

SEQ ID NO: 180404 - DNA, 24 bp, Artificial Sequence
  Description of Artificial Sequence: Synthetic oligonucleotide
ccgtgtggggtgactgtggccttc

SEQ ID NO: 180405 - DNA, 24 bp, Artificial Sequence
  Description of Artificial Sequence: Synthetic oligonucleotide
cgtgtggggtgactgtggccttcc

SEQ ID NO: 180406 - DNA, 24 bp, Artificial Sequence
  Description of Artificial Sequence: Synthetic oligonucleotide
gtgtggggtgactgtggccttccc

SEQ ID NO: 180407 - DNA, 24 bp, Artificial Sequence
  Description of Artificial Sequence: Synthetic oligonucleotide
tgtggggtgactgtggccttcccc

SEQ ID NO: 180408 - DNA, 23 bp, Artificial Sequence
  Description of Artificial Sequence: Synthetic oligonucleotide
gtggggtgactgtggccttcccc

SEQ ID NO: 180409 - DNA, 24 bp, Artificial Sequence
  Description of Artificial Sequence: Synthetic oligonucleotide
tggggtgactgtggccttccccca

SEQ ID NO: 180410 - DNA, 23 bp, Artificial Sequence
  Description of Artificial Sequence: Synthetic oligonucleotide
ggggtgactgtggccttccccca

SEQ ID NO: 180411 - DNA, 25 bp, Artificial Sequence
  Description of Artificial Sequence: Synthetic oligonucleotide
gggtgactgtggccttcccccagat

SEQ ID NO: 180412 - DNA, 27 bp, Artificial Sequence
  Description of Artificial Sequence: Synthetic oligonucleotide
ggtgactgtggccttcccccagatgta

SEQ ID NO: 180413 - DNA, 27 bp, Artificial Sequence
  Description of Artificial Sequence: Synthetic oligonucleotide
gtgactgtggccttcccccagatgtac

SEQ ID NO: 180414 - DNA, 27 bp, Artificial Sequence
  Description of Artificial Sequence: Synthetic oligonucleotide
tgactgtggccttcccccagatgtacc

SEQ ID NO: 180415 - DNA, 27 bp, Artificial Sequence
  Description of Artificial Sequence: Synthetic oligonucleotide
gactgtggccttcccccagatgtacct

SEQ ID NO: 180416 - DNA, 30 bp, Artificial Sequence
  Description of Artificial Sequence: Synthetic oligonucleotide
actgtggccttcccccagatgtacctaatg

SEQ ID NO: 180417 - DNA, 29 bp, Artificial Sequence
  Description of Artificial Sequence: Synthetic oligonucleotide
ctgtggccttcccccagatgtacctaatg

SEQ ID NO: 180418 - DNA, 29 bp, Artificial Sequence
  Description of Artificial Sequence: Synthetic oligonucleotide
tgtggccttcccccagatgtacctaatgc

SEQ ID NO: 180419 - DNA, 28 bp, Artificial Sequence
  Description of Artificial Sequence: Synthetic oligonucleotide
gtggccttcccccagatgtacctaatgc

SEQ ID NO: 180420 - DNA, 28 bp, Artificial Sequence
  Description of Artificial Sequence: Synthetic oligonucleotide
tggccttcccccagatgtacctaatgcc

SEQ ID NO: 180421 - DNA, 27 bp, Artificial Sequence
  Description of Artificial Sequence: Synthetic oligonucleotide
ggccttcccccagatgtacctaatgcc

SEQ ID NO: 180422 - DNA, 27 bp, Artificial Sequence
  Description of Artificial Sequence: Synthetic oligonucleotide
gccttcccccagatgtacctaatgccc

SEQ ID NO: 180423 - DNA, 28 bp, Artificial Sequence
  Description of Artificial Sequence: Synthetic oligonucleotide
ccttcccccagatgtacctaatgcccag

SEQ ID NO: 180424 - DNA, 28 bp, Artificial Sequence
  Description of Artificial Sequence: Synthetic oligonucleotide
cttcccccagatgtacctaatgcccagc

SEQ ID NO: 180425 - DNA, 28 bp, Artificial Sequence
  Description of Artificial Sequence: Synthetic oligonucleotide
ttcccccagatgtacctaatgcccagcc

SEQ ID NO: 180426 - DNA, 27 bp, Artificial Sequence
  Description of Artificial Sequence: Synthetic oligonucleotide
tcccccagatgtacctaatgcccagcc

SEQ ID NO: 180427 - DNA, 27 bp, Artificial Sequence
  Description of Artificial Sequence: Synthetic oligonucleotide
cccccagatgtacctaatgcccagcca

SEQ ID NO: 180428 - DNA, 27 bp, Artificial Sequence
  Description of Artificial Sequence: Synthetic oligonucleotide
ccccagatgtacctaatgcccagccag

SEQ ID NO: 180429 - DNA, 27 bp, Artificial Sequence
  Description of Artificial Sequence: Synthetic oligonucleotide
cccagatgtacctaatgcccagccagc

SEQ ID NO: 180430 - DNA, 30 bp, Artificial Sequence
  Description of Artificial Sequence: Synthetic oligonucleotide
ccagatgtacctaatgcccagccagctttg

SEQ ID NO: 180431 - DNA, 30 bp, Artificial Sequence
  Description of Artificial Sequence: Synthetic oligonucleotide
cagatgtacctaatgcccagccagctttgg

SEQ ID NO: 180432 - DNA, 32 bp, Artificial Sequence
  Description of Artificial Sequence: Synthetic oligonucleotide
agatgtacctaatgcccagccagctttggaag

SEQ ID NO: 180433 - DNA, 31 bp, Artificial Sequence
  Description of Artificial Sequence: Synthetic oligonucleotide
gatgtacctaatgcccagccagctttggaag

SEQ ID NO: 180434 - DNA, 31 bp, Artificial Sequence
  Description of Artificial Sequence: Synthetic oligonucleotide
atgtacctaatgcccagccagctttggaagg

SEQ ID NO: 180435 - DNA, 30 bp, Artificial Sequence
  Description of Artificial Sequence: Synthetic oligonucleotide
tgtacctaatgcccagccagctttggaagg

SEQ ID NO: 180436 - DNA, 29 bp, Artificial Sequence
  Description of Artificial Sequence: Synthetic oligonucleotide
gtacctaatgcccagccagctttggaagg

SEQ ID NO: 180437 - DNA, 29 bp, Artificial Sequence
  Description of Artificial Sequence: Synthetic oligonucleotide
tacctaatgcccagccagctttggaaggc

SEQ ID NO: 180438 - DNA, 28 bp, Artificial Sequence
  Description of Artificial Sequence: Synthetic oligonucleotide
acctaatgcccagccagctttggaaggc

SEQ ID NO: 180439 - DNA, 27 bp, Artificial Sequence
  Description of Artificial Sequence: Synthetic oligonucleotide
cctaatgcccagccagctttggaaggc

SEQ ID NO: 180440 - DNA, 27 bp, Artificial Sequence
  Description of Artificial Sequence: Synthetic oligonucleotide
ctaatgcccagccagctttggaaggcc

SEQ ID NO: 180441 - DNA, 27 bp, Artificial Sequence
  Description of Artificial Sequence: Synthetic oligonucleotide
taatgcccagccagctttggaaggccg

SEQ ID NO: 180442 - DNA, 27 bp, Artificial Sequence
  Description of Artificial Sequence: Synthetic oligonucleotide
aatgcccagccagctttggaaggccgt

SEQ ID NO: 180443 - DNA, 27 bp, Artificial Sequence
  Description of Artificial Sequence: Synthetic oligonucleotide
atgcccagccagctttggaaggccgta

SEQ ID NO: 180444 - DNA, 26 bp, Artificial Sequence
  Description of Artificial Sequence: Synthetic oligonucleotide
tgcccagccagctttggaaggccgta

SEQ ID NO: 180445 - DNA, 25 bp, Artificial Sequence
  Description of Artificial Sequence: Synthetic oligonucleotide
gcccagccagctttggaaggccgta

SEQ ID NO: 180446 - DNA, 27 bp, Artificial Sequence
  Description of Artificial Sequence: Synthetic oligonucleotide
cccagccagctttggaaggccgtacaa

SEQ ID NO: 180447 - DNA, 27 bp, Artificial Sequence
  Description of Artificial Sequence: Synthetic oligonucleotide
ccagccagctttggaaggccgtacaag

SEQ ID NO: 180448 - DNA, 31 bp, Artificial Sequence
  Description of Artificial Sequence: Synthetic oligonucleotide
cagccagctttggaaggccgtacaagttttc

SEQ ID NO: 180449 - DNA, 31 bp, Artificial Sequence
  Description of Artificial Sequence: Synthetic oligonucleotide
agccagctttggaaggccgtacaagttttcc

SEQ ID NO: 180450 - DNA, 30 bp, Artificial Sequence
  Description of Artificial Sequence: Synthetic oligonucleotide
gccagctttggaaggccgtacaagttttcc

SEQ ID NO: 180451 - DNA, 30 bp, Artificial Sequence
  Description of Artificial Sequence: Synthetic oligonucleotide
ccagctttggaaggccgtacaagttttccc

SEQ ID NO: 180452 - DNA, 30 bp, Artificial Sequence
  Description of Artificial Sequence: Synthetic oligonucleotide
cagctttggaaggccgtacaagttttcccg

SEQ ID NO: 180453 - DNA, 31 bp, Artificial Sequence
  Description of Artificial Sequence: Synthetic oligonucleotide
agctttggaaggccgtacaagttttcccgag

SEQ ID NO: 180454 - DNA, 30 bp, Artificial Sequence
  Description of Artificial Sequence: Synthetic oligonucleotide
gctttggaaggccgtacaagttttcccgag

SEQ ID NO: 180455 - DNA, 30 bp, Artificial Sequence
  Description of Artificial Sequence: Synthetic oligonucleotide
ctttggaaggccgtacaagttttcccgagg

SEQ ID NO: 180456 - DNA, 33 bp, Artificial Sequence
  Description of Artificial Sequence: Synthetic oligonucleotide
tttggaaggccgtacaagttttcccgaggatac

SEQ ID NO: 180457 - DNA, 32 bp, Artificial Sequence
  Description of Artificial Sequence: Synthetic oligonucleotide
ttggaaggccgtacaagttttcccgaggatac

SEQ ID NO: 180458 - DNA, 31 bp, Artificial Sequence
  Description of Artificial Sequence: Synthetic oligonucleotide
tggaaggccgtacaagttttcccgaggatac

SEQ ID NO: 180459 - DNA, 30 bp, Artificial Sequence
  Description of Artificial Sequence: Synthetic oligonucleotide
ggaaggccgtacaagttttcccgaggatac

SEQ ID NO: 180460 - DNA, 31 bp, Artificial Sequence
  Description of Artificial Sequence: Synthetic oligonucleotide
gaaggccgtacaagttttcccgaggatactg

SEQ ID NO: 180461 - DNA, 37 bp, Artificial Sequence
  Description of Artificial Sequence: Synthetic oligonucleotide
aaggccgtacaagttttcccgaggatactgtaataac

SEQ ID NO: 180462 - DNA, 36 bp, Artificial Sequence
  Description of Artificial Sequence: Synthetic oligonucleotide
aggccgtacaagttttcccgaggatactgtaataac

SEQ ID NO: 180463 - DNA, 35 bp, Artificial Sequence
  Description of Artificial Sequence: Synthetic oligonucleotide
ggccgtacaagttttcccgaggatactgtaataac

SEQ ID NO: 180464 - DNA, 35 bp, Artificial Sequence
  Description of Artificial Sequence: Synthetic oligonucleotide
gccgtacaagttttcccgaggatactgtaataacg

SEQ ID NO: 180465 - DNA, 37 bp, Artificial Sequence
  Description of Artificial Sequence: Synthetic oligonucleotide
ccgtacaagttttcccgaggatactgtaataacgtac

SEQ ID NO: 180466 - DNA, 41 bp, Artificial Sequence
  Description of Artificial Sequence: Synthetic oligonucleotide
cgtacaagttttcccgaggatactgtaataacgtacaaatg

SEQ ID NO: 180467 - DNA, 42 bp, Artificial Sequence
  Description of Artificial Sequence: Synthetic oligonucleotide
gtacaagttttcccgaggatactgtaataacgtacaaatgtg

SEQ ID NO: 180468 - DNA, 44 bp, Artificial Sequence
  Description of Artificial Sequence: Synthetic oligonucleotide
tacaagttttcccgaggatactgtaataacgtacaaatgtgaag

SEQ ID NO: 180469 - DNA, 43 bp, Artificial Sequence
  Description of Artificial Sequence: Synthetic oligonucleotide
acaagttttcccgaggatactgtaataacgtacaaatgtgaag

SEQ ID NO: 180470 - DNA, 42 bp, Artificial Sequence
  Description of Artificial Sequence: Synthetic oligonucleotide
caagttttcccgaggatactgtaataacgtacaaatgtgaag

SEQ ID NO: 180471 - DNA, 45 bp, Artificial Sequence
  Description of Artificial Sequence: Synthetic oligonucleotide
aagttttcccgaggatactgtaataacgtacaaatgtgaagaaag

SEQ ID NO: 180472 - DNA, 44 bp, Artificial Sequence
  Description of Artificial Sequence: Synthetic oligonucleotide
agttttcccgaggatactgtaataacgtacaaatgtgaagaaag

SEQ ID NO: 180473 - DNA, 43 bp, Artificial Sequence
  Description of Artificial Sequence: Synthetic oligonucleotide
gttttcccgaggatactgtaataacgtacaaatgtgaagaaag

SEQ ID NO: 180474 - DNA, 43 bp, Artificial Sequence
  Description of Artificial Sequence: Synthetic oligonucleotide
ttttcccgaggatactgtaataacgtacaaatgtgaagaaagc

SEQ ID NO: 180475 - DNA, 42 bp, Artificial Sequence
  Description of Artificial Sequence: Synthetic oligonucleotide
tttcccgaggatactgtaataacgtacaaatgtgaagaaagc

SEQ ID NO: 180476 - DNA, 41 bp, Artificial Sequence
  Description of Artificial Sequence: Synthetic oligonucleotide
ttcccgaggatactgtaataacgtacaaatgtgaagaaagc

SEQ ID NO: 180477 - DNA, 40 bp, Artificial Sequence
  Description of Artificial Sequence: Synthetic oligonucleotide
tcccgaggatactgtaataacgtacaaatgtgaagaaagc

SEQ ID NO: 180478 - DNA, 39 bp, Artificial Sequence
  Description of Artificial Sequence: Synthetic oligonucleotide
cccgaggatactgtaataacgtacaaatgtgaagaaagc

SEQ ID NO: 180479 - DNA, 42 bp, Artificial Sequence
  Description of Artificial Sequence: Synthetic oligonucleotide
ccgaggatactgtaataacgtacaaatgtgaagaaagctttg

SEQ ID NO: 180480 - DNA, 43 bp, Artificial Sequence
  Description of Artificial Sequence: Synthetic oligonucleotide
cgaggatactgtaataacgtacaaatgtgaagaaagctttgtg

SEQ ID NO: 180481 - DNA, 49 bp, Artificial Sequence
  Description of Artificial Sequence: Synthetic oligonucleotide
gaggatactgtaataacgtacaaatgtgaagaaagctttgtgaaaattc

SEQ ID NO: 180482 - DNA, 49 bp, Artificial Sequence
  Description of Artificial Sequence: Synthetic oligonucleotide
aggatactgtaataacgtacaaatgtgaagaaagctttgtgaaaattcc

SEQ ID NO: 180483 - DNA, 48 bp, Artificial Sequence
  Description of Artificial Sequence: Synthetic oligonucleotide
ggatactgtaataacgtacaaatgtgaagaaagctttgtgaaaattcc

SEQ ID NO: 180484 - DNA, 49 bp, Artificial Sequence
  Description of Artificial Sequence: Synthetic oligonucleotide
gatactgtaataacgtacaaatgtgaagaaagctttgtgaaaattcctg

SEQ ID NO: 180485 - DNA, 49 bp, Artificial Sequence
  Description of Artificial Sequence: Synthetic oligonucleotide
atactgtaataacgtacaaatgtgaagaaagctttgtgaaaattcctgg

SEQ ID NO: 180486 - DNA, 48 bp, Artificial Sequence
  Description of Artificial Sequence: Synthetic oligonucleotide
tactgtaataacgtacaaatgtgaagaaagctttgtgaaaattcctgg

SEQ ID NO: 180487 - DNA, 47 bp, Artificial Sequence
  Description of Artificial Sequence: Synthetic oligonucleotide
actgtaataacgtacaaatgtgaagaaagctttgtgaaaattcctgg

SEQ ID NO: 180488 - DNA, 46 bp, Artificial Sequence
  Description of Artificial Sequence: Synthetic oligonucleotide
ctgtaataacgtacaaatgtgaagaaagctttgtgaaaattcctgg

SEQ ID NO: 180489 - DNA, 46 bp, Artificial Sequence
  Description of Artificial Sequence: Synthetic oligonucleotide
tgtaataacgtacaaatgtgaagaaagctttgtgaaaattcctggc

SEQ ID NO: 180490 - DNA, 45 bp, Artificial Sequence
  Description of Artificial Sequence: Synthetic oligonucleotide
gtaataacgtacaaatgtgaagaaagctttgtgaaaattcctggc

SEQ ID NO: 180491 - DNA, 45 bp, Artificial Sequence
  Description of Artificial Sequence: Synthetic oligonucleotide
taataacgtacaaatgtgaagaaagctttgtgaaaattcctggcg

SEQ ID NO: 180492 - DNA, 44 bp, Artificial Sequence
  Description of Artificial Sequence: Synthetic oligonucleotide
aataacgtacaaatgtgaagaaagctttgtgaaaattcctggcg

SEQ ID NO: 180493 - DNA, 43 bp, Artificial Sequence
  Description of Artificial Sequence: Synthetic oligonucleotide
ataacgtacaaatgtgaagaaagctttgtgaaaattcctggcg

SEQ ID NO: 180494 - DNA, 42 bp, Artificial Sequence
  Description of Artificial Sequence: Synthetic oligonucleotide
taacgtacaaatgtgaagaaagctttgtgaaaattcctggcg

SEQ ID NO: 180495 - DNA, 41 bp, Artificial Sequence
  Description of Artificial Sequence: Synthetic oligonucleotide
aacgtacaaatgtgaagaaagctttgtgaaaattcctggcg

SEQ ID NO: 180496 - DNA, 40 bp, Artificial Sequence
  Description of Artificial Sequence: Synthetic oligonucleotide
acgtacaaatgtgaagaaagctttgtgaaaattcctggcg

SEQ ID NO: 180497 - DNA, 39 bp, Artificial Sequence
  Description of Artificial Sequence: Synthetic oligonucleotide
cgtacaaatgtgaagaaagctttgtgaaaattcctggcg

SEQ ID NO: 180498 - DNA, 40 bp, Artificial Sequence
  Description of Artificial Sequence: Synthetic oligonucleotide
gtacaaatgtgaagaaagctttgtgaaaattcctggcgag

SEQ ID NO: 180499 - DNA, 42 bp, Artificial Sequence
  Description of Artificial Sequence: Synthetic oligonucleotide
tacaaatgtgaagaaagctttgtgaaaattcctggcgagaag

SEQ ID NO: 180500 - DNA, 41 bp, Artificial Sequence
  Description of Artificial Sequence: Synthetic oligonucleotide
acaaatgtgaagaaagctttgtgaaaattcctggcgagaag

SEQ ID NO: 180501 - DNA, 40 bp, Artificial Sequence
  Description of Artificial Sequence: Synthetic oligonucleotide
caaatgtgaagaaagctttgtgaaaattcctggcgagaag

SEQ ID NO: 180502 - DNA, 40 bp, Artificial Sequence
  Description of Artificial Sequence: Synthetic oligonucleotide
aaatgtgaagaaagctttgtgaaaattcctggcgagaagg

SEQ ID NO: 180503 - DNA, 39 bp, Artificial Sequence
  Description of Artificial Sequence: Synthetic oligonucleotide
aatgtgaagaaagctttgtgaaaattcctggcgagaagg

SEQ ID NO: 180504 - DNA, 38 bp, Artificial Sequence
  Description of Artificial Sequence: Synthetic oligonucleotide
atgtgaagaaagctttgtgaaaattcctggcgagaagg

SEQ ID NO: 180505 - DNA, 37 bp, Artificial Sequence
  Description of Artificial Sequence: Synthetic oligonucleotide
tgtgaagaaagctttgtgaaaattcctggcgagaagg

SEQ ID NO: 180506 - DNA, 36 bp, Artificial Sequence
  Description of Artificial Sequence: Synthetic oligonucleotide
gtgaagaaagctttgtgaaaattcctggcgagaagg

SEQ ID NO: 180507 - DNA, 37 bp, Artificial Sequence
  Description of Artificial Sequence: Synthetic oligonucleotide
tgaagaaagctttgtgaaaattcctggcgagaaggac

SEQ ID NO: 180508 - DNA, 36 bp, Artificial Sequence
  Description of Artificial Sequence: Synthetic oligonucleotide
gaagaaagctttgtgaaaattcctggcgagaaggac

SEQ ID NO: 180509 - DNA, 37 bp, Artificial Sequence
  Description of Artificial Sequence: Synthetic oligonucleotide
aagaaagctttgtgaaaattcctggcgagaaggactc

SEQ ID NO: 180510 - DNA, 36 bp, Artificial Sequence
  Description of Artificial Sequence: Synthetic oligonucleotide
agaaagctttgtgaaaattcctggcgagaaggactc

SEQ ID NO: 180511 - DNA, 35 bp, Artificial Sequence
  Description of Artificial Sequence: Synthetic oligonucleotide
gaaagctttgtgaaaattcctggcgagaaggactc

SEQ ID NO: 180512 - DNA, 36 bp, Artificial Sequence
  Description of Artificial Sequence: Synthetic oligonucleotide
aaagctttgtgaaaattcctggcgagaaggactcag

SEQ ID NO: 180513 - DNA, 35 bp, Artificial Sequence
  Description of Artificial Sequence: Synthetic oligonucleotide
aagctttgtgaaaattcctggcgagaaggactcag

SEQ ID NO: 180514 - DNA, 34 bp, Artificial Sequence
  Description of Artificial Sequence: Synthetic oligonucleotide
agctttgtgaaaattcctggcgagaaggactcag

SEQ ID NO: 180515 - DNA, 33 bp, Artificial Sequence
  Description of Artificial Sequence: Synthetic oligonucleotide
gctttgtgaaaattcctggcgagaaggactcag

SEQ ID NO: 180516 - DNA, 34 bp, Artificial Sequence
  Description of Artificial Sequence: Synthetic oligonucleotide
ctttgtgaaaattcctggcgagaaggactcagtg

SEQ ID NO: 180517 - DNA, 36 bp, Artificial Sequence
  Description of Artificial Sequence: Synthetic oligonucleotide
tttgtgaaaattcctggcgagaaggactcagtgatc

SEQ ID NO: 180518 - DNA, 35 bp, Artificial Sequence
  Description of Artificial Sequence: Synthetic oligonucleotide
ttgtgaaaattcctggcgagaaggactcagtgatc

SEQ ID NO: 180519 - DNA, 34 bp, Artificial Sequence
  Description of Artificial Sequence: Synthetic oligonucleotide
tgtgaaaattcctggcgagaaggactcagtgatc

SEQ ID NO: 180520 - DNA, 33 bp, Artificial Sequence
  Description of Artificial Sequence: Synthetic oligonucleotide
gtgaaaattcctggcgagaaggactcagtgatc

SEQ ID NO: 180521 - DNA, 34 bp, Artificial Sequence
  Description of Artificial Sequence: Synthetic oligonucleotide
tgaaaattcctggcgagaaggactcagtgatctg

SEQ ID NO: 180522 - DNA, 33 bp, Artificial Sequence
  Description of Artificial Sequence: Synthetic oligonucleotide
gaaaattcctggcgagaaggactcagtgatctg

SEQ ID NO: 180523 - DNA, 33 bp, Artificial Sequence
  Description of Artificial Sequence: Synthetic oligonucleotide
aaaattcctggcgagaaggactcagtgatctgc

SEQ ID NO: 180524 - DNA, 32 bp, Artificial Sequence
  Description of Artificial Sequence: Synthetic oligonucleotide
aaattcctggcgagaaggactcagtgatctgc

SEQ ID NO: 180525 - DNA, 31 bp, Artificial Sequence
  Description of Artificial Sequence: Synthetic oligonucleotide
aattcctggcgagaaggactcagtgatctgc

SEQ ID NO: 180526 - DNA, 30 bp, Artificial Sequence
  Description of Artificial Sequence: Synthetic oligonucleotide
attcctggcgagaaggactcagtgatctgc

SEQ ID NO: 180527 - DNA, 29 bp, Artificial Sequence
  Description of Artificial Sequence: Synthetic oligonucleotide
ttcctggcgagaaggactcagtgatctgc

SEQ ID NO: 180528 - DNA, 28 bp, Artificial Sequence
  Description of Artificial Sequence: Synthetic oligonucleotide
tcctggcgagaaggactcagtgatctgc

SEQ ID NO: 180529 - DNA, 27 bp, Artificial Sequence
  Description of Artificial Sequence: Synthetic oligonucleotide
cctggcgagaaggactcagtgatctgc

SEQ ID NO: 180530 - DNA, 27 bp, Artificial Sequence
  Description of Artificial Sequence: Synthetic oligonucleotide
ctggcgagaaggactcagtgatctgcc

SEQ ID NO: 180531 - DNA, 31 bp, Artificial Sequence
  Description of Artificial Sequence: Synthetic oligonucleotide
tggcgagaaggactcagtgatctgccttaag

SEQ ID NO: 180532 - DNA, 30 bp, Artificial Sequence
  Description of Artificial Sequence: Synthetic oligonucleotide
ggcgagaaggactcagtgatctgccttaag

SEQ ID NO: 180533 - DNA, 30 bp, Artificial Sequence
  Description of Artificial Sequence: Synthetic oligonucleotide
gcgagaaggactcagtgatctgccttaagg

SEQ ID NO: 180534 - DNA, 30 bp, Artificial Sequence
  Description of Artificial Sequence: Synthetic oligonucleotide
cgagaaggactcagtgatctgccttaaggg

SEQ ID NO: 180535 - DNA, 30 bp, Artificial Sequence
  Description of Artificial Sequence: Synthetic oligonucleotide
gagaaggactcagtgatctgccttaagggc

SEQ ID NO: 180536 - DNA, 31 bp, Artificial Sequence
  Description of Artificial Sequence: Synthetic oligonucleotide
agaaggactcagtgatctgccttaagggcag

SEQ ID NO: 180537 - DNA, 30 bp, Artificial Sequence
  Description of Artificial Sequence: Synthetic oligonucleotide
gaaggactcagtgatctgccttaagggcag

SEQ ID NO: 180538 - DNA, 31 bp, Artificial Sequence
  Description of Artificial Sequence: Synthetic oligonucleotide
aaggactcagtgatctgccttaagggcagtc

SEQ ID NO: 180539 - DNA, 30 bp, Artificial Sequence
  Description of Artificial Sequence: Synthetic oligonucleotide
aggactcagtgatctgccttaagggcagtc

SEQ ID NO: 180540 - DNA, 29 bp, Artificial Sequence
  Description of Artificial Sequence: Synthetic oligonucleotide
ggactcagtgatctgccttaagggcagtc

SEQ ID NO: 180541 - DNA, 32 bp, Artificial Sequence
  Description of Artificial Sequence: Synthetic oligonucleotide
gactcagtgatctgccttaagggcagtcaatg

SEQ ID NO: 180542 - DNA, 32 bp, Artificial Sequence
  Description of Artificial Sequence: Synthetic oligonucleotide
actcagtgatctgccttaagggcagtcaatgg

SEQ ID NO: 180543 - DNA, 31 bp, Artificial Sequence
  Description of Artificial Sequence: Synthetic oligonucleotide
ctcagtgatctgccttaagggcagtcaatgg

SEQ ID NO: 180544 - DNA, 32 bp, Artificial Sequence
  Description of Artificial Sequence: Synthetic oligonucleotide
tcagtgatctgccttaagggcagtcaatggtc

SEQ ID NO: 180545 - DNA, 31 bp, Artificial Sequence
  Description of Artificial Sequence: Synthetic oligonucleotide
cagtgatctgccttaagggcagtcaatggtc

SEQ ID NO: 180546 - DNA, 32 bp, Artificial Sequence
  Description of Artificial Sequence: Synthetic oligonucleotide
agtgatctgccttaagggcagtcaatggtcag

SEQ ID NO: 180547 - DNA, 31 bp, Artificial Sequence
  Description of Artificial Sequence: Synthetic oligonucleotide
gtgatctgccttaagggcagtcaatggtcag

SEQ ID NO: 180548 - DNA, 36 bp, Artificial Sequence
  Description of Artificial Sequence: Synthetic oligonucleotide
tgatctgccttaagggcagtcaatggtcagatattg

SEQ ID NO: 180549 - DNA, 35 bp, Artificial Sequence
  Description of Artificial Sequence: Synthetic oligonucleotide
gatctgccttaagggcagtcaatggtcagatattg

SEQ ID NO: 180550 - DNA, 37 bp, Artificial Sequence
  Description of Artificial Sequence: Synthetic oligonucleotide
atctgccttaagggcagtcaatggtcagatattgaag

SEQ ID NO: 180551 - DNA, 36 bp, Artificial Sequence
  Description of Artificial Sequence: Synthetic oligonucleotide
tctgccttaagggcagtcaatggtcagatattgaag

SEQ ID NO: 180552 - DNA, 35 bp, Artificial Sequence
  Description of Artificial Sequence: Synthetic oligonucleotide
ctgccttaagggcagtcaatggtcagatattgaag

SEQ ID NO: 180553 - DNA, 36 bp, Artificial Sequence
  Description of Artificial Sequence: Synthetic oligonucleotide
tgccttaagggcagtcaatggtcagatattgaagag

SEQ ID NO: 180554 - DNA, 35 bp, Artificial Sequence
  Description of Artificial Sequence: Synthetic oligonucleotide
gccttaagggcagtcaatggtcagatattgaagag

SEQ ID NO: 180555 - DNA, 37 bp, Artificial Sequence
  Description of Artificial Sequence: Synthetic oligonucleotide
ccttaagggcagtcaatggtcagatattgaagagttc

SEQ ID NO: 180556 - DNA, 38 bp, Artificial Sequence
  Description of Artificial Sequence: Synthetic oligonucleotide
cttaagggcagtcaatggtcagatattgaagagttctg

SEQ ID NO: 180557 - DNA, 38 bp, Artificial Sequence
  Description of Artificial Sequence: Synthetic oligonucleotide
ttaagggcagtcaatggtcagatattgaagagttctgc

SEQ ID NO: 180558 - DNA, 37 bp, Artificial Sequence
  Description of Artificial Sequence: Synthetic oligonucleotide
taagggcagtcaatggtcagatattgaagagttctgc

SEQ ID NO: 180559 - DNA, 36 bp, Artificial Sequence
  Description of Artificial Sequence: Synthetic oligonucleotide
aagggcagtcaatggtcagatattgaagagttctgc

SEQ ID NO: 180560 - DNA, 35 bp, Artificial Sequence
  Description of Artificial Sequence: Synthetic oligonucleotide
agggcagtcaatggtcagatattgaagagttctgc

SEQ ID NO: 180561 - DNA, 34 bp, Artificial Sequence
  Description of Artificial Sequence: Synthetic oligonucleotide
gggcagtcaatggtcagatattgaagagttctgc

SEQ ID NO: 180562 - DNA, 37 bp, Artificial Sequence
  Description of Artificial Sequence: Synthetic oligonucleotide
ggcagtcaatggtcagatattgaagagttctgcaatc

SEQ ID NO: 180563 - DNA, 37 bp, Artificial Sequence
  Description of Artificial Sequence: Synthetic oligonucleotide
gcagtcaatggtcagatattgaagagttctgcaatcg

SEQ ID NO: 180564 - DNA, 39 bp, Artificial Sequence
  Description of Artificial Sequence: Synthetic oligonucleotide
cagtcaatggtcagatattgaagagttctgcaatcgtag

SEQ ID NO: 180565 - DNA, 39 bp, Artificial Sequence
  Description of Artificial Sequence: Synthetic oligonucleotide
agtcaatggtcagatattgaagagttctgcaatcgtagc

SEQ ID NO: 180566 - DNA, 38 bp, Artificial Sequence
  Description of Artificial Sequence: Synthetic oligonucleotide
gtcaatggtcagatattgaagagttctgcaatcgtagc

SEQ ID NO: 180567 - DNA, 39 bp, Artificial Sequence
  Description of Artificial Sequence: Synthetic oligonucleotide
tcaatggtcagatattgaagagttctgcaatcgtagctg

SEQ ID NO: 180568 - DNA, 38 bp, Artificial Sequence
  Description of Artificial Sequence: Synthetic oligonucleotide
caatggtcagatattgaagagttctgcaatcgtagctg

SEQ ID NO: 180569 - DNA, 38 bp, Artificial Sequence
  Description of Artificial Sequence: Synthetic oligonucleotide
aatggtcagatattgaagagttctgcaatcgtagctgc

SEQ ID NO: 180570 - DNA, 37 bp, Artificial Sequence
  Description of Artificial Sequence: Synthetic oligonucleotide
atggtcagatattgaagagttctgcaatcgtagctgc

SEQ ID NO: 180571 - DNA, 36 bp, Artificial Sequence
  Description of Artificial Sequence: Synthetic oligonucleotide
tggtcagatattgaagagttctgcaatcgtagctgc

SEQ ID NO: 180572 - DNA, 35 bp, Artificial Sequence
  Description of Artificial Sequence: Synthetic oligonucleotide
ggtcagatattgaagagttctgcaatcgtagctgc

SEQ ID NO: 180573 - DNA, 35 bp, Artificial Sequence
  Description of Artificial Sequence: Synthetic oligonucleotide
gtcagatattgaagagttctgcaatcgtagctgcg

SEQ ID NO: 180574 - DNA, 36 bp, Artificial Sequence
  Description of Artificial Sequence: Synthetic oligonucleotide
tcagatattgaagagttctgcaatcgtagctgcgag

SEQ ID NO: 180575 - DNA, 35 bp, Artificial Sequence
  Description of Artificial Sequence: Synthetic oligonucleotide
cagatattgaagagttctgcaatcgtagctgcgag

SEQ ID NO: 180576 - DNA, 35 bp, Artificial Sequence
  Description of Artificial Sequence: Synthetic oligonucleotide
agatattgaagagttctgcaatcgtagctgcgagg

SEQ ID NO: 180577 - DNA, 34 bp, Artificial Sequence
  Description of Artificial Sequence: Synthetic oligonucleotide
gatattgaagagttctgcaatcgtagctgcgagg

SEQ ID NO: 180578 - DNA, 35 bp, Artificial Sequence
  Description of Artificial Sequence: Synthetic oligonucleotide
atattgaagagttctgcaatcgtagctgcgaggtg

SEQ ID NO: 180579 - DNA, 34 bp, Artificial Sequence
  Description of Artificial Sequence: Synthetic oligonucleotide
tattgaagagttctgcaatcgtagctgcgaggtg

SEQ ID NO: 180580 - DNA, 33 bp, Artificial Sequence
  Description of Artificial Sequence: Synthetic oligonucleotide
attgaagagttctgcaatcgtagctgcgaggtg

SEQ ID NO: 180581 - DNA, 32 bp, Artificial Sequence
  Description of Artificial Sequence: Synthetic oligonucleotide
ttgaagagttctgcaatcgtagctgcgaggtg

SEQ ID NO: 180582 - DNA, 31 bp, Artificial Sequence
  Description of Artificial Sequence: Synthetic oligonucleotide
tgaagagttctgcaatcgtagctgcgaggtg

SEQ ID NO: 180583 - DNA, 30 bp, Artificial Sequence
  Description of Artificial Sequence: Synthetic oligonucleotide
gaagagttctgcaatcgtagctgcgaggtg

SEQ ID NO: 180584 - DNA, 30 bp, Artificial Sequence
  Description of Artificial Sequence: Synthetic oligonucleotide
aagagttctgcaatcgtagctgcgaggtgc

SEQ ID NO: 180585 - DNA, 29 bp, Artificial Sequence
  Description of Artificial Sequence: Synthetic oligonucleotide
agagttctgcaatcgtagctgcgaggtgc

SEQ ID NO: 180586 - DNA, 28 bp, Artificial Sequence
  Description of Artificial Sequence: Synthetic oligonucleotide
gagttctgcaatcgtagctgcgaggtgc

SEQ ID NO: 180587 - DNA, 28 bp, Artificial Sequence
  Description of Artificial Sequence: Synthetic oligonucleotide
agttctgcaatcgtagctgcgaggtgcc

SEQ ID NO: 180588 - DNA, 27 bp, Artificial Sequence
  Description of Artificial Sequence: Synthetic oligonucleotide
gttctgcaatcgtagctgcgaggtgcc

SEQ ID NO: 180589 - DNA, 29 bp, Artificial Sequence
  Description of Artificial Sequence: Synthetic oligonucleotide
ttctgcaatcgtagctgcgaggtgccaac

SEQ ID NO: 180590 - DNA, 28 bp, Artificial Sequence
  Description of Artificial Sequence: Synthetic oligonucleotide
tctgcaatcgtagctgcgaggtgccaac

SEQ ID NO: 180591 - DNA, 27 bp, Artificial Sequence
  Description of Artificial Sequence: Synthetic oligonucleotide
ctgcaatcgtagctgcgaggtgccaac

SEQ ID NO: 180592 - DNA, 29 bp, Artificial Sequence
  Description of Artificial Sequence: Synthetic oligonucleotide
tgcaatcgtagctgcgaggtgccaacaag

SEQ ID NO: 180593 - DNA, 28 bp, Artificial Sequence
  Description of Artificial Sequence: Synthetic oligonucleotide
gcaatcgtagctgcgaggtgccaacaag

SEQ ID NO: 180594 - DNA, 28 bp, Artificial Sequence
  Description of Artificial Sequence: Synthetic oligonucleotide
caatcgtagctgcgaggtgccaacaagg

SEQ ID NO: 180595 - DNA, 28 bp, Artificial Sequence
  Description of Artificial Sequence: Synthetic oligonucleotide
aatcgtagctgcgaggtgccaacaaggc

SEQ ID NO: 180596 - DNA, 27 bp, Artificial Sequence
  Description of Artificial Sequence: Synthetic oligonucleotide
atcgtagctgcgaggtgccaacaaggc

SEQ ID NO: 180597 - DNA, 27 bp, Artificial Sequence
  Description of Artificial Sequence: Synthetic oligonucleotide
tcgtagctgcgaggtgccaacaaggct

SEQ ID NO: 180598 - DNA, 27 bp, Artificial Sequence
  Description of Artificial Sequence: Synthetic oligonucleotide
cgtagctgcgaggtgccaacaaggcta

SEQ ID NO: 180599 - DNA, 31 bp, Artificial Sequence
  Description of Artificial Sequence: Synthetic oligonucleotide
gtagctgcgaggtgccaacaaggctaaattc

SEQ ID NO: 180600 - DNA, 32 bp, Artificial Sequence
  Description of Artificial Sequence: Synthetic oligonucleotide
tagctgcgaggtgccaacaaggctaaattctg

SEQ ID NO: 180601 - DNA, 31 bp, Artificial Sequence
  Description of Artificial Sequence: Synthetic oligonucleotide
agctgcgaggtgccaacaaggctaaattctg

SEQ ID NO: 180602 - DNA, 30 bp, Artificial Sequence
  Description of Artificial Sequence: Synthetic oligonucleotide
gctgcgaggtgccaacaaggctaaattctg

SEQ ID NO: 180603 - DNA, 30 bp, Artificial Sequence
  Description of Artificial Sequence: Synthetic oligonucleotide
ctgcgaggtgccaacaaggctaaattctgc

SEQ ID NO: 180604 - DNA, 32 bp, Artificial Sequence
  Description of Artificial Sequence: Synthetic oligonucleotide
tgcgaggtgccaacaaggctaaattctgcatc

SEQ ID NO: 180605 - DNA, 31 bp, Artificial Sequence
  Description of Artificial Sequence: Synthetic oligonucleotide
gcgaggtgccaacaaggctaaattctgcatc

SEQ ID NO: 180606 - DNA, 31 bp, Artificial Sequence
  Description of Artificial Sequence: Synthetic oligonucleotide
cgaggtgccaacaaggctaaattctgcatcc

SEQ ID NO: 180607 - DNA, 31 bp, Artificial Sequence
  Description of Artificial Sequence: Synthetic oligonucleotide
gaggtgccaacaaggctaaattctgcatccc

SEQ ID NO: 180608 - DNA, 32 bp, Artificial Sequence
  Description of Artificial Sequence: Synthetic oligonucleotide
aggtgccaacaaggctaaattctgcatccctc

SEQ ID NO: 180609 - DNA, 31 bp, Artificial Sequence
  Description of Artificial Sequence: Synthetic oligonucleotide
ggtgccaacaaggctaaattctgcatccctc

SEQ ID NO: 180610 - DNA, 34 bp, Artificial Sequence
  Description of Artificial Sequence: Synthetic oligonucleotide
gtgccaacaaggctaaattctgcatccctcaaac

SEQ ID NO: 180611 - DNA, 35 bp, Artificial Sequence
  Description of Artificial Sequence: Synthetic oligonucleotide
tgccaacaaggctaaattctgcatccctcaaacag

SEQ ID NO: 180612 - DNA, 34 bp, Artificial Sequence
  Description of Artificial Sequence: Synthetic oligonucleotide
gccaacaaggctaaattctgcatccctcaaacag

SEQ ID NO: 180613 - DNA, 34 bp, Artificial Sequence
  Description of Artificial Sequence: Synthetic oligonucleotide
ccaacaaggctaaattctgcatccctcaaacagc

SEQ ID NO: 180614 - DNA, 34 bp, Artificial Sequence
  Description of Artificial Sequence: Synthetic oligonucleotide
caacaaggctaaattctgcatccctcaaacagcc

SEQ ID NO: 180615 - DNA, 40 bp, Artificial Sequence
  Description of Artificial Sequence: Synthetic oligonucleotide
aacaaggctaaattctgcatccctcaaacagccttatatc

SEQ ID NO: 180616 - DNA, 39 bp, Artificial Sequence
  Description of Artificial Sequence: Synthetic oligonucleotide
acaaggctaaattctgcatccctcaaacagccttatatc

SEQ ID NO: 180617 - DNA, 38 bp, Artificial Sequence
  Description of Artificial Sequence: Synthetic oligonucleotide
caaggctaaattctgcatccctcaaacagccttatatc

SEQ ID NO: 180618 - DNA, 39 bp, Artificial Sequence
  Description of Artificial Sequence: Synthetic oligonucleotide
aaggctaaattctgcatccctcaaacagccttatatcac

SEQ ID NO: 180619 - DNA, 38 bp, Artificial Sequence
  Description of Artificial Sequence: Synthetic oligonucleotide
aggctaaattctgcatccctcaaacagccttatatcac

SEQ ID NO: 180620 - DNA, 37 bp, Artificial Sequence
  Description of Artificial Sequence: Synthetic oligonucleotide
ggctaaattctgcatccctcaaacagccttatatcac

SEQ ID NO: 180621 - DNA, 38 bp, Artificial Sequence
  Description of Artificial Sequence: Synthetic oligonucleotide
gctaaattctgcatccctcaaacagccttatatcactc

SEQ ID NO: 180622 - DNA, 39 bp, Artificial Sequence
  Description of Artificial Sequence: Synthetic oligonucleotide
ctaaattctgcatccctcaaacagccttatatcactcag

SEQ ID NO: 180623 - DNA, 48 bp, Artificial Sequence
  Description of Artificial Sequence: Synthetic oligonucleotide
taaattctgcatccctcaaacagccttatatcactcagaattattttc

SEQ ID NO: 180624 - DNA, 47 bp, Artificial Sequence
  Description of Artificial Sequence: Synthetic oligonucleotide
aaattctgcatccctcaaacagccttatatcactcagaattattttc

SEQ ID NO: 180625 - DNA, 46 bp, Artificial Sequence
  Description of Artificial Sequence: Synthetic oligonucleotide
aattctgcatccctcaaacagccttatatcactcagaattattttc

SEQ ID NO: 180626 - DNA, 45 bp, Artificial Sequence
  Description of Artificial Sequence: Synthetic oligonucleotide
attctgcatccctcaaacagccttatatcactcagaattattttc

SEQ ID NO: 180627 - DNA, 44 bp, Artificial Sequence
  Description of Artificial Sequence: Synthetic oligonucleotide
ttctgcatccctcaaacagccttatatcactcagaattattttc

SEQ ID NO: 180628 - DNA, 43 bp, Artificial Sequence
  Description of Artificial Sequence: Synthetic oligonucleotide
tctgcatccctcaaacagccttatatcactcagaattattttc

SEQ ID NO: 180629 - DNA, 42 bp, Artificial Sequence
  Description of Artificial Sequence: Synthetic oligonucleotide
ctgcatccctcaaacagccttatatcactcagaattattttc

SEQ ID NO: 180630 - DNA, 42 bp, Artificial Sequence
  Description of Artificial Sequence: Synthetic oligonucleotide
tgcatccctcaaacagccttatatcactcagaattattttcc

SEQ ID NO: 180631 - DNA, 41 bp, Artificial Sequence
  Description of Artificial Sequence: Synthetic oligonucleotide
gcatccctcaaacagccttatatcactcagaattattttcc

SEQ ID NO: 180632 - DNA, 42 bp, Artificial Sequence
  Description of Artificial Sequence: Synthetic oligonucleotide
catccctcaaacagccttatatcactcagaattattttccag

SEQ ID NO: 180633 - DNA, 43 bp, Artificial Sequence
  Description of Artificial Sequence: Synthetic oligonucleotide
atccctcaaacagccttatatcactcagaattattttccagtc

SEQ ID NO: 180634 - DNA, 42 bp, Artificial Sequence
  Description of Artificial Sequence: Synthetic oligonucleotide
tccctcaaacagccttatatcactcagaattattttccagtc

SEQ ID NO: 180635 - DNA, 41 bp, Artificial Sequence
  Description of Artificial Sequence: Synthetic oligonucleotide
ccctcaaacagccttatatcactcagaattattttccagtc

SEQ ID NO: 180636 - DNA, 41 bp, Artificial Sequence
  Description of Artificial Sequence: Synthetic oligonucleotide
cctcaaacagccttatatcactcagaattattttccagtcg

SEQ ID NO: 180637 - DNA, 41 bp, Artificial Sequence
  Description of Artificial Sequence: Synthetic oligonucleotide
ctcaaacagccttatatcactcagaattattttccagtcgg

SEQ ID NO: 180638 - DNA, 43 bp, Artificial Sequence
  Description of Artificial Sequence: Synthetic oligonucleotide
tcaaacagccttatatcactcagaattattttccagtcggtac

SEQ ID NO: 180639 - DNA, 42 bp, Artificial Sequence
  Description of Artificial Sequence: Synthetic oligonucleotide
caaacagccttatatcactcagaattattttccagtcggtac

SEQ ID NO: 180640 - DNA, 43 bp, Artificial Sequence
  Description of Artificial Sequence: Synthetic oligonucleotide
aaacagccttatatcactcagaattattttccagtcggtactg

SEQ ID NO: 180641 - DNA, 42 bp, Artificial Sequence
  Description of Artificial Sequence: Synthetic oligonucleotide
aacagccttatatcactcagaattattttccagtcggtactg

SEQ ID NO: 180642 - DNA, 41 bp, Artificial Sequence
  Description of Artificial Sequence: Synthetic oligonucleotide
acagccttatatcactcagaattattttccagtcggtactg

SEQ ID NO: 180643 - DNA, 40 bp, Artificial Sequence
  Description of Artificial Sequence: Synthetic oligonucleotide
cagccttatatcactcagaattattttccagtcggtactg

SEQ ID NO: 180644 - DNA, 42 bp, Artificial Sequence
  Description of Artificial Sequence: Synthetic oligonucleotide
agccttatatcactcagaattattttccagtcggtactgttg

SEQ ID NO: 180645 - DNA, 41 bp, Artificial Sequence
  Description of Artificial Sequence: Synthetic oligonucleotide
gccttatatcactcagaattattttccagtcggtactgttg

SEQ ID NO: 180646 - DNA, 42 bp, Artificial Sequence
  Description of Artificial Sequence: Synthetic oligonucleotide
ccttatatcactcagaattattttccagtcggtactgttgtg

SEQ ID NO: 180647 - DNA, 42 bp, Artificial Sequence
  Description of Artificial Sequence: Synthetic oligonucleotide
cttatatcactcagaattattttccagtcggtactgttgtgg

SEQ ID NO: 180648 - DNA, 47 bp, Artificial Sequence
  Description of Artificial Sequence: Synthetic oligonucleotide
ttatatcactcagaattattttccagtcggtactgttgtggaatatg

SEQ ID NO: 180649 - DNA, 46 bp, Artificial Sequence
  Description of Artificial Sequence: Synthetic oligonucleotide
tatatcactcagaattattttccagtcggtactgttgtggaatatg

SEQ ID NO: 180650 - DNA, 45 bp, Artificial Sequence
  Description of Artificial Sequence: Synthetic oligonucleotide
atatcactcagaattattttccagtcggtactgttgtggaatatg

SEQ ID NO: 180651 - DNA, 44 bp, Artificial Sequence
  Description of Artificial Sequence: Synthetic oligonucleotide
tatcactcagaattattttccagtcggtactgttgtggaatatg

SEQ ID NO: 180652 - DNA, 43 bp, Artificial Sequence
  Description of Artificial Sequence: Synthetic oligonucleotide
atcactcagaattattttccagtcggtactgttgtggaatatg

SEQ ID NO: 180653 - DNA, 42 bp, Artificial Sequence
  Description of Artificial Sequence: Synthetic oligonucleotide
tcactcagaattattttccagtcggtactgttgtggaatatg

SEQ ID NO: 180654 - DNA, 41 bp, Artificial Sequence
  Description of Artificial Sequence: Synthetic oligonucleotide
cactcagaattattttccagtcggtactgttgtggaatatg

SEQ ID NO: 180655 - DNA, 42 bp, Artificial Sequence
  Description of Artificial Sequence: Synthetic oligonucleotide
actcagaattattttccagtcggtactgttgtggaatatgag

SEQ ID NO: 180656 - DNA, 41 bp, Artificial Sequence
  Description of Artificial Sequence: Synthetic oligonucleotide
ctcagaattattttccagtcggtactgttgtggaatatgag

SEQ ID NO: 180657 - DNA, 42 bp, Artificial Sequence
  Description of Artificial Sequence: Synthetic oligonucleotide
tcagaattattttccagtcggtactgttgtggaatatgagtg

SEQ ID NO: 180658 - DNA, 41 bp, Artificial Sequence
  Description of Artificial Sequence: Synthetic oligonucleotide
cagaattattttccagtcggtactgttgtggaatatgagtg

SEQ ID NO: 180659 - DNA, 41 bp, Artificial Sequence
  Description of Artificial Sequence: Synthetic oligonucleotide
agaattattttccagtcggtactgttgtggaatatgagtgc

SEQ ID NO: 180660 - DNA, 40 bp, Artificial Sequence
  Description of Artificial Sequence: Synthetic oligonucleotide
gaattattttccagtcggtactgttgtggaatatgagtgc

SEQ ID NO: 180661 - DNA, 40 bp, Artificial Sequence
  Description of Artificial Sequence: Synthetic oligonucleotide
aattattttccagtcggtactgttgtggaatatgagtgcc

SEQ ID NO: 180662 - DNA, 39 bp, Artificial Sequence
  Description of Artificial Sequence: Synthetic oligonucleotide
attattttccagtcggtactgttgtggaatatgagtgcc

SEQ ID NO: 180663 - DNA, 38 bp, Artificial Sequence
  Description of Artificial Sequence: Synthetic oligonucleotide
ttattttccagtcggtactgttgtggaatatgagtgcc

SEQ ID NO: 180664 - DNA, 37 bp, Artificial Sequence
  Description of Artificial Sequence: Synthetic oligonucleotide
tattttccagtcggtactgttgtggaatatgagtgcc

SEQ ID NO: 180665 - DNA, 36 bp, Artificial Sequence
  Description of Artificial Sequence: Synthetic oligonucleotide
attttccagtcggtactgttgtggaatatgagtgcc

SEQ ID NO: 180666 - DNA, 35 bp, Artificial Sequence
  Description of Artificial Sequence: Synthetic oligonucleotide
ttttccagtcggtactgttgtggaatatgagtgcc

SEQ ID NO: 180667 - DNA, 34 bp, Artificial Sequence
  Description of Artificial Sequence: Synthetic oligonucleotide
tttccagtcggtactgttgtggaatatgagtgcc

SEQ ID NO: 180668 - DNA, 33 bp, Artificial Sequence
  Description of Artificial Sequence: Synthetic oligonucleotide
ttccagtcggtactgttgtggaatatgagtgcc

SEQ ID NO: 180669 - DNA, 32 bp, Artificial Sequence
  Description of Artificial Sequence: Synthetic oligonucleotide
tccagtcggtactgttgtggaatatgagtgcc

SEQ ID NO: 180670 - DNA, 31 bp, Artificial Sequence
  Description of Artificial Sequence: Synthetic oligonucleotide
ccagtcggtactgttgtggaatatgagtgcc

SEQ ID NO: 180671 - DNA, 31 bp, Artificial Sequence
  Description of Artificial Sequence: Synthetic oligonucleotide
cagtcggtactgttgtggaatatgagtgccg

SEQ ID NO: 180672 - DNA, 32 bp, Artificial Sequence
  Description of Artificial Sequence: Synthetic oligonucleotide
agtcggtactgttgtggaatatgagtgccgtc

SEQ ID NO: 180673 - DNA, 31 bp, Artificial Sequence
  Description of Artificial Sequence: Synthetic oligonucleotide
gtcggtactgttgtggaatatgagtgccgtc

SEQ ID NO: 180674 - DNA, 31 bp, Artificial Sequence
  Description of Artificial Sequence: Synthetic oligonucleotide
tcggtactgttgtggaatatgagtgccgtcc

SEQ ID NO: 180675 - DNA, 30 bp, Artificial Sequence
  Description of Artificial Sequence: Synthetic oligonucleotide
cggtactgttgtggaatatgagtgccgtcc

SEQ ID NO: 180676 - DNA, 31 bp, Artificial Sequence
  Description of Artificial Sequence: Synthetic oligonucleotide
ggtactgttgtggaatatgagtgccgtccag

SEQ ID NO: 180677 - DNA, 31 bp, Artificial Sequence
  Description of Artificial Sequence: Synthetic oligonucleotide
gtactgttgtggaatatgagtgccgtccagg

SEQ ID NO: 180678 - DNA, 34 bp, Artificial Sequence
  Description of Artificial Sequence: Synthetic oligonucleotide
tactgttgtggaatatgagtgccgtccaggttac

SEQ ID NO: 180679 - DNA, 33 bp, Artificial Sequence
  Description of Artificial Sequence: Synthetic oligonucleotide
actgttgtggaatatgagtgccgtccaggttac

SEQ ID NO: 180680 - DNA, 32 bp, Artificial Sequence
  Description of Artificial Sequence: Synthetic oligonucleotide
ctgttgtggaatatgagtgccgtccaggttac

SEQ ID NO: 180681 - DNA, 33 bp, Artificial Sequence
  Description of Artificial Sequence: Synthetic oligonucleotide
tgttgtggaatatgagtgccgtccaggttacag

SEQ ID NO: 180682 - DNA, 32 bp, Artificial Sequence
  Description of Artificial Sequence: Synthetic oligonucleotide
gttgtggaatatgagtgccgtccaggttacag

SEQ ID NO: 180683 - DNA, 34 bp, Artificial Sequence
  Description of Artificial Sequence: Synthetic oligonucleotide
ttgtggaatatgagtgccgtccaggttacagaag

SEQ ID NO: 180684 - DNA, 33 bp, Artificial Sequence
  Description of Artificial Sequence: Synthetic oligonucleotide
tgtggaatatgagtgccgtccaggttacagaag

SEQ ID NO: 180685 - DNA, 32 bp, Artificial Sequence
  Description of Artificial Sequence: Synthetic oligonucleotide
gtggaatatgagtgccgtccaggttacagaag

SEQ ID NO: 180686 - DNA, 33 bp, Artificial Sequence
  Description of Artificial Sequence: Synthetic oligonucleotide
tggaatatgagtgccgtccaggttacagaagag

SEQ ID NO: 180687 - DNA, 32 bp, Artificial Sequence
  Description of Artificial Sequence: Synthetic oligonucleotide
ggaatatgagtgccgtccaggttacagaagag

SEQ ID NO: 180688 - DNA, 34 bp, Artificial Sequence
  Description of Artificial Sequence: Synthetic oligonucleotide
gaatatgagtgccgtccaggttacagaagagaac

SEQ ID NO: 180689 - DNA, 34 bp, Artificial Sequence
  Description of Artificial Sequence: Synthetic oligonucleotide
aatatgagtgccgtccaggttacagaagagaacc

SEQ ID NO: 180690 - DNA, 33 bp, Artificial Sequence
  Description of Artificial Sequence: Synthetic oligonucleotide
atatgagtgccgtccaggttacagaagagaacc

SEQ ID NO: 180691 - DNA, 32 bp, Artificial Sequence
  Description of Artificial Sequence: Synthetic oligonucleotide
tatgagtgccgtccaggttacagaagagaacc

SEQ ID NO: 180692 - DNA, 31 bp, Artificial Sequence
  Description of Artificial Sequence: Synthetic oligonucleotide
atgagtgccgtccaggttacagaagagaacc

SEQ ID NO: 180693 - DNA, 30 bp, Artificial Sequence
  Description of Artificial Sequence: Synthetic oligonucleotide
tgagtgccgtccaggttacagaagagaacc

SEQ ID NO: 180694 - DNA, 29 bp, Artificial Sequence
  Description of Artificial Sequence: Synthetic oligonucleotide
gagtgccgtccaggttacagaagagaacc

SEQ ID NO: 180695 - DNA, 31 bp, Artificial Sequence
  Description of Artificial Sequence: Synthetic oligonucleotide
agtgccgtccaggttacagaagagaaccttc

SEQ ID NO: 180696 - DNA, 30 bp, Artificial Sequence
  Description of Artificial Sequence: Synthetic oligonucleotide
gtgccgtccaggttacagaagagaaccttc

SEQ ID NO: 180697 - DNA, 31 bp, Artificial Sequence
  Description of Artificial Sequence: Synthetic oligonucleotide
tgccgtccaggttacagaagagaaccttctc

SEQ ID NO: 180698 - DNA, 30 bp, Artificial Sequence
  Description of Artificial Sequence: Synthetic oligonucleotide
gccgtccaggttacagaagagaaccttctc

SEQ ID NO: 180699 - DNA, 33 bp, Artificial Sequence
  Description of Artificial Sequence: Synthetic oligonucleotide
ccgtccaggttacagaagagaaccttctctatc

SEQ ID NO: 180700 - DNA, 34 bp, Artificial Sequence
  Description of Artificial Sequence: Synthetic oligonucleotide
cgtccaggttacagaagagaaccttctctatcac

SEQ ID NO: 180701 - DNA, 34 bp, Artificial Sequence
  Description of Artificial Sequence: Synthetic oligonucleotide
gtccaggttacagaagagaaccttctctatcacc

SEQ ID NO: 180702 - DNA, 38 bp, Artificial Sequence
  Description of Artificial Sequence: Synthetic oligonucleotide
tccaggttacagaagagaaccttctctatcaccaaaac

SEQ ID NO: 180703 - DNA, 37 bp, Artificial Sequence
  Description of Artificial Sequence: Synthetic oligonucleotide
ccaggttacagaagagaaccttctctatcaccaaaac

SEQ ID NO: 180704 - DNA, 40 bp, Artificial Sequence
  Description of Artificial Sequence: Synthetic oligonucleotide
caggttacagaagagaaccttctctatcaccaaaactaac

SEQ ID NO: 180705 - DNA, 42 bp, Artificial Sequence
  Description of Artificial Sequence: Synthetic oligonucleotide
aggttacagaagagaaccttctctatcaccaaaactaacttg

SEQ ID NO: 180706 - DNA, 41 bp, Artificial Sequence
  Description of Artificial Sequence: Synthetic oligonucleotide
ggttacagaagagaaccttctctatcaccaaaactaacttg

SEQ ID NO: 180707 - DNA, 41 bp, Artificial Sequence
  Description of Artificial Sequence: Synthetic oligonucleotide
gttacagaagagaaccttctctatcaccaaaactaacttgc

SEQ ID NO: 180708 - DNA, 41 bp, Artificial Sequence
  Description of Artificial Sequence: Synthetic oligonucleotide
ttacagaagagaaccttctctatcaccaaaactaacttgcc

SEQ ID NO: 180709 - DNA, 40 bp, Artificial Sequence
  Description of Artificial Sequence: Synthetic oligonucleotide
tacagaagagaaccttctctatcaccaaaactaacttgcc

SEQ ID NO: 180710 - DNA, 39 bp, Artificial Sequence
  Description of Artificial Sequence: Synthetic oligonucleotide
acagaagagaaccttctctatcaccaaaactaacttgcc

SEQ ID NO: 180711 - DNA, 38 bp, Artificial Sequence
  Description of Artificial Sequence: Synthetic oligonucleotide
cagaagagaaccttctctatcaccaaaactaacttgcc

SEQ ID NO: 180712 - DNA, 40 bp, Artificial Sequence
  Description of Artificial Sequence: Synthetic oligonucleotide
agaagagaaccttctctatcaccaaaactaacttgccttc

SEQ ID NO: 180713 - DNA, 39 bp, Artificial Sequence
  Description of Artificial Sequence: Synthetic oligonucleotide
gaagagaaccttctctatcaccaaaactaacttgccttc

SEQ ID NO: 180714 - DNA, 40 bp, Artificial Sequence
  Description of Artificial Sequence: Synthetic oligonucleotide
aagagaaccttctctatcaccaaaactaacttgccttcag

SEQ ID NO: 180715 - DNA, 39 bp, Artificial Sequence
  Description of Artificial Sequence: Synthetic oligonucleotide
agagaaccttctctatcaccaaaactaacttgccttcag

SEQ ID NO: 180716 - DNA, 38 bp, Artificial Sequence
  Description of Artificial Sequence: Synthetic oligonucleotide
gagaaccttctctatcaccaaaactaacttgccttcag

SEQ ID NO: 180717 - DNA, 48 bp, Artificial Sequence
  Description of Artificial Sequence: Synthetic oligonucleotide
agaaccttctctatcaccaaaactaacttgccttcagaatttaaaatg

SEQ ID NO: 180718 - DNA, 47 bp, Artificial Sequence
  Description of Artificial Sequence: Synthetic oligonucleotide
gaaccttctctatcaccaaaactaacttgccttcagaatttaaaatg

SEQ ID NO: 180719 - DNA, 47 bp, Artificial Sequence
  Description of Artificial Sequence: Synthetic oligonucleotide
aaccttctctatcaccaaaactaacttgccttcagaatttaaaatgg

SEQ ID NO: 180720 - DNA, 46 bp, Artificial Sequence
  Description of Artificial Sequence: Synthetic oligonucleotide
accttctctatcaccaaaactaacttgccttcagaatttaaaatgg

SEQ ID NO: 180721 - DNA, 45 bp, Artificial Sequence
  Description of Artificial Sequence: Synthetic oligonucleotide
ccttctctatcaccaaaactaacttgccttcagaatttaaaatgg

SEQ ID NO: 180722 - DNA, 46 bp, Artificial Sequence
  Description of Artificial Sequence: Synthetic oligonucleotide
cttctctatcaccaaaactaacttgccttcagaatttaaaatggtc

SEQ ID NO: 180723 - DNA, 46 bp, Artificial Sequence
  Description of Artificial Sequence: Synthetic oligonucleotide
ttctctatcaccaaaactaacttgccttcagaatttaaaatggtcc

SEQ ID NO: 180724 - DNA, 45 bp, Artificial Sequence
  Description of Artificial Sequence: Synthetic oligonucleotide
tctctatcaccaaaactaacttgccttcagaatttaaaatggtcc

SEQ ID NO: 180725 - DNA, 44 bp, Artificial Sequence
  Description of Artificial Sequence: Synthetic oligonucleotide
ctctatcaccaaaactaacttgccttcagaatttaaaatggtcc

SEQ ID NO: 180726 - DNA, 45 bp, Artificial Sequence
  Description of Artificial Sequence: Synthetic oligonucleotide
tctatcaccaaaactaacttgccttcagaatttaaaatggtccac

SEQ ID NO: 180727 - DNA, 44 bp, Artificial Sequence
  Description of Artificial Sequence: Synthetic oligonucleotide
ctatcaccaaaactaacttgccttcagaatttaaaatggtccac

SEQ ID NO: 180728 - DNA, 45 bp, Artificial Sequence
  Description of Artificial Sequence: Synthetic oligonucleotide
tatcaccaaaactaacttgccttcagaatttaaaatggtccacag

SEQ ID NO: 180729 - DNA, 44 bp, Artificial Sequence
  Description of Artificial Sequence: Synthetic oligonucleotide
atcaccaaaactaacttgccttcagaatttaaaatggtccacag

SEQ ID NO: 180730 - DNA, 43 bp, Artificial Sequence
  Description of Artificial Sequence: Synthetic oligonucleotide
tcaccaaaactaacttgccttcagaatttaaaatggtccacag

SEQ ID NO: 180731 - DNA, 42 bp, Artificial Sequence
  Description of Artificial Sequence: Synthetic oligonucleotide
caccaaaactaacttgccttcagaatttaaaatggtccacag

SEQ ID NO: 180732 - DNA, 42 bp, Artificial Sequence
  Description of Artificial Sequence: Synthetic oligonucleotide
accaaaactaacttgccttcagaatttaaaatggtccacagc

SEQ ID NO: 180733 - DNA, 41 bp, Artificial Sequence
  Description of Artificial Sequence: Synthetic oligonucleotide
ccaaaactaacttgccttcagaatttaaaatggtccacagc

SEQ ID NO: 180734 - DNA, 42 bp, Artificial Sequence
  Description of Artificial Sequence: Synthetic oligonucleotide
caaaactaacttgccttcagaatttaaaatggtccacagcag

SEQ ID NO: 180735 - DNA, 43 bp, Artificial Sequence
  Description of Artificial Sequence: Synthetic oligonucleotide
aaaactaacttgccttcagaatttaaaatggtccacagcagtc

SEQ ID NO: 180736 - DNA, 42 bp, Artificial Sequence
  Description of Artificial Sequence: Synthetic oligonucleotide
aaactaacttgccttcagaatttaaaatggtccacagcagtc

SEQ ID NO: 180737 - DNA, 41 bp, Artificial Sequence
  Description of Artificial Sequence: Synthetic oligonucleotide
aactaacttgccttcagaatttaaaatggtccacagcagtc

SEQ ID NO: 180738 - DNA, 40 bp, Artificial Sequence
  Description of Artificial Sequence: Synthetic oligonucleotide
actaacttgccttcagaatttaaaatggtccacagcagtc

SEQ ID NO: 180739 - DNA, 39 bp, Artificial Sequence
  Description of Artificial Sequence: Synthetic oligonucleotide
ctaacttgccttcagaatttaaaatggtccacagcagtc

SEQ ID NO: 180740 - DNA, 39 bp, Artificial Sequence
  Description of Artificial Sequence: Synthetic oligonucleotide
taacttgccttcagaatttaaaatggtccacagcagtcg

SEQ ID NO: 180741 - DNA, 38 bp, Artificial Sequence
  Description of Artificial Sequence: Synthetic oligonucleotide
aacttgccttcagaatttaaaatggtccacagcagtcg

SEQ ID NO: 180742 - DNA, 37 bp, Artificial Sequence
  Description of Artificial Sequence: Synthetic oligonucleotide
acttgccttcagaatttaaaatggtccacagcagtcg

SEQ ID NO: 180743 - DNA, 36 bp, Artificial Sequence
  Description of Artificial Sequence: Synthetic oligonucleotide
cttgccttcagaatttaaaatggtccacagcagtcg

SEQ ID NO: 180744 - DNA, 42 bp, Artificial Sequence
  Description of Artificial Sequence: Synthetic oligonucleotide
ttgccttcagaatttaaaatggtccacagcagtcgaattttg

SEQ ID NO: 180745 - DNA, 41 bp, Artificial Sequence
  Description of Artificial Sequence: Synthetic oligonucleotide
tgccttcagaatttaaaatggtccacagcagtcgaattttg

SEQ ID NO: 180746 - DNA, 40 bp, Artificial Sequence
  Description of Artificial Sequence: Synthetic oligonucleotide
gccttcagaatttaaaatggtccacagcagtcgaattttg

SEQ ID NO: 180747 - DNA, 46 bp, Artificial Sequence
  Description of Artificial Sequence: Synthetic oligonucleotide
ccttcagaatttaaaatggtccacagcagtcgaattttgtaaaaag

SEQ ID NO: 180748 - DNA, 50 bp, Artificial Sequence
  Description of Artificial Sequence: Synthetic oligonucleotide
cttcagaatttaaaatggtccacagcagtcgaattttgtaaaaagaaatc

SEQ ID NO: 180749 - DNA, 52 bp, Artificial Sequence
  Description of Artificial Sequence: Synthetic oligonucleotide
ttcagaatttaaaatggtccacagcagtcgaattttgtaaaaagaaatcatg

SEQ ID NO: 180750 - DNA, 51 bp, Artificial Sequence
  Description of Artificial Sequence: Synthetic oligonucleotide
tcagaatttaaaatggtccacagcagtcgaattttgtaaaaagaaatcatg

SEQ ID NO: 180751 - DNA, 50 bp, Artificial Sequence
  Description of Artificial Sequence: Synthetic oligonucleotide
cagaatttaaaatggtccacagcagtcgaattttgtaaaaagaaatcatg

SEQ ID NO: 180752 - DNA, 50 bp, Artificial Sequence
  Description of Artificial Sequence: Synthetic oligonucleotide
agaatttaaaatggtccacagcagtcgaattttgtaaaaagaaatcatgc

SEQ ID NO: 180753 - DNA, 49 bp, Artificial Sequence
  Description of Artificial Sequence: Synthetic oligonucleotide
gaatttaaaatggtccacagcagtcgaattttgtaaaaagaaatcatgc

SEQ ID NO: 180754 - DNA, 49 bp, Artificial Sequence
  Description of Artificial Sequence: Synthetic oligonucleotide
aatttaaaatggtccacagcagtcgaattttgtaaaaagaaatcatgcc

SEQ ID NO: 180755 - DNA, 48 bp, Artificial Sequence
  Description of Artificial Sequence: Synthetic oligonucleotide
atttaaaatggtccacagcagtcgaattttgtaaaaagaaatcatgcc

SEQ ID NO: 180756 - DNA, 47 bp, Artificial Sequence
  Description of Artificial Sequence: Synthetic oligonucleotide
tttaaaatggtccacagcagtcgaattttgtaaaaagaaatcatgcc

SEQ ID NO: 180757 - DNA, 46 bp, Artificial Sequence
  Description of Artificial Sequence: Synthetic oligonucleotide
ttaaaatggtccacagcagtcgaattttgtaaaaagaaatcatgcc

SEQ ID NO: 180758 - DNA, 45 bp, Artificial Sequence
  Description of Artificial Sequence: Synthetic oligonucleotide
taaaatggtccacagcagtcgaattttgtaaaaagaaatcatgcc

SEQ ID NO: 180759 - DNA, 44 bp, Artificial Sequence
  Description of Artificial Sequence: Synthetic oligonucleotide
aaaatggtccacagcagtcgaattttgtaaaaagaaatcatgcc

SEQ ID NO: 180760 - DNA, 43 bp, Artificial Sequence
  Description of Artificial Sequence: Synthetic oligonucleotide
aaatggtccacagcagtcgaattttgtaaaaagaaatcatgcc

SEQ ID NO: 180761 - DNA, 42 bp, Artificial Sequence
  Description of Artificial Sequence: Synthetic oligonucleotide
aatggtccacagcagtcgaattttgtaaaaagaaatcatgcc

SEQ ID NO: 180762 - DNA, 41 bp, Artificial Sequence
  Description of Artificial Sequence: Synthetic oligonucleotide
atggtccacagcagtcgaattttgtaaaaagaaatcatgcc

SEQ ID NO: 180763 - DNA, 40 bp, Artificial Sequence
  Description of Artificial Sequence: Synthetic oligonucleotide
tggtccacagcagtcgaattttgtaaaaagaaatcatgcc

SEQ ID NO: 180764 - DNA, 39 bp, Artificial Sequence
  Description of Artificial Sequence: Synthetic oligonucleotide
ggtccacagcagtcgaattttgtaaaaagaaatcatgcc

SEQ ID NO: 180765 - DNA, 39 bp, Artificial Sequence
  Description of Artificial Sequence: Synthetic oligonucleotide
gtccacagcagtcgaattttgtaaaaagaaatcatgccc

SEQ ID NO: 180766 - DNA, 43 bp, Artificial Sequence
  Description of Artificial Sequence: Synthetic oligonucleotide
tccacagcagtcgaattttgtaaaaagaaatcatgccctaatc

SEQ ID NO: 180767 - DNA, 42 bp, Artificial Sequence
  Description of Artificial Sequence: Synthetic oligonucleotide
ccacagcagtcgaattttgtaaaaagaaatcatgccctaatc

SEQ ID NO: 180768 - DNA, 42 bp, Artificial Sequence
  Description of Artificial Sequence: Synthetic oligonucleotide
cacagcagtcgaattttgtaaaaagaaatcatgccctaatcc

SEQ ID NO: 180769 - DNA, 42 bp, Artificial Sequence
  Description of Artificial Sequence: Synthetic oligonucleotide
acagcagtcgaattttgtaaaaagaaatcatgccctaatccg

SEQ ID NO: 180770 - DNA, 41 bp, Artificial Sequence
  Description of Artificial Sequence: Synthetic oligonucleotide
cagcagtcgaattttgtaaaaagaaatcatgccctaatccg

SEQ ID NO: 180771 - DNA, 41 bp, Artificial Sequence
  Description of Artificial Sequence: Synthetic oligonucleotide
agcagtcgaattttgtaaaaagaaatcatgccctaatccgg

SEQ ID NO: 180772 - DNA, 40 bp, Artificial Sequence
  Description of Artificial Sequence: Synthetic oligonucleotide
gcagtcgaattttgtaaaaagaaatcatgccctaatccgg

SEQ ID NO: 180773 - DNA, 40 bp, Artificial Sequence
  Description of Artificial Sequence: Synthetic oligonucleotide
cagtcgaattttgtaaaaagaaatcatgccctaatccggg

SEQ ID NO: 180774 - DNA, 41 bp, Artificial Sequence
  Description of Artificial Sequence: Synthetic oligonucleotide
agtcgaattttgtaaaaagaaatcatgccctaatccgggag

SEQ ID NO: 180775 - DNA, 40 bp, Artificial Sequence
  Description of Artificial Sequence: Synthetic oligonucleotide
gtcgaattttgtaaaaagaaatcatgccctaatccgggag

SEQ ID NO: 180776 - DNA, 45 bp, Artificial Sequence
  Description of Artificial Sequence: Synthetic oligonucleotide
tcgaattttgtaaaaagaaatcatgccctaatccgggagaaatac

SEQ ID NO: 180777 - DNA, 44 bp, Artificial Sequence
  Description of Artificial Sequence: Synthetic oligonucleotide
cgaattttgtaaaaagaaatcatgccctaatccgggagaaatac

SEQ ID NO: 180778 - DNA, 44 bp, Artificial Sequence
  Description of Artificial Sequence: Synthetic oligonucleotide
gaattttgtaaaaagaaatcatgccctaatccgggagaaatacg

SEQ ID NO: 180779 - DNA, 48 bp, Artificial Sequence
  Description of Artificial Sequence: Synthetic oligonucleotide
aattttgtaaaaagaaatcatgccctaatccgggagaaatacgaaatg

SEQ ID NO: 180780 - DNA, 47 bp, Artificial Sequence
  Description of Artificial Sequence: Synthetic oligonucleotide
attttgtaaaaagaaatcatgccctaatccgggagaaatacgaaatg

SEQ ID NO: 180781 - DNA, 46 bp, Artificial Sequence
  Description of Artificial Sequence: Synthetic oligonucleotide
ttttgtaaaaagaaatcatgccctaatccgggagaaatacgaaatg

SEQ ID NO: 180782 - DNA, 45 bp, Artificial Sequence
  Description of Artificial Sequence: Synthetic oligonucleotide
tttgtaaaaagaaatcatgccctaatccgggagaaatacgaaatg

SEQ ID NO: 180783 - DNA, 44 bp, Artificial Sequence
  Description of Artificial Sequence: Synthetic oligonucleotide
ttgtaaaaagaaatcatgccctaatccgggagaaatacgaaatg

SEQ ID NO: 180784 - DNA, 43 bp, Artificial Sequence
  Description of Artificial Sequence: Synthetic oligonucleotide
tgtaaaaagaaatcatgccctaatccgggagaaatacgaaatg

SEQ ID NO: 180785 - DNA, 42 bp, Artificial Sequence
  Description of Artificial Sequence: Synthetic oligonucleotide
gtaaaaagaaatcatgccctaatccgggagaaatacgaaatg

SEQ ID NO: 180786 - DNA, 42 bp, Artificial Sequence
  Description of Artificial Sequence: Synthetic oligonucleotide
taaaaagaaatcatgccctaatccgggagaaatacgaaatgg

SEQ ID NO: 180787 - DNA, 41 bp, Artificial Sequence
  Description of Artificial Sequence: Synthetic oligonucleotide
aaaaagaaatcatgccctaatccgggagaaatacgaaatgg

SEQ ID NO: 180788 - DNA, 40 bp, Artificial Sequence
  Description of Artificial Sequence: Synthetic oligonucleotide
aaaagaaatcatgccctaatccgggagaaatacgaaatgg

SEQ ID NO: 180789 - DNA, 39 bp, Artificial Sequence
  Description of Artificial Sequence: Synthetic oligonucleotide
aaagaaatcatgccctaatccgggagaaatacgaaatgg

SEQ ID NO: 180790 - DNA, 38 bp, Artificial Sequence
  Description of Artificial Sequence: Synthetic oligonucleotide
aagaaatcatgccctaatccgggagaaatacgaaatgg

SEQ ID NO: 180791 - DNA, 37 bp, Artificial Sequence
  Description of Artificial Sequence: Synthetic oligonucleotide
agaaatcatgccctaatccgggagaaatacgaaatgg

SEQ ID NO: 180792 - DNA, 36 bp, Artificial Sequence
  Description of Artificial Sequence: Synthetic oligonucleotide
gaaatcatgccctaatccgggagaaatacgaaatgg

SEQ ID NO: 180793 - DNA, 37 bp, Artificial Sequence
  Description of Artificial Sequence: Synthetic oligonucleotide
aaatcatgccctaatccgggagaaatacgaaatggtc

SEQ ID NO: 180794 - DNA, 36 bp, Artificial Sequence
  Description of Artificial Sequence: Synthetic oligonucleotide
aatcatgccctaatccgggagaaatacgaaatggtc

SEQ ID NO: 180795 - DNA, 35 bp, Artificial Sequence
  Description of Artificial Sequence: Synthetic oligonucleotide
atcatgccctaatccgggagaaatacgaaatggtc

SEQ ID NO: 180796 - DNA, 34 bp, Artificial Sequence
  Description of Artificial Sequence: Synthetic oligonucleotide
tcatgccctaatccgggagaaatacgaaatggtc

SEQ ID NO: 180797 - DNA, 33 bp, Artificial Sequence
  Description of Artificial Sequence: Synthetic oligonucleotide
catgccctaatccgggagaaatacgaaatggtc

SEQ ID NO: 180798 - DNA, 34 bp, Artificial Sequence
  Description of Artificial Sequence: Synthetic oligonucleotide
atgccctaatccgggagaaatacgaaatggtcag

SEQ ID NO: 180799 - DNA, 33 bp, Artificial Sequence
  Description of Artificial Sequence: Synthetic oligonucleotide
tgccctaatccgggagaaatacgaaatggtcag

SEQ ID NO: 180800 - DNA, 32 bp, Artificial Sequence
  Description of Artificial Sequence: Synthetic oligonucleotide
gccctaatccgggagaaatacgaaatggtcag

SEQ ID NO: 180801 - DNA, 35 bp, Artificial Sequence
  Description of Artificial Sequence: Synthetic oligonucleotide
ccctaatccgggagaaatacgaaatggtcagattg

SEQ ID NO: 180802 - DNA, 37 bp, Artificial Sequence
  Description of Artificial Sequence: Synthetic oligonucleotide
cctaatccgggagaaatacgaaatggtcagattgatg

SEQ ID NO: 180803 - DNA, 39 bp, Artificial Sequence
  Description of Artificial Sequence: Synthetic oligonucleotide
ctaatccgggagaaatacgaaatggtcagattgatgtac

SEQ ID NO: 180804 - DNA, 39 bp, Artificial Sequence
  Description of Artificial Sequence: Synthetic oligonucleotide
taatccgggagaaatacgaaatggtcagattgatgtacc

SEQ ID NO: 180805 - DNA, 38 bp, Artificial Sequence
  Description of Artificial Sequence: Synthetic oligonucleotide
aatccgggagaaatacgaaatggtcagattgatgtacc

SEQ ID NO: 180806 - DNA, 37 bp, Artificial Sequence
  Description of Artificial Sequence: Synthetic oligonucleotide
atccgggagaaatacgaaatggtcagattgatgtacc

SEQ ID NO: 180807 - DNA, 36 bp, Artificial Sequence
  Description of Artificial Sequence: Synthetic oligonucleotide
tccgggagaaatacgaaatggtcagattgatgtacc

SEQ ID NO: 180808 - DNA, 35 bp, Artificial Sequence
  Description of Artificial Sequence: Synthetic oligonucleotide
ccgggagaaatacgaaatggtcagattgatgtacc

SEQ ID NO: 180809 - DNA, 36 bp, Artificial Sequence
  Description of Artificial Sequence: Synthetic oligonucleotide
cgggagaaatacgaaatggtcagattgatgtaccag

SEQ ID NO: 180810 - DNA, 36 bp, Artificial Sequence
  Description of Artificial Sequence: Synthetic oligonucleotide
gggagaaatacgaaatggtcagattgatgtaccagg

SEQ ID NO: 180811 - DNA, 37 bp, Artificial Sequence
  Description of Artificial Sequence: Synthetic oligonucleotide
ggagaaatacgaaatggtcagattgatgtaccaggtg

SEQ ID NO: 180812 - DNA, 37 bp, Artificial Sequence
  Description of Artificial Sequence: Synthetic oligonucleotide
gagaaatacgaaatggtcagattgatgtaccaggtgg

SEQ ID NO: 180813 - DNA, 37 bp, Artificial Sequence
  Description of Artificial Sequence: Synthetic oligonucleotide
agaaatacgaaatggtcagattgatgtaccaggtggc

SEQ ID NO: 180814 - DNA, 36 bp, Artificial Sequence
  Description of Artificial Sequence: Synthetic oligonucleotide
gaaatacgaaatggtcagattgatgtaccaggtggc

SEQ ID NO: 180815 - DNA, 45 bp, Artificial Sequence
  Description of Artificial Sequence: Synthetic oligonucleotide
aaatacgaaatggtcagattgatgtaccaggtggcatattatttg

SEQ ID NO: 180816 - DNA, 44 bp, Artificial Sequence
  Description of Artificial Sequence: Synthetic oligonucleotide
aatacgaaatggtcagattgatgtaccaggtggcatattatttg

SEQ ID NO: 180817 - DNA, 43 bp, Artificial Sequence
  Description of Artificial Sequence: Synthetic oligonucleotide
atacgaaatggtcagattgatgtaccaggtggcatattatttg

SEQ ID NO: 180818 - DNA, 42 bp, Artificial Sequence
  Description of Artificial Sequence: Synthetic oligonucleotide
tacgaaatggtcagattgatgtaccaggtggcatattatttg

SEQ ID NO: 180819 - DNA, 41 bp, Artificial Sequence
  Description of Artificial Sequence: Synthetic oligonucleotide
acgaaatggtcagattgatgtaccaggtggcatattatttg

SEQ ID NO: 180820 - DNA, 40 bp, Artificial Sequence
  Description of Artificial Sequence: Synthetic oligonucleotide
cgaaatggtcagattgatgtaccaggtggcatattatttg

SEQ ID NO: 180821 - DNA, 40 bp, Artificial Sequence
  Description of Artificial Sequence: Synthetic oligonucleotide
gaaatggtcagattgatgtaccaggtggcatattatttgg

SEQ ID NO: 180822 - DNA, 41 bp, Artificial Sequence
  Description of Artificial Sequence: Synthetic oligonucleotide
aaatggtcagattgatgtaccaggtggcatattatttggtg

SEQ ID NO: 180823 - DNA, 40 bp, Artificial Sequence
  Description of Artificial Sequence: Synthetic oligonucleotide
aatggtcagattgatgtaccaggtggcatattatttggtg

SEQ ID NO: 180824 - DNA, 39 bp, Artificial Sequence
  Description of Artificial Sequence: Synthetic oligonucleotide
atggtcagattgatgtaccaggtggcatattatttggtg

SEQ ID NO: 180825 - DNA, 38 bp, Artificial Sequence
  Description of Artificial Sequence: Synthetic oligonucleotide
tggtcagattgatgtaccaggtggcatattatttggtg

SEQ ID NO: 180826 - DNA, 37 bp, Artificial Sequence
  Description of Artificial Sequence: Synthetic oligonucleotide
ggtcagattgatgtaccaggtggcatattatttggtg

SEQ ID NO: 180827 - DNA, 37 bp, Artificial Sequence
  Description of Artificial Sequence: Synthetic oligonucleotide
gtcagattgatgtaccaggtggcatattatttggtgc

SEQ ID NO: 180828 - DNA, 39 bp, Artificial Sequence
  Description of Artificial Sequence: Synthetic oligonucleotide
tcagattgatgtaccaggtggcatattatttggtgcaac

SEQ ID NO: 180829 - DNA, 38 bp, Artificial Sequence
  Description of Artificial Sequence: Synthetic oligonucleotide
cagattgatgtaccaggtggcatattatttggtgcaac

SEQ ID NO: 180830 - DNA, 38 bp, Artificial Sequence
  Description of Artificial Sequence: Synthetic oligonucleotide
agattgatgtaccaggtggcatattatttggtgcaacc

SEQ ID NO: 180831 - DNA, 37 bp, Artificial Sequence
  Description of Artificial Sequence: Synthetic oligonucleotide
gattgatgtaccaggtggcatattatttggtgcaacc

SEQ ID NO: 180832 - DNA, 39 bp, Artificial Sequence
  Description of Artificial Sequence: Synthetic oligonucleotide
attgatgtaccaggtggcatattatttggtgcaaccatc

SEQ ID NO: 180833 - DNA, 38 bp, Artificial Sequence
  Description of Artificial Sequence: Synthetic oligonucleotide
ttgatgtaccaggtggcatattatttggtgcaaccatc

SEQ ID NO: 180834 - DNA, 37 bp, Artificial Sequence
  Description of Artificial Sequence: Synthetic oligonucleotide
tgatgtaccaggtggcatattatttggtgcaaccatc

SEQ ID NO: 180835 - DNA, 36 bp, Artificial Sequence
  Description of Artificial Sequence: Synthetic oligonucleotide
gatgtaccaggtggcatattatttggtgcaaccatc

SEQ ID NO: 180836 - DNA, 37 bp, Artificial Sequence
  Description of Artificial Sequence: Synthetic oligonucleotide
atgtaccaggtggcatattatttggtgcaaccatctc

SEQ ID NO: 180837 - DNA, 36 bp, Artificial Sequence
  Description of Artificial Sequence: Synthetic oligonucleotide
tgtaccaggtggcatattatttggtgcaaccatctc

SEQ ID NO: 180838 - DNA, 35 bp, Artificial Sequence
  Description of Artificial Sequence: Synthetic oligonucleotide
gtaccaggtggcatattatttggtgcaaccatctc

SEQ ID NO: 180839 - DNA, 35 bp, Artificial Sequence
  Description of Artificial Sequence: Synthetic oligonucleotide
taccaggtggcatattatttggtgcaaccatctcc

SEQ ID NO: 180840 - DNA, 34 bp, Artificial Sequence
  Description of Artificial Sequence: Synthetic oligonucleotide
accaggtggcatattatttggtgcaaccatctcc

SEQ ID NO: 180841 - DNA, 33 bp, Artificial Sequence
  Description of Artificial Sequence: Synthetic oligonucleotide
ccaggtggcatattatttggtgcaaccatctcc

SEQ ID NO: 180842 - DNA, 35 bp, Artificial Sequence
  Description of Artificial Sequence: Synthetic oligonucleotide
caggtggcatattatttggtgcaaccatctccttc

SEQ ID NO: 180843 - DNA, 36 bp, Artificial Sequence
  Description of Artificial Sequence: Synthetic oligonucleotide
aggtggcatattatttggtgcaaccatctccttctc

SEQ ID NO: 180844 - DNA, 35 bp, Artificial Sequence
  Description of Artificial Sequence: Synthetic oligonucleotide
ggtggcatattatttggtgcaaccatctccttctc

SEQ ID NO: 180845 - DNA, 37 bp, Artificial Sequence
  Description of Artificial Sequence: Synthetic oligonucleotide
gtggcatattatttggtgcaaccatctccttctcatg

SEQ ID NO: 180846 - DNA, 40 bp, Artificial Sequence
  Description of Artificial Sequence: Synthetic oligonucleotide
tggcatattatttggtgcaaccatctccttctcatgtaac

SEQ ID NO: 180847 - DNA, 39 bp, Artificial Sequence
  Description of Artificial Sequence: Synthetic oligonucleotide
ggcatattatttggtgcaaccatctccttctcatgtaac

SEQ ID NO: 180848 - DNA, 40 bp, Artificial Sequence
  Description of Artificial Sequence: Synthetic oligonucleotide
gcatattatttggtgcaaccatctccttctcatgtaacac

SEQ ID NO: 180849 - DNA, 41 bp, Artificial Sequence
  Description of Artificial Sequence: Synthetic oligonucleotide
catattatttggtgcaaccatctccttctcatgtaacacag

SEQ ID NO: 180850 - DNA, 41 bp, Artificial Sequence
  Description of Artificial Sequence: Synthetic oligonucleotide
atattatttggtgcaaccatctccttctcatgtaacacagg

SEQ ID NO: 180851 - DNA, 40 bp, Artificial Sequence
  Description of Artificial Sequence: Synthetic oligonucleotide
tattatttggtgcaaccatctccttctcatgtaacacagg

SEQ ID NO: 180852 - DNA, 39 bp, Artificial Sequence
  Description of Artificial Sequence: Synthetic oligonucleotide
attatttggtgcaaccatctccttctcatgtaacacagg

SEQ ID NO: 180853 - DNA, 38 bp, Artificial Sequence
  Description of Artificial Sequence: Synthetic oligonucleotide
ttatttggtgcaaccatctccttctcatgtaacacagg

SEQ ID NO: 180854 - DNA, 37 bp, Artificial Sequence
  Description of Artificial Sequence: Synthetic oligonucleotide
tatttggtgcaaccatctccttctcatgtaacacagg

SEQ ID NO: 180855 - DNA, 36 bp, Artificial Sequence
  Description of Artificial Sequence: Synthetic oligonucleotide
atttggtgcaaccatctccttctcatgtaacacagg

SEQ ID NO: 180856 - DNA, 35 bp, Artificial Sequence
  Description of Artificial Sequence: Synthetic oligonucleotide
tttggtgcaaccatctccttctcatgtaacacagg

SEQ ID NO: 180857 - DNA, 34 bp, Artificial Sequence
  Description of Artificial Sequence: Synthetic oligonucleotide
ttggtgcaaccatctccttctcatgtaacacagg

SEQ ID NO: 180858 - DNA, 33 bp, Artificial Sequence
  Description of Artificial Sequence: Synthetic oligonucleotide
tggtgcaaccatctccttctcatgtaacacagg

SEQ ID NO: 180859 - DNA, 32 bp, Artificial Sequence
  Description of Artificial Sequence: Synthetic oligonucleotide
ggtgcaaccatctccttctcatgtaacacagg

SEQ ID NO: 180860 - DNA, 32 bp, Artificial Sequence
  Description of Artificial Sequence: Synthetic oligonucleotide
gtgcaaccatctccttctcatgtaacacaggg

SEQ ID NO: 180861 - DNA, 34 bp, Artificial Sequence
  Description of Artificial Sequence: Synthetic oligonucleotide
tgcaaccatctccttctcatgtaacacagggtac

SEQ ID NO: 180862 - DNA, 33 bp, Artificial Sequence
  Description of Artificial Sequence: Synthetic oligonucleotide
gcaaccatctccttctcatgtaacacagggtac

SEQ ID NO: 180863 - DNA, 42 bp, Artificial Sequence
  Description of Artificial Sequence: Synthetic oligonucleotide
caaccatctccttctcatgtaacacagggtacaaattatttg

SEQ ID NO: 180864 - DNA, 42 bp, Artificial Sequence
  Description of Artificial Sequence: Synthetic oligonucleotide
aaccatctccttctcatgtaacacagggtacaaattatttgg

SEQ ID NO: 180865 - DNA, 41 bp, Artificial Sequence
  Description of Artificial Sequence: Synthetic oligonucleotide
accatctccttctcatgtaacacagggtacaaattatttgg

SEQ ID NO: 180866 - DNA, 40 bp, Artificial Sequence
  Description of Artificial Sequence: Synthetic oligonucleotide
ccatctccttctcatgtaacacagggtacaaattatttgg

SEQ ID NO: 180867 - DNA, 40 bp, Artificial Sequence
  Description of Artificial Sequence: Synthetic oligonucleotide
catctccttctcatgtaacacagggtacaaattatttggc

SEQ ID NO: 180868 - DNA, 41 bp, Artificial Sequence
  Description of Artificial Sequence: Synthetic oligonucleotide
atctccttctcatgtaacacagggtacaaattatttggctc

SEQ ID NO: 180869 - DNA, 40 bp, Artificial Sequence
  Description of Artificial Sequence: Synthetic oligonucleotide
tctccttctcatgtaacacagggtacaaattatttggctc

SEQ ID NO: 180870 - DNA, 39 bp, Artificial Sequence
  Description of Artificial Sequence: Synthetic oligonucleotide
ctccttctcatgtaacacagggtacaaattatttggctc

SEQ ID NO: 180871 - DNA, 39 bp, Artificial Sequence
  Description of Artificial Sequence: Synthetic oligonucleotide
tccttctcatgtaacacagggtacaaattatttggctcg

SEQ ID NO: 180872 - DNA, 38 bp, Artificial Sequence
  Description of Artificial Sequence: Synthetic oligonucleotide
ccttctcatgtaacacagggtacaaattatttggctcg

SEQ ID NO: 180873 - DNA, 39 bp, Artificial Sequence
  Description of Artificial Sequence: Synthetic oligonucleotide
cttctcatgtaacacagggtacaaattatttggctcgac

SEQ ID NO: 180874 - DNA, 41 bp, Artificial Sequence
  Description of Artificial Sequence: Synthetic oligonucleotide
ttctcatgtaacacagggtacaaattatttggctcgacttc

SEQ ID NO: 180875 - DNA, 40 bp, Artificial Sequence
  Description of Artificial Sequence: Synthetic oligonucleotide
tctcatgtaacacagggtacaaattatttggctcgacttc

SEQ ID NO: 180876 - DNA, 39 bp, Artificial Sequence
  Description of Artificial Sequence: Synthetic oligonucleotide
ctcatgtaacacagggtacaaattatttggctcgacttc

SEQ ID NO: 180877 - DNA, 41 bp, Artificial Sequence
  Description of Artificial Sequence: Synthetic oligonucleotide
tcatgtaacacagggtacaaattatttggctcgacttctag

SEQ ID NO: 180878 - DNA, 40 bp, Artificial Sequence
  Description of Artificial Sequence: Synthetic oligonucleotide
catgtaacacagggtacaaattatttggctcgacttctag

SEQ ID NO: 180879 - DNA, 45 bp, Artificial Sequence
  Description of Artificial Sequence: Synthetic oligonucleotide
atgtaacacagggtacaaattatttggctcgacttctagtttttg

SEQ ID NO: 180880 - DNA, 44 bp, Artificial Sequence
  Description of Artificial Sequence: Synthetic oligonucleotide
tgtaacacagggtacaaattatttggctcgacttctagtttttg

SEQ ID NO: 180881 - DNA, 43 bp, Artificial Sequence
  Description of Artificial Sequence: Synthetic oligonucleotide
gtaacacagggtacaaattatttggctcgacttctagtttttg

SEQ ID NO: 180882 - DNA, 44 bp, Artificial Sequence
  Description of Artificial Sequence: Synthetic oligonucleotide
taacacagggtacaaattatttggctcgacttctagtttttgtc

SEQ ID NO: 180883 - DNA, 43 bp, Artificial Sequence
  Description of Artificial Sequence: Synthetic oligonucleotide
aacacagggtacaaattatttggctcgacttctagtttttgtc

SEQ ID NO: 180884 - DNA, 42 bp, Artificial Sequence
  Description of Artificial Sequence: Synthetic oligonucleotide
acacagggtacaaattatttggctcgacttctagtttttgtc

SEQ ID NO: 180885 - DNA, 41 bp, Artificial Sequence
  Description of Artificial Sequence: Synthetic oligonucleotide
cacagggtacaaattatttggctcgacttctagtttttgtc

SEQ ID NO: 180886 - DNA, 47 bp, Artificial Sequence
  Description of Artificial Sequence: Synthetic oligonucleotide
acagggtacaaattatttggctcgacttctagtttttgtcttatttc

SEQ ID NO: 180887 - DNA, 46 bp, Artificial Sequence
  Description of Artificial Sequence: Synthetic oligonucleotide
cagggtacaaattatttggctcgacttctagtttttgtcttatttc

SEQ ID NO: 180888 - DNA, 47 bp, Artificial Sequence
  Description of Artificial Sequence: Synthetic oligonucleotide
agggtacaaattatttggctcgacttctagtttttgtcttatttcag

SEQ ID NO: 180889 - DNA, 46 bp, Artificial Sequence
  Description of Artificial Sequence: Synthetic oligonucleotide
gggtacaaattatttggctcgacttctagtttttgtcttatttcag

SEQ ID NO: 180890 - DNA, 46 bp, Artificial Sequence
  Description of Artificial Sequence: Synthetic oligonucleotide
ggtacaaattatttggctcgacttctagtttttgtcttatttcagg

SEQ ID NO: 180891 - DNA, 46 bp, Artificial Sequence
  Description of Artificial Sequence: Synthetic oligonucleotide
gtacaaattatttggctcgacttctagtttttgtcttatttcaggc

SEQ ID NO: 180892 - DNA, 47 bp, Artificial Sequence
  Description of Artificial Sequence: Synthetic oligonucleotide
tacaaattatttggctcgacttctagtttttgtcttatttcaggcag

SEQ ID NO: 180893 - DNA, 46 bp, Artificial Sequence
  Description of Artificial Sequence: Synthetic oligonucleotide
acaaattatttggctcgacttctagtttttgtcttatttcaggcag

SEQ ID NO: 180894 - DNA, 45 bp, Artificial Sequence
  Description of Artificial Sequence: Synthetic oligonucleotide
caaattatttggctcgacttctagtttttgtcttatttcaggcag

SEQ ID NO: 180895 - DNA, 45 bp, Artificial Sequence
  Description of Artificial Sequence: Synthetic oligonucleotide
aaattatttggctcgacttctagtttttgtcttatttcaggcagc

SEQ ID NO: 180896 - DNA, 44 bp, Artificial Sequence
  Description of Artificial Sequence: Synthetic oligonucleotide
aattatttggctcgacttctagtttttgtcttatttcaggcagc

SEQ ID NO: 180897 - DNA, 43 bp, Artificial Sequence
  Description of Artificial Sequence: Synthetic oligonucleotide
attatttggctcgacttctagtttttgtcttatttcaggcagc

SEQ ID NO: 180898 - DNA, 42 bp, Artificial Sequence
  Description of Artificial Sequence: Synthetic oligonucleotide
ttatttggctcgacttctagtttttgtcttatttcaggcagc

SEQ ID NO: 180899 - DNA, 41 bp, Artificial Sequence
  Description of Artificial Sequence: Synthetic oligonucleotide
tatttggctcgacttctagtttttgtcttatttcaggcagc

SEQ ID NO: 180900 - DNA, 40 bp, Artificial Sequence
  Description of Artificial Sequence: Synthetic oligonucleotide
atttggctcgacttctagtttttgtcttatttcaggcagc

SEQ ID NO: 180901 - DNA, 39 bp, Artificial Sequence
  Description of Artificial Sequence: Synthetic oligonucleotide
tttggctcgacttctagtttttgtcttatttcaggcagc

SEQ ID NO: 180902 - DNA, 38 bp, Artificial Sequence
  Description of Artificial Sequence: Synthetic oligonucleotide
ttggctcgacttctagtttttgtcttatttcaggcagc

SEQ ID NO: 180903 - DNA, 37 bp, Artificial Sequence
  Description of Artificial Sequence: Synthetic oligonucleotide
tggctcgacttctagtttttgtcttatttcaggcagc

SEQ ID NO: 180904 - DNA, 36 bp, Artificial Sequence
  Description of Artificial Sequence: Synthetic oligonucleotide
ggctcgacttctagtttttgtcttatttcaggcagc

SEQ ID NO: 180905 - DNA, 37 bp, Artificial Sequence
  Description of Artificial Sequence: Synthetic oligonucleotide
gctcgacttctagtttttgtcttatttcaggcagctc

SEQ ID NO: 180906 - DNA, 38 bp, Artificial Sequence
  Description of Artificial Sequence: Synthetic oligonucleotide
ctcgacttctagtttttgtcttatttcaggcagctctg

SEQ ID NO: 180907 - DNA, 39 bp, Artificial Sequence
  Description of Artificial Sequence: Synthetic oligonucleotide
tcgacttctagtttttgtcttatttcaggcagctctgtc

SEQ ID NO: 180908 - DNA, 38 bp, Artificial Sequence
  Description of Artificial Sequence: Synthetic oligonucleotide
cgacttctagtttttgtcttatttcaggcagctctgtc

SEQ ID NO: 180909 - DNA, 38 bp, Artificial Sequence
  Description of Artificial Sequence: Synthetic oligonucleotide
gacttctagtttttgtcttatttcaggcagctctgtcc

SEQ ID NO: 180910 - DNA, 39 bp, Artificial Sequence
  Description of Artificial Sequence: Synthetic oligonucleotide
acttctagtttttgtcttatttcaggcagctctgtccag

SEQ ID NO: 180911 - DNA, 38 bp, Artificial Sequence
  Description of Artificial Sequence: Synthetic oligonucleotide
cttctagtttttgtcttatttcaggcagctctgtccag

SEQ ID NO: 180912 - DNA, 39 bp, Artificial Sequence
  Description of Artificial Sequence: Synthetic oligonucleotide
ttctagtttttgtcttatttcaggcagctctgtccagtg

SEQ ID NO: 180913 - DNA, 38 bp, Artificial Sequence
  Description of Artificial Sequence: Synthetic oligonucleotide
tctagtttttgtcttatttcaggcagctctgtccagtg

SEQ ID NO: 180914 - DNA, 37 bp, Artificial Sequence
  Description of Artificial Sequence: Synthetic oligonucleotide
ctagtttttgtcttatttcaggcagctctgtccagtg

SEQ ID NO: 180915 - DNA, 37 bp, Artificial Sequence
  Description of Artificial Sequence: Synthetic oligonucleotide
tagtttttgtcttatttcaggcagctctgtccagtgg

SEQ ID NO: 180916 - DNA, 36 bp, Artificial Sequence
  Description of Artificial Sequence: Synthetic oligonucleotide
agtttttgtcttatttcaggcagctctgtccagtgg

SEQ ID NO: 180917 - DNA, 35 bp, Artificial Sequence
  Description of Artificial Sequence: Synthetic oligonucleotide
gtttttgtcttatttcaggcagctctgtccagtgg

SEQ ID NO: 180918 - DNA, 36 bp, Artificial Sequence
  Description of Artificial Sequence: Synthetic oligonucleotide
tttttgtcttatttcaggcagctctgtccagtggag

SEQ ID NO: 180919 - DNA, 35 bp, Artificial Sequence
  Description of Artificial Sequence: Synthetic oligonucleotide
ttttgtcttatttcaggcagctctgtccagtggag

SEQ ID NO: 180920 - DNA, 34 bp, Artificial Sequence
  Description of Artificial Sequence: Synthetic oligonucleotide
tttgtcttatttcaggcagctctgtccagtggag

SEQ ID NO: 180921 - DNA, 33 bp, Artificial Sequence
  Description of Artificial Sequence: Synthetic oligonucleotide
ttgtcttatttcaggcagctctgtccagtggag

SEQ ID NO: 180922 - DNA, 32 bp, Artificial Sequence
  Description of Artificial Sequence: Synthetic oligonucleotide
tgtcttatttcaggcagctctgtccagtggag

SEQ ID NO: 180923 - DNA, 31 bp, Artificial Sequence
  Description of Artificial Sequence: Synthetic oligonucleotide
gtcttatttcaggcagctctgtccagtggag

SEQ ID NO: 180924 - DNA, 32 bp, Artificial Sequence
  Description of Artificial Sequence: Synthetic oligonucleotide
tcttatttcaggcagctctgtccagtggagtg

SEQ ID NO: 180925 - DNA, 31 bp, Artificial Sequence
  Description of Artificial Sequence: Synthetic oligonucleotide
cttatttcaggcagctctgtccagtggagtg

SEQ ID NO: 180926 - DNA, 32 bp, Artificial Sequence
  Description of Artificial Sequence: Synthetic oligonucleotide
ttatttcaggcagctctgtccagtggagtgac

SEQ ID NO: 180927 - DNA, 31 bp, Artificial Sequence
  Description of Artificial Sequence: Synthetic oligonucleotide
tatttcaggcagctctgtccagtggagtgac

SEQ ID NO: 180928 - DNA, 30 bp, Artificial Sequence
  Description of Artificial Sequence: Synthetic oligonucleotide
atttcaggcagctctgtccagtggagtgac

SEQ ID NO: 180929 - DNA, 29 bp, Artificial Sequence
  Description of Artificial Sequence: Synthetic oligonucleotide
tttcaggcagctctgtccagtggagtgac

SEQ ID NO: 180930 - DNA, 28 bp, Artificial Sequence
  Description of Artificial Sequence: Synthetic oligonucleotide
ttcaggcagctctgtccagtggagtgac

SEQ ID NO: 180931 - DNA, 27 bp, Artificial Sequence
  Description of Artificial Sequence: Synthetic oligonucleotide
tcaggcagctctgtccagtggagtgac

SEQ ID NO: 180932 - DNA, 26 bp, Artificial Sequence
  Description of Artificial Sequence: Synthetic oligonucleotide
caggcagctctgtccagtggagtgac

SEQ ID NO: 180933 - DNA, 26 bp, Artificial Sequence
  Description of Artificial Sequence: Synthetic oligonucleotide
aggcagctctgtccagtggagtgacc

SEQ ID NO: 180934 - DNA, 25 bp, Artificial Sequence
  Description of Artificial Sequence: Synthetic oligonucleotide
ggcagctctgtccagtggagtgacc

SEQ ID NO: 180935 - DNA, 25 bp, Artificial Sequence
  Description of Artificial Sequence: Synthetic oligonucleotide
gcagctctgtccagtggagtgaccc

SEQ ID NO: 180936 - DNA, 27 bp, Artificial Sequence
  Description of Artificial Sequence: Synthetic oligonucleotide
cagctctgtccagtggagtgacccgtt

SEQ ID NO: 180937 - DNA, 27 bp, Artificial Sequence
  Description of Artificial Sequence: Synthetic oligonucleotide
agctctgtccagtggagtgacccgttg

SEQ ID NO: 180938 - DNA, 26 bp, Artificial Sequence
  Description of Artificial Sequence: Synthetic oligonucleotide
gctctgtccagtggagtgacccgttg

SEQ ID NO: 180939 - DNA, 26 bp, Artificial Sequence
  Description of Artificial Sequence: Synthetic oligonucleotide
ctctgtccagtggagtgacccgttgc

SEQ ID NO: 180940 - DNA, 27 bp, Artificial Sequence
  Description of Artificial Sequence: Synthetic oligonucleotide
tctgtccagtggagtgacccgttgcca

SEQ ID NO: 180941 - DNA, 26 bp, Artificial Sequence
  Description of Artificial Sequence: Synthetic oligonucleotide
ctgtccagtggagtgacccgttgcca

SEQ ID NO: 180942 - DNA, 27 bp, Artificial Sequence
  Description of Artificial Sequence: Synthetic oligonucleotide
tgtccagtggagtgacccgttgccaga

SEQ ID NO: 180943 - DNA, 26 bp, Artificial Sequence
  Description of Artificial Sequence: Synthetic oligonucleotide
gtccagtggagtgacccgttgccaga

SEQ ID NO: 180944 - DNA, 27 bp, Artificial Sequence
  Description of Artificial Sequence: Synthetic oligonucleotide
tccagtggagtgacccgttgccagagt

SEQ ID NO: 180945 - DNA, 26 bp, Artificial Sequence
  Description of Artificial Sequence: Synthetic oligonucleotide
ccagtggagtgacccgttgccagagt

SEQ ID NO: 180946 - DNA, 26 bp, Artificial Sequence
  Description of Artificial Sequence: Synthetic oligonucleotide
cagtggagtgacccgttgccagagtg

SEQ ID NO: 180947 - DNA, 27 bp, Artificial Sequence
  Description of Artificial Sequence: Synthetic oligonucleotide
agtggagtgacccgttgccagagtgca

SEQ ID NO: 180948 - DNA, 26 bp, Artificial Sequence
  Description of Artificial Sequence: Synthetic oligonucleotide
gtggagtgacccgttgccagagtgca

SEQ ID NO: 180949 - DNA, 27 bp, Artificial Sequence
  Description of Artificial Sequence: Synthetic oligonucleotide
tggagtgacccgttgccagagtgcaga

SEQ ID NO: 180950 - DNA, 26 bp, Artificial Sequence
  Description of Artificial Sequence: Synthetic oligonucleotide
ggagtgacccgttgccagagtgcaga

SEQ ID NO: 180951 - DNA, 27 bp, Artificial Sequence
  Description of Artificial Sequence: Synthetic oligonucleotide
gagtgacccgttgccagagtgcagaga

SEQ ID NO: 180952 - DNA, 35 bp, Artificial Sequence
  Description of Artificial Sequence: Synthetic oligonucleotide
agtgacccgttgccagagtgcagagaaatttattg

SEQ ID NO: 180953 - DNA, 34 bp, Artificial Sequence
  Description of Artificial Sequence: Synthetic oligonucleotide
gtgacccgttgccagagtgcagagaaatttattg

SEQ ID NO: 180954 - DNA, 35 bp, Artificial Sequence
  Description of Artificial Sequence: Synthetic oligonucleotide
tgacccgttgccagagtgcagagaaatttattgtc

SEQ ID NO: 180955 - DNA, 34 bp, Artificial Sequence
  Description of Artificial Sequence: Synthetic oligonucleotide
gacccgttgccagagtgcagagaaatttattgtc

SEQ ID NO: 180956 - DNA, 34 bp, Artificial Sequence
  Description of Artificial Sequence: Synthetic oligonucleotide
acccgttgccagagtgcagagaaatttattgtcc

SEQ ID NO: 180957 - DNA, 33 bp, Artificial Sequence
  Description of Artificial Sequence: Synthetic oligonucleotide
cccgttgccagagtgcagagaaatttattgtcc

SEQ ID NO: 180958 - DNA, 34 bp, Artificial Sequence
  Description of Artificial Sequence: Synthetic oligonucleotide
ccgttgccagagtgcagagaaatttattgtccag

SEQ ID NO: 180959 - DNA, 34 bp, Artificial Sequence
  Description of Artificial Sequence: Synthetic oligonucleotide
cgttgccagagtgcagagaaatttattgtccagc

SEQ ID NO: 180960 - DNA, 35 bp, Artificial Sequence
  Description of Artificial Sequence: Synthetic oligonucleotide
gttgccagagtgcagagaaatttattgtccagcac

SEQ ID NO: 180961 - DNA, 35 bp, Artificial Sequence
  Description of Artificial Sequence: Synthetic oligonucleotide
ttgccagagtgcagagaaatttattgtccagcacc

SEQ ID NO: 180962 - DNA, 34 bp, Artificial Sequence
  Description of Artificial Sequence: Synthetic oligonucleotide
tgccagagtgcagagaaatttattgtccagcacc

SEQ ID NO: 180963 - DNA, 33 bp, Artificial Sequence
  Description of Artificial Sequence: Synthetic oligonucleotide
gccagagtgcagagaaatttattgtccagcacc

SEQ ID NO: 180964 - DNA, 34 bp, Artificial Sequence
  Description of Artificial Sequence: Synthetic oligonucleotide
ccagagtgcagagaaatttattgtccagcaccac

SEQ ID NO: 180965 - DNA, 34 bp, Artificial Sequence
  Description of Artificial Sequence: Synthetic oligonucleotide
cagagtgcagagaaatttattgtccagcaccacc

SEQ ID NO: 180966 - DNA, 35 bp, Artificial Sequence
  Description of Artificial Sequence: Synthetic oligonucleotide
agagtgcagagaaatttattgtccagcaccaccac

SEQ ID NO: 180967 - DNA, 34 bp, Artificial Sequence
  Description of Artificial Sequence: Synthetic oligonucleotide
gagtgcagagaaatttattgtccagcaccaccac

SEQ ID NO: 180968 - DNA, 39 bp, Artificial Sequence
  Description of Artificial Sequence: Synthetic oligonucleotide
agtgcagagaaatttattgtccagcaccaccacaaattg

SEQ ID NO: 180969 - DNA, 38 bp, Artificial Sequence
  Description of Artificial Sequence: Synthetic oligonucleotide
gtgcagagaaatttattgtccagcaccaccacaaattg

SEQ ID NO: 180970 - DNA, 39 bp, Artificial Sequence
  Description of Artificial Sequence: Synthetic oligonucleotide
tgcagagaaatttattgtccagcaccaccacaaattgac

SEQ ID NO: 180971 - DNA, 38 bp, Artificial Sequence
  Description of Artificial Sequence: Synthetic oligonucleotide
gcagagaaatttattgtccagcaccaccacaaattgac

SEQ ID NO: 180972 - DNA, 41 bp, Artificial Sequence
  Description of Artificial Sequence: Synthetic oligonucleotide
cagagaaatttattgtccagcaccaccacaaattgacaatg

SEQ ID NO: 180973 - DNA, 41 bp, Artificial Sequence
  Description of Artificial Sequence: Synthetic oligonucleotide
agagaaatttattgtccagcaccaccacaaattgacaatgg

SEQ ID NO: 180974 - DNA, 40 bp, Artificial Sequence
  Description of Artificial Sequence: Synthetic oligonucleotide
gagaaatttattgtccagcaccaccacaaattgacaatgg

SEQ ID NO: 180975 - DNA, 47 bp, Artificial Sequence
  Description of Artificial Sequence: Synthetic oligonucleotide
agaaatttattgtccagcaccaccacaaattgacaatggaataattc

SEQ ID NO: 180976 - DNA, 46 bp, Artificial Sequence
  Description of Artificial Sequence: Synthetic oligonucleotide
gaaatttattgtccagcaccaccacaaattgacaatggaataattc

SEQ ID NO: 180977 - DNA, 48 bp, Artificial Sequence
  Description of Artificial Sequence: Synthetic oligonucleotide
aaatttattgtccagcaccaccacaaattgacaatggaataattcaag

SEQ ID NO: 180978 - DNA, 47 bp, Artificial Sequence
  Description of Artificial Sequence: Synthetic oligonucleotide
aatttattgtccagcaccaccacaaattgacaatggaataattcaag

SEQ ID NO: 180979 - DNA, 46 bp, Artificial Sequence
  Description of Artificial Sequence: Synthetic oligonucleotide
atttattgtccagcaccaccacaaattgacaatggaataattcaag

SEQ ID NO: 180980 - DNA, 45 bp, Artificial Sequence
  Description of Artificial Sequence: Synthetic oligonucleotide
tttattgtccagcaccaccacaaattgacaatggaataattcaag

SEQ ID NO: 180981 - DNA, 44 bp, Artificial Sequence
  Description of Artificial Sequence: Synthetic oligonucleotide
ttattgtccagcaccaccacaaattgacaatggaataattcaag

SEQ ID NO: 180982 - DNA, 43 bp, Artificial Sequence
  Description of Artificial Sequence: Synthetic oligonucleotide
tattgtccagcaccaccacaaattgacaatggaataattcaag

SEQ ID NO: 180983 - DNA, 42 bp, Artificial Sequence
  Description of Artificial Sequence: Synthetic oligonucleotide
attgtccagcaccaccacaaattgacaatggaataattcaag

SEQ ID NO: 180984 - DNA, 41 bp, Artificial Sequence
  Description of Artificial Sequence: Synthetic oligonucleotide
ttgtccagcaccaccacaaattgacaatggaataattcaag

SEQ ID NO: 180985 - DNA, 40 bp, Artificial Sequence
  Description of Artificial Sequence: Synthetic oligonucleotide
tgtccagcaccaccacaaattgacaatggaataattcaag

SEQ ID NO: 180986 - DNA, 39 bp, Artificial Sequence
  Description of Artificial Sequence: Synthetic oligonucleotide
gtccagcaccaccacaaattgacaatggaataattcaag

SEQ ID NO: 180987 - DNA, 39 bp, Artificial Sequence
  Description of Artificial Sequence: Synthetic oligonucleotide
tccagcaccaccacaaattgacaatggaataattcaagg

SEQ ID NO: 180988 - DNA, 38 bp, Artificial Sequence
  Description of Artificial Sequence: Synthetic oligonucleotide
ccagcaccaccacaaattgacaatggaataattcaagg

SEQ ID NO: 180989 - DNA, 38 bp, Artificial Sequence
  Description of Artificial Sequence: Synthetic oligonucleotide
cagcaccaccacaaattgacaatggaataattcaaggg

SEQ ID NO: 180990 - DNA, 38 bp, Artificial Sequence
  Description of Artificial Sequence: Synthetic oligonucleotide
agcaccaccacaaattgacaatggaataattcaagggg

SEQ ID NO: 180991 - DNA, 37 bp, Artificial Sequence
  Description of Artificial Sequence: Synthetic oligonucleotide
gcaccaccacaaattgacaatggaataattcaagggg

SEQ ID NO: 180992 - DNA, 39 bp, Artificial Sequence
  Description of Artificial Sequence: Synthetic oligonucleotide
caccaccacaaattgacaatggaataattcaaggggaac

SEQ ID NO: 180993 - DNA, 39 bp, Artificial Sequence
  Description of Artificial Sequence: Synthetic oligonucleotide
accaccacaaattgacaatggaataattcaaggggaacg

SEQ ID NO: 180994 - DNA, 38 bp, Artificial Sequence
  Description of Artificial Sequence: Synthetic oligonucleotide
ccaccacaaattgacaatggaataattcaaggggaacg

SEQ ID NO: 180995 - DNA, 39 bp, Artificial Sequence
  Description of Artificial Sequence: Synthetic oligonucleotide
caccacaaattgacaatggaataattcaaggggaacgtg

SEQ ID NO: 180996 - DNA, 40 bp, Artificial Sequence
  Description of Artificial Sequence: Synthetic oligonucleotide
accacaaattgacaatggaataattcaaggggaacgtgac

SEQ ID NO: 180997 - DNA, 39 bp, Artificial Sequence
  Description of Artificial Sequence: Synthetic oligonucleotide
ccacaaattgacaatggaataattcaaggggaacgtgac

SEQ ID NO: 180998 - DNA, 39 bp, Artificial Sequence
  Description of Artificial Sequence: Synthetic oligonucleotide
cacaaattgacaatggaataattcaaggggaacgtgacc

SEQ ID NO: 180999 - DNA, 44 bp, Artificial Sequence
  Description of Artificial Sequence: Synthetic oligonucleotide
acaaattgacaatggaataattcaaggggaacgtgaccattatg

SEQ ID NO: 181000 - DNA, 43 bp, Artificial Sequence
  Description of Artificial Sequence: Synthetic oligonucleotide
caaattgacaatggaataattcaaggggaacgtgaccattatg

SEQ ID NO: 181001 - DNA, 43 bp, Artificial Sequence
  Description of Artificial Sequence: Synthetic oligonucleotide
aaattgacaatggaataattcaaggggaacgtgaccattatgg

SEQ ID NO: 181002 - DNA, 42 bp, Artificial Sequence
  Description of Artificial Sequence: Synthetic oligonucleotide
aattgacaatggaataattcaaggggaacgtgaccattatgg

SEQ ID NO: 181003 - DNA, 41 bp, Artificial Sequence
  Description of Artificial Sequence: Synthetic oligonucleotide
attgacaatggaataattcaaggggaacgtgaccattatgg

SEQ ID NO: 181004 - DNA, 40 bp, Artificial Sequence
  Description of Artificial Sequence: Synthetic oligonucleotide
ttgacaatggaataattcaaggggaacgtgaccattatgg

SEQ ID NO: 181005 - DNA, 39 bp, Artificial Sequence
  Description of Artificial Sequence: Synthetic oligonucleotide
tgacaatggaataattcaaggggaacgtgaccattatgg

SEQ ID NO: 181006 - DNA, 38 bp, Artificial Sequence
  Description of Artificial Sequence: Synthetic oligonucleotide
gacaatggaataattcaaggggaacgtgaccattatgg

SEQ ID NO: 181007 - DNA, 43 bp, Artificial Sequence
  Description of Artificial Sequence: Synthetic oligonucleotide
acaatggaataattcaaggggaacgtgaccattatggatatag

SEQ ID NO: 181008 - DNA, 42 bp, Artificial Sequence
  Description of Artificial Sequence: Synthetic oligonucleotide
caatggaataattcaaggggaacgtgaccattatggatatag

SEQ ID NO: 181009 - DNA, 43 bp, Artificial Sequence
  Description of Artificial Sequence: Synthetic oligonucleotide
aatggaataattcaaggggaacgtgaccattatggatatagac

SEQ ID NO: 181010 - DNA, 42 bp, Artificial Sequence
  Description of Artificial Sequence: Synthetic oligonucleotide
atggaataattcaaggggaacgtgaccattatggatatagac

SEQ ID NO: 181011 - DNA, 41 bp, Artificial Sequence
  Description of Artificial Sequence: Synthetic oligonucleotide
tggaataattcaaggggaacgtgaccattatggatatagac

SEQ ID NO: 181012 - DNA, 40 bp, Artificial Sequence
  Description of Artificial Sequence: Synthetic oligonucleotide
ggaataattcaaggggaacgtgaccattatggatatagac

SEQ ID NO: 181013 - DNA, 41 bp, Artificial Sequence
  Description of Artificial Sequence: Synthetic oligonucleotide
gaataattcaaggggaacgtgaccattatggatatagacag

SEQ ID NO: 181014 - DNA, 42 bp, Artificial Sequence
  Description of Artificial Sequence: Synthetic oligonucleotide
aataattcaaggggaacgtgaccattatggatatagacagtc

SEQ ID NO: 181015 - DNA, 41 bp, Artificial Sequence
  Description of Artificial Sequence: Synthetic oligonucleotide
ataattcaaggggaacgtgaccattatggatatagacagtc

SEQ ID NO: 181016 - DNA, 40 bp, Artificial Sequence
  Description of Artificial Sequence: Synthetic oligonucleotide
taattcaaggggaacgtgaccattatggatatagacagtc

SEQ ID NO: 181017 - DNA, 39 bp, Artificial Sequence
  Description of Artificial Sequence: Synthetic oligonucleotide
aattcaaggggaacgtgaccattatggatatagacagtc

SEQ ID NO: 181018 - DNA, 38 bp, Artificial Sequence
  Description of Artificial Sequence: Synthetic oligonucleotide
attcaaggggaacgtgaccattatggatatagacagtc

SEQ ID NO: 181019 - DNA, 37 bp, Artificial Sequence
  Description of Artificial Sequence: Synthetic oligonucleotide
ttcaaggggaacgtgaccattatggatatagacagtc

SEQ ID NO: 181020 - DNA, 36 bp, Artificial Sequence
  Description of Artificial Sequence: Synthetic oligonucleotide
tcaaggggaacgtgaccattatggatatagacagtc

SEQ ID NO: 181021 - DNA, 35 bp, Artificial Sequence
  Description of Artificial Sequence: Synthetic oligonucleotide
caaggggaacgtgaccattatggatatagacagtc

SEQ ID NO: 181022 - DNA, 36 bp, Artificial Sequence
  Description of Artificial Sequence: Synthetic oligonucleotide
aaggggaacgtgaccattatggatatagacagtctg

SEQ ID NO: 181023 - DNA, 35 bp, Artificial Sequence
  Description of Artificial Sequence: Synthetic oligonucleotide
aggggaacgtgaccattatggatatagacagtctg

SEQ ID NO: 181024 - DNA, 34 bp, Artificial Sequence
  Description of Artificial Sequence: Synthetic oligonucleotide
ggggaacgtgaccattatggatatagacagtctg

SEQ ID NO: 181025 - DNA, 37 bp, Artificial Sequence
  Description of Artificial Sequence: Synthetic oligonucleotide
gggaacgtgaccattatggatatagacagtctgtaac

SEQ ID NO: 181026 - DNA, 37 bp, Artificial Sequence
  Description of Artificial Sequence: Synthetic oligonucleotide
ggaacgtgaccattatggatatagacagtctgtaacg

SEQ ID NO: 181027 - DNA, 40 bp, Artificial Sequence
  Description of Artificial Sequence: Synthetic oligonucleotide
gaacgtgaccattatggatatagacagtctgtaacgtatg

SEQ ID NO: 181028 - DNA, 40 bp, Artificial Sequence
  Description of Artificial Sequence: Synthetic oligonucleotide
aacgtgaccattatggatatagacagtctgtaacgtatgc

SEQ ID NO: 181029 - DNA, 39 bp, Artificial Sequence
  Description of Artificial Sequence: Synthetic oligonucleotide
acgtgaccattatggatatagacagtctgtaacgtatgc

SEQ ID NO: 181030 - DNA, 38 bp, Artificial Sequence
  Description of Artificial Sequence: Synthetic oligonucleotide
cgtgaccattatggatatagacagtctgtaacgtatgc

SEQ ID NO: 181031 - DNA, 40 bp, Artificial Sequence
  Description of Artificial Sequence: Synthetic oligonucleotide
gtgaccattatggatatagacagtctgtaacgtatgcatg

SEQ ID NO: 181032 - DNA, 47 bp, Artificial Sequence
  Description of Artificial Sequence: Synthetic oligonucleotide
tgaccattatggatatagacagtctgtaacgtatgcatgtaataaag

SEQ ID NO: 181033 - DNA, 46 bp, Artificial Sequence
  Description of Artificial Sequence: Synthetic oligonucleotide
gaccattatggatatagacagtctgtaacgtatgcatgtaataaag

SEQ ID NO: 181034 - DNA, 46 bp, Artificial Sequence
  Description of Artificial Sequence: Synthetic oligonucleotide
accattatggatatagacagtctgtaacgtatgcatgtaataaagg

SEQ ID NO: 181035 - DNA, 45 bp, Artificial Sequence
  Description of Artificial Sequence: Synthetic oligonucleotide
ccattatggatatagacagtctgtaacgtatgcatgtaataaagg

SEQ ID NO: 181036 - DNA, 48 bp, Artificial Sequence
  Description of Artificial Sequence: Synthetic oligonucleotide
cattatggatatagacagtctgtaacgtatgcatgtaataaaggattc

SEQ ID NO: 181037 - DNA, 49 bp, Artificial Sequence
  Description of Artificial Sequence: Synthetic oligonucleotide
attatggatatagacagtctgtaacgtatgcatgtaataaaggattcac

SEQ ID NO: 181038 - DNA, 48 bp, Artificial Sequence
  Description of Artificial Sequence: Synthetic oligonucleotide
ttatggatatagacagtctgtaacgtatgcatgtaataaaggattcac

SEQ ID NO: 181039 - DNA, 47 bp, Artificial Sequence
  Description of Artificial Sequence: Synthetic oligonucleotide
tatggatatagacagtctgtaacgtatgcatgtaataaaggattcac

SEQ ID NO: 181040 - DNA, 46 bp, Artificial Sequence
  Description of Artificial Sequence: Synthetic oligonucleotide
atggatatagacagtctgtaacgtatgcatgtaataaaggattcac

SEQ ID NO: 181041 - DNA, 45 bp, Artificial Sequence
  Description of Artificial Sequence: Synthetic oligonucleotide
tggatatagacagtctgtaacgtatgcatgtaataaaggattcac

SEQ ID NO: 181042 - DNA, 44 bp, Artificial Sequence
  Description of Artificial Sequence: Synthetic oligonucleotide
ggatatagacagtctgtaacgtatgcatgtaataaaggattcac

SEQ ID NO: 181043 - DNA, 44 bp, Artificial Sequence
  Description of Artificial Sequence: Synthetic oligonucleotide
gatatagacagtctgtaacgtatgcatgtaataaaggattcacc

SEQ ID NO: 181044 - DNA, 46 bp, Artificial Sequence
  Description of Artificial Sequence: Synthetic oligonucleotide
atatagacagtctgtaacgtatgcatgtaataaaggattcaccatg

SEQ ID NO: 181045 - DNA, 45 bp, Artificial Sequence
  Description of Artificial Sequence: Synthetic oligonucleotide
tatagacagtctgtaacgtatgcatgtaataaaggattcaccatg

SEQ ID NO: 181046 - DNA, 44 bp, Artificial Sequence
  Description of Artificial Sequence: Synthetic oligonucleotide
atagacagtctgtaacgtatgcatgtaataaaggattcaccatg

SEQ ID NO: 181047 - DNA, 43 bp, Artificial Sequence
  Description of Artificial Sequence: Synthetic oligonucleotide
tagacagtctgtaacgtatgcatgtaataaaggattcaccatg

SEQ ID NO: 181048 - DNA, 42 bp, Artificial Sequence
  Description of Artificial Sequence: Synthetic oligonucleotide
agacagtctgtaacgtatgcatgtaataaaggattcaccatg

SEQ ID NO: 181049 - DNA, 41 bp, Artificial Sequence
  Description of Artificial Sequence: Synthetic oligonucleotide
gacagtctgtaacgtatgcatgtaataaaggattcaccatg

SEQ ID NO: 181050 - DNA, 44 bp, Artificial Sequence
  Description of Artificial Sequence: Synthetic oligonucleotide
acagtctgtaacgtatgcatgtaataaaggattcaccatgattg

SEQ ID NO: 181051 - DNA, 43 bp, Artificial Sequence
  Description of Artificial Sequence: Synthetic oligonucleotide
cagtctgtaacgtatgcatgtaataaaggattcaccatgattg

SEQ ID NO: 181052 - DNA, 43 bp, Artificial Sequence
  Description of Artificial Sequence: Synthetic oligonucleotide
agtctgtaacgtatgcatgtaataaaggattcaccatgattgg

SEQ ID NO: 181053 - DNA, 42 bp, Artificial Sequence
  Description of Artificial Sequence: Synthetic oligonucleotide
gtctgtaacgtatgcatgtaataaaggattcaccatgattgg

SEQ ID NO: 181054 - DNA, 43 bp, Artificial Sequence
  Description of Artificial Sequence: Synthetic oligonucleotide
tctgtaacgtatgcatgtaataaaggattcaccatgattggag

SEQ ID NO: 181055 - DNA, 42 bp, Artificial Sequence
  Description of Artificial Sequence: Synthetic oligonucleotide
ctgtaacgtatgcatgtaataaaggattcaccatgattggag

SEQ ID NO: 181056 - DNA, 43 bp, Artificial Sequence
  Description of Artificial Sequence: Synthetic oligonucleotide
tgtaacgtatgcatgtaataaaggattcaccatgattggagag

SEQ ID NO: 181057 - DNA, 42 bp, Artificial Sequence
  Description of Artificial Sequence: Synthetic oligonucleotide
gtaacgtatgcatgtaataaaggattcaccatgattggagag

SEQ ID NO: 181058 - DNA, 42 bp, Artificial Sequence
  Description of Artificial Sequence: Synthetic oligonucleotide
taacgtatgcatgtaataaaggattcaccatgattggagagc

SEQ ID NO: 181059 - DNA, 41 bp, Artificial Sequence
  Description of Artificial Sequence: Synthetic oligonucleotide
aacgtatgcatgtaataaaggattcaccatgattggagagc

SEQ ID NO: 181060 - DNA, 40 bp, Artificial Sequence
  Description of Artificial Sequence: Synthetic oligonucleotide
acgtatgcatgtaataaaggattcaccatgattggagagc

SEQ ID NO: 181061 - DNA, 39 bp, Artificial Sequence
  Description of Artificial Sequence: Synthetic oligonucleotide
cgtatgcatgtaataaaggattcaccatgattggagagc

SEQ ID NO: 181062 - DNA, 40 bp, Artificial Sequence
  Description of Artificial Sequence: Synthetic oligonucleotide
gtatgcatgtaataaaggattcaccatgattggagagcac

SEQ ID NO: 181063 - DNA, 41 bp, Artificial Sequence
  Description of Artificial Sequence: Synthetic oligonucleotide
tatgcatgtaataaaggattcaccatgattggagagcactc

SEQ ID NO: 181064 - DNA, 40 bp, Artificial Sequence
  Description of Artificial Sequence: Synthetic oligonucleotide
atgcatgtaataaaggattcaccatgattggagagcactc

SEQ ID NO: 181065 - DNA, 39 bp, Artificial Sequence
  Description of Artificial Sequence: Synthetic oligonucleotide
tgcatgtaataaaggattcaccatgattggagagcactc

SEQ ID NO: 181066 - DNA, 38 bp, Artificial Sequence
  Description of Artificial Sequence: Synthetic oligonucleotide
gcatgtaataaaggattcaccatgattggagagcactc

SEQ ID NO: 181067 - DNA, 46 bp, Artificial Sequence
  Description of Artificial Sequence: Synthetic oligonucleotide
catgtaataaaggattcaccatgattggagagcactctatttattg

SEQ ID NO: 181068 - DNA, 48 bp, Artificial Sequence
  Description of Artificial Sequence: Synthetic oligonucleotide
atgtaataaaggattcaccatgattggagagcactctatttattgtac

SEQ ID NO: 181069 - DNA, 47 bp, Artificial Sequence
  Description of Artificial Sequence: Synthetic oligonucleotide
tgtaataaaggattcaccatgattggagagcactctatttattgtac

SEQ ID NO: 181070 - DNA, 46 bp, Artificial Sequence
  Description of Artificial Sequence: Synthetic oligonucleotide
gtaataaaggattcaccatgattggagagcactctatttattgtac

SEQ ID NO: 181071 - DNA, 47 bp, Artificial Sequence
  Description of Artificial Sequence: Synthetic oligonucleotide
taataaaggattcaccatgattggagagcactctatttattgtactg

SEQ ID NO: 181072 - DNA, 46 bp, Artificial Sequence
  Description of Artificial Sequence: Synthetic oligonucleotide
aataaaggattcaccatgattggagagcactctatttattgtactg

SEQ ID NO: 181073 - DNA, 45 bp, Artificial Sequence
  Description of Artificial Sequence: Synthetic oligonucleotide
ataaaggattcaccatgattggagagcactctatttattgtactg

SEQ ID NO: 181074 - DNA, 44 bp, Artificial Sequence
  Description of Artificial Sequence: Synthetic oligonucleotide
taaaggattcaccatgattggagagcactctatttattgtactg

SEQ ID NO: 181075 - DNA, 43 bp, Artificial Sequence
  Description of Artificial Sequence: Synthetic oligonucleotide
aaaggattcaccatgattggagagcactctatttattgtactg

SEQ ID NO: 181076 - DNA, 42 bp, Artificial Sequence
  Description of Artificial Sequence: Synthetic oligonucleotide
aaggattcaccatgattggagagcactctatttattgtactg

SEQ ID NO: 181077 - DNA, 41 bp, Artificial Sequence
  Description of Artificial Sequence: Synthetic oligonucleotide
aggattcaccatgattggagagcactctatttattgtactg

SEQ ID NO: 181078 - DNA, 40 bp, Artificial Sequence
  Description of Artificial Sequence: Synthetic oligonucleotide
ggattcaccatgattggagagcactctatttattgtactg

SEQ ID NO: 181079 - DNA, 41 bp, Artificial Sequence
  Description of Artificial Sequence: Synthetic oligonucleotide
gattcaccatgattggagagcactctatttattgtactgtg

SEQ ID NO: 181080 - DNA, 47 bp, Artificial Sequence
  Description of Artificial Sequence: Synthetic oligonucleotide
attcaccatgattggagagcactctatttattgtactgtgaataatg

SEQ ID NO: 181081 - DNA, 46 bp, Artificial Sequence
  Description of Artificial Sequence: Synthetic oligonucleotide
ttcaccatgattggagagcactctatttattgtactgtgaataatg

SEQ ID NO: 181082 - DNA, 45 bp, Artificial Sequence
  Description of Artificial Sequence: Synthetic oligonucleotide
tcaccatgattggagagcactctatttattgtactgtgaataatg

SEQ ID NO: 181083 - DNA, 44 bp, Artificial Sequence
  Description of Artificial Sequence: Synthetic oligonucleotide
caccatgattggagagcactctatttattgtactgtgaataatg

SEQ ID NO: 181084 - DNA, 46 bp, Artificial Sequence
  Description of Artificial Sequence: Synthetic oligonucleotide
accatgattggagagcactctatttattgtactgtgaataatgatg

SEQ ID NO: 181085 - DNA, 45 bp, Artificial Sequence
  Description of Artificial Sequence: Synthetic oligonucleotide
ccatgattggagagcactctatttattgtactgtgaataatgatg

SEQ ID NO: 181086 - DNA, 47 bp, Artificial Sequence
  Description of Artificial Sequence: Synthetic oligonucleotide
catgattggagagcactctatttattgtactgtgaataatgatgaag

SEQ ID NO: 181087 - DNA, 47 bp, Artificial Sequence
  Description of Artificial Sequence: Synthetic oligonucleotide
atgattggagagcactctatttattgtactgtgaataatgatgaagg

SEQ ID NO: 181088 - DNA, 46 bp, Artificial Sequence
  Description of Artificial Sequence: Synthetic oligonucleotide
tgattggagagcactctatttattgtactgtgaataatgatgaagg

SEQ ID NO: 181089 - DNA, 45 bp, Artificial Sequence
  Description of Artificial Sequence: Synthetic oligonucleotide
gattggagagcactctatttattgtactgtgaataatgatgaagg

SEQ ID NO: 181090 - DNA, 46 bp, Artificial Sequence
  Description of Artificial Sequence: Synthetic oligonucleotide
attggagagcactctatttattgtactgtgaataatgatgaaggag

SEQ ID NO: 181091 - DNA, 45 bp, Artificial Sequence
  Description of Artificial Sequence: Synthetic oligonucleotide
ttggagagcactctatttattgtactgtgaataatgatgaaggag

SEQ ID NO: 181092 - DNA, 44 bp, Artificial Sequence
  Description of Artificial Sequence: Synthetic oligonucleotide
tggagagcactctatttattgtactgtgaataatgatgaaggag

SEQ ID NO: 181093 - DNA, 43 bp, Artificial Sequence
  Description of Artificial Sequence: Synthetic oligonucleotide
ggagagcactctatttattgtactgtgaataatgatgaaggag

SEQ ID NO: 181094 - DNA, 44 bp, Artificial Sequence
  Description of Artificial Sequence: Synthetic oligonucleotide
gagagcactctatttattgtactgtgaataatgatgaaggagag

SEQ ID NO: 181095 - DNA, 45 bp, Artificial Sequence
  Description of Artificial Sequence: Synthetic oligonucleotide
agagcactctatttattgtactgtgaataatgatgaaggagagtg

SEQ ID NO: 181096 - DNA, 44 bp, Artificial Sequence
  Description of Artificial Sequence: Synthetic oligonucleotide
gagcactctatttattgtactgtgaataatgatgaaggagagtg

SEQ ID NO: 181097 - DNA, 44 bp, Artificial Sequence
  Description of Artificial Sequence: Synthetic oligonucleotide
agcactctatttattgtactgtgaataatgatgaaggagagtgg

SEQ ID NO: 181098 - DNA, 43 bp, Artificial Sequence
  Description of Artificial Sequence: Synthetic oligonucleotide
gcactctatttattgtactgtgaataatgatgaaggagagtgg

SEQ ID NO: 181099 - DNA, 44 bp, Artificial Sequence
  Description of Artificial Sequence: Synthetic oligonucleotide
cactctatttattgtactgtgaataatgatgaaggagagtggag

SEQ ID NO: 181100 - DNA, 45 bp, Artificial Sequence
  Description of Artificial Sequence: Synthetic oligonucleotide
actctatttattgtactgtgaataatgatgaaggagagtggagtg

SEQ ID NO: 181101 - DNA, 44 bp, Artificial Sequence
  Description of Artificial Sequence: Synthetic oligonucleotide
ctctatttattgtactgtgaataatgatgaaggagagtggagtg

SEQ ID NO: 181102 - DNA, 44 bp, Artificial Sequence
  Description of Artificial Sequence: Synthetic oligonucleotide
tctatttattgtactgtgaataatgatgaaggagagtggagtgg

SEQ ID NO: 181103 - DNA, 43 bp, Artificial Sequence
  Description of Artificial Sequence: Synthetic oligonucleotide
ctatttattgtactgtgaataatgatgaaggagagtggagtgg

SEQ ID NO: 181104 - DNA, 43 bp, Artificial Sequence
  Description of Artificial Sequence: Synthetic oligonucleotide
tatttattgtactgtgaataatgatgaaggagagtggagtggc

SEQ ID NO: 181105 - DNA, 42 bp, Artificial Sequence
  Description of Artificial Sequence: Synthetic oligonucleotide
atttattgtactgtgaataatgatgaaggagagtggagtggc

SEQ ID NO: 181106 - DNA, 41 bp, Artificial Sequence
  Description of Artificial Sequence: Synthetic oligonucleotide
tttattgtactgtgaataatgatgaaggagagtggagtggc

SEQ ID NO: 181107 - DNA, 40 bp, Artificial Sequence
  Description of Artificial Sequence: Synthetic oligonucleotide
ttattgtactgtgaataatgatgaaggagagtggagtggc

SEQ ID NO: 181108 - DNA, 39 bp, Artificial Sequence
  Description of Artificial Sequence: Synthetic oligonucleotide
tattgtactgtgaataatgatgaaggagagtggagtggc

SEQ ID NO: 181109 - DNA, 38 bp, Artificial Sequence
  Description of Artificial Sequence: Synthetic oligonucleotide
attgtactgtgaataatgatgaaggagagtggagtggc

SEQ ID NO: 181110 - DNA, 37 bp, Artificial Sequence
  Description of Artificial Sequence: Synthetic oligonucleotide
ttgtactgtgaataatgatgaaggagagtggagtggc

SEQ ID NO: 181111 - DNA, 36 bp, Artificial Sequence
  Description of Artificial Sequence: Synthetic oligonucleotide
tgtactgtgaataatgatgaaggagagtggagtggc

SEQ ID NO: 181112 - DNA, 35 bp, Artificial Sequence
  Description of Artificial Sequence: Synthetic oligonucleotide
gtactgtgaataatgatgaaggagagtggagtggc

SEQ ID NO: 181113 - DNA, 35 bp, Artificial Sequence
  Description of Artificial Sequence: Synthetic oligonucleotide
tactgtgaataatgatgaaggagagtggagtggcc

SEQ ID NO: 181114 - DNA, 34 bp, Artificial Sequence
  Description of Artificial Sequence: Synthetic oligonucleotide
actgtgaataatgatgaaggagagtggagtggcc

SEQ ID NO: 181115 - DNA, 33 bp, Artificial Sequence
  Description of Artificial Sequence: Synthetic oligonucleotide
ctgtgaataatgatgaaggagagtggagtggcc

SEQ ID NO: 181116 - DNA, 33 bp, Artificial Sequence
  Description of Artificial Sequence: Synthetic oligonucleotide
tgtgaataatgatgaaggagagtggagtggccc

SEQ ID NO: 181117 - DNA, 32 bp, Artificial Sequence
  Description of Artificial Sequence: Synthetic oligonucleotide
gtgaataatgatgaaggagagtggagtggccc

SEQ ID NO: 181118 - DNA, 33 bp, Artificial Sequence
  Description of Artificial Sequence: Synthetic oligonucleotide
tgaataatgatgaaggagagtggagtggcccac

SEQ ID NO: 181119 - DNA, 32 bp, Artificial Sequence
  Description of Artificial Sequence: Synthetic oligonucleotide
gaataatgatgaaggagagtggagtggcccac

SEQ ID NO: 181120 - DNA, 32 bp, Artificial Sequence
  Description of Artificial Sequence: Synthetic oligonucleotide
aataatgatgaaggagagtggagtggcccacc

SEQ ID NO: 181121 - DNA, 31 bp, Artificial Sequence
  Description of Artificial Sequence: Synthetic oligonucleotide
ataatgatgaaggagagtggagtggcccacc

SEQ ID NO: 181122 - DNA, 30 bp, Artificial Sequence
  Description of Artificial Sequence: Synthetic oligonucleotide
taatgatgaaggagagtggagtggcccacc

SEQ ID NO: 181123 - DNA, 29 bp, Artificial Sequence
  Description of Artificial Sequence: Synthetic oligonucleotide
aatgatgaaggagagtggagtggcccacc

SEQ ID NO: 181124 - DNA, 28 bp, Artificial Sequence
  Description of Artificial Sequence: Synthetic oligonucleotide
atgatgaaggagagtggagtggcccacc

SEQ ID NO: 181125 - DNA, 27 bp, Artificial Sequence
  Description of Artificial Sequence: Synthetic oligonucleotide
tgatgaaggagagtggagtggcccacc

SEQ ID NO: 181126 - DNA, 27 bp, Artificial Sequence
  Description of Artificial Sequence: Synthetic oligonucleotide
gatgaaggagagtggagtggcccacca

SEQ ID NO: 181127 - DNA, 27 bp, Artificial Sequence
  Description of Artificial Sequence: Synthetic oligonucleotide
atgaaggagagtggagtggcccaccac

SEQ ID NO: 181128 - DNA, 26 bp, Artificial Sequence
  Description of Artificial Sequence: Synthetic oligonucleotide
tgaaggagagtggagtggcccaccac

SEQ ID NO: 181129 - DNA, 25 bp, Artificial Sequence
  Description of Artificial Sequence: Synthetic oligonucleotide
gaaggagagtggagtggcccaccac

SEQ ID NO: 181130 - DNA, 26 bp, Artificial Sequence
  Description of Artificial Sequence: Synthetic oligonucleotide
aaggagagtggagtggcccaccacct

SEQ ID NO: 181131 - DNA, 25 bp, Artificial Sequence
  Description of Artificial Sequence: Synthetic oligonucleotide
aggagagtggagtggcccaccacct

SEQ ID NO: 181132 - DNA, 24 bp, Artificial Sequence
  Description of Artificial Sequence: Synthetic oligonucleotide
ggagagtggagtggcccaccacct

SEQ ID NO: 181133 - DNA, 27 bp, Artificial Sequence
  Description of Artificial Sequence: Synthetic oligonucleotide
gagagtggagtggcccaccacctgaat

SEQ ID NO: 181134 - DNA, 27 bp, Artificial Sequence
  Description of Artificial Sequence: Synthetic oligonucleotide
agagtggagtggcccaccacctgaatg

SEQ ID NO: 181135 - DNA, 26 bp, Artificial Sequence
  Description of Artificial Sequence: Synthetic oligonucleotide
gagtggagtggcccaccacctgaatg

SEQ ID NO: 181136 - DNA, 27 bp, Artificial Sequence
  Description of Artificial Sequence: Synthetic oligonucleotide
agtggagtggcccaccacctgaatgca

SEQ ID NO: 181137 - DNA, 26 bp, Artificial Sequence
  Description of Artificial Sequence: Synthetic oligonucleotide
gtggagtggcccaccacctgaatgca

SEQ ID NO: 181138 - DNA, 27 bp, Artificial Sequence
  Description of Artificial Sequence: Synthetic oligonucleotide
tggagtggcccaccacctgaatgcaga

SEQ ID NO: 181139 - DNA, 26 bp, Artificial Sequence
  Description of Artificial Sequence: Synthetic oligonucleotide
ggagtggcccaccacctgaatgcaga

SEQ ID NO: 181140 - DNA, 26 bp, Artificial Sequence
  Description of Artificial Sequence: Synthetic oligonucleotide
gagtggcccaccacctgaatgcagag

SEQ ID NO: 181141 - DNA, 27 bp, Artificial Sequence
  Description of Artificial Sequence: Synthetic oligonucleotide
agtggcccaccacctgaatgcagagga

SEQ ID NO: 181142 - DNA, 27 bp, Artificial Sequence
  Description of Artificial Sequence: Synthetic oligonucleotide
gtggcccaccacctgaatgcagaggaa

SEQ ID NO: 181143 - DNA, 30 bp, Artificial Sequence
  Description of Artificial Sequence: Synthetic oligonucleotide
tggcccaccacctgaatgcagaggaaaatc

SEQ ID NO: 181144 - DNA, 29 bp, Artificial Sequence
  Description of Artificial Sequence: Synthetic oligonucleotide
ggcccaccacctgaatgcagaggaaaatc

SEQ ID NO: 181145 - DNA, 30 bp, Artificial Sequence
  Description of Artificial Sequence: Synthetic oligonucleotide
gcccaccacctgaatgcagaggaaaatctc

SEQ ID NO: 181146 - DNA, 33 bp, Artificial Sequence
  Description of Artificial Sequence: Synthetic oligonucleotide
cccaccacctgaatgcagaggaaaatctctaac

SEQ ID NO: 181147 - DNA, 35 bp, Artificial Sequence
  Description of Artificial Sequence: Synthetic oligonucleotide
ccaccacctgaatgcagaggaaaatctctaacttc

SEQ ID NO: 181148 - DNA, 35 bp, Artificial Sequence
  Description of Artificial Sequence: Synthetic oligonucleotide
caccacctgaatgcagaggaaaatctctaacttcc

SEQ ID NO: 181149 - DNA, 37 bp, Artificial Sequence
  Description of Artificial Sequence: Synthetic oligonucleotide
accacctgaatgcagaggaaaatctctaacttccaag

SEQ ID NO: 181150 - DNA, 36 bp, Artificial Sequence
  Description of Artificial Sequence: Synthetic oligonucleotide
ccacctgaatgcagaggaaaatctctaacttccaag

SEQ ID NO: 181151 - DNA, 36 bp, Artificial Sequence
  Description of Artificial Sequence: Synthetic oligonucleotide
cacctgaatgcagaggaaaatctctaacttccaagg

SEQ ID NO: 181152 - DNA, 37 bp, Artificial Sequence
  Description of Artificial Sequence: Synthetic oligonucleotide
acctgaatgcagaggaaaatctctaacttccaaggtc

SEQ ID NO: 181153 - DNA, 36 bp, Artificial Sequence
  Description of Artificial Sequence: Synthetic oligonucleotide
cctgaatgcagaggaaaatctctaacttccaaggtc

SEQ ID NO: 181154 - DNA, 36 bp, Artificial Sequence
  Description of Artificial Sequence: Synthetic oligonucleotide
ctgaatgcagaggaaaatctctaacttccaaggtcc

SEQ ID NO: 181155 - DNA, 36 bp, Artificial Sequence
  Description of Artificial Sequence: Synthetic oligonucleotide
tgaatgcagaggaaaatctctaacttccaaggtccc

SEQ ID NO: 181156 - DNA, 35 bp, Artificial Sequence
  Description of Artificial Sequence: Synthetic oligonucleotide
gaatgcagaggaaaatctctaacttccaaggtccc

SEQ ID NO: 181157 - DNA, 36 bp, Artificial Sequence
  Description of Artificial Sequence: Synthetic oligonucleotide
aatgcagaggaaaatctctaacttccaaggtcccac

SEQ ID NO: 181158 - DNA, 35 bp, Artificial Sequence
  Description of Artificial Sequence: Synthetic oligonucleotide
atgcagaggaaaatctctaacttccaaggtcccac

SEQ ID NO: 181159 - DNA, 34 bp, Artificial Sequence
  Description of Artificial Sequence: Synthetic oligonucleotide
tgcagaggaaaatctctaacttccaaggtcccac

SEQ ID NO: 181160 - DNA, 33 bp, Artificial Sequence
  Description of Artificial Sequence: Synthetic oligonucleotide
gcagaggaaaatctctaacttccaaggtcccac

SEQ ID NO: 181161 - DNA, 33 bp, Artificial Sequence
  Description of Artificial Sequence: Synthetic oligonucleotide
cagaggaaaatctctaacttccaaggtcccacc

SEQ ID NO: 181162 - DNA, 35 bp, Artificial Sequence
  Description of Artificial Sequence: Synthetic oligonucleotide
agaggaaaatctctaacttccaaggtcccaccaac

SEQ ID NO: 181163 - DNA, 34 bp, Artificial Sequence
  Description of Artificial Sequence: Synthetic oligonucleotide
gaggaaaatctctaacttccaaggtcccaccaac

SEQ ID NO: 181164 - DNA, 35 bp, Artificial Sequence
  Description of Artificial Sequence: Synthetic oligonucleotide
aggaaaatctctaacttccaaggtcccaccaacag

SEQ ID NO: 181165 - DNA, 34 bp, Artificial Sequence
  Description of Artificial Sequence: Synthetic oligonucleotide
ggaaaatctctaacttccaaggtcccaccaacag

SEQ ID NO: 181166 - DNA, 36 bp, Artificial Sequence
  Description of Artificial Sequence: Synthetic oligonucleotide
gaaaatctctaacttccaaggtcccaccaacagttc

SEQ ID NO: 181167 - DNA, 37 bp, Artificial Sequence
  Description of Artificial Sequence: Synthetic oligonucleotide
aaaatctctaacttccaaggtcccaccaacagttcag

SEQ ID NO: 181168 - DNA, 36 bp, Artificial Sequence
  Description of Artificial Sequence: Synthetic oligonucleotide
aaatctctaacttccaaggtcccaccaacagttcag

SEQ ID NO: 181169 - DNA, 35 bp, Artificial Sequence
  Description of Artificial Sequence: Synthetic oligonucleotide
aatctctaacttccaaggtcccaccaacagttcag

SEQ ID NO: 181170 - DNA, 34 bp, Artificial Sequence
  Description of Artificial Sequence: Synthetic oligonucleotide
atctctaacttccaaggtcccaccaacagttcag

SEQ ID NO: 181171 - DNA, 33 bp, Artificial Sequence
  Description of Artificial Sequence: Synthetic oligonucleotide
tctctaacttccaaggtcccaccaacagttcag

SEQ ID NO: 181172 - DNA, 32 bp, Artificial Sequence
  Description of Artificial Sequence: Synthetic oligonucleotide
ctctaacttccaaggtcccaccaacagttcag

SEQ ID NO: 181173 - DNA, 35 bp, Artificial Sequence
  Description of Artificial Sequence: Synthetic oligonucleotide
tctaacttccaaggtcccaccaacagttcagaaac

SEQ ID NO: 181174 - DNA, 34 bp, Artificial Sequence
  Description of Artificial Sequence: Synthetic oligonucleotide
ctaacttccaaggtcccaccaacagttcagaaac

SEQ ID NO: 181175 - DNA, 34 bp, Artificial Sequence
  Description of Artificial Sequence: Synthetic oligonucleotide
taacttccaaggtcccaccaacagttcagaaacc

SEQ ID NO: 181176 - DNA, 33 bp, Artificial Sequence
  Description of Artificial Sequence: Synthetic oligonucleotide
aacttccaaggtcccaccaacagttcagaaacc

SEQ ID NO: 181177 - DNA, 32 bp, Artificial Sequence
  Description of Artificial Sequence: Synthetic oligonucleotide
acttccaaggtcccaccaacagttcagaaacc

SEQ ID NO: 181178 - DNA, 31 bp, Artificial Sequence
  Description of Artificial Sequence: Synthetic oligonucleotide
cttccaaggtcccaccaacagttcagaaacc

SEQ ID NO: 181179 - DNA, 33 bp, Artificial Sequence
  Description of Artificial Sequence: Synthetic oligonucleotide
ttccaaggtcccaccaacagttcagaaacctac

SEQ ID NO: 181180 - DNA, 32 bp, Artificial Sequence
  Description of Artificial Sequence: Synthetic oligonucleotide
tccaaggtcccaccaacagttcagaaacctac

SEQ ID NO: 181181 - DNA, 31 bp, Artificial Sequence
  Description of Artificial Sequence: Synthetic oligonucleotide
ccaaggtcccaccaacagttcagaaacctac

SEQ ID NO: 181182 - DNA, 31 bp, Artificial Sequence
  Description of Artificial Sequence: Synthetic oligonucleotide
caaggtcccaccaacagttcagaaacctacc

SEQ ID NO: 181183 - DNA, 32 bp, Artificial Sequence
  Description of Artificial Sequence: Synthetic oligonucleotide
aaggtcccaccaacagttcagaaacctaccac

SEQ ID NO: 181184 - DNA, 31 bp, Artificial Sequence
  Description of Artificial Sequence: Synthetic oligonucleotide
aggtcccaccaacagttcagaaacctaccac

SEQ ID NO: 181185 - DNA, 30 bp, Artificial Sequence
  Description of Artificial Sequence: Synthetic oligonucleotide
ggtcccaccaacagttcagaaacctaccac

SEQ ID NO: 181186 - DNA, 31 bp, Artificial Sequence
  Description of Artificial Sequence: Synthetic oligonucleotide
gtcccaccaacagttcagaaacctaccacag

SEQ ID NO: 181187 - DNA, 36 bp, Artificial Sequence
  Description of Artificial Sequence: Synthetic oligonucleotide
tcccaccaacagttcagaaacctaccacagtaaatg

SEQ ID NO: 181188 - DNA, 35 bp, Artificial Sequence
  Description of Artificial Sequence: Synthetic oligonucleotide
cccaccaacagttcagaaacctaccacagtaaatg

SEQ ID NO: 181189 - DNA, 37 bp, Artificial Sequence
  Description of Artificial Sequence: Synthetic oligonucleotide
ccaccaacagttcagaaacctaccacagtaaatgttc

SEQ ID NO: 181190 - DNA, 37 bp, Artificial Sequence
  Description of Artificial Sequence: Synthetic oligonucleotide
caccaacagttcagaaacctaccacagtaaatgttcc

SEQ ID NO: 181191 - DNA, 39 bp, Artificial Sequence
  Description of Artificial Sequence: Synthetic oligonucleotide
accaacagttcagaaacctaccacagtaaatgttccaac

SEQ ID NO: 181192 - DNA, 38 bp, Artificial Sequence
  Description of Artificial Sequence: Synthetic oligonucleotide
ccaacagttcagaaacctaccacagtaaatgttccaac

SEQ ID NO: 181193 - DNA, 40 bp, Artificial Sequence
  Description of Artificial Sequence: Synthetic oligonucleotide
caacagttcagaaacctaccacagtaaatgttccaactac

SEQ ID NO: 181194 - DNA, 41 bp, Artificial Sequence
  Description of Artificial Sequence: Synthetic oligonucleotide
aacagttcagaaacctaccacagtaaatgttccaactacag

SEQ ID NO: 181195 - DNA, 40 bp, Artificial Sequence
  Description of Artificial Sequence: Synthetic oligonucleotide
acagttcagaaacctaccacagtaaatgttccaactacag

SEQ ID NO: 181196 - DNA, 39 bp, Artificial Sequence
  Description of Artificial Sequence: Synthetic oligonucleotide
cagttcagaaacctaccacagtaaatgttccaactacag

SEQ ID NO: 181197 - DNA, 41 bp, Artificial Sequence
  Description of Artificial Sequence: Synthetic oligonucleotide
agttcagaaacctaccacagtaaatgttccaactacagaag

SEQ ID NO: 181198 - DNA, 40 bp, Artificial Sequence
  Description of Artificial Sequence: Synthetic oligonucleotide
gttcagaaacctaccacagtaaatgttccaactacagaag

SEQ ID NO: 181199 - DNA, 41 bp, Artificial Sequence
  Description of Artificial Sequence: Synthetic oligonucleotide
ttcagaaacctaccacagtaaatgttccaactacagaagtc

SEQ ID NO: 181200 - DNA, 40 bp, Artificial Sequence
  Description of Artificial Sequence: Synthetic oligonucleotide
tcagaaacctaccacagtaaatgttccaactacagaagtc

SEQ ID NO: 181201 - DNA, 39 bp, Artificial Sequence
  Description of Artificial Sequence: Synthetic oligonucleotide
cagaaacctaccacagtaaatgttccaactacagaagtc

SEQ ID NO: 181202 - DNA, 40 bp, Artificial Sequence
  Description of Artificial Sequence: Synthetic oligonucleotide
agaaacctaccacagtaaatgttccaactacagaagtctc

SEQ ID NO: 181203 - DNA, 39 bp, Artificial Sequence
  Description of Artificial Sequence: Synthetic oligonucleotide
gaaacctaccacagtaaatgttccaactacagaagtctc

SEQ ID NO: 181204 - DNA, 40 bp, Artificial Sequence
  Description of Artificial Sequence: Synthetic oligonucleotide
aaacctaccacagtaaatgttccaactacagaagtctcac

SEQ ID NO: 181205 - DNA, 39 bp, Artificial Sequence
  Description of Artificial Sequence: Synthetic oligonucleotide
aacctaccacagtaaatgttccaactacagaagtctcac

SEQ ID NO: 181206 - DNA, 38 bp, Artificial Sequence
  Description of Artificial Sequence: Synthetic oligonucleotide
acctaccacagtaaatgttccaactacagaagtctcac

SEQ ID NO: 181207 - DNA, 37 bp, Artificial Sequence
  Description of Artificial Sequence: Synthetic oligonucleotide
cctaccacagtaaatgttccaactacagaagtctcac

SEQ ID NO: 181208 - DNA, 37 bp, Artificial Sequence
  Description of Artificial Sequence: Synthetic oligonucleotide
ctaccacagtaaatgttccaactacagaagtctcacc

SEQ ID NO: 181209 - DNA, 39 bp, Artificial Sequence
  Description of Artificial Sequence: Synthetic oligonucleotide
taccacagtaaatgttccaactacagaagtctcaccaac

SEQ ID NO: 181210 - DNA, 38 bp, Artificial Sequence
  Description of Artificial Sequence: Synthetic oligonucleotide
accacagtaaatgttccaactacagaagtctcaccaac

SEQ ID NO: 181211 - DNA, 37 bp, Artificial Sequence
  Description of Artificial Sequence: Synthetic oligonucleotide
ccacagtaaatgttccaactacagaagtctcaccaac

SEQ ID NO: 181212 - DNA, 39 bp, Artificial Sequence
  Description of Artificial Sequence: Synthetic oligonucleotide
cacagtaaatgttccaactacagaagtctcaccaacttc

SEQ ID NO: 181213 - DNA, 40 bp, Artificial Sequence
  Description of Artificial Sequence: Synthetic oligonucleotide
acagtaaatgttccaactacagaagtctcaccaacttctc

SEQ ID NO: 181214 - DNA, 39 bp, Artificial Sequence
  Description of Artificial Sequence: Synthetic oligonucleotide
cagtaaatgttccaactacagaagtctcaccaacttctc

SEQ ID NO: 181215 - DNA, 40 bp, Artificial Sequence
  Description of Artificial Sequence: Synthetic oligonucleotide
agtaaatgttccaactacagaagtctcaccaacttctcag

SEQ ID NO: 181216 - DNA, 39 bp, Artificial Sequence
  Description of Artificial Sequence: Synthetic oligonucleotide
gtaaatgttccaactacagaagtctcaccaacttctcag

SEQ ID NO: 181217 - DNA, 43 bp, Artificial Sequence
  Description of Artificial Sequence: Synthetic oligonucleotide
taaatgttccaactacagaagtctcaccaacttctcagaaaac

SEQ ID NO: 181218 - DNA, 42 bp, Artificial Sequence
  Description of Artificial Sequence: Synthetic oligonucleotide
aaatgttccaactacagaagtctcaccaacttctcagaaaac

SEQ ID NO: 181219 - DNA, 41 bp, Artificial Sequence
  Description of Artificial Sequence: Synthetic oligonucleotide
aatgttccaactacagaagtctcaccaacttctcagaaaac

SEQ ID NO: 181220 - DNA, 40 bp, Artificial Sequence
  Description of Artificial Sequence: Synthetic oligonucleotide
atgttccaactacagaagtctcaccaacttctcagaaaac

SEQ ID NO: 181221 - DNA, 39 bp, Artificial Sequence
  Description of Artificial Sequence: Synthetic oligonucleotide
tgttccaactacagaagtctcaccaacttctcagaaaac

SEQ ID NO: 181222 - DNA, 38 bp, Artificial Sequence
  Description of Artificial Sequence: Synthetic oligonucleotide
gttccaactacagaagtctcaccaacttctcagaaaac

SEQ ID NO: 181223 - DNA, 38 bp, Artificial Sequence
  Description of Artificial Sequence: Synthetic oligonucleotide
ttccaactacagaagtctcaccaacttctcagaaaacc

SEQ ID NO: 181224 - DNA, 37 bp, Artificial Sequence
  Description of Artificial Sequence: Synthetic oligonucleotide
tccaactacagaagtctcaccaacttctcagaaaacc

SEQ ID NO: 181225 - DNA, 36 bp, Artificial Sequence
  Description of Artificial Sequence: Synthetic oligonucleotide
ccaactacagaagtctcaccaacttctcagaaaacc

SEQ ID NO: 181226 - DNA, 37 bp, Artificial Sequence
  Description of Artificial Sequence: Synthetic oligonucleotide
caactacagaagtctcaccaacttctcagaaaaccac

SEQ ID NO: 181227 - DNA, 37 bp, Artificial Sequence
  Description of Artificial Sequence: Synthetic oligonucleotide
aactacagaagtctcaccaacttctcagaaaaccacc

SEQ ID NO: 181228 - DNA, 36 bp, Artificial Sequence
  Description of Artificial Sequence: Synthetic oligonucleotide
actacagaagtctcaccaacttctcagaaaaccacc

SEQ ID NO: 181229 - DNA, 35 bp, Artificial Sequence
  Description of Artificial Sequence: Synthetic oligonucleotide
ctacagaagtctcaccaacttctcagaaaaccacc

SEQ ID NO: 181230 - DNA, 36 bp, Artificial Sequence
  Description of Artificial Sequence: Synthetic oligonucleotide
tacagaagtctcaccaacttctcagaaaaccaccac

SEQ ID NO: 181231 - DNA, 35 bp, Artificial Sequence
  Description of Artificial Sequence: Synthetic oligonucleotide
acagaagtctcaccaacttctcagaaaaccaccac

SEQ ID NO: 181232 - DNA, 34 bp, Artificial Sequence
  Description of Artificial Sequence: Synthetic oligonucleotide
cagaagtctcaccaacttctcagaaaaccaccac

SEQ ID NO: 181233 - DNA, 39 bp, Artificial Sequence
  Description of Artificial Sequence: Synthetic oligonucleotide
agaagtctcaccaacttctcagaaaaccaccacaaaaac

SEQ ID NO: 181234 - DNA, 38 bp, Artificial Sequence
  Description of Artificial Sequence: Synthetic oligonucleotide
gaagtctcaccaacttctcagaaaaccaccacaaaaac

SEQ ID NO: 181235 - DNA, 38 bp, Artificial Sequence
  Description of Artificial Sequence: Synthetic oligonucleotide
aagtctcaccaacttctcagaaaaccaccacaaaaacc

SEQ ID NO: 181236 - DNA, 37 bp, Artificial Sequence
  Description of Artificial Sequence: Synthetic oligonucleotide
agtctcaccaacttctcagaaaaccaccacaaaaacc

SEQ ID NO: 181237 - DNA, 36 bp, Artificial Sequence
  Description of Artificial Sequence: Synthetic oligonucleotide
gtctcaccaacttctcagaaaaccaccacaaaaacc

SEQ ID NO: 181238 - DNA, 37 bp, Artificial Sequence
  Description of Artificial Sequence: Synthetic oligonucleotide
tctcaccaacttctcagaaaaccaccacaaaaaccac

SEQ ID NO: 181239 - DNA, 36 bp, Artificial Sequence
  Description of Artificial Sequence: Synthetic oligonucleotide
ctcaccaacttctcagaaaaccaccacaaaaaccac

SEQ ID NO: 181240 - DNA, 36 bp, Artificial Sequence
  Description of Artificial Sequence: Synthetic oligonucleotide
tcaccaacttctcagaaaaccaccacaaaaaccacc

SEQ ID NO: 181241 - DNA, 35 bp, Artificial Sequence
  Description of Artificial Sequence: Synthetic oligonucleotide
caccaacttctcagaaaaccaccacaaaaaccacc

SEQ ID NO: 181242 - DNA, 36 bp, Artificial Sequence
  Description of Artificial Sequence: Synthetic oligonucleotide
accaacttctcagaaaaccaccacaaaaaccaccac

SEQ ID NO: 181243 - DNA, 35 bp, Artificial Sequence
  Description of Artificial Sequence: Synthetic oligonucleotide
ccaacttctcagaaaaccaccacaaaaaccaccac

SEQ ID NO: 181244 - DNA, 36 bp, Artificial Sequence
  Description of Artificial Sequence: Synthetic oligonucleotide
caacttctcagaaaaccaccacaaaaaccaccacac

SEQ ID NO: 181245 - DNA, 36 bp, Artificial Sequence
  Description of Artificial Sequence: Synthetic oligonucleotide
aacttctcagaaaaccaccacaaaaaccaccacacc

SEQ ID NO: 181246 - DNA, 35 bp, Artificial Sequence
  Description of Artificial Sequence: Synthetic oligonucleotide
acttctcagaaaaccaccacaaaaaccaccacacc

SEQ ID NO: 181247 - DNA, 34 bp, Artificial Sequence
  Description of Artificial Sequence: Synthetic oligonucleotide
cttctcagaaaaccaccacaaaaaccaccacacc

SEQ ID NO: 181248 - DNA, 38 bp, Artificial Sequence
  Description of Artificial Sequence: Synthetic oligonucleotide
ttctcagaaaaccaccacaaaaaccaccacaccaaatg

SEQ ID NO: 181249 - DNA, 37 bp, Artificial Sequence
  Description of Artificial Sequence: Synthetic oligonucleotide
tctcagaaaaccaccacaaaaaccaccacaccaaatg

SEQ ID NO: 181250 - DNA, 36 bp, Artificial Sequence
  Description of Artificial Sequence: Synthetic oligonucleotide
ctcagaaaaccaccacaaaaaccaccacaccaaatg

SEQ ID NO: 181251 - DNA, 36 bp, Artificial Sequence
  Description of Artificial Sequence: Synthetic oligonucleotide
tcagaaaaccaccacaaaaaccaccacaccaaatgc

SEQ ID NO: 181252 - DNA, 35 bp, Artificial Sequence
  Description of Artificial Sequence: Synthetic oligonucleotide
cagaaaaccaccacaaaaaccaccacaccaaatgc

SEQ ID NO: 181253 - DNA, 36 bp, Artificial Sequence
  Description of Artificial Sequence: Synthetic oligonucleotide
agaaaaccaccacaaaaaccaccacaccaaatgctc

SEQ ID NO: 181254 - DNA, 35 bp, Artificial Sequence
  Description of Artificial Sequence: Synthetic oligonucleotide
gaaaaccaccacaaaaaccaccacaccaaatgctc

SEQ ID NO: 181255 - DNA, 37 bp, Artificial Sequence
  Description of Artificial Sequence: Synthetic oligonucleotide
aaaaccaccacaaaaaccaccacaccaaatgctcaag

SEQ ID NO: 181256 - DNA, 36 bp, Artificial Sequence
  Description of Artificial Sequence: Synthetic oligonucleotide
aaaccaccacaaaaaccaccacaccaaatgctcaag

SEQ ID NO: 181257 - DNA, 35 bp, Artificial Sequence
  Description of Artificial Sequence: Synthetic oligonucleotide
aaccaccacaaaaaccaccacaccaaatgctcaag

SEQ ID NO: 181258 - DNA, 34 bp, Artificial Sequence
  Description of Artificial Sequence: Synthetic oligonucleotide
accaccacaaaaaccaccacaccaaatgctcaag

SEQ ID NO: 181259 - DNA, 33 bp, Artificial Sequence
  Description of Artificial Sequence: Synthetic oligonucleotide
ccaccacaaaaaccaccacaccaaatgctcaag

SEQ ID NO: 181260 - DNA, 33 bp, Artificial Sequence
  Description of Artificial Sequence: Synthetic oligonucleotide
caccacaaaaaccaccacaccaaatgctcaagc

SEQ ID NO: 181261 - DNA, 35 bp, Artificial Sequence
  Description of Artificial Sequence: Synthetic oligonucleotide
accacaaaaaccaccacaccaaatgctcaagcaac

SEQ ID NO: 181262 - DNA, 34 bp, Artificial Sequence
  Description of Artificial Sequence: Synthetic oligonucleotide
ccacaaaaaccaccacaccaaatgctcaagcaac

SEQ ID NO: 181263 - DNA, 35 bp, Artificial Sequence
  Description of Artificial Sequence: Synthetic oligonucleotide
cacaaaaaccaccacaccaaatgctcaagcaacac

SEQ ID NO: 181264 - DNA, 35 bp, Artificial Sequence
  Description of Artificial Sequence: Synthetic oligonucleotide
acaaaaaccaccacaccaaatgctcaagcaacacg

SEQ ID NO: 181265 - DNA, 34 bp, Artificial Sequence
  Description of Artificial Sequence: Synthetic oligonucleotide
caaaaaccaccacaccaaatgctcaagcaacacg

SEQ ID NO: 181266 - DNA, 34 bp, Artificial Sequence
  Description of Artificial Sequence: Synthetic oligonucleotide
aaaaaccaccacaccaaatgctcaagcaacacgg

SEQ ID NO: 181267 - DNA, 33 bp, Artificial Sequence
  Description of Artificial Sequence: Synthetic oligonucleotide
aaaaccaccacaccaaatgctcaagcaacacgg

SEQ ID NO: 181268 - DNA, 32 bp, Artificial Sequence
  Description of Artificial Sequence: Synthetic oligonucleotide
aaaccaccacaccaaatgctcaagcaacacgg

SEQ ID NO: 181269 - DNA, 31 bp, Artificial Sequence
  Description of Artificial Sequence: Synthetic oligonucleotide
aaccaccacaccaaatgctcaagcaacacgg

SEQ ID NO: 181270 - DNA, 30 bp, Artificial Sequence
  Description of Artificial Sequence: Synthetic oligonucleotide
accaccacaccaaatgctcaagcaacacgg

SEQ ID NO: 181271 - DNA, 29 bp, Artificial Sequence
  Description of Artificial Sequence: Synthetic oligonucleotide
ccaccacaccaaatgctcaagcaacacgg

SEQ ID NO: 181272 - DNA, 30 bp, Artificial Sequence
  Description of Artificial Sequence: Synthetic oligonucleotide
caccacaccaaatgctcaagcaacacggag

SEQ ID NO: 181273 - DNA, 32 bp, Artificial Sequence
  Description of Artificial Sequence: Synthetic oligonucleotide
accacaccaaatgctcaagcaacacggagtac

SEQ ID NO: 181274 - DNA, 31 bp, Artificial Sequence
  Description of Artificial Sequence: Synthetic oligonucleotide
ccacaccaaatgctcaagcaacacggagtac

SEQ ID NO: 181275 - DNA, 32 bp, Artificial Sequence
  Description of Artificial Sequence: Synthetic oligonucleotide
cacaccaaatgctcaagcaacacggagtacac

SEQ ID NO: 181276 - DNA, 32 bp, Artificial Sequence
  Description of Artificial Sequence: Synthetic oligonucleotide
acaccaaatgctcaagcaacacggagtacacc

SEQ ID NO: 181277 - DNA, 31 bp, Artificial Sequence
  Description of Artificial Sequence: Synthetic oligonucleotide
caccaaatgctcaagcaacacggagtacacc

SEQ ID NO: 181278 - DNA, 32 bp, Artificial Sequence
  Description of Artificial Sequence: Synthetic oligonucleotide
accaaatgctcaagcaacacggagtacacctg

SEQ ID NO: 181279 - DNA, 31 bp, Artificial Sequence
  Description of Artificial Sequence: Synthetic oligonucleotide
ccaaatgctcaagcaacacggagtacacctg

SEQ ID NO: 181280 - DNA, 34 bp, Artificial Sequence
  Description of Artificial Sequence: Synthetic oligonucleotide
caaatgctcaagcaacacggagtacacctgtttc

SEQ ID NO: 181281 - DNA, 34 bp, Artificial Sequence
  Description of Artificial Sequence: Synthetic oligonucleotide
aaatgctcaagcaacacggagtacacctgtttcc

SEQ ID NO: 181282 - DNA, 33 bp, Artificial Sequence
  Description of Artificial Sequence: Synthetic oligonucleotide
aatgctcaagcaacacggagtacacctgtttcc

SEQ ID NO: 181283 - DNA, 32 bp, Artificial Sequence
  Description of Artificial Sequence: Synthetic oligonucleotide
atgctcaagcaacacggagtacacctgtttcc

SEQ ID NO: 181284 - DNA, 31 bp, Artificial Sequence
  Description of Artificial Sequence: Synthetic oligonucleotide
tgctcaagcaacacggagtacacctgtttcc

SEQ ID NO: 181285 - DNA, 30 bp, Artificial Sequence
  Description of Artificial Sequence: Synthetic oligonucleotide
gctcaagcaacacggagtacacctgtttcc

SEQ ID NO: 181286 - DNA, 31 bp, Artificial Sequence
  Description of Artificial Sequence: Synthetic oligonucleotide
ctcaagcaacacggagtacacctgtttccag

SEQ ID NO: 181287 - DNA, 31 bp, Artificial Sequence
  Description of Artificial Sequence: Synthetic oligonucleotide
tcaagcaacacggagtacacctgtttccagg

SEQ ID NO: 181288 - DNA, 30 bp, Artificial Sequence
  Description of Artificial Sequence: Synthetic oligonucleotide
caagcaacacggagtacacctgtttccagg

SEQ ID NO: 181289 - DNA, 31 bp, Artificial Sequence
  Description of Artificial Sequence: Synthetic oligonucleotide
aagcaacacggagtacacctgtttccaggac

SEQ ID NO: 181290 - DNA, 30 bp, Artificial Sequence
  Description of Artificial Sequence: Synthetic oligonucleotide
agcaacacggagtacacctgtttccaggac

SEQ ID NO: 181291 - DNA, 29 bp, Artificial Sequence
  Description of Artificial Sequence: Synthetic oligonucleotide
gcaacacggagtacacctgtttccaggac

SEQ ID NO: 181292 - DNA, 31 bp, Artificial Sequence
  Description of Artificial Sequence: Synthetic oligonucleotide
caacacggagtacacctgtttccaggacaac

SEQ ID NO: 181293 - DNA, 31 bp, Artificial Sequence
  Description of Artificial Sequence: Synthetic oligonucleotide
aacacggagtacacctgtttccaggacaacc

SEQ ID NO: 181294 - DNA, 30 bp, Artificial Sequence
  Description of Artificial Sequence: Synthetic oligonucleotide
acacggagtacacctgtttccaggacaacc

SEQ ID NO: 181295 - DNA, 29 bp, Artificial Sequence
  Description of Artificial Sequence: Synthetic oligonucleotide
cacggagtacacctgtttccaggacaacc

SEQ ID NO: 181296 - DNA, 31 bp, Artificial Sequence
  Description of Artificial Sequence: Synthetic oligonucleotide
acggagtacacctgtttccaggacaaccaag

SEQ ID NO: 181297 - DNA, 30 bp, Artificial Sequence
  Description of Artificial Sequence: Synthetic oligonucleotide
cggagtacacctgtttccaggacaaccaag

SEQ ID NO: 181298 - DNA, 30 bp, Artificial Sequence
  Description of Artificial Sequence: Synthetic oligonucleotide
ggagtacacctgtttccaggacaaccaagc

SEQ ID NO: 181299 - DNA, 35 bp, Artificial Sequence
  Description of Artificial Sequence: Synthetic oligonucleotide
gagtacacctgtttccaggacaaccaagcattttc

SEQ ID NO: 181300 - DNA, 37 bp, Artificial Sequence
  Description of Artificial Sequence: Synthetic oligonucleotide
agtacacctgtttccaggacaaccaagcattttcatg

SEQ ID NO: 181301 - DNA, 36 bp, Artificial Sequence
  Description of Artificial Sequence: Synthetic oligonucleotide
gtacacctgtttccaggacaaccaagcattttcatg

SEQ ID NO: 181302 - DNA, 39 bp, Artificial Sequence
  Description of Artificial Sequence: Synthetic oligonucleotide
tacacctgtttccaggacaaccaagcattttcatgaaac

SEQ ID NO: 181303 - DNA, 38 bp, Artificial Sequence
  Description of Artificial Sequence: Synthetic oligonucleotide
acacctgtttccaggacaaccaagcattttcatgaaac

SEQ ID NO: 181304 - DNA, 37 bp, Artificial Sequence
  Description of Artificial Sequence: Synthetic oligonucleotide
cacctgtttccaggacaaccaagcattttcatgaaac

SEQ ID NO: 181305 - DNA, 39 bp, Artificial Sequence
  Description of Artificial Sequence: Synthetic oligonucleotide
acctgtttccaggacaaccaagcattttcatgaaacaac

SEQ ID NO: 181306 - DNA, 38 bp, Artificial Sequence
  Description of Artificial Sequence: Synthetic oligonucleotide
cctgtttccaggacaaccaagcattttcatgaaacaac

SEQ ID NO: 181307 - DNA, 38 bp, Artificial Sequence
  Description of Artificial Sequence: Synthetic oligonucleotide
ctgtttccaggacaaccaagcattttcatgaaacaacc

SEQ ID NO: 181308 - DNA, 38 bp, Artificial Sequence
  Description of Artificial Sequence: Synthetic oligonucleotide
tgtttccaggacaaccaagcattttcatgaaacaaccc

SEQ ID NO: 181309 - DNA, 37 bp, Artificial Sequence
  Description of Artificial Sequence: Synthetic oligonucleotide
gtttccaggacaaccaagcattttcatgaaacaaccc

SEQ ID NO: 181310 - DNA, 37 bp, Artificial Sequence
  Description of Artificial Sequence: Synthetic oligonucleotide
tttccaggacaaccaagcattttcatgaaacaacccc

SEQ ID NO: 181311 - DNA, 36 bp, Artificial Sequence
  Description of Artificial Sequence: Synthetic oligonucleotide
ttccaggacaaccaagcattttcatgaaacaacccc

SEQ ID NO: 181312 - DNA, 35 bp, Artificial Sequence
  Description of Artificial Sequence: Synthetic oligonucleotide
tccaggacaaccaagcattttcatgaaacaacccc

SEQ ID NO: 181313 - DNA, 34 bp, Artificial Sequence
  Description of Artificial Sequence: Synthetic oligonucleotide
ccaggacaaccaagcattttcatgaaacaacccc

SEQ ID NO: 181314 - DNA, 41 bp, Artificial Sequence
  Description of Artificial Sequence: Synthetic oligonucleotide
caggacaaccaagcattttcatgaaacaaccccaaataaag

SEQ ID NO: 181315 - DNA, 41 bp, Artificial Sequence
  Description of Artificial Sequence: Synthetic oligonucleotide
aggacaaccaagcattttcatgaaacaaccccaaataaagg

SEQ ID NO: 181316 - DNA, 40 bp, Artificial Sequence
  Description of Artificial Sequence: Synthetic oligonucleotide
ggacaaccaagcattttcatgaaacaaccccaaataaagg

SEQ ID NO: 181317 - DNA, 42 bp, Artificial Sequence
  Description of Artificial Sequence: Synthetic oligonucleotide
gacaaccaagcattttcatgaaacaaccccaaataaaggaag

SEQ ID NO: 181318 - DNA, 43 bp, Artificial Sequence
  Description of Artificial Sequence: Synthetic oligonucleotide
acaaccaagcattttcatgaaacaaccccaaataaaggaagtg

SEQ ID NO: 181319 - DNA, 42 bp, Artificial Sequence
  Description of Artificial Sequence: Synthetic oligonucleotide
caaccaagcattttcatgaaacaaccccaaataaaggaagtg

SEQ ID NO: 181320 - DNA, 42 bp, Artificial Sequence
  Description of Artificial Sequence: Synthetic oligonucleotide
aaccaagcattttcatgaaacaaccccaaataaaggaagtgg

SEQ ID NO: 181321 - DNA, 41 bp, Artificial Sequence
  Description of Artificial Sequence: Synthetic oligonucleotide
accaagcattttcatgaaacaaccccaaataaaggaagtgg

SEQ ID NO: 181322 - DNA, 40 bp, Artificial Sequence
  Description of Artificial Sequence: Synthetic oligonucleotide
ccaagcattttcatgaaacaaccccaaataaaggaagtgg

SEQ ID NO: 181323 - DNA, 42 bp, Artificial Sequence
  Description of Artificial Sequence: Synthetic oligonucleotide
caagcattttcatgaaacaaccccaaataaaggaagtggaac

SEQ ID NO: 181324 - DNA, 42 bp, Artificial Sequence
  Description of Artificial Sequence: Synthetic oligonucleotide
aagcattttcatgaaacaaccccaaataaaggaagtggaacc

SEQ ID NO: 181325 - DNA, 41 bp, Artificial Sequence
  Description of Artificial Sequence: Synthetic oligonucleotide
agcattttcatgaaacaaccccaaataaaggaagtggaacc

SEQ ID NO: 181326 - DNA, 40 bp, Artificial Sequence
  Description of Artificial Sequence: Synthetic oligonucleotide
gcattttcatgaaacaaccccaaataaaggaagtggaacc

SEQ ID NO: 181327 - DNA, 41 bp, Artificial Sequence
  Description of Artificial Sequence: Synthetic oligonucleotide
cattttcatgaaacaaccccaaataaaggaagtggaaccac

SEQ ID NO: 181328 - DNA, 43 bp, Artificial Sequence
  Description of Artificial Sequence: Synthetic oligonucleotide
attttcatgaaacaaccccaaataaaggaagtggaaccacttc

SEQ ID NO: 181329 - DNA, 42 bp, Artificial Sequence
  Description of Artificial Sequence: Synthetic oligonucleotide
ttttcatgaaacaaccccaaataaaggaagtggaaccacttc

SEQ ID NO: 181330 - DNA, 41 bp, Artificial Sequence
  Description of Artificial Sequence: Synthetic oligonucleotide
tttcatgaaacaaccccaaataaaggaagtggaaccacttc

SEQ ID NO: 181331 - DNA, 40 bp, Artificial Sequence
  Description of Artificial Sequence: Synthetic oligonucleotide
ttcatgaaacaaccccaaataaaggaagtggaaccacttc

SEQ ID NO: 181332 - DNA, 39 bp, Artificial Sequence
  Description of Artificial Sequence: Synthetic oligonucleotide
tcatgaaacaaccccaaataaaggaagtggaaccacttc

SEQ ID NO: 181333 - DNA, 38 bp, Artificial Sequence
  Description of Artificial Sequence: Synthetic oligonucleotide
catgaaacaaccccaaataaaggaagtggaaccacttc

SEQ ID NO: 181334 - DNA, 39 bp, Artificial Sequence
  Description of Artificial Sequence: Synthetic oligonucleotide
atgaaacaaccccaaataaaggaagtggaaccacttcag

SEQ ID NO: 181335 - DNA, 38 bp, Artificial Sequence
  Description of Artificial Sequence: Synthetic oligonucleotide
tgaaacaaccccaaataaaggaagtggaaccacttcag

SEQ ID NO: 181336 - DNA, 37 bp, Artificial Sequence
  Description of Artificial Sequence: Synthetic oligonucleotide
gaaacaaccccaaataaaggaagtggaaccacttcag

SEQ ID NO: 181337 - DNA, 37 bp, Artificial Sequence
  Description of Artificial Sequence: Synthetic oligonucleotide
aaacaaccccaaataaaggaagtggaaccacttcagg

SEQ ID NO: 181338 - DNA, 36 bp, Artificial Sequence
  Description of Artificial Sequence: Synthetic oligonucleotide
aacaaccccaaataaaggaagtggaaccacttcagg

SEQ ID NO: 181339 - DNA, 35 bp, Artificial Sequence
  Description of Artificial Sequence: Synthetic oligonucleotide
acaaccccaaataaaggaagtggaaccacttcagg

SEQ ID NO: 181340 - DNA, 34 bp, Artificial Sequence
  Description of Artificial Sequence: Synthetic oligonucleotide
caaccccaaataaaggaagtggaaccacttcagg

SEQ ID NO: 181341 - DNA, 36 bp, Artificial Sequence
  Description of Artificial Sequence: Synthetic oligonucleotide
aaccccaaataaaggaagtggaaccacttcaggtac

SEQ ID NO: 181342 - DNA, 35 bp, Artificial Sequence
  Description of Artificial Sequence: Synthetic oligonucleotide
accccaaataaaggaagtggaaccacttcaggtac

SEQ ID NO: 181343 - DNA, 34 bp, Artificial Sequence
  Description of Artificial Sequence: Synthetic oligonucleotide
ccccaaataaaggaagtggaaccacttcaggtac

SEQ ID NO: 181344 - DNA, 36 bp, Artificial Sequence
  Description of Artificial Sequence: Synthetic oligonucleotide
cccaaataaaggaagtggaaccacttcaggtactac

SEQ ID NO: 181345 - DNA, 36 bp, Artificial Sequence
  Description of Artificial Sequence: Synthetic oligonucleotide
ccaaataaaggaagtggaaccacttcaggtactacc

SEQ ID NO: 181346 - DNA, 36 bp, Artificial Sequence
  Description of Artificial Sequence: Synthetic oligonucleotide
caaataaaggaagtggaaccacttcaggtactaccc

SEQ ID NO: 181347 - DNA, 36 bp, Artificial Sequence
  Description of Artificial Sequence: Synthetic oligonucleotide
aaataaaggaagtggaaccacttcaggtactacccg

SEQ ID NO: 181348 - DNA, 35 bp, Artificial Sequence
  Description of Artificial Sequence: Synthetic oligonucleotide
aataaaggaagtggaaccacttcaggtactacccg

SEQ ID NO: 181349 - DNA, 34 bp, Artificial Sequence
  Description of Artificial Sequence: Synthetic oligonucleotide
ataaaggaagtggaaccacttcaggtactacccg

SEQ ID NO: 181350 - DNA, 33 bp, Artificial Sequence
  Description of Artificial Sequence: Synthetic oligonucleotide
taaaggaagtggaaccacttcaggtactacccg

SEQ ID NO: 181351 - DNA, 32 bp, Artificial Sequence
  Description of Artificial Sequence: Synthetic oligonucleotide
aaaggaagtggaaccacttcaggtactacccg

SEQ ID NO: 181352 - DNA, 31 bp, Artificial Sequence
  Description of Artificial Sequence: Synthetic oligonucleotide
aaggaagtggaaccacttcaggtactacccg

SEQ ID NO: 181353 - DNA, 30 bp, Artificial Sequence
  Description of Artificial Sequence: Synthetic oligonucleotide
aggaagtggaaccacttcaggtactacccg

SEQ ID NO: 181354 - DNA, 29 bp, Artificial Sequence
  Description of Artificial Sequence: Synthetic oligonucleotide
ggaagtggaaccacttcaggtactacccg

SEQ ID NO: 181355 - DNA, 30 bp, Artificial Sequence
  Description of Artificial Sequence: Synthetic oligonucleotide
gaagtggaaccacttcaggtactacccgtc

SEQ ID NO: 181356 - DNA, 32 bp, Artificial Sequence
  Description of Artificial Sequence: Synthetic oligonucleotide
aagtggaaccacttcaggtactacccgtcttc

SEQ ID NO: 181357 - DNA, 31 bp, Artificial Sequence
  Description of Artificial Sequence: Synthetic oligonucleotide
agtggaaccacttcaggtactacccgtcttc

SEQ ID NO: 181358 - DNA, 30 bp, Artificial Sequence
  Description of Artificial Sequence: Synthetic oligonucleotide
gtggaaccacttcaggtactacccgtcttc

SEQ ID NO: 181359 - DNA, 33 bp, Artificial Sequence
  Description of Artificial Sequence: Synthetic oligonucleotide
tggaaccacttcaggtactacccgtcttctatc

SEQ ID NO: 181360 - DNA, 32 bp, Artificial Sequence
  Description of Artificial Sequence: Synthetic oligonucleotide
ggaaccacttcaggtactacccgtcttctatc

SEQ ID NO: 181361 - DNA, 33 bp, Artificial Sequence
  Description of Artificial Sequence: Synthetic oligonucleotide
gaaccacttcaggtactacccgtcttctatctg

SEQ ID NO: 181362 - DNA, 33 bp, Artificial Sequence
  Description of Artificial Sequence: Synthetic oligonucleotide
aaccacttcaggtactacccgtcttctatctgg

SEQ ID NO: 181363 - DNA, 32 bp, Artificial Sequence
  Description of Artificial Sequence: Synthetic oligonucleotide
accacttcaggtactacccgtcttctatctgg

SEQ ID NO: 181364 - DNA, 31 bp, Artificial Sequence
  Description of Artificial Sequence: Synthetic oligonucleotide
ccacttcaggtactacccgtcttctatctgg

SEQ ID NO: 181365 - DNA, 31 bp, Artificial Sequence
  Description of Artificial Sequence: Synthetic oligonucleotide
cacttcaggtactacccgtcttctatctggg

SEQ ID NO: 181366 - DNA, 31 bp, Artificial Sequence
  Description of Artificial Sequence: Synthetic oligonucleotide
acttcaggtactacccgtcttctatctgggc

SEQ ID NO: 181367 - DNA, 30 bp, Artificial Sequence
  Description of Artificial Sequence: Synthetic oligonucleotide
cttcaggtactacccgtcttctatctgggc

SEQ ID NO: 181368 - DNA, 31 bp, Artificial Sequence
  Description of Artificial Sequence: Synthetic oligonucleotide
ttcaggtactacccgtcttctatctgggcac

SEQ ID NO: 181369 - DNA, 30 bp, Artificial Sequence
  Description of Artificial Sequence: Synthetic oligonucleotide
tcaggtactacccgtcttctatctgggcac

SEQ ID NO: 181370 - DNA, 29 bp, Artificial Sequence
  Description of Artificial Sequence: Synthetic oligonucleotide
caggtactacccgtcttctatctgggcac

SEQ ID NO: 181371 - DNA, 30 bp, Artificial Sequence
  Description of Artificial Sequence: Synthetic oligonucleotide
aggtactacccgtcttctatctgggcacac

SEQ ID NO: 181372 - DNA, 29 bp, Artificial Sequence
  Description of Artificial Sequence: Synthetic oligonucleotide
ggtactacccgtcttctatctgggcacac

SEQ ID NO: 181373 - DNA, 29 bp, Artificial Sequence
  Description of Artificial Sequence: Synthetic oligonucleotide
gtactacccgtcttctatctgggcacacg

SEQ ID NO: 181374 - DNA, 30 bp, Artificial Sequence
  Description of Artificial Sequence: Synthetic oligonucleotide
tactacccgtcttctatctgggcacacgtg

SEQ ID NO: 181375 - DNA, 29 bp, Artificial Sequence
  Description of Artificial Sequence: Synthetic oligonucleotide
actacccgtcttctatctgggcacacgtg

SEQ ID NO: 181376 - DNA, 28 bp, Artificial Sequence
  Description of Artificial Sequence: Synthetic oligonucleotide
ctacccgtcttctatctgggcacacgtg

SEQ ID NO: 181377 - DNA, 31 bp, Artificial Sequence
  Description of Artificial Sequence: Synthetic oligonucleotide
tacccgtcttctatctgggcacacgtgtttc

SEQ ID NO: 181378 - DNA, 30 bp, Artificial Sequence
  Description of Artificial Sequence: Synthetic oligonucleotide
acccgtcttctatctgggcacacgtgtttc

SEQ ID NO: 181379 - DNA, 29 bp, Artificial Sequence
  Description of Artificial Sequence: Synthetic oligonucleotide
cccgtcttctatctgggcacacgtgtttc

SEQ ID NO: 181380 - DNA, 30 bp, Artificial Sequence
  Description of Artificial Sequence: Synthetic oligonucleotide
ccgtcttctatctgggcacacgtgtttcac

SEQ ID NO: 181381 - DNA, 30 bp, Artificial Sequence
  Description of Artificial Sequence: Synthetic oligonucleotide
cgtcttctatctgggcacacgtgtttcacg

SEQ ID NO: 181382 - DNA, 32 bp, Artificial Sequence
  Description of Artificial Sequence: Synthetic oligonucleotide
gtcttctatctgggcacacgtgtttcacgttg

SEQ ID NO: 181383 - DNA, 33 bp, Artificial Sequence
  Description of Artificial Sequence: Synthetic oligonucleotide
tcttctatctgggcacacgtgtttcacgttgac

SEQ ID NO: 181384 - DNA, 32 bp, Artificial Sequence
  Description of Artificial Sequence: Synthetic oligonucleotide
cttctatctgggcacacgtgtttcacgttgac

SEQ ID NO: 181385 - DNA, 33 bp, Artificial Sequence
  Description of Artificial Sequence: Synthetic oligonucleotide
ttctatctgggcacacgtgtttcacgttgacag

SEQ ID NO: 181386 - DNA, 32 bp, Artificial Sequence
  Description of Artificial Sequence: Synthetic oligonucleotide
tctatctgggcacacgtgtttcacgttgacag

SEQ ID NO: 181387 - DNA, 31 bp, Artificial Sequence
  Description of Artificial Sequence: Synthetic oligonucleotide
ctatctgggcacacgtgtttcacgttgacag

SEQ ID NO: 181388 - DNA, 31 bp, Artificial Sequence
  Description of Artificial Sequence: Synthetic oligonucleotide
tatctgggcacacgtgtttcacgttgacagg

SEQ ID NO: 181389 - DNA, 30 bp, Artificial Sequence
  Description of Artificial Sequence: Synthetic oligonucleotide
atctgggcacacgtgtttcacgttgacagg

SEQ ID NO: 181390 - DNA, 29 bp, Artificial Sequence
  Description of Artificial Sequence: Synthetic oligonucleotide
tctgggcacacgtgtttcacgttgacagg

SEQ ID NO: 181391 - DNA, 28 bp, Artificial Sequence
  Description of Artificial Sequence: Synthetic oligonucleotide
ctgggcacacgtgtttcacgttgacagg

SEQ ID NO: 181392 - DNA, 31 bp, Artificial Sequence
  Description of Artificial Sequence: Synthetic oligonucleotide
tgggcacacgtgtttcacgttgacaggtttg

SEQ ID NO: 181393 - DNA, 30 bp, Artificial Sequence
  Description of Artificial Sequence: Synthetic oligonucleotide
gggcacacgtgtttcacgttgacaggtttg

SEQ ID NO: 181394 - DNA, 30 bp, Artificial Sequence
  Description of Artificial Sequence: Synthetic oligonucleotide
ggcacacgtgtttcacgttgacaggtttgc

SEQ ID NO: 181395 - DNA, 32 bp, Artificial Sequence
  Description of Artificial Sequence: Synthetic oligonucleotide
gcacacgtgtttcacgttgacaggtttgcttg

SEQ ID NO: 181396 - DNA, 32 bp, Artificial Sequence
  Description of Artificial Sequence: Synthetic oligonucleotide
cacacgtgtttcacgttgacaggtttgcttgg

SEQ ID NO: 181397 - DNA, 32 bp, Artificial Sequence
  Description of Artificial Sequence: Synthetic oligonucleotide
acacgtgtttcacgttgacaggtttgcttggg

SEQ ID NO: 181398 - DNA, 31 bp, Artificial Sequence
  Description of Artificial Sequence: Synthetic oligonucleotide
cacgtgtttcacgttgacaggtttgcttggg

SEQ ID NO: 181399 - DNA, 32 bp, Artificial Sequence
  Description of Artificial Sequence: Synthetic oligonucleotide
acgtgtttcacgttgacaggtttgcttgggac

SEQ ID NO: 181400 - DNA, 31 bp, Artificial Sequence
  Description of Artificial Sequence: Synthetic oligonucleotide
cgtgtttcacgttgacaggtttgcttgggac

SEQ ID NO: 181401 - DNA, 31 bp, Artificial Sequence
  Description of Artificial Sequence: Synthetic oligonucleotide
gtgtttcacgttgacaggtttgcttgggacg

SEQ ID NO: 181402 - DNA, 31 bp, Artificial Sequence
  Description of Artificial Sequence: Synthetic oligonucleotide
tgtttcacgttgacaggtttgcttgggacgc

SEQ ID NO: 181403 - DNA, 30 bp, Artificial Sequence
  Description of Artificial Sequence: Synthetic oligonucleotide
gtttcacgttgacaggtttgcttgggacgc

SEQ ID NO: 181404 - DNA, 32 bp, Artificial Sequence
  Description of Artificial Sequence: Synthetic oligonucleotide
tttcacgttgacaggtttgcttgggacgctag

SEQ ID NO: 181405 - DNA, 31 bp, Artificial Sequence
  Description of Artificial Sequence: Synthetic oligonucleotide
ttcacgttgacaggtttgcttgggacgctag

SEQ ID NO: 181406 - DNA, 30 bp, Artificial Sequence
  Description of Artificial Sequence: Synthetic oligonucleotide
tcacgttgacaggtttgcttgggacgctag

SEQ ID NO: 181407 - DNA, 29 bp, Artificial Sequence
  Description of Artificial Sequence: Synthetic oligonucleotide
cacgttgacaggtttgcttgggacgctag

SEQ ID NO: 181408 - DNA, 32 bp, Artificial Sequence
  Description of Artificial Sequence: Synthetic oligonucleotide
acgttgacaggtttgcttgggacgctagtaac

SEQ ID NO: 181409 - DNA, 31 bp, Artificial Sequence
  Description of Artificial Sequence: Synthetic oligonucleotide
cgttgacaggtttgcttgggacgctagtaac

SEQ ID NO: 181410 - DNA, 31 bp, Artificial Sequence
  Description of Artificial Sequence: Synthetic oligonucleotide
gttgacaggtttgcttgggacgctagtaacc

SEQ ID NO: 181411 - DNA, 33 bp, Artificial Sequence
  Description of Artificial Sequence: Synthetic oligonucleotide
ttgacaggtttgcttgggacgctagtaaccatg

SEQ ID NO: 181412 - DNA, 32 bp, Artificial Sequence
  Description of Artificial Sequence: Synthetic oligonucleotide
tgacaggtttgcttgggacgctagtaaccatg

SEQ ID NO: 181413 - DNA, 31 bp, Artificial Sequence
  Description of Artificial Sequence: Synthetic oligonucleotide
gacaggtttgcttgggacgctagtaaccatg

SEQ ID NO: 181414 - DNA, 31 bp, Artificial Sequence
  Description of Artificial Sequence: Synthetic oligonucleotide
acaggtttgcttgggacgctagtaaccatgg

SEQ ID NO: 181415 - DNA, 30 bp, Artificial Sequence
  Description of Artificial Sequence: Synthetic oligonucleotide
caggtttgcttgggacgctagtaaccatgg

SEQ ID NO: 181416 - DNA, 30 bp, Artificial Sequence
  Description of Artificial Sequence: Synthetic oligonucleotide
aggtttgcttgggacgctagtaaccatggg

SEQ ID NO: 181417 - DNA, 29 bp, Artificial Sequence
  Description of Artificial Sequence: Synthetic oligonucleotide
ggtttgcttgggacgctagtaaccatggg

SEQ ID NO: 181418 - DNA, 29 bp, Artificial Sequence
  Description of Artificial Sequence: Synthetic oligonucleotide
gtttgcttgggacgctagtaaccatgggc

SEQ ID NO: 181419 - DNA, 31 bp, Artificial Sequence
  Description of Artificial Sequence: Synthetic oligonucleotide
tttgcttgggacgctagtaaccatgggcttg

SEQ ID NO: 181420 - DNA, 30 bp, Artificial Sequence
  Description of Artificial Sequence: Synthetic oligonucleotide
ttgcttgggacgctagtaaccatgggcttg

SEQ ID NO: 181421 - DNA, 29 bp, Artificial Sequence
  Description of Artificial Sequence: Synthetic oligonucleotide
tgcttgggacgctagtaaccatgggcttg

SEQ ID NO: 181422 - DNA, 28 bp, Artificial Sequence
  Description of Artificial Sequence: Synthetic oligonucleotide
gcttgggacgctagtaaccatgggcttg

SEQ ID NO: 181423 - DNA, 28 bp, Artificial Sequence
  Description of Artificial Sequence: Synthetic oligonucleotide
cttgggacgctagtaaccatgggcttgc

SEQ ID NO: 181424 - DNA, 29 bp, Artificial Sequence
  Description of Artificial Sequence: Synthetic oligonucleotide
ttgggacgctagtaaccatgggcttgctg

SEQ ID NO: 181425 - DNA, 28 bp, Artificial Sequence
  Description of Artificial Sequence: Synthetic oligonucleotide
tgggacgctagtaaccatgggcttgctg

SEQ ID NO: 181426 - DNA, 27 bp, Artificial Sequence
  Description of Artificial Sequence: Synthetic oligonucleotide
gggacgctagtaaccatgggcttgctg

SEQ ID NO: 181427 - DNA, 28 bp, Artificial Sequence
  Description of Artificial Sequence: Synthetic oligonucleotide
ggacgctagtaaccatgggcttgctgac

SEQ ID NO: 181428 - DNA, 31 bp, Artificial Sequence
  Description of Artificial Sequence: Synthetic oligonucleotide
gacgctagtaaccatgggcttgctgacttag

SEQ ID NO: 181429 - DNA, 32 bp, Artificial Sequence
  Description of Artificial Sequence: Synthetic oligonucleotide
tgccgtccaggttacagaagagaaccttcttc

SEQ ID NO: 181430 - DNA, 31 bp, Artificial Sequence
  Description of Artificial Sequence: Synthetic oligonucleotide
gccgtccaggttacagaagagaaccttcttc

SEQ ID NO: 181431 - DNA, 34 bp, Artificial Sequence
  Description of Artificial Sequence: Synthetic oligonucleotide
ccgtccaggttacagaagagaaccttcttctatc

SEQ ID NO: 181432 - DNA, 35 bp, Artificial Sequence
  Description of Artificial Sequence: Synthetic oligonucleotide
cgtccaggttacagaagagaaccttcttctatcac

SEQ ID NO: 181433 - DNA, 35 bp, Artificial Sequence
  Description of Artificial Sequence: Synthetic oligonucleotide
gtccaggttacagaagagaaccttcttctatcacc

SEQ ID NO: 181434 - DNA, 39 bp, Artificial Sequence
  Description of Artificial Sequence: Synthetic oligonucleotide
tccaggttacagaagagaaccttcttctatcaccaaaac

SEQ ID NO: 181435 - DNA, 38 bp, Artificial Sequence
  Description of Artificial Sequence: Synthetic oligonucleotide
ccaggttacagaagagaaccttcttctatcaccaaaac

SEQ ID NO: 181436 - DNA, 41 bp, Artificial Sequence
  Description of Artificial Sequence: Synthetic oligonucleotide
caggttacagaagagaaccttcttctatcaccaaaactaac

SEQ ID NO: 181437 - DNA, 43 bp, Artificial Sequence
  Description of Artificial Sequence: Synthetic oligonucleotide
aggttacagaagagaaccttcttctatcaccaaaactaacttg

SEQ ID NO: 181438 - DNA, 42 bp, Artificial Sequence
  Description of Artificial Sequence: Synthetic oligonucleotide
ggttacagaagagaaccttcttctatcaccaaaactaacttg

SEQ ID NO: 181439 - DNA, 42 bp, Artificial Sequence
  Description of Artificial Sequence: Synthetic oligonucleotide
gttacagaagagaaccttcttctatcaccaaaactaacttgc

SEQ ID NO: 181440 - DNA, 42 bp, Artificial Sequence
  Description of Artificial Sequence: Synthetic oligonucleotide
ttacagaagagaaccttcttctatcaccaaaactaacttgcc

SEQ ID NO: 181441 - DNA, 41 bp, Artificial Sequence
  Description of Artificial Sequence: Synthetic oligonucleotide
tacagaagagaaccttcttctatcaccaaaactaacttgcc

SEQ ID NO: 181442 - DNA, 40 bp, Artificial Sequence
  Description of Artificial Sequence: Synthetic oligonucleotide
acagaagagaaccttcttctatcaccaaaactaacttgcc

SEQ ID NO: 181443 - DNA, 39 bp, Artificial Sequence
  Description of Artificial Sequence: Synthetic oligonucleotide
cagaagagaaccttcttctatcaccaaaactaacttgcc

SEQ ID NO: 181444 - DNA, 41 bp, Artificial Sequence
  Description of Artificial Sequence: Synthetic oligonucleotide
agaagagaaccttcttctatcaccaaaactaacttgccttc

SEQ ID NO: 181445 - DNA, 40 bp, Artificial Sequence
  Description of Artificial Sequence: Synthetic oligonucleotide
gaagagaaccttcttctatcaccaaaactaacttgccttc

SEQ ID NO: 181446 - DNA, 41 bp, Artificial Sequence
  Description of Artificial Sequence: Synthetic oligonucleotide
aagagaaccttcttctatcaccaaaactaacttgccttcag

SEQ ID NO: 181447 - DNA, 40 bp, Artificial Sequence
  Description of Artificial Sequence: Synthetic oligonucleotide
agagaaccttcttctatcaccaaaactaacttgccttcag

SEQ ID NO: 181448 - DNA, 39 bp, Artificial Sequence
  Description of Artificial Sequence: Synthetic oligonucleotide
gagaaccttcttctatcaccaaaactaacttgccttcag

SEQ ID NO: 181449 - DNA, 49 bp, Artificial Sequence
  Description of Artificial Sequence: Synthetic oligonucleotide
agaaccttcttctatcaccaaaactaacttgccttcagaatttaaaatg

SEQ ID NO: 181450 - DNA, 48 bp, Artificial Sequence
  Description of Artificial Sequence: Synthetic oligonucleotide
gaaccttcttctatcaccaaaactaacttgccttcagaatttaaaatg

SEQ ID NO: 181451 - DNA, 48 bp, Artificial Sequence
  Description of Artificial Sequence: Synthetic oligonucleotide
aaccttcttctatcaccaaaactaacttgccttcagaatttaaaatgg

SEQ ID NO: 181452 - DNA, 47 bp, Artificial Sequence
  Description of Artificial Sequence: Synthetic oligonucleotide
accttcttctatcaccaaaactaacttgccttcagaatttaaaatgg

SEQ ID NO: 181453 - DNA, 46 bp, Artificial Sequence
  Description of Artificial Sequence: Synthetic oligonucleotide
ccttcttctatcaccaaaactaacttgccttcagaatttaaaatgg

SEQ ID NO: 181454 - DNA, 47 bp, Artificial Sequence
  Description of Artificial Sequence: Synthetic oligonucleotide
cttcttctatcaccaaaactaacttgccttcagaatttaaaatggtc

SEQ ID NO: 181455 - DNA, 47 bp, Artificial Sequence
  Description of Artificial Sequence: Synthetic oligonucleotide
ttcttctatcaccaaaactaacttgccttcagaatttaaaatggtcc

SEQ ID NO: 181456 - DNA, 46 bp, Artificial Sequence
  Description of Artificial Sequence: Synthetic oligonucleotide
tcttctatcaccaaaactaacttgccttcagaatttaaaatggtcc

SEQ ID NO: 181457 - DNA, 45 bp, Artificial Sequence
  Description of Artificial Sequence: Synthetic oligonucleotide
cttctatcaccaaaactaacttgccttcagaatttaaaatggtcc

SEQ ID NO: 181458 - DNA, 46 bp, Artificial Sequence
  Description of Artificial Sequence: Synthetic oligonucleotide
ttctatcaccaaaactaacttgccttcagaatttaaaatggtccac

SEQ ID NO: 181459 - DNA, 35 bp, Artificial Sequence
  Description of Artificial Sequence: Synthetic oligonucleotide
tttgtgaaaattcctggcgagaaggactcagtgac

SEQ ID NO: 181460 - DNA, 34 bp, Artificial Sequence
  Description of Artificial Sequence: Synthetic oligonucleotide
ttgtgaaaattcctggcgagaaggactcagtgac

SEQ ID NO: 181461 - DNA, 33 bp, Artificial Sequence
  Description of Artificial Sequence: Synthetic oligonucleotide
tgtgaaaattcctggcgagaaggactcagtgac

SEQ ID NO: 181462 - DNA, 32 bp, Artificial Sequence
  Description of Artificial Sequence: Synthetic oligonucleotide
gtgaaaattcctggcgagaaggactcagtgac

SEQ ID NO: 181463 - DNA, 32 bp, Artificial Sequence
  Description of Artificial Sequence: Synthetic oligonucleotide
tgaaaattcctggcgagaaggactcagtgacc

SEQ ID NO: 181464 - DNA, 31 bp, Artificial Sequence
  Description of Artificial Sequence: Synthetic oligonucleotide
gaaaattcctggcgagaaggactcagtgacc

SEQ ID NO: 181465 - DNA, 32 bp, Artificial Sequence
  Description of Artificial Sequence: Synthetic oligonucleotide
aaaattcctggcgagaaggactcagtgacctg

SEQ ID NO: 181466 - DNA, 31 bp, Artificial Sequence
  Description of Artificial Sequence: Synthetic oligonucleotide
aaattcctggcgagaaggactcagtgacctg

SEQ ID NO: 181467 - DNA, 30 bp, Artificial Sequence
  Description of Artificial Sequence: Synthetic oligonucleotide
aattcctggcgagaaggactcagtgacctg

SEQ ID NO: 181468 - DNA, 29 bp, Artificial Sequence
  Description of Artificial Sequence: Synthetic oligonucleotide
attcctggcgagaaggactcagtgacctg

SEQ ID NO: 181469 - DNA, 28 bp, Artificial Sequence
  Description of Artificial Sequence: Synthetic oligonucleotide
ttcctggcgagaaggactcagtgacctg

SEQ ID NO: 181470 - DNA, 27 bp, Artificial Sequence
  Description of Artificial Sequence: Synthetic oligonucleotide
tcctggcgagaaggactcagtgacctg

SEQ ID NO: 181471 - DNA, 26 bp, Artificial Sequence
  Description of Artificial Sequence: Synthetic oligonucleotide
cctggcgagaaggactcagtgacctg

SEQ ID NO: 181472 - DNA, 26 bp, Artificial Sequence
  Description of Artificial Sequence: Synthetic oligonucleotide
ctggcgagaaggactcagtgacctgc

SEQ ID NO: 181473 - DNA, 27 bp, Artificial Sequence
  Description of Artificial Sequence: Synthetic oligonucleotide
tggcgagaaggactcagtgacctgcct

SEQ ID NO: 181474 - DNA, 27 bp, Artificial Sequence
  Description of Artificial Sequence: Synthetic oligonucleotide
ggcgagaaggactcagtgacctgcctt

SEQ ID NO: 181475 - DNA, 29 bp, Artificial Sequence
  Description of Artificial Sequence: Synthetic oligonucleotide
gcgagaaggactcagtgacctgccttaag

SEQ ID NO: 181476 - DNA, 29 bp, Artificial Sequence
  Description of Artificial Sequence: Synthetic oligonucleotide
cgagaaggactcagtgacctgccttaagg

SEQ ID NO: 181477 - DNA, 29 bp, Artificial Sequence
  Description of Artificial Sequence: Synthetic oligonucleotide
gagaaggactcagtgacctgccttaaggg

SEQ ID NO: 181478 - DNA, 29 bp, Artificial Sequence
  Description of Artificial Sequence: Synthetic oligonucleotide
agaaggactcagtgacctgccttaagggc

SEQ ID NO: 181479 - DNA, 28 bp, Artificial Sequence
  Description of Artificial Sequence: Synthetic oligonucleotide
gaaggactcagtgacctgccttaagggc

SEQ ID NO: 181480 - DNA, 30 bp, Artificial Sequence
  Description of Artificial Sequence: Synthetic oligonucleotide
aaggactcagtgacctgccttaagggcatg

SEQ ID NO: 181481 - DNA, 29 bp, Artificial Sequence
  Description of Artificial Sequence: Synthetic oligonucleotide
aggactcagtgacctgccttaagggcatg

SEQ ID NO: 181482 - DNA, 28 bp, Artificial Sequence
  Description of Artificial Sequence: Synthetic oligonucleotide
ggactcagtgacctgccttaagggcatg

SEQ ID NO: 181483 - DNA, 28 bp, Artificial Sequence
  Description of Artificial Sequence: Synthetic oligonucleotide
gactcagtgacctgccttaagggcatgc

SEQ ID NO: 181484 - DNA, 31 bp, Artificial Sequence
  Description of Artificial Sequence: Synthetic oligonucleotide
actcagtgacctgccttaagggcatgcaatg

SEQ ID NO: 181485 - DNA, 30 bp, Artificial Sequence
  Description of Artificial Sequence: Synthetic oligonucleotide
ctcagtgacctgccttaagggcatgcaatg

SEQ ID NO: 181486 - DNA, 30 bp, Artificial Sequence
  Description of Artificial Sequence: Synthetic oligonucleotide
tcagtgacctgccttaagggcatgcaatgg

SEQ ID NO: 181487 - DNA, 29 bp, Artificial Sequence
  Description of Artificial Sequence: Synthetic oligonucleotide
cagtgacctgccttaagggcatgcaatgg

SEQ ID NO: 181488 - DNA, 30 bp, Artificial Sequence
  Description of Artificial Sequence: Synthetic oligonucleotide
agtgacctgccttaagggcatgcaatggtc

SEQ ID NO: 181489 - DNA, 29 bp, Artificial Sequence
  Description of Artificial Sequence: Synthetic oligonucleotide
gtgacctgccttaagggcatgcaatggtc

SEQ ID NO: 181490 - DNA, 30 bp, Artificial Sequence
  Description of Artificial Sequence: Synthetic oligonucleotide
tgacctgccttaagggcatgcaatggtcag

SEQ ID NO: 181491 - DNA, 29 bp, Artificial Sequence
  Description of Artificial Sequence: Synthetic oligonucleotide
gacctgccttaagggcatgcaatggtcag

SEQ ID NO: 181492 - DNA, 34 bp, Artificial Sequence
  Description of Artificial Sequence: Synthetic oligonucleotide
acctgccttaagggcatgcaatggtcagatattg

SEQ ID NO: 181493 - DNA, 33 bp, Artificial Sequence
  Description of Artificial Sequence: Synthetic oligonucleotide
cctgccttaagggcatgcaatggtcagatattg

SEQ ID NO: 181494 - DNA, 35 bp, Artificial Sequence
  Description of Artificial Sequence: Synthetic oligonucleotide
ctgccttaagggcatgcaatggtcagatattgaag

SEQ ID NO: 181495 - DNA, 36 bp, Artificial Sequence
  Description of Artificial Sequence: Synthetic oligonucleotide
tgccttaagggcatgcaatggtcagatattgaagag

SEQ ID NO: 181496 - DNA, 35 bp, Artificial Sequence
  Description of Artificial Sequence: Synthetic oligonucleotide
gccttaagggcatgcaatggtcagatattgaagag

SEQ ID NO: 181497 - DNA, 37 bp, Artificial Sequence
  Description of Artificial Sequence: Synthetic oligonucleotide
ccttaagggcatgcaatggtcagatattgaagagttc

SEQ ID NO: 181498 - DNA, 38 bp, Artificial Sequence
  Description of Artificial Sequence: Synthetic oligonucleotide
cttaagggcatgcaatggtcagatattgaagagttctg

SEQ ID NO: 181499 - DNA, 38 bp, Artificial Sequence
  Description of Artificial Sequence: Synthetic oligonucleotide
ttaagggcatgcaatggtcagatattgaagagttctgc

SEQ ID NO: 181500 - DNA, 37 bp, Artificial Sequence
  Description of Artificial Sequence: Synthetic oligonucleotide
taagggcatgcaatggtcagatattgaagagttctgc

SEQ ID NO: 181501 - DNA, 36 bp, Artificial Sequence
  Description of Artificial Sequence: Synthetic oligonucleotide
aagggcatgcaatggtcagatattgaagagttctgc

SEQ ID NO: 181502 - DNA, 35 bp, Artificial Sequence
  Description of Artificial Sequence: Synthetic oligonucleotide
agggcatgcaatggtcagatattgaagagttctgc

SEQ ID NO: 181503 - DNA, 34 bp, Artificial Sequence
  Description of Artificial Sequence: Synthetic oligonucleotide
gggcatgcaatggtcagatattgaagagttctgc

SEQ ID NO: 181504 - DNA, 37 bp, Artificial Sequence
  Description of Artificial Sequence: Synthetic oligonucleotide
ggcatgcaatggtcagatattgaagagttctgcaatc

SEQ ID NO: 181505 - DNA, 37 bp, Artificial Sequence
  Description of Artificial Sequence: Synthetic oligonucleotide
gcatgcaatggtcagatattgaagagttctgcaatcg

SEQ ID NO: 181506 - DNA, 39 bp, Artificial Sequence
  Description of Artificial Sequence: Synthetic oligonucleotide
catgcaatggtcagatattgaagagttctgcaatcgtag

SEQ ID NO: 181507 - DNA, 39 bp, Artificial Sequence
  Description of Artificial Sequence: Synthetic oligonucleotide
atgcaatggtcagatattgaagagttctgcaatcgtagc

SEQ ID NO: 181508 - DNA, 38 bp, Artificial Sequence
  Description of Artificial Sequence: Synthetic oligonucleotide
tgcaatggtcagatattgaagagttctgcaatcgtagc

SEQ ID NO: 181509 - DNA, 37 bp, Artificial Sequence
  Description of Artificial Sequence: Synthetic oligonucleotide
gcaatggtcagatattgaagagttctgcaatcgtagc

SEQ ID NO: 181510 - DNA, 48 bp, Artificial Sequence
  Description of Artificial Sequence: Synthetic oligonucleotide
gtacaaattatttggcttgacttctagtttttgtcttatttcaggcag

SEQ ID NO: 181511 - DNA, 48 bp, Artificial Sequence
  Description of Artificial Sequence: Synthetic oligonucleotide
tacaaattatttggcttgacttctagtttttgtcttatttcaggcagc

SEQ ID NO: 181512 - DNA, 37 bp, Artificial Sequence
  Description of Artificial Sequence: Synthetic oligonucleotide
atgtaccaggtggcatattatttggtgcaaccatcac

SEQ ID NO: 181513 - DNA, 36 bp, Artificial Sequence
  Description of Artificial Sequence: Synthetic oligonucleotide
tgtaccaggtggcatattatttggtgcaaccatcac

SEQ ID NO: 181514 - DNA, 35 bp, Artificial Sequence
  Description of Artificial Sequence: Synthetic oligonucleotide
gtaccaggtggcatattatttggtgcaaccatcac

SEQ ID NO: 181515 - DNA, 35 bp, Artificial Sequence
  Description of Artificial Sequence: Synthetic oligonucleotide
taccaggtggcatattatttggtgcaaccatcacc

SEQ ID NO: 181516 - DNA, 34 bp, Artificial Sequence
  Description of Artificial Sequence: Synthetic oligonucleotide
accaggtggcatattatttggtgcaaccatcacc

SEQ ID NO: 181517 - DNA, 33 bp, Artificial Sequence
  Description of Artificial Sequence: Synthetic oligonucleotide
ccaggtggcatattatttggtgcaaccatcacc

SEQ ID NO: 181518 - DNA, 35 bp, Artificial Sequence
  Description of Artificial Sequence: Synthetic oligonucleotide
caggtggcatattatttggtgcaaccatcaccttc

SEQ ID NO: 181519 - DNA, 36 bp, Artificial Sequence
  Description of Artificial Sequence: Synthetic oligonucleotide
aggtggcatattatttggtgcaaccatcaccttctc

SEQ ID NO: 181520 - DNA, 35 bp, Artificial Sequence
  Description of Artificial Sequence: Synthetic oligonucleotide
ggtggcatattatttggtgcaaccatcaccttctc

SEQ ID NO: 181521 - DNA, 37 bp, Artificial Sequence
  Description of Artificial Sequence: Synthetic oligonucleotide
gtggcatattatttggtgcaaccatcaccttctcatg

SEQ ID NO: 181522 - DNA, 40 bp, Artificial Sequence
  Description of Artificial Sequence: Synthetic oligonucleotide
tggcatattatttggtgcaaccatcaccttctcatgtaac

SEQ ID NO: 181523 - DNA, 39 bp, Artificial Sequence
  Description of Artificial Sequence: Synthetic oligonucleotide
ggcatattatttggtgcaaccatcaccttctcatgtaac

SEQ ID NO: 181524 - DNA, 40 bp, Artificial Sequence
  Description of Artificial Sequence: Synthetic oligonucleotide
gcatattatttggtgcaaccatcaccttctcatgtaacac

SEQ ID NO: 181525 - DNA, 41 bp, Artificial Sequence
  Description of Artificial Sequence: Synthetic oligonucleotide
catattatttggtgcaaccatcaccttctcatgtaacacag

SEQ ID NO: 181526 - DNA, 41 bp, Artificial Sequence
  Description of Artificial Sequence: Synthetic oligonucleotide
atattatttggtgcaaccatcaccttctcatgtaacacagg

SEQ ID NO: 181527 - DNA, 40 bp, Artificial Sequence
  Description of Artificial Sequence: Synthetic oligonucleotide
tattatttggtgcaaccatcaccttctcatgtaacacagg

SEQ ID NO: 181528 - DNA, 39 bp, Artificial Sequence
  Description of Artificial Sequence: Synthetic oligonucleotide
attatttggtgcaaccatcaccttctcatgtaacacagg

SEQ ID NO: 181529 - DNA, 38 bp, Artificial Sequence
  Description of Artificial Sequence: Synthetic oligonucleotide
ttatttggtgcaaccatcaccttctcatgtaacacagg

SEQ ID NO: 181530 - DNA, 37 bp, Artificial Sequence
  Description of Artificial Sequence: Synthetic oligonucleotide
tatttggtgcaaccatcaccttctcatgtaacacagg

SEQ ID NO: 181531 - DNA, 36 bp, Artificial Sequence
  Description of Artificial Sequence: Synthetic oligonucleotide
atttggtgcaaccatcaccttctcatgtaacacagg

SEQ ID NO: 181532 - DNA, 35 bp, Artificial Sequence
  Description of Artificial Sequence: Synthetic oligonucleotide
tttggtgcaaccatcaccttctcatgtaacacagg

SEQ ID NO: 181533 - DNA, 34 bp, Artificial Sequence
  Description of Artificial Sequence: Synthetic oligonucleotide
ttggtgcaaccatcaccttctcatgtaacacagg

SEQ ID NO: 181534 - DNA, 33 bp, Artificial Sequence
  Description of Artificial Sequence: Synthetic oligonucleotide
tggtgcaaccatcaccttctcatgtaacacagg

SEQ ID NO: 181535 - DNA, 32 bp, Artificial Sequence
  Description of Artificial Sequence: Synthetic oligonucleotide
ggtgcaaccatcaccttctcatgtaacacagg

SEQ ID NO: 181536 - DNA, 32 bp, Artificial Sequence
  Description of Artificial Sequence: Synthetic oligonucleotide
gtgcaaccatcaccttctcatgtaacacaggg

SEQ ID NO: 181537 - DNA, 34 bp, Artificial Sequence
  Description of Artificial Sequence: Synthetic oligonucleotide
tgcaaccatcaccttctcatgtaacacagggtac

SEQ ID NO: 181538 - DNA, 33 bp, Artificial Sequence
  Description of Artificial Sequence: Synthetic oligonucleotide
gcaaccatcaccttctcatgtaacacagggtac

SEQ ID NO: 181539 - DNA, 38 bp, Artificial Sequence
  Description of Artificial Sequence: Synthetic oligonucleotide
caaccatcaccttctcatgtaacacagggtacaaattg

SEQ ID NO: 181540 - DNA, 41 bp, Artificial Sequence
  Description of Artificial Sequence: Synthetic oligonucleotide
aaccatcaccttctcatgtaacacagggtacaaattgtttg

SEQ ID NO: 181541 - DNA, 40 bp, Artificial Sequence
  Description of Artificial Sequence: Synthetic oligonucleotide
accatcaccttctcatgtaacacagggtacaaattgtttg

SEQ ID NO: 181542 - DNA, 39 bp, Artificial Sequence
  Description of Artificial Sequence: Synthetic oligonucleotide
ccatcaccttctcatgtaacacagggtacaaattgtttg

SEQ ID NO: 181543 - DNA, 39 bp, Artificial Sequence
  Description of Artificial Sequence: Synthetic oligonucleotide
catcaccttctcatgtaacacagggtacaaattgtttgg

SEQ ID NO: 181544 - DNA, 39 bp, Artificial Sequence
  Description of Artificial Sequence: Synthetic oligonucleotide
atcaccttctcatgtaacacagggtacaaattgtttggc

SEQ ID NO: 181545 - DNA, 38 bp, Artificial Sequence
  Description of Artificial Sequence: Synthetic oligonucleotide
tcaccttctcatgtaacacagggtacaaattgtttggc

SEQ ID NO: 181546 - DNA, 37 bp, Artificial Sequence
  Description of Artificial Sequence: Synthetic oligonucleotide
caccttctcatgtaacacagggtacaaattgtttggc

SEQ ID NO: 181547 - DNA, 38 bp, Artificial Sequence
  Description of Artificial Sequence: Synthetic oligonucleotide
accttctcatgtaacacagggtacaaattgtttggctc

SEQ ID NO: 181548 - DNA, 37 bp, Artificial Sequence
  Description of Artificial Sequence: Synthetic oligonucleotide
ccttctcatgtaacacagggtacaaattgtttggctc

SEQ ID NO: 181549 - DNA, 37 bp, Artificial Sequence
  Description of Artificial Sequence: Synthetic oligonucleotide
cttctcatgtaacacagggtacaaattgtttggctcg

SEQ ID NO: 181550 - DNA, 38 bp, Artificial Sequence
  Description of Artificial Sequence: Synthetic oligonucleotide
ttctcatgtaacacagggtacaaattgtttggctcgac

SEQ ID NO: 181551 - DNA, 37 bp, Artificial Sequence
  Description of Artificial Sequence: Synthetic oligonucleotide
tctcatgtaacacagggtacaaattgtttggctcgac

SEQ ID NO: 181552 - DNA, 36 bp, Artificial Sequence
  Description of Artificial Sequence: Synthetic oligonucleotide
ctcatgtaacacagggtacaaattgtttggctcgac

SEQ ID NO: 181553 - DNA, 38 bp, Artificial Sequence
  Description of Artificial Sequence: Synthetic oligonucleotide
tcatgtaacacagggtacaaattgtttggctcgacttc

SEQ ID NO: 181554 - DNA, 37 bp, Artificial Sequence
  Description of Artificial Sequence: Synthetic oligonucleotide
catgtaacacagggtacaaattgtttggctcgacttc

SEQ ID NO: 181555 - DNA, 39 bp, Artificial Sequence
  Description of Artificial Sequence: Synthetic oligonucleotide
atgtaacacagggtacaaattgtttggctcgacttctag

SEQ ID NO: 181556 - DNA, 38 bp, Artificial Sequence
  Description of Artificial Sequence: Synthetic oligonucleotide
tgtaacacagggtacaaattgtttggctcgacttctag

SEQ ID NO: 181557 - DNA, 37 bp, Artificial Sequence
  Description of Artificial Sequence: Synthetic oligonucleotide
gtaacacagggtacaaattgtttggctcgacttctag

SEQ ID NO: 181558 - DNA, 42 bp, Artificial Sequence
  Description of Artificial Sequence: Synthetic oligonucleotide
taacacagggtacaaattgtttggctcgacttctagtttttg

SEQ ID NO: 181559 - DNA, 41 bp, Artificial Sequence
  Description of Artificial Sequence: Synthetic oligonucleotide
aacacagggtacaaattgtttggctcgacttctagtttttg

SEQ ID NO: 181560 - DNA, 40 bp, Artificial Sequence
  Description of Artificial Sequence: Synthetic oligonucleotide
acacagggtacaaattgtttggctcgacttctagtttttg

SEQ ID NO: 181561 - DNA, 39 bp, Artificial Sequence
  Description of Artificial Sequence: Synthetic oligonucleotide
cacagggtacaaattgtttggctcgacttctagtttttg

SEQ ID NO: 181562 - DNA, 40 bp, Artificial Sequence
  Description of Artificial Sequence: Synthetic oligonucleotide
acagggtacaaattgtttggctcgacttctagtttttgtc

SEQ ID NO: 181563 - DNA, 39 bp, Artificial Sequence
  Description of Artificial Sequence: Synthetic oligonucleotide
cagggtacaaattgtttggctcgacttctagtttttgtc

SEQ ID NO: 181564 - DNA, 45 bp, Artificial Sequence
  Description of Artificial Sequence: Synthetic oligonucleotide
agggtacaaattgtttggctcgacttctagtttttgtcttatttc

SEQ ID NO: 181565 - DNA, 44 bp, Artificial Sequence
  Description of Artificial Sequence: Synthetic oligonucleotide
gggtacaaattgtttggctcgacttctagtttttgtcttatttc

SEQ ID NO: 181566 - DNA, 45 bp, Artificial Sequence
  Description of Artificial Sequence: Synthetic oligonucleotide
ggtacaaattgtttggctcgacttctagtttttgtcttatttcag

SEQ ID NO: 181567 - DNA, 45 bp, Artificial Sequence
  Description of Artificial Sequence: Synthetic oligonucleotide
gtacaaattgtttggctcgacttctagtttttgtcttatttcagg

SEQ ID NO: 181568 - DNA, 45 bp, Artificial Sequence
  Description of Artificial Sequence: Synthetic oligonucleotide
tacaaattgtttggctcgacttctagtttttgtcttatttcaggc

SEQ ID NO: 181569 - DNA, 44 bp, Artificial Sequence
  Description of Artificial Sequence: Synthetic oligonucleotide
acaaattgtttggctcgacttctagtttttgtcttatttcaggc

SEQ ID NO: 181570 - DNA, 43 bp, Artificial Sequence
  Description of Artificial Sequence: Synthetic oligonucleotide
caaattgtttggctcgacttctagtttttgtcttatttcaggc

SEQ ID NO: 181571 - DNA, 44 bp, Artificial Sequence
  Description of Artificial Sequence: Synthetic oligonucleotide
aaattgtttggctcgacttctagtttttgtcttatttcaggcag

SEQ ID NO: 181572 - DNA, 43 bp, Artificial Sequence
  Description of Artificial Sequence: Synthetic oligonucleotide
aattgtttggctcgacttctagtttttgtcttatttcaggcag

SEQ ID NO: 181573 - DNA, 42 bp, Artificial Sequence
  Description of Artificial Sequence: Synthetic oligonucleotide
attgtttggctcgacttctagtttttgtcttatttcaggcag

SEQ ID NO: 181574 - DNA, 41 bp, Artificial Sequence
  Description of Artificial Sequence: Synthetic oligonucleotide
ttgtttggctcgacttctagtttttgtcttatttcaggcag

SEQ ID NO: 181575 - DNA, 40 bp, Artificial Sequence
  Description of Artificial Sequence: Synthetic oligonucleotide
tgtttggctcgacttctagtttttgtcttatttcaggcag

SEQ ID NO: 181576 - DNA, 39 bp, Artificial Sequence
  Description of Artificial Sequence: Synthetic oligonucleotide
gtttggctcgacttctagtttttgtcttatttcaggcag

SEQ ID NO: 181577 - DNA, 37 bp, Artificial Sequence
  Description of Artificial Sequence: Synthetic oligonucleotide
aaaatctctaacttccaaggtcccaccaacagttcac

SEQ ID NO: 181578 - DNA, 36 bp, Artificial Sequence
  Description of Artificial Sequence: Synthetic oligonucleotide
aaatctctaacttccaaggtcccaccaacagttcac

SEQ ID NO: 181579 - DNA, 35 bp, Artificial Sequence
  Description of Artificial Sequence: Synthetic oligonucleotide
aatctctaacttccaaggtcccaccaacagttcac

SEQ ID NO: 181580 - DNA, 34 bp, Artificial Sequence
  Description of Artificial Sequence: Synthetic oligonucleotide
atctctaacttccaaggtcccaccaacagttcac

SEQ ID NO: 181581 - DNA, 33 bp, Artificial Sequence
  Description of Artificial Sequence: Synthetic oligonucleotide
tctctaacttccaaggtcccaccaacagttcac

SEQ ID NO: 181582 - DNA, 32 bp, Artificial Sequence
  Description of Artificial Sequence: Synthetic oligonucleotide
ctctaacttccaaggtcccaccaacagttcac

SEQ ID NO: 181583 - DNA, 35 bp, Artificial Sequence
  Description of Artificial Sequence: Synthetic oligonucleotide
tctaacttccaaggtcccaccaacagttcacaaac

SEQ ID NO: 181584 - DNA, 34 bp, Artificial Sequence
  Description of Artificial Sequence: Synthetic oligonucleotide
ctaacttccaaggtcccaccaacagttcacaaac

SEQ ID NO: 181585 - DNA, 34 bp, Artificial Sequence
  Description of Artificial Sequence: Synthetic oligonucleotide
taacttccaaggtcccaccaacagttcacaaacc

SEQ ID NO: 181586 - DNA, 33 bp, Artificial Sequence
  Description of Artificial Sequence: Synthetic oligonucleotide
aacttccaaggtcccaccaacagttcacaaacc

SEQ ID NO: 181587 - DNA, 32 bp, Artificial Sequence
  Description of Artificial Sequence: Synthetic oligonucleotide
acttccaaggtcccaccaacagttcacaaacc

SEQ ID NO: 181588 - DNA, 31 bp, Artificial Sequence
  Description of Artificial Sequence: Synthetic oligonucleotide
cttccaaggtcccaccaacagttcacaaacc

SEQ ID NO: 181589 - DNA, 33 bp, Artificial Sequence
  Description of Artificial Sequence: Synthetic oligonucleotide
ttccaaggtcccaccaacagttcacaaacctac

SEQ ID NO: 181590 - DNA, 32 bp, Artificial Sequence
  Description of Artificial Sequence: Synthetic oligonucleotide
tccaaggtcccaccaacagttcacaaacctac

SEQ ID NO: 181591 - DNA, 31 bp, Artificial Sequence
  Description of Artificial Sequence: Synthetic oligonucleotide
ccaaggtcccaccaacagttcacaaacctac

SEQ ID NO: 181592 - DNA, 31 bp, Artificial Sequence
  Description of Artificial Sequence: Synthetic oligonucleotide
caaggtcccaccaacagttcacaaacctacc

SEQ ID NO: 181593 - DNA, 32 bp, Artificial Sequence
  Description of Artificial Sequence: Synthetic oligonucleotide
aaggtcccaccaacagttcacaaacctaccac

SEQ ID NO: 181594 - DNA, 31 bp, Artificial Sequence
  Description of Artificial Sequence: Synthetic oligonucleotide
aggtcccaccaacagttcacaaacctaccac

SEQ ID NO: 181595 - DNA, 30 bp, Artificial Sequence
  Description of Artificial Sequence: Synthetic oligonucleotide
ggtcccaccaacagttcacaaacctaccac

SEQ ID NO: 181596 - DNA, 31 bp, Artificial Sequence
  Description of Artificial Sequence: Synthetic oligonucleotide
gtcccaccaacagttcacaaacctaccacag

SEQ ID NO: 181597 - DNA, 36 bp, Artificial Sequence
  Description of Artificial Sequence: Synthetic oligonucleotide
tcccaccaacagttcacaaacctaccacagtaaatg

SEQ ID NO: 181598 - DNA, 35 bp, Artificial Sequence
  Description of Artificial Sequence: Synthetic oligonucleotide
cccaccaacagttcacaaacctaccacagtaaatg

SEQ ID NO: 181599 - DNA, 37 bp, Artificial Sequence
  Description of Artificial Sequence: Synthetic oligonucleotide
ccaccaacagttcacaaacctaccacagtaaatgttc

SEQ ID NO: 181600 - DNA, 37 bp, Artificial Sequence
  Description of Artificial Sequence: Synthetic oligonucleotide
caccaacagttcacaaacctaccacagtaaatgttcc

SEQ ID NO: 181601 - DNA, 39 bp, Artificial Sequence
  Description of Artificial Sequence: Synthetic oligonucleotide
accaacagttcacaaacctaccacagtaaatgttccaac

SEQ ID NO: 181602 - DNA, 38 bp, Artificial Sequence
  Description of Artificial Sequence: Synthetic oligonucleotide
ccaacagttcacaaacctaccacagtaaatgttccaac

SEQ ID NO: 181603 - DNA, 40 bp, Artificial Sequence
  Description of Artificial Sequence: Synthetic oligonucleotide
caacagttcacaaacctaccacagtaaatgttccaactac

SEQ ID NO: 181604 - DNA, 41 bp, Artificial Sequence
  Description of Artificial Sequence: Synthetic oligonucleotide
aacagttcacaaacctaccacagtaaatgttccaactacag

SEQ ID NO: 181605 - DNA, 40 bp, Artificial Sequence
  Description of Artificial Sequence: Synthetic oligonucleotide
acagttcacaaacctaccacagtaaatgttccaactacag

SEQ ID NO: 181606 - DNA, 39 bp, Artificial Sequence
  Description of Artificial Sequence: Synthetic oligonucleotide
cagttcacaaacctaccacagtaaatgttccaactacag

SEQ ID NO: 181607 - DNA, 41 bp, Artificial Sequence
  Description of Artificial Sequence: Synthetic oligonucleotide
agttcacaaacctaccacagtaaatgttccaactacagaag

SEQ ID NO: 181608 - DNA, 40 bp, Artificial Sequence
  Description of Artificial Sequence: Synthetic oligonucleotide
gttcacaaacctaccacagtaaatgttccaactacagaag

SEQ ID NO: 181609 - DNA, 41 bp, Artificial Sequence
  Description of Artificial Sequence: Synthetic oligonucleotide
ttcacaaacctaccacagtaaatgttccaactacagaagtc

SEQ ID NO: 181610 - DNA, 40 bp, Artificial Sequence
  Description of Artificial Sequence: Synthetic oligonucleotide
tcacaaacctaccacagtaaatgttccaactacagaagtc

SEQ ID NO: 181611 - DNA, 39 bp, Artificial Sequence
  Description of Artificial Sequence: Synthetic oligonucleotide
cacaaacctaccacagtaaatgttccaactacagaagtc

SEQ ID NO: 181612 - DNA, 40 bp, Artificial Sequence
  Description of Artificial Sequence: Synthetic oligonucleotide
acaaacctaccacagtaaatgttccaactacagaagtctc

SEQ ID NO: 181613 - DNA, 39 bp, Artificial Sequence
  Description of Artificial Sequence: Synthetic oligonucleotide
caaacctaccacagtaaatgttccaactacagaagtctc

SEQ ID NO: 181614 - DNA, 36 bp, Artificial Sequence
  Description of Artificial Sequence: Synthetic oligonucleotide
atggaggagctgcaggatgattatgaagacatgatg

SEQ ID NO: 181615 - DNA, 35 bp, Artificial Sequence
  Description of Artificial Sequence: Synthetic oligonucleotide
tggaggagctgcaggatgattatgaagacatgatg

SEQ ID NO: 181616 - DNA, 34 bp, Artificial Sequence
  Description of Artificial Sequence: Synthetic oligonucleotide
ggaggagctgcaggatgattatgaagacatgatg

SEQ ID NO: 181617 - DNA, 34 bp, Artificial Sequence
  Description of Artificial Sequence: Synthetic oligonucleotide
gaggagctgcaggatgattatgaagacatgatgg

SEQ ID NO: 181618 - DNA, 35 bp, Artificial Sequence
  Description of Artificial Sequence: Synthetic oligonucleotide
aggagctgcaggatgattatgaagacatgatggag

SEQ ID NO: 181619 - DNA, 34 bp, Artificial Sequence
  Description of Artificial Sequence: Synthetic oligonucleotide
ggagctgcaggatgattatgaagacatgatggag

SEQ ID NO: 181620 - DNA, 34 bp, Artificial Sequence
  Description of Artificial Sequence: Synthetic oligonucleotide
gagctgcaggatgattatgaagacatgatggagg

SEQ ID NO: 181621 - DNA, 35 bp, Artificial Sequence
  Description of Artificial Sequence: Synthetic oligonucleotide
agctgcaggatgattatgaagacatgatggaggag

SEQ ID NO: 181622 - DNA, 34 bp, Artificial Sequence
  Description of Artificial Sequence: Synthetic oligonucleotide
gctgcaggatgattatgaagacatgatggaggag

SEQ ID NO: 181623 - DNA, 37 bp, Artificial Sequence
  Description of Artificial Sequence: Synthetic oligonucleotide
ctgcaggatgattatgaagacatgatggaggagaatc

SEQ ID NO: 181624 - DNA, 38 bp, Artificial Sequence
  Description of Artificial Sequence: Synthetic oligonucleotide
tgcaggatgattatgaagacatgatggaggagaatctg

SEQ ID NO: 181625 - DNA, 37 bp, Artificial Sequence
  Description of Artificial Sequence: Synthetic oligonucleotide
gcaggatgattatgaagacatgatggaggagaatctg

SEQ ID NO: 181626 - DNA, 37 bp, Artificial Sequence
  Description of Artificial Sequence: Synthetic oligonucleotide
caggatgattatgaagacatgatggaggagaatctgg

SEQ ID NO: 181627 - DNA, 38 bp, Artificial Sequence
  Description of Artificial Sequence: Synthetic oligonucleotide
aggatgattatgaagacatgatggaggagaatctggag

SEQ ID NO: 181628 - DNA, 37 bp, Artificial Sequence
  Description of Artificial Sequence: Synthetic oligonucleotide
ggatgattatgaagacatgatggaggagaatctggag

SEQ ID NO: 181629 - DNA, 37 bp, Artificial Sequence
  Description of Artificial Sequence: Synthetic oligonucleotide
gatgattatgaagacatgatggaggagaatctggagc

SEQ ID NO: 181630 - DNA, 38 bp, Artificial Sequence
  Description of Artificial Sequence: Synthetic oligonucleotide
atgattatgaagacatgatggaggagaatctggagcag

SEQ ID NO: 181631 - DNA, 37 bp, Artificial Sequence
  Description of Artificial Sequence: Synthetic oligonucleotide
tgattatgaagacatgatggaggagaatctggagcag

SEQ ID NO: 181632 - DNA, 36 bp, Artificial Sequence
  Description of Artificial Sequence: Synthetic oligonucleotide
gattatgaagacatgatggaggagaatctggagcag

SEQ ID NO: 181633 - DNA, 36 bp, Artificial Sequence
  Description of Artificial Sequence: Synthetic oligonucleotide
attatgaagacatgatggaggagaatctggagcagg

SEQ ID NO: 181634 - DNA, 35 bp, Artificial Sequence
  Description of Artificial Sequence: Synthetic oligonucleotide
ttatgaagacatgatggaggagaatctggagcagg

SEQ ID NO: 181635 - DNA, 34 bp, Artificial Sequence
  Description of Artificial Sequence: Synthetic oligonucleotide
tatgaagacatgatggaggagaatctggagcagg

SEQ ID NO: 181636 - DNA, 33 bp, Artificial Sequence
  Description of Artificial Sequence: Synthetic oligonucleotide
atgaagacatgatggaggagaatctggagcagg

SEQ ID NO: 181637 - DNA, 32 bp, Artificial Sequence
  Description of Artificial Sequence: Synthetic oligonucleotide
tgaagacatgatggaggagaatctggagcagg

SEQ ID NO: 181638 - DNA, 31 bp, Artificial Sequence
  Description of Artificial Sequence: Synthetic oligonucleotide
gaagacatgatggaggagaatctggagcagg

SEQ ID NO: 181639 - DNA, 32 bp, Artificial Sequence
  Description of Artificial Sequence: Synthetic oligonucleotide
aagacatgatggaggagaatctggagcaggag

SEQ ID NO: 181640 - DNA, 31 bp, Artificial Sequence
  Description of Artificial Sequence: Synthetic oligonucleotide
agacatgatggaggagaatctggagcaggag

SEQ ID NO: 181641 - DNA, 30 bp, Artificial Sequence
  Description of Artificial Sequence: Synthetic oligonucleotide
gacatgatggaggagaatctggagcaggag

SEQ ID NO: 181642 - DNA, 30 bp, Artificial Sequence
  Description of Artificial Sequence: Synthetic oligonucleotide
acatgatggaggagaatctggagcaggagg

SEQ ID NO: 181643 - DNA, 29 bp, Artificial Sequence
  Description of Artificial Sequence: Synthetic oligonucleotide
catgatggaggagaatctggagcaggagg

SEQ ID NO: 181644 - DNA, 34 bp, Artificial Sequence
  Description of Artificial Sequence: Synthetic oligonucleotide
atgatggaggagaatctggagcaggaggaatatg

SEQ ID NO: 181645 - DNA, 33 bp, Artificial Sequence
  Description of Artificial Sequence: Synthetic oligonucleotide
tgatggaggagaatctggagcaggaggaatatg

SEQ ID NO: 181646 - DNA, 32 bp, Artificial Sequence
  Description of Artificial Sequence: Synthetic oligonucleotide
gatggaggagaatctggagcaggaggaatatg

SEQ ID NO: 181647 - DNA, 34 bp, Artificial Sequence
  Description of Artificial Sequence: Synthetic oligonucleotide
atggaggagaatctggagcaggaggaatatgaag

SEQ ID NO: 181648 - DNA, 33 bp, Artificial Sequence
  Description of Artificial Sequence: Synthetic oligonucleotide
tggaggagaatctggagcaggaggaatatgaag

SEQ ID NO: 181649 - DNA, 32 bp, Artificial Sequence
  Description of Artificial Sequence: Synthetic oligonucleotide
ggaggagaatctggagcaggaggaatatgaag

SEQ ID NO: 181650 - DNA, 33 bp, Artificial Sequence
  Description of Artificial Sequence: Synthetic oligonucleotide
gaggagaatctggagcaggaggaatatgaagac

SEQ ID NO: 181651 - DNA, 33 bp, Artificial Sequence
  Description of Artificial Sequence: Synthetic oligonucleotide
aggagaatctggagcaggaggaatatgaagacc

SEQ ID NO: 181652 - DNA, 32 bp, Artificial Sequence
  Description of Artificial Sequence: Synthetic oligonucleotide
ggagaatctggagcaggaggaatatgaagacc

SEQ ID NO: 181653 - DNA, 32 bp, Artificial Sequence
  Description of Artificial Sequence: Synthetic oligonucleotide
gagaatctggagcaggaggaatatgaagaccc

SEQ ID NO: 181654 - DNA, 33 bp, Artificial Sequence
  Description of Artificial Sequence: Synthetic oligonucleotide
agaatctggagcaggaggaatatgaagacccag

SEQ ID NO: 181655 - DNA, 32 bp, Artificial Sequence
  Description of Artificial Sequence: Synthetic oligonucleotide
gaatctggagcaggaggaatatgaagacccag

SEQ ID NO: 181656 - DNA, 33 bp, Artificial Sequence
  Description of Artificial Sequence: Synthetic oligonucleotide
aatctggagcaggaggaatatgaagacccagac

SEQ ID NO: 181657 - DNA, 32 bp, Artificial Sequence
  Description of Artificial Sequence: Synthetic oligonucleotide
atctggagcaggaggaatatgaagacccagac

SEQ ID NO: 181658 - DNA, 31 bp, Artificial Sequence
  Description of Artificial Sequence: Synthetic oligonucleotide
tctggagcaggaggaatatgaagacccagac

SEQ ID NO: 181659 - DNA, 30 bp, Artificial Sequence
  Description of Artificial Sequence: Synthetic oligonucleotide
ctggagcaggaggaatatgaagacccagac

SEQ ID NO: 181660 - DNA, 32 bp, Artificial Sequence
  Description of Artificial Sequence: Synthetic oligonucleotide
tggagcaggaggaatatgaagacccagacatc

SEQ ID NO: 181661 - DNA, 31 bp, Artificial Sequence
  Description of Artificial Sequence: Synthetic oligonucleotide
ggagcaggaggaatatgaagacccagacatc

SEQ ID NO: 181662 - DNA, 31 bp, Artificial Sequence
  Description of Artificial Sequence: Synthetic oligonucleotide
gagcaggaggaatatgaagacccagacatcc

SEQ ID NO: 181663 - DNA, 31 bp, Artificial Sequence
  Description of Artificial Sequence: Synthetic oligonucleotide
agcaggaggaatatgaagacccagacatccc

SEQ ID NO: 181664 - DNA, 30 bp, Artificial Sequence
  Description of Artificial Sequence: Synthetic oligonucleotide
gcaggaggaatatgaagacccagacatccc

SEQ ID NO: 181665 - DNA, 30 bp, Artificial Sequence
  Description of Artificial Sequence: Synthetic oligonucleotide
caggaggaatatgaagacccagacatcccc

SEQ ID NO: 181666 - DNA, 30 bp, Artificial Sequence
  Description of Artificial Sequence: Synthetic oligonucleotide
aggaggaatatgaagacccagacatccccg

SEQ ID NO: 181667 - DNA, 29 bp, Artificial Sequence
  Description of Artificial Sequence: Synthetic oligonucleotide
ggaggaatatgaagacccagacatccccg

SEQ ID NO: 181668 - DNA, 30 bp, Artificial Sequence
  Description of Artificial Sequence: Synthetic oligonucleotide
gaggaatatgaagacccagacatccccgag

SEQ ID NO: 181669 - DNA, 31 bp, Artificial Sequence
  Description of Artificial Sequence: Synthetic oligonucleotide
aggaatatgaagacccagacatccccgagtc

SEQ ID NO: 181670 - DNA, 30 bp, Artificial Sequence
  Description of Artificial Sequence: Synthetic oligonucleotide
ggaatatgaagacccagacatccccgagtc

SEQ ID NO: 181671 - DNA, 30 bp, Artificial Sequence
  Description of Artificial Sequence: Synthetic oligonucleotide
gaatatgaagacccagacatccccgagtcc

SEQ ID NO: 181672 - DNA, 30 bp, Artificial Sequence
  Description of Artificial Sequence: Synthetic oligonucleotide
aatatgaagacccagacatccccgagtccc

SEQ ID NO: 181673 - DNA, 29 bp, Artificial Sequence
  Description of Artificial Sequence: Synthetic oligonucleotide
atatgaagacccagacatccccgagtccc

SEQ ID NO: 181674 - DNA, 28 bp, Artificial Sequence
  Description of Artificial Sequence: Synthetic oligonucleotide
tatgaagacccagacatccccgagtccc

SEQ ID NO: 181675 - DNA, 27 bp, Artificial Sequence
  Description of Artificial Sequence: Synthetic oligonucleotide
atgaagacccagacatccccgagtccc

SEQ ID NO: 181676 - DNA, 27 bp, Artificial Sequence
  Description of Artificial Sequence: Synthetic oligonucleotide
tgaagacccagacatccccgagtccca

SEQ ID NO: 181677 - DNA, 26 bp, Artificial Sequence
  Description of Artificial Sequence: Synthetic oligonucleotide
gaagacccagacatccccgagtccca

SEQ ID NO: 181678 - DNA, 27 bp, Artificial Sequence
  Description of Artificial Sequence: Synthetic oligonucleotide
aagacccagacatccccgagtcccaga

SEQ ID NO: 181679 - DNA, 27 bp, Artificial Sequence
  Description of Artificial Sequence: Synthetic oligonucleotide
agacccagacatccccgagtcccagat

SEQ ID NO: 181680 - DNA, 26 bp, Artificial Sequence
  Description of Artificial Sequence: Synthetic oligonucleotide
gacccagacatccccgagtcccagat

SEQ ID NO: 181681 - DNA, 26 bp, Artificial Sequence
  Description of Artificial Sequence: Synthetic oligonucleotide
acccagacatccccgagtcccagatg

SEQ ID NO: 181682 - DNA, 25 bp, Artificial Sequence
  Description of Artificial Sequence: Synthetic oligonucleotide
cccagacatccccgagtcccagatg

SEQ ID NO: 181683 - DNA, 26 bp, Artificial Sequence
  Description of Artificial Sequence: Synthetic oligonucleotide
ccagacatccccgagtcccagatgga

SEQ ID NO: 181684 - DNA, 26 bp, Artificial Sequence
  Description of Artificial Sequence: Synthetic oligonucleotide
cagacatccccgagtcccagatggag

SEQ ID NO: 181685 - DNA, 27 bp, Artificial Sequence
  Description of Artificial Sequence: Synthetic oligonucleotide
agacatccccgagtcccagatggagga

SEQ ID NO: 181686 - DNA, 26 bp, Artificial Sequence
  Description of Artificial Sequence: Synthetic oligonucleotide
gacatccccgagtcccagatggagga

SEQ ID NO: 181687 - DNA, 26 bp, Artificial Sequence
  Description of Artificial Sequence: Synthetic oligonucleotide
acatccccgagtcccagatggaggag

SEQ ID NO: 181688 - DNA, 25 bp, Artificial Sequence
  Description of Artificial Sequence: Synthetic oligonucleotide
catccccgagtcccagatggaggag

SEQ ID NO: 181689 - DNA, 25 bp, Artificial Sequence
  Description of Artificial Sequence: Synthetic oligonucleotide
atccccgagtcccagatggaggagc

SEQ ID NO: 181690 - DNA, 24 bp, Artificial Sequence
  Description of Artificial Sequence: Synthetic oligonucleotide
tccccgagtcccagatggaggagc

SEQ ID NO: 181691 - DNA, 23 bp, Artificial Sequence
  Description of Artificial Sequence: Synthetic oligonucleotide
ccccgagtcccagatggaggagc

SEQ ID NO: 181692 - DNA, 23 bp, Artificial Sequence
  Description of Artificial Sequence: Synthetic oligonucleotide
cccgagtcccagatggaggagcc

SEQ ID NO: 181693 - DNA, 23 bp, Artificial Sequence
  Description of Artificial Sequence: Synthetic oligonucleotide
ccgagtcccagatggaggagccg

SEQ ID NO: 181694 - DNA, 23 bp, Artificial Sequence
  Description of Artificial Sequence: Synthetic oligonucleotide
cgagtcccagatggaggagccgg

SEQ ID NO: 181695 - DNA, 24 bp, Artificial Sequence
  Description of Artificial Sequence: Synthetic oligonucleotide
gagtcccagatggaggagccggca

SEQ ID NO: 181696 - DNA, 24 bp, Artificial Sequence
  Description of Artificial Sequence: Synthetic oligonucleotide
agtcccagatggaggagccggcag

SEQ ID NO: 181697 - DNA, 23 bp, Artificial Sequence
  Description of Artificial Sequence: Synthetic oligonucleotide
gtcccagatggaggagccggcag

SEQ ID NO: 181698 - DNA, 24 bp, Artificial Sequence
  Description of Artificial Sequence: Synthetic oligonucleotide
tcccagatggaggagccggcagct

SEQ ID NO: 181699 - DNA, 23 bp, Artificial Sequence
  Description of Artificial Sequence: Synthetic oligonucleotide
cccagatggaggagccggcagct

SEQ ID NO: 181700 - DNA, 24 bp, Artificial Sequence
  Description of Artificial Sequence: Synthetic oligonucleotide
ccagatggaggagccggcagctca

SEQ ID NO: 181701 - DNA, 24 bp, Artificial Sequence
  Description of Artificial Sequence: Synthetic oligonucleotide
cagatggaggagccggcagctcac

SEQ ID NO: 181702 - DNA, 25 bp, Artificial Sequence
  Description of Artificial Sequence: Synthetic oligonucleotide
agatggaggagccggcagctcacga

SEQ ID NO: 181703 - DNA, 24 bp, Artificial Sequence
  Description of Artificial Sequence: Synthetic oligonucleotide
gatggaggagccggcagctcacga

SEQ ID NO: 181704 - DNA, 25 bp, Artificial Sequence
  Description of Artificial Sequence: Synthetic oligonucleotide
atggaggagccggcagctcacgaca

SEQ ID NO: 181705 - DNA, 24 bp, Artificial Sequence
  Description of Artificial Sequence: Synthetic oligonucleotide
tggaggagccggcagctcacgaca

SEQ ID NO: 181706 - DNA, 23 bp, Artificial Sequence
  Description of Artificial Sequence: Synthetic oligonucleotide
ggaggagccggcagctcacgaca

SEQ ID NO: 181707 - DNA, 23 bp, Artificial Sequence
  Description of Artificial Sequence: Synthetic oligonucleotide
gaggagccggcagctcacgacac

SEQ ID NO: 181708 - DNA, 23 bp, Artificial Sequence
  Description of Artificial Sequence: Synthetic oligonucleotide
aggagccggcagctcacgacacc

SEQ ID NO: 181709 - DNA, 22 bp, Artificial Sequence
  Description of Artificial Sequence: Synthetic oligonucleotide
ggagccggcagctcacgacacc

SEQ ID NO: 181710 - DNA, 23 bp, Artificial Sequence
  Description of Artificial Sequence: Synthetic oligonucleotide
gagccggcagctcacgacaccga

SEQ ID NO: 181711 - DNA, 23 bp, Artificial Sequence
  Description of Artificial Sequence: Synthetic oligonucleotide
agccggcagctcacgacaccgag

SEQ ID NO: 181712 - DNA, 22 bp, Artificial Sequence
  Description of Artificial Sequence: Synthetic oligonucleotide
gccggcagctcacgacaccgag

SEQ ID NO: 181713 - DNA, 22 bp, Artificial Sequence
  Description of Artificial Sequence: Synthetic oligonucleotide
ccggcagctcacgacaccgagg

SEQ ID NO: 181714 - DNA, 24 bp, Artificial Sequence
  Description of Artificial Sequence: Synthetic oligonucleotide
cggcagctcacgacaccgaggcaa

SEQ ID NO: 181715 - DNA, 25 bp, Artificial Sequence
  Description of Artificial Sequence: Synthetic oligonucleotide
ggcagctcacgacaccgaggcaaca

SEQ ID NO: 181716 - DNA, 25 bp, Artificial Sequence
  Description of Artificial Sequence: Synthetic oligonucleotide
gcagctcacgacaccgaggcaacag

SEQ ID NO: 181717 - DNA, 25 bp, Artificial Sequence
  Description of Artificial Sequence: Synthetic oligonucleotide
cagctcacgacaccgaggcaacagc

SEQ ID NO: 181718 - DNA, 26 bp, Artificial Sequence
  Description of Artificial Sequence: Synthetic oligonucleotide
agctcacgacaccgaggcaacagcca

SEQ ID NO: 181719 - DNA, 25 bp, Artificial Sequence
  Description of Artificial Sequence: Synthetic oligonucleotide
gctcacgacaccgaggcaacagcca

SEQ ID NO: 181720 - DNA, 26 bp, Artificial Sequence
  Description of Artificial Sequence: Synthetic oligonucleotide
ctcacgacaccgaggcaacagccaca

SEQ ID NO: 181721 - DNA, 27 bp, Artificial Sequence
  Description of Artificial Sequence: Synthetic oligonucleotide
tcacgacaccgaggcaacagccacaga

SEQ ID NO: 181722 - DNA, 26 bp, Artificial Sequence
  Description of Artificial Sequence: Synthetic oligonucleotide
cacgacaccgaggcaacagccacaga

SEQ ID NO: 181723 - DNA, 27 bp, Artificial Sequence
  Description of Artificial Sequence: Synthetic oligonucleotide
acgacaccgaggcaacagccacagact

SEQ ID NO: 181724 - DNA, 27 bp, Artificial Sequence
  Description of Artificial Sequence: Synthetic oligonucleotide
cgacaccgaggcaacagccacagacta

SEQ ID NO: 181725 - DNA, 27 bp, Artificial Sequence
  Description of Artificial Sequence: Synthetic oligonucleotide
gacaccgaggcaacagccacagactac

SEQ ID NO: 181726 - DNA, 27 bp, Artificial Sequence
  Description of Artificial Sequence: Synthetic oligonucleotide
acaccgaggcaacagccacagactacc

SEQ ID NO: 181727 - DNA, 27 bp, Artificial Sequence
  Description of Artificial Sequence: Synthetic oligonucleotide
caccgaggcaacagccacagactacca

SEQ ID NO: 181728 - DNA, 27 bp, Artificial Sequence
  Description of Artificial Sequence: Synthetic oligonucleotide
accgaggcaacagccacagactaccac

SEQ ID NO: 181729 - DNA, 27 bp, Artificial Sequence
  Description of Artificial Sequence: Synthetic oligonucleotide
ccgaggcaacagccacagactaccaca

SEQ ID NO: 181730 - DNA, 27 bp, Artificial Sequence
  Description of Artificial Sequence: Synthetic oligonucleotide
cgaggcaacagccacagactaccacac

SEQ ID NO: 181731 - DNA, 27 bp, Artificial Sequence
  Description of Artificial Sequence: Synthetic oligonucleotide
gaggcaacagccacagactaccacacc

SEQ ID NO: 181732 - DNA, 28 bp, Artificial Sequence
  Description of Artificial Sequence: Synthetic oligonucleotide
aggcaacagccacagactaccacaccac

SEQ ID NO: 181733 - DNA, 27 bp, Artificial Sequence
  Description of Artificial Sequence: Synthetic oligonucleotide
ggcaacagccacagactaccacaccac

SEQ ID NO: 181734 - DNA, 29 bp, Artificial Sequence
  Description of Artificial Sequence: Synthetic oligonucleotide
gcaacagccacagactaccacaccacatc

SEQ ID NO: 181735 - DNA, 30 bp, Artificial Sequence
  Description of Artificial Sequence: Synthetic oligonucleotide
caacagccacagactaccacaccacatcac

SEQ ID NO: 181736 - DNA, 31 bp, Artificial Sequence
  Description of Artificial Sequence: Synthetic oligonucleotide
aacagccacagactaccacaccacatcacac

SEQ ID NO: 181737 - DNA, 30 bp, Artificial Sequence
  Description of Artificial Sequence: Synthetic oligonucleotide
acagccacagactaccacaccacatcacac

SEQ ID NO: 181738 - DNA, 29 bp, Artificial Sequence
  Description of Artificial Sequence: Synthetic oligonucleotide
cagccacagactaccacaccacatcacac

SEQ ID NO: 181739 - DNA, 29 bp, Artificial Sequence
  Description of Artificial Sequence: Synthetic oligonucleotide
agccacagactaccacaccacatcacacc

SEQ ID NO: 181740 - DNA, 28 bp, Artificial Sequence
  Description of Artificial Sequence: Synthetic oligonucleotide
gccacagactaccacaccacatcacacc

SEQ ID NO: 181741 - DNA, 28 bp, Artificial Sequence
  Description of Artificial Sequence: Synthetic oligonucleotide
ccacagactaccacaccacatcacaccc

SEQ ID NO: 181742 - DNA, 28 bp, Artificial Sequence
  Description of Artificial Sequence: Synthetic oligonucleotide
cacagactaccacaccacatcacacccg

SEQ ID NO: 181743 - DNA, 28 bp, Artificial Sequence
  Description of Artificial Sequence: Synthetic oligonucleotide
acagactaccacaccacatcacacccgg

SEQ ID NO: 181744 - DNA, 27 bp, Artificial Sequence
  Description of Artificial Sequence: Synthetic oligonucleotide
cagactaccacaccacatcacacccgg

SEQ ID NO: 181745 - DNA, 27 bp, Artificial Sequence
  Description of Artificial Sequence: Synthetic oligonucleotide
agactaccacaccacatcacacccggg

SEQ ID NO: 181746 - DNA, 27 bp, Artificial Sequence
  Description of Artificial Sequence: Synthetic oligonucleotide
gactaccacaccacatcacacccgggt

SEQ ID NO: 181747 - DNA, 28 bp, Artificial Sequence
  Description of Artificial Sequence: Synthetic oligonucleotide
actaccacaccacatcacacccgggtac

SEQ ID NO: 181748 - DNA, 27 bp, Artificial Sequence
  Description of Artificial Sequence: Synthetic oligonucleotide
ctaccacaccacatcacacccgggtac

SEQ ID NO: 181749 - DNA, 27 bp, Artificial Sequence
  Description of Artificial Sequence: Synthetic oligonucleotide
taccacaccacatcacacccgggtacc

SEQ ID NO: 181750 - DNA, 26 bp, Artificial Sequence
  Description of Artificial Sequence: Synthetic oligonucleotide
accacaccacatcacacccgggtacc

SEQ ID NO: 181751 - DNA, 25 bp, Artificial Sequence
  Description of Artificial Sequence: Synthetic oligonucleotide
ccacaccacatcacacccgggtacc

SEQ ID NO: 181752 - DNA, 26 bp, Artificial Sequence
  Description of Artificial Sequence: Synthetic oligonucleotide
cacaccacatcacacccgggtaccca

SEQ ID NO: 181753 - DNA, 27 bp, Artificial Sequence
  Description of Artificial Sequence: Synthetic oligonucleotide
acaccacatcacacccgggtacccaca

SEQ ID NO: 181754 - DNA, 27 bp, Artificial Sequence
  Description of Artificial Sequence: Synthetic oligonucleotide
caccacatcacacccgggtacccacaa

SEQ ID NO: 181755 - DNA, 27 bp, Artificial Sequence
  Description of Artificial Sequence: Synthetic oligonucleotide
accacatcacacccgggtacccacaag

SEQ ID NO: 181756 - DNA, 26 bp, Artificial Sequence
  Description of Artificial Sequence: Synthetic oligonucleotide
ccacatcacacccgggtacccacaag

SEQ ID NO: 181757 - DNA, 27 bp, Artificial Sequence
  Description of Artificial Sequence: Synthetic oligonucleotide
cacatcacacccgggtacccacaaggt

SEQ ID NO: 181758 - DNA, 27 bp, Artificial Sequence
  Description of Artificial Sequence: Synthetic oligonucleotide
acatcacacccgggtacccacaaggtc

SEQ ID NO: 181759 - DNA, 27 bp, Artificial Sequence
  Description of Artificial Sequence: Synthetic oligonucleotide
catcacacccgggtacccacaaggtct

SEQ ID NO: 181760 - DNA, 29 bp, Artificial Sequence
  Description of Artificial Sequence: Synthetic oligonucleotide
atcacacccgggtacccacaaggtctatg

SEQ ID NO: 181761 - DNA, 28 bp, Artificial Sequence
  Description of Artificial Sequence: Synthetic oligonucleotide
tcacacccgggtacccacaaggtctatg

SEQ ID NO: 181762 - DNA, 27 bp, Artificial Sequence
  Description of Artificial Sequence: Synthetic oligonucleotide
cacacccgggtacccacaaggtctatg

SEQ ID NO: 181763 - DNA, 28 bp, Artificial Sequence
  Description of Artificial Sequence: Synthetic oligonucleotide
acacccgggtacccacaaggtctatgtg

SEQ ID NO: 181764 - DNA, 27 bp, Artificial Sequence
  Description of Artificial Sequence: Synthetic oligonucleotide
cacccgggtacccacaaggtctatgtg

SEQ ID NO: 181765 - DNA, 27 bp, Artificial Sequence
  Description of Artificial Sequence: Synthetic oligonucleotide
acccgggtacccacaaggtctatgtgg

SEQ ID NO: 181766 - DNA, 27 bp, Artificial Sequence
  Description of Artificial Sequence: Synthetic oligonucleotide
cccgggtacccacaaggtctatgtgga

SEQ ID NO: 181767 - DNA, 27 bp, Artificial Sequence
  Description of Artificial Sequence: Synthetic oligonucleotide
ccgggtacccacaaggtctatgtggag

SEQ ID NO: 181768 - DNA, 27 bp, Artificial Sequence
  Description of Artificial Sequence: Synthetic oligonucleotide
cgggtacccacaaggtctatgtggagc

SEQ ID NO: 181769 - DNA, 28 bp, Artificial Sequence
  Description of Artificial Sequence: Synthetic oligonucleotide
gggtacccacaaggtctatgtggagctg

SEQ ID NO: 181770 - DNA, 28 bp, Artificial Sequence
  Description of Artificial Sequence: Synthetic oligonucleotide
ggtacccacaaggtctatgtggagctgc

SEQ ID NO: 181771 - DNA, 29 bp, Artificial Sequence
  Description of Artificial Sequence: Synthetic oligonucleotide
gtacccacaaggtctatgtggagctgcag

SEQ ID NO: 181772 - DNA, 29 bp, Artificial Sequence
  Description of Artificial Sequence: Synthetic oligonucleotide
tacccacaaggtctatgtggagctgcagg

SEQ ID NO: 181773 - DNA, 28 bp, Artificial Sequence
  Description of Artificial Sequence: Synthetic oligonucleotide
acccacaaggtctatgtggagctgcagg

SEQ ID NO: 181774 - DNA, 27 bp, Artificial Sequence
  Description of Artificial Sequence: Synthetic oligonucleotide
cccacaaggtctatgtggagctgcagg

SEQ ID NO: 181775 - DNA, 28 bp, Artificial Sequence
  Description of Artificial Sequence: Synthetic oligonucleotide
ccacaaggtctatgtggagctgcaggag

SEQ ID NO: 181776 - DNA, 28 bp, Artificial Sequence
  Description of Artificial Sequence: Synthetic oligonucleotide
cacaaggtctatgtggagctgcaggagc

SEQ ID NO: 181777 - DNA, 29 bp, Artificial Sequence
  Description of Artificial Sequence: Synthetic oligonucleotide
acaaggtctatgtggagctgcaggagctg

SEQ ID NO: 181778 - DNA, 28 bp, Artificial Sequence
  Description of Artificial Sequence: Synthetic oligonucleotide
caaggtctatgtggagctgcaggagctg

SEQ ID NO: 181779 - DNA, 28 bp, Artificial Sequence
  Description of Artificial Sequence: Synthetic oligonucleotide
aaggtctatgtggagctgcaggagctgg

SEQ ID NO: 181780 - DNA, 27 bp, Artificial Sequence
  Description of Artificial Sequence: Synthetic oligonucleotide
aggtctatgtggagctgcaggagctgg

SEQ ID NO: 181781 - DNA, 27 bp, Artificial Sequence
  Description of Artificial Sequence: Synthetic oligonucleotide
ggtctatgtggagctgcaggagctggt

SEQ ID NO: 181782 - DNA, 27 bp, Artificial Sequence
  Description of Artificial Sequence: Synthetic oligonucleotide
gtctatgtggagctgcaggagctggtg

SEQ ID NO: 181783 - DNA, 29 bp, Artificial Sequence
  Description of Artificial Sequence: Synthetic oligonucleotide
tctatgtggagctgcaggagctggtgatg

SEQ ID NO: 181784 - DNA, 28 bp, Artificial Sequence
  Description of Artificial Sequence: Synthetic oligonucleotide
ctatgtggagctgcaggagctggtgatg

SEQ ID NO: 181785 - DNA, 28 bp, Artificial Sequence
  Description of Artificial Sequence: Synthetic oligonucleotide
tatgtggagctgcaggagctggtgatgg

SEQ ID NO: 181786 - DNA, 27 bp, Artificial Sequence
  Description of Artificial Sequence: Synthetic oligonucleotide
atgtggagctgcaggagctggtgatgg

SEQ ID NO: 181787 - DNA, 27 bp, Artificial Sequence
  Description of Artificial Sequence: Synthetic oligonucleotide
tgtggagctgcaggagctggtgatgga

SEQ ID NO: 181788 - DNA, 26 bp, Artificial Sequence
  Description of Artificial Sequence: Synthetic oligonucleotide
gtggagctgcaggagctggtgatgga

SEQ ID NO: 181789 - DNA, 26 bp, Artificial Sequence
  Description of Artificial Sequence: Synthetic oligonucleotide
tggagctgcaggagctggtgatggac

SEQ ID NO: 181790 - DNA, 25 bp, Artificial Sequence
  Description of Artificial Sequence: Synthetic oligonucleotide
ggagctgcaggagctggtgatggac

SEQ ID NO: 181791 - DNA, 27 bp, Artificial Sequence
  Description of Artificial Sequence: Synthetic oligonucleotide
gagctgcaggagctggtgatggacgaa

SEQ ID NO: 181792 - DNA, 29 bp, Artificial Sequence
  Description of Artificial Sequence: Synthetic oligonucleotide
agctgcaggagctggtgatggacgaaaag

SEQ ID NO: 181793 - DNA, 28 bp, Artificial Sequence
  Description of Artificial Sequence: Synthetic oligonucleotide
gctgcaggagctggtgatggacgaaaag

SEQ ID NO: 181794 - DNA, 30 bp, Artificial Sequence
  Description of Artificial Sequence: Synthetic oligonucleotide
ctgcaggagctggtgatggacgaaaagaac

SEQ ID NO: 181795 - DNA, 30 bp, Artificial Sequence
  Description of Artificial Sequence: Synthetic oligonucleotide
tgcaggagctggtgatggacgaaaagaacc

SEQ ID NO: 181796 - DNA, 29 bp, Artificial Sequence
  Description of Artificial Sequence: Synthetic oligonucleotide
gcaggagctggtgatggacgaaaagaacc

SEQ ID NO: 181797 - DNA, 30 bp, Artificial Sequence
  Description of Artificial Sequence: Synthetic oligonucleotide
caggagctggtgatggacgaaaagaaccag

SEQ ID NO: 181798 - DNA, 30 bp, Artificial Sequence
  Description of Artificial Sequence: Synthetic oligonucleotide
aggagctggtgatggacgaaaagaaccagg

SEQ ID NO: 181799 - DNA, 29 bp, Artificial Sequence
  Description of Artificial Sequence: Synthetic oligonucleotide
ggagctggtgatggacgaaaagaaccagg

SEQ ID NO: 181800 - DNA, 30 bp, Artificial Sequence
  Description of Artificial Sequence: Synthetic oligonucleotide
gagctggtgatggacgaaaagaaccaggag

SEQ ID NO: 181801 - DNA, 30 bp, Artificial Sequence
  Description of Artificial Sequence: Synthetic oligonucleotide
agctggtgatggacgaaaagaaccaggagc

SEQ ID NO: 181802 - DNA, 29 bp, Artificial Sequence
  Description of Artificial Sequence: Synthetic oligonucleotide
gctggtgatggacgaaaagaaccaggagc

SEQ ID NO: 181803 - DNA, 30 bp, Artificial Sequence
  Description of Artificial Sequence: Synthetic oligonucleotide
ctggtgatggacgaaaagaaccaggagctg

SEQ ID NO: 181804 - DNA, 31 bp, Artificial Sequence
  Description of Artificial Sequence: Synthetic oligonucleotide
tggtgatggacgaaaagaaccaggagctgag

SEQ ID NO: 181805 - DNA, 30 bp, Artificial Sequence
  Description of Artificial Sequence: Synthetic oligonucleotide
ggtgatggacgaaaagaaccaggagctgag

SEQ ID NO: 181806 - DNA, 32 bp, Artificial Sequence
  Description of Artificial Sequence: Synthetic oligonucleotide
gtgatggacgaaaagaaccaggagctgagatg

SEQ ID NO: 181807 - DNA, 32 bp, Artificial Sequence
  Description of Artificial Sequence: Synthetic oligonucleotide
tgatggacgaaaagaaccaggagctgagatgg

SEQ ID NO: 181808 - DNA, 31 bp, Artificial Sequence
  Description of Artificial Sequence: Synthetic oligonucleotide
gatggacgaaaagaaccaggagctgagatgg

SEQ ID NO: 181809 - DNA, 33 bp, Artificial Sequence
  Description of Artificial Sequence: Synthetic oligonucleotide
atggacgaaaagaaccaggagctgagatggatg

SEQ ID NO: 181810 - DNA, 32 bp, Artificial Sequence
  Description of Artificial Sequence: Synthetic oligonucleotide
tggacgaaaagaaccaggagctgagatggatg

SEQ ID NO: 181811 - DNA, 31 bp, Artificial Sequence
  Description of Artificial Sequence: Synthetic oligonucleotide
ggacgaaaagaaccaggagctgagatggatg

SEQ ID NO: 181812 - DNA, 31 bp, Artificial Sequence
  Description of Artificial Sequence: Synthetic oligonucleotide
gacgaaaagaaccaggagctgagatggatgg

SEQ ID NO: 181813 - DNA, 32 bp, Artificial Sequence
  Description of Artificial Sequence: Synthetic oligonucleotide
acgaaaagaaccaggagctgagatggatggag

SEQ ID NO: 181814 - DNA, 31 bp, Artificial Sequence
  Description of Artificial Sequence: Synthetic oligonucleotide
cgaaaagaaccaggagctgagatggatggag

SEQ ID NO: 181815 - DNA, 31 bp, Artificial Sequence
  Description of Artificial Sequence: Synthetic oligonucleotide
gaaaagaaccaggagctgagatggatggagg

SEQ ID NO: 181816 - DNA, 31 bp, Artificial Sequence
  Description of Artificial Sequence: Synthetic oligonucleotide
aaaagaaccaggagctgagatggatggaggc

SEQ ID NO: 181817 - DNA, 30 bp, Artificial Sequence
  Description of Artificial Sequence: Synthetic oligonucleotide
aaagaaccaggagctgagatggatggaggc

SEQ ID NO: 181818 - DNA, 29 bp, Artificial Sequence
  Description of Artificial Sequence: Synthetic oligonucleotide
aagaaccaggagctgagatggatggaggc

SEQ ID NO: 181819 - DNA, 28 bp, Artificial Sequence
  Description of Artificial Sequence: Synthetic oligonucleotide
agaaccaggagctgagatggatggaggc

SEQ ID NO: 181820 - DNA, 27 bp, Artificial Sequence
  Description of Artificial Sequence: Synthetic oligonucleotide
gaaccaggagctgagatggatggaggc

SEQ ID NO: 181821 - DNA, 27 bp, Artificial Sequence
  Description of Artificial Sequence: Synthetic oligonucleotide
aaccaggagctgagatggatggaggcg

SEQ ID NO: 181822 - DNA, 26 bp, Artificial Sequence
  Description of Artificial Sequence: Synthetic oligonucleotide
accaggagctgagatggatggaggcg

SEQ ID NO: 181823 - DNA, 25 bp, Artificial Sequence
  Description of Artificial Sequence: Synthetic oligonucleotide
ccaggagctgagatggatggaggcg

SEQ ID NO: 181824 - DNA, 25 bp, Artificial Sequence
  Description of Artificial Sequence: Synthetic oligonucleotide
caggagctgagatggatggaggcgg

SEQ ID NO: 181825 - DNA, 25 bp, Artificial Sequence
  Description of Artificial Sequence: Synthetic oligonucleotide
aggagctgagatggatggaggcggc

SEQ ID NO: 181826 - DNA, 24 bp, Artificial Sequence
  Description of Artificial Sequence: Synthetic oligonucleotide
ggagctgagatggatggaggcggc

SEQ ID NO: 181827 - DNA, 24 bp, Artificial Sequence
  Description of Artificial Sequence: Synthetic oligonucleotide
gagctgagatggatggaggcggcg

SEQ ID NO: 181828 - DNA, 24 bp, Artificial Sequence
  Description of Artificial Sequence: Synthetic oligonucleotide
agctgagatggatggaggcggcgc

SEQ ID NO: 181829 - DNA, 23 bp, Artificial Sequence
  Description of Artificial Sequence: Synthetic oligonucleotide
gctgagatggatggaggcggcgc

SEQ ID NO: 181830 - DNA, 23 bp, Artificial Sequence
  Description of Artificial Sequence: Synthetic oligonucleotide
ctgagatggatggaggcggcgcg

SEQ ID NO: 181831 - DNA, 24 bp, Artificial Sequence
  Description of Artificial Sequence: Synthetic oligonucleotide
tgagatggatggaggcggcgcgct

SEQ ID NO: 181832 - DNA, 23 bp, Artificial Sequence
  Description of Artificial Sequence: Synthetic oligonucleotide
gagatggatggaggcggcgcgct

SEQ ID NO: 181833 - DNA, 23 bp, Artificial Sequence
  Description of Artificial Sequence: Synthetic oligonucleotide
agatggatggaggcggcgcgctg

SEQ ID NO: 181834 - DNA, 22 bp, Artificial Sequence
  Description of Artificial Sequence: Synthetic oligonucleotide
gatggatggaggcggcgcgctg

SEQ ID NO: 181835 - DNA, 22 bp, Artificial Sequence
  Description of Artificial Sequence: Synthetic oligonucleotide
atggatggaggcggcgcgctgg

SEQ ID NO: 181836 - DNA, 21 bp, Artificial Sequence
  Description of Artificial Sequence: Synthetic oligonucleotide
tggatggaggcggcgcgctgg

SEQ ID NO: 181837 - DNA, 20 bp, Artificial Sequence
  Description of Artificial Sequence: Synthetic oligonucleotide
ggatggaggcggcgcgctgg

SEQ ID NO: 181838 - DNA, 21 bp, Artificial Sequence
  Description of Artificial Sequence: Synthetic oligonucleotide
gatggaggcggcgcgctgggt

SEQ ID NO: 181839 - DNA, 21 bp, Artificial Sequence
  Description of Artificial Sequence: Synthetic oligonucleotide
atggaggcggcgcgctgggtg

SEQ ID NO: 181840 - DNA, 20 bp, Artificial Sequence
  Description of Artificial Sequence: Synthetic oligonucleotide
tggaggcggcgcgctgggtg

SEQ ID NO: 181841 - DNA, 20 bp, Artificial Sequence
  Description of Artificial Sequence: Synthetic oligonucleotide
ggaggcggcgcgctgggtgt

SEQ ID NO: 181842 - DNA, 21 bp, Artificial Sequence
  Description of Artificial Sequence: Synthetic oligonucleotide
gaggcggcgcgctgggtgcaa

SEQ ID NO: 181843 - DNA, 22 bp, Artificial Sequence
  Description of Artificial Sequence: Synthetic oligonucleotide
aggcggcgcgctgggtgcaact

SEQ ID NO: 181844 - DNA, 21 bp, Artificial Sequence
  Description of Artificial Sequence: Synthetic oligonucleotide
ggcggcgcgctgggtgcaact

SEQ ID NO: 181845 - DNA, 21 bp, Artificial Sequence
  Description of Artificial Sequence: Synthetic oligonucleotide
gcggcgcgctgggtgcaactg

SEQ ID NO: 181846 - DNA, 22 bp, Artificial Sequence
  Description of Artificial Sequence: Synthetic oligonucleotide
cggcgcgctgggtgcaactgga

SEQ ID NO: 181847 - DNA, 22 bp, Artificial Sequence
  Description of Artificial Sequence: Synthetic oligonucleotide
ggcgcgctgggtgcaactggag

SEQ ID NO: 181848 - DNA, 23 bp, Artificial Sequence
  Description of Artificial Sequence: Synthetic oligonucleotide
gcgcgctgggtgcaactggagga

SEQ ID NO: 181849 - DNA, 25 bp, Artificial Sequence
  Description of Artificial Sequence: Synthetic oligonucleotide
cgcgctgggtgcaactggaggagaa

SEQ ID NO: 181850 - DNA, 25 bp, Artificial Sequence
  Description of Artificial Sequence: Synthetic oligonucleotide
gcgctgggtgcaactggaggagaac

SEQ ID NO: 181851 - DNA, 26 bp, Artificial Sequence
  Description of Artificial Sequence: Synthetic oligonucleotide
cgctgggtgcaactggaggagaacct

SEQ ID NO: 181852 - DNA, 26 bp, Artificial Sequence
  Description of Artificial Sequence: Synthetic oligonucleotide
gctgggtgcaactggaggagaacctg

SEQ ID NO: 181853 - DNA, 26 bp, Artificial Sequence
  Description of Artificial Sequence: Synthetic oligonucleotide
ctgggtgcaactggaggagaacctgg

SEQ ID NO: 181854 - DNA, 26 bp, Artificial Sequence
  Description of Artificial Sequence: Synthetic oligonucleotide
tgggtgcaactggaggagaacctggg

SEQ ID NO: 181855 - DNA, 25 bp, Artificial Sequence
  Description of Artificial Sequence: Synthetic oligonucleotide
gggtgcaactggaggagaacctggg

SEQ ID NO: 181856 - DNA, 25 bp, Artificial Sequence
  Description of Artificial Sequence: Synthetic oligonucleotide
ggtgcaactggaggagaacctgggg

SEQ ID NO: 181857 - DNA, 26 bp, Artificial Sequence
  Description of Artificial Sequence: Synthetic oligonucleotide
gtgcaactggaggagaacctggggga

SEQ ID NO: 181858 - DNA, 27 bp, Artificial Sequence
  Description of Artificial Sequence: Synthetic oligonucleotide
tgcaactggaggagaacctgggggaga

SEQ ID NO: 181859 - DNA, 27 bp, Artificial Sequence
  Description of Artificial Sequence: Synthetic oligonucleotide
gcaactggaggagaacctgggggagaa

SEQ ID NO: 181860 - DNA, 28 bp, Artificial Sequence
  Description of Artificial Sequence: Synthetic oligonucleotide
caactggaggagaacctgggggagaatg

SEQ ID NO: 181861 - DNA, 28 bp, Artificial Sequence
  Description of Artificial Sequence: Synthetic oligonucleotide
aactggaggagaacctgggggagaatgg

SEQ ID NO: 181862 - DNA, 27 bp, Artificial Sequence
  Description of Artificial Sequence: Synthetic oligonucleotide
actggaggagaacctgggggagaatgg

SEQ ID NO: 181863 - DNA, 26 bp, Artificial Sequence
  Description of Artificial Sequence: Synthetic oligonucleotide
ctggaggagaacctgggggagaatgg

SEQ ID NO: 181864 - DNA, 26 bp, Artificial Sequence
  Description of Artificial Sequence: Synthetic oligonucleotide
tggaggagaacctgggggagaatggg

SEQ ID NO: 181865 - DNA, 25 bp, Artificial Sequence
  Description of Artificial Sequence: Synthetic oligonucleotide
ggaggagaacctgggggagaatggg

SEQ ID NO: 181866 - DNA, 25 bp, Artificial Sequence
  Description of Artificial Sequence: Synthetic oligonucleotide
gaggagaacctgggggagaatgggg

SEQ ID NO: 181867 - DNA, 25 bp, Artificial Sequence
  Description of Artificial Sequence: Synthetic oligonucleotide
aggagaacctgggggagaatggggc

SEQ ID NO: 181868 - DNA, 24 bp, Artificial Sequence
  Description of Artificial Sequence: Synthetic oligonucleotide
ggagaacctgggggagaatggggc

SEQ ID NO: 181869 - DNA, 25 bp, Artificial Sequence
  Description of Artificial Sequence: Synthetic oligonucleotide
gagaacctgggggagaatggggcct

SEQ ID NO: 181870 - DNA, 25 bp, Artificial Sequence
  Description of Artificial Sequence: Synthetic oligonucleotide
agaacctgggggagaatggggcctg

SEQ ID NO: 181871 - DNA, 24 bp, Artificial Sequence
  Description of Artificial Sequence: Synthetic oligonucleotide
gaacctgggggagaatggggcctg

SEQ ID NO: 181872 - DNA, 24 bp, Artificial Sequence
  Description of Artificial Sequence: Synthetic oligonucleotide
aacctgggggagaatggggcctgg

SEQ ID NO: 181873 - DNA, 23 bp, Artificial Sequence
  Description of Artificial Sequence: Synthetic oligonucleotide
acctgggggagaatggggcctgg

SEQ ID NO: 181874 - DNA, 22 bp, Artificial Sequence
  Description of Artificial Sequence: Synthetic oligonucleotide
cctgggggagaatggggcctgg

SEQ ID NO: 181875 - DNA, 22 bp, Artificial Sequence
  Description of Artificial Sequence: Synthetic oligonucleotide
ctgggggagaatggggcctggg

SEQ ID NO: 181876 - DNA, 22 bp, Artificial Sequence
  Description of Artificial Sequence: Synthetic oligonucleotide
tgggggagaatggggcctgggg

SEQ ID NO: 181877 - DNA, 21 bp, Artificial Sequence
  Description of Artificial Sequence: Synthetic oligonucleotide
gggggagaatggggcctgggg

SEQ ID NO: 181878 - DNA, 21 bp, Artificial Sequence
  Description of Artificial Sequence: Synthetic oligonucleotide
ggggagaatggggcctggggc

SEQ ID NO: 181879 - DNA, 21 bp, Artificial Sequence
  Description of Artificial Sequence: Synthetic oligonucleotide
gggagaatggggcctggggcc

SEQ ID NO: 181880 - DNA, 21 bp, Artificial Sequence
  Description of Artificial Sequence: Synthetic oligonucleotide
ggagaatggggcctggggccg

SEQ ID NO: 181881 - DNA, 21 bp, Artificial Sequence
  Description of Artificial Sequence: Synthetic oligonucleotide
gagaatggggcctggggccgc

SEQ ID NO: 181882 - DNA, 21 bp, Artificial Sequence
  Description of Artificial Sequence: Synthetic oligonucleotide
agaatggggcctggggccgcc

SEQ ID NO: 181883 - DNA, 20 bp, Artificial Sequence
  Description of Artificial Sequence: Synthetic oligonucleotide
gaatggggcctggggccgcc

SEQ ID NO: 181884 - DNA, 20 bp, Artificial Sequence
  Description of Artificial Sequence: Synthetic oligonucleotide
aatggggcctggggccgccc

SEQ ID NO: 181885 - DNA, 20 bp, Artificial Sequence
  Description of Artificial Sequence: Synthetic oligonucleotide
atggggcctggggccgccct

SEQ ID NO: 181886 - DNA, 20 bp, Artificial Sequence
  Description of Artificial Sequence: Synthetic oligonucleotide
tggggcctggggccgccctt

SEQ ID NO: 181887 - DNA, 20 bp, Artificial Sequence
  Description of Artificial Sequence: Synthetic oligonucleotide
ggggcctggggccgcccttt

SEQ ID NO: 181888 - DNA, 20 bp, Artificial Sequence
  Description of Artificial Sequence: Synthetic oligonucleotide
gggcctggggccgcccgttt

SEQ ID NO: 181889 - DNA, 20 bp, Artificial Sequence
  Description of Artificial Sequence: Synthetic oligonucleotide
ggcctggggccgcccgcatt

SEQ ID NO: 181890 - DNA, 20 bp, Artificial Sequence
  Description of Artificial Sequence: Synthetic oligonucleotide
gcctggggccgcccgcactt

SEQ ID NO: 181891 - DNA, 20 bp, Artificial Sequence
  Description of Artificial Sequence: Synthetic oligonucleotide
cctggggccgcccgcacctt

SEQ ID NO: 181892 - DNA, 20 bp, Artificial Sequence
  Description of Artificial Sequence: Synthetic oligonucleotide
ctggggccgcccgcacctct

SEQ ID NO: 181893 - DNA, 21 bp, Artificial Sequence
  Description of Artificial Sequence: Synthetic oligonucleotide
tggggccgcccgcacctctct

SEQ ID NO: 181894 - DNA, 20 bp, Artificial Sequence
  Description of Artificial Sequence: Synthetic oligonucleotide
ggggccgcccgcacctctct

SEQ ID NO: 181895 - DNA, 21 bp, Artificial Sequence
  Description of Artificial Sequence: Synthetic oligonucleotide
gggccgcccgcacctctctca

SEQ ID NO: 181896 - DNA, 21 bp, Artificial Sequence
  Description of Artificial Sequence: Synthetic oligonucleotide
ggccgcccgcacctctctcac

SEQ ID NO: 181897 - DNA, 22 bp, Artificial Sequence
  Description of Artificial Sequence: Synthetic oligonucleotide
gccgcccgcacctctctcacct

SEQ ID NO: 181898 - DNA, 23 bp, Artificial Sequence
  Description of Artificial Sequence: Synthetic oligonucleotide
ccgcccgcacctctctcacctca

SEQ ID NO: 181899 - DNA, 23 bp, Artificial Sequence
  Description of Artificial Sequence: Synthetic oligonucleotide
cgcccgcacctctctcacctcac

SEQ ID NO: 181900 - DNA, 25 bp, Artificial Sequence
  Description of Artificial Sequence: Synthetic oligonucleotide
gcccgcacctctctcacctcacctt

SEQ ID NO: 181901 - DNA, 26 bp, Artificial Sequence
  Description of Artificial Sequence: Synthetic oligonucleotide
cccgcacctctctcacctcaccttct

SEQ ID NO: 181902 - DNA, 26 bp, Artificial Sequence
  Description of Artificial Sequence: Synthetic oligonucleotide
ccgcacctctctcacctcaccttctg

SEQ ID NO: 181903 - DNA, 27 bp, Artificial Sequence
  Description of Artificial Sequence: Synthetic oligonucleotide
cgcacctctctcacctcaccttctgga

SEQ ID NO: 181904 - DNA, 27 bp, Artificial Sequence
  Description of Artificial Sequence: Synthetic oligonucleotide
gcacctctctcacctcaccttctggag

SEQ ID NO: 181905 - DNA, 27 bp, Artificial Sequence
  Description of Artificial Sequence: Synthetic oligonucleotide
cacctctctcacctcaccttctggagc

SEQ ID NO: 181906 - DNA, 27 bp, Artificial Sequence
  Description of Artificial Sequence: Synthetic oligonucleotide
acctctctcacctcaccttctggagcc

SEQ ID NO: 181907 - DNA, 27 bp, Artificial Sequence
  Description of Artificial Sequence: Synthetic oligonucleotide
cctctctcacctcaccttctggagcct

SEQ ID NO: 181908 - DNA, 27 bp, Artificial Sequence
  Description of Artificial Sequence: Synthetic oligonucleotide
ctctctcacctcaccttctggagcctc

SEQ ID NO: 181909 - DNA, 27 bp, Artificial Sequence
  Description of Artificial Sequence: Synthetic oligonucleotide
tctctcacctcaccttctggagcctcc

SEQ ID NO: 181910 - DNA, 27 bp, Artificial Sequence
  Description of Artificial Sequence: Synthetic oligonucleotide
ctctcacctcaccttctggagcctcct

SEQ ID NO: 181911 - DNA, 28 bp, Artificial Sequence
  Description of Artificial Sequence: Synthetic oligonucleotide
tctcacctcaccttctggagcctcctag

SEQ ID NO: 181912 - DNA, 27 bp, Artificial Sequence
  Description of Artificial Sequence: Synthetic oligonucleotide
ctcacctcaccttctggagcctcctag

SEQ ID NO: 181913 - DNA, 28 bp, Artificial Sequence
  Description of Artificial Sequence: Synthetic oligonucleotide
tcacctcaccttctggagcctcctagag

SEQ ID NO: 181914 - DNA, 27 bp, Artificial Sequence
  Description of Artificial Sequence: Synthetic oligonucleotide
cacctcaccttctggagcctcctagag

SEQ ID NO: 181915 - DNA, 27 bp, Artificial Sequence
  Description of Artificial Sequence: Synthetic oligonucleotide
acctcaccttctggagcctcctagagc

SEQ ID NO: 181916 - DNA, 27 bp, Artificial Sequence
  Description of Artificial Sequence: Synthetic oligonucleotide
cctcaccttctggagcctcctagagct

SEQ ID NO: 181917 - DNA, 27 bp, Artificial Sequence
  Description of Artificial Sequence: Synthetic oligonucleotide
ctcaccttctggagcctcctagagctg

SEQ ID NO: 181918 - DNA, 27 bp, Artificial Sequence
  Description of Artificial Sequence: Synthetic oligonucleotide
tcaccttctggagcctcctagagctgc

SEQ ID NO: 181919 - DNA, 26 bp, Artificial Sequence
  Description of Artificial Sequence: Synthetic oligonucleotide
caccttctggagcctcctagagctgc

SEQ ID NO: 181920 - DNA, 27 bp, Artificial Sequence
  Description of Artificial Sequence: Synthetic oligonucleotide
accttctggagcctcctagagctgcgt

SEQ ID NO: 181921 - DNA, 27 bp, Artificial Sequence
  Description of Artificial Sequence: Synthetic oligonucleotide
ccttctggagcctcctagagctgcgta

SEQ ID NO: 181922 - DNA, 27 bp, Artificial Sequence
  Description of Artificial Sequence: Synthetic oligonucleotide
cttctggagcctcctagagctgcgtag

SEQ ID NO: 181923 - DNA, 28 bp, Artificial Sequence
  Description of Artificial Sequence: Synthetic oligonucleotide
ttctggagcctcctagagctgcgtagag

SEQ ID NO: 181924 - DNA, 27 bp, Artificial Sequence
  Description of Artificial Sequence: Synthetic oligonucleotide
tctggagcctcctagagctgcgtagag

SEQ ID NO: 181925 - DNA, 27 bp, Artificial Sequence
  Description of Artificial Sequence: Synthetic oligonucleotide
ctggagcctcctagagctgcgtagagt

SEQ ID NO: 181926 - DNA, 27 bp, Artificial Sequence
  Description of Artificial Sequence: Synthetic oligonucleotide
tggagcctcctagagctgcgtagagtc

SEQ ID NO: 181927 - DNA, 27 bp, Artificial Sequence
  Description of Artificial Sequence: Synthetic oligonucleotide
ggagcctcctagagctgcgtagagtct

SEQ ID NO: 181928 - DNA, 28 bp, Artificial Sequence
  Description of Artificial Sequence: Synthetic oligonucleotide
gagcctcctagagctgcgtagagtcttc

SEQ ID NO: 181929 - DNA, 29 bp, Artificial Sequence
  Description of Artificial Sequence: Synthetic oligonucleotide
agcctcctagagctgcgtagagtcttcac

SEQ ID NO: 181930 - DNA, 28 bp, Artificial Sequence
  Description of Artificial Sequence: Synthetic oligonucleotide
gcctcctagagctgcgtagagtcttcac

SEQ ID NO: 181931 - DNA, 28 bp, Artificial Sequence
  Description of Artificial Sequence: Synthetic oligonucleotide
cctcctagagctgcgtagagtcttcacc

SEQ ID NO: 181932 - DNA, 30 bp, Artificial Sequence
  Description of Artificial Sequence: Synthetic oligonucleotide
ctcctagagctgcgtagagtcttcaccaag

SEQ ID NO: 181933 - DNA, 30 bp, Artificial Sequence
  Description of Artificial Sequence: Synthetic oligonucleotide
tcctagagctgcgtagagtcttcaccaagg

SEQ ID NO: 181934 - DNA, 29 bp, Artificial Sequence
  Description of Artificial Sequence: Synthetic oligonucleotide
cctagagctgcgtagagtcttcaccaagg

SEQ ID NO: 181935 - DNA, 29 bp, Artificial Sequence
  Description of Artificial Sequence: Synthetic oligonucleotide
ctagagctgcgtagagtcttcaccaaggg

SEQ ID NO: 181936 - DNA, 31 bp, Artificial Sequence
  Description of Artificial Sequence: Synthetic oligonucleotide
tagagctgcgtagagtcttcaccaagggtac

SEQ ID NO: 181937 - DNA, 30 bp, Artificial Sequence
  Description of Artificial Sequence: Synthetic oligonucleotide
agagctgcgtagagtcttcaccaagggtac

SEQ ID NO: 181938 - DNA, 29 bp, Artificial Sequence
  Description of Artificial Sequence: Synthetic oligonucleotide
gagctgcgtagagtcttcaccaagggtac

SEQ ID NO: 181939 - DNA, 30 bp, Artificial Sequence
  Description of Artificial Sequence: Synthetic oligonucleotide
agctgcgtagagtcttcaccaagggtactg

SEQ ID NO: 181940 - DNA, 29 bp, Artificial Sequence
  Description of Artificial Sequence: Synthetic oligonucleotide
gctgcgtagagtcttcaccaagggtactg

SEQ ID NO: 181941 - DNA, 30 bp, Artificial Sequence
  Description of Artificial Sequence: Synthetic oligonucleotide
ctgcgtagagtcttcaccaagggtactgtc

SEQ ID NO: 181942 - DNA, 30 bp, Artificial Sequence
  Description of Artificial Sequence: Synthetic oligonucleotide
tgcgtagagtcttcaccaagggtactgtcc

SEQ ID NO: 181943 - DNA, 29 bp, Artificial Sequence
  Description of Artificial Sequence: Synthetic oligonucleotide
gcgtagagtcttcaccaagggtactgtcc

SEQ ID NO: 181944 - DNA, 30 bp, Artificial Sequence
  Description of Artificial Sequence: Synthetic oligonucleotide
cgtagagtcttcaccaagggtactgtcctc

SEQ ID NO: 181945 - DNA, 30 bp, Artificial Sequence
  Description of Artificial Sequence: Synthetic oligonucleotide
gtagagtcttcaccaagggtactgtcctcc

SEQ ID NO: 181946 - DNA, 32 bp, Artificial Sequence
  Description of Artificial Sequence: Synthetic oligonucleotide
tagagtcttcaccaagggtactgtcctcctag

SEQ ID NO: 181947 - DNA, 31 bp, Artificial Sequence
  Description of Artificial Sequence: Synthetic oligonucleotide
agagtcttcaccaagggtactgtcctcctag

SEQ ID NO: 181948 - DNA, 30 bp, Artificial Sequence
  Description of Artificial Sequence: Synthetic oligonucleotide
gagtcttcaccaagggtactgtcctcctag

SEQ ID NO: 181949 - DNA, 31 bp, Artificial Sequence
  Description of Artificial Sequence: Synthetic oligonucleotide
agtcttcaccaagggtactgtcctcctagac

SEQ ID NO: 181950 - DNA, 30 bp, Artificial Sequence
  Description of Artificial Sequence: Synthetic oligonucleotide
gtcttcaccaagggtactgtcctcctagac

SEQ ID NO: 181951 - DNA, 30 bp, Artificial Sequence
  Description of Artificial Sequence: Synthetic oligonucleotide
tcttcaccaagggtactgtcctcctagacc

SEQ ID NO: 181952 - DNA, 29 bp, Artificial Sequence
  Description of Artificial Sequence: Synthetic oligonucleotide
cttcaccaagggtactgtcctcctagacc

SEQ ID NO: 181953 - DNA, 30 bp, Artificial Sequence
  Description of Artificial Sequence: Synthetic oligonucleotide
ttcaccaagggtactgtcctcctagacctg

SEQ ID NO: 181954 - DNA, 29 bp, Artificial Sequence
  Description of Artificial Sequence: Synthetic oligonucleotide
tcaccaagggtactgtcctcctagacctg

SEQ ID NO: 181955 - DNA, 28 bp, Artificial Sequence
  Description of Artificial Sequence: Synthetic oligonucleotide
caccaagggtactgtcctcctagacctg

SEQ ID NO: 181956 - DNA, 28 bp, Artificial Sequence
  Description of Artificial Sequence: Synthetic oligonucleotide
accaagggtactgtcctcctagacctgc

SEQ ID NO: 181957 - DNA, 27 bp, Artificial Sequence
  Description of Artificial Sequence: Synthetic oligonucleotide
ccaagggtactgtcctcctagacctgc

SEQ ID NO: 181958 - DNA, 29 bp, Artificial Sequence
  Description of Artificial Sequence: Synthetic oligonucleotide
caagggtactgtcctcctagacctgcaag

SEQ ID NO: 181959 - DNA, 30 bp, Artificial Sequence
  Description of Artificial Sequence: Synthetic oligonucleotide
aagggtactgtcctcctagacctgcaagag

SEQ ID NO: 181960 - DNA, 29 bp, Artificial Sequence
  Description of Artificial Sequence: Synthetic oligonucleotide
agggtactgtcctcctagacctgcaagag

SEQ ID NO: 181961 - DNA, 28 bp, Artificial Sequence
  Description of Artificial Sequence: Synthetic oligonucleotide
gggtactgtcctcctagacctgcaagag

SEQ ID NO: 181962 - DNA, 29 bp, Artificial Sequence
  Description of Artificial Sequence: Synthetic oligonucleotide
ggtactgtcctcctagacctgcaagagac

SEQ ID NO: 181963 - DNA, 29 bp, Artificial Sequence
  Description of Artificial Sequence: Synthetic oligonucleotide
gtactgtcctcctagacctgcaagagacc

SEQ ID NO: 181964 - DNA, 30 bp, Artificial Sequence
  Description of Artificial Sequence: Synthetic oligonucleotide
tactgtcctcctagacctgcaagagacctc

SEQ ID NO: 181965 - DNA, 29 bp, Artificial Sequence
  Description of Artificial Sequence: Synthetic oligonucleotide
actgtcctcctagacctgcaagagacctc

SEQ ID NO: 181966 - DNA, 28 bp, Artificial Sequence
  Description of Artificial Sequence: Synthetic oligonucleotide
ctgtcctcctagacctgcaagagacctc

SEQ ID NO: 181967 - DNA, 28 bp, Artificial Sequence
  Description of Artificial Sequence: Synthetic oligonucleotide
tgtcctcctagacctgcaagagacctcc

SEQ ID NO: 181968 - DNA, 27 bp, Artificial Sequence
  Description of Artificial Sequence: Synthetic oligonucleotide
gtcctcctagacctgcaagagacctcc

SEQ ID NO: 181969 - DNA, 27 bp, Artificial Sequence
  Description of Artificial Sequence: Synthetic oligonucleotide
tcctcctagacctgcaagagacctccc

SEQ ID NO: 181970 - DNA, 27 bp, Artificial Sequence
  Description of Artificial Sequence: Synthetic oligonucleotide
cctcctagacctgcaagagacctccct

SEQ ID NO: 181971 - DNA, 27 bp, Artificial Sequence
  Description of Artificial Sequence: Synthetic oligonucleotide
ctcctagacctgcaagagacctccctg

SEQ ID NO: 181972 - DNA, 27 bp, Artificial Sequence
  Description of Artificial Sequence: Synthetic oligonucleotide
tcctagacctgcaagagacctccctgg

SEQ ID NO: 181973 - DNA, 26 bp, Artificial Sequence
  Description of Artificial Sequence: Synthetic oligonucleotide
cctagacctgcaagagacctccctgg

SEQ ID NO: 181974 - DNA, 27 bp, Artificial Sequence
  Description of Artificial Sequence: Synthetic oligonucleotide
ctagacctgcaagagacctccctggct

SEQ ID NO: 181975 - DNA, 27 bp, Artificial Sequence
  Description of Artificial Sequence: Synthetic oligonucleotide
tagacctgcaagagacctccctggctg

SEQ ID NO: 181976 - DNA, 26 bp, Artificial Sequence
  Description of Artificial Sequence: Synthetic oligonucleotide
agacctgcaagagacctccctggctg

SEQ ID NO: 181977 - DNA, 25 bp, Artificial Sequence
  Description of Artificial Sequence: Synthetic oligonucleotide
gacctgcaagagacctccctggctg

SEQ ID NO: 181978 - DNA, 26 bp, Artificial Sequence
  Description of Artificial Sequence: Synthetic oligonucleotide
acctgcaagagacctccctggctgga

SEQ ID NO: 181979 - DNA, 25 bp, Artificial Sequence
  Description of Artificial Sequence: Synthetic oligonucleotide
cctgcaagagacctccctggctgga

SEQ ID NO: 181980 - DNA, 26 bp, Artificial Sequence
  Description of Artificial Sequence: Synthetic oligonucleotide
ctgcaagagacctccctggctggagt

SEQ ID NO: 181981 - DNA, 26 bp, Artificial Sequence
  Description of Artificial Sequence: Synthetic oligonucleotide
tgcaagagacctccctggctggagtg

SEQ ID NO: 181982 - DNA, 25 bp, Artificial Sequence
  Description of Artificial Sequence: Synthetic oligonucleotide
gcaagagacctccctggctggagtg

SEQ ID NO: 181983 - DNA, 25 bp, Artificial Sequence
  Description of Artificial Sequence: Synthetic oligonucleotide
caagagacctccctggctggagtgg

SEQ ID NO: 181984 - DNA, 25 bp, Artificial Sequence
  Description of Artificial Sequence: Synthetic oligonucleotide
aagagacctccctggctggagtggc

SEQ ID NO: 181985 - DNA, 24 bp, Artificial Sequence
  Description of Artificial Sequence: Synthetic oligonucleotide
agagacctccctggctggagtggc

SEQ ID NO: 181986 - DNA, 23 bp, Artificial Sequence
  Description of Artificial Sequence: Synthetic oligonucleotide
gagacctccctggctggagtggc

SEQ ID NO: 181987 - DNA, 25 bp, Artificial Sequence
  Description of Artificial Sequence: Synthetic oligonucleotide
agacctccctggctggagtggccaa

SEQ ID NO: 181988 - DNA, 24 bp, Artificial Sequence
  Description of Artificial Sequence: Synthetic oligonucleotide
gacctccctggctggagtggccaa

SEQ ID NO: 181989 - DNA, 24 bp, Artificial Sequence
  Description of Artificial Sequence: Synthetic oligonucleotide
acctccctggctggagtggccaac

SEQ ID NO: 181990 - DNA, 23 bp, Artificial Sequence
  Description of Artificial Sequence: Synthetic oligonucleotide
cctccctggctggagtggccaac

SEQ ID NO: 181991 - DNA, 25 bp, Artificial Sequence
  Description of Artificial Sequence: Synthetic oligonucleotide
ctccctggctggagtggccaaccaa

SEQ ID NO: 181992 - DNA, 26 bp, Artificial Sequence
  Description of Artificial Sequence: Synthetic oligonucleotide
tccctggctggagtggccaaccaact

SEQ ID NO: 181993 - DNA, 25 bp, Artificial Sequence
  Description of Artificial Sequence: Synthetic oligonucleotide
ccctggctggagtggccaaccaact

SEQ ID NO: 181994 - DNA, 25 bp, Artificial Sequence
  Description of Artificial Sequence: Synthetic oligonucleotide
cctggctggagtggccaaccaactg

SEQ ID NO: 181995 - DNA, 27 bp, Artificial Sequence
  Description of Artificial Sequence: Synthetic oligonucleotide
ctggctggagtggccaaccaactgcta

SEQ ID NO: 181996 - DNA, 27 bp, Artificial Sequence
  Description of Artificial Sequence: Synthetic oligonucleotide
tggctggagtggccaaccaactgctag

SEQ ID NO: 181997 - DNA, 27 bp, Artificial Sequence
  Description of Artificial Sequence: Synthetic oligonucleotide
ggctggagtggccaaccaactgctaga

SEQ ID NO: 181998 - DNA, 27 bp, Artificial Sequence
  Description of Artificial Sequence: Synthetic oligonucleotide
gctggagtggccaaccaactgctagac

SEQ ID NO: 181999 - DNA, 28 bp, Artificial Sequence
  Description of Artificial Sequence: Synthetic oligonucleotide
ctggagtggccaaccaactgctagacag

SEQ ID NO: 182000 - DNA, 28 bp, Artificial Sequence
  Description of Artificial Sequence: Synthetic oligonucleotide
tggagtggccaaccaactgctagacagg

SEQ ID NO: 182001 - DNA, 27 bp, Artificial Sequence
  Description of Artificial Sequence: Synthetic oligonucleotide
ggagtggccaaccaactgctagacagg

SEQ ID NO: 182002 - DNA, 32 bp, Artificial Sequence
  Description of Artificial Sequence: Synthetic oligonucleotide
gagtggccaaccaactgctagacaggtttatc

SEQ ID NO: 182003 - DNA, 35 bp, Artificial Sequence
  Description of Artificial Sequence: Synthetic oligonucleotide
agtggccaaccaactgctagacaggtttatctttg

SEQ ID NO: 182004 - DNA, 34 bp, Artificial Sequence
  Description of Artificial Sequence: Synthetic oligonucleotide
gtggccaaccaactgctagacaggtttatctttg

SEQ ID NO: 182005 - DNA, 36 bp, Artificial Sequence
  Description of Artificial Sequence: Synthetic oligonucleotide
tggccaaccaactgctagacaggtttatctttgaag

SEQ ID NO: 182006 - DNA, 35 bp, Artificial Sequence
  Description of Artificial Sequence: Synthetic oligonucleotide
ggccaaccaactgctagacaggtttatctttgaag

SEQ ID NO: 182007 - DNA, 36 bp, Artificial Sequence
  Description of Artificial Sequence: Synthetic oligonucleotide
gccaaccaactgctagacaggtttatctttgaagac

SEQ ID NO: 182008 - DNA, 36 bp, Artificial Sequence
  Description of Artificial Sequence: Synthetic oligonucleotide
ccaaccaactgctagacaggtttatctttgaagacc

SEQ ID NO: 182009 - DNA, 37 bp, Artificial Sequence
  Description of Artificial Sequence: Synthetic oligonucleotide
caaccaactgctagacaggtttatctttgaagaccag

SEQ ID NO: 182010 - DNA, 39 bp, Artificial Sequence
  Description of Artificial Sequence: Synthetic oligonucleotide
aaccaactgctagacaggtttatctttgaagaccagatc

SEQ ID NO: 182011 - DNA, 38 bp, Artificial Sequence
  Description of Artificial Sequence: Synthetic oligonucleotide
accaactgctagacaggtttatctttgaagaccagatc

SEQ ID NO: 182012 - DNA, 37 bp, Artificial Sequence
  Description of Artificial Sequence: Synthetic oligonucleotide
ccaactgctagacaggtttatctttgaagaccagatc

SEQ ID NO: 182013 - DNA, 37 bp, Artificial Sequence
  Description of Artificial Sequence: Synthetic oligonucleotide
caactgctagacaggtttatctttgaagaccagatcc

SEQ ID NO: 182014 - DNA, 37 bp, Artificial Sequence
  Description of Artificial Sequence: Synthetic oligonucleotide
aactgctagacaggtttatctttgaagaccagatccg

SEQ ID NO: 182015 - DNA, 36 bp, Artificial Sequence
  Description of Artificial Sequence: Synthetic oligonucleotide
actgctagacaggtttatctttgaagaccagatccg

SEQ ID NO: 182016 - DNA, 35 bp, Artificial Sequence
  Description of Artificial Sequence: Synthetic oligonucleotide
ctgctagacaggtttatctttgaagaccagatccg

SEQ ID NO: 182017 - DNA, 35 bp, Artificial Sequence
  Description of Artificial Sequence: Synthetic oligonucleotide
tgctagacaggtttatctttgaagaccagatccgg

SEQ ID NO: 182018 - DNA, 34 bp, Artificial Sequence
  Description of Artificial Sequence: Synthetic oligonucleotide
gctagacaggtttatctttgaagaccagatccgg

SEQ ID NO: 182019 - DNA, 34 bp, Artificial Sequence
  Description of Artificial Sequence: Synthetic oligonucleotide
ctagacaggtttatctttgaagaccagatccggc

SEQ ID NO: 182020 - DNA, 34 bp, Artificial Sequence
  Description of Artificial Sequence: Synthetic oligonucleotide
tagacaggtttatctttgaagaccagatccggcc

SEQ ID NO: 182021 - DNA, 33 bp, Artificial Sequence
  Description of Artificial Sequence: Synthetic oligonucleotide
agacaggtttatctttgaagaccagatccggcc

SEQ ID NO: 182022 - DNA, 32 bp, Artificial Sequence
  Description of Artificial Sequence: Synthetic oligonucleotide
gacaggtttatctttgaagaccagatccggcc

SEQ ID NO: 182023 - DNA, 33 bp, Artificial Sequence
  Description of Artificial Sequence: Synthetic oligonucleotide
acaggtttatctttgaagaccagatccggcctc

SEQ ID NO: 182024 - DNA, 32 bp, Artificial Sequence
  Description of Artificial Sequence: Synthetic oligonucleotide
caggtttatctttgaagaccagatccggcctc

SEQ ID NO: 182025 - DNA, 33 bp, Artificial Sequence
  Description of Artificial Sequence: Synthetic oligonucleotide
aggtttatctttgaagaccagatccggcctcag

SEQ ID NO: 182026 - DNA, 32 bp, Artificial Sequence
  Description of Artificial Sequence: Synthetic oligonucleotide
ggtttatctttgaagaccagatccggcctcag

SEQ ID NO: 182027 - DNA, 32 bp, Artificial Sequence
  Description of Artificial Sequence: Synthetic oligonucleotide
gtttatctttgaagaccagatccggcctcagg

SEQ ID NO: 182028 - DNA, 33 bp, Artificial Sequence
  Description of Artificial Sequence: Synthetic oligonucleotide
tttatctttgaagaccagatccggcctcaggac

SEQ ID NO: 182029 - DNA, 32 bp, Artificial Sequence
  Description of Artificial Sequence: Synthetic oligonucleotide
ttatctttgaagaccagatccggcctcaggac

SEQ ID NO: 182030 - DNA, 31 bp, Artificial Sequence
  Description of Artificial Sequence: Synthetic oligonucleotide
tatctttgaagaccagatccggcctcaggac

SEQ ID NO: 182031 - DNA, 30 bp, Artificial Sequence
  Description of Artificial Sequence: Synthetic oligonucleotide
atctttgaagaccagatccggcctcaggac

SEQ ID NO: 182032 - DNA, 29 bp, Artificial Sequence
  Description of Artificial Sequence: Synthetic oligonucleotide
tctttgaagaccagatccggcctcaggac

SEQ ID NO: 182033 - DNA, 28 bp, Artificial Sequence
  Description of Artificial Sequence: Synthetic oligonucleotide
ctttgaagaccagatccggcctcaggac

SEQ ID NO: 182034 - DNA, 28 bp, Artificial Sequence
  Description of Artificial Sequence: Synthetic oligonucleotide
tttgaagaccagatccggcctcaggacc

SEQ ID NO: 182035 - DNA, 27 bp, Artificial Sequence
  Description of Artificial Sequence: Synthetic oligonucleotide
ttgaagaccagatccggcctcaggacc

SEQ ID NO: 182036 - DNA, 26 bp, Artificial Sequence
  Description of Artificial Sequence: Synthetic oligonucleotide
tgaagaccagatccggcctcaggacc

SEQ ID NO: 182037 - DNA, 25 bp, Artificial Sequence
  Description of Artificial Sequence: Synthetic oligonucleotide
gaagaccagatccggcctcaggacc

SEQ ID NO: 182038 - DNA, 26 bp, Artificial Sequence
  Description of Artificial Sequence: Synthetic oligonucleotide
aagaccagatccggcctcaggaccga

SEQ ID NO: 182039 - DNA, 25 bp, Artificial Sequence
  Description of Artificial Sequence: Synthetic oligonucleotide
agaccagatccggcctcaggaccga

SEQ ID NO: 182040 - DNA, 24 bp, Artificial Sequence
  Description of Artificial Sequence: Synthetic oligonucleotide
gaccagatccggcctcaggaccga

SEQ ID NO: 182041 - DNA, 25 bp, Artificial Sequence
  Description of Artificial Sequence: Synthetic oligonucleotide
accagatccggcctcaggaccgaga

SEQ ID NO: 182042 - DNA, 24 bp, Artificial Sequence
  Description of Artificial Sequence: Synthetic oligonucleotide
ccagatccggcctcaggaccgaga

SEQ ID NO: 182043 - DNA, 24 bp, Artificial Sequence
  Description of Artificial Sequence: Synthetic oligonucleotide
cagatccggcctcaggaccgagag

SEQ ID NO: 182044 - DNA, 25 bp, Artificial Sequence
  Description of Artificial Sequence: Synthetic oligonucleotide
agatccggcctcaggaccgagagga

SEQ ID NO: 182045 - DNA, 24 bp, Artificial Sequence
  Description of Artificial Sequence: Synthetic oligonucleotide
gatccggcctcaggaccgagagga

SEQ ID NO: 182046 - DNA, 24 bp, Artificial Sequence
  Description of Artificial Sequence: Synthetic oligonucleotide
atccggcctcaggaccgagaggag

SEQ ID NO: 182047 - DNA, 23 bp, Artificial Sequence
  Description of Artificial Sequence: Synthetic oligonucleotide
tccggcctcaggaccgagaggag

SEQ ID NO: 182048 - DNA, 22 bp, Artificial Sequence
  Description of Artificial Sequence: Synthetic oligonucleotide
ccggcctcaggaccgagaggag

SEQ ID NO: 182049 - DNA, 23 bp, Artificial Sequence
  Description of Artificial Sequence: Synthetic oligonucleotide
cggcctcaggaccgagaggagct

SEQ ID NO: 182050 - DNA, 23 bp, Artificial Sequence
  Description of Artificial Sequence: Synthetic oligonucleotide
ggcctcaggaccgagaggagctg

SEQ ID NO: 182051 - DNA, 24 bp, Artificial Sequence
  Description of Artificial Sequence: Synthetic oligonucleotide
gcctcaggaccgagaggagctgct

SEQ ID NO: 182052 - DNA, 24 bp, Artificial Sequence
  Description of Artificial Sequence: Synthetic oligonucleotide
cctcaggaccgagaggagctgctc

SEQ ID NO: 182053 - DNA, 24 bp, Artificial Sequence
  Description of Artificial Sequence: Synthetic oligonucleotide
ctcaggaccgagaggagctgctcc

SEQ ID NO: 182054 - DNA, 24 bp, Artificial Sequence
  Description of Artificial Sequence: Synthetic oligonucleotide
tcaggaccgagaggagctgctccg

SEQ ID NO: 182055 - DNA, 23 bp, Artificial Sequence
  Description of Artificial Sequence: Synthetic oligonucleotide
caggaccgagaggagctgctccg

SEQ ID NO: 182056 - DNA, 23 bp, Artificial Sequence
  Description of Artificial Sequence: Synthetic oligonucleotide
aggaccgagaggagctgctccgg

SEQ ID NO: 182057 - DNA, 22 bp, Artificial Sequence
  Description of Artificial Sequence: Synthetic oligonucleotide
ggaccgagaggagctgctccgg

SEQ ID NO: 182058 - DNA, 22 bp, Artificial Sequence
  Description of Artificial Sequence: Synthetic oligonucleotide
gaccgagaggagctgctccggg

SEQ ID NO: 182059 - DNA, 22 bp, Artificial Sequence
  Description of Artificial Sequence: Synthetic oligonucleotide
accgagaggagctgctccgggc

SEQ ID NO: 182060 - DNA, 21 bp, Artificial Sequence
  Description of Artificial Sequence: Synthetic oligonucleotide
ccgagaggagctgctccgggc

SEQ ID NO: 182061 - DNA, 21 bp, Artificial Sequence
  Description of Artificial Sequence: Synthetic oligonucleotide
cgagaggagctgctccgggcc

SEQ ID NO: 182062 - DNA, 22 bp, Artificial Sequence
  Description of Artificial Sequence: Synthetic oligonucleotide
gagaggagctgctccgggccct

SEQ ID NO: 182063 - DNA, 22 bp, Artificial Sequence
  Description of Artificial Sequence: Synthetic oligonucleotide
agaggagctgctccgggccctg

SEQ ID NO: 182064 - DNA, 21 bp, Artificial Sequence
  Description of Artificial Sequence: Synthetic oligonucleotide
gaggagctgctccgggccctg

SEQ ID NO: 182065 - DNA, 22 bp, Artificial Sequence
  Description of Artificial Sequence: Synthetic oligonucleotide
aggagctgctccgggccctgct

SEQ ID NO: 182066 - DNA, 21 bp, Artificial Sequence
  Description of Artificial Sequence: Synthetic oligonucleotide
ggagctgctccgggccctgct

SEQ ID NO: 182067 - DNA, 21 bp, Artificial Sequence
  Description of Artificial Sequence: Synthetic oligonucleotide
gagctgctccgggccctgctg

SEQ ID NO: 182068 - DNA, 26 bp, Artificial Sequence
  Description of Artificial Sequence: Synthetic oligonucleotide
agctgctccgggccctgctgcttaaa

SEQ ID NO: 182069 - DNA, 25 bp, Artificial Sequence
  Description of Artificial Sequence: Synthetic oligonucleotide
gctgctccgggccctgctgcttaaa

SEQ ID NO: 182070 - DNA, 26 bp, Artificial Sequence
  Description of Artificial Sequence: Synthetic oligonucleotide
ctgctccgggccctgctgcttaaaca

SEQ ID NO: 182071 - DNA, 27 bp, Artificial Sequence
  Description of Artificial Sequence: Synthetic oligonucleotide
tgctccgggccctgctgcttaaacaca

SEQ ID NO: 182072 - DNA, 26 bp, Artificial Sequence
  Description of Artificial Sequence: Synthetic oligonucleotide
gctccgggccctgctgcttaaacaca

SEQ ID NO: 182073 - DNA, 26 bp, Artificial Sequence
  Description of Artificial Sequence: Synthetic oligonucleotide
ctccgggccctgctgcttaaacacag

SEQ ID NO: 182074 - DNA, 26 bp, Artificial Sequence
  Description of Artificial Sequence: Synthetic oligonucleotide
tccgggccctgctgcttaaacacagc

SEQ ID NO: 182075 - DNA, 25 bp, Artificial Sequence
  Description of Artificial Sequence: Synthetic oligonucleotide
ccgggccctgctgcttaaacacagc

SEQ ID NO: 182076 - DNA, 26 bp, Artificial Sequence
  Description of Artificial Sequence: Synthetic oligonucleotide
cgggccctgctgcttaaacacagcca

SEQ ID NO: 182077 - DNA, 26 bp, Artificial Sequence
  Description of Artificial Sequence: Synthetic oligonucleotide
gggccctgctgcttaaacacagccac

SEQ ID NO: 182078 - DNA, 26 bp, Artificial Sequence
  Description of Artificial Sequence: Synthetic oligonucleotide
ggccctgctgcttaaacacagccacg

SEQ ID NO: 182079 - DNA, 27 bp, Artificial Sequence
  Description of Artificial Sequence: Synthetic oligonucleotide
gccctgctgcttaaacacagccacgct

SEQ ID NO: 182080 - DNA, 27 bp, Artificial Sequence
  Description of Artificial Sequence: Synthetic oligonucleotide
ccctgctgcttaaacacagccacgctg

SEQ ID NO: 182081 - DNA, 27 bp, Artificial Sequence
  Description of Artificial Sequence: Synthetic oligonucleotide
cctgctgcttaaacacagccacgctgg

SEQ ID NO: 182082 - DNA, 28 bp, Artificial Sequence
  Description of Artificial Sequence: Synthetic oligonucleotide
ctgctgcttaaacacagccacgctggag

SEQ ID NO: 182083 - DNA, 29 bp, Artificial Sequence
  Description of Artificial Sequence: Synthetic oligonucleotide
tgctgcttaaacacagccacgctggagag

SEQ ID NO: 182084 - DNA, 28 bp, Artificial Sequence
  Description of Artificial Sequence: Synthetic oligonucleotide
gctgcttaaacacagccacgctggagag

SEQ ID NO: 182085 - DNA, 28 bp, Artificial Sequence
  Description of Artificial Sequence: Synthetic oligonucleotide
ctgcttaaacacagccacgctggagagc

SEQ ID NO: 182086 - DNA, 29 bp, Artificial Sequence
  Description of Artificial Sequence: Synthetic oligonucleotide
tgcttaaacacagccacgctggagagctg

SEQ ID NO: 182087 - DNA, 28 bp, Artificial Sequence
  Description of Artificial Sequence: Synthetic oligonucleotide
gcttaaacacagccacgctggagagctg

SEQ ID NO: 182088 - DNA, 28 bp, Artificial Sequence
  Description of Artificial Sequence: Synthetic oligonucleotide
cttaaacacagccacgctggagagctgg

SEQ ID NO: 182089 - DNA, 29 bp, Artificial Sequence
  Description of Artificial Sequence: Synthetic oligonucleotide
ttaaacacagccacgctggagagctggag

SEQ ID NO: 182090 - DNA, 28 bp, Artificial Sequence
  Description of Artificial Sequence: Synthetic oligonucleotide
taaacacagccacgctggagagctggag

SEQ ID NO: 182091 - DNA, 27 bp, Artificial Sequence
  Description of Artificial Sequence: Synthetic oligonucleotide
aaacacagccacgctggagagctggag

SEQ ID NO: 182092 - DNA, 26 bp, Artificial Sequence
  Description of Artificial Sequence: Synthetic oligonucleotide
aacacagccacgctggagagctggag

SEQ ID NO: 182093 - DNA, 25 bp, Artificial Sequence
  Description of Artificial Sequence: Synthetic oligonucleotide
acacagccacgctggagagctggag

SEQ ID NO: 182094 - DNA, 24 bp, Artificial Sequence
  Description of Artificial Sequence: Synthetic oligonucleotide
cacagccacgctggagagctggag

SEQ ID NO: 182095 - DNA, 24 bp, Artificial Sequence
  Description of Artificial Sequence: Synthetic oligonucleotide
acagccacgctggagagctggagg

SEQ ID NO: 182096 - DNA, 23 bp, Artificial Sequence
  Description of Artificial Sequence: Synthetic oligonucleotide
cagccacgctggagagctggagg

SEQ ID NO: 182097 - DNA, 23 bp, Artificial Sequence
  Description of Artificial Sequence: Synthetic oligonucleotide
agccacgctggagagctggaggc

SEQ ID NO: 182098 - DNA, 22 bp, Artificial Sequence
  Description of Artificial Sequence: Synthetic oligonucleotide
gccacgctggagagctggaggc

SEQ ID NO: 182099 - DNA, 22 bp, Artificial Sequence
  Description of Artificial Sequence: Synthetic oligonucleotide
ccacgctggagagctggaggcc

SEQ ID NO: 182100 - DNA, 23 bp, Artificial Sequence
  Description of Artificial Sequence: Synthetic oligonucleotide
cacgctggagagctggaggccct

SEQ ID NO: 182101 - DNA, 23 bp, Artificial Sequence
  Description of Artificial Sequence: Synthetic oligonucleotide
acgctggagagctggaggccctg

SEQ ID NO: 182102 - DNA, 22 bp, Artificial Sequence
  Description of Artificial Sequence: Synthetic oligonucleotide
cgctggagagctggaggccctg

SEQ ID NO: 182103 - DNA, 22 bp, Artificial Sequence
  Description of Artificial Sequence: Synthetic oligonucleotide
gctggagagctggaggccctgg

SEQ ID NO: 182104 - DNA, 22 bp, Artificial Sequence
  Description of Artificial Sequence: Synthetic oligonucleotide
ctggagagctggaggccctggg

SEQ ID NO: 182105 - DNA, 22 bp, Artificial Sequence
  Description of Artificial Sequence: Synthetic oligonucleotide
tggagagctggaggccctgggg

SEQ ID NO: 182106 - DNA, 21 bp, Artificial Sequence
  Description of Artificial Sequence: Synthetic oligonucleotide
ggagagctggaggccctgggg

SEQ ID NO: 182107 - DNA, 21 bp, Artificial Sequence
  Description of Artificial Sequence: Synthetic oligonucleotide
gagagctggaggccctggggg

SEQ ID NO: 182108 - DNA, 22 bp, Artificial Sequence
  Description of Artificial Sequence: Synthetic oligonucleotide
agagctggaggccctggggggt

SEQ ID NO: 182109 - DNA, 21 bp, Artificial Sequence
  Description of Artificial Sequence: Synthetic oligonucleotide
gagctggaggccctggggggt

SEQ ID NO: 182110 - DNA, 22 bp, Artificial Sequence
  Description of Artificial Sequence: Synthetic oligonucleotide
agctggaggccctggggggtgt

SEQ ID NO: 182111 - DNA, 21 bp, Artificial Sequence
  Description of Artificial Sequence: Synthetic oligonucleotide
gctggaggccctggggggtgt

SEQ ID NO: 182112 - DNA, 23 bp, Artificial Sequence
  Description of Artificial Sequence: Synthetic oligonucleotide
ctggaggccctggggggtgtgaa

SEQ ID NO: 182113 - DNA, 23 bp, Artificial Sequence
  Description of Artificial Sequence: Synthetic oligonucleotide
tggaggccctggggggtgtgaag

SEQ ID NO: 182114 - DNA, 22 bp, Artificial Sequence
  Description of Artificial Sequence: Synthetic oligonucleotide
ggaggccctggggggtgtgaag

SEQ ID NO: 182115 - DNA, 22 bp, Artificial Sequence
  Description of Artificial Sequence: Synthetic oligonucleotide
gaggccctggggggtgtgaagc

SEQ ID NO: 182116 - DNA, 23 bp, Artificial Sequence
  Description of Artificial Sequence: Synthetic oligonucleotide
aggccctggggggtgtgaagcct

SEQ ID NO: 182117 - DNA, 22 bp, Artificial Sequence
  Description of Artificial Sequence: Synthetic oligonucleotide
ggccctggggggtgtgaagcct

SEQ ID NO: 182118 - DNA, 22 bp, Artificial Sequence
  Description of Artificial Sequence: Synthetic oligonucleotide
gccctggggggtgtgaagcctg

SEQ ID NO: 182119 - DNA, 23 bp, Artificial Sequence
  Description of Artificial Sequence: Synthetic oligonucleotide
ccctggggggtgtgaagcctgca

SEQ ID NO: 182120 - DNA, 24 bp, Artificial Sequence
  Description of Artificial Sequence: Synthetic oligonucleotide
cctggggggtgtgaagcctgcagt

SEQ ID NO: 182121 - DNA, 24 bp, Artificial Sequence
  Description of Artificial Sequence: Synthetic oligonucleotide
ctggggggtgtgaagcctgcagtc

SEQ ID NO: 182122 - DNA, 25 bp, Artificial Sequence
  Description of Artificial Sequence: Synthetic oligonucleotide
tggggggtgtgaagcctgcagtcct

SEQ ID NO: 182123 - DNA, 24 bp, Artificial Sequence
  Description of Artificial Sequence: Synthetic oligonucleotide
ggggggtgtgaagcctgcagtcct

SEQ ID NO: 182124 - DNA, 25 bp, Artificial Sequence
  Description of Artificial Sequence: Synthetic oligonucleotide
gggggtgtgaagcctgcagtcctga

SEQ ID NO: 182125 - DNA, 26 bp, Artificial Sequence
  Description of Artificial Sequence: Synthetic oligonucleotide
ggggtgtgaagcctgcagtcctgaca

SEQ ID NO: 182126 - DNA, 26 bp, Artificial Sequence
  Description of Artificial Sequence: Synthetic oligonucleotide
gggtgtgaagcctgcagtcctgacac

SEQ ID NO: 182127 - DNA, 26 bp, Artificial Sequence
  Description of Artificial Sequence: Synthetic oligonucleotide
ggtgtgaagcctgcagtcctgacacg

SEQ ID NO: 182128 - DNA, 27 bp, Artificial Sequence
  Description of Artificial Sequence: Synthetic oligonucleotide
gtgtgaagcctgcagtcctgacacgct

SEQ ID NO: 182129 - DNA, 27 bp, Artificial Sequence
  Description of Artificial Sequence: Synthetic oligonucleotide
tgtgaagcctgcagtcctgacacgctc

SEQ ID NO: 182130 - DNA, 27 bp, Artificial Sequence
  Description of Artificial Sequence: Synthetic oligonucleotide
gtgaagcctgcagtcctgacacgctct

SEQ ID NO: 182131 - DNA, 27 bp, Artificial Sequence
  Description of Artificial Sequence: Synthetic oligonucleotide
tgaagcctgcagtcctgacacgctctg

SEQ ID NO: 182132 - DNA, 26 bp, Artificial Sequence
  Description of Artificial Sequence: Synthetic oligonucleotide
gaagcctgcagtcctgacacgctctg

SEQ ID NO: 182133 - DNA, 26 bp, Artificial Sequence
  Description of Artificial Sequence: Synthetic oligonucleotide
aagcctgcagtcctgacacgctctgg

SEQ ID NO: 182134 - DNA, 25 bp, Artificial Sequence
  Description of Artificial Sequence: Synthetic oligonucleotide
agcctgcagtcctgacacgctctgg

SEQ ID NO: 182135 - DNA, 24 bp, Artificial Sequence
  Description of Artificial Sequence: Synthetic oligonucleotide
gcctgcagtcctgacacgctctgg

SEQ ID NO: 182136 - DNA, 24 bp, Artificial Sequence
  Description of Artificial Sequence: Synthetic oligonucleotide
cctgcagtcctgacacgctctggg

SEQ ID NO: 182137 - DNA, 26 bp, Artificial Sequence
  Description of Artificial Sequence: Synthetic oligonucleotide
ctgcagtcctgacacgctctggggat

SEQ ID NO: 182138 - DNA, 26 bp, Artificial Sequence
  Description of Artificial Sequence: Synthetic oligonucleotide
tgcagtcctgacacgctctggggatc

SEQ ID NO: 182139 - DNA, 25 bp, Artificial Sequence
  Description of Artificial Sequence: Synthetic oligonucleotide
gcagtcctgacacgctctggggatc

SEQ ID NO: 182140 - DNA, 27 bp, Artificial Sequence
  Description of Artificial Sequence: Synthetic oligonucleotide
cagtcctgacacgctctggggatcctt

SEQ ID NO: 182141 - DNA, 27 bp, Artificial Sequence
  Description of Artificial Sequence: Synthetic oligonucleotide
agtcctgacacgctctggggatccttc

SEQ ID NO: 182142 - DNA, 27 bp, Artificial Sequence
  Description of Artificial Sequence: Synthetic oligonucleotide
gtcctgacacgctctggggatccttca

SEQ ID NO: 182143 - DNA, 27 bp, Artificial Sequence
  Description of Artificial Sequence: Synthetic oligonucleotide
tcctgacacgctctggggatccttcac

SEQ ID NO: 182144 - DNA, 27 bp, Artificial Sequence
  Description of Artificial Sequence: Synthetic oligonucleotide
cctgacacgctctggggatccttcaca

SEQ ID NO: 182145 - DNA, 27 bp, Artificial Sequence
  Description of Artificial Sequence: Synthetic oligonucleotide
ctgacacgctctggggatccttcacag

SEQ ID NO: 182146 - DNA, 27 bp, Artificial Sequence
  Description of Artificial Sequence: Synthetic oligonucleotide
tgacacgctctggggatccttcacagc

SEQ ID NO: 182147 - DNA, 26 bp, Artificial Sequence
  Description of Artificial Sequence: Synthetic oligonucleotide
gacacgctctggggatccttcacagc

SEQ ID NO: 182148 - DNA, 27 bp, Artificial Sequence
  Description of Artificial Sequence: Synthetic oligonucleotide
acacgctctggggatccttcacagcct

SEQ ID NO: 182149 - DNA, 26 bp, Artificial Sequence
  Description of Artificial Sequence: Synthetic oligonucleotide
cacgctctggggatccttcacagcct

SEQ ID NO: 182150 - DNA, 27 bp, Artificial Sequence
  Description of Artificial Sequence: Synthetic oligonucleotide
acgctctggggatccttcacagcctct

SEQ ID NO: 182151 - DNA, 26 bp, Artificial Sequence
  Description of Artificial Sequence: Synthetic oligonucleotide
cgctctggggatccttcacagcctct

SEQ ID NO: 182152 - DNA, 26 bp, Artificial Sequence
  Description of Artificial Sequence: Synthetic oligonucleotide
gctctggggatccttcacagcctctg

SEQ ID NO: 182153 - DNA, 27 bp, Artificial Sequence
  Description of Artificial Sequence: Synthetic oligonucleotide
ctctggggatccttcacagcctctgct

SEQ ID NO: 182154 - DNA, 27 bp, Artificial Sequence
  Description of Artificial Sequence: Synthetic oligonucleotide
tctggggatccttcacagcctctgctc

SEQ ID NO: 182155 - DNA, 26 bp, Artificial Sequence
  Description of Artificial Sequence: Synthetic oligonucleotide
ctggggatccttcacagcctctgctc

SEQ ID NO: 182156 - DNA, 26 bp, Artificial Sequence
  Description of Artificial Sequence: Synthetic oligonucleotide
tggggatccttcacagcctctgctcc

SEQ ID NO: 182157 - DNA, 25 bp, Artificial Sequence
  Description of Artificial Sequence: Synthetic oligonucleotide
ggggatccttcacagcctctgctcc

SEQ ID NO: 182158 - DNA, 25 bp, Artificial Sequence
  Description of Artificial Sequence: Synthetic oligonucleotide
gggatccttcacagcctctgctccc

SEQ ID NO: 182159 - DNA, 25 bp, Artificial Sequence
  Description of Artificial Sequence: Synthetic oligonucleotide
ggatccttcacagcctctgctcccc

SEQ ID NO: 182160 - DNA, 27 bp, Artificial Sequence
  Description of Artificial Sequence: Synthetic oligonucleotide
gatccttcacagcctctgctcccccaa

SEQ ID NO: 182161 - DNA, 27 bp, Artificial Sequence
  Description of Artificial Sequence: Synthetic oligonucleotide
atccttcacagcctctgctcccccaac

SEQ ID NO: 182162 - DNA, 27 bp, Artificial Sequence
  Description of Artificial Sequence: Synthetic oligonucleotide
tccttcacagcctctgctcccccaaca

SEQ ID NO: 182163 - DNA, 26 bp, Artificial Sequence
  Description of Artificial Sequence: Synthetic oligonucleotide
ccttcacagcctctgctcccccaaca

SEQ ID NO: 182164 - DNA, 27 bp, Artificial Sequence
  Description of Artificial Sequence: Synthetic oligonucleotide
cttcacagcctctgctcccccaacact

SEQ ID NO: 182165 - DNA, 27 bp, Artificial Sequence
  Description of Artificial Sequence: Synthetic oligonucleotide
ttcacagcctctgctcccccaacactc

SEQ ID NO: 182166 - DNA, 26 bp, Artificial Sequence
  Description of Artificial Sequence: Synthetic oligonucleotide
tcacagcctctgctcccccaacactc

SEQ ID NO: 182167 - DNA, 25 bp, Artificial Sequence
  Description of Artificial Sequence: Synthetic oligonucleotide
cacagcctctgctcccccaacactc

SEQ ID NO: 182168 - DNA, 26 bp, Artificial Sequence
  Description of Artificial Sequence: Synthetic oligonucleotide
acagcctctgctcccccaacactcct

SEQ ID NO: 182169 - DNA, 25 bp, Artificial Sequence
  Description of Artificial Sequence: Synthetic oligonucleotide
cagcctctgctcccccaacactcct

SEQ ID NO: 182170 - DNA, 26 bp, Artificial Sequence
  Description of Artificial Sequence: Synthetic oligonucleotide
agcctctgctcccccaacactcctca

SEQ ID NO: 182171 - DNA, 25 bp, Artificial Sequence
  Description of Artificial Sequence: Synthetic oligonucleotide
gcctctgctcccccaacactcctca

SEQ ID NO: 182172 - DNA, 26 bp, Artificial Sequence
  Description of Artificial Sequence: Synthetic oligonucleotide
cctctgctcccccaacactcctcact

SEQ ID NO: 182173 - DNA, 26 bp, Artificial Sequence
  Description of Artificial Sequence: Synthetic oligonucleotide
ctctgctcccccaacactcctcactg

SEQ ID NO: 182174 - DNA, 27 bp, Artificial Sequence
  Description of Artificial Sequence: Synthetic oligonucleotide
tctgctcccccaacactcctcactgga

SEQ ID NO: 182175 - DNA, 26 bp, Artificial Sequence
  Description of Artificial Sequence: Synthetic oligonucleotide
ctgctcccccaacactcctcactgga

SEQ ID NO: 182176 - DNA, 27 bp, Artificial Sequence
  Description of Artificial Sequence: Synthetic oligonucleotide
tgctcccccaacactcctcactggaga

SEQ ID NO: 182177 - DNA, 26 bp, Artificial Sequence
  Description of Artificial Sequence: Synthetic oligonucleotide
gctcccccaacactcctcactggaga

SEQ ID NO: 182178 - DNA, 27 bp, Artificial Sequence
  Description of Artificial Sequence: Synthetic oligonucleotide
ctcccccaacactcctcactggagaca

SEQ ID NO: 182179 - DNA, 27 bp, Artificial Sequence
  Description of Artificial Sequence: Synthetic oligonucleotide
tcccccaacactcctcactggagacac

SEQ ID NO: 182180 - DNA, 27 bp, Artificial Sequence
  Description of Artificial Sequence: Synthetic oligonucleotide
cccccaacactcctcactggagacaca

SEQ ID NO: 182181 - DNA, 27 bp, Artificial Sequence
  Description of Artificial Sequence: Synthetic oligonucleotide
ccccaacactcctcactggagacacag

SEQ ID NO: 182182 - DNA, 27 bp, Artificial Sequence
  Description of Artificial Sequence: Synthetic oligonucleotide
cccaacactcctcactggagacacagc

SEQ ID NO: 182183 - DNA, 28 bp, Artificial Sequence
  Description of Artificial Sequence: Synthetic oligonucleotide
ccaacactcctcactggagacacagctc

SEQ ID NO: 182184 - DNA, 30 bp, Artificial Sequence
  Description of Artificial Sequence: Synthetic oligonucleotide
caacactcctcactggagacacagctcttc

SEQ ID NO: 182185 - DNA, 31 bp, Artificial Sequence
  Description of Artificial Sequence: Synthetic oligonucleotide
aacactcctcactggagacacagctcttctg

SEQ ID NO: 182186 - DNA, 30 bp, Artificial Sequence
  Description of Artificial Sequence: Synthetic oligonucleotide
acactcctcactggagacacagctcttctg

SEQ ID NO: 182187 - DNA, 29 bp, Artificial Sequence
  Description of Artificial Sequence: Synthetic oligonucleotide
cactcctcactggagacacagctcttctg

SEQ ID NO: 182188 - DNA, 30 bp, Artificial Sequence
  Description of Artificial Sequence: Synthetic oligonucleotide
actcctcactggagacacagctcttctgtg

SEQ ID NO: 182189 - DNA, 29 bp, Artificial Sequence
  Description of Artificial Sequence: Synthetic oligonucleotide
ctcctcactggagacacagctcttctgtg

SEQ ID NO: 182190 - DNA, 30 bp, Artificial Sequence
  Description of Artificial Sequence: Synthetic oligonucleotide
tcctcactggagacacagctcttctgtgag

SEQ ID NO: 182191 - DNA, 29 bp, Artificial Sequence
  Description of Artificial Sequence: Synthetic oligonucleotide
cctcactggagacacagctcttctgtgag

SEQ ID NO: 182192 - DNA, 29 bp, Artificial Sequence
  Description of Artificial Sequence: Synthetic oligonucleotide
ctcactggagacacagctcttctgtgagc

SEQ ID NO: 182193 - DNA, 30 bp, Artificial Sequence
  Description of Artificial Sequence: Synthetic oligonucleotide
tcactggagacacagctcttctgtgagcag

SEQ ID NO: 182194 - DNA, 29 bp, Artificial Sequence
  Description of Artificial Sequence: Synthetic oligonucleotide
cactggagacacagctcttctgtgagcag

SEQ ID NO: 182195 - DNA, 29 bp, Artificial Sequence
  Description of Artificial Sequence: Synthetic oligonucleotide
actggagacacagctcttctgtgagcagg

SEQ ID NO: 182196 - DNA, 28 bp, Artificial Sequence
  Description of Artificial Sequence: Synthetic oligonucleotide
ctggagacacagctcttctgtgagcagg

SEQ ID NO: 182197 - DNA, 28 bp, Artificial Sequence
  Description of Artificial Sequence: Synthetic oligonucleotide
tggagacacagctcttctgtgagcaggg

SEQ ID NO: 182198 - DNA, 27 bp, Artificial Sequence
  Description of Artificial Sequence: Synthetic oligonucleotide
ggagacacagctcttctgtgagcaggg

SEQ ID NO: 182199 - DNA, 28 bp, Artificial Sequence
  Description of Artificial Sequence: Synthetic oligonucleotide
gagacacagctcttctgtgagcagggag

SEQ ID NO: 182200 - DNA, 30 bp, Artificial Sequence
  Description of Artificial Sequence: Synthetic oligonucleotide
agacacagctcttctgtgagcagggagatg

SEQ ID NO: 182201 - DNA, 29 bp, Artificial Sequence
  Description of Artificial Sequence: Synthetic oligonucleotide
gacacagctcttctgtgagcagggagatg

SEQ ID NO: 182202 - DNA, 29 bp, Artificial Sequence
  Description of Artificial Sequence: Synthetic oligonucleotide
acacagctcttctgtgagcagggagatgg

SEQ ID NO: 182203 - DNA, 28 bp, Artificial Sequence
  Description of Artificial Sequence: Synthetic oligonucleotide
cacagctcttctgtgagcagggagatgg

SEQ ID NO: 182204 - DNA, 28 bp, Artificial Sequence
  Description of Artificial Sequence: Synthetic oligonucleotide
acagctcttctgtgagcagggagatggg

SEQ ID NO: 182205 - DNA, 27 bp, Artificial Sequence
  Description of Artificial Sequence: Synthetic oligonucleotide
cagctcttctgtgagcagggagatggg

SEQ ID NO: 182206 - DNA, 27 bp, Artificial Sequence
  Description of Artificial Sequence: Synthetic oligonucleotide
agctcttctgtgagcagggagatgggg

SEQ ID NO: 182207 - DNA, 26 bp, Artificial Sequence
  Description of Artificial Sequence: Synthetic oligonucleotide
gctcttctgtgagcagggagatgggg

SEQ ID NO: 182208 - DNA, 26 bp, Artificial Sequence
  Description of Artificial Sequence: Synthetic oligonucleotide
ctcttctgtgagcagggagatggggg

SEQ ID NO: 182209 - DNA, 27 bp, Artificial Sequence
  Description of Artificial Sequence: Synthetic oligonucleotide
tcttctgtgagcagggagatgggggca

SEQ ID NO: 182210 - DNA, 26 bp, Artificial Sequence
  Description of Artificial Sequence: Synthetic oligonucleotide
cttctgtgagcagggagatgggggca

SEQ ID NO: 182211 - DNA, 27 bp, Artificial Sequence
  Description of Artificial Sequence: Synthetic oligonucleotide
ttctgtgagcagggagatgggggcaca

SEQ ID NO: 182212 - DNA, 26 bp, Artificial Sequence
  Description of Artificial Sequence: Synthetic oligonucleotide
tctgtgagcagggagatgggggcaca

SEQ ID NO: 182213 - DNA, 25 bp, Artificial Sequence
  Description of Artificial Sequence: Synthetic oligonucleotide
ctgtgagcagggagatgggggcaca

SEQ ID NO: 182214 - DNA, 27 bp, Artificial Sequence
  Description of Artificial Sequence: Synthetic oligonucleotide
tgtgagcagggagatgggggcacagaa

SEQ ID NO: 182215 - DNA, 26 bp, Artificial Sequence
  Description of Artificial Sequence: Synthetic oligonucleotide
gtgagcagggagatgggggcacagaa

SEQ ID NO: 182216 - DNA, 26 bp, Artificial Sequence
  Description of Artificial Sequence: Synthetic oligonucleotide
tgagcagggagatgggggcacagaag

SEQ ID NO: 182217 - DNA, 25 bp, Artificial Sequence
  Description of Artificial Sequence: Synthetic oligonucleotide
gagcagggagatgggggcacagaag

SEQ ID NO: 182218 - DNA, 25 bp, Artificial Sequence
  Description of Artificial Sequence: Synthetic oligonucleotide
agcagggagatgggggcacagaagg

SEQ ID NO: 182219 - DNA, 24 bp, Artificial Sequence
  Description of Artificial Sequence: Synthetic oligonucleotide
gcagggagatgggggcacagaagg

SEQ ID NO: 182220 - DNA, 24 bp, Artificial Sequence
  Description of Artificial Sequence: Synthetic oligonucleotide
cagggagatgggggcacagaaggg

SEQ ID NO: 182221 - DNA, 25 bp, Artificial Sequence
  Description of Artificial Sequence: Synthetic oligonucleotide
agggagatgggggcacagaagggca

SEQ ID NO: 182222 - DNA, 24 bp, Artificial Sequence
  Description of Artificial Sequence: Synthetic oligonucleotide
gggagatgggggcacagaagggca

SEQ ID NO: 182223 - DNA, 25 bp, Artificial Sequence
  Description of Artificial Sequence: Synthetic oligonucleotide
ggagatgggggcacagaagggcact

SEQ ID NO: 182224 - DNA, 26 bp, Artificial Sequence
  Description of Artificial Sequence: Synthetic oligonucleotide
gagatgggggcacagaagggcactca

SEQ ID NO: 182225 - DNA, 26 bp, Artificial Sequence
  Description of Artificial Sequence: Synthetic oligonucleotide
agatgggggcacagaagggcactcac

SEQ ID NO: 182226 - DNA, 25 bp, Artificial Sequence
  Description of Artificial Sequence: Synthetic oligonucleotide
gatgggggcacagaagggcactcac

SEQ ID NO: 182227 - DNA, 27 bp, Artificial Sequence
  Description of Artificial Sequence: Synthetic oligonucleotide
atgggggcacagaagggcactcaccat

SEQ ID NO: 182228 - DNA, 26 bp, Artificial Sequence
  Description of Artificial Sequence: Synthetic oligonucleotide
tgggggcacagaagggcactcaccat

SEQ ID NO: 182229 - DNA, 25 bp, Artificial Sequence
  Description of Artificial Sequence: Synthetic oligonucleotide
gggggcacagaagggcactcaccat

SEQ ID NO: 182230 - DNA, 26 bp, Artificial Sequence
  Description of Artificial Sequence: Synthetic oligonucleotide
ggggcacagaagggcactcaccatct

SEQ ID NO: 182231 - DNA, 26 bp, Artificial Sequence
  Description of Artificial Sequence: Synthetic oligonucleotide
gggcacagaagggcactcaccatctg

SEQ ID NO: 182232 - DNA, 27 bp, Artificial Sequence
  Description of Artificial Sequence: Synthetic oligonucleotide
ggcacagaagggcactcaccatctgga

SEQ ID NO: 182233 - DNA, 30 bp, Artificial Sequence
  Description of Artificial Sequence: Synthetic oligonucleotide
gcacagaagggcactcaccatctggaattc

SEQ ID NO: 182234 - DNA, 31 bp, Artificial Sequence
  Description of Artificial Sequence: Synthetic oligonucleotide
cacagaagggcactcaccatctggaattctg

SEQ ID NO: 182235 - DNA, 31 bp, Artificial Sequence
  Description of Artificial Sequence: Synthetic oligonucleotide
acagaagggcactcaccatctggaattctgg

SEQ ID NO: 182236 - DNA, 30 bp, Artificial Sequence
  Description of Artificial Sequence: Synthetic oligonucleotide
cagaagggcactcaccatctggaattctgg

SEQ ID NO: 182237 - DNA, 34 bp, Artificial Sequence
  Description of Artificial Sequence: Synthetic oligonucleotide
agaagggcactcaccatctggaattctggaaaag

SEQ ID NO: 182238 - DNA, 33 bp, Artificial Sequence
  Description of Artificial Sequence: Synthetic oligonucleotide
gaagggcactcaccatctggaattctggaaaag

SEQ ID NO: 182239 - DNA, 36 bp, Artificial Sequence
  Description of Artificial Sequence: Synthetic oligonucleotide
aagggcactcaccatctggaattctggaaaagattc

SEQ ID NO: 182240 - DNA, 35 bp, Artificial Sequence
  Description of Artificial Sequence: Synthetic oligonucleotide
agggcactcaccatctggaattctggaaaagattc

SEQ ID NO: 182241 - DNA, 34 bp, Artificial Sequence
  Description of Artificial Sequence: Synthetic oligonucleotide
gggcactcaccatctggaattctggaaaagattc

SEQ ID NO: 182242 - DNA, 34 bp, Artificial Sequence
  Description of Artificial Sequence: Synthetic oligonucleotide
ggcactcaccatctggaattctggaaaagattcc

SEQ ID NO: 182243 - DNA, 34 bp, Artificial Sequence
  Description of Artificial Sequence: Synthetic oligonucleotide
gcactcaccatctggaattctggaaaagattccc

SEQ ID NO: 182244 - DNA, 34 bp, Artificial Sequence
  Description of Artificial Sequence: Synthetic oligonucleotide
cactcaccatctggaattctggaaaagattcccc

SEQ ID NO: 182245 - DNA, 34 bp, Artificial Sequence
  Description of Artificial Sequence: Synthetic oligonucleotide
actcaccatctggaattctggaaaagattccccc

SEQ ID NO: 182246 - DNA, 33 bp, Artificial Sequence
  Description of Artificial Sequence: Synthetic oligonucleotide
ctcaccatctggaattctggaaaagattccccc

SEQ ID NO: 182247 - DNA, 33 bp, Artificial Sequence
  Description of Artificial Sequence: Synthetic oligonucleotide
tcaccatctggaattctggaaaagattcccccg

SEQ ID NO: 182248 - DNA, 32 bp, Artificial Sequence
  Description of Artificial Sequence: Synthetic oligonucleotide
caccatctggaattctggaaaagattcccccg

SEQ ID NO: 182249 - DNA, 32 bp, Artificial Sequence
  Description of Artificial Sequence: Synthetic oligonucleotide
accatctggaattctggaaaagattcccccgg

SEQ ID NO: 182250 - DNA, 31 bp, Artificial Sequence
  Description of Artificial Sequence: Synthetic oligonucleotide
ccatctggaattctggaaaagattcccccgg

SEQ ID NO: 182251 - DNA, 34 bp, Artificial Sequence
  Description of Artificial Sequence: Synthetic oligonucleotide
catctggaattctggaaaagattcccccggattc

SEQ ID NO: 182252 - DNA, 35 bp, Artificial Sequence
  Description of Artificial Sequence: Synthetic oligonucleotide
atctggaattctggaaaagattcccccggattcag

SEQ ID NO: 182253 - DNA, 34 bp, Artificial Sequence
  Description of Artificial Sequence: Synthetic oligonucleotide
tctggaattctggaaaagattcccccggattcag

SEQ ID NO: 182254 - DNA, 33 bp, Artificial Sequence
  Description of Artificial Sequence: Synthetic oligonucleotide
ctggaattctggaaaagattcccccggattcag

SEQ ID NO: 182255 - DNA, 34 bp, Artificial Sequence
  Description of Artificial Sequence: Synthetic oligonucleotide
tggaattctggaaaagattcccccggattcagag

SEQ ID NO: 182256 - DNA, 33 bp, Artificial Sequence
  Description of Artificial Sequence: Synthetic oligonucleotide
ggaattctggaaaagattcccccggattcagag

SEQ ID NO: 182257 - DNA, 33 bp, Artificial Sequence
  Description of Artificial Sequence: Synthetic oligonucleotide
gaattctggaaaagattcccccggattcagagg

SEQ ID NO: 182258 - DNA, 33 bp, Artificial Sequence
  Description of Artificial Sequence: Synthetic oligonucleotide
aattctggaaaagattcccccggattcagaggc

SEQ ID NO: 182259 - DNA, 32 bp, Artificial Sequence
  Description of Artificial Sequence: Synthetic oligonucleotide
attctggaaaagattcccccggattcagaggc

SEQ ID NO: 182260 - DNA, 31 bp, Artificial Sequence
  Description of Artificial Sequence: Synthetic oligonucleotide
ttctggaaaagattcccccggattcagaggc

SEQ ID NO: 182261 - DNA, 30 bp, Artificial Sequence
  Description of Artificial Sequence: Synthetic oligonucleotide
tctggaaaagattcccccggattcagaggc

SEQ ID NO: 182262 - DNA, 29 bp, Artificial Sequence
  Description of Artificial Sequence: Synthetic oligonucleotide
ctggaaaagattcccccggattcagaggc

SEQ ID NO: 182263 - DNA, 29 bp, Artificial Sequence
  Description of Artificial Sequence: Synthetic oligonucleotide
tggaaaagattcccccggattcagaggcc

SEQ ID NO: 182264 - DNA, 28 bp, Artificial Sequence
  Description of Artificial Sequence: Synthetic oligonucleotide
ggaaaagattcccccggattcagaggcc

SEQ ID NO: 182265 - DNA, 29 bp, Artificial Sequence
  Description of Artificial Sequence: Synthetic oligonucleotide
gaaaagattcccccggattcagaggccac

SEQ ID NO: 182266 - DNA, 29 bp, Artificial Sequence
  Description of Artificial Sequence: Synthetic oligonucleotide
aaaagattcccccggattcagaggccacg

SEQ ID NO: 182267 - DNA, 28 bp, Artificial Sequence
  Description of Artificial Sequence: Synthetic oligonucleotide
aaagattcccccggattcagaggccacg

SEQ ID NO: 182268 - DNA, 27 bp, Artificial Sequence
  Description of Artificial Sequence: Synthetic oligonucleotide
aagattcccccggattcagaggccacg

SEQ ID NO: 182269 - DNA, 27 bp, Artificial Sequence
  Description of Artificial Sequence: Synthetic oligonucleotide
agattcccccggattcagaggccacgt

SEQ ID NO: 182270 - DNA, 27 bp, Artificial Sequence
  Description of Artificial Sequence: Synthetic oligonucleotide
gattcccccggattcagaggccacgtt

SEQ ID NO: 182271 - DNA, 27 bp, Artificial Sequence
  Description of Artificial Sequence: Synthetic oligonucleotide
attcccccggattcagaggccacgttg

SEQ ID NO: 182272 - DNA, 26 bp, Artificial Sequence
  Description of Artificial Sequence: Synthetic oligonucleotide
ttcccccggattcagaggccacgttg

SEQ ID NO: 182273 - DNA, 25 bp, Artificial Sequence
  Description of Artificial Sequence: Synthetic oligonucleotide
tcccccggattcagaggccacgttg

SEQ ID NO: 182274 - DNA, 24 bp, Artificial Sequence
  Description of Artificial Sequence: Synthetic oligonucleotide
cccccggattcagaggccacgttg

SEQ ID NO: 182275 - DNA, 25 bp, Artificial Sequence
  Description of Artificial Sequence: Synthetic oligonucleotide
ccccggattcagaggccacgttggt

SEQ ID NO: 182276 - DNA, 25 bp, Artificial Sequence
  Description of Artificial Sequence: Synthetic oligonucleotide
cccggattcagaggccacgttggtg

SEQ ID NO: 182277 - DNA, 27 bp, Artificial Sequence
  Description of Artificial Sequence: Synthetic oligonucleotide
ccggattcagaggccacgttggtgcta

SEQ ID NO: 182278 - DNA, 27 bp, Artificial Sequence
  Description of Artificial Sequence: Synthetic oligonucleotide
cggattcagaggccacgttggtgctag

SEQ ID NO: 182279 - DNA, 28 bp, Artificial Sequence
  Description of Artificial Sequence: Synthetic oligonucleotide
ggattcagaggccacgttggtgctagtg

SEQ ID NO: 182280 - DNA, 28 bp, Artificial Sequence
  Description of Artificial Sequence: Synthetic oligonucleotide
gattcagaggccacgttggtgctagtgg

SEQ ID NO: 182281 - DNA, 28 bp, Artificial Sequence
  Description of Artificial Sequence: Synthetic oligonucleotide
attcagaggccacgttggtgctagtggg

SEQ ID NO: 182282 - DNA, 27 bp, Artificial Sequence
  Description of Artificial Sequence: Synthetic oligonucleotide
ttcagaggccacgttggtgctagtggg

SEQ ID NO: 182283 - DNA, 26 bp, Artificial Sequence
  Description of Artificial Sequence: Synthetic oligonucleotide
tcagaggccacgttggtgctagtggg

SEQ ID NO: 182284 - DNA, 25 bp, Artificial Sequence
  Description of Artificial Sequence: Synthetic oligonucleotide
cagaggccacgttggtgctagtggg

SEQ ID NO: 182285 - DNA, 25 bp, Artificial Sequence
  Description of Artificial Sequence: Synthetic oligonucleotide
agaggccacgttggtgctagtgggc

SEQ ID NO: 182286 - DNA, 24 bp, Artificial Sequence
  Description of Artificial Sequence: Synthetic oligonucleotide
gaggccacgttggtgctagtgggc

SEQ ID NO: 182287 - DNA, 24 bp, Artificial Sequence
  Description of Artificial Sequence: Synthetic oligonucleotide
aggccacgttggtgctagtgggcc

SEQ ID NO: 182288 - DNA, 23 bp, Artificial Sequence
  Description of Artificial Sequence: Synthetic oligonucleotide
ggccacgttggtgctagtgggcc

SEQ ID NO: 182289 - DNA, 23 bp, Artificial Sequence
  Description of Artificial Sequence: Synthetic oligonucleotide
gccacgttggtgctagtgggccg

SEQ ID NO: 182290 - DNA, 23 bp, Artificial Sequence
  Description of Artificial Sequence: Synthetic oligonucleotide
ccacgttggtgctagtgggccgc

SEQ ID NO: 182291 - DNA, 23 bp, Artificial Sequence
  Description of Artificial Sequence: Synthetic oligonucleotide
cacgttggtgctagtgggccgcg

SEQ ID NO: 182292 - DNA, 23 bp, Artificial Sequence
  Description of Artificial Sequence: Synthetic oligonucleotide
acgttggtgctagtgggccgcgc

SEQ ID NO: 182293 - DNA, 22 bp, Artificial Sequence
  Description of Artificial Sequence: Synthetic oligonucleotide
cgttggtgctagtgggccgcgc

SEQ ID NO: 182294 - DNA, 22 bp, Artificial Sequence
  Description of Artificial Sequence: Synthetic oligonucleotide
gttggtgctagtgggccgcgcc

SEQ ID NO: 182295 - DNA, 23 bp, Artificial Sequence
  Description of Artificial Sequence: Synthetic oligonucleotide
ttggtgctagtgggccgcgccga

SEQ ID NO: 182296 - DNA, 22 bp, Artificial Sequence
  Description of Artificial Sequence: Synthetic oligonucleotide
tggtgctagtgggccgcgccga

SEQ ID NO: 182297 - DNA, 21 bp, Artificial Sequence
  Description of Artificial Sequence: Synthetic oligonucleotide
ggtgctagtgggccgcgccga

SEQ ID NO: 182298 - DNA, 23 bp, Artificial Sequence
  Description of Artificial Sequence: Synthetic oligonucleotide
gtgctagtgggccgcgccgactt

SEQ ID NO: 182299 - DNA, 23 bp, Artificial Sequence
  Description of Artificial Sequence: Synthetic oligonucleotide
tgctagtgggccgcgccgacttc

SEQ ID NO: 182300 - DNA, 22 bp, Artificial Sequence
  Description of Artificial Sequence: Synthetic oligonucleotide
gctagtgggccgcgccgacttc

SEQ ID NO: 182301 - DNA, 23 bp, Artificial Sequence
  Description of Artificial Sequence: Synthetic oligonucleotide
ctagtgggccgcgccgacttcct

SEQ ID NO: 182302 - DNA, 23 bp, Artificial Sequence
  Description of Artificial Sequence: Synthetic oligonucleotide
tagtgggccgcgccgacttcctg

SEQ ID NO: 182303 - DNA, 22 bp, Artificial Sequence
  Description of Artificial Sequence: Synthetic oligonucleotide
agtgggccgcgccgacttcctg

SEQ ID NO: 182304 - DNA, 21 bp, Artificial Sequence
  Description of Artificial Sequence: Synthetic oligonucleotide
gtgggccgcgccgacttcctg

SEQ ID NO: 182305 - DNA, 22 bp, Artificial Sequence
  Description of Artificial Sequence: Synthetic oligonucleotide
tgggccgcgccgacttcctgga

SEQ ID NO: 182306 - DNA, 21 bp, Artificial Sequence
  Description of Artificial Sequence: Synthetic oligonucleotide
gggccgcgccgacttcctgga

SEQ ID NO: 182307 - DNA, 21 bp, Artificial Sequence
  Description of Artificial Sequence: Synthetic oligonucleotide
ggccgcgccgacttcctggag

SEQ ID NO: 182308 - DNA, 22 bp, Artificial Sequence
  Description of Artificial Sequence: Synthetic oligonucleotide
gccgcgccgacttcctggagca

SEQ ID NO: 182309 - DNA, 22 bp, Artificial Sequence
  Description of Artificial Sequence: Synthetic oligonucleotide
ccgcgccgacttcctggagcag

SEQ ID NO: 182310 - DNA, 22 bp, Artificial Sequence
  Description of Artificial Sequence: Synthetic oligonucleotide
cgcgccgacttcctggagcagc

SEQ ID NO: 182311 - DNA, 22 bp, Artificial Sequence
  Description of Artificial Sequence: Synthetic oligonucleotide
gcgccgacttcctggagcagcc

SEQ ID NO: 182312 - DNA, 22 bp, Artificial Sequence
  Description of Artificial Sequence: Synthetic oligonucleotide
cgccgacttcctggagcagccg

SEQ ID NO: 182313 - DNA, 23 bp, Artificial Sequence
  Description of Artificial Sequence: Synthetic oligonucleotide
gccgacttcctggagcagccggt

SEQ ID NO: 182314 - DNA, 23 bp, Artificial Sequence
  Description of Artificial Sequence: Synthetic oligonucleotide
ccgacttcctggagcagccggtg

SEQ ID NO: 182315 - DNA, 24 bp, Artificial Sequence
  Description of Artificial Sequence: Synthetic oligonucleotide
cgacttcctggagcagccggtgct

SEQ ID NO: 182316 - DNA, 24 bp, Artificial Sequence
  Description of Artificial Sequence: Synthetic oligonucleotide
gacttcctggagcagccggtgctg

SEQ ID NO: 182317 - DNA, 24 bp, Artificial Sequence
  Description of Artificial Sequence: Synthetic oligonucleotide
acttcctggagcagccggtgctgg

SEQ ID NO: 182318 - DNA, 23 bp, Artificial Sequence
  Description of Artificial Sequence: Synthetic oligonucleotide
cttcctggagcagccggtgctgg

SEQ ID NO: 182319 - DNA, 23 bp, Artificial Sequence
  Description of Artificial Sequence: Synthetic oligonucleotide
ttcctggagcagccggtgctggg

SEQ ID NO: 182320 - DNA, 22 bp, Artificial Sequence
  Description of Artificial Sequence: Synthetic oligonucleotide
tcctggagcagccggtgctggg

SEQ ID NO: 182321 - DNA, 21 bp, Artificial Sequence
  Description of Artificial Sequence: Synthetic oligonucleotide
cctggagcagccggtgctggg

SEQ ID NO: 182322 - DNA, 23 bp, Artificial Sequence
  Description of Artificial Sequence: Synthetic oligonucleotide
ctggagcagccggtgctgggctt

SEQ ID NO: 182323 - DNA, 23 bp, Artificial Sequence
  Description of Artificial Sequence: Synthetic oligonucleotide
tggagcagccggtgctgggcttc

SEQ ID NO: 182324 - DNA, 22 bp, Artificial Sequence
  Description of Artificial Sequence: Synthetic oligonucleotide
ggagcagccggtgctgggcttc

SEQ ID NO: 182325 - DNA, 23 bp, Artificial Sequence
  Description of Artificial Sequence: Synthetic oligonucleotide
gagcagccggtgctgggcttcgt

SEQ ID NO: 182326 - DNA, 24 bp, Artificial Sequence
  Description of Artificial Sequence: Synthetic oligonucleotide
agcagccggtgctgggcttcgtga

SEQ ID NO: 182327 - DNA, 23 bp, Artificial Sequence
  Description of Artificial Sequence: Synthetic oligonucleotide
gcagccggtgctgggcttcgtga

SEQ ID NO: 182328 - DNA, 23 bp, Artificial Sequence
  Description of Artificial Sequence: Synthetic oligonucleotide
cagccggtgctgggcttcgtgag

SEQ ID NO: 182329 - DNA, 23 bp, Artificial Sequence
  Description of Artificial Sequence: Synthetic oligonucleotide
agccggtgctgggcttcgtgagg

SEQ ID NO: 182330 - DNA, 22 bp, Artificial Sequence
  Description of Artificial Sequence: Synthetic oligonucleotide
gccggtgctgggcttcgtgagg

SEQ ID NO: 182331 - DNA, 23 bp, Artificial Sequence
  Description of Artificial Sequence: Synthetic oligonucleotide
ccggtgctgggcttcgtgaggct

SEQ ID NO: 182332 - DNA, 23 bp, Artificial Sequence
  Description of Artificial Sequence: Synthetic oligonucleotide
cggtgctgggcttcgtgaggctg

SEQ ID NO: 182333 - DNA, 24 bp, Artificial Sequence
  Description of Artificial Sequence: Synthetic oligonucleotide
ggtgctgggcttcgtgaggctgca

SEQ ID NO: 182334 - DNA, 24 bp, Artificial Sequence
  Description of Artificial Sequence: Synthetic oligonucleotide
gtgctgggcttcgtgaggctgcag

SEQ ID NO: 182335 - DNA, 25 bp, Artificial Sequence
  Description of Artificial Sequence: Synthetic oligonucleotide
tgctgggcttcgtgaggctgcagga

SEQ ID NO: 182336 - DNA, 24 bp, Artificial Sequence
  Description of Artificial Sequence: Synthetic oligonucleotide
gctgggcttcgtgaggctgcagga

SEQ ID NO: 182337 - DNA, 24 bp, Artificial Sequence
  Description of Artificial Sequence: Synthetic oligonucleotide
ctgggcttcgtgaggctgcaggag

SEQ ID NO: 182338 - DNA, 24 bp, Artificial Sequence
  Description of Artificial Sequence: Synthetic oligonucleotide
tgggcttcgtgaggctgcaggagg

SEQ ID NO: 182339 - DNA, 23 bp, Artificial Sequence
  Description of Artificial Sequence: Synthetic oligonucleotide
gggcttcgtgaggctgcaggagg

SEQ ID NO: 182340 - DNA, 24 bp, Artificial Sequence
  Description of Artificial Sequence: Synthetic oligonucleotide
ggcttcgtgaggctgcaggaggca

SEQ ID NO: 182341 - DNA, 24 bp, Artificial Sequence
  Description of Artificial Sequence: Synthetic oligonucleotide
gcttcgtgaggctgcaggaggcag

SEQ ID NO: 182342 - DNA, 24 bp, Artificial Sequence
  Description of Artificial Sequence: Synthetic oligonucleotide
cttcgtgaggctgcaggaggcagc

SEQ ID NO: 182343 - DNA, 24 bp, Artificial Sequence
  Description of Artificial Sequence: Synthetic oligonucleotide
ttcgtgaggctgcaggaggcagcg

SEQ ID NO: 182344 - DNA, 23 bp, Artificial Sequence
  Description of Artificial Sequence: Synthetic oligonucleotide
tcgtgaggctgcaggaggcagcg

SEQ ID NO: 182345 - DNA, 22 bp, Artificial Sequence
  Description of Artificial Sequence: Synthetic oligonucleotide
cgtgaggctgcaggaggcagcg

SEQ ID NO: 182346 - DNA, 23 bp, Artificial Sequence
  Description of Artificial Sequence: Synthetic oligonucleotide
gtgaggctgcaggaggcagcgga

SEQ ID NO: 182347 - DNA, 23 bp, Artificial Sequence
  Description of Artificial Sequence: Synthetic oligonucleotide
tgaggctgcaggaggcagcggag

SEQ ID NO: 182348 - DNA, 22 bp, Artificial Sequence
  Description of Artificial Sequence: Synthetic oligonucleotide
gaggctgcaggaggcagcggag

SEQ ID NO: 182349 - DNA, 23 bp, Artificial Sequence
  Description of Artificial Sequence: Synthetic oligonucleotide
aggctgcaggaggcagcggagct

SEQ ID NO: 182350 - DNA, 22 bp, Artificial Sequence
  Description of Artificial Sequence: Synthetic oligonucleotide
ggctgcaggaggcagcggagct

SEQ ID NO: 182351 - DNA, 22 bp, Artificial Sequence
  Description of Artificial Sequence: Synthetic oligonucleotide
gctgcaggaggcagcggagctg

SEQ ID NO: 182352 - DNA, 23 bp, Artificial Sequence
  Description of Artificial Sequence: Synthetic oligonucleotide
ctgcaggaggcagcggagctgga

SEQ ID NO: 182353 - DNA, 23 bp, Artificial Sequence
  Description of Artificial Sequence: Synthetic oligonucleotide
tgcaggaggcagcggagctggag

SEQ ID NO: 182354 - DNA, 22 bp, Artificial Sequence
  Description of Artificial Sequence: Synthetic oligonucleotide
gcaggaggcagcggagctggag

SEQ ID NO: 182355 - DNA, 22 bp, Artificial Sequence
  Description of Artificial Sequence: Synthetic oligonucleotide
caggaggcagcggagctggagg

SEQ ID NO: 182356 - DNA, 22 bp, Artificial Sequence
  Description of Artificial Sequence: Synthetic oligonucleotide
aggaggcagcggagctggaggc

SEQ ID NO: 182357 - DNA, 21 bp, Artificial Sequence
  Description of Artificial Sequence: Synthetic oligonucleotide
ggaggcagcggagctggaggc

SEQ ID NO: 182358 - DNA, 21 bp, Artificial Sequence
  Description of Artificial Sequence: Synthetic oligonucleotide
gaggcagcggagctggaggcg

SEQ ID NO: 182359 - DNA, 22 bp, Artificial Sequence
  Description of Artificial Sequence: Synthetic oligonucleotide
aggcagcggagctggaggcggt

SEQ ID NO: 182360 - DNA, 21 bp, Artificial Sequence
  Description of Artificial Sequence: Synthetic oligonucleotide
ggcagcggagctggaggcggt

SEQ ID NO: 182361 - DNA, 21 bp, Artificial Sequence
  Description of Artificial Sequence: Synthetic oligonucleotide
gcagcggagctggaggcggtg

SEQ ID NO: 182362 - DNA, 22 bp, Artificial Sequence
  Description of Artificial Sequence: Synthetic oligonucleotide
cagcggagctggaggcggtgga

SEQ ID NO: 182363 - DNA, 22 bp, Artificial Sequence
  Description of Artificial Sequence: Synthetic oligonucleotide
agcggagctggaggcggtggag

SEQ ID NO: 182364 - DNA, 21 bp, Artificial Sequence
  Description of Artificial Sequence: Synthetic oligonucleotide
gcggagctggaggcggtggag

SEQ ID NO: 182365 - DNA, 22 bp, Artificial Sequence
  Description of Artificial Sequence: Synthetic oligonucleotide
cggagctggaggcggtggagct

SEQ ID NO: 182366 - DNA, 22 bp, Artificial Sequence
  Description of Artificial Sequence: Synthetic oligonucleotide
ggagctggaggcggtggagctg

SEQ ID NO: 182367 - DNA, 22 bp, Artificial Sequence
  Description of Artificial Sequence: Synthetic oligonucleotide
gagctggaggcggtggagctgc

SEQ ID NO: 182368 - DNA, 22 bp, Artificial Sequence
  Description of Artificial Sequence: Synthetic oligonucleotide
agctggaggcggtggagctgcc

SEQ ID NO: 182369 - DNA, 21 bp, Artificial Sequence
  Description of Artificial Sequence: Synthetic oligonucleotide
gctggaggcggtggagctgcc

SEQ ID NO: 182370 - DNA, 21 bp, Artificial Sequence
  Description of Artificial Sequence: Synthetic oligonucleotide
ctggaggcggtggagctgccg

SEQ ID NO: 182371 - DNA, 22 bp, Artificial Sequence
  Description of Artificial Sequence: Synthetic oligonucleotide
tggaggcggtggagctgccggt

SEQ ID NO: 182372 - DNA, 21 bp, Artificial Sequence
  Description of Artificial Sequence: Synthetic oligonucleotide
ggaggcggtggagctgccggt

SEQ ID NO: 182373 - DNA, 21 bp, Artificial Sequence
  Description of Artificial Sequence: Synthetic oligonucleotide
gaggcggtggagctgccggtg

SEQ ID NO: 182374 - DNA, 21 bp, Artificial Sequence
  Description of Artificial Sequence: Synthetic oligonucleotide
aggcggtggagctgccggtgc

SEQ ID NO: 182375 - DNA, 20 bp, Artificial Sequence
  Description of Artificial Sequence: Synthetic oligonucleotide
ggcggtggagctgccggtgc

SEQ ID NO: 182376 - DNA, 24 bp, Artificial Sequence
  Description of Artificial Sequence: Synthetic oligonucleotide
gcggtggagctgccggtgcctata

SEQ ID NO: 182377 - DNA, 24 bp, Artificial Sequence
  Description of Artificial Sequence: Synthetic oligonucleotide
cggtggagctgccggtgcctatac

SEQ ID NO: 182378 - DNA, 24 bp, Artificial Sequence
  Description of Artificial Sequence: Synthetic oligonucleotide
ggtggagctgccggtgcctatacg

SEQ ID NO: 182379 - DNA, 26 bp, Artificial Sequence
  Description of Artificial Sequence: Synthetic oligonucleotide
gtggagctgccggtgcctatacgctt

SEQ ID NO: 182380 - DNA, 26 bp, Artificial Sequence
  Description of Artificial Sequence: Synthetic oligonucleotide
tggagctgccggtgcctatacgcttc

SEQ ID NO: 182381 - DNA, 25 bp, Artificial Sequence
  Description of Artificial Sequence: Synthetic oligonucleotide
ggagctgccggtgcctatacgcttc

SEQ ID NO: 182382 - DNA, 26 bp, Artificial Sequence
  Description of Artificial Sequence: Synthetic oligonucleotide
gagctgccggtgcctatacgcttcct

SEQ ID NO: 182383 - DNA, 27 bp, Artificial Sequence
  Description of Artificial Sequence: Synthetic oligonucleotide
agctgccggtgcctatacgcttcctct

SEQ ID NO: 182384 - DNA, 27 bp, Artificial Sequence
  Description of Artificial Sequence: Synthetic oligonucleotide
gctgccggtgcctatacgcttcctctt

SEQ ID NO: 182385 - DNA, 28 bp, Artificial Sequence
  Description of Artificial Sequence: Synthetic oligonucleotide
ctgccggtgcctatacgcttcctctttg

SEQ ID NO: 182386 - DNA, 29 bp, Artificial Sequence
  Description of Artificial Sequence: Synthetic oligonucleotide
tgccggtgcctatacgcttcctctttgtg

SEQ ID NO: 182387 - DNA, 28 bp, Artificial Sequence
  Description of Artificial Sequence: Synthetic oligonucleotide
gccggtgcctatacgcttcctctttgtg

SEQ ID NO: 182388 - DNA, 30 bp, Artificial Sequence
  Description of Artificial Sequence: Synthetic oligonucleotide
ccggtgcctatacgcttcctctttgtgttg

SEQ ID NO: 182389 - DNA, 30 bp, Artificial Sequence
  Description of Artificial Sequence: Synthetic oligonucleotide
cggtgcctatacgcttcctctttgtgttgc

SEQ ID NO: 182390 - DNA, 31 bp, Artificial Sequence
  Description of Artificial Sequence: Synthetic oligonucleotide
ggtgcctatacgcttcctctttgtgttgctg

SEQ ID NO: 182391 - DNA, 31 bp, Artificial Sequence
  Description of Artificial Sequence: Synthetic oligonucleotide
gtgcctatacgcttcctctttgtgttgctgg

SEQ ID NO: 182392 - DNA, 31 bp, Artificial Sequence
  Description of Artificial Sequence: Synthetic oligonucleotide
tgcctatacgcttcctctttgtgttgctggg

SEQ ID NO: 182393 - DNA, 30 bp, Artificial Sequence
  Description of Artificial Sequence: Synthetic oligonucleotide
gcctatacgcttcctctttgtgttgctggg

SEQ ID NO: 182394 - DNA, 31 bp, Artificial Sequence
  Description of Artificial Sequence: Synthetic oligonucleotide
cctatacgcttcctctttgtgttgctgggac

SEQ ID NO: 182395 - DNA, 31 bp, Artificial Sequence
  Description of Artificial Sequence: Synthetic oligonucleotide
ctatacgcttcctctttgtgttgctgggacc

SEQ ID NO: 182396 - DNA, 32 bp, Artificial Sequence
  Description of Artificial Sequence: Synthetic oligonucleotide
tatacgcttcctctttgtgttgctgggacctg

SEQ ID NO: 182397 - DNA, 31 bp, Artificial Sequence
  Description of Artificial Sequence: Synthetic oligonucleotide
atacgcttcctctttgtgttgctgggacctg

SEQ ID NO: 182398 - DNA, 30 bp, Artificial Sequence
  Description of Artificial Sequence: Synthetic oligonucleotide
tacgcttcctctttgtgttgctgggacctg

SEQ ID NO: 182399 - DNA, 29 bp, Artificial Sequence
  Description of Artificial Sequence: Synthetic oligonucleotide
acgcttcctctttgtgttgctgggacctg

SEQ ID NO: 182400 - DNA, 28 bp, Artificial Sequence
  Description of Artificial Sequence: Synthetic oligonucleotide
cgcttcctctttgtgttgctgggacctg

SEQ ID NO: 182401 - DNA, 29 bp, Artificial Sequence
  Description of Artificial Sequence: Synthetic oligonucleotide
gcttcctctttgtgttgctgggacctgag

SEQ ID NO: 182402 - DNA, 29 bp, Artificial Sequence
  Description of Artificial Sequence: Synthetic oligonucleotide
cttcctctttgtgttgctgggacctgagg

SEQ ID NO: 182403 - DNA, 29 bp, Artificial Sequence
  Description of Artificial Sequence: Synthetic oligonucleotide
ttcctctttgtgttgctgggacctgaggc

SEQ ID NO: 182404 - DNA, 28 bp, Artificial Sequence
  Description of Artificial Sequence: Synthetic oligonucleotide
tcctctttgtgttgctgggacctgaggc

SEQ ID NO: 182405 - DNA, 27 bp, Artificial Sequence
  Description of Artificial Sequence: Synthetic oligonucleotide
cctctttgtgttgctgggacctgaggc

SEQ ID NO: 182406 - DNA, 27 bp, Artificial Sequence
  Description of Artificial Sequence: Synthetic oligonucleotide
ctctttgtgttgctgggacctgaggcc

SEQ ID NO: 182407 - DNA, 27 bp, Artificial Sequence
  Description of Artificial Sequence: Synthetic oligonucleotide
tctttgtgttgctgggacctgaggccc

SEQ ID NO: 182408 - DNA, 26 bp, Artificial Sequence
  Description of Artificial Sequence: Synthetic oligonucleotide
ctttgtgttgctgggacctgaggccc

SEQ ID NO: 182409 - DNA, 26 bp, Artificial Sequence
  Description of Artificial Sequence: Synthetic oligonucleotide
tttgtgttgctgggacctgaggcccc

SEQ ID NO: 182410 - DNA, 25 bp, Artificial Sequence
  Description of Artificial Sequence: Synthetic oligonucleotide
ttgtgttgctgggacctgaggcccc

SEQ ID NO: 182411 - DNA, 24 bp, Artificial Sequence
  Description of Artificial Sequence: Synthetic oligonucleotide
tgtgttgctgggacctgaggcccc

SEQ ID NO: 182412 - DNA, 23 bp, Artificial Sequence
  Description of Artificial Sequence: Synthetic oligonucleotide
gtgttgctgggacctgaggcccc

SEQ ID NO: 182413 - DNA, 23 bp, Artificial Sequence
  Description of Artificial Sequence: Synthetic oligonucleotide
tgttgctgggacctgaggccccc

SEQ ID NO: 182414 - DNA, 22 bp, Artificial Sequence
  Description of Artificial Sequence: Synthetic oligonucleotide
gttgctgggacctgaggccccc

SEQ ID NO: 182415 - DNA, 23 bp, Artificial Sequence
  Description of Artificial Sequence: Synthetic oligonucleotide
ttgctgggacctgaggcccccca

SEQ ID NO: 182416 - DNA, 22 bp, Artificial Sequence
  Description of Artificial Sequence: Synthetic oligonucleotide
tgctgggacctgaggcccccca

SEQ ID NO: 182417 - DNA, 21 bp, Artificial Sequence
  Description of Artificial Sequence: Synthetic oligonucleotide
gctgggacctgaggcccccca

SEQ ID NO: 182418 - DNA, 23 bp, Artificial Sequence
  Description of Artificial Sequence: Synthetic oligonucleotide
ctgggacctgaggccccccacat

SEQ ID NO: 182419 - DNA, 23 bp, Artificial Sequence
  Description of Artificial Sequence: Synthetic oligonucleotide
tgggacctgaggccccccacatc

SEQ ID NO: 182420 - DNA, 22 bp, Artificial Sequence
  Description of Artificial Sequence: Synthetic oligonucleotide
gggacctgaggccccccacatc

SEQ ID NO: 182421 - DNA, 26 bp, Artificial Sequence
  Description of Artificial Sequence: Synthetic oligonucleotide
ggacctgaggccccccacatcgatta

SEQ ID NO: 182422 - DNA, 27 bp, Artificial Sequence
  Description of Artificial Sequence: Synthetic oligonucleotide
gacctgaggccccccacatcgattaca

SEQ ID NO: 182423 - DNA, 27 bp, Artificial Sequence
  Description of Artificial Sequence: Synthetic oligonucleotide
acctgaggccccccacatcgattacac

SEQ ID NO: 182424 - DNA, 26 bp, Artificial Sequence
  Description of Artificial Sequence: Synthetic oligonucleotide
cctgaggccccccacatcgattacac

SEQ ID NO: 182425 - DNA, 26 bp, Artificial Sequence
  Description of Artificial Sequence: Synthetic oligonucleotide
ctgaggccccccacatcgattacacc

SEQ ID NO: 182426 - DNA, 27 bp, Artificial Sequence
  Description of Artificial Sequence: Synthetic oligonucleotide
tgaggccccccacatcgattacaccca

SEQ ID NO: 182427 - DNA, 26 bp, Artificial Sequence
  Description of Artificial Sequence: Synthetic oligonucleotide
gaggccccccacatcgattacaccca

SEQ ID NO: 182428 - DNA, 26 bp, Artificial Sequence
  Description of Artificial Sequence: Synthetic oligonucleotide
aggccccccacatcgattacacccag

SEQ ID NO: 182429 - DNA, 25 bp, Artificial Sequence
  Description of Artificial Sequence: Synthetic oligonucleotide
ggccccccacatcgattacacccag

SEQ ID NO: 182430 - DNA, 27 bp, Artificial Sequence
  Description of Artificial Sequence: Synthetic oligonucleotide
gccccccacatcgattacacccagctt

SEQ ID NO: 182431 - DNA, 27 bp, Artificial Sequence
  Description of Artificial Sequence: Synthetic oligonucleotide
ccccccacatcgattacacccagcttg

SEQ ID NO: 182432 - DNA, 27 bp, Artificial Sequence
  Description of Artificial Sequence: Synthetic oligonucleotide
cccccacatcgattacacccagcttgg

SEQ ID NO: 182433 - DNA, 27 bp, Artificial Sequence
  Description of Artificial Sequence: Synthetic oligonucleotide
ccccacatcgattacacccagcttggc

SEQ ID NO: 182434 - DNA, 27 bp, Artificial Sequence
  Description of Artificial Sequence: Synthetic oligonucleotide
cccacatcgattacacccagcttggcc

SEQ ID NO: 182435 - DNA, 27 bp, Artificial Sequence
  Description of Artificial Sequence: Synthetic oligonucleotide
ccacatcgattacacccagcttggccg

SEQ ID NO: 182436 - DNA, 27 bp, Artificial Sequence
  Description of Artificial Sequence: Synthetic oligonucleotide
cacatcgattacacccagcttggccgg

SEQ ID NO: 182437 - DNA, 27 bp, Artificial Sequence
  Description of Artificial Sequence: Synthetic oligonucleotide
acatcgattacacccagcttggccggg

SEQ ID NO: 182438 - DNA, 26 bp, Artificial Sequence
  Description of Artificial Sequence: Synthetic oligonucleotide
catcgattacacccagcttggccggg

SEQ ID NO: 182439 - DNA, 27 bp, Artificial Sequence
  Description of Artificial Sequence: Synthetic oligonucleotide
atcgattacacccagcttggccgggct

SEQ ID NO: 182440 - DNA, 26 bp, Artificial Sequence
  Description of Artificial Sequence: Synthetic oligonucleotide
tcgattacacccagcttggccgggct

SEQ ID NO: 182441 - DNA, 25 bp, Artificial Sequence
  Description of Artificial Sequence: Synthetic oligonucleotide
cgattacacccagcttggccgggct

SEQ ID NO: 182442 - DNA, 25 bp, Artificial Sequence
  Description of Artificial Sequence: Synthetic oligonucleotide
gattacacccagcttggccgggctg

SEQ ID NO: 182443 - DNA, 26 bp, Artificial Sequence
  Description of Artificial Sequence: Synthetic oligonucleotide
attacacccagcttggccgggctgct

SEQ ID NO: 182444 - DNA, 25 bp, Artificial Sequence
  Description of Artificial Sequence: Synthetic oligonucleotide
ttacacccagcttggccgggctgct

SEQ ID NO: 182445 - DNA, 24 bp, Artificial Sequence
  Description of Artificial Sequence: Synthetic oligonucleotide
tacacccagcttggccgggctgct

SEQ ID NO: 182446 - DNA, 23 bp, Artificial Sequence
  Description of Artificial Sequence: Synthetic oligonucleotide
acacccagcttggccgggctgct

SEQ ID NO: 182447 - DNA, 22 bp, Artificial Sequence
  Description of Artificial Sequence: Synthetic oligonucleotide
cacccagcttggccgggctgct

SEQ ID NO: 182448 - DNA, 22 bp, Artificial Sequence
  Description of Artificial Sequence: Synthetic oligonucleotide
acccagcttggccgggctgctg

SEQ ID NO: 182449 - DNA, 21 bp, Artificial Sequence
  Description of Artificial Sequence: Synthetic oligonucleotide
cccagcttggccgggctgctg

SEQ ID NO: 182450 - DNA, 21 bp, Artificial Sequence
  Description of Artificial Sequence: Synthetic oligonucleotide
ccagcttggccgggctgctgc

SEQ ID NO: 182451 - DNA, 22 bp, Artificial Sequence
  Description of Artificial Sequence: Synthetic oligonucleotide
cagcttggccgggctgctgcca

SEQ ID NO: 182452 - DNA, 22 bp, Artificial Sequence
  Description of Artificial Sequence: Synthetic oligonucleotide
agcttggccgggctgctgccac

SEQ ID NO: 182453 - DNA, 21 bp, Artificial Sequence
  Description of Artificial Sequence: Synthetic oligonucleotide
gcttggccgggctgctgccac

SEQ ID NO: 182454 - DNA, 21 bp, Artificial Sequence
  Description of Artificial Sequence: Synthetic oligonucleotide
cttggccgggctgctgccacc

SEQ ID NO: 182455 - DNA, 22 bp, Artificial Sequence
  Description of Artificial Sequence: Synthetic oligonucleotide
ttggccgggctgctgccaccct

SEQ ID NO: 182456 - DNA, 21 bp, Artificial Sequence
  Description of Artificial Sequence: Synthetic oligonucleotide
tggccgggctgctgccaccct

SEQ ID NO: 182457 - DNA, 20 bp, Artificial Sequence
  Description of Artificial Sequence: Synthetic oligonucleotide
ggccgggctgctgccaccct

SEQ ID NO: 182458 - DNA, 22 bp, Artificial Sequence
  Description of Artificial Sequence: Synthetic oligonucleotide
gccgggctgctgccaccctcat

SEQ ID NO: 182459 - DNA, 23 bp, Artificial Sequence
  Description of Artificial Sequence: Synthetic oligonucleotide
ccgggctgctgccaccctcatgt

SEQ ID NO: 182460 - DNA, 24 bp, Artificial Sequence
  Description of Artificial Sequence: Synthetic oligonucleotide
cgggctgctgccaccctcatgtca

SEQ ID NO: 182461 - DNA, 25 bp, Artificial Sequence
  Description of Artificial Sequence: Synthetic oligonucleotide
gggctgctgccaccctcatgtcaga

SEQ ID NO: 182462 - DNA, 26 bp, Artificial Sequence
  Description of Artificial Sequence: Synthetic oligonucleotide
ggctgctgccaccctcatgtcagaga

SEQ ID NO: 182463 - DNA, 26 bp, Artificial Sequence
  Description of Artificial Sequence: Synthetic oligonucleotide
gctgctgccaccctcatgtcagagag

SEQ ID NO: 182464 - DNA, 26 bp, Artificial Sequence
  Description of Artificial Sequence: Synthetic oligonucleotide
ctgctgccaccctcatgtcagagagg

SEQ ID NO: 182465 - DNA, 27 bp, Artificial Sequence
  Description of Artificial Sequence: Synthetic oligonucleotide
tgctgccaccctcatgtcagagagggt

SEQ ID NO: 182466 - DNA, 26 bp, Artificial Sequence
  Description of Artificial Sequence: Synthetic oligonucleotide
gctgccaccctcatgtcagagagggt

SEQ ID NO: 182467 - DNA, 27 bp, Artificial Sequence
  Description of Artificial Sequence: Synthetic oligonucleotide
ctgccaccctcatgtcagagagggtgt

SEQ ID NO: 182468 - DNA, 28 bp, Artificial Sequence
  Description of Artificial Sequence: Synthetic oligonucleotide
tgccaccctcatgtcagagagggtgttc

SEQ ID NO: 182469 - DNA, 27 bp, Artificial Sequence
  Description of Artificial Sequence: Synthetic oligonucleotide
gccaccctcatgtcagagagggtgttc

SEQ ID NO: 182470 - DNA, 27 bp, Artificial Sequence
  Description of Artificial Sequence: Synthetic oligonucleotide
ccaccctcatgtcagagagggtgttcc

SEQ ID NO: 182471 - DNA, 27 bp, Artificial Sequence
  Description of Artificial Sequence: Synthetic oligonucleotide
caccctcatgtcagagagggtgttccg

SEQ ID NO: 182472 - DNA, 27 bp, Artificial Sequence
  Description of Artificial Sequence: Synthetic oligonucleotide
accctcatgtcagagagggtgttccgc

SEQ ID NO: 182473 - DNA, 27 bp, Artificial Sequence
  Description of Artificial Sequence: Synthetic oligonucleotide
ccctcatgtcagagagggtgttccgca

SEQ ID NO: 182474 - DNA, 29 bp, Artificial Sequence
  Description of Artificial Sequence: Synthetic oligonucleotide
cctcatgtcagagagggtgttccgcatag

SEQ ID NO: 182475 - DNA, 31 bp, Artificial Sequence
  Description of Artificial Sequence: Synthetic oligonucleotide
ctcatgtcagagagggtgttccgcatagatg

SEQ ID NO: 182476 - DNA, 31 bp, Artificial Sequence
  Description of Artificial Sequence: Synthetic oligonucleotide
tcatgtcagagagggtgttccgcatagatgc

SEQ ID NO: 182477 - DNA, 30 bp, Artificial Sequence
  Description of Artificial Sequence: Synthetic oligonucleotide
catgtcagagagggtgttccgcatagatgc

SEQ ID NO: 182478 - DNA, 30 bp, Artificial Sequence
  Description of Artificial Sequence: Synthetic oligonucleotide
atgtcagagagggtgttccgcatagatgcc

SEQ ID NO: 182479 - DNA, 29 bp, Artificial Sequence
  Description of Artificial Sequence: Synthetic oligonucleotide
tgtcagagagggtgttccgcatagatgcc

SEQ ID NO: 182480 - DNA, 28 bp, Artificial Sequence
  Description of Artificial Sequence: Synthetic oligonucleotide
gtcagagagggtgttccgcatagatgcc

SEQ ID NO: 182481 - DNA, 30 bp, Artificial Sequence
  Description of Artificial Sequence: Synthetic oligonucleotide
tcagagagggtgttccgcatagatgcctac

SEQ ID NO: 182482 - DNA, 29 bp, Artificial Sequence
  Description of Artificial Sequence: Synthetic oligonucleotide
cagagagggtgttccgcatagatgcctac

SEQ ID NO: 182483 - DNA, 31 bp, Artificial Sequence
  Description of Artificial Sequence: Synthetic oligonucleotide
agagagggtgttccgcatagatgcctacatg

SEQ ID NO: 182484 - DNA, 30 bp, Artificial Sequence
  Description of Artificial Sequence: Synthetic oligonucleotide
gagagggtgttccgcatagatgcctacatg

SEQ ID NO: 182485 - DNA, 30 bp, Artificial Sequence
  Description of Artificial Sequence: Synthetic oligonucleotide
agagggtgttccgcatagatgcctacatgg

SEQ ID NO: 182486 - DNA, 29 bp, Artificial Sequence
  Description of Artificial Sequence: Synthetic oligonucleotide
gagggtgttccgcatagatgcctacatgg

SEQ ID NO: 182487 - DNA, 29 bp, Artificial Sequence
  Description of Artificial Sequence: Synthetic oligonucleotide
agggtgttccgcatagatgcctacatggc

SEQ ID NO: 182488 - DNA, 28 bp, Artificial Sequence
  Description of Artificial Sequence: Synthetic oligonucleotide
gggtgttccgcatagatgcctacatggc

SEQ ID NO: 182489 - DNA, 29 bp, Artificial Sequence
  Description of Artificial Sequence: Synthetic oligonucleotide
ggtgttccgcatagatgcctacatggctc

SEQ ID NO: 182490 - DNA, 30 bp, Artificial Sequence
  Description of Artificial Sequence: Synthetic oligonucleotide
gtgttccgcatagatgcctacatggctcag

SEQ ID NO: 182491 - DNA, 31 bp, Artificial Sequence
  Description of Artificial Sequence: Synthetic oligonucleotide
tgttccgcatagatgcctacatggctcagag

SEQ ID NO: 182492 - DNA, 30 bp, Artificial Sequence
  Description of Artificial Sequence: Synthetic oligonucleotide
gttccgcatagatgcctacatggctcagag

SEQ ID NO: 182493 - DNA, 30 bp, Artificial Sequence
  Description of Artificial Sequence: Synthetic oligonucleotide
ttccgcatagatgcctacatggctcagagc

SEQ ID NO: 182494 - DNA, 29 bp, Artificial Sequence
  Description of Artificial Sequence: Synthetic oligonucleotide
tccgcatagatgcctacatggctcagagc

SEQ ID NO: 182495 - DNA, 28 bp, Artificial Sequence
  Description of Artificial Sequence: Synthetic oligonucleotide
ccgcatagatgcctacatggctcagagc

SEQ ID NO: 182496 - DNA, 28 bp, Artificial Sequence
  Description of Artificial Sequence: Synthetic oligonucleotide
cgcatagatgcctacatggctcagagcc

SEQ ID NO: 182497 - DNA, 28 bp, Artificial Sequence
  Description of Artificial Sequence: Synthetic oligonucleotide
gcatagatgcctacatggctcagagccg

SEQ ID NO: 182498 - DNA, 29 bp, Artificial Sequence
  Description of Artificial Sequence: Synthetic oligonucleotide
catagatgcctacatggctcagagccgag

SEQ ID NO: 182499 - DNA, 29 bp, Artificial Sequence
  Description of Artificial Sequence: Synthetic oligonucleotide
atagatgcctacatggctcagagccgagg

SEQ ID NO: 182500 - DNA, 28 bp, Artificial Sequence
  Description of Artificial Sequence: Synthetic oligonucleotide
tagatgcctacatggctcagagccgagg

SEQ ID NO: 182501 - DNA, 27 bp, Artificial Sequence
  Description of Artificial Sequence: Synthetic oligonucleotide
agatgcctacatggctcagagccgagg

SEQ ID NO: 182502 - DNA, 26 bp, Artificial Sequence
  Description of Artificial Sequence: Synthetic oligonucleotide
gatgcctacatggctcagagccgagg

SEQ ID NO: 182503 - DNA, 26 bp, Artificial Sequence
  Description of Artificial Sequence: Synthetic oligonucleotide
atgcctacatggctcagagccgaggg

SEQ ID NO: 182504 - DNA, 25 bp, Artificial Sequence
  Description of Artificial Sequence: Synthetic oligonucleotide
tgcctacatggctcagagccgaggg

SEQ ID NO: 182505 - DNA, 24 bp, Artificial Sequence
  Description of Artificial Sequence: Synthetic oligonucleotide
gcctacatggctcagagccgaggg

SEQ ID NO: 182506 - DNA, 25 bp, Artificial Sequence
  Description of Artificial Sequence: Synthetic oligonucleotide
cctacatggctcagagccgagggga

SEQ ID NO: 182507 - DNA, 25 bp, Artificial Sequence
  Description of Artificial Sequence: Synthetic oligonucleotide
ctacatggctcagagccgaggggag

SEQ ID NO: 182508 - DNA, 26 bp, Artificial Sequence
  Description of Artificial Sequence: Synthetic oligonucleotide
tacatggctcagagccgaggggagct

SEQ ID NO: 182509 - DNA, 25 bp, Artificial Sequence
  Description of Artificial Sequence: Synthetic oligonucleotide
acatggctcagagccgaggggagct

SEQ ID NO: 182510 - DNA, 24 bp, Artificial Sequence
  Description of Artificial Sequence: Synthetic oligonucleotide
catggctcagagccgaggggagct

SEQ ID NO: 182511 - DNA, 24 bp, Artificial Sequence
  Description of Artificial Sequence: Synthetic oligonucleotide
atggctcagagccgaggggagctg

SEQ ID NO: 182512 - DNA, 23 bp, Artificial Sequence
  Description of Artificial Sequence: Synthetic oligonucleotide
tggctcagagccgaggggagctg

SEQ ID NO: 182513 - DNA, 22 bp, Artificial Sequence
  Description of Artificial Sequence: Synthetic oligonucleotide
ggctcagagccgaggggagctg

SEQ ID NO: 182514 - DNA, 23 bp, Artificial Sequence
  Description of Artificial Sequence: Synthetic oligonucleotide
gctcagagccgaggggagctgct

SEQ ID NO: 182515 - DNA, 23 bp, Artificial Sequence
  Description of Artificial Sequence: Synthetic oligonucleotide
ctcagagccgaggggagctgctg

SEQ ID NO: 182516 - DNA, 24 bp, Artificial Sequence
  Description of Artificial Sequence: Synthetic oligonucleotide
tcagagccgaggggagctgctgca

SEQ ID NO: 182517 - DNA, 23 bp, Artificial Sequence
  Description of Artificial Sequence: Synthetic oligonucleotide
cagagccgaggggagctgctgca

SEQ ID NO: 182518 - DNA, 24 bp, Artificial Sequence
  Description of Artificial Sequence: Synthetic oligonucleotide
agagccgaggggagctgctgcact

SEQ ID NO: 182519 - DNA, 23 bp, Artificial Sequence
  Description of Artificial Sequence: Synthetic oligonucleotide
gagccgaggggagctgctgcact

SEQ ID NO: 182520 - DNA, 23 bp, Artificial Sequence
  Description of Artificial Sequence: Synthetic oligonucleotide
agccgaggggagctgctgcactc

SEQ ID NO: 182521 - DNA, 22 bp, Artificial Sequence
  Description of Artificial Sequence: Synthetic oligonucleotide
gccgaggggagctgctgcactc

SEQ ID NO: 182522 - DNA, 22 bp, Artificial Sequence
  Description of Artificial Sequence: Synthetic oligonucleotide
ccgaggggagctgctgcactcc

SEQ ID NO: 182523 - DNA, 24 bp, Artificial Sequence
  Description of Artificial Sequence: Synthetic oligonucleotide
cgaggggagctgctgcactcccta

SEQ ID NO: 182524 - DNA, 25 bp, Artificial Sequence
  Description of Artificial Sequence: Synthetic oligonucleotide
gaggggagctgctgcactccctaga

SEQ ID NO: 182525 - DNA, 25 bp, Artificial Sequence
  Description of Artificial Sequence: Synthetic oligonucleotide
aggggagctgctgcactccctagag

SEQ ID NO: 182526 - DNA, 24 bp, Artificial Sequence
  Description of Artificial Sequence: Synthetic oligonucleotide
ggggagctgctgcactccctagag

SEQ ID NO: 182527 - DNA, 24 bp, Artificial Sequence
  Description of Artificial Sequence: Synthetic oligonucleotide
gggagctgctgcactccctagagg

SEQ ID NO: 182528 - DNA, 24 bp, Artificial Sequence
  Description of Artificial Sequence: Synthetic oligonucleotide
ggagctgctgcactccctagaggg

SEQ ID NO: 182529 - DNA, 26 bp, Artificial Sequence
  Description of Artificial Sequence: Synthetic oligonucleotide
gagctgctgcactccctagagggctt

SEQ ID NO: 182530 - DNA, 26 bp, Artificial Sequence
  Description of Artificial Sequence: Synthetic oligonucleotide
agctgctgcactccctagagggcttc

SEQ ID NO: 182531 - DNA, 25 bp, Artificial Sequence
  Description of Artificial Sequence: Synthetic oligonucleotide
gctgctgcactccctagagggcttc

SEQ ID NO: 182532 - DNA, 26 bp, Artificial Sequence
  Description of Artificial Sequence: Synthetic oligonucleotide
ctgctgcactccctagagggcttcct

SEQ ID NO: 182533 - DNA, 26 bp, Artificial Sequence
  Description of Artificial Sequence: Synthetic oligonucleotide
tgctgcactccctagagggcttcctg

SEQ ID NO: 182534 - DNA, 25 bp, Artificial Sequence
  Description of Artificial Sequence: Synthetic oligonucleotide
gctgcactccctagagggcttcctg

SEQ ID NO: 182535 - DNA, 26 bp, Artificial Sequence
  Description of Artificial Sequence: Synthetic oligonucleotide
ctgcactccctagagggcttcctgga

SEQ ID NO: 182536 - DNA, 27 bp, Artificial Sequence
  Description of Artificial Sequence: Synthetic oligonucleotide
tgcactccctagagggcttcctggact

SEQ ID NO: 182537 - DNA, 26 bp, Artificial Sequence
  Description of Artificial Sequence: Synthetic oligonucleotide
gcactccctagagggcttcctggact

SEQ ID NO: 182538 - DNA, 26 bp, Artificial Sequence
  Description of Artificial Sequence: Synthetic oligonucleotide
cactccctagagggcttcctggactg

SEQ ID NO: 182539 - DNA, 27 bp, Artificial Sequence
  Description of Artificial Sequence: Synthetic oligonucleotide
actccctagagggcttcctggactgca

SEQ ID NO: 182540 - DNA, 26 bp, Artificial Sequence
  Description of Artificial Sequence: Synthetic oligonucleotide
ctccctagagggcttcctggactgca

SEQ ID NO: 182541 - DNA, 26 bp, Artificial Sequence
  Description of Artificial Sequence: Synthetic oligonucleotide
tccctagagggcttcctggactgcag

SEQ ID NO: 182542 - DNA, 25 bp, Artificial Sequence
  Description of Artificial Sequence: Synthetic oligonucleotide
ccctagagggcttcctggactgcag

SEQ ID NO: 182543 - DNA, 25 bp, Artificial Sequence
  Description of Artificial Sequence: Synthetic oligonucleotide
cctagagggcttcctggactgcagc

SEQ ID NO: 182544 - DNA, 27 bp, Artificial Sequence
  Description of Artificial Sequence: Synthetic oligonucleotide
ctagagggcttcctggactgcagccta

SEQ ID NO: 182545 - DNA, 27 bp, Artificial Sequence
  Description of Artificial Sequence: Synthetic oligonucleotide
tagagggcttcctggactgcagcctag

SEQ ID NO: 182546 - DNA, 27 bp, Artificial Sequence
  Description of Artificial Sequence: Synthetic oligonucleotide
agagggcttcctggactgcagcctagt

SEQ ID NO: 182547 - DNA, 26 bp, Artificial Sequence
  Description of Artificial Sequence: Synthetic oligonucleotide
gagggcttcctggactgcagcctagt

SEQ ID NO: 182548 - DNA, 26 bp, Artificial Sequence
  Description of Artificial Sequence: Synthetic oligonucleotide
agggcttcctggactgcagcctagtg

SEQ ID NO: 182549 - DNA, 25 bp, Artificial Sequence
  Description of Artificial Sequence: Synthetic oligonucleotide
gggcttcctggactgcagcctagtg

SEQ ID NO: 182550 - DNA, 26 bp, Artificial Sequence
  Description of Artificial Sequence: Synthetic oligonucleotide
ggcttcctggactgcagcctagtgct

SEQ ID NO: 182551 - DNA, 26 bp, Artificial Sequence
  Description of Artificial Sequence: Synthetic oligonucleotide
gcttcctggactgcagcctagtgctg

SEQ ID NO: 182552 - DNA, 26 bp, Artificial Sequence
  Description of Artificial Sequence: Synthetic oligonucleotide
cttcctggactgcagcctagtgctgc

SEQ ID NO: 182553 - DNA, 27 bp, Artificial Sequence
  Description of Artificial Sequence: Synthetic oligonucleotide
ttcctggactgcagcctagtgctgcct

SEQ ID NO: 182554 - DNA, 26 bp, Artificial Sequence
  Description of Artificial Sequence: Synthetic oligonucleotide
tcctggactgcagcctagtgctgcct

SEQ ID NO: 182555 - DNA, 25 bp, Artificial Sequence
  Description of Artificial Sequence: Synthetic oligonucleotide
cctggactgcagcctagtgctgcct

SEQ ID NO: 182556 - DNA, 25 bp, Artificial Sequence
  Description of Artificial Sequence: Synthetic oligonucleotide
ctggactgcagcctagtgctgcctc

SEQ ID NO: 182557 - DNA, 25 bp, Artificial Sequence
  Description of Artificial Sequence: Synthetic oligonucleotide
tggactgcagcctagtgctgcctcc

SEQ ID NO: 182558 - DNA, 24 bp, Artificial Sequence
  Description of Artificial Sequence: Synthetic oligonucleotide
ggactgcagcctagtgctgcctcc

SEQ ID NO: 182559 - DNA, 25 bp, Artificial Sequence
  Description of Artificial Sequence: Synthetic oligonucleotide
gactgcagcctagtgctgcctccca

SEQ ID NO: 182560 - DNA, 25 bp, Artificial Sequence
  Description of Artificial Sequence: Synthetic oligonucleotide
actgcagcctagtgctgcctcccac

SEQ ID NO: 182561 - DNA, 24 bp, Artificial Sequence
  Description of Artificial Sequence: Synthetic oligonucleotide
ctgcagcctagtgctgcctcccac

SEQ ID NO: 182562 - DNA, 24 bp, Artificial Sequence
  Description of Artificial Sequence: Synthetic oligonucleotide
tgcagcctagtgctgcctcccacc

SEQ ID NO: 182563 - DNA, 23 bp, Artificial Sequence
  Description of Artificial Sequence: Synthetic oligonucleotide
gcagcctagtgctgcctcccacc

SEQ ID NO: 182564 - DNA, 25 bp, Artificial Sequence
  Description of Artificial Sequence: Synthetic oligonucleotide
cagcctagtgctgcctcccaccgat

SEQ ID NO: 182565 - DNA, 25 bp, Artificial Sequence
  Description of Artificial Sequence: Synthetic oligonucleotide
agcctagtgctgcctcccaccgatg

SEQ ID NO: 182566 - DNA, 24 bp, Artificial Sequence
  Description of Artificial Sequence: Synthetic oligonucleotide
gcctagtgctgcctcccaccgatg

SEQ ID NO: 182567 - DNA, 24 bp, Artificial Sequence
  Description of Artificial Sequence: Synthetic oligonucleotide
cctagtgctgcctcccaccgatgc

SEQ ID NO: 182568 - DNA, 24 bp, Artificial Sequence
  Description of Artificial Sequence: Synthetic oligonucleotide
ctagtgctgcctcccaccgatgcc

SEQ ID NO: 182569 - DNA, 24 bp, Artificial Sequence
  Description of Artificial Sequence: Synthetic oligonucleotide
tagtgctgcctcccaccgatgccc

SEQ ID NO: 182570 - DNA, 23 bp, Artificial Sequence
  Description of Artificial Sequence: Synthetic oligonucleotide
agtgctgcctcccaccgatgccc

SEQ ID NO: 182571 - DNA, 22 bp, Artificial Sequence
  Description of Artificial Sequence: Synthetic oligonucleotide
gtgctgcctcccaccgatgccc

SEQ ID NO: 182572 - DNA, 22 bp, Artificial Sequence
  Description of Artificial Sequence: Synthetic oligonucleotide
tgctgcctcccaccgatgcccc

SEQ ID NO: 182573 - DNA, 21 bp, Artificial Sequence
  Description of Artificial Sequence: Synthetic oligonucleotide
gctgcctcccaccgatgcccc

SEQ ID NO: 182574 - DNA, 22 bp, Artificial Sequence
  Description of Artificial Sequence: Synthetic oligonucleotide
ctgcctcccaccgatgccccct

SEQ ID NO: 182575 - DNA, 22 bp, Artificial Sequence
  Description of Artificial Sequence: Synthetic oligonucleotide
tgcctcccaccgatgccccctc

SEQ ID NO: 182576 - DNA, 21 bp, Artificial Sequence
  Description of Artificial Sequence: Synthetic oligonucleotide
gcctcccaccgatgccccctc

SEQ ID NO: 182577 - DNA, 21 bp, Artificial Sequence
  Description of Artificial Sequence: Synthetic oligonucleotide
cctcccaccgatgccccctcc

SEQ ID NO: 182578 - DNA, 22 bp, Artificial Sequence
  Description of Artificial Sequence: Synthetic oligonucleotide
ctcccaccgatgccccctccga

SEQ ID NO: 182579 - DNA, 22 bp, Artificial Sequence
  Description of Artificial Sequence: Synthetic oligonucleotide
tcccaccgatgccccctccgag

SEQ ID NO: 182580 - DNA, 21 bp, Artificial Sequence
  Description of Artificial Sequence: Synthetic oligonucleotide
cccaccgatgccccctccgag

SEQ ID NO: 182581 - DNA, 22 bp, Artificial Sequence
  Description of Artificial Sequence: Synthetic oligonucleotide
ccaccgatgccccctccgagca

SEQ ID NO: 182582 - DNA, 22 bp, Artificial Sequence
  Description of Artificial Sequence: Synthetic oligonucleotide
caccgatgccccctccgagcag

SEQ ID NO: 182583 - DNA, 22 bp, Artificial Sequence
  Description of Artificial Sequence: Synthetic oligonucleotide
accgatgccccctccgagcagg

SEQ ID NO: 182584 - DNA, 21 bp, Artificial Sequence
  Description of Artificial Sequence: Synthetic oligonucleotide
ccgatgccccctccgagcagg

SEQ ID NO: 182585 - DNA, 22 bp, Artificial Sequence
  Description of Artificial Sequence: Synthetic oligonucleotide
cgatgccccctccgagcaggca

SEQ ID NO: 182586 - DNA, 23 bp, Artificial Sequence
  Description of Artificial Sequence: Synthetic oligonucleotide
gatgccccctccgagcaggcact

SEQ ID NO: 182587 - DNA, 23 bp, Artificial Sequence
  Description of Artificial Sequence: Synthetic oligonucleotide
atgccccctccgagcaggcactg

SEQ ID NO: 182588 - DNA, 22 bp, Artificial Sequence
  Description of Artificial Sequence: Synthetic oligonucleotide
tgccccctccgagcaggcactg

SEQ ID NO: 182589 - DNA, 21 bp, Artificial Sequence
  Description of Artificial Sequence: Synthetic oligonucleotide
gccccctccgagcaggcactg

SEQ ID NO: 182590 - DNA, 22 bp, Artificial Sequence
  Description of Artificial Sequence: Synthetic oligonucleotide
ccccctccgagcaggcactgct

SEQ ID NO: 182591 - DNA, 23 bp, Artificial Sequence
  Description of Artificial Sequence: Synthetic oligonucleotide
cccctccgagcaggcactgctca

SEQ ID NO: 182592 - DNA, 24 bp, Artificial Sequence
  Description of Artificial Sequence: Synthetic oligonucleotide
ccctccgagcaggcactgctcagt

SEQ ID NO: 182593 - DNA, 25 bp, Artificial Sequence
  Description of Artificial Sequence: Synthetic oligonucleotide
cctccgagcaggcactgctcagtct

SEQ ID NO: 182594 - DNA, 25 bp, Artificial Sequence
  Description of Artificial Sequence: Synthetic oligonucleotide
ctccgagcaggcactgctcagtctg

SEQ ID NO: 182595 - DNA, 26 bp, Artificial Sequence
  Description of Artificial Sequence: Synthetic oligonucleotide
tccgagcaggcactgctcagtctggt

SEQ ID NO: 182596 - DNA, 25 bp, Artificial Sequence
  Description of Artificial Sequence: Synthetic oligonucleotide
ccgagcaggcactgctcagtctggt

SEQ ID NO: 182597 - DNA, 25 bp, Artificial Sequence
  Description of Artificial Sequence: Synthetic oligonucleotide
cgagcaggcactgctcagtctggtg

SEQ ID NO: 182598 - DNA, 25 bp, Artificial Sequence
  Description of Artificial Sequence: Synthetic oligonucleotide
gagcaggcactgctcagtctggtgc

SEQ ID NO: 182599 - DNA, 26 bp, Artificial Sequence
  Description of Artificial Sequence: Synthetic oligonucleotide
agcaggcactgctcagtctggtgcct

SEQ ID NO: 182600 - DNA, 25 bp, Artificial Sequence
  Description of Artificial Sequence: Synthetic oligonucleotide
gcaggcactgctcagtctggtgcct

SEQ ID NO: 182601 - DNA, 26 bp, Artificial Sequence
  Description of Artificial Sequence: Synthetic oligonucleotide
caggcactgctcagtctggtgcctgt

SEQ ID NO: 182602 - DNA, 26 bp, Artificial Sequence
  Description of Artificial Sequence: Synthetic oligonucleotide
aggcactgctcagtctggtgcctgtg

SEQ ID NO: 182603 - DNA, 25 bp, Artificial Sequence
  Description of Artificial Sequence: Synthetic oligonucleotide
ggcactgctcagtctggtgcctgtg

SEQ ID NO: 182604 - DNA, 26 bp, Artificial Sequence
  Description of Artificial Sequence: Synthetic oligonucleotide
gcactgctcagtctggtgcctgtgca

SEQ ID NO: 182605 - DNA, 27 bp, Artificial Sequence
  Description of Artificial Sequence: Synthetic oligonucleotide
cactgctcagtctggtgcctgtgcaga

SEQ ID NO: 182606 - DNA, 27 bp, Artificial Sequence
  Description of Artificial Sequence: Synthetic oligonucleotide
actgctcagtctggtgcctgtgcagag

SEQ ID NO: 182607 - DNA, 26 bp, Artificial Sequence
  Description of Artificial Sequence: Synthetic oligonucleotide
ctgctcagtctggtgcctgtgcagag

SEQ ID NO: 182608 - DNA, 26 bp, Artificial Sequence
  Description of Artificial Sequence: Synthetic oligonucleotide
tgctcagtctggtgcctgtgcagagg

SEQ ID NO: 182609 - DNA, 25 bp, Artificial Sequence
  Description of Artificial Sequence: Synthetic oligonucleotide
gctcagtctggtgcctgtgcagagg

SEQ ID NO: 182610 - DNA, 26 bp, Artificial Sequence
  Description of Artificial Sequence: Synthetic oligonucleotide
ctcagtctggtgcctgtgcagaggga

SEQ ID NO: 182611 - DNA, 26 bp, Artificial Sequence
  Description of Artificial Sequence: Synthetic oligonucleotide
tcagtctggtgcctgtgcagagggag

SEQ ID NO: 182612 - DNA, 25 bp, Artificial Sequence
  Description of Artificial Sequence: Synthetic oligonucleotide
cagtctggtgcctgtgcagagggag

SEQ ID NO: 182613 - DNA, 27 bp, Artificial Sequence
  Description of Artificial Sequence: Synthetic oligonucleotide
agtctggtgcctgtgcagagggagcta

SEQ ID NO: 182614 - DNA, 26 bp, Artificial Sequence
  Description of Artificial Sequence: Synthetic oligonucleotide
gtctggtgcctgtgcagagggagcta

SEQ ID NO: 182615 - DNA, 27 bp, Artificial Sequence
  Description of Artificial Sequence: Synthetic oligonucleotide
tctggtgcctgtgcagagggagctact

SEQ ID NO: 182616 - DNA, 27 bp, Artificial Sequence
  Description of Artificial Sequence: Synthetic oligonucleotide
ctggtgcctgtgcagagggagctactt

SEQ ID NO: 182617 - DNA, 27 bp, Artificial Sequence
  Description of Artificial Sequence: Synthetic oligonucleotide
tggtgcctgtgcagagggagctacttc

SEQ ID NO: 182618 - DNA, 26 bp, Artificial Sequence
  Description of Artificial Sequence: Synthetic oligonucleotide
ggtgcctgtgcagagggagctacttc

SEQ ID NO: 182619 - DNA, 27 bp, Artificial Sequence
  Description of Artificial Sequence: Synthetic oligonucleotide
gtgcctgtgcagagggagctacttcga

SEQ ID NO: 182620 - DNA, 28 bp, Artificial Sequence
  Description of Artificial Sequence: Synthetic oligonucleotide
tgcctgtgcagagggagctacttcgaag

SEQ ID NO: 182621 - DNA, 27 bp, Artificial Sequence
  Description of Artificial Sequence: Synthetic oligonucleotide
gcctgtgcagagggagctacttcgaag

SEQ ID NO: 182622 - DNA, 27 bp, Artificial Sequence
  Description of Artificial Sequence: Synthetic oligonucleotide
cctgtgcagagggagctacttcgaagg

SEQ ID NO: 182623 - DNA, 27 bp, Artificial Sequence
  Description of Artificial Sequence: Synthetic oligonucleotide
ctgtgcagagggagctacttcgaaggc

SEQ ID NO: 182624 - DNA, 27 bp, Artificial Sequence
  Description of Artificial Sequence: Synthetic oligonucleotide
tgtgcagagggagctacttcgaaggcg

SEQ ID NO: 182625 - DNA, 26 bp, Artificial Sequence
  Description of Artificial Sequence: Synthetic oligonucleotide
gtgcagagggagctacttcgaaggcg

SEQ ID NO: 182626 - DNA, 27 bp, Artificial Sequence
  Description of Artificial Sequence: Synthetic oligonucleotide
tgcagagggagctacttcgaaggcgct

SEQ ID NO: 182627 - DNA, 27 bp, Artificial Sequence
  Description of Artificial Sequence: Synthetic oligonucleotide
gcagagggagctacttcgaaggcgcta

SEQ ID NO: 182628 - DNA, 28 bp, Artificial Sequence
  Description of Artificial Sequence: Synthetic oligonucleotide
cagagggagctacttcgaaggcgctatc

SEQ ID NO: 182629 - DNA, 29 bp, Artificial Sequence
  Description of Artificial Sequence: Synthetic oligonucleotide
agagggagctacttcgaaggcgctatcag

SEQ ID NO: 182630 - DNA, 28 bp, Artificial Sequence
  Description of Artificial Sequence: Synthetic oligonucleotide
gagggagctacttcgaaggcgctatcag

SEQ ID NO: 182631 - DNA, 29 bp, Artificial Sequence
  Description of Artificial Sequence: Synthetic oligonucleotide
agggagctacttcgaaggcgctatcagtc

SEQ ID NO: 182632 - DNA, 28 bp, Artificial Sequence
  Description of Artificial Sequence: Synthetic oligonucleotide
gggagctacttcgaaggcgctatcagtc

SEQ ID NO: 182633 - DNA, 28 bp, Artificial Sequence
  Description of Artificial Sequence: Synthetic oligonucleotide
ggagctacttcgaaggcgctatcagtcc

SEQ ID NO: 182634 - DNA, 29 bp, Artificial Sequence
  Description of Artificial Sequence: Synthetic oligonucleotide
gagctacttcgaaggcgctatcagtccag

SEQ ID NO: 182635 - DNA, 29 bp, Artificial Sequence
  Description of Artificial Sequence: Synthetic oligonucleotide
agctacttcgaaggcgctatcagtccagc

SEQ ID NO: 182636 - DNA, 28 bp, Artificial Sequence
  Description of Artificial Sequence: Synthetic oligonucleotide
gctacttcgaaggcgctatcagtccagc

SEQ ID NO: 182637 - DNA, 28 bp, Artificial Sequence
  Description of Artificial Sequence: Synthetic oligonucleotide
ctacttcgaaggcgctatcagtccagcc

SEQ ID NO: 182638 - DNA, 28 bp, Artificial Sequence
  Description of Artificial Sequence: Synthetic oligonucleotide
tacttcgaaggcgctatcagtccagccc

SEQ ID NO: 182639 - DNA, 27 bp, Artificial Sequence
  Description of Artificial Sequence: Synthetic oligonucleotide
acttcgaaggcgctatcagtccagccc

SEQ ID NO: 182640 - DNA, 27 bp, Artificial Sequence
  Description of Artificial Sequence: Synthetic oligonucleotide
cttcgaaggcgctatcagtccagccct

SEQ ID NO: 182641 - DNA, 27 bp, Artificial Sequence
  Description of Artificial Sequence: Synthetic oligonucleotide
ttcgaaggcgctatcagtccagccctg

SEQ ID NO: 182642 - DNA, 26 bp, Artificial Sequence
  Description of Artificial Sequence: Synthetic oligonucleotide
tcgaaggcgctatcagtccagccctg

SEQ ID NO: 182643 - DNA, 25 bp, Artificial Sequence
  Description of Artificial Sequence: Synthetic oligonucleotide
cgaaggcgctatcagtccagccctg

SEQ ID NO: 182644 - DNA, 25 bp, Artificial Sequence
  Description of Artificial Sequence: Synthetic oligonucleotide
gaaggcgctatcagtccagccctgc

SEQ ID NO: 182645 - DNA, 27 bp, Artificial Sequence
  Description of Artificial Sequence: Synthetic oligonucleotide
aaggcgctatcagtccagccctgccaa

SEQ ID NO: 182646 - DNA, 26 bp, Artificial Sequence
  Description of Artificial Sequence: Synthetic oligonucleotide
aggcgctatcagtccagccctgccaa

SEQ ID NO: 182647 - DNA, 25 bp, Artificial Sequence
  Description of Artificial Sequence: Synthetic oligonucleotide
ggcgctatcagtccagccctgccaa

SEQ ID NO: 182648 - DNA, 25 bp, Artificial Sequence
  Description of Artificial Sequence: Synthetic oligonucleotide
gcgctatcagtccagccctgccaag

SEQ ID NO: 182649 - DNA, 25 bp, Artificial Sequence
  Description of Artificial Sequence: Synthetic oligonucleotide
cgctatcagtccagccctgccaagc

SEQ ID NO: 182650 - DNA, 26 bp, Artificial Sequence
  Description of Artificial Sequence: Synthetic oligonucleotide
gctatcagtccagccctgccaagcca

SEQ ID NO: 182651 - DNA, 27 bp, Artificial Sequence
  Description of Artificial Sequence: Synthetic oligonucleotide
ctatcagtccagccctgccaagccaga

SEQ ID NO: 182652 - DNA, 27 bp, Artificial Sequence
  Description of Artificial Sequence: Synthetic oligonucleotide
tatcagtccagccctgccaagccagac

SEQ ID NO: 182653 - DNA, 27 bp, Artificial Sequence
  Description of Artificial Sequence: Synthetic oligonucleotide
atcagtccagccctgccaagccagact

SEQ ID NO: 182654 - DNA, 26 bp, Artificial Sequence
  Description of Artificial Sequence: Synthetic oligonucleotide
tcagtccagccctgccaagccagact

SEQ ID NO: 182655 - DNA, 25 bp, Artificial Sequence
  Description of Artificial Sequence: Synthetic oligonucleotide
cagtccagccctgccaagccagact

SEQ ID NO: 182656 - DNA, 25 bp, Artificial Sequence
  Description of Artificial Sequence: Synthetic oligonucleotide
agtccagccctgccaagccagactc

SEQ ID NO: 182657 - DNA, 24 bp, Artificial Sequence
  Description of Artificial Sequence: Synthetic oligonucleotide
gtccagccctgccaagccagactc

SEQ ID NO: 182658 - DNA, 25 bp, Artificial Sequence
  Description of Artificial Sequence: Synthetic oligonucleotide
tccagccctgccaagccagactcca

SEQ ID NO: 182659 - DNA, 24 bp, Artificial Sequence
  Description of Artificial Sequence: Synthetic oligonucleotide
ccagccctgccaagccagactcca

SEQ ID NO: 182660 - DNA, 24 bp, Artificial Sequence
  Description of Artificial Sequence: Synthetic oligonucleotide
cagccctgccaagccagactccag

SEQ ID NO: 182661 - DNA, 26 bp, Artificial Sequence
  Description of Artificial Sequence: Synthetic oligonucleotide
agccctgccaagccagactccagctt

SEQ ID NO: 182662 - DNA, 25 bp, Artificial Sequence
  Description of Artificial Sequence: Synthetic oligonucleotide
gccctgccaagccagactccagctt

SEQ ID NO: 182663 - DNA, 27 bp, Artificial Sequence
  Description of Artificial Sequence: Synthetic oligonucleotide
ccctgccaagccagactccagcttcta

SEQ ID NO: 182664 - DNA, 27 bp, Artificial Sequence
  Description of Artificial Sequence: Synthetic oligonucleotide
cctgccaagccagactccagcttctac

SEQ ID NO: 182665 - DNA, 29 bp, Artificial Sequence
  Description of Artificial Sequence: Synthetic oligonucleotide
ctgccaagccagactccagcttctacaag

SEQ ID NO: 182666 - DNA, 29 bp, Artificial Sequence
  Description of Artificial Sequence: Synthetic oligonucleotide
tgccaagccagactccagcttctacaagg

SEQ ID NO: 182667 - DNA, 28 bp, Artificial Sequence
  Description of Artificial Sequence: Synthetic oligonucleotide
gccaagccagactccagcttctacaagg

SEQ ID NO: 182668 - DNA, 28 bp, Artificial Sequence
  Description of Artificial Sequence: Synthetic oligonucleotide
ccaagccagactccagcttctacaaggg

SEQ ID NO: 182669 - DNA, 28 bp, Artificial Sequence
  Description of Artificial Sequence: Synthetic oligonucleotide
caagccagactccagcttctacaagggc

SEQ ID NO: 182670 - DNA, 28 bp, Artificial Sequence
  Description of Artificial Sequence: Synthetic oligonucleotide
aagccagactccagcttctacaagggcc

SEQ ID NO: 182671 - DNA, 27 bp, Artificial Sequence
  Description of Artificial Sequence: Synthetic oligonucleotide
agccagactccagcttctacaagggcc

SEQ ID NO: 182672 - DNA, 27 bp, Artificial Sequence
  Description of Artificial Sequence: Synthetic oligonucleotide
gccagactccagcttctacaagggcct

SEQ ID NO: 182673 - DNA, 28 bp, Artificial Sequence
  Description of Artificial Sequence: Synthetic oligonucleotide
ccagactccagcttctacaagggcctag

SEQ ID NO: 182674 - DNA, 29 bp, Artificial Sequence
  Description of Artificial Sequence: Synthetic oligonucleotide
cagactccagcttctacaagggcctagac

SEQ ID NO: 182675 - DNA, 35 bp, Artificial Sequence
  Description of Artificial Sequence: Synthetic oligonucleotide
agactccagcttctacaagggcctagacttaaatg

SEQ ID NO: 182676 - DNA, 34 bp, Artificial Sequence
  Description of Artificial Sequence: Synthetic oligonucleotide
gactccagcttctacaagggcctagacttaaatg

SEQ ID NO: 182677 - DNA, 34 bp, Artificial Sequence
  Description of Artificial Sequence: Synthetic oligonucleotide
actccagcttctacaagggcctagacttaaatgg

SEQ ID NO: 182678 - DNA, 33 bp, Artificial Sequence
  Description of Artificial Sequence: Synthetic oligonucleotide
ctccagcttctacaagggcctagacttaaatgg

SEQ ID NO: 182679 - DNA, 33 bp, Artificial Sequence
  Description of Artificial Sequence: Synthetic oligonucleotide
tccagcttctacaagggcctagacttaaatggg

SEQ ID NO: 182680 - DNA, 32 bp, Artificial Sequence
  Description of Artificial Sequence: Synthetic oligonucleotide
ccagcttctacaagggcctagacttaaatggg

SEQ ID NO: 182681 - DNA, 32 bp, Artificial Sequence
  Description of Artificial Sequence: Synthetic oligonucleotide
cagcttctacaagggcctagacttaaatgggg

SEQ ID NO: 182682 - DNA, 32 bp, Artificial Sequence
  Description of Artificial Sequence: Synthetic oligonucleotide
agcttctacaagggcctagacttaaatggggg

SEQ ID NO: 182683 - DNA, 31 bp, Artificial Sequence
  Description of Artificial Sequence: Synthetic oligonucleotide
gcttctacaagggcctagacttaaatggggg

SEQ ID NO: 182684 - DNA, 31 bp, Artificial Sequence
  Description of Artificial Sequence: Synthetic oligonucleotide
cttctacaagggcctagacttaaatgggggc

SEQ ID NO: 182685 - DNA, 31 bp, Artificial Sequence
  Description of Artificial Sequence: Synthetic oligonucleotide
ttctacaagggcctagacttaaatgggggcc

SEQ ID NO: 182686 - DNA, 30 bp, Artificial Sequence
  Description of Artificial Sequence: Synthetic oligonucleotide
tctacaagggcctagacttaaatgggggcc

SEQ ID NO: 182687 - DNA, 29 bp, Artificial Sequence
  Description of Artificial Sequence: Synthetic oligonucleotide
ctacaagggcctagacttaaatgggggcc

SEQ ID NO: 182688 - DNA, 29 bp, Artificial Sequence
  Description of Artificial Sequence: Synthetic oligonucleotide
tacaagggcctagacttaaatgggggccc

SEQ ID NO: 182689 - DNA, 28 bp, Artificial Sequence
  Description of Artificial Sequence: Synthetic oligonucleotide
acaagggcctagacttaaatgggggccc

SEQ ID NO: 182690 - DNA, 27 bp, Artificial Sequence
  Description of Artificial Sequence: Synthetic oligonucleotide
caagggcctagacttaaatgggggccc

SEQ ID NO: 182691 - DNA, 28 bp, Artificial Sequence
  Description of Artificial Sequence: Synthetic oligonucleotide
aagggcctagacttaaatgggggcccag

SEQ ID NO: 182692 - DNA, 27 bp, Artificial Sequence
  Description of Artificial Sequence: Synthetic oligonucleotide
agggcctagacttaaatgggggcccag

SEQ ID NO: 182693 - DNA, 27 bp, Artificial Sequence
  Description of Artificial Sequence: Synthetic oligonucleotide
gggcctagacttaaatgggggcccaga

SEQ ID NO: 182694 - DNA, 28 bp, Artificial Sequence
  Description of Artificial Sequence: Synthetic oligonucleotide
ggcctagacttaaatgggggcccagatg

SEQ ID NO: 182695 - DNA, 29 bp, Artificial Sequence
  Description of Artificial Sequence: Synthetic oligonucleotide
gcctagacttaaatgggggcccagatgac

SEQ ID NO: 182696 - DNA, 29 bp, Artificial Sequence
  Description of Artificial Sequence: Synthetic oligonucleotide
cctagacttaaatgggggcccagatgacc

SEQ ID NO: 182697 - DNA, 29 bp, Artificial Sequence
  Description of Artificial Sequence: Synthetic oligonucleotide
ctagacttaaatgggggcccagatgaccc

SEQ ID NO: 182698 - DNA, 30 bp, Artificial Sequence
  Description of Artificial Sequence: Synthetic oligonucleotide
tagacttaaatgggggcccagatgaccctc

SEQ ID NO: 182699 - DNA, 29 bp, Artificial Sequence
  Description of Artificial Sequence: Synthetic oligonucleotide
agacttaaatgggggcccagatgaccctc

SEQ ID NO: 182700 - DNA, 28 bp, Artificial Sequence
  Description of Artificial Sequence: Synthetic oligonucleotide
gacttaaatgggggcccagatgaccctc

SEQ ID NO: 182701 - DNA, 29 bp, Artificial Sequence
  Description of Artificial Sequence: Synthetic oligonucleotide
acttaaatgggggcccagatgaccctctg

SEQ ID NO: 182702 - DNA, 28 bp, Artificial Sequence
  Description of Artificial Sequence: Synthetic oligonucleotide
cttaaatgggggcccagatgaccctctg

SEQ ID NO: 182703 - DNA, 28 bp, Artificial Sequence
  Description of Artificial Sequence: Synthetic oligonucleotide
ttaaatgggggcccagatgaccctctgc

SEQ ID NO: 182704 - DNA, 27 bp, Artificial Sequence
  Description of Artificial Sequence: Synthetic oligonucleotide
taaatgggggcccagatgaccctctgc

SEQ ID NO: 182705 - DNA, 27 bp, Artificial Sequence
  Description of Artificial Sequence: Synthetic oligonucleotide
aaatgggggcccagatgaccctctgca

SEQ ID NO: 182706 - DNA, 26 bp, Artificial Sequence
  Description of Artificial Sequence: Synthetic oligonucleotide
aatgggggcccagatgaccctctgca

SEQ ID NO: 182707 - DNA, 25 bp, Artificial Sequence
  Description of Artificial Sequence: Synthetic oligonucleotide
atgggggcccagatgaccctctgca

SEQ ID NO: 182708 - DNA, 24 bp, Artificial Sequence
  Description of Artificial Sequence: Synthetic oligonucleotide
tgggggcccagatgaccctctgca

SEQ ID NO: 182709 - DNA, 23 bp, Artificial Sequence
  Description of Artificial Sequence: Synthetic oligonucleotide
gggggcccagatgaccctctgca

SEQ ID NO: 182710 - DNA, 23 bp, Artificial Sequence
  Description of Artificial Sequence: Synthetic oligonucleotide
ggggcccagatgaccctctgcag

SEQ ID NO: 182711 - DNA, 24 bp, Artificial Sequence
  Description of Artificial Sequence: Synthetic oligonucleotide
gggcccagatgaccctctgcagca

SEQ ID NO: 182712 - DNA, 25 bp, Artificial Sequence
  Description of Artificial Sequence: Synthetic oligonucleotide
ggcccagatgaccctctgcagcaga

SEQ ID NO: 182713 - DNA, 26 bp, Artificial Sequence
  Description of Artificial Sequence: Synthetic oligonucleotide
gcccagatgaccctctgcagcagaca

SEQ ID NO: 182714 - DNA, 26 bp, Artificial Sequence
  Description of Artificial Sequence: Synthetic oligonucleotide
cccagatgaccctctgcagcagacag

SEQ ID NO: 182715 - DNA, 26 bp, Artificial Sequence
  Description of Artificial Sequence: Synthetic oligonucleotide
ccagatgaccctctgcagcagacagg

SEQ ID NO: 182716 - DNA, 26 bp, Artificial Sequence
  Description of Artificial Sequence: Synthetic oligonucleotide
cagatgaccctctgcagcagacaggc

SEQ ID NO: 182717 - DNA, 27 bp, Artificial Sequence
  Description of Artificial Sequence: Synthetic oligonucleotide
agatgaccctctgcagcagacaggcca

SEQ ID NO: 182718 - DNA, 26 bp, Artificial Sequence
  Description of Artificial Sequence: Synthetic oligonucleotide
gatgaccctctgcagcagacaggcca

SEQ ID NO: 182719 - DNA, 26 bp, Artificial Sequence
  Description of Artificial Sequence: Synthetic oligonucleotide
atgaccctctgcagcagacaggccag

SEQ ID NO: 182720 - DNA, 25 bp, Artificial Sequence
  Description of Artificial Sequence: Synthetic oligonucleotide
tgaccctctgcagcagacaggccag

SEQ ID NO: 182721 - DNA, 24 bp, Artificial Sequence
  Description of Artificial Sequence: Synthetic oligonucleotide
gaccctctgcagcagacaggccag

SEQ ID NO: 182722 - DNA, 25 bp, Artificial Sequence
  Description of Artificial Sequence: Synthetic oligonucleotide
accctctgcagcagacaggccagct

SEQ ID NO: 182723 - DNA, 24 bp, Artificial Sequence
  Description of Artificial Sequence: Synthetic oligonucleotide
ccctctgcagcagacaggccagct

SEQ ID NO: 182724 - DNA, 26 bp, Artificial Sequence
  Description of Artificial Sequence: Synthetic oligonucleotide
cctctgcagcagacaggccagctctt

SEQ ID NO: 182725 - DNA, 26 bp, Artificial Sequence
  Description of Artificial Sequence: Synthetic oligonucleotide
ctctgcagcagacaggccagctcttc

SEQ ID NO: 182726 - DNA, 26 bp, Artificial Sequence
  Description of Artificial Sequence: Synthetic oligonucleotide
tctgcagcagacaggccagctcttcg

SEQ ID NO: 182727 - DNA, 25 bp, Artificial Sequence
  Description of Artificial Sequence: Synthetic oligonucleotide
ctgcagcagacaggccagctcttcg

SEQ ID NO: 182728 - DNA, 25 bp, Artificial Sequence
  Description of Artificial Sequence: Synthetic oligonucleotide
tgcagcagacaggccagctcttcgg

SEQ ID NO: 182729 - DNA, 24 bp, Artificial Sequence
  Description of Artificial Sequence: Synthetic oligonucleotide
gcagcagacaggccagctcttcgg

SEQ ID NO: 182730 - DNA, 24 bp, Artificial Sequence
  Description of Artificial Sequence: Synthetic oligonucleotide
cagcagacaggccagctcttcggg

SEQ ID NO: 182731 - DNA, 24 bp, Artificial Sequence
  Description of Artificial Sequence: Synthetic oligonucleotide
agcagacaggccagctcttcgggg

SEQ ID NO: 182732 - DNA, 23 bp, Artificial Sequence
  Description of Artificial Sequence: Synthetic oligonucleotide
gcagacaggccagctcttcgggg

SEQ ID NO: 182733 - DNA, 23 bp, Artificial Sequence
  Description of Artificial Sequence: Synthetic oligonucleotide
cagacaggccagctcttcggggg

SEQ ID NO: 182734 - DNA, 23 bp, Artificial Sequence
  Description of Artificial Sequence: Synthetic oligonucleotide
agacaggccagctcttcgggggc

SEQ ID NO: 182735 - DNA, 22 bp, Artificial Sequence
  Description of Artificial Sequence: Synthetic oligonucleotide
gacaggccagctcttcgggggc

SEQ ID NO: 182736 - DNA, 23 bp, Artificial Sequence
  Description of Artificial Sequence: Synthetic oligonucleotide
acaggccagctcttcgggggcct

SEQ ID NO: 182737 - DNA, 22 bp, Artificial Sequence
  Description of Artificial Sequence: Synthetic oligonucleotide
caggccagctcttcgggggcct

SEQ ID NO: 182738 - DNA, 22 bp, Artificial Sequence
  Description of Artificial Sequence: Synthetic oligonucleotide
aggccagctcttcgggggcctg

SEQ ID NO: 182739 - DNA, 21 bp, Artificial Sequence
  Description of Artificial Sequence: Synthetic oligonucleotide
ggccagctcttcgggggcctg

SEQ ID NO: 182740 - DNA, 22 bp, Artificial Sequence
  Description of Artificial Sequence: Synthetic oligonucleotide
gccagctcttcgggggcctggt

SEQ ID NO: 182741 - DNA, 22 bp, Artificial Sequence
  Description of Artificial Sequence: Synthetic oligonucleotide
ccagctcttcgggggcctggtg

SEQ ID NO: 182742 - DNA, 22 bp, Artificial Sequence
  Description of Artificial Sequence: Synthetic oligonucleotide
cagctcttcgggggcctggtgc

SEQ ID NO: 182743 - DNA, 23 bp, Artificial Sequence
  Description of Artificial Sequence: Synthetic oligonucleotide
agctcttcgggggcctggtgcgt

SEQ ID NO: 182744 - DNA, 22 bp, Artificial Sequence
  Description of Artificial Sequence: Synthetic oligonucleotide
gctcttcgggggcctggtgcgt

SEQ ID NO: 182745 - DNA, 26 bp, Artificial Sequence
  Description of Artificial Sequence: Synthetic oligonucleotide
ctcttcgggggcctggtgcgtgatat

SEQ ID NO: 182746 - DNA, 26 bp, Artificial Sequence
  Description of Artificial Sequence: Synthetic oligonucleotide
tcttcgggggcctggtgcgtgatatc

SEQ ID NO: 182747 - DNA, 25 bp, Artificial Sequence
  Description of Artificial Sequence: Synthetic oligonucleotide
cttcgggggcctggtgcgtgatatc

SEQ ID NO: 182748 - DNA, 25 bp, Artificial Sequence
  Description of Artificial Sequence: Synthetic oligonucleotide
ttcgggggcctggtgcgtgatatcc

SEQ ID NO: 182749 - DNA, 24 bp, Artificial Sequence
  Description of Artificial Sequence: Synthetic oligonucleotide
tcgggggcctggtgcgtgatatcc

SEQ ID NO: 182750 - DNA, 23 bp, Artificial Sequence
  Description of Artificial Sequence: Synthetic oligonucleotide
cgggggcctggtgcgtgatatcc

SEQ ID NO: 182751 - DNA, 23 bp, Artificial Sequence
  Description of Artificial Sequence: Synthetic oligonucleotide
gggggcctggtgcgtgatatccg

SEQ ID NO: 182752 - DNA, 23 bp, Artificial Sequence
  Description of Artificial Sequence: Synthetic oligonucleotide
ggggcctggtgcgtgatatccgg

SEQ ID NO: 182753 - DNA, 23 bp, Artificial Sequence
  Description of Artificial Sequence: Synthetic oligonucleotide
gggcctggtgcgtgatatccggc

SEQ ID NO: 182754 - DNA, 23 bp, Artificial Sequence
  Description of Artificial Sequence: Synthetic oligonucleotide
ggcctggtgcgtgatatccggcg

SEQ ID NO: 182755 - DNA, 23 bp, Artificial Sequence
  Description of Artificial Sequence: Synthetic oligonucleotide
gcctggtgcgtgatatccggcgc

SEQ ID NO: 182756 - DNA, 23 bp, Artificial Sequence
  Description of Artificial Sequence: Synthetic oligonucleotide
cctggtgcgtgatatccggcgcc

SEQ ID NO: 182757 - DNA, 23 bp, Artificial Sequence
  Description of Artificial Sequence: Synthetic oligonucleotide
ctggtgcgtgatatccggcgccg

SEQ ID NO: 182758 - DNA, 25 bp, Artificial Sequence
  Description of Artificial Sequence: Synthetic oligonucleotide
tggtgcgtgatatccggcgccgcta

SEQ ID NO: 182759 - DNA, 24 bp, Artificial Sequence
  Description of Artificial Sequence: Synthetic oligonucleotide
ggtgcgtgatatccggcgccgcta

SEQ ID NO: 182760 - DNA, 24 bp, Artificial Sequence
  Description of Artificial Sequence: Synthetic oligonucleotide
gtgcgtgatatccggcgccgctac

SEQ ID NO: 182761 - DNA, 24 bp, Artificial Sequence
  Description of Artificial Sequence: Synthetic oligonucleotide
tgcgtgatatccggcgccgctacc

SEQ ID NO: 182762 - DNA, 23 bp, Artificial Sequence
  Description of Artificial Sequence: Synthetic oligonucleotide
gcgtgatatccggcgccgctacc

SEQ ID NO: 182763 - DNA, 23 bp, Artificial Sequence
  Description of Artificial Sequence: Synthetic oligonucleotide
cgtgatatccggcgccgctaccc

SEQ ID NO: 182764 - DNA, 27 bp, Artificial Sequence
  Description of Artificial Sequence: Synthetic oligonucleotide
gtgatatccggcgccgctacccctatt

SEQ ID NO: 182765 - DNA, 28 bp, Artificial Sequence
  Description of Artificial Sequence: Synthetic oligonucleotide
tgatatccggcgccgctacccctattac

SEQ ID NO: 182766 - DNA, 27 bp, Artificial Sequence
  Description of Artificial Sequence: Synthetic oligonucleotide
gatatccggcgccgctacccctattac

SEQ ID NO: 182767 - DNA, 27 bp, Artificial Sequence
  Description of Artificial Sequence: Synthetic oligonucleotide
atatccggcgccgctacccctattacc

SEQ ID NO: 182768 - DNA, 27 bp, Artificial Sequence
  Description of Artificial Sequence: Synthetic oligonucleotide
tatccggcgccgctacccctattacct

SEQ ID NO: 182769 - DNA, 26 bp, Artificial Sequence
  Description of Artificial Sequence: Synthetic oligonucleotide
atccggcgccgctacccctattacct

SEQ ID NO: 182770 - DNA, 25 bp, Artificial Sequence
  Description of Artificial Sequence: Synthetic oligonucleotide
tccggcgccgctacccctattacct

SEQ ID NO: 182771 - DNA, 24 bp, Artificial Sequence
  Description of Artificial Sequence: Synthetic oligonucleotide
ccggcgccgctacccctattacct

SEQ ID NO: 182772 - DNA, 25 bp, Artificial Sequence
  Description of Artificial Sequence: Synthetic oligonucleotide
cggcgccgctacccctattacctga

SEQ ID NO: 182773 - DNA, 26 bp, Artificial Sequence
  Description of Artificial Sequence: Synthetic oligonucleotide
ggcgccgctacccctattacctgagt

SEQ ID NO: 182774 - DNA, 27 bp, Artificial Sequence
  Description of Artificial Sequence: Synthetic oligonucleotide
gcgccgctacccctattacctgagtga

SEQ ID NO: 182775 - DNA, 27 bp, Artificial Sequence
  Description of Artificial Sequence: Synthetic oligonucleotide
cgccgctacccctattacctgagtgac

SEQ ID NO: 182776 - DNA, 29 bp, Artificial Sequence
  Description of Artificial Sequence: Synthetic oligonucleotide
gccgctacccctattacctgagtgacatc

SEQ ID NO: 182777 - DNA, 30 bp, Artificial Sequence
  Description of Artificial Sequence: Synthetic oligonucleotide
ccgctacccctattacctgagtgacatcac

SEQ ID NO: 182778 - DNA, 31 bp, Artificial Sequence
  Description of Artificial Sequence: Synthetic oligonucleotide
cgctacccctattacctgagtgacatcacag

SEQ ID NO: 182779 - DNA, 33 bp, Artificial Sequence
  Description of Artificial Sequence: Synthetic oligonucleotide
gctacccctattacctgagtgacatcacagatg

SEQ ID NO: 182780 - DNA, 33 bp, Artificial Sequence
  Description of Artificial Sequence: Synthetic oligonucleotide
ctacccctattacctgagtgacatcacagatgc

SEQ ID NO: 182781 - DNA, 36 bp, Artificial Sequence
  Description of Artificial Sequence: Synthetic oligonucleotide
tacccctattacctgagtgacatcacagatgcattc

SEQ ID NO: 182782 - DNA, 35 bp, Artificial Sequence
  Description of Artificial Sequence: Synthetic oligonucleotide
acccctattacctgagtgacatcacagatgcattc

SEQ ID NO: 182783 - DNA, 34 bp, Artificial Sequence
  Description of Artificial Sequence: Synthetic oligonucleotide
cccctattacctgagtgacatcacagatgcattc

SEQ ID NO: 182784 - DNA, 35 bp, Artificial Sequence
  Description of Artificial Sequence: Synthetic oligonucleotide
ccctattacctgagtgacatcacagatgcattcag

SEQ ID NO: 182785 - DNA, 35 bp, Artificial Sequence
  Description of Artificial Sequence: Synthetic oligonucleotide
cctattacctgagtgacatcacagatgcattcagc

SEQ ID NO: 182786 - DNA, 35 bp, Artificial Sequence
  Description of Artificial Sequence: Synthetic oligonucleotide
ctattacctgagtgacatcacagatgcattcagcc

SEQ ID NO: 182787 - DNA, 35 bp, Artificial Sequence
  Description of Artificial Sequence: Synthetic oligonucleotide
tattacctgagtgacatcacagatgcattcagccc

SEQ ID NO: 182788 - DNA, 34 bp, Artificial Sequence
  Description of Artificial Sequence: Synthetic oligonucleotide
attacctgagtgacatcacagatgcattcagccc

SEQ ID NO: 182789 - DNA, 33 bp, Artificial Sequence
  Description of Artificial Sequence: Synthetic oligonucleotide
ttacctgagtgacatcacagatgcattcagccc

SEQ ID NO: 182790 - DNA, 32 bp, Artificial Sequence
  Description of Artificial Sequence: Synthetic oligonucleotide
tacctgagtgacatcacagatgcattcagccc

SEQ ID NO: 182791 - DNA, 31 bp, Artificial Sequence
  Description of Artificial Sequence: Synthetic oligonucleotide
acctgagtgacatcacagatgcattcagccc

SEQ ID NO: 182792 - DNA, 30 bp, Artificial Sequence
  Description of Artificial Sequence: Synthetic oligonucleotide
cctgagtgacatcacagatgcattcagccc

SEQ ID NO: 182793 - DNA, 30 bp, Artificial Sequence
  Description of Artificial Sequence: Synthetic oligonucleotide
ctgagtgacatcacagatgcattcagcccc

SEQ ID NO: 182794 - DNA, 30 bp, Artificial Sequence
  Description of Artificial Sequence: Synthetic oligonucleotide
tgagtgacatcacagatgcattcagccccc

SEQ ID NO: 182795 - DNA, 29 bp, Artificial Sequence
  Description of Artificial Sequence: Synthetic oligonucleotide
gagtgacatcacagatgcattcagccccc

SEQ ID NO: 182796 - DNA, 30 bp, Artificial Sequence
  Description of Artificial Sequence: Synthetic oligonucleotide
agtgacatcacagatgcattcagcccccag

SEQ ID NO: 182797 - DNA, 29 bp, Artificial Sequence
  Description of Artificial Sequence: Synthetic oligonucleotide
gtgacatcacagatgcattcagcccccag

SEQ ID NO: 182798 - DNA, 29 bp, Artificial Sequence
  Description of Artificial Sequence: Synthetic oligonucleotide
tgacatcacagatgcattcagcccccagg

SEQ ID NO: 182799 - DNA, 28 bp, Artificial Sequence
  Description of Artificial Sequence: Synthetic oligonucleotide
gacatcacagatgcattcagcccccagg

SEQ ID NO: 182800 - DNA, 29 bp, Artificial Sequence
  Description of Artificial Sequence: Synthetic oligonucleotide
acatcacagatgcattcagcccccaggtc

SEQ ID NO: 182801 - DNA, 28 bp, Artificial Sequence
  Description of Artificial Sequence: Synthetic oligonucleotide
catcacagatgcattcagcccccaggtc

SEQ ID NO: 182802 - DNA, 28 bp, Artificial Sequence
  Description of Artificial Sequence: Synthetic oligonucleotide
atcacagatgcattcagcccccaggtcc

SEQ ID NO: 182803 - DNA, 27 bp, Artificial Sequence
  Description of Artificial Sequence: Synthetic oligonucleotide
tcacagatgcattcagcccccaggtcc

SEQ ID NO: 182804 - DNA, 27 bp, Artificial Sequence
  Description of Artificial Sequence: Synthetic oligonucleotide
cacagatgcattcagcccccaggtcct

SEQ ID NO: 182805 - DNA, 27 bp, Artificial Sequence
  Description of Artificial Sequence: Synthetic oligonucleotide
acagatgcattcagcccccaggtcctg

SEQ ID NO: 182806 - DNA, 26 bp, Artificial Sequence
  Description of Artificial Sequence: Synthetic oligonucleotide
cagatgcattcagcccccaggtcctg

SEQ ID NO: 182807 - DNA, 26 bp, Artificial Sequence
  Description of Artificial Sequence: Synthetic oligonucleotide
agatgcattcagcccccaggtcctgg

SEQ ID NO: 182808 - DNA, 25 bp, Artificial Sequence
  Description of Artificial Sequence: Synthetic oligonucleotide
gatgcattcagcccccaggtcctgg

SEQ ID NO: 182809 - DNA, 26 bp, Artificial Sequence
  Description of Artificial Sequence: Synthetic oligonucleotide
atgcattcagcccccaggtcctggct

SEQ ID NO: 182810 - DNA, 25 bp, Artificial Sequence
  Description of Artificial Sequence: Synthetic oligonucleotide
tgcattcagcccccaggtcctggct

SEQ ID NO: 182811 - DNA, 24 bp, Artificial Sequence
  Description of Artificial Sequence: Synthetic oligonucleotide
gcattcagcccccaggtcctggct

SEQ ID NO: 182812 - DNA, 24 bp, Artificial Sequence
  Description of Artificial Sequence: Synthetic oligonucleotide
cattcagcccccaggtcctggctg

SEQ ID NO: 182813 - DNA, 24 bp, Artificial Sequence
  Description of Artificial Sequence: Synthetic oligonucleotide
attcagcccccaggtcctggctgc

SEQ ID NO: 182814 - DNA, 23 bp, Artificial Sequence
  Description of Artificial Sequence: Synthetic oligonucleotide
ttcagcccccaggtcctggctgc

SEQ ID NO: 182815 - DNA, 22 bp, Artificial Sequence
  Description of Artificial Sequence: Synthetic oligonucleotide
tcagcccccaggtcctggctgc

SEQ ID NO: 182816 - DNA, 21 bp, Artificial Sequence
  Description of Artificial Sequence: Synthetic oligonucleotide
cagcccccaggtcctggctgc

SEQ ID NO: 182817 - DNA, 21 bp, Artificial Sequence
  Description of Artificial Sequence: Synthetic oligonucleotide
agcccccaggtcctggctgcc

SEQ ID NO: 182818 - DNA, 20 bp, Artificial Sequence
  Description of Artificial Sequence: Synthetic oligonucleotide
gcccccaggtcctggctgcc

SEQ ID NO: 182819 - DNA, 21 bp, Artificial Sequence
  Description of Artificial Sequence: Synthetic oligonucleotide
cccccaggtcctggctgccgt

SEQ ID NO: 182820 - DNA, 23 bp, Artificial Sequence
  Description of Artificial Sequence: Synthetic oligonucleotide
ccccaggtcctggctgccgtcat

SEQ ID NO: 182821 - DNA, 25 bp, Artificial Sequence
  Description of Artificial Sequence: Synthetic oligonucleotide
cccaggtcctggctgccgtcatctt

SEQ ID NO: 182822 - DNA, 27 bp, Artificial Sequence
  Description of Artificial Sequence: Synthetic oligonucleotide
ccaggtcctggctgccgtcatcttcat

SEQ ID NO: 182823 - DNA, 27 bp, Artificial Sequence
  Description of Artificial Sequence: Synthetic oligonucleotide
caggtcctggctgccgtcatcttcatc

SEQ ID NO: 182824 - DNA, 29 bp, Artificial Sequence
  Description of Artificial Sequence: Synthetic oligonucleotide
aggtcctggctgccgtcatcttcatctac

SEQ ID NO: 182825 - DNA, 28 bp, Artificial Sequence
  Description of Artificial Sequence: Synthetic oligonucleotide
ggtcctggctgccgtcatcttcatctac

SEQ ID NO: 182826 - DNA, 31 bp, Artificial Sequence
  Description of Artificial Sequence: Synthetic oligonucleotide
gtcctggctgccgtcatcttcatctactttg

SEQ ID NO: 182827 - DNA, 31 bp, Artificial Sequence
  Description of Artificial Sequence: Synthetic oligonucleotide
tcctggctgccgtcatcttcatctactttgc

SEQ ID NO: 182828 - DNA, 30 bp, Artificial Sequence
  Description of Artificial Sequence: Synthetic oligonucleotide
cctggctgccgtcatcttcatctactttgc

SEQ ID NO: 182829 - DNA, 31 bp, Artificial Sequence
  Description of Artificial Sequence: Synthetic oligonucleotide
ctggctgccgtcatcttcatctactttgctg

SEQ ID NO: 182830 - DNA, 31 bp, Artificial Sequence
  Description of Artificial Sequence: Synthetic oligonucleotide
tggctgccgtcatcttcatctactttgctgc

SEQ ID NO: 182831 - DNA, 30 bp, Artificial Sequence
  Description of Artificial Sequence: Synthetic oligonucleotide
ggctgccgtcatcttcatctactttgctgc

SEQ ID NO: 182832 - DNA, 31 bp, Artificial Sequence
  Description of Artificial Sequence: Synthetic oligonucleotide
gctgccgtcatcttcatctactttgctgcac

SEQ ID NO: 182833 - DNA, 32 bp, Artificial Sequence
  Description of Artificial Sequence: Synthetic oligonucleotide
ctgccgtcatcttcatctactttgctgcactg

SEQ ID NO: 182834 - DNA, 33 bp, Artificial Sequence
  Description of Artificial Sequence: Synthetic oligonucleotide
tgccgtcatcttcatctactttgctgcactgtc

SEQ ID NO: 182835 - DNA, 32 bp, Artificial Sequence
  Description of Artificial Sequence: Synthetic oligonucleotide
gccgtcatcttcatctactttgctgcactgtc

SEQ ID NO: 182836 - DNA, 33 bp, Artificial Sequence
  Description of Artificial Sequence: Synthetic oligonucleotide
ccgtcatcttcatctactttgctgcactgtcac

SEQ ID NO: 182837 - DNA, 33 bp, Artificial Sequence
  Description of Artificial Sequence: Synthetic oligonucleotide
cgtcatcttcatctactttgctgcactgtcacc

SEQ ID NO: 182838 - DNA, 33 bp, Artificial Sequence
  Description of Artificial Sequence: Synthetic oligonucleotide
gtcatcttcatctactttgctgcactgtcaccc

SEQ ID NO: 182839 - DNA, 33 bp, Artificial Sequence
  Description of Artificial Sequence: Synthetic oligonucleotide
tcatcttcatctactttgctgcactgtcacccg

SEQ ID NO: 182840 - DNA, 32 bp, Artificial Sequence
  Description of Artificial Sequence: Synthetic oligonucleotide
catcttcatctactttgctgcactgtcacccg

SEQ ID NO: 182841 - DNA, 32 bp, Artificial Sequence
  Description of Artificial Sequence: Synthetic oligonucleotide
atcttcatctactttgctgcactgtcacccgc

SEQ ID NO: 182842 - DNA, 31 bp, Artificial Sequence
  Description of Artificial Sequence: Synthetic oligonucleotide
tcttcatctactttgctgcactgtcacccgc

SEQ ID NO: 182843 - DNA, 30 bp, Artificial Sequence
  Description of Artificial Sequence: Synthetic oligonucleotide
cttcatctactttgctgcactgtcacccgc

SEQ ID NO: 182844 - DNA, 30 bp, Artificial Sequence
  Description of Artificial Sequence: Synthetic oligonucleotide
ttcatctactttgctgcactgtcacccgcc

SEQ ID NO: 182845 - DNA, 29 bp, Artificial Sequence
  Description of Artificial Sequence: Synthetic oligonucleotide
tcatctactttgctgcactgtcacccgcc

SEQ ID NO: 182846 - DNA, 28 bp, Artificial Sequence
  Description of Artificial Sequence: Synthetic oligonucleotide
catctactttgctgcactgtcacccgcc

SEQ ID NO: 182847 - DNA, 30 bp, Artificial Sequence
  Description of Artificial Sequence: Synthetic oligonucleotide
atctactttgctgcactgtcacccgccatc

SEQ ID NO: 182848 - DNA, 29 bp, Artificial Sequence
  Description of Artificial Sequence: Synthetic oligonucleotide
tctactttgctgcactgtcacccgccatc

SEQ ID NO: 182849 - DNA, 28 bp, Artificial Sequence
  Description of Artificial Sequence: Synthetic oligonucleotide
ctactttgctgcactgtcacccgccatc

SEQ ID NO: 182850 - DNA, 29 bp, Artificial Sequence
  Description of Artificial Sequence: Synthetic oligonucleotide
tactttgctgcactgtcacccgccatcac

SEQ ID NO: 182851 - DNA, 28 bp, Artificial Sequence
  Description of Artificial Sequence: Synthetic oligonucleotide
actttgctgcactgtcacccgccatcac

SEQ ID NO: 182852 - DNA, 27 bp, Artificial Sequence
  Description of Artificial Sequence: Synthetic oligonucleotide
ctttgctgcactgtcacccgccatcac

SEQ ID NO: 182853 - DNA, 27 bp, Artificial Sequence
  Description of Artificial Sequence: Synthetic oligonucleotide
tttgctgcactgtcacccgccatcacc

SEQ ID NO: 182854 - DNA, 27 bp, Artificial Sequence
  Description of Artificial Sequence: Synthetic oligonucleotide
ttgctgcactgtcacccgccatcacct

SEQ ID NO: 182855 - DNA, 27 bp, Artificial Sequence
  Description of Artificial Sequence: Synthetic oligonucleotide
tgctgcactgtcacccgccatcacctt

SEQ ID NO: 182856 - DNA, 26 bp, Artificial Sequence
  Description of Artificial Sequence: Synthetic oligonucleotide
gctgcactgtcacccgccatcacctt

SEQ ID NO: 182857 - DNA, 26 bp, Artificial Sequence
  Description of Artificial Sequence: Synthetic oligonucleotide
ctgcactgtcacccgccatcaccttc

SEQ ID NO: 182858 - DNA, 26 bp, Artificial Sequence
  Description of Artificial Sequence: Synthetic oligonucleotide
tgcactgtcacccgccatcaccttcg

SEQ ID NO: 182859 - DNA, 25 bp, Artificial Sequence
  Description of Artificial Sequence: Synthetic oligonucleotide
gcactgtcacccgccatcaccttcg

SEQ ID NO: 182860 - DNA, 25 bp, Artificial Sequence
  Description of Artificial Sequence: Synthetic oligonucleotide
cactgtcacccgccatcaccttcgg

SEQ ID NO: 182861 - DNA, 25 bp, Artificial Sequence
  Description of Artificial Sequence: Synthetic oligonucleotide
actgtcacccgccatcaccttcggc

SEQ ID NO: 182862 - DNA, 24 bp, Artificial Sequence
  Description of Artificial Sequence: Synthetic oligonucleotide
ctgtcacccgccatcaccttcggc

SEQ ID NO: 182863 - DNA, 24 bp, Artificial Sequence
  Description of Artificial Sequence: Synthetic oligonucleotide
tgtcacccgccatcaccttcggcg

SEQ ID NO: 182864 - DNA, 23 bp, Artificial Sequence
  Description of Artificial Sequence: Synthetic oligonucleotide
gtcacccgccatcaccttcggcg

SEQ ID NO: 182865 - DNA, 23 bp, Artificial Sequence
  Description of Artificial Sequence: Synthetic oligonucleotide
tcacccgccatcaccttcggcgg

SEQ ID NO: 182866 - DNA, 22 bp, Artificial Sequence
  Description of Artificial Sequence: Synthetic oligonucleotide
cacccgccatcaccttcggcgg

SEQ ID NO: 182867 - DNA, 22 bp, Artificial Sequence
  Description of Artificial Sequence: Synthetic oligonucleotide
acccgccatcaccttcggcggc

SEQ ID NO: 182868 - DNA, 21 bp, Artificial Sequence
  Description of Artificial Sequence: Synthetic oligonucleotide
cccgccatcaccttcggcggc

SEQ ID NO: 182869 - DNA, 22 bp, Artificial Sequence
  Description of Artificial Sequence: Synthetic oligonucleotide
ccgccatcaccttcggcggcct

SEQ ID NO: 182870 - DNA, 22 bp, Artificial Sequence
  Description of Artificial Sequence: Synthetic oligonucleotide
cgccatcaccttcggcggcctc

SEQ ID NO: 182871 - DNA, 23 bp, Artificial Sequence
  Description of Artificial Sequence: Synthetic oligonucleotide
gccatcaccttcggcggcctcct

SEQ ID NO: 182872 - DNA, 23 bp, Artificial Sequence
  Description of Artificial Sequence: Synthetic oligonucleotide
ccatcaccttcggcggcctcctg

SEQ ID NO: 182873 - DNA, 23 bp, Artificial Sequence
  Description of Artificial Sequence: Synthetic oligonucleotide
catcaccttcggcggcctcctgg

SEQ ID NO: 182874 - DNA, 24 bp, Artificial Sequence
  Description of Artificial Sequence: Synthetic oligonucleotide
atcaccttcggcggcctcctggga

SEQ ID NO: 182875 - DNA, 23 bp, Artificial Sequence
  Description of Artificial Sequence: Synthetic oligonucleotide
tcaccttcggcggcctcctggga

SEQ ID NO: 182876 - DNA, 22 bp, Artificial Sequence
  Description of Artificial Sequence: Synthetic oligonucleotide
caccttcggcggcctcctggga

SEQ ID NO: 182877 - DNA, 26 bp, Artificial Sequence
  Description of Artificial Sequence: Synthetic oligonucleotide
accttcggcggcctcctgggagaaaa

SEQ ID NO: 182878 - DNA, 25 bp, Artificial Sequence
  Description of Artificial Sequence: Synthetic oligonucleotide
ccttcggcggcctcctgggagaaaa

SEQ ID NO: 182879 - DNA, 26 bp, Artificial Sequence
  Description of Artificial Sequence: Synthetic oligonucleotide
cttcggcggcctcctgggagaaaaga

SEQ ID NO: 182880 - DNA, 26 bp, Artificial Sequence
  Description of Artificial Sequence: Synthetic oligonucleotide
ttcggcggcctcctgggagaaaagac

SEQ ID NO: 182881 - DNA, 25 bp, Artificial Sequence
  Description of Artificial Sequence: Synthetic oligonucleotide
tcggcggcctcctgggagaaaagac

SEQ ID NO: 182882 - DNA, 24 bp, Artificial Sequence
  Description of Artificial Sequence: Synthetic oligonucleotide
cggcggcctcctgggagaaaagac

SEQ ID NO: 182883 - DNA, 24 bp, Artificial Sequence
  Description of Artificial Sequence: Synthetic oligonucleotide
ggcggcctcctgggagaaaagacc

SEQ ID NO: 182884 - DNA, 24 bp, Artificial Sequence
  Description of Artificial Sequence: Synthetic oligonucleotide
gcggcctcctgggagaaaagaccc

SEQ ID NO: 182885 - DNA, 24 bp, Artificial Sequence
  Description of Artificial Sequence: Synthetic oligonucleotide
cggcctcctgggagaaaagacccg

SEQ ID NO: 182886 - DNA, 26 bp, Artificial Sequence
  Description of Artificial Sequence: Synthetic oligonucleotide
ggcctcctgggagaaaagacccggaa

SEQ ID NO: 182887 - DNA, 26 bp, Artificial Sequence
  Description of Artificial Sequence: Synthetic oligonucleotide
gcctcctgggagaaaagacccggaac

SEQ ID NO: 182888 - DNA, 27 bp, Artificial Sequence
  Description of Artificial Sequence: Synthetic oligonucleotide
cctcctgggagaaaagacccggaacca

SEQ ID NO: 182889 - DNA, 27 bp, Artificial Sequence
  Description of Artificial Sequence: Synthetic oligonucleotide
ctcctgggagaaaagacccggaaccag

SEQ ID NO: 182890 - DNA, 29 bp, Artificial Sequence
  Description of Artificial Sequence: Synthetic oligonucleotide
tcctgggagaaaagacccggaaccagatg

SEQ ID NO: 182891 - DNA, 28 bp, Artificial Sequence
  Description of Artificial Sequence: Synthetic oligonucleotide
cctgggagaaaagacccggaaccagatg

SEQ ID NO: 182892 - DNA, 28 bp, Artificial Sequence
  Description of Artificial Sequence: Synthetic oligonucleotide
ctgggagaaaagacccggaaccagatgg

SEQ ID NO: 182893 - DNA, 28 bp, Artificial Sequence
  Description of Artificial Sequence: Synthetic oligonucleotide
tgggagaaaagacccggaaccagatggg

SEQ ID NO: 182894 - DNA, 27 bp, Artificial Sequence
  Description of Artificial Sequence: Synthetic oligonucleotide
gggagaaaagacccggaaccagatggg

SEQ ID NO: 182895 - DNA, 28 bp, Artificial Sequence
  Description of Artificial Sequence: Synthetic oligonucleotide
ggagaaaagacccggaaccagatgggag

SEQ ID NO: 182896 - DNA, 29 bp, Artificial Sequence
  Description of Artificial Sequence: Synthetic oligonucleotide
gagaaaagacccggaaccagatgggagtg

SEQ ID NO: 182897 - DNA, 30 bp, Artificial Sequence
  Description of Artificial Sequence: Synthetic oligonucleotide
agaaaagacccggaaccagatgggagtgtc

SEQ ID NO: 182898 - DNA, 29 bp, Artificial Sequence
  Description of Artificial Sequence: Synthetic oligonucleotide
gaaaagacccggaaccagatgggagtgtc

SEQ ID NO: 182899 - DNA, 29 bp, Artificial Sequence
  Description of Artificial Sequence: Synthetic oligonucleotide
aaaagacccggaaccagatgggagtgtcg

SEQ ID NO: 182900 - DNA, 28 bp, Artificial Sequence
  Description of Artificial Sequence: Synthetic oligonucleotide
aaagacccggaaccagatgggagtgtcg

SEQ ID NO: 182901 - DNA, 27 bp, Artificial Sequence
  Description of Artificial Sequence: Synthetic oligonucleotide
aagacccggaaccagatgggagtgtcg

SEQ ID NO: 182902 - DNA, 26 bp, Artificial Sequence
  Description of Artificial Sequence: Synthetic oligonucleotide
agacccggaaccagatgggagtgtcg

SEQ ID NO: 182903 - DNA, 25 bp, Artificial Sequence
  Description of Artificial Sequence: Synthetic oligonucleotide
gacccggaaccagatgggagtgtcg

SEQ ID NO: 182904 - DNA, 26 bp, Artificial Sequence
  Description of Artificial Sequence: Synthetic oligonucleotide
acccggaaccagatgggagtgtcgga

SEQ ID NO: 182905 - DNA, 25 bp, Artificial Sequence
  Description of Artificial Sequence: Synthetic oligonucleotide
cccggaaccagatgggagtgtcgga

SEQ ID NO: 182906 - DNA, 25 bp, Artificial Sequence
  Description of Artificial Sequence: Synthetic oligonucleotide
ccggaaccagatgggagtgtcggag

SEQ ID NO: 182907 - DNA, 26 bp, Artificial Sequence
  Description of Artificial Sequence: Synthetic oligonucleotide
cggaaccagatgggagtgtcggagct

SEQ ID NO: 182908 - DNA, 26 bp, Artificial Sequence
  Description of Artificial Sequence: Synthetic oligonucleotide
ggaaccagatgggagtgtcggagctg

SEQ ID NO: 182909 - DNA, 27 bp, Artificial Sequence
  Description of Artificial Sequence: Synthetic oligonucleotide
gaaccagatgggagtgtcggagctgct

SEQ ID NO: 182910 - DNA, 27 bp, Artificial Sequence
  Description of Artificial Sequence: Synthetic oligonucleotide
aaccagatgggagtgtcggagctgctg

SEQ ID NO: 182911 - DNA, 27 bp, Artificial Sequence
  Description of Artificial Sequence: Synthetic oligonucleotide
accagatgggagtgtcggagctgctga

SEQ ID NO: 182912 - DNA, 27 bp, Artificial Sequence
  Description of Artificial Sequence: Synthetic oligonucleotide
ccagatgggagtgtcggagctgctgat

SEQ ID NO: 182913 - DNA, 27 bp, Artificial Sequence
  Description of Artificial Sequence: Synthetic oligonucleotide
cagatgggagtgtcggagctgctgatc

SEQ ID NO: 182914 - DNA, 28 bp, Artificial Sequence
  Description of Artificial Sequence: Synthetic oligonucleotide
agatgggagtgtcggagctgctgatctc

SEQ ID NO: 182915 - DNA, 27 bp, Artificial Sequence
  Description of Artificial Sequence: Synthetic oligonucleotide
gatgggagtgtcggagctgctgatctc

SEQ ID NO: 182916 - DNA, 27 bp, Artificial Sequence
  Description of Artificial Sequence: Synthetic oligonucleotide
atgggagtgtcggagctgctgatctcc

SEQ ID NO: 182917 - DNA, 27 bp, Artificial Sequence
  Description of Artificial Sequence: Synthetic oligonucleotide
tgggagtgtcggagctgctgatctcca

SEQ ID NO: 182918 - DNA, 26 bp, Artificial Sequence
  Description of Artificial Sequence: Synthetic oligonucleotide
gggagtgtcggagctgctgatctcca

SEQ ID NO: 182919 - DNA, 27 bp, Artificial Sequence
  Description of Artificial Sequence: Synthetic oligonucleotide
ggagtgtcggagctgctgatctccact

SEQ ID NO: 182920 - DNA, 27 bp, Artificial Sequence
  Description of Artificial Sequence: Synthetic oligonucleotide
gagtgtcggagctgctgatctccactg

SEQ ID NO: 182921 - DNA, 27 bp, Artificial Sequence
  Description of Artificial Sequence: Synthetic oligonucleotide
agtgtcggagctgctgatctccactgc

SEQ ID NO: 182922 - DNA, 27 bp, Artificial Sequence
  Description of Artificial Sequence: Synthetic oligonucleotide
gtgtcggagctgctgatctccactgca

SEQ ID NO: 182923 - DNA, 27 bp, Artificial Sequence
  Description of Artificial Sequence: Synthetic oligonucleotide
tgtcggagctgctgatctccactgcag

SEQ ID NO: 182924 - DNA, 27 bp, Artificial Sequence
  Description of Artificial Sequence: Synthetic oligonucleotide
gtcggagctgctgatctccactgcagt

SEQ ID NO: 182925 - DNA, 27 bp, Artificial Sequence
  Description of Artificial Sequence: Synthetic oligonucleotide
tcggagctgctgatctccactgcagtg

SEQ ID NO: 182926 - DNA, 26 bp, Artificial Sequence
  Description of Artificial Sequence: Synthetic oligonucleotide
cggagctgctgatctccactgcagtg

SEQ ID NO: 182927 - DNA, 27 bp, Artificial Sequence
  Description of Artificial Sequence: Synthetic oligonucleotide
ggagctgctgatctccactgcagtgca

SEQ ID NO: 182928 - DNA, 27 bp, Artificial Sequence
  Description of Artificial Sequence: Synthetic oligonucleotide
gagctgctgatctccactgcagtgcag

SEQ ID NO: 182929 - DNA, 27 bp, Artificial Sequence
  Description of Artificial Sequence: Synthetic oligonucleotide
agctgctgatctccactgcagtgcagg

SEQ ID NO: 182930 - DNA, 26 bp, Artificial Sequence
  Description of Artificial Sequence: Synthetic oligonucleotide
gctgctgatctccactgcagtgcagg

SEQ ID NO: 182931 - DNA, 26 bp, Artificial Sequence
  Description of Artificial Sequence: Synthetic oligonucleotide
ctgctgatctccactgcagtgcaggg

SEQ ID NO: 182932 - DNA, 27 bp, Artificial Sequence
  Description of Artificial Sequence: Synthetic oligonucleotide
tgctgatctccactgcagtgcagggca

SEQ ID NO: 182933 - DNA, 27 bp, Artificial Sequence
  Description of Artificial Sequence: Synthetic oligonucleotide
gctgatctccactgcagtgcagggcat

SEQ ID NO: 182934 - DNA, 28 bp, Artificial Sequence
  Description of Artificial Sequence: Synthetic oligonucleotide
ctgatctccactgcagtgcagggcattc

SEQ ID NO: 182935 - DNA, 29 bp, Artificial Sequence
  Description of Artificial Sequence: Synthetic oligonucleotide
tgatctccactgcagtgcagggcattctc

SEQ ID NO: 182936 - DNA, 28 bp, Artificial Sequence
  Description of Artificial Sequence: Synthetic oligonucleotide
gatctccactgcagtgcagggcattctc

SEQ ID NO: 182937 - DNA, 30 bp, Artificial Sequence
  Description of Artificial Sequence: Synthetic oligonucleotide
atctccactgcagtgcagggcattctcttc

SEQ ID NO: 182938 - DNA, 29 bp, Artificial Sequence
  Description of Artificial Sequence: Synthetic oligonucleotide
tctccactgcagtgcagggcattctcttc

SEQ ID NO: 182939 - DNA, 28 bp, Artificial Sequence
  Description of Artificial Sequence: Synthetic oligonucleotide
ctccactgcagtgcagggcattctcttc

SEQ ID NO: 182940 - DNA, 28 bp, Artificial Sequence
  Description of Artificial Sequence: Synthetic oligonucleotide
tccactgcagtgcagggcattctcttcg

SEQ ID NO: 182941 - DNA, 27 bp, Artificial Sequence
  Description of Artificial Sequence: Synthetic oligonucleotide
ccactgcagtgcagggcattctcttcg

SEQ ID NO: 182942 - DNA, 27 bp, Artificial Sequence
  Description of Artificial Sequence: Synthetic oligonucleotide
cactgcagtgcagggcattctcttcgc

SEQ ID NO: 182943 - DNA, 27 bp, Artificial Sequence
  Description of Artificial Sequence: Synthetic oligonucleotide
actgcagtgcagggcattctcttcgcc

SEQ ID NO: 182944 - DNA, 26 bp, Artificial Sequence
  Description of Artificial Sequence: Synthetic oligonucleotide
ctgcagtgcagggcattctcttcgcc

SEQ ID NO: 182945 - DNA, 27 bp, Artificial Sequence
  Description of Artificial Sequence: Synthetic oligonucleotide
tgcagtgcagggcattctcttcgccct

SEQ ID NO: 182946 - DNA, 26 bp, Artificial Sequence
  Description of Artificial Sequence: Synthetic oligonucleotide
gcagtgcagggcattctcttcgccct

SEQ ID NO: 182947 - DNA, 26 bp, Artificial Sequence
  Description of Artificial Sequence: Synthetic oligonucleotide
cagtgcagggcattctcttcgccctg

SEQ ID NO: 182948 - DNA, 27 bp, Artificial Sequence
  Description of Artificial Sequence: Synthetic oligonucleotide
agtgcagggcattctcttcgccctgct

SEQ ID NO: 182949 - DNA, 26 bp, Artificial Sequence
  Description of Artificial Sequence: Synthetic oligonucleotide
gtgcagggcattctcttcgccctgct

SEQ ID NO: 182950 - DNA, 26 bp, Artificial Sequence
  Description of Artificial Sequence: Synthetic oligonucleotide
tgcagggcattctcttcgccctgctg

SEQ ID NO: 182951 - DNA, 25 bp, Artificial Sequence
  Description of Artificial Sequence: Synthetic oligonucleotide
gcagggcattctcttcgccctgctg

SEQ ID NO: 182952 - DNA, 25 bp, Artificial Sequence
  Description of Artificial Sequence: Synthetic oligonucleotide
cagggcattctcttcgccctgctgg

SEQ ID NO: 182953 - DNA, 25 bp, Artificial Sequence
  Description of Artificial Sequence: Synthetic oligonucleotide
agggcattctcttcgccctgctggg

SEQ ID NO: 182954 - DNA, 24 bp, Artificial Sequence
  Description of Artificial Sequence: Synthetic oligonucleotide
gggcattctcttcgccctgctggg

SEQ ID NO: 182955 - DNA, 24 bp, Artificial Sequence
  Description of Artificial Sequence: Synthetic oligonucleotide
ggcattctcttcgccctgctgggg

SEQ ID NO: 182956 - DNA, 24 bp, Artificial Sequence
  Description of Artificial Sequence: Synthetic oligonucleotide
gcattctcttcgccctgctggggg

SEQ ID NO: 182957 - DNA, 25 bp, Artificial Sequence
  Description of Artificial Sequence: Synthetic oligonucleotide
cattctcttcgccctgctgggggct

SEQ ID NO: 182958 - DNA, 26 bp, Artificial Sequence
  Description of Artificial Sequence: Synthetic oligonucleotide
attctcttcgccctgctgggggctca

SEQ ID NO: 182959 - DNA, 25 bp, Artificial Sequence
  Description of Artificial Sequence: Synthetic oligonucleotide
ttctcttcgccctgctgggggctca

SEQ ID NO: 182960 - DNA, 24 bp, Artificial Sequence
  Description of Artificial Sequence: Synthetic oligonucleotide
tctcttcgccctgctgggggctca

SEQ ID NO: 182961 - DNA, 23 bp, Artificial Sequence
  Description of Artificial Sequence: Synthetic oligonucleotide
ctcttcgccctgctgggggctca

SEQ ID NO: 182962 - DNA, 23 bp, Artificial Sequence
  Description of Artificial Sequence: Synthetic oligonucleotide
tcttcgccctgctgggggctcag

SEQ ID NO: 182963 - DNA, 22 bp, Artificial Sequence
  Description of Artificial Sequence: Synthetic oligonucleotide
cttcgccctgctgggggctcag

SEQ ID NO: 182964 - DNA, 22 bp, Artificial Sequence
  Description of Artificial Sequence: Synthetic oligonucleotide
ttcgccctgctgggggctcagc

SEQ ID NO: 182965 - DNA, 21 bp, Artificial Sequence
  Description of Artificial Sequence: Synthetic oligonucleotide
tcgccctgctgggggctcagc

SEQ ID NO: 182966 - DNA, 20 bp, Artificial Sequence
  Description of Artificial Sequence: Synthetic oligonucleotide
cgccctgctgggggctcagc

SEQ ID NO: 182967 - DNA, 20 bp, Artificial Sequence
  Description of Artificial Sequence: Synthetic oligonucleotide
gccctgctgggggctcagcc

SEQ ID NO: 182968 - DNA, 20 bp, Artificial Sequence
  Description of Artificial Sequence: Synthetic oligonucleotide
ccctgctgggggctcagccc

SEQ ID NO: 182969 - DNA, 21 bp, Artificial Sequence
  Description of Artificial Sequence: Synthetic oligonucleotide
cctgctgggggctcagcccct

SEQ ID NO: 182970 - DNA, 21 bp, Artificial Sequence
  Description of Artificial Sequence: Synthetic oligonucleotide
ctgctgggggctcagcccctg

SEQ ID NO: 182971 - DNA, 23 bp, Artificial Sequence
  Description of Artificial Sequence: Synthetic oligonucleotide
tgctgggggctcagcccctgctt

SEQ ID NO: 182972 - DNA, 22 bp, Artificial Sequence
  Description of Artificial Sequence: Synthetic oligonucleotide
gctgggggctcagcccctgctt

SEQ ID NO: 182973 - DNA, 23 bp, Artificial Sequence
  Description of Artificial Sequence: Synthetic oligonucleotide
ctgggggctcagcccctgcttgt

SEQ ID NO: 182974 - DNA, 23 bp, Artificial Sequence
  Description of Artificial Sequence: Synthetic oligonucleotide
tgggggctcagcccctgcttgtg

SEQ ID NO: 182975 - DNA, 22 bp, Artificial Sequence
  Description of Artificial Sequence: Synthetic oligonucleotide
gggggctcagcccctgcttgtg

SEQ ID NO: 182976 - DNA, 23 bp, Artificial Sequence
  Description of Artificial Sequence: Synthetic oligonucleotide
ggggctcagcccctgcttgtggt

SEQ ID NO: 182977 - DNA, 23 bp, Artificial Sequence
  Description of Artificial Sequence: Synthetic oligonucleotide
gggctcagcccctgcttgtggtc

SEQ ID NO: 182978 - DNA, 23 bp, Artificial Sequence
  Description of Artificial Sequence: Synthetic oligonucleotide
ggctcagcccctgcttgtggtcg

SEQ ID NO: 182979 - DNA, 23 bp, Artificial Sequence
  Description of Artificial Sequence: Synthetic oligonucleotide
gctcagcccctgcttgtggtcgg

SEQ ID NO: 182980 - DNA, 25 bp, Artificial Sequence
  Description of Artificial Sequence: Synthetic oligonucleotide
ctcagcccctgcttgtggtcggctt

SEQ ID NO: 182981 - DNA, 26 bp, Artificial Sequence
  Description of Artificial Sequence: Synthetic oligonucleotide
tcagcccctgcttgtggtcggcttct

SEQ ID NO: 182982 - DNA, 25 bp, Artificial Sequence
  Description of Artificial Sequence: Synthetic oligonucleotide
cagcccctgcttgtggtcggcttct

SEQ ID NO: 182983 - DNA, 26 bp, Artificial Sequence
  Description of Artificial Sequence: Synthetic oligonucleotide
agcccctgcttgtggtcggcttctca

SEQ ID NO: 182984 - DNA, 25 bp, Artificial Sequence
  Description of Artificial Sequence: Synthetic oligonucleotide
gcccctgcttgtggtcggcttctca

SEQ ID NO: 182985 - DNA, 25 bp, Artificial Sequence
  Description of Artificial Sequence: Synthetic oligonucleotide
cccctgcttgtggtcggcttctcag

SEQ ID NO: 182986 - DNA, 26 bp, Artificial Sequence
  Description of Artificial Sequence: Synthetic oligonucleotide
ccctgcttgtggtcggcttctcagga

SEQ ID NO: 182987 - DNA, 26 bp, Artificial Sequence
  Description of Artificial Sequence: Synthetic oligonucleotide
cctgcttgtggtcggcttctcaggac

SEQ ID NO: 182988 - DNA, 26 bp, Artificial Sequence
  Description of Artificial Sequence: Synthetic oligonucleotide
ctgcttgtggtcggcttctcaggacc

SEQ ID NO: 182989 - DNA, 26 bp, Artificial Sequence
  Description of Artificial Sequence: Synthetic oligonucleotide
tgcttgtggtcggcttctcaggaccc

SEQ ID NO: 182990 - DNA, 25 bp, Artificial Sequence
  Description of Artificial Sequence: Synthetic oligonucleotide
gcttgtggtcggcttctcaggaccc

SEQ ID NO: 182991 - DNA, 26 bp, Artificial Sequence
  Description of Artificial Sequence: Synthetic oligonucleotide
cttgtggtcggcttctcaggacccct

SEQ ID NO: 182992 - DNA, 26 bp, Artificial Sequence
  Description of Artificial Sequence: Synthetic oligonucleotide
ttgtggtcggcttctcaggacccctg

SEQ ID NO: 182993 - DNA, 25 bp, Artificial Sequence
  Description of Artificial Sequence: Synthetic oligonucleotide
tgtggtcggcttctcaggacccctg

SEQ ID NO: 182994 - DNA, 24 bp, Artificial Sequence
  Description of Artificial Sequence: Synthetic oligonucleotide
gtggtcggcttctcaggacccctg

SEQ ID NO: 182995 - DNA, 25 bp, Artificial Sequence
  Description of Artificial Sequence: Synthetic oligonucleotide
tggtcggcttctcaggacccctgct

SEQ ID NO: 182996 - DNA, 24 bp, Artificial Sequence
  Description of Artificial Sequence: Synthetic oligonucleotide
ggtcggcttctcaggacccctgct

SEQ ID NO: 182997 - DNA, 24 bp, Artificial Sequence
  Description of Artificial Sequence: Synthetic oligonucleotide
gtcggcttctcaggacccctgctg

SEQ ID NO: 182998 - DNA, 25 bp, Artificial Sequence
  Description of Artificial Sequence: Synthetic oligonucleotide
tcggcttctcaggacccctgctggt

SEQ ID NO: 182999 - DNA, 24 bp, Artificial Sequence
  Description of Artificial Sequence: Synthetic oligonucleotide
cggcttctcaggacccctgctggt

SEQ ID NO: 183000 - DNA, 27 bp, Artificial Sequence
  Description of Artificial Sequence: Synthetic oligonucleotide
ggcttctcaggacccctgctggtgttt

SEQ ID NO: 183001 - DNA, 27 bp, Artificial Sequence
  Description of Artificial Sequence: Synthetic oligonucleotide
gcttctcaggacccctgctggtgtttg

SEQ ID NO: 183002 - DNA, 28 bp, Artificial Sequence
  Description of Artificial Sequence: Synthetic oligonucleotide
cttctcaggacccctgctggtgtttgag

SEQ ID NO: 183003 - DNA, 28 bp, Artificial Sequence
  Description of Artificial Sequence: Synthetic oligonucleotide
ttctcaggacccctgctggtgtttgagg

SEQ ID NO: 183004 - DNA, 27 bp, Artificial Sequence
  Description of Artificial Sequence: Synthetic oligonucleotide
tctcaggacccctgctggtgtttgagg

SEQ ID NO: 183005 - DNA, 27 bp, Artificial Sequence
  Description of Artificial Sequence: Synthetic oligonucleotide
ctcaggacccctgctggtgtttgagga

SEQ ID NO: 183006 - DNA, 28 bp, Artificial Sequence
  Description of Artificial Sequence: Synthetic oligonucleotide
tcaggacccctgctggtgtttgaggaag

SEQ ID NO: 183007 - DNA, 27 bp, Artificial Sequence
  Description of Artificial Sequence: Synthetic oligonucleotide
caggacccctgctggtgtttgaggaag

SEQ ID NO: 183008 - DNA, 27 bp, Artificial Sequence
  Description of Artificial Sequence: Synthetic oligonucleotide
aggacccctgctggtgtttgaggaagc

SEQ ID NO: 183009 - DNA, 26 bp, Artificial Sequence
  Description of Artificial Sequence: Synthetic oligonucleotide
ggacccctgctggtgtttgaggaagc

SEQ ID NO: 183010 - DNA, 27 bp, Artificial Sequence
  Description of Artificial Sequence: Synthetic oligonucleotide
gacccctgctggtgtttgaggaagcct

SEQ ID NO: 183011 - DNA, 28 bp, Artificial Sequence
  Description of Artificial Sequence: Synthetic oligonucleotide
acccctgctggtgtttgaggaagccttc

SEQ ID NO: 183012 - DNA, 27 bp, Artificial Sequence
  Description of Artificial Sequence: Synthetic oligonucleotide
cccctgctggtgtttgaggaagccttc

SEQ ID NO: 183013 - DNA, 29 bp, Artificial Sequence
  Description of Artificial Sequence: Synthetic oligonucleotide
ccctgctggtgtttgaggaagccttcttc

SEQ ID NO: 183014 - DNA, 30 bp, Artificial Sequence
  Description of Artificial Sequence: Synthetic oligonucleotide
cctgctggtgtttgaggaagccttcttctc

SEQ ID NO: 183015 - DNA, 30 bp, Artificial Sequence
  Description of Artificial Sequence: Synthetic oligonucleotide
ctgctggtgtttgaggaagccttcttctcg

SEQ ID NO: 183016 - DNA, 32 bp, Artificial Sequence
  Description of Artificial Sequence: Synthetic oligonucleotide
tgctggtgtttgaggaagccttcttctcgttc

SEQ ID NO: 183017 - DNA, 31 bp, Artificial Sequence
  Description of Artificial Sequence: Synthetic oligonucleotide
gctggtgtttgaggaagccttcttctcgttc

SEQ ID NO: 183018 - DNA, 32 bp, Artificial Sequence
  Description of Artificial Sequence: Synthetic oligonucleotide
ctggtgtttgaggaagccttcttctcgttctg

SEQ ID NO: 183019 - DNA, 32 bp, Artificial Sequence
  Description of Artificial Sequence: Synthetic oligonucleotide
tggtgtttgaggaagccttcttctcgttctgc

SEQ ID NO: 183020 - DNA, 31 bp, Artificial Sequence
  Description of Artificial Sequence: Synthetic oligonucleotide
ggtgtttgaggaagccttcttctcgttctgc

SEQ ID NO: 183021 - DNA, 31 bp, Artificial Sequence
  Description of Artificial Sequence: Synthetic oligonucleotide
gtgtttgaggaagccttcttctcgttctgcg

SEQ ID NO: 183022 - DNA, 32 bp, Artificial Sequence
  Description of Artificial Sequence: Synthetic oligonucleotide
tgtttgaggaagccttcttctcgttctgcgag

SEQ ID NO: 183023 - DNA, 31 bp, Artificial Sequence
  Description of Artificial Sequence: Synthetic oligonucleotide
gtttgaggaagccttcttctcgttctgcgag

SEQ ID NO: 183024 - DNA, 32 bp, Artificial Sequence
  Description of Artificial Sequence: Synthetic oligonucleotide
tttgaggaagccttcttctcgttctgcgagac

SEQ ID NO: 183025 - DNA, 31 bp, Artificial Sequence
  Description of Artificial Sequence: Synthetic oligonucleotide
ttgaggaagccttcttctcgttctgcgagac

SEQ ID NO: 183026 - DNA, 30 bp, Artificial Sequence
  Description of Artificial Sequence: Synthetic oligonucleotide
tgaggaagccttcttctcgttctgcgagac

SEQ ID NO: 183027 - DNA, 29 bp, Artificial Sequence
  Description of Artificial Sequence: Synthetic oligonucleotide
gaggaagccttcttctcgttctgcgagac

SEQ ID NO: 183028 - DNA, 29 bp, Artificial Sequence
  Description of Artificial Sequence: Synthetic oligonucleotide
aggaagccttcttctcgttctgcgagacc

SEQ ID NO: 183029 - DNA, 28 bp, Artificial Sequence
  Description of Artificial Sequence: Synthetic oligonucleotide
ggaagccttcttctcgttctgcgagacc

SEQ ID NO: 183030 - DNA, 30 bp, Artificial Sequence
  Description of Artificial Sequence: Synthetic oligonucleotide
gaagccttcttctcgttctgcgagaccaac

SEQ ID NO: 183031 - DNA, 30 bp, Artificial Sequence
  Description of Artificial Sequence: Synthetic oligonucleotide
aagccttcttctcgttctgcgagaccaacg

SEQ ID NO: 183032 - DNA, 29 bp, Artificial Sequence
  Description of Artificial Sequence: Synthetic oligonucleotide
agccttcttctcgttctgcgagaccaacg

SEQ ID NO: 183033 - DNA, 28 bp, Artificial Sequence
  Description of Artificial Sequence: Synthetic oligonucleotide
gccttcttctcgttctgcgagaccaacg

SEQ ID NO: 183034 - DNA, 28 bp, Artificial Sequence
  Description of Artificial Sequence: Synthetic oligonucleotide
ccttcttctcgttctgcgagaccaacgg

SEQ ID NO: 183035 - DNA, 29 bp, Artificial Sequence
  Description of Artificial Sequence: Synthetic oligonucleotide
cttcttctcgttctgcgagaccaacggtc

SEQ ID NO: 183036 - DNA, 31 bp, Artificial Sequence
  Description of Artificial Sequence: Synthetic oligonucleotide
ttcttctcgttctgcgagaccaacggtctag

SEQ ID NO: 183037 - DNA, 30 bp, Artificial Sequence
  Description of Artificial Sequence: Synthetic oligonucleotide
tcttctcgttctgcgagaccaacggtctag

SEQ ID NO: 183038 - DNA, 29 bp, Artificial Sequence
  Description of Artificial Sequence: Synthetic oligonucleotide
cttctcgttctgcgagaccaacggtctag

SEQ ID NO: 183039 - DNA, 30 bp, Artificial Sequence
  Description of Artificial Sequence: Synthetic oligonucleotide
ttctcgttctgcgagaccaacggtctagag

SEQ ID NO: 183040 - DNA, 29 bp, Artificial Sequence
  Description of Artificial Sequence: Synthetic oligonucleotide
tctcgttctgcgagaccaacggtctagag

SEQ ID NO: 183041 - DNA, 28 bp, Artificial Sequence
  Description of Artificial Sequence: Synthetic oligonucleotide
ctcgttctgcgagaccaacggtctagag

SEQ ID NO: 183042 - DNA, 30 bp, Artificial Sequence
  Description of Artificial Sequence: Synthetic oligonucleotide
tcgttctgcgagaccaacggtctagagtac

SEQ ID NO: 183043 - DNA, 29 bp, Artificial Sequence
  Description of Artificial Sequence: Synthetic oligonucleotide
cgttctgcgagaccaacggtctagagtac

SEQ ID NO: 183044 - DNA, 31 bp, Artificial Sequence
  Description of Artificial Sequence: Synthetic oligonucleotide
gttctgcgagaccaacggtctagagtacatc

SEQ ID NO: 183045 - DNA, 31 bp, Artificial Sequence
  Description of Artificial Sequence: Synthetic oligonucleotide
ttctgcgagaccaacggtctagagtacatcg

SEQ ID NO: 183046 - DNA, 30 bp, Artificial Sequence
  Description of Artificial Sequence: Synthetic oligonucleotide
tctgcgagaccaacggtctagagtacatcg

SEQ ID NO: 183047 - DNA, 29 bp, Artificial Sequence
  Description of Artificial Sequence: Synthetic oligonucleotide
ctgcgagaccaacggtctagagtacatcg

SEQ ID NO: 183048 - DNA, 30 bp, Artificial Sequence
  Description of Artificial Sequence: Synthetic oligonucleotide
tgcgagaccaacggtctagagtacatcgtg

SEQ ID NO: 183049 - DNA, 29 bp, Artificial Sequence
  Description of Artificial Sequence: Synthetic oligonucleotide
gcgagaccaacggtctagagtacatcgtg

SEQ ID NO: 183050 - DNA, 29 bp, Artificial Sequence
  Description of Artificial Sequence: Synthetic oligonucleotide
cgagaccaacggtctagagtacatcgtgg

SEQ ID NO: 183051 - DNA, 29 bp, Artificial Sequence
  Description of Artificial Sequence: Synthetic oligonucleotide
gagaccaacggtctagagtacatcgtggg

SEQ ID NO: 183052 - DNA, 29 bp, Artificial Sequence
  Description of Artificial Sequence: Synthetic oligonucleotide
agaccaacggtctagagtacatcgtgggc

SEQ ID NO: 183053 - DNA, 28 bp, Artificial Sequence
  Description of Artificial Sequence: Synthetic oligonucleotide
gaccaacggtctagagtacatcgtgggc

SEQ ID NO: 183054 - DNA, 28 bp, Artificial Sequence
  Description of Artificial Sequence: Synthetic oligonucleotide
accaacggtctagagtacatcgtgggcc

SEQ ID NO: 183055 - DNA, 27 bp, Artificial Sequence
  Description of Artificial Sequence: Synthetic oligonucleotide
ccaacggtctagagtacatcgtgggcc

SEQ ID NO: 183056 - DNA, 27 bp, Artificial Sequence
  Description of Artificial Sequence: Synthetic oligonucleotide
caacggtctagagtacatcgtgggccg

SEQ ID NO: 183057 - DNA, 27 bp, Artificial Sequence
  Description of Artificial Sequence: Synthetic oligonucleotide
aacggtctagagtacatcgtgggccgc

SEQ ID NO: 183058 - DNA, 26 bp, Artificial Sequence
  Description of Artificial Sequence: Synthetic oligonucleotide
acggtctagagtacatcgtgggccgc

SEQ ID NO: 183059 - DNA, 25 bp, Artificial Sequence
  Description of Artificial Sequence: Synthetic oligonucleotide
cggtctagagtacatcgtgggccgc

SEQ ID NO: 183060 - DNA, 26 bp, Artificial Sequence
  Description of Artificial Sequence: Synthetic oligonucleotide
ggtctagagtacatcgtgggccgcgt

SEQ ID NO: 183061 - DNA, 27 bp, Artificial Sequence
  Description of Artificial Sequence: Synthetic oligonucleotide
gtctagagtacatcgtgggccgcgtgt

SEQ ID NO: 183062 - DNA, 27 bp, Artificial Sequence
  Description of Artificial Sequence: Synthetic oligonucleotide
tctagagtacatcgtgggccgcgtgtg

SEQ ID NO: 183063 - DNA, 26 bp, Artificial Sequence
  Description of Artificial Sequence: Synthetic oligonucleotide
ctagagtacatcgtgggccgcgtgtg

SEQ ID NO: 183064 - DNA, 27 bp, Artificial Sequence
  Description of Artificial Sequence: Synthetic oligonucleotide
tagagtacatcgtgggccgcgtgtgga

SEQ ID NO: 183065 - DNA, 27 bp, Artificial Sequence
  Description of Artificial Sequence: Synthetic oligonucleotide
agagtacatcgtgggccgcgtgtggat

SEQ ID NO: 183066 - DNA, 26 bp, Artificial Sequence
  Description of Artificial Sequence: Synthetic oligonucleotide
gagtacatcgtgggccgcgtgtggat

SEQ ID NO: 183067 - DNA, 26 bp, Artificial Sequence
  Description of Artificial Sequence: Synthetic oligonucleotide
agtacatcgtgggccgcgtgtggatc

SEQ ID NO: 183068 - DNA, 25 bp, Artificial Sequence
  Description of Artificial Sequence: Synthetic oligonucleotide
gtacatcgtgggccgcgtgtggatc

SEQ ID NO: 183069 - DNA, 25 bp, Artificial Sequence
  Description of Artificial Sequence: Synthetic oligonucleotide
tacatcgtgggccgcgtgtggatcg

SEQ ID NO: 183070 - DNA, 24 bp, Artificial Sequence
  Description of Artificial Sequence: Synthetic oligonucleotide
acatcgtgggccgcgtgtggatcg

SEQ ID NO: 183071 - DNA, 23 bp, Artificial Sequence
  Description of Artificial Sequence: Synthetic oligonucleotide
catcgtgggccgcgtgtggatcg

SEQ ID NO: 183072 - DNA, 23 bp, Artificial Sequence
  Description of Artificial Sequence: Synthetic oligonucleotide
atcgtgggccgcgtgtggatcgg

SEQ ID NO: 183073 - DNA, 22 bp, Artificial Sequence
  Description of Artificial Sequence: Synthetic oligonucleotide
tcgtgggccgcgtgtggatcgg

SEQ ID NO: 183074 - DNA, 21 bp, Artificial Sequence
  Description of Artificial Sequence: Synthetic oligonucleotide
cgtgggccgcgtgtggatcgg

SEQ ID NO: 183075 - DNA, 23 bp, Artificial Sequence
  Description of Artificial Sequence: Synthetic oligonucleotide
gtgggccgcgtgtggatcggctt

SEQ ID NO: 183076 - DNA, 24 bp, Artificial Sequence
  Description of Artificial Sequence: Synthetic oligonucleotide
tgggccgcgtgtggatcggcttct

SEQ ID NO: 183077 - DNA, 23 bp, Artificial Sequence
  Description of Artificial Sequence: Synthetic oligonucleotide
gggccgcgtgtggatcggcttct

SEQ ID NO: 183078 - DNA, 23 bp, Artificial Sequence
  Description of Artificial Sequence: Synthetic oligonucleotide
ggccgcgtgtggatcggcttctg

SEQ ID NO: 183079 - DNA, 23 bp, Artificial Sequence
  Description of Artificial Sequence: Synthetic oligonucleotide
gccgcgtgtggatcggcttctgg

SEQ ID NO: 183080 - DNA, 24 bp, Artificial Sequence
  Description of Artificial Sequence: Synthetic oligonucleotide
ccgcgtgtggatcggcttctggct

SEQ ID NO: 183081 - DNA, 26 bp, Artificial Sequence
  Description of Artificial Sequence: Synthetic oligonucleotide
cgcgtgtggatcggcttctggctcat

SEQ ID NO: 183082 - DNA, 26 bp, Artificial Sequence
  Description of Artificial Sequence: Synthetic oligonucleotide
gcgtgtggatcggcttctggctcatc

SEQ ID NO: 183083 - DNA, 27 bp, Artificial Sequence
  Description of Artificial Sequence: Synthetic oligonucleotide
cgtgtggatcggcttctggctcatcct

SEQ ID NO: 183084 - DNA, 27 bp, Artificial Sequence
  Description of Artificial Sequence: Synthetic oligonucleotide
gtgtggatcggcttctggctcatcctg

SEQ ID NO: 183085 - DNA, 27 bp, Artificial Sequence
  Description of Artificial Sequence: Synthetic oligonucleotide
tgtggatcggcttctggctcatcctgc

SEQ ID NO: 183086 - DNA, 27 bp, Artificial Sequence
  Description of Artificial Sequence: Synthetic oligonucleotide
gtggatcggcttctggctcatcctgct

SEQ ID NO: 183087 - DNA, 27 bp, Artificial Sequence
  Description of Artificial Sequence: Synthetic oligonucleotide
tggatcggcttctggctcatcctgctg

SEQ ID NO: 183088 - DNA, 26 bp, Artificial Sequence
  Description of Artificial Sequence: Synthetic oligonucleotide
ggatcggcttctggctcatcctgctg

SEQ ID NO: 183089 - DNA, 27 bp, Artificial Sequence
  Description of Artificial Sequence: Synthetic oligonucleotide
gatcggcttctggctcatcctgctggt

SEQ ID NO: 183090 - DNA, 27 bp, Artificial Sequence
  Description of Artificial Sequence: Synthetic oligonucleotide
atcggcttctggctcatcctgctggtg

SEQ ID NO: 183091 - DNA, 26 bp, Artificial Sequence
  Description of Artificial Sequence: Synthetic oligonucleotide
tcggcttctggctcatcctgctggtg

SEQ ID NO: 183092 - DNA, 25 bp, Artificial Sequence
  Description of Artificial Sequence: Synthetic oligonucleotide
cggcttctggctcatcctgctggtg

SEQ ID NO: 183093 - DNA, 26 bp, Artificial Sequence
  Description of Artificial Sequence: Synthetic oligonucleotide
ggcttctggctcatcctgctggtggt

SEQ ID NO: 183094 - DNA, 27 bp, Artificial Sequence
  Description of Artificial Sequence: Synthetic oligonucleotide
gcttctggctcatcctgctggtggtgt

SEQ ID NO: 183095 - DNA, 28 bp, Artificial Sequence
  Description of Artificial Sequence: Synthetic oligonucleotide
cttctggctcatcctgctggtggtgttg

SEQ ID NO: 183096 - DNA, 28 bp, Artificial Sequence
  Description of Artificial Sequence: Synthetic oligonucleotide
ttctggctcatcctgctggtggtgttgg

SEQ ID NO: 183097 - DNA, 27 bp, Artificial Sequence
  Description of Artificial Sequence: Synthetic oligonucleotide
tctggctcatcctgctggtggtgttgg

SEQ ID NO: 183098 - DNA, 27 bp, Artificial Sequence
  Description of Artificial Sequence: Synthetic oligonucleotide
ctggctcatcctgctggtggtgttggt

SEQ ID NO: 183099 - DNA, 27 bp, Artificial Sequence
  Description of Artificial Sequence: Synthetic oligonucleotide
tggctcatcctgctggtggtgttggtg

SEQ ID NO: 183100 - DNA, 26 bp, Artificial Sequence
  Description of Artificial Sequence: Synthetic oligonucleotide
ggctcatcctgctggtggtgttggtg

SEQ ID NO: 183101 - DNA, 27 bp, Artificial Sequence
  Description of Artificial Sequence: Synthetic oligonucleotide
gctcatcctgctggtggtgttggtggt

SEQ ID NO: 183102 - DNA, 27 bp, Artificial Sequence
  Description of Artificial Sequence: Synthetic oligonucleotide
ctcatcctgctggtggtgttggtggtg

SEQ ID NO: 183103 - DNA, 27 bp, Artificial Sequence
  Description of Artificial Sequence: Synthetic oligonucleotide
tcatcctgctggtggtgttggtggtgg

SEQ ID NO: 183104 - DNA, 26 bp, Artificial Sequence
  Description of Artificial Sequence: Synthetic oligonucleotide
catcctgctggtggtgttggtggtgg

SEQ ID NO: 183105 - DNA, 26 bp, Artificial Sequence
  Description of Artificial Sequence: Synthetic oligonucleotide
atcctgctggtggtgttggtggtggc

SEQ ID NO: 183106 - DNA, 25 bp, Artificial Sequence
  Description of Artificial Sequence: Synthetic oligonucleotide
tcctgctggtggtgttggtggtggc

SEQ ID NO: 183107 - DNA, 24 bp, Artificial Sequence
  Description of Artificial Sequence: Synthetic oligonucleotide
cctgctggtggtgttggtggtggc

SEQ ID NO: 183108 - DNA, 26 bp, Artificial Sequence
  Description of Artificial Sequence: Synthetic oligonucleotide
ctgctggtggtgttggtggtggcctt

SEQ ID NO: 183109 - DNA, 26 bp, Artificial Sequence
  Description of Artificial Sequence: Synthetic oligonucleotide
tgctggtggtgttggtggtggccttc

SEQ ID NO: 183110 - DNA, 25 bp, Artificial Sequence
  Description of Artificial Sequence: Synthetic oligonucleotide
gctggtggtgttggtggtggccttc

SEQ ID NO: 183111 - DNA, 26 bp, Artificial Sequence
  Description of Artificial Sequence: Synthetic oligonucleotide
ctggtggtgttggtggtggccttcga

SEQ ID NO: 183112 - DNA, 26 bp, Artificial Sequence
  Description of Artificial Sequence: Synthetic oligonucleotide
tggtggtgttggtggtggccttcgag

SEQ ID NO: 183113 - DNA, 25 bp, Artificial Sequence
  Description of Artificial Sequence: Synthetic oligonucleotide
ggtggtgttggtggtggccttcgag

SEQ ID NO: 183114 - DNA, 25 bp, Artificial Sequence
  Description of Artificial Sequence: Synthetic oligonucleotide
gtggtgttggtggtggccttcgagg

SEQ ID NO: 183115 - DNA, 27 bp, Artificial Sequence
  Description of Artificial Sequence: Synthetic oligonucleotide
tggtgttggtggtggccttcgagggta

SEQ ID NO: 183116 - DNA, 26 bp, Artificial Sequence
  Description of Artificial Sequence: Synthetic oligonucleotide
ggtgttggtggtggccttcgagggta

SEQ ID NO: 183117 - DNA, 26 bp, Artificial Sequence
  Description of Artificial Sequence: Synthetic oligonucleotide
gtgttggtggtggccttcgagggtag

SEQ ID NO: 183118 - DNA, 27 bp, Artificial Sequence
  Description of Artificial Sequence: Synthetic oligonucleotide
tgttggtggtggccttcgagggtagct

SEQ ID NO: 183119 - DNA, 27 bp, Artificial Sequence
  Description of Artificial Sequence: Synthetic oligonucleotide
gttggtggtggccttcgagggtagctt

SEQ ID NO: 183120 - DNA, 27 bp, Artificial Sequence
  Description of Artificial Sequence: Synthetic oligonucleotide
ttggtggtggccttcgagggtagcttc

SEQ ID NO: 183121 - DNA, 26 bp, Artificial Sequence
  Description of Artificial Sequence: Synthetic oligonucleotide
tggtggtggccttcgagggtagcttc

SEQ ID NO: 183122 - DNA, 25 bp, Artificial Sequence
  Description of Artificial Sequence: Synthetic oligonucleotide
ggtggtggccttcgagggtagcttc

SEQ ID NO: 183123 - DNA, 26 bp, Artificial Sequence
  Description of Artificial Sequence: Synthetic oligonucleotide
gtggtggccttcgagggtagcttcct

SEQ ID NO: 183124 - DNA, 26 bp, Artificial Sequence
  Description of Artificial Sequence: Synthetic oligonucleotide
tggtggccttcgagggtagcttcctg

SEQ ID NO: 183125 - DNA, 25 bp, Artificial Sequence
  Description of Artificial Sequence: Synthetic oligonucleotide
ggtggccttcgagggtagcttcctg

SEQ ID NO: 183126 - DNA, 26 bp, Artificial Sequence
  Description of Artificial Sequence: Synthetic oligonucleotide
gtggccttcgagggtagcttcctggt

SEQ ID NO: 183127 - DNA, 26 bp, Artificial Sequence
  Description of Artificial Sequence: Synthetic oligonucleotide
tggccttcgagggtagcttcctggtc

SEQ ID NO: 183128 - DNA, 25 bp, Artificial Sequence
  Description of Artificial Sequence: Synthetic oligonucleotide
ggccttcgagggtagcttcctggtc

SEQ ID NO: 183129 - DNA, 25 bp, Artificial Sequence
  Description of Artificial Sequence: Synthetic oligonucleotide
gccttcgagggtagcttcctggtcc

SEQ ID NO: 183130 - DNA, 25 bp, Artificial Sequence
  Description of Artificial Sequence: Synthetic oligonucleotide
ccttcgagggtagcttcctggtccg

SEQ ID NO: 183131 - DNA, 27 bp, Artificial Sequence
  Description of Artificial Sequence: Synthetic oligonucleotide
cttcgagggtagcttcctggtccgctt

SEQ ID NO: 183132 - DNA, 27 bp, Artificial Sequence
  Description of Artificial Sequence: Synthetic oligonucleotide
ttcgagggtagcttcctggtccgcttc

SEQ ID NO: 183133 - DNA, 27 bp, Artificial Sequence
  Description of Artificial Sequence: Synthetic oligonucleotide
tcgagggtagcttcctggtccgcttca

SEQ ID NO: 183134 - DNA, 27 bp, Artificial Sequence
  Description of Artificial Sequence: Synthetic oligonucleotide
cgagggtagcttcctggtccgcttcat

SEQ ID NO: 183135 - DNA, 27 bp, Artificial Sequence
  Description of Artificial Sequence: Synthetic oligonucleotide
gagggtagcttcctggtccgcttcatc

SEQ ID NO: 183136 - DNA, 28 bp, Artificial Sequence
  Description of Artificial Sequence: Synthetic oligonucleotide
agggtagcttcctggtccgcttcatctc

SEQ ID NO: 183137 - DNA, 27 bp, Artificial Sequence
  Description of Artificial Sequence: Synthetic oligonucleotide
gggtagcttcctggtccgcttcatctc

SEQ ID NO: 183138 - DNA, 27 bp, Artificial Sequence
  Description of Artificial Sequence: Synthetic oligonucleotide
ggtagcttcctggtccgcttcatctcc

SEQ ID NO: 183139 - DNA, 27 bp, Artificial Sequence
  Description of Artificial Sequence: Synthetic oligonucleotide
gtagcttcctggtccgcttcatctccc

SEQ ID NO: 183140 - DNA, 27 bp, Artificial Sequence
  Description of Artificial Sequence: Synthetic oligonucleotide
tagcttcctggtccgcttcatctcccg

SEQ ID NO: 183141 - DNA, 26 bp, Artificial Sequence
  Description of Artificial Sequence: Synthetic oligonucleotide
agcttcctggtccgcttcatctcccg

SEQ ID NO: 183142 - DNA, 25 bp, Artificial Sequence
  Description of Artificial Sequence: Synthetic oligonucleotide
gcttcctggtccgcttcatctcccg

SEQ ID NO: 183143 - DNA, 27 bp, Artificial Sequence
  Description of Artificial Sequence: Synthetic oligonucleotide
cttcctggtccgcttcatctcccgcta

SEQ ID NO: 183144 - DNA, 29 bp, Artificial Sequence
  Description of Artificial Sequence: Synthetic oligonucleotide
ttcctggtccgcttcatctcccgctatac

SEQ ID NO: 183145 - DNA, 28 bp, Artificial Sequence
  Description of Artificial Sequence: Synthetic oligonucleotide
tcctggtccgcttcatctcccgctatac

SEQ ID NO: 183146 - DNA, 27 bp, Artificial Sequence
  Description of Artificial Sequence: Synthetic oligonucleotide
cctggtccgcttcatctcccgctatac

SEQ ID NO: 183147 - DNA, 27 bp, Artificial Sequence
  Description of Artificial Sequence: Synthetic oligonucleotide
ctggtccgcttcatctcccgctatacc

SEQ ID NO: 183148 - DNA, 27 bp, Artificial Sequence
  Description of Artificial Sequence: Synthetic oligonucleotide
tggtccgcttcatctcccgctataccc

SEQ ID NO: 183149 - DNA, 27 bp, Artificial Sequence
  Description of Artificial Sequence: Synthetic oligonucleotide
ggtccgcttcatctcccgctataccca

SEQ ID NO: 183150 - DNA, 27 bp, Artificial Sequence
  Description of Artificial Sequence: Synthetic oligonucleotide
gtccgcttcatctcccgctatacccag

SEQ ID NO: 183151 - DNA, 27 bp, Artificial Sequence
  Description of Artificial Sequence: Synthetic oligonucleotide
tccgcttcatctcccgctatacccagg

SEQ ID NO: 183152 - DNA, 27 bp, Artificial Sequence
  Description of Artificial Sequence: Synthetic oligonucleotide
ccgcttcatctcccgctatacccagga

SEQ ID NO: 183153 - DNA, 27 bp, Artificial Sequence
  Description of Artificial Sequence: Synthetic oligonucleotide
cgcttcatctcccgctatacccaggag

SEQ ID NO: 183154 - DNA, 29 bp, Artificial Sequence
  Description of Artificial Sequence: Synthetic oligonucleotide
gcttcatctcccgctatacccaggagatc

SEQ ID NO: 183155 - DNA, 31 bp, Artificial Sequence
  Description of Artificial Sequence: Synthetic oligonucleotide
cttcatctcccgctatacccaggagatcttc

SEQ ID NO: 183156 - DNA, 32 bp, Artificial Sequence
  Description of Artificial Sequence: Synthetic oligonucleotide
ttcatctcccgctatacccaggagatcttctc

SEQ ID NO: 183157 - DNA, 31 bp, Artificial Sequence
  Description of Artificial Sequence: Synthetic oligonucleotide
tcatctcccgctatacccaggagatcttctc

SEQ ID NO: 183158 - DNA, 30 bp, Artificial Sequence
  Description of Artificial Sequence: Synthetic oligonucleotide
catctcccgctatacccaggagatcttctc

SEQ ID NO: 183159 - DNA, 30 bp, Artificial Sequence
  Description of Artificial Sequence: Synthetic oligonucleotide
atctcccgctatacccaggagatcttctcc

SEQ ID NO: 183160 - DNA, 29 bp, Artificial Sequence
  Description of Artificial Sequence: Synthetic oligonucleotide
tctcccgctatacccaggagatcttctcc

SEQ ID NO: 183161 - DNA, 28 bp, Artificial Sequence
  Description of Artificial Sequence: Synthetic oligonucleotide
ctcccgctatacccaggagatcttctcc

SEQ ID NO: 183162 - DNA, 30 bp, Artificial Sequence
  Description of Artificial Sequence: Synthetic oligonucleotide
tcccgctatacccaggagatcttctccttc

SEQ ID NO: 183163 - DNA, 29 bp, Artificial Sequence
  Description of Artificial Sequence: Synthetic oligonucleotide
cccgctatacccaggagatcttctccttc

SEQ ID NO: 183164 - DNA, 29 bp, Artificial Sequence
  Description of Artificial Sequence: Synthetic oligonucleotide
ccgctatacccaggagatcttctccttcc

SEQ ID NO: 183165 - DNA, 30 bp, Artificial Sequence
  Description of Artificial Sequence: Synthetic oligonucleotide
cgctatacccaggagatcttctccttcctc

SEQ ID NO: 183166 - DNA, 34 bp, Artificial Sequence
  Description of Artificial Sequence: Synthetic oligonucleotide
gctatacccaggagatcttctccttcctcatttc

SEQ ID NO: 183167 - DNA, 34 bp, Artificial Sequence
  Description of Artificial Sequence: Synthetic oligonucleotide
ctatacccaggagatcttctccttcctcatttcc

SEQ ID NO: 183168 - DNA, 34 bp, Artificial Sequence
  Description of Artificial Sequence: Synthetic oligonucleotide
tatacccaggagatcttctccttcctcatttccc

SEQ ID NO: 183169 - DNA, 33 bp, Artificial Sequence
  Description of Artificial Sequence: Synthetic oligonucleotide
atacccaggagatcttctccttcctcatttccc

SEQ ID NO: 183170 - DNA, 32 bp, Artificial Sequence
  Description of Artificial Sequence: Synthetic oligonucleotide
tacccaggagatcttctccttcctcatttccc

SEQ ID NO: 183171 - DNA, 31 bp, Artificial Sequence
  Description of Artificial Sequence: Synthetic oligonucleotide
acccaggagatcttctccttcctcatttccc

SEQ ID NO: 183172 - DNA, 30 bp, Artificial Sequence
  Description of Artificial Sequence: Synthetic oligonucleotide
cccaggagatcttctccttcctcatttccc

SEQ ID NO: 183173 - DNA, 31 bp, Artificial Sequence
  Description of Artificial Sequence: Synthetic oligonucleotide
ccaggagatcttctccttcctcatttccctc

SEQ ID NO: 183174 - DNA, 33 bp, Artificial Sequence
  Description of Artificial Sequence: Synthetic oligonucleotide
caggagatcttctccttcctcatttccctcatc

SEQ ID NO: 183175 - DNA, 35 bp, Artificial Sequence
  Description of Artificial Sequence: Synthetic oligonucleotide
aggagatcttctccttcctcatttccctcatcttc

SEQ ID NO: 183176 - DNA, 34 bp, Artificial Sequence
  Description of Artificial Sequence: Synthetic oligonucleotide
ggagatcttctccttcctcatttccctcatcttc

SEQ ID NO: 183177 - DNA, 36 bp, Artificial Sequence
  Description of Artificial Sequence: Synthetic oligonucleotide
gagatcttctccttcctcatttccctcatcttcatc

SEQ ID NO: 183178 - DNA, 39 bp, Artificial Sequence
  Description of Artificial Sequence: Synthetic oligonucleotide
agatcttctccttcctcatttccctcatcttcatctatg

SEQ ID NO: 183179 - DNA, 38 bp, Artificial Sequence
  Description of Artificial Sequence: Synthetic oligonucleotide
gatcttctccttcctcatttccctcatcttcatctatg

SEQ ID NO: 183180 - DNA, 39 bp, Artificial Sequence
  Description of Artificial Sequence: Synthetic oligonucleotide
atcttctccttcctcatttccctcatcttcatctatgag

SEQ ID NO: 183181 - DNA, 38 bp, Artificial Sequence
  Description of Artificial Sequence: Synthetic oligonucleotide
tcttctccttcctcatttccctcatcttcatctatgag

SEQ ID NO: 183182 - DNA, 37 bp, Artificial Sequence
  Description of Artificial Sequence: Synthetic oligonucleotide
cttctccttcctcatttccctcatcttcatctatgag

SEQ ID NO: 183183 - DNA, 38 bp, Artificial Sequence
  Description of Artificial Sequence: Synthetic oligonucleotide
ttctccttcctcatttccctcatcttcatctatgagac

SEQ ID NO: 183184 - DNA, 37 bp, Artificial Sequence
  Description of Artificial Sequence: Synthetic oligonucleotide
tctccttcctcatttccctcatcttcatctatgagac

SEQ ID NO: 183185 - DNA, 36 bp, Artificial Sequence
  Description of Artificial Sequence: Synthetic oligonucleotide
ctccttcctcatttccctcatcttcatctatgagac

SEQ ID NO: 183186 - DNA, 39 bp, Artificial Sequence
  Description of Artificial Sequence: Synthetic oligonucleotide
tccttcctcatttccctcatcttcatctatgagactttc

SEQ ID NO: 183187 - DNA, 38 bp, Artificial Sequence
  Description of Artificial Sequence: Synthetic oligonucleotide
ccttcctcatttccctcatcttcatctatgagactttc

SEQ ID NO: 183188 - DNA, 39 bp, Artificial Sequence
  Description of Artificial Sequence: Synthetic oligonucleotide
cttcctcatttccctcatcttcatctatgagactttctc

SEQ ID NO: 183189 - DNA, 39 bp, Artificial Sequence
  Description of Artificial Sequence: Synthetic oligonucleotide
ttcctcatttccctcatcttcatctatgagactttctcc

SEQ ID NO: 183190 - DNA, 38 bp, Artificial Sequence
  Description of Artificial Sequence: Synthetic oligonucleotide
tcctcatttccctcatcttcatctatgagactttctcc

SEQ ID NO: 183191 - DNA, 37 bp, Artificial Sequence
  Description of Artificial Sequence: Synthetic oligonucleotide
cctcatttccctcatcttcatctatgagactttctcc

SEQ ID NO: 183192 - DNA, 39 bp, Artificial Sequence
  Description of Artificial Sequence: Synthetic oligonucleotide
ctcatttccctcatcttcatctatgagactttctccaag

SEQ ID NO: 183193 - DNA, 39 bp, Artificial Sequence
  Description of Artificial Sequence: Synthetic oligonucleotide
tcatttccctcatcttcatctatgagactttctccaagc

SEQ ID NO: 183194 - DNA, 38 bp, Artificial Sequence
  Description of Artificial Sequence: Synthetic oligonucleotide
catttccctcatcttcatctatgagactttctccaagc

SEQ ID NO: 183195 - DNA, 39 bp, Artificial Sequence
  Description of Artificial Sequence: Synthetic oligonucleotide
atttccctcatcttcatctatgagactttctccaagctg

SEQ ID NO: 183196 - DNA, 38 bp, Artificial Sequence
  Description of Artificial Sequence: Synthetic oligonucleotide
tttccctcatcttcatctatgagactttctccaagctg

SEQ ID NO: 183197 - DNA, 37 bp, Artificial Sequence
  Description of Artificial Sequence: Synthetic oligonucleotide
ttccctcatcttcatctatgagactttctccaagctg

SEQ ID NO: 183198 - DNA, 36 bp, Artificial Sequence
  Description of Artificial Sequence: Synthetic oligonucleotide
tccctcatcttcatctatgagactttctccaagctg

SEQ ID NO: 183199 - DNA, 35 bp, Artificial Sequence
  Description of Artificial Sequence: Synthetic oligonucleotide
ccctcatcttcatctatgagactttctccaagctg

SEQ ID NO: 183200 - DNA, 37 bp, Artificial Sequence
  Description of Artificial Sequence: Synthetic oligonucleotide
cctcatcttcatctatgagactttctccaagctgatc

SEQ ID NO: 183201 - DNA, 39 bp, Artificial Sequence
  Description of Artificial Sequence: Synthetic oligonucleotide
ctcatcttcatctatgagactttctccaagctgatcaag

SEQ ID NO: 183202 - DNA, 41 bp, Artificial Sequence
  Description of Artificial Sequence: Synthetic oligonucleotide
tcatcttcatctatgagactttctccaagctgatcaagatc

SEQ ID NO: 183203 - DNA, 40 bp, Artificial Sequence
  Description of Artificial Sequence: Synthetic oligonucleotide
catcttcatctatgagactttctccaagctgatcaagatc

SEQ ID NO: 183204 - DNA, 42 bp, Artificial Sequence
  Description of Artificial Sequence: Synthetic oligonucleotide
atcttcatctatgagactttctccaagctgatcaagatcttc

SEQ ID NO: 183205 - DNA, 41 bp, Artificial Sequence
  Description of Artificial Sequence: Synthetic oligonucleotide
tcttcatctatgagactttctccaagctgatcaagatcttc

SEQ ID NO: 183206 - DNA, 40 bp, Artificial Sequence
  Description of Artificial Sequence: Synthetic oligonucleotide
cttcatctatgagactttctccaagctgatcaagatcttc

SEQ ID NO: 183207 - DNA, 40 bp, Artificial Sequence
  Description of Artificial Sequence: Synthetic oligonucleotide
ttcatctatgagactttctccaagctgatcaagatcttcc

SEQ ID NO: 183208 - DNA, 39 bp, Artificial Sequence
  Description of Artificial Sequence: Synthetic oligonucleotide
tcatctatgagactttctccaagctgatcaagatcttcc

SEQ ID NO: 183209 - DNA, 38 bp, Artificial Sequence
  Description of Artificial Sequence: Synthetic oligonucleotide
catctatgagactttctccaagctgatcaagatcttcc

SEQ ID NO: 183210 - DNA, 39 bp, Artificial Sequence
  Description of Artificial Sequence: Synthetic oligonucleotide
atctatgagactttctccaagctgatcaagatcttccag

SEQ ID NO: 183211 - DNA, 38 bp, Artificial Sequence
  Description of Artificial Sequence: Synthetic oligonucleotide
tctatgagactttctccaagctgatcaagatcttccag

SEQ ID NO: 183212 - DNA, 37 bp, Artificial Sequence
  Description of Artificial Sequence: Synthetic oligonucleotide
ctatgagactttctccaagctgatcaagatcttccag

SEQ ID NO: 183213 - DNA, 37 bp, Artificial Sequence
  Description of Artificial Sequence: Synthetic oligonucleotide
tatgagactttctccaagctgatcaagatcttccagg

SEQ ID NO: 183214 - DNA, 36 bp, Artificial Sequence
  Description of Artificial Sequence: Synthetic oligonucleotide
atgagactttctccaagctgatcaagatcttccagg

SEQ ID NO: 183215 - DNA, 35 bp, Artificial Sequence
  Description of Artificial Sequence: Synthetic oligonucleotide
tgagactttctccaagctgatcaagatcttccagg

SEQ ID NO: 183216 - DNA, 34 bp, Artificial Sequence
  Description of Artificial Sequence: Synthetic oligonucleotide
gagactttctccaagctgatcaagatcttccagg

SEQ ID NO: 183217 - DNA, 35 bp, Artificial Sequence
  Description of Artificial Sequence: Synthetic oligonucleotide
agactttctccaagctgatcaagatcttccaggac

SEQ ID NO: 183218 - DNA, 34 bp, Artificial Sequence
  Description of Artificial Sequence: Synthetic oligonucleotide
gactttctccaagctgatcaagatcttccaggac

SEQ ID NO: 183219 - DNA, 34 bp, Artificial Sequence
  Description of Artificial Sequence: Synthetic oligonucleotide
actttctccaagctgatcaagatcttccaggacc

SEQ ID NO: 183220 - DNA, 33 bp, Artificial Sequence
  Description of Artificial Sequence: Synthetic oligonucleotide
ctttctccaagctgatcaagatcttccaggacc

SEQ ID NO: 183221 - DNA, 34 bp, Artificial Sequence
  Description of Artificial Sequence: Synthetic oligonucleotide
tttctccaagctgatcaagatcttccaggaccac

SEQ ID NO: 183222 - DNA, 33 bp, Artificial Sequence
  Description of Artificial Sequence: Synthetic oligonucleotide
ttctccaagctgatcaagatcttccaggaccac

SEQ ID NO: 183223 - DNA, 32 bp, Artificial Sequence
  Description of Artificial Sequence: Synthetic oligonucleotide
tctccaagctgatcaagatcttccaggaccac

SEQ ID NO: 183224 - DNA, 31 bp, Artificial Sequence
  Description of Artificial Sequence: Synthetic oligonucleotide
ctccaagctgatcaagatcttccaggaccac

SEQ ID NO: 183225 - DNA, 31 bp, Artificial Sequence
  Description of Artificial Sequence: Synthetic oligonucleotide
tccaagctgatcaagatcttccaggaccacc

SEQ ID NO: 183226 - DNA, 30 bp, Artificial Sequence
  Description of Artificial Sequence: Synthetic oligonucleotide
ccaagctgatcaagatcttccaggaccacc

SEQ ID NO: 183227 - DNA, 30 bp, Artificial Sequence
  Description of Artificial Sequence: Synthetic oligonucleotide
caagctgatcaagatcttccaggaccaccc

SEQ ID NO: 183228 - DNA, 31 bp, Artificial Sequence
  Description of Artificial Sequence: Synthetic oligonucleotide
aagctgatcaagatcttccaggaccacccac

SEQ ID NO: 183229 - DNA, 30 bp, Artificial Sequence
  Description of Artificial Sequence: Synthetic oligonucleotide
agctgatcaagatcttccaggaccacccac

SEQ ID NO: 183230 - DNA, 29 bp, Artificial Sequence
  Description of Artificial Sequence: Synthetic oligonucleotide
gctgatcaagatcttccaggaccacccac

SEQ ID NO: 183231 - DNA, 31 bp, Artificial Sequence
  Description of Artificial Sequence: Synthetic oligonucleotide
ctgatcaagatcttccaggaccacccactac

SEQ ID NO: 183232 - DNA, 32 bp, Artificial Sequence
  Description of Artificial Sequence: Synthetic oligonucleotide
tgatcaagatcttccaggaccacccactacag

SEQ ID NO: 183233 - DNA, 31 bp, Artificial Sequence
  Description of Artificial Sequence: Synthetic oligonucleotide
gatcaagatcttccaggaccacccactacag

SEQ ID NO: 183234 - DNA, 33 bp, Artificial Sequence
  Description of Artificial Sequence: Synthetic oligonucleotide
atcaagatcttccaggaccacccactacagaag

SEQ ID NO: 183235 - DNA, 32 bp, Artificial Sequence
  Description of Artificial Sequence: Synthetic oligonucleotide
tcaagatcttccaggaccacccactacagaag

SEQ ID NO: 183236 - DNA, 31 bp, Artificial Sequence
  Description of Artificial Sequence: Synthetic oligonucleotide
caagatcttccaggaccacccactacagaag

SEQ ID NO: 183237 - DNA, 32 bp, Artificial Sequence
  Description of Artificial Sequence: Synthetic oligonucleotide
aagatcttccaggaccacccactacagaagac

SEQ ID NO: 183238 - DNA, 31 bp, Artificial Sequence
  Description of Artificial Sequence: Synthetic oligonucleotide
agatcttccaggaccacccactacagaagac

SEQ ID NO: 183239 - DNA, 30 bp, Artificial Sequence
  Description of Artificial Sequence: Synthetic oligonucleotide
gatcttccaggaccacccactacagaagac

SEQ ID NO: 183240 - DNA, 36 bp, Artificial Sequence
  Description of Artificial Sequence: Synthetic oligonucleotide
atcttccaggaccacccactacagaagacttataac

SEQ ID NO: 183241 - DNA, 35 bp, Artificial Sequence
  Description of Artificial Sequence: Synthetic oligonucleotide
tcttccaggaccacccactacagaagacttataac

SEQ ID NO: 183242 - DNA, 34 bp, Artificial Sequence
  Description of Artificial Sequence: Synthetic oligonucleotide
cttccaggaccacccactacagaagacttataac

SEQ ID NO: 183243 - DNA, 36 bp, Artificial Sequence
  Description of Artificial Sequence: Synthetic oligonucleotide
ttccaggaccacccactacagaagacttataactac

SEQ ID NO: 183244 - DNA, 35 bp, Artificial Sequence
  Description of Artificial Sequence: Synthetic oligonucleotide
tccaggaccacccactacagaagacttataactac

SEQ ID NO: 183245 - DNA, 34 bp, Artificial Sequence
  Description of Artificial Sequence: Synthetic oligonucleotide
ccaggaccacccactacagaagacttataactac

SEQ ID NO: 183246 - DNA, 36 bp, Artificial Sequence
  Description of Artificial Sequence: Synthetic oligonucleotide
caggaccacccactacagaagacttataactacaac

SEQ ID NO: 183247 - DNA, 36 bp, Artificial Sequence
  Description of Artificial Sequence: Synthetic oligonucleotide
aggaccacccactacagaagacttataactacaacg

SEQ ID NO: 183248 - DNA, 35 bp, Artificial Sequence
  Description of Artificial Sequence: Synthetic oligonucleotide
ggaccacccactacagaagacttataactacaacg

SEQ ID NO: 183249 - DNA, 36 bp, Artificial Sequence
  Description of Artificial Sequence: Synthetic oligonucleotide
gaccacccactacagaagacttataactacaacgtg

SEQ ID NO: 183250 - DNA, 38 bp, Artificial Sequence
  Description of Artificial Sequence: Synthetic oligonucleotide
accacccactacagaagacttataactacaacgtgttg

SEQ ID NO: 183251 - DNA, 37 bp, Artificial Sequence
  Description of Artificial Sequence: Synthetic oligonucleotide
ccacccactacagaagacttataactacaacgtgttg

SEQ ID NO: 183252 - DNA, 39 bp, Artificial Sequence
  Description of Artificial Sequence: Synthetic oligonucleotide
cacccactacagaagacttataactacaacgtgttgatg

SEQ ID NO: 183253 - DNA, 39 bp, Artificial Sequence
  Description of Artificial Sequence: Synthetic oligonucleotide
acccactacagaagacttataactacaacgtgttgatgg

SEQ ID NO: 183254 - DNA, 38 bp, Artificial Sequence
  Description of Artificial Sequence: Synthetic oligonucleotide
cccactacagaagacttataactacaacgtgttgatgg

SEQ ID NO: 183255 - DNA, 39 bp, Artificial Sequence
  Description of Artificial Sequence: Synthetic oligonucleotide
ccactacagaagacttataactacaacgtgttgatggtg

SEQ ID NO: 183256 - DNA, 39 bp, Artificial Sequence
  Description of Artificial Sequence: Synthetic oligonucleotide
cactacagaagacttataactacaacgtgttgatggtgc

SEQ ID NO: 183257 - DNA, 39 bp, Artificial Sequence
  Description of Artificial Sequence: Synthetic oligonucleotide
actacagaagacttataactacaacgtgttgatggtgcc

SEQ ID NO: 183258 - DNA, 38 bp, Artificial Sequence
  Description of Artificial Sequence: Synthetic oligonucleotide
ctacagaagacttataactacaacgtgttgatggtgcc

SEQ ID NO: 183259 - DNA, 38 bp, Artificial Sequence
  Description of Artificial Sequence: Synthetic oligonucleotide
tacagaagacttataactacaacgtgttgatggtgccc

SEQ ID NO: 183260 - DNA, 37 bp, Artificial Sequence
  Description of Artificial Sequence: Synthetic oligonucleotide
acagaagacttataactacaacgtgttgatggtgccc

SEQ ID NO: 183261 - DNA, 36 bp, Artificial Sequence
  Description of Artificial Sequence: Synthetic oligonucleotide
cagaagacttataactacaacgtgttgatggtgccc

SEQ ID NO: 183262 - DNA, 39 bp, Artificial Sequence
  Description of Artificial Sequence: Synthetic oligonucleotide
agaagacttataactacaacgtgttgatggtgcccaaac

SEQ ID NO: 183263 - DNA, 38 bp, Artificial Sequence
  Description of Artificial Sequence: Synthetic oligonucleotide
gaagacttataactacaacgtgttgatggtgcccaaac

SEQ ID NO: 183264 - DNA, 38 bp, Artificial Sequence
  Description of Artificial Sequence: Synthetic oligonucleotide
aagacttataactacaacgtgttgatggtgcccaaacc

SEQ ID NO: 183265 - DNA, 37 bp, Artificial Sequence
  Description of Artificial Sequence: Synthetic oligonucleotide
agacttataactacaacgtgttgatggtgcccaaacc

SEQ ID NO: 183266 - DNA, 36 bp, Artificial Sequence
  Description of Artificial Sequence: Synthetic oligonucleotide
gacttataactacaacgtgttgatggtgcccaaacc

SEQ ID NO: 183267 - DNA, 37 bp, Artificial Sequence
  Description of Artificial Sequence: Synthetic oligonucleotide
acttataactacaacgtgttgatggtgcccaaacctc

SEQ ID NO: 183268 - DNA, 36 bp, Artificial Sequence
  Description of Artificial Sequence: Synthetic oligonucleotide
cttataactacaacgtgttgatggtgcccaaacctc

SEQ ID NO: 183269 - DNA, 37 bp, Artificial Sequence
  Description of Artificial Sequence: Synthetic oligonucleotide
ttataactacaacgtgttgatggtgcccaaacctcag

SEQ ID NO: 183270 - DNA, 36 bp, Artificial Sequence
  Description of Artificial Sequence: Synthetic oligonucleotide
tataactacaacgtgttgatggtgcccaaacctcag

SEQ ID NO: 183271 - DNA, 35 bp, Artificial Sequence
  Description of Artificial Sequence: Synthetic oligonucleotide
ataactacaacgtgttgatggtgcccaaacctcag

SEQ ID NO: 183272 - DNA, 34 bp, Artificial Sequence
  Description of Artificial Sequence: Synthetic oligonucleotide
taactacaacgtgttgatggtgcccaaacctcag

SEQ ID NO: 183273 - DNA, 33 bp, Artificial Sequence
  Description of Artificial Sequence: Synthetic oligonucleotide
aactacaacgtgttgatggtgcccaaacctcag

SEQ ID NO: 183274 - DNA, 32 bp, Artificial Sequence
  Description of Artificial Sequence: Synthetic oligonucleotide
actacaacgtgttgatggtgcccaaacctcag

SEQ ID NO: 183275 - DNA, 31 bp, Artificial Sequence
  Description of Artificial Sequence: Synthetic oligonucleotide
ctacaacgtgttgatggtgcccaaacctcag

SEQ ID NO: 183276 - DNA, 31 bp, Artificial Sequence
  Description of Artificial Sequence: Synthetic oligonucleotide
tacaacgtgttgatggtgcccaaacctcagg

SEQ ID NO: 183277 - DNA, 30 bp, Artificial Sequence
  Description of Artificial Sequence: Synthetic oligonucleotide
acaacgtgttgatggtgcccaaacctcagg

SEQ ID NO: 183278 - DNA, 29 bp, Artificial Sequence
  Description of Artificial Sequence: Synthetic oligonucleotide
caacgtgttgatggtgcccaaacctcagg

SEQ ID NO: 183279 - DNA, 29 bp, Artificial Sequence
  Description of Artificial Sequence: Synthetic oligonucleotide
aacgtgttgatggtgcccaaacctcaggg

SEQ ID NO: 183280 - DNA, 28 bp, Artificial Sequence
  Description of Artificial Sequence: Synthetic oligonucleotide
acgtgttgatggtgcccaaacctcaggg

SEQ ID NO: 183281 - DNA, 27 bp, Artificial Sequence
  Description of Artificial Sequence: Synthetic oligonucleotide
cgtgttgatggtgcccaaacctcaggg

SEQ ID NO: 183282 - DNA, 27 bp, Artificial Sequence
  Description of Artificial Sequence: Synthetic oligonucleotide
gtgttgatggtgcccaaacctcagggc

SEQ ID NO: 183283 - DNA, 27 bp, Artificial Sequence
  Description of Artificial Sequence: Synthetic oligonucleotide
tgttgatggtgcccaaacctcagggcc

SEQ ID NO: 183284 - DNA, 26 bp, Artificial Sequence
  Description of Artificial Sequence: Synthetic oligonucleotide
gttgatggtgcccaaacctcagggcc

SEQ ID NO: 183285 - DNA, 26 bp, Artificial Sequence
  Description of Artificial Sequence: Synthetic oligonucleotide
ttgatggtgcccaaacctcagggccc

SEQ ID NO: 183286 - DNA, 25 bp, Artificial Sequence
  Description of Artificial Sequence: Synthetic oligonucleotide
tgatggtgcccaaacctcagggccc

SEQ ID NO: 183287 - DNA, 24 bp, Artificial Sequence
  Description of Artificial Sequence: Synthetic oligonucleotide
gatggtgcccaaacctcagggccc

SEQ ID NO: 183288 - DNA, 24 bp, Artificial Sequence
  Description of Artificial Sequence: Synthetic oligonucleotide
atggtgcccaaacctcagggcccc

SEQ ID NO: 183289 - DNA, 23 bp, Artificial Sequence
  Description of Artificial Sequence: Synthetic oligonucleotide
tggtgcccaaacctcagggcccc

SEQ ID NO: 183290 - DNA, 22 bp, Artificial Sequence
  Description of Artificial Sequence: Synthetic oligonucleotide
ggtgcccaaacctcagggcccc

SEQ ID NO: 183291 - DNA, 23 bp, Artificial Sequence
  Description of Artificial Sequence: Synthetic oligonucleotide
gtgcccaaacctcagggccccct

SEQ ID NO: 183292 - DNA, 23 bp, Artificial Sequence
  Description of Artificial Sequence: Synthetic oligonucleotide
tgcccaaacctcagggccccctg

SEQ ID NO: 183293 - DNA, 22 bp, Artificial Sequence
  Description of Artificial Sequence: Synthetic oligonucleotide
gcccaaacctcagggccccctg

SEQ ID NO: 183294 - DNA, 22 bp, Artificial Sequence
  Description of Artificial Sequence: Synthetic oligonucleotide
cccaaacctcagggccccctgc

SEQ ID NO: 183295 - DNA, 22 bp, Artificial Sequence
  Description of Artificial Sequence: Synthetic oligonucleotide
ccaaacctcagggccccctgcc

SEQ ID NO: 183296 - DNA, 24 bp, Artificial Sequence
  Description of Artificial Sequence: Synthetic oligonucleotide
caaacctcagggccccctgcccaa

SEQ ID NO: 183297 - DNA, 25 bp, Artificial Sequence
  Description of Artificial Sequence: Synthetic oligonucleotide
aaacctcagggccccctgcccaaca

SEQ ID NO: 183298 - DNA, 24 bp, Artificial Sequence
  Description of Artificial Sequence: Synthetic oligonucleotide
aacctcagggccccctgcccaaca

SEQ ID NO: 183299 - DNA, 23 bp, Artificial Sequence
  Description of Artificial Sequence: Synthetic oligonucleotide
acctcagggccccctgcccaaca

SEQ ID NO: 183300 - DNA, 22 bp, Artificial Sequence
  Description of Artificial Sequence: Synthetic oligonucleotide
cctcagggccccctgcccaaca

SEQ ID NO: 183301 - DNA, 23 bp, Artificial Sequence
  Description of Artificial Sequence: Synthetic oligonucleotide
ctcagggccccctgcccaacaca

SEQ ID NO: 183302 - DNA, 23 bp, Artificial Sequence
  Description of Artificial Sequence: Synthetic oligonucleotide
tcagggccccctgcccaacacag

SEQ ID NO: 183303 - DNA, 22 bp, Artificial Sequence
  Description of Artificial Sequence: Synthetic oligonucleotide
cagggccccctgcccaacacag

SEQ ID NO: 183304 - DNA, 22 bp, Artificial Sequence
  Description of Artificial Sequence: Synthetic oligonucleotide
agggccccctgcccaacacagc

SEQ ID NO: 183305 - DNA, 21 bp, Artificial Sequence
  Description of Artificial Sequence: Synthetic oligonucleotide
gggccccctgcccaacacagc

SEQ ID NO: 183306 - DNA, 21 bp, Artificial Sequence
  Description of Artificial Sequence: Synthetic oligonucleotide
ggccccctgcccaacacagcc

SEQ ID NO: 183307 - DNA, 22 bp, Artificial Sequence
  Description of Artificial Sequence: Synthetic oligonucleotide
gccccctgcccaacacagccct

SEQ ID NO: 183308 - DNA, 22 bp, Artificial Sequence
  Description of Artificial Sequence: Synthetic oligonucleotide
ccccctgcccaacacagccctc

SEQ ID NO: 183309 - DNA, 23 bp, Artificial Sequence
  Description of Artificial Sequence: Synthetic oligonucleotide
cccctgcccaacacagccctcct

SEQ ID NO: 183310 - DNA, 24 bp, Artificial Sequence
  Description of Artificial Sequence: Synthetic oligonucleotide
ccctgcccaacacagccctcctct

SEQ ID NO: 183311 - DNA, 24 bp, Artificial Sequence
  Description of Artificial Sequence: Synthetic oligonucleotide
cctgcccaacacagccctcctctc

SEQ ID NO: 183312 - DNA, 24 bp, Artificial Sequence
  Description of Artificial Sequence: Synthetic oligonucleotide
ctgcccaacacagccctcctctcc

SEQ ID NO: 183313 - DNA, 26 bp, Artificial Sequence
  Description of Artificial Sequence: Synthetic oligonucleotide
tgcccaacacagccctcctctccctt

SEQ ID NO: 183314 - DNA, 25 bp, Artificial Sequence
  Description of Artificial Sequence: Synthetic oligonucleotide
gcccaacacagccctcctctccctt

SEQ ID NO: 183315 - DNA, 26 bp, Artificial Sequence
  Description of Artificial Sequence: Synthetic oligonucleotide
cccaacacagccctcctctcccttgt

SEQ ID NO: 183316 - DNA, 26 bp, Artificial Sequence
  Description of Artificial Sequence: Synthetic oligonucleotide
ccaacacagccctcctctcccttgtg

SEQ ID NO: 183317 - DNA, 27 bp, Artificial Sequence
  Description of Artificial Sequence: Synthetic oligonucleotide
caacacagccctcctctcccttgtgct

SEQ ID NO: 183318 - DNA, 27 bp, Artificial Sequence
  Description of Artificial Sequence: Synthetic oligonucleotide
aacacagccctcctctcccttgtgctc

SEQ ID NO: 183319 - DNA, 27 bp, Artificial Sequence
  Description of Artificial Sequence: Synthetic oligonucleotide
acacagccctcctctcccttgtgctca

SEQ ID NO: 183320 - DNA, 27 bp, Artificial Sequence
  Description of Artificial Sequence: Synthetic oligonucleotide
cacagccctcctctcccttgtgctcat

SEQ ID NO: 183321 - DNA, 27 bp, Artificial Sequence
  Description of Artificial Sequence: Synthetic oligonucleotide
acagccctcctctcccttgtgctcatg

SEQ ID NO: 183322 - DNA, 26 bp, Artificial Sequence
  Description of Artificial Sequence: Synthetic oligonucleotide
cagccctcctctcccttgtgctcatg

SEQ ID NO: 183323 - DNA, 26 bp, Artificial Sequence
  Description of Artificial Sequence: Synthetic oligonucleotide
agccctcctctcccttgtgctcatgg

SEQ ID NO: 183324 - DNA, 25 bp, Artificial Sequence
  Description of Artificial Sequence: Synthetic oligonucleotide
gccctcctctcccttgtgctcatgg

SEQ ID NO: 183325 - DNA, 25 bp, Artificial Sequence
  Description of Artificial Sequence: Synthetic oligonucleotide
ccctcctctcccttgtgctcatggc

SEQ ID NO: 183326 - DNA, 25 bp, Artificial Sequence
  Description of Artificial Sequence: Synthetic oligonucleotide
cctcctctcccttgtgctcatggcc

SEQ ID NO: 183327 - DNA, 25 bp, Artificial Sequence
  Description of Artificial Sequence: Synthetic oligonucleotide
ctcctctcccttgtgctcatggccg

SEQ ID NO: 183328 - DNA, 27 bp, Artificial Sequence
  Description of Artificial Sequence: Synthetic oligonucleotide
tcctctcccttgtgctcatggccggta

SEQ ID NO: 183329 - DNA, 26 bp, Artificial Sequence
  Description of Artificial Sequence: Synthetic oligonucleotide
cctctcccttgtgctcatggccggta

SEQ ID NO: 183330 - DNA, 26 bp, Artificial Sequence
  Description of Artificial Sequence: Synthetic oligonucleotide
ctctcccttgtgctcatggccggtac

SEQ ID NO: 183331 - DNA, 27 bp, Artificial Sequence
  Description of Artificial Sequence: Synthetic oligonucleotide
tctcccttgtgctcatggccggtacct

SEQ ID NO: 183332 - DNA, 27 bp, Artificial Sequence
  Description of Artificial Sequence: Synthetic oligonucleotide
ctcccttgtgctcatggccggtacctt

SEQ ID NO: 183333 - DNA, 27 bp, Artificial Sequence
  Description of Artificial Sequence: Synthetic oligonucleotide
tcccttgtgctcatggccggtaccttc

SEQ ID NO: 183334 - DNA, 27 bp, Artificial Sequence
  Description of Artificial Sequence: Synthetic oligonucleotide
cccttgtgctcatggccggtaccttct

SEQ ID NO: 183335 - DNA, 28 bp, Artificial Sequence
  Description of Artificial Sequence: Synthetic oligonucleotide
ccttgtgctcatggccggtaccttcttc

SEQ ID NO: 183336 - DNA, 31 bp, Artificial Sequence
  Description of Artificial Sequence: Synthetic oligonucleotide
cttgtgctcatggccggtaccttcttctttg

SEQ ID NO: 183337 - DNA, 31 bp, Artificial Sequence
  Description of Artificial Sequence: Synthetic oligonucleotide
ttgtgctcatggccggtaccttcttctttgc

SEQ ID NO: 183338 - DNA, 30 bp, Artificial Sequence
  Description of Artificial Sequence: Synthetic oligonucleotide
tgtgctcatggccggtaccttcttctttgc

SEQ ID NO: 183339 - DNA, 29 bp, Artificial Sequence
  Description of Artificial Sequence: Synthetic oligonucleotide
gtgctcatggccggtaccttcttctttgc

SEQ ID NO: 183340 - DNA, 29 bp, Artificial Sequence
  Description of Artificial Sequence: Synthetic oligonucleotide
tgctcatggccggtaccttcttctttgcc

SEQ ID NO: 183341 - DNA, 28 bp, Artificial Sequence
  Description of Artificial Sequence: Synthetic oligonucleotide
gctcatggccggtaccttcttctttgcc

SEQ ID NO: 183342 - DNA, 30 bp, Artificial Sequence
  Description of Artificial Sequence: Synthetic oligonucleotide
ctcatggccggtaccttcttctttgccatg

SEQ ID NO: 183343 - DNA, 32 bp, Artificial Sequence
  Description of Artificial Sequence: Synthetic oligonucleotide
tcatggccggtaccttcttctttgccatgatg

SEQ ID NO: 183344 - DNA, 31 bp, Artificial Sequence
  Description of Artificial Sequence: Synthetic oligonucleotide
catggccggtaccttcttctttgccatgatg

SEQ ID NO: 183345 - DNA, 31 bp, Artificial Sequence
  Description of Artificial Sequence: Synthetic oligonucleotide
atggccggtaccttcttctttgccatgatgc

SEQ ID NO: 183346 - DNA, 30 bp, Artificial Sequence
  Description of Artificial Sequence: Synthetic oligonucleotide
tggccggtaccttcttctttgccatgatgc

SEQ ID NO: 183347 - DNA, 29 bp, Artificial Sequence
  Description of Artificial Sequence: Synthetic oligonucleotide
ggccggtaccttcttctttgccatgatgc

SEQ ID NO: 183348 - DNA, 30 bp, Artificial Sequence
  Description of Artificial Sequence: Synthetic oligonucleotide
gccggtaccttcttctttgccatgatgctg

SEQ ID NO: 183349 - DNA, 30 bp, Artificial Sequence
  Description of Artificial Sequence: Synthetic oligonucleotide
ccggtaccttcttctttgccatgatgctgc

SEQ ID NO: 183350 - DNA, 30 bp, Artificial Sequence
  Description of Artificial Sequence: Synthetic oligonucleotide
cggtaccttcttctttgccatgatgctgcg

SEQ ID NO: 183351 - DNA, 30 bp, Artificial Sequence
  Description of Artificial Sequence: Synthetic oligonucleotide
ggtaccttcttctttgccatgatgctgcgc

SEQ ID NO: 183352 - DNA, 32 bp, Artificial Sequence
  Description of Artificial Sequence: Synthetic oligonucleotide
gtaccttcttctttgccatgatgctgcgcaag

SEQ ID NO: 183353 - DNA, 34 bp, Artificial Sequence
  Description of Artificial Sequence: Synthetic oligonucleotide
taccttcttctttgccatgatgctgcgcaagttc

SEQ ID NO: 183354 - DNA, 33 bp, Artificial Sequence
  Description of Artificial Sequence: Synthetic oligonucleotide
accttcttctttgccatgatgctgcgcaagttc

SEQ ID NO: 183355 - DNA, 32 bp, Artificial Sequence
  Description of Artificial Sequence: Synthetic oligonucleotide
ccttcttctttgccatgatgctgcgcaagttc

SEQ ID NO: 183356 - DNA, 34 bp, Artificial Sequence
  Description of Artificial Sequence: Synthetic oligonucleotide
cttcttctttgccatgatgctgcgcaagttcaag

SEQ ID NO: 183357 - DNA, 36 bp, Artificial Sequence
  Description of Artificial Sequence: Synthetic oligonucleotide
ttcttctttgccatgatgctgcgcaagttcaagaac

SEQ ID NO: 183358 - DNA, 35 bp, Artificial Sequence
  Description of Artificial Sequence: Synthetic oligonucleotide
tcttctttgccatgatgctgcgcaagttcaagaac

SEQ ID NO: 183359 - DNA, 34 bp, Artificial Sequence
  Description of Artificial Sequence: Synthetic oligonucleotide
cttctttgccatgatgctgcgcaagttcaagaac

SEQ ID NO: 183360 - DNA, 35 bp, Artificial Sequence
  Description of Artificial Sequence: Synthetic oligonucleotide
ttctttgccatgatgctgcgcaagttcaagaacag

SEQ ID NO: 183361 - DNA, 34 bp, Artificial Sequence
  Description of Artificial Sequence: Synthetic oligonucleotide
tctttgccatgatgctgcgcaagttcaagaacag

SEQ ID NO: 183362 - DNA, 33 bp, Artificial Sequence
  Description of Artificial Sequence: Synthetic oligonucleotide
ctttgccatgatgctgcgcaagttcaagaacag

SEQ ID NO: 183363 - DNA, 33 bp, Artificial Sequence
  Description of Artificial Sequence: Synthetic oligonucleotide
tttgccatgatgctgcgcaagttcaagaacagc

SEQ ID NO: 183364 - DNA, 32 bp, Artificial Sequence
  Description of Artificial Sequence: Synthetic oligonucleotide
ttgccatgatgctgcgcaagttcaagaacagc

SEQ ID NO: 183365 - DNA, 31 bp, Artificial Sequence
  Description of Artificial Sequence: Synthetic oligonucleotide
tgccatgatgctgcgcaagttcaagaacagc

SEQ ID NO: 183366 - DNA, 30 bp, Artificial Sequence
  Description of Artificial Sequence: Synthetic oligonucleotide
gccatgatgctgcgcaagttcaagaacagc

SEQ ID NO: 183367 - DNA, 31 bp, Artificial Sequence
  Description of Artificial Sequence: Synthetic oligonucleotide
ccatgatgctgcgcaagttcaagaacagctc

SEQ ID NO: 183368 - DNA, 31 bp, Artificial Sequence
  Description of Artificial Sequence: Synthetic oligonucleotide
catgatgctgcgcaagttcaagaacagctcc

SEQ ID NO: 183369 - DNA, 36 bp, Artificial Sequence
  Description of Artificial Sequence: Synthetic oligonucleotide
atgatgctgcgcaagttcaagaacagctcctatttc

SEQ ID NO: 183370 - DNA, 35 bp, Artificial Sequence
  Description of Artificial Sequence: Synthetic oligonucleotide
tgatgctgcgcaagttcaagaacagctcctatttc

SEQ ID NO: 183371 - DNA, 34 bp, Artificial Sequence
  Description of Artificial Sequence: Synthetic oligonucleotide
gatgctgcgcaagttcaagaacagctcctatttc

SEQ ID NO: 183372 - DNA, 34 bp, Artificial Sequence
  Description of Artificial Sequence: Synthetic oligonucleotide
atgctgcgcaagttcaagaacagctcctatttcc

SEQ ID NO: 183373 - DNA, 33 bp, Artificial Sequence
  Description of Artificial Sequence: Synthetic oligonucleotide
tgctgcgcaagttcaagaacagctcctatttcc

SEQ ID NO: 183374 - DNA, 32 bp, Artificial Sequence
  Description of Artificial Sequence: Synthetic oligonucleotide
gctgcgcaagttcaagaacagctcctatttcc

SEQ ID NO: 183375 - DNA, 32 bp, Artificial Sequence
  Description of Artificial Sequence: Synthetic oligonucleotide
ctgcgcaagttcaagaacagctcctatttccc

SEQ ID NO: 183376 - DNA, 33 bp, Artificial Sequence
  Description of Artificial Sequence: Synthetic oligonucleotide
tgcgcaagttcaagaacagctcctatttccctg

SEQ ID NO: 183377 - DNA, 32 bp, Artificial Sequence
  Description of Artificial Sequence: Synthetic oligonucleotide
gcgcaagttcaagaacagctcctatttccctg

SEQ ID NO: 183378 - DNA, 32 bp, Artificial Sequence
  Description of Artificial Sequence: Synthetic oligonucleotide
cgcaagttcaagaacagctcctatttccctgg

SEQ ID NO: 183379 - DNA, 32 bp, Artificial Sequence
  Description of Artificial Sequence: Synthetic oligonucleotide
gcaagttcaagaacagctcctatttccctggc

SEQ ID NO: 183380 - DNA, 34 bp, Artificial Sequence
  Description of Artificial Sequence: Synthetic oligonucleotide
caagttcaagaacagctcctatttccctggcaag

SEQ ID NO: 183381 - DNA, 34 bp, Artificial Sequence
  Description of Artificial Sequence: Synthetic oligonucleotide
aagttcaagaacagctcctatttccctggcaagc

SEQ ID NO: 183382 - DNA, 33 bp, Artificial Sequence
  Description of Artificial Sequence: Synthetic oligonucleotide
agttcaagaacagctcctatttccctggcaagc

SEQ ID NO: 183383 - DNA, 32 bp, Artificial Sequence
  Description of Artificial Sequence: Synthetic oligonucleotide
gttcaagaacagctcctatttccctggcaagc

SEQ ID NO: 183384 - DNA, 33 bp, Artificial Sequence
  Description of Artificial Sequence: Synthetic oligonucleotide
ttcaagaacagctcctatttccctggcaagctg

SEQ ID NO: 183385 - DNA, 32 bp, Artificial Sequence
  Description of Artificial Sequence: Synthetic oligonucleotide
tcaagaacagctcctatttccctggcaagctg

SEQ ID NO: 183386 - DNA, 31 bp, Artificial Sequence
  Description of Artificial Sequence: Synthetic oligonucleotide
caagaacagctcctatttccctggcaagctg

SEQ ID NO: 183387 - DNA, 31 bp, Artificial Sequence
  Description of Artificial Sequence: Synthetic oligonucleotide
aagaacagctcctatttccctggcaagctgc

SEQ ID NO: 183388 - DNA, 30 bp, Artificial Sequence
  Description of Artificial Sequence: Synthetic oligonucleotide
agaacagctcctatttccctggcaagctgc

SEQ ID NO: 183389 - DNA, 29 bp, Artificial Sequence
  Description of Artificial Sequence: Synthetic oligonucleotide
gaacagctcctatttccctggcaagctgc

SEQ ID NO: 183390 - DNA, 29 bp, Artificial Sequence
  Description of Artificial Sequence: Synthetic oligonucleotide
aacagctcctatttccctggcaagctgcg

SEQ ID NO: 183391 - DNA, 28 bp, Artificial Sequence
  Description of Artificial Sequence: Synthetic oligonucleotide
acagctcctatttccctggcaagctgcg

SEQ ID NO: 183392 - DNA, 27 bp, Artificial Sequence
  Description of Artificial Sequence: Synthetic oligonucleotide
cagctcctatttccctggcaagctgcg

SEQ ID NO: 183393 - DNA, 28 bp, Artificial Sequence
  Description of Artificial Sequence: Synthetic oligonucleotide
agctcctatttccctggcaagctgcgtc

SEQ ID NO: 183394 - DNA, 27 bp, Artificial Sequence
  Description of Artificial Sequence: Synthetic oligonucleotide
gctcctatttccctggcaagctgcgtc

SEQ ID NO: 183395 - DNA, 27 bp, Artificial Sequence
  Description of Artificial Sequence: Synthetic oligonucleotide
ctcctatttccctggcaagctgcgtcg

SEQ ID NO: 183396 - DNA, 27 bp, Artificial Sequence
  Description of Artificial Sequence: Synthetic oligonucleotide
tcctatttccctggcaagctgcgtcgg

SEQ ID NO: 183397 - DNA, 26 bp, Artificial Sequence
  Description of Artificial Sequence: Synthetic oligonucleotide
cctatttccctggcaagctgcgtcgg

SEQ ID NO: 183398 - DNA, 27 bp, Artificial Sequence
  Description of Artificial Sequence: Synthetic oligonucleotide
ctatttccctggcaagctgcgtcgggt

SEQ ID NO: 183399 - DNA, 27 bp, Artificial Sequence
  Description of Artificial Sequence: Synthetic oligonucleotide
tatttccctggcaagctgcgtcgggtc

SEQ ID NO: 183400 - DNA, 27 bp, Artificial Sequence
  Description of Artificial Sequence: Synthetic oligonucleotide
atttccctggcaagctgcgtcgggtca

SEQ ID NO: 183401 - DNA, 27 bp, Artificial Sequence
  Description of Artificial Sequence: Synthetic oligonucleotide
tttccctggcaagctgcgtcgggtcat

SEQ ID NO: 183402 - DNA, 26 bp, Artificial Sequence
  Description of Artificial Sequence: Synthetic oligonucleotide
ttccctggcaagctgcgtcgggtcat

SEQ ID NO: 183403 - DNA, 25 bp, Artificial Sequence
  Description of Artificial Sequence: Synthetic oligonucleotide
tccctggcaagctgcgtcgggtcat

SEQ ID NO: 183404 - DNA, 24 bp, Artificial Sequence
  Description of Artificial Sequence: Synthetic oligonucleotide
ccctggcaagctgcgtcgggtcat

SEQ ID NO: 183405 - DNA, 24 bp, Artificial Sequence
  Description of Artificial Sequence: Synthetic oligonucleotide
cctggcaagctgcgtcgggtcatc

SEQ ID NO: 183406 - DNA, 24 bp, Artificial Sequence
  Description of Artificial Sequence: Synthetic oligonucleotide
ctggcaagctgcgtcgggtcatcg

SEQ ID NO: 183407 - DNA, 24 bp, Artificial Sequence
  Description of Artificial Sequence: Synthetic oligonucleotide
tggcaagctgcgtcgggtcatcgg

SEQ ID NO: 183408 - DNA, 23 bp, Artificial Sequence
  Description of Artificial Sequence: Synthetic oligonucleotide
ggcaagctgcgtcgggtcatcgg

SEQ ID NO: 183409 - DNA, 23 bp, Artificial Sequence
  Description of Artificial Sequence: Synthetic oligonucleotide
gcaagctgcgtcgggtcatcggg

SEQ ID NO: 183410 - DNA, 24 bp, Artificial Sequence
  Description of Artificial Sequence: Synthetic oligonucleotide
caagctgcgtcgggtcatcgggga

SEQ ID NO: 183411 - DNA, 26 bp, Artificial Sequence
  Description of Artificial Sequence: Synthetic oligonucleotide
aagctgcgtcgggtcatcggggactt

SEQ ID NO: 183412 - DNA, 25 bp, Artificial Sequence
  Description of Artificial Sequence: Synthetic oligonucleotide
agctgcgtcgggtcatcggggactt

SEQ ID NO: 183413 - DNA, 24 bp, Artificial Sequence
  Description of Artificial Sequence: Synthetic oligonucleotide
gctgcgtcgggtcatcggggactt

SEQ ID NO: 183414 - DNA, 24 bp, Artificial Sequence
  Description of Artificial Sequence: Synthetic oligonucleotide
ctgcgtcgggtcatcggggacttc

SEQ ID NO: 183415 - DNA, 24 bp, Artificial Sequence
  Description of Artificial Sequence: Synthetic oligonucleotide
tgcgtcgggtcatcggggacttcg

SEQ ID NO: 183416 - DNA, 23 bp, Artificial Sequence
  Description of Artificial Sequence: Synthetic oligonucleotide
gcgtcgggtcatcggggacttcg

SEQ ID NO: 183417 - DNA, 23 bp, Artificial Sequence
  Description of Artificial Sequence: Synthetic oligonucleotide
cgtcgggtcatcggggacttcgg

SEQ ID NO: 183418 - DNA, 23 bp, Artificial Sequence
  Description of Artificial Sequence: Synthetic oligonucleotide
gtcgggtcatcggggacttcggg

SEQ ID NO: 183419 - DNA, 24 bp, Artificial Sequence
  Description of Artificial Sequence: Synthetic oligonucleotide
tcgggtcatcggggacttcggggt

SEQ ID NO: 183420 - DNA, 23 bp, Artificial Sequence
  Description of Artificial Sequence: Synthetic oligonucleotide
cgggtcatcggggacttcggggt

SEQ ID NO: 183421 - DNA, 23 bp, Artificial Sequence
  Description of Artificial Sequence: Synthetic oligonucleotide
gggtcatcggggacttcggggtc

SEQ ID NO: 183422 - DNA, 23 bp, Artificial Sequence
  Description of Artificial Sequence: Synthetic oligonucleotide
ggtcatcggggacttcggggtcc

SEQ ID NO: 183423 - DNA, 23 bp, Artificial Sequence
  Description of Artificial Sequence: Synthetic oligonucleotide
gtcatcggggacttcggggtccc

SEQ ID NO: 183424 - DNA, 25 bp, Artificial Sequence
  Description of Artificial Sequence: Synthetic oligonucleotide
tcatcggggacttcggggtccccat

SEQ ID NO: 183425 - DNA, 24 bp, Artificial Sequence
  Description of Artificial Sequence: Synthetic oligonucleotide
catcggggacttcggggtccccat

SEQ ID NO: 183426 - DNA, 25 bp, Artificial Sequence
  Description of Artificial Sequence: Synthetic oligonucleotide
atcggggacttcggggtccccatct

SEQ ID NO: 183427 - DNA, 24 bp, Artificial Sequence
  Description of Artificial Sequence: Synthetic oligonucleotide
tcggggacttcggggtccccatct

SEQ ID NO: 183428 - DNA, 23 bp, Artificial Sequence
  Description of Artificial Sequence: Synthetic oligonucleotide
cggggacttcggggtccccatct

SEQ ID NO: 183429 - DNA, 23 bp, Artificial Sequence
  Description of Artificial Sequence: Synthetic oligonucleotide
ggggacttcggggtccccatctc

SEQ ID NO: 183430 - DNA, 25 bp, Artificial Sequence
  Description of Artificial Sequence: Synthetic oligonucleotide
gggacttcggggtccccatctccat

SEQ ID NO: 183431 - DNA, 25 bp, Artificial Sequence
  Description of Artificial Sequence: Synthetic oligonucleotide
ggacttcggggtccccatctccatc

SEQ ID NO: 183432 - DNA, 26 bp, Artificial Sequence
  Description of Artificial Sequence: Synthetic oligonucleotide
gacttcggggtccccatctccatcct

SEQ ID NO: 183433 - DNA, 27 bp, Artificial Sequence
  Description of Artificial Sequence: Synthetic oligonucleotide
acttcggggtccccatctccatcctga

SEQ ID NO: 183434 - DNA, 27 bp, Artificial Sequence
  Description of Artificial Sequence: Synthetic oligonucleotide
cttcggggtccccatctccatcctgat

SEQ ID NO: 183435 - DNA, 27 bp, Artificial Sequence
  Description of Artificial Sequence: Synthetic oligonucleotide
ttcggggtccccatctccatcctgatc

SEQ ID NO: 183436 - DNA, 27 bp, Artificial Sequence
  Description of Artificial Sequence: Synthetic oligonucleotide
tcggggtccccatctccatcctgatca

SEQ ID NO: 183437 - DNA, 27 bp, Artificial Sequence
  Description of Artificial Sequence: Synthetic oligonucleotide
cggggtccccatctccatcctgatcat

SEQ ID NO: 183438 - DNA, 27 bp, Artificial Sequence
  Description of Artificial Sequence: Synthetic oligonucleotide
ggggtccccatctccatcctgatcatg

SEQ ID NO: 183439 - DNA, 27 bp, Artificial Sequence
  Description of Artificial Sequence: Synthetic oligonucleotide
gggtccccatctccatcctgatcatgg

SEQ ID NO: 183440 - DNA, 28 bp, Artificial Sequence
  Description of Artificial Sequence: Synthetic oligonucleotide
ggtccccatctccatcctgatcatggtc

SEQ ID NO: 183441 - DNA, 28 bp, Artificial Sequence
  Description of Artificial Sequence: Synthetic oligonucleotide
gtccccatctccatcctgatcatggtcc

SEQ ID NO: 183442 - DNA, 29 bp, Artificial Sequence
  Description of Artificial Sequence: Synthetic oligonucleotide
tccccatctccatcctgatcatggtcctg

SEQ ID NO: 183443 - DNA, 28 bp, Artificial Sequence
  Description of Artificial Sequence: Synthetic oligonucleotide
ccccatctccatcctgatcatggtcctg

SEQ ID NO: 183444 - DNA, 28 bp, Artificial Sequence
  Description of Artificial Sequence: Synthetic oligonucleotide
cccatctccatcctgatcatggtcctgg

SEQ ID NO: 183445 - DNA, 29 bp, Artificial Sequence
  Description of Artificial Sequence: Synthetic oligonucleotide
ccatctccatcctgatcatggtcctggtg

SEQ ID NO: 183446 - DNA, 29 bp, Artificial Sequence
  Description of Artificial Sequence: Synthetic oligonucleotide
catctccatcctgatcatggtcctggtgg

SEQ ID NO: 183447 - DNA, 33 bp, Artificial Sequence
  Description of Artificial Sequence: Synthetic oligonucleotide
atctccatcctgatcatggtcctggtggatttc

SEQ ID NO: 183448 - DNA, 32 bp, Artificial Sequence
  Description of Artificial Sequence: Synthetic oligonucleotide
tctccatcctgatcatggtcctggtggatttc

SEQ ID NO: 183449 - DNA, 31 bp, Artificial Sequence
  Description of Artificial Sequence: Synthetic oligonucleotide
ctccatcctgatcatggtcctggtggatttc

SEQ ID NO: 183450 - DNA, 33 bp, Artificial Sequence
  Description of Artificial Sequence: Synthetic oligonucleotide
tccatcctgatcatggtcctggtggatttcttc

SEQ ID NO: 183451 - DNA, 32 bp, Artificial Sequence
  Description of Artificial Sequence: Synthetic oligonucleotide
ccatcctgatcatggtcctggtggatttcttc

SEQ ID NO: 183452 - DNA, 35 bp, Artificial Sequence
  Description of Artificial Sequence: Synthetic oligonucleotide
catcctgatcatggtcctggtggatttcttcattc

SEQ ID NO: 183453 - DNA, 36 bp, Artificial Sequence
  Description of Artificial Sequence: Synthetic oligonucleotide
atcctgatcatggtcctggtggatttcttcattcag

SEQ ID NO: 183454 - DNA, 35 bp, Artificial Sequence
  Description of Artificial Sequence: Synthetic oligonucleotide
tcctgatcatggtcctggtggatttcttcattcag

SEQ ID NO: 183455 - DNA, 34 bp, Artificial Sequence
  Description of Artificial Sequence: Synthetic oligonucleotide
cctgatcatggtcctggtggatttcttcattcag

SEQ ID NO: 183456 - DNA, 34 bp, Artificial Sequence
  Description of Artificial Sequence: Synthetic oligonucleotide
ctgatcatggtcctggtggatttcttcattcagg

SEQ ID NO: 183457 - DNA, 37 bp, Artificial Sequence
  Description of Artificial Sequence: Synthetic oligonucleotide
tgatcatggtcctggtggatttcttcattcaggatac

SEQ ID NO: 183458 - DNA, 36 bp, Artificial Sequence
  Description of Artificial Sequence: Synthetic oligonucleotide
gatcatggtcctggtggatttcttcattcaggatac

SEQ ID NO: 183459 - DNA, 36 bp, Artificial Sequence
  Description of Artificial Sequence: Synthetic oligonucleotide
atcatggtcctggtggatttcttcattcaggatacc

SEQ ID NO: 183460 - DNA, 35 bp, Artificial Sequence
  Description of Artificial Sequence: Synthetic oligonucleotide
tcatggtcctggtggatttcttcattcaggatacc

SEQ ID NO: 183461 - DNA, 34 bp, Artificial Sequence
  Description of Artificial Sequence: Synthetic oligonucleotide
catggtcctggtggatttcttcattcaggatacc

SEQ ID NO: 183462 - DNA, 36 bp, Artificial Sequence
  Description of Artificial Sequence: Synthetic oligonucleotide
atggtcctggtggatttcttcattcaggatacctac

SEQ ID NO: 183463 - DNA, 35 bp, Artificial Sequence
  Description of Artificial Sequence: Synthetic oligonucleotide
tggtcctggtggatttcttcattcaggatacctac

SEQ ID NO: 183464 - DNA, 34 bp, Artificial Sequence
  Description of Artificial Sequence: Synthetic oligonucleotide
ggtcctggtggatttcttcattcaggatacctac

SEQ ID NO: 183465 - DNA, 35 bp, Artificial Sequence
  Description of Artificial Sequence: Synthetic oligonucleotide
gtcctggtggatttcttcattcaggatacctacac

SEQ ID NO: 183466 - DNA, 35 bp, Artificial Sequence
  Description of Artificial Sequence: Synthetic oligonucleotide
tcctggtggatttcttcattcaggatacctacacc

SEQ ID NO: 183467 - DNA, 34 bp, Artificial Sequence
  Description of Artificial Sequence: Synthetic oligonucleotide
cctggtggatttcttcattcaggatacctacacc

SEQ ID NO: 183468 - DNA, 34 bp, Artificial Sequence
  Description of Artificial Sequence: Synthetic oligonucleotide
ctggtggatttcttcattcaggatacctacaccc

SEQ ID NO: 183469 - DNA, 35 bp, Artificial Sequence
  Description of Artificial Sequence: Synthetic oligonucleotide
tggtggatttcttcattcaggatacctacacccag

SEQ ID NO: 183470 - DNA, 34 bp, Artificial Sequence
  Description of Artificial Sequence: Synthetic oligonucleotide
ggtggatttcttcattcaggatacctacacccag

SEQ ID NO: 183471 - DNA, 37 bp, Artificial Sequence
  Description of Artificial Sequence: Synthetic oligonucleotide
gtggatttcttcattcaggatacctacacccagaaac

SEQ ID NO: 183472 - DNA, 38 bp, Artificial Sequence
  Description of Artificial Sequence: Synthetic oligonucleotide
tggatttcttcattcaggatacctacacccagaaactc

SEQ ID NO: 183473 - DNA, 37 bp, Artificial Sequence
  Description of Artificial Sequence: Synthetic oligonucleotide
ggatttcttcattcaggatacctacacccagaaactc

SEQ ID NO: 183474 - DNA, 38 bp, Artificial Sequence
  Description of Artificial Sequence: Synthetic oligonucleotide
gatttcttcattcaggatacctacacccagaaactctc

SEQ ID NO: 183475 - DNA, 38 bp, Artificial Sequence
  Description of Artificial Sequence: Synthetic oligonucleotide
atttcttcattcaggatacctacacccagaaactctcg

SEQ ID NO: 183476 - DNA, 37 bp, Artificial Sequence
  Description of Artificial Sequence: Synthetic oligonucleotide
tttcttcattcaggatacctacacccagaaactctcg

SEQ ID NO: 183477 - DNA, 36 bp, Artificial Sequence
  Description of Artificial Sequence: Synthetic oligonucleotide
ttcttcattcaggatacctacacccagaaactctcg

SEQ ID NO: 183478 - DNA, 35 bp, Artificial Sequence
  Description of Artificial Sequence: Synthetic oligonucleotide
tcttcattcaggatacctacacccagaaactctcg

SEQ ID NO: 183479 - DNA, 34 bp, Artificial Sequence
  Description of Artificial Sequence: Synthetic oligonucleotide
cttcattcaggatacctacacccagaaactctcg

SEQ ID NO: 183480 - DNA, 34 bp, Artificial Sequence
  Description of Artificial Sequence: Synthetic oligonucleotide
ttcattcaggatacctacacccagaaactctcgg

SEQ ID NO: 183481 - DNA, 33 bp, Artificial Sequence
  Description of Artificial Sequence: Synthetic oligonucleotide
tcattcaggatacctacacccagaaactctcgg

SEQ ID NO: 183482 - DNA, 32 bp, Artificial Sequence
  Description of Artificial Sequence: Synthetic oligonucleotide
cattcaggatacctacacccagaaactctcgg

SEQ ID NO: 183483 - DNA, 33 bp, Artificial Sequence
  Description of Artificial Sequence: Synthetic oligonucleotide
attcaggatacctacacccagaaactctcggtg

SEQ ID NO: 183484 - DNA, 32 bp, Artificial Sequence
  Description of Artificial Sequence: Synthetic oligonucleotide
ttcaggatacctacacccagaaactctcggtg

SEQ ID NO: 183485 - DNA, 31 bp, Artificial Sequence
  Description of Artificial Sequence: Synthetic oligonucleotide
tcaggatacctacacccagaaactctcggtg

SEQ ID NO: 183486 - DNA, 30 bp, Artificial Sequence
  Description of Artificial Sequence: Synthetic oligonucleotide
caggatacctacacccagaaactctcggtg

SEQ ID NO: 183487 - DNA, 30 bp, Artificial Sequence
  Description of Artificial Sequence: Synthetic oligonucleotide
aggatacctacacccagaaactctcggtgc

SEQ ID NO: 183488 - DNA, 29 bp, Artificial Sequence
  Description of Artificial Sequence: Synthetic oligonucleotide
ggatacctacacccagaaactctcggtgc

SEQ ID NO: 183489 - DNA, 29 bp, Artificial Sequence
  Description of Artificial Sequence: Synthetic oligonucleotide
gatacctacacccagaaactctcggtgcc

SEQ ID NO: 183490 - DNA, 30 bp, Artificial Sequence
  Description of Artificial Sequence: Synthetic oligonucleotide
atacctacacccagaaactctcggtgcctg

SEQ ID NO: 183491 - DNA, 29 bp, Artificial Sequence
  Description of Artificial Sequence: Synthetic oligonucleotide
tacctacacccagaaactctcggtgcctg

SEQ ID NO: 183492 - DNA, 28 bp, Artificial Sequence
  Description of Artificial Sequence: Synthetic oligonucleotide
acctacacccagaaactctcggtgcctg

SEQ ID NO: 183493 - DNA, 27 bp, Artificial Sequence
  Description of Artificial Sequence: Synthetic oligonucleotide
cctacacccagaaactctcggtgcctg

SEQ ID NO: 183494 - DNA, 29 bp, Artificial Sequence
  Description of Artificial Sequence: Synthetic oligonucleotide
ctacacccagaaactctcggtgcctgatg

SEQ ID NO: 183495 - DNA, 29 bp, Artificial Sequence
  Description of Artificial Sequence: Synthetic oligonucleotide
tacacccagaaactctcggtgcctgatgg

SEQ ID NO: 183496 - DNA, 28 bp, Artificial Sequence
  Description of Artificial Sequence: Synthetic oligonucleotide
acacccagaaactctcggtgcctgatgg

SEQ ID NO: 183497 - DNA, 27 bp, Artificial Sequence
  Description of Artificial Sequence: Synthetic oligonucleotide
cacccagaaactctcggtgcctgatgg

SEQ ID NO: 183498 - DNA, 27 bp, Artificial Sequence
  Description of Artificial Sequence: Synthetic oligonucleotide
acccagaaactctcggtgcctgatggc

SEQ ID NO: 183499 - DNA, 27 bp, Artificial Sequence
  Description of Artificial Sequence: Synthetic oligonucleotide
cccagaaactctcggtgcctgatggct

SEQ ID NO: 183500 - DNA, 28 bp, Artificial Sequence
  Description of Artificial Sequence: Synthetic oligonucleotide
ccagaaactctcggtgcctgatggcttc

SEQ ID NO: 183501 - DNA, 30 bp, Artificial Sequence
  Description of Artificial Sequence: Synthetic oligonucleotide
cagaaactctcggtgcctgatggcttcaag

SEQ ID NO: 183502 - DNA, 30 bp, Artificial Sequence
  Description of Artificial Sequence: Synthetic oligonucleotide
agaaactctcggtgcctgatggcttcaagg

SEQ ID NO: 183503 - DNA, 29 bp, Artificial Sequence
  Description of Artificial Sequence: Synthetic oligonucleotide
gaaactctcggtgcctgatggcttcaagg

SEQ ID NO: 183504 - DNA, 30 bp, Artificial Sequence
  Description of Artificial Sequence: Synthetic oligonucleotide
aaactctcggtgcctgatggcttcaaggtg

SEQ ID NO: 183505 - DNA, 29 bp, Artificial Sequence
  Description of Artificial Sequence: Synthetic oligonucleotide
aactctcggtgcctgatggcttcaaggtg

SEQ ID NO: 183506 - DNA, 28 bp, Artificial Sequence
  Description of Artificial Sequence: Synthetic oligonucleotide
actctcggtgcctgatggcttcaaggtg

SEQ ID NO: 183507 - DNA, 27 bp, Artificial Sequence
  Description of Artificial Sequence: Synthetic oligonucleotide
ctctcggtgcctgatggcttcaaggtg

SEQ ID NO: 183508 - DNA, 28 bp, Artificial Sequence
  Description of Artificial Sequence: Synthetic oligonucleotide
tctcggtgcctgatggcttcaaggtgtc

SEQ ID NO: 183509 - DNA, 27 bp, Artificial Sequence
  Description of Artificial Sequence: Synthetic oligonucleotide
ctcggtgcctgatggcttcaaggtgtc

SEQ ID NO: 183510 - DNA, 27 bp, Artificial Sequence
  Description of Artificial Sequence: Synthetic oligonucleotide
tcggtgcctgatggcttcaaggtgtcc

SEQ ID NO: 183511 - DNA, 27 bp, Artificial Sequence
  Description of Artificial Sequence: Synthetic oligonucleotide
cggtgcctgatggcttcaaggtgtcca

SEQ ID NO: 183512 - DNA, 28 bp, Artificial Sequence
  Description of Artificial Sequence: Synthetic oligonucleotide
ggtgcctgatggcttcaaggtgtccaac

SEQ ID NO: 183513 - DNA, 29 bp, Artificial Sequence
  Description of Artificial Sequence: Synthetic oligonucleotide
gtgcctgatggcttcaaggtgtccaactc

SEQ ID NO: 183514 - DNA, 29 bp, Artificial Sequence
  Description of Artificial Sequence: Synthetic oligonucleotide
tgcctgatggcttcaaggtgtccaactcc

SEQ ID NO: 183515 - DNA, 28 bp, Artificial Sequence
  Description of Artificial Sequence: Synthetic oligonucleotide
gcctgatggcttcaaggtgtccaactcc

SEQ ID NO: 183516 - DNA, 29 bp, Artificial Sequence
  Description of Artificial Sequence: Synthetic oligonucleotide
cctgatggcttcaaggtgtccaactcctc

SEQ ID NO: 183517 - DNA, 30 bp, Artificial Sequence
  Description of Artificial Sequence: Synthetic oligonucleotide
ctgatggcttcaaggtgtccaactcctcag

SEQ ID NO: 183518 - DNA, 30 bp, Artificial Sequence
  Description of Artificial Sequence: Synthetic oligonucleotide
tgatggcttcaaggtgtccaactcctcagc

SEQ ID NO: 183519 - DNA, 29 bp, Artificial Sequence
  Description of Artificial Sequence: Synthetic oligonucleotide
gatggcttcaaggtgtccaactcctcagc

SEQ ID NO: 183520 - DNA, 29 bp, Artificial Sequence
  Description of Artificial Sequence: Synthetic oligonucleotide
atggcttcaaggtgtccaactcctcagcc

SEQ ID NO: 183521 - DNA, 28 bp, Artificial Sequence
  Description of Artificial Sequence: Synthetic oligonucleotide
tggcttcaaggtgtccaactcctcagcc

SEQ ID NO: 183522 - DNA, 27 bp, Artificial Sequence
  Description of Artificial Sequence: Synthetic oligonucleotide
ggcttcaaggtgtccaactcctcagcc

SEQ ID NO: 183523 - DNA, 27 bp, Artificial Sequence
  Description of Artificial Sequence: Synthetic oligonucleotide
gcttcaaggtgtccaactcctcagccc

SEQ ID NO: 183524 - DNA, 27 bp, Artificial Sequence
  Description of Artificial Sequence: Synthetic oligonucleotide
cttcaaggtgtccaactcctcagcccg

SEQ ID NO: 183525 - DNA, 27 bp, Artificial Sequence
  Description of Artificial Sequence: Synthetic oligonucleotide
ttcaaggtgtccaactcctcagcccgg

SEQ ID NO: 183526 - DNA, 26 bp, Artificial Sequence
  Description of Artificial Sequence: Synthetic oligonucleotide
tcaaggtgtccaactcctcagcccgg

SEQ ID NO: 183527 - DNA, 25 bp, Artificial Sequence
  Description of Artificial Sequence: Synthetic oligonucleotide
caaggtgtccaactcctcagcccgg

SEQ ID NO: 183528 - DNA, 25 bp, Artificial Sequence
  Description of Artificial Sequence: Synthetic oligonucleotide
aaggtgtccaactcctcagcccggg

SEQ ID NO: 183529 - DNA, 24 bp, Artificial Sequence
  Description of Artificial Sequence: Synthetic oligonucleotide
aggtgtccaactcctcagcccggg

SEQ ID NO: 183530 - DNA, 23 bp, Artificial Sequence
  Description of Artificial Sequence: Synthetic oligonucleotide
ggtgtccaactcctcagcccggg

SEQ ID NO: 183531 - DNA, 23 bp, Artificial Sequence
  Description of Artificial Sequence: Synthetic oligonucleotide
gtgtccaactcctcagcccgggg

SEQ ID NO: 183532 - DNA, 24 bp, Artificial Sequence
  Description of Artificial Sequence: Synthetic oligonucleotide
tgtccaactcctcagcccggggct

SEQ ID NO: 183533 - DNA, 23 bp, Artificial Sequence
  Description of Artificial Sequence: Synthetic oligonucleotide
gtccaactcctcagcccggggct

SEQ ID NO: 183534 - DNA, 23 bp, Artificial Sequence
  Description of Artificial Sequence: Synthetic oligonucleotide
tccaactcctcagcccggggctg

SEQ ID NO: 183535 - DNA, 22 bp, Artificial Sequence
  Description of Artificial Sequence: Synthetic oligonucleotide
ccaactcctcagcccggggctg

SEQ ID NO: 183536 - DNA, 22 bp, Artificial Sequence
  Description of Artificial Sequence: Synthetic oligonucleotide
caactcctcagcccggggctgg

SEQ ID NO: 183537 - DNA, 23 bp, Artificial Sequence
  Description of Artificial Sequence: Synthetic oligonucleotide
aactcctcagcccggggctgggt

SEQ ID NO: 183538 - DNA, 22 bp, Artificial Sequence
  Description of Artificial Sequence: Synthetic oligonucleotide
actcctcagcccggggctgggt

SEQ ID NO: 183539 - DNA, 21 bp, Artificial Sequence
  Description of Artificial Sequence: Synthetic oligonucleotide
ctcctcagcccggggctgggt

SEQ ID NO: 183540 - DNA, 23 bp, Artificial Sequence
  Description of Artificial Sequence: Synthetic oligonucleotide
tcctcagcccggggctgggtcat

SEQ ID NO: 183541 - DNA, 22 bp, Artificial Sequence
  Description of Artificial Sequence: Synthetic oligonucleotide
cctcagcccggggctgggtcat

SEQ ID NO: 183542 - DNA, 22 bp, Artificial Sequence
  Description of Artificial Sequence: Synthetic oligonucleotide
ctcagcccggggctgggtcatc

SEQ ID NO: 183543 - DNA, 23 bp, Artificial Sequence
  Description of Artificial Sequence: Synthetic oligonucleotide
tcagcccggggctgggtcatcca

SEQ ID NO: 183544 - DNA, 22 bp, Artificial Sequence
  Description of Artificial Sequence: Synthetic oligonucleotide
cagcccggggctgggtcatcca

SEQ ID NO: 183545 - DNA, 22 bp, Artificial Sequence
  Description of Artificial Sequence: Synthetic oligonucleotide
agcccggggctgggtcatccac

SEQ ID NO: 183546 - DNA, 21 bp, Artificial Sequence
  Description of Artificial Sequence: Synthetic oligonucleotide
gcccggggctgggtcatccac

SEQ ID NO: 183547 - DNA, 21 bp, Artificial Sequence
  Description of Artificial Sequence: Synthetic oligonucleotide
cccggggctgggtcatccacc

SEQ ID NO: 183548 - DNA, 22 bp, Artificial Sequence
  Description of Artificial Sequence: Synthetic oligonucleotide
ccggggctgggtcatccaccca

SEQ ID NO: 183549 - DNA, 23 bp, Artificial Sequence
  Description of Artificial Sequence: Synthetic oligonucleotide
cggggctgggtcatccacccact

SEQ ID NO: 183550 - DNA, 23 bp, Artificial Sequence
  Description of Artificial Sequence: Synthetic oligonucleotide
ggggctgggtcatccacccactg

SEQ ID NO: 183551 - DNA, 23 bp, Artificial Sequence
  Description of Artificial Sequence: Synthetic oligonucleotide
gggctgggtcatccacccactgg

SEQ ID NO: 183552 - DNA, 23 bp, Artificial Sequence
  Description of Artificial Sequence: Synthetic oligonucleotide
ggctgggtcatccacccactggg

SEQ ID NO: 183553 - DNA, 25 bp, Artificial Sequence
  Description of Artificial Sequence: Synthetic oligonucleotide
gctgggtcatccacccactgggctt

SEQ ID NO: 183554 - DNA, 25 bp, Artificial Sequence
  Description of Artificial Sequence: Synthetic oligonucleotide
ctgggtcatccacccactgggcttg

SEQ ID NO: 183555 - DNA, 25 bp, Artificial Sequence
  Description of Artificial Sequence: Synthetic oligonucleotide
tgggtcatccacccactgggcttgc

SEQ ID NO: 183556 - DNA, 24 bp, Artificial Sequence
  Description of Artificial Sequence: Synthetic oligonucleotide
gggtcatccacccactgggcttgc

SEQ ID NO: 183557 - DNA, 26 bp, Artificial Sequence
  Description of Artificial Sequence: Synthetic oligonucleotide
ggtcatccacccactgggcttgcgtt

SEQ ID NO: 183558 - DNA, 26 bp, Artificial Sequence
  Description of Artificial Sequence: Synthetic oligonucleotide
gtcatccacccactgggcttgcgttc

SEQ ID NO: 183559 - DNA, 26 bp, Artificial Sequence
  Description of Artificial Sequence: Synthetic oligonucleotide
tcatccacccactgggcttgcgttcc

SEQ ID NO: 183560 - DNA, 25 bp, Artificial Sequence
  Description of Artificial Sequence: Synthetic oligonucleotide
catccacccactgggcttgcgttcc

SEQ ID NO: 183561 - DNA, 26 bp, Artificial Sequence
  Description of Artificial Sequence: Synthetic oligonucleotide
atccacccactgggcttgcgttccga

SEQ ID NO: 183562 - DNA, 25 bp, Artificial Sequence
  Description of Artificial Sequence: Synthetic oligonucleotide
tccacccactgggcttgcgttccga

SEQ ID NO: 183563 - DNA, 24 bp, Artificial Sequence
  Description of Artificial Sequence: Synthetic oligonucleotide
ccacccactgggcttgcgttccga

SEQ ID NO: 183564 - DNA, 27 bp, Artificial Sequence
  Description of Artificial Sequence: Synthetic oligonucleotide
cacccactgggcttgcgttccgagttt

SEQ ID NO: 183565 - DNA, 27 bp, Artificial Sequence
  Description of Artificial Sequence: Synthetic oligonucleotide
acccactgggcttgcgttccgagtttc

SEQ ID NO: 183566 - DNA, 26 bp, Artificial Sequence
  Description of Artificial Sequence: Synthetic oligonucleotide
cccactgggcttgcgttccgagtttc

SEQ ID NO: 183567 - DNA, 26 bp, Artificial Sequence
  Description of Artificial Sequence: Synthetic oligonucleotide
ccactgggcttgcgttccgagtttcc

SEQ ID NO: 183568 - DNA, 27 bp, Artificial Sequence
  Description of Artificial Sequence: Synthetic oligonucleotide
cactgggcttgcgttccgagtttccca

SEQ ID NO: 183569 - DNA, 28 bp, Artificial Sequence
  Description of Artificial Sequence: Synthetic oligonucleotide
actgggcttgcgttccgagtttcccatc

SEQ ID NO: 183570 - DNA, 27 bp, Artificial Sequence
  Description of Artificial Sequence: Synthetic oligonucleotide
ctgggcttgcgttccgagtttcccatc

SEQ ID NO: 183571 - DNA, 28 bp, Artificial Sequence
  Description of Artificial Sequence: Synthetic oligonucleotide
tgggcttgcgttccgagtttcccatctg

SEQ ID NO: 183572 - DNA, 27 bp, Artificial Sequence
  Description of Artificial Sequence: Synthetic oligonucleotide
gggcttgcgttccgagtttcccatctg

SEQ ID NO: 183573 - DNA, 27 bp, Artificial Sequence
  Description of Artificial Sequence: Synthetic oligonucleotide
ggcttgcgttccgagtttcccatctgg

SEQ ID NO: 183574 - DNA, 29 bp, Artificial Sequence
  Description of Artificial Sequence: Synthetic oligonucleotide
gcttgcgttccgagtttcccatctggatg

SEQ ID NO: 183575 - DNA, 31 bp, Artificial Sequence
  Description of Artificial Sequence: Synthetic oligonucleotide
cttgcgttccgagtttcccatctggatgatg

SEQ ID NO: 183576 - DNA, 34 bp, Artificial Sequence
  Description of Artificial Sequence: Synthetic oligonucleotide
ttgcgttccgagtttcccatctggatgatgtttg

SEQ ID NO: 183577 - DNA, 33 bp, Artificial Sequence
  Description of Artificial Sequence: Synthetic oligonucleotide
tgcgttccgagtttcccatctggatgatgtttg

SEQ ID NO: 183578 - DNA, 32 bp, Artificial Sequence
  Description of Artificial Sequence: Synthetic oligonucleotide
gcgttccgagtttcccatctggatgatgtttg

SEQ ID NO: 183579 - DNA, 32 bp, Artificial Sequence
  Description of Artificial Sequence: Synthetic oligonucleotide
cgttccgagtttcccatctggatgatgtttgc

SEQ ID NO: 183580 - DNA, 32 bp, Artificial Sequence
  Description of Artificial Sequence: Synthetic oligonucleotide
gttccgagtttcccatctggatgatgtttgcc

SEQ ID NO: 183581 - DNA, 33 bp, Artificial Sequence
  Description of Artificial Sequence: Synthetic oligonucleotide
ttccgagtttcccatctggatgatgtttgcctc

SEQ ID NO: 183582 - DNA, 32 bp, Artificial Sequence
  Description of Artificial Sequence: Synthetic oligonucleotide
tccgagtttcccatctggatgatgtttgcctc

SEQ ID NO: 183583 - DNA, 31 bp, Artificial Sequence
  Description of Artificial Sequence: Synthetic oligonucleotide
ccgagtttcccatctggatgatgtttgcctc

SEQ ID NO: 183584 - DNA, 31 bp, Artificial Sequence
  Description of Artificial Sequence: Synthetic oligonucleotide
cgagtttcccatctggatgatgtttgcctcc

SEQ ID NO: 183585 - DNA, 31 bp, Artificial Sequence
  Description of Artificial Sequence: Synthetic oligonucleotide
gagtttcccatctggatgatgtttgcctccg

SEQ ID NO: 183586 - DNA, 31 bp, Artificial Sequence
  Description of Artificial Sequence: Synthetic oligonucleotide
agtttcccatctggatgatgtttgcctccgc

SEQ ID NO: 183587 - DNA, 30 bp, Artificial Sequence
  Description of Artificial Sequence: Synthetic oligonucleotide
gtttcccatctggatgatgtttgcctccgc

SEQ ID NO: 183588 - DNA, 30 bp, Artificial Sequence
  Description of Artificial Sequence: Synthetic oligonucleotide
tttcccatctggatgatgtttgcctccgcc

SEQ ID NO: 183589 - DNA, 29 bp, Artificial Sequence
  Description of Artificial Sequence: Synthetic oligonucleotide
ttcccatctggatgatgtttgcctccgcc

SEQ ID NO: 183590 - DNA, 28 bp, Artificial Sequence
  Description of Artificial Sequence: Synthetic oligonucleotide
tcccatctggatgatgtttgcctccgcc

SEQ ID NO: 183591 - DNA, 27 bp, Artificial Sequence
  Description of Artificial Sequence: Synthetic oligonucleotide
cccatctggatgatgtttgcctccgcc

SEQ ID NO: 183592 - DNA, 27 bp, Artificial Sequence
  Description of Artificial Sequence: Synthetic oligonucleotide
ccatctggatgatgtttgcctccgccc

SEQ ID NO: 183593 - DNA, 28 bp, Artificial Sequence
  Description of Artificial Sequence: Synthetic oligonucleotide
catctggatgatgtttgcctccgccctg

SEQ ID NO: 183594 - DNA, 28 bp, Artificial Sequence
  Description of Artificial Sequence: Synthetic oligonucleotide
atctggatgatgtttgcctccgccctgc

SEQ ID NO: 183595 - DNA, 27 bp, Artificial Sequence
  Description of Artificial Sequence: Synthetic oligonucleotide
tctggatgatgtttgcctccgccctgc

SEQ ID NO: 183596 - DNA, 26 bp, Artificial Sequence
  Description of Artificial Sequence: Synthetic oligonucleotide
ctggatgatgtttgcctccgccctgc

SEQ ID NO: 183597 - DNA, 27 bp, Artificial Sequence
  Description of Artificial Sequence: Synthetic oligonucleotide
tggatgatgtttgcctccgccctgcct

SEQ ID NO: 183598 - DNA, 26 bp, Artificial Sequence
  Description of Artificial Sequence: Synthetic oligonucleotide
ggatgatgtttgcctccgccctgcct

SEQ ID NO: 183599 - DNA, 26 bp, Artificial Sequence
  Description of Artificial Sequence: Synthetic oligonucleotide
gatgatgtttgcctccgccctgcctg

SEQ ID NO: 183600 - DNA, 27 bp, Artificial Sequence
  Description of Artificial Sequence: Synthetic oligonucleotide
atgatgtttgcctccgccctgcctgct

SEQ ID NO: 183601 - DNA, 26 bp, Artificial Sequence
  Description of Artificial Sequence: Synthetic oligonucleotide
tgatgtttgcctccgccctgcctgct

SEQ ID NO: 183602 - DNA, 25 bp, Artificial Sequence
  Description of Artificial Sequence: Synthetic oligonucleotide
gatgtttgcctccgccctgcctgct

SEQ ID NO: 183603 - DNA, 26 bp, Artificial Sequence
  Description of Artificial Sequence: Synthetic oligonucleotide
atgtttgcctccgccctgcctgctct

SEQ ID NO: 183604 - DNA, 25 bp, Artificial Sequence
  Description of Artificial Sequence: Synthetic oligonucleotide
tgtttgcctccgccctgcctgctct

SEQ ID NO: 183605 - DNA, 24 bp, Artificial Sequence
  Description of Artificial Sequence: Synthetic oligonucleotide
gtttgcctccgccctgcctgctct

SEQ ID NO: 183606 - DNA, 24 bp, Artificial Sequence
  Description of Artificial Sequence: Synthetic oligonucleotide
tttgcctccgccctgcctgctctg

SEQ ID NO: 183607 - DNA, 23 bp, Artificial Sequence
  Description of Artificial Sequence: Synthetic oligonucleotide
ttgcctccgccctgcctgctctg

SEQ ID NO: 183608 - DNA, 22 bp, Artificial Sequence
  Description of Artificial Sequence: Synthetic oligonucleotide
tgcctccgccctgcctgctctg

SEQ ID NO: 183609 - DNA, 21 bp, Artificial Sequence
  Description of Artificial Sequence: Synthetic oligonucleotide
gcctccgccctgcctgctctg

SEQ ID NO: 183610 - DNA, 22 bp, Artificial Sequence
  Description of Artificial Sequence: Synthetic oligonucleotide
cctccgccctgcctgctctgct

SEQ ID NO: 183611 - DNA, 22 bp, Artificial Sequence
  Description of Artificial Sequence: Synthetic oligonucleotide
ctccgccctgcctgctctgctg

SEQ ID NO: 183612 - DNA, 23 bp, Artificial Sequence
  Description of Artificial Sequence: Synthetic oligonucleotide
tccgccctgcctgctctgctggt

SEQ ID NO: 183613 - DNA, 22 bp, Artificial Sequence
  Description of Artificial Sequence: Synthetic oligonucleotide
ccgccctgcctgctctgctggt

SEQ ID NO: 183614 - DNA, 24 bp, Artificial Sequence
  Description of Artificial Sequence: Synthetic oligonucleotide
cgccctgcctgctctgctggtctt

SEQ ID NO: 183615 - DNA, 26 bp, Artificial Sequence
  Description of Artificial Sequence: Synthetic oligonucleotide
gccctgcctgctctgctggtcttcat

SEQ ID NO: 183616 - DNA, 26 bp, Artificial Sequence
  Description of Artificial Sequence: Synthetic oligonucleotide
ccctgcctgctctgctggtcttcatc

SEQ ID NO: 183617 - DNA, 27 bp, Artificial Sequence
  Description of Artificial Sequence: Synthetic oligonucleotide
cctgcctgctctgctggtcttcatcct

SEQ ID NO: 183618 - DNA, 27 bp, Artificial Sequence
  Description of Artificial Sequence: Synthetic oligonucleotide
ctgcctgctctgctggtcttcatcctc

SEQ ID NO: 183619 - DNA, 32 bp, Artificial Sequence
  Description of Artificial Sequence: Synthetic oligonucleotide
tgcctgctctgctggtcttcatcctcatattc

SEQ ID NO: 183620 - DNA, 31 bp, Artificial Sequence
  Description of Artificial Sequence: Synthetic oligonucleotide
gcctgctctgctggtcttcatcctcatattc

SEQ ID NO: 183621 - DNA, 31 bp, Artificial Sequence
  Description of Artificial Sequence: Synthetic oligonucleotide
cctgctctgctggtcttcatcctcatattcc

SEQ ID NO: 183622 - DNA, 32 bp, Artificial Sequence
  Description of Artificial Sequence: Synthetic oligonucleotide
ctgctctgctggtcttcatcctcatattcctg

SEQ ID NO: 183623 - DNA, 32 bp, Artificial Sequence
  Description of Artificial Sequence: Synthetic oligonucleotide
tgctctgctggtcttcatcctcatattcctgg

SEQ ID NO: 183624 - DNA, 31 bp, Artificial Sequence
  Description of Artificial Sequence: Synthetic oligonucleotide
gctctgctggtcttcatcctcatattcctgg

SEQ ID NO: 183625 - DNA, 32 bp, Artificial Sequence
  Description of Artificial Sequence: Synthetic oligonucleotide
ctctgctggtcttcatcctcatattcctggag

SEQ ID NO: 183626 - DNA, 33 bp, Artificial Sequence
  Description of Artificial Sequence: Synthetic oligonucleotide
tctgctggtcttcatcctcatattcctggagtc

SEQ ID NO: 183627 - DNA, 32 bp, Artificial Sequence
  Description of Artificial Sequence: Synthetic oligonucleotide
ctgctggtcttcatcctcatattcctggagtc

SEQ ID NO: 183628 - DNA, 33 bp, Artificial Sequence
  Description of Artificial Sequence: Synthetic oligonucleotide
tgctggtcttcatcctcatattcctggagtctc

SEQ ID NO: 183629 - DNA, 32 bp, Artificial Sequence
  Description of Artificial Sequence: Synthetic oligonucleotide
gctggtcttcatcctcatattcctggagtctc

SEQ ID NO: 183630 - DNA, 33 bp, Artificial Sequence
  Description of Artificial Sequence: Synthetic oligonucleotide
ctggtcttcatcctcatattcctggagtctcag

SEQ ID NO: 183631 - DNA, 35 bp, Artificial Sequence
  Description of Artificial Sequence: Synthetic oligonucleotide
tggtcttcatcctcatattcctggagtctcagatc

SEQ ID NO: 183632 - DNA, 34 bp, Artificial Sequence
  Description of Artificial Sequence: Synthetic oligonucleotide
ggtcttcatcctcatattcctggagtctcagatc

SEQ ID NO: 183633 - DNA, 35 bp, Artificial Sequence
  Description of Artificial Sequence: Synthetic oligonucleotide
gtcttcatcctcatattcctggagtctcagatcac

SEQ ID NO: 183634 - DNA, 35 bp, Artificial Sequence
  Description of Artificial Sequence: Synthetic oligonucleotide
tcttcatcctcatattcctggagtctcagatcacc

SEQ ID NO: 183635 - DNA, 34 bp, Artificial Sequence
  Description of Artificial Sequence: Synthetic oligonucleotide
cttcatcctcatattcctggagtctcagatcacc

SEQ ID NO: 183636 - DNA, 35 bp, Artificial Sequence
  Description of Artificial Sequence: Synthetic oligonucleotide
ttcatcctcatattcctggagtctcagatcaccac

SEQ ID NO: 183637 - DNA, 34 bp, Artificial Sequence
  Description of Artificial Sequence: Synthetic oligonucleotide
tcatcctcatattcctggagtctcagatcaccac

SEQ ID NO: 183638 - DNA, 33 bp, Artificial Sequence
  Description of Artificial Sequence: Synthetic oligonucleotide
catcctcatattcctggagtctcagatcaccac

SEQ ID NO: 183639 - DNA, 33 bp, Artificial Sequence
  Description of Artificial Sequence: Synthetic oligonucleotide
atcctcatattcctggagtctcagatcaccacg

SEQ ID NO: 183640 - DNA, 32 bp, Artificial Sequence
  Description of Artificial Sequence: Synthetic oligonucleotide
tcctcatattcctggagtctcagatcaccacg

SEQ ID NO: 183641 - DNA, 31 bp, Artificial Sequence
  Description of Artificial Sequence: Synthetic oligonucleotide
cctcatattcctggagtctcagatcaccacg

SEQ ID NO: 183642 - DNA, 31 bp, Artificial Sequence
  Description of Artificial Sequence: Synthetic oligonucleotide
ctcatattcctggagtctcagatcaccacgc

SEQ ID NO: 183643 - DNA, 32 bp, Artificial Sequence
  Description of Artificial Sequence: Synthetic oligonucleotide
tcatattcctggagtctcagatcaccacgctg

SEQ ID NO: 183644 - DNA, 31 bp, Artificial Sequence
  Description of Artificial Sequence: Synthetic oligonucleotide
catattcctggagtctcagatcaccacgctg

SEQ ID NO: 183645 - DNA, 34 bp, Artificial Sequence
  Description of Artificial Sequence: Synthetic oligonucleotide
atattcctggagtctcagatcaccacgctgattg

SEQ ID NO: 183646 - DNA, 33 bp, Artificial Sequence
  Description of Artificial Sequence: Synthetic oligonucleotide
tattcctggagtctcagatcaccacgctgattg

SEQ ID NO: 183647 - DNA, 32 bp, Artificial Sequence
  Description of Artificial Sequence: Synthetic oligonucleotide
attcctggagtctcagatcaccacgctgattg

SEQ ID NO: 183648 - DNA, 31 bp, Artificial Sequence
  Description of Artificial Sequence: Synthetic oligonucleotide
ttcctggagtctcagatcaccacgctgattg

SEQ ID NO: 183649 - DNA, 30 bp, Artificial Sequence
  Description of Artificial Sequence: Synthetic oligonucleotide
tcctggagtctcagatcaccacgctgattg

SEQ ID NO: 183650 - DNA, 29 bp, Artificial Sequence
  Description of Artificial Sequence: Synthetic oligonucleotide
cctggagtctcagatcaccacgctgattg

SEQ ID NO: 183651 - DNA, 30 bp, Artificial Sequence
  Description of Artificial Sequence: Synthetic oligonucleotide
ctggagtctcagatcaccacgctgattgtc

SEQ ID NO: 183652 - DNA, 31 bp, Artificial Sequence
  Description of Artificial Sequence: Synthetic oligonucleotide
tggagtctcagatcaccacgctgattgtcag

SEQ ID NO: 183653 - DNA, 30 bp, Artificial Sequence
  Description of Artificial Sequence: Synthetic oligonucleotide
ggagtctcagatcaccacgctgattgtcag

SEQ ID NO: 183654 - DNA, 30 bp, Artificial Sequence
  Description of Artificial Sequence: Synthetic oligonucleotide
gagtctcagatcaccacgctgattgtcagc

SEQ ID NO: 183655 - DNA, 33 bp, Artificial Sequence
  Description of Artificial Sequence: Synthetic oligonucleotide
agtctcagatcaccacgctgattgtcagcaaac

SEQ ID NO: 183656 - DNA, 32 bp, Artificial Sequence
  Description of Artificial Sequence: Synthetic oligonucleotide
gtctcagatcaccacgctgattgtcagcaaac

SEQ ID NO: 183657 - DNA, 32 bp, Artificial Sequence
  Description of Artificial Sequence: Synthetic oligonucleotide
tctcagatcaccacgctgattgtcagcaaacc

SEQ ID NO: 183658 - DNA, 31 bp, Artificial Sequence
  Description of Artificial Sequence: Synthetic oligonucleotide
ctcagatcaccacgctgattgtcagcaaacc

SEQ ID NO: 183659 - DNA, 32 bp, Artificial Sequence
  Description of Artificial Sequence: Synthetic oligonucleotide
tcagatcaccacgctgattgtcagcaaacctg

SEQ ID NO: 183660 - DNA, 31 bp, Artificial Sequence
  Description of Artificial Sequence: Synthetic oligonucleotide
cagatcaccacgctgattgtcagcaaacctg

SEQ ID NO: 183661 - DNA, 32 bp, Artificial Sequence
  Description of Artificial Sequence: Synthetic oligonucleotide
agatcaccacgctgattgtcagcaaacctgag

SEQ ID NO: 183662 - DNA, 31 bp, Artificial Sequence
  Description of Artificial Sequence: Synthetic oligonucleotide
gatcaccacgctgattgtcagcaaacctgag

SEQ ID NO: 183663 - DNA, 31 bp, Artificial Sequence
  Description of Artificial Sequence: Synthetic oligonucleotide
atcaccacgctgattgtcagcaaacctgagc

SEQ ID NO: 183664 - DNA, 30 bp, Artificial Sequence
  Description of Artificial Sequence: Synthetic oligonucleotide
tcaccacgctgattgtcagcaaacctgagc

SEQ ID NO: 183665 - DNA, 29 bp, Artificial Sequence
  Description of Artificial Sequence: Synthetic oligonucleotide
caccacgctgattgtcagcaaacctgagc

SEQ ID NO: 183666 - DNA, 29 bp, Artificial Sequence
  Description of Artificial Sequence: Synthetic oligonucleotide
accacgctgattgtcagcaaacctgagcg

SEQ ID NO: 183667 - DNA, 28 bp, Artificial Sequence
  Description of Artificial Sequence: Synthetic oligonucleotide
ccacgctgattgtcagcaaacctgagcg

SEQ ID NO: 183668 - DNA, 28 bp, Artificial Sequence
  Description of Artificial Sequence: Synthetic oligonucleotide
cacgctgattgtcagcaaacctgagcgc

SEQ ID NO: 183669 - DNA, 30 bp, Artificial Sequence
  Description of Artificial Sequence: Synthetic oligonucleotide
acgctgattgtcagcaaacctgagcgcaag

SEQ ID NO: 183670 - DNA, 29 bp, Artificial Sequence
  Description of Artificial Sequence: Synthetic oligonucleotide
cgctgattgtcagcaaacctgagcgcaag

SEQ ID NO: 183671 - DNA, 31 bp, Artificial Sequence
  Description of Artificial Sequence: Synthetic oligonucleotide
gctgattgtcagcaaacctgagcgcaagatg

SEQ ID NO: 183672 - DNA, 31 bp, Artificial Sequence
  Description of Artificial Sequence: Synthetic oligonucleotide
ctgattgtcagcaaacctgagcgcaagatgg

SEQ ID NO: 183673 - DNA, 32 bp, Artificial Sequence
  Description of Artificial Sequence: Synthetic oligonucleotide
tgattgtcagcaaacctgagcgcaagatggtc

SEQ ID NO: 183674 - DNA, 31 bp, Artificial Sequence
  Description of Artificial Sequence: Synthetic oligonucleotide
gattgtcagcaaacctgagcgcaagatggtc

SEQ ID NO: 183675 - DNA, 33 bp, Artificial Sequence
  Description of Artificial Sequence: Synthetic oligonucleotide
attgtcagcaaacctgagcgcaagatggtcaag

SEQ ID NO: 183676 - DNA, 32 bp, Artificial Sequence
  Description of Artificial Sequence: Synthetic oligonucleotide
ttgtcagcaaacctgagcgcaagatggtcaag

SEQ ID NO: 183677 - DNA, 31 bp, Artificial Sequence
  Description of Artificial Sequence: Synthetic oligonucleotide
tgtcagcaaacctgagcgcaagatggtcaag

SEQ ID NO: 183678 - DNA, 30 bp, Artificial Sequence
  Description of Artificial Sequence: Synthetic oligonucleotide
gtcagcaaacctgagcgcaagatggtcaag

SEQ ID NO: 183679 - DNA, 30 bp, Artificial Sequence
  Description of Artificial Sequence: Synthetic oligonucleotide
tcagcaaacctgagcgcaagatggtcaagg

SEQ ID NO: 183680 - DNA, 29 bp, Artificial Sequence
  Description of Artificial Sequence: Synthetic oligonucleotide
cagcaaacctgagcgcaagatggtcaagg

SEQ ID NO: 183681 - DNA, 29 bp, Artificial Sequence
  Description of Artificial Sequence: Synthetic oligonucleotide
agcaaacctgagcgcaagatggtcaaggg

SEQ ID NO: 183682 - DNA, 28 bp, Artificial Sequence
  Description of Artificial Sequence: Synthetic oligonucleotide
gcaaacctgagcgcaagatggtcaaggg

SEQ ID NO: 183683 - DNA, 28 bp, Artificial Sequence
  Description of Artificial Sequence: Synthetic oligonucleotide
caaacctgagcgcaagatggtcaagggc

SEQ ID NO: 183684 - DNA, 29 bp, Artificial Sequence
  Description of Artificial Sequence: Synthetic oligonucleotide
aaacctgagcgcaagatggtcaagggctc

SEQ ID NO: 183685 - DNA, 28 bp, Artificial Sequence
  Description of Artificial Sequence: Synthetic oligonucleotide
aacctgagcgcaagatggtcaagggctc

SEQ ID NO: 183686 - DNA, 27 bp, Artificial Sequence
  Description of Artificial Sequence: Synthetic oligonucleotide
acctgagcgcaagatggtcaagggctc

SEQ ID NO: 183687 - DNA, 26 bp, Artificial Sequence
  Description of Artificial Sequence: Synthetic oligonucleotide
cctgagcgcaagatggtcaagggctc

SEQ ID NO: 183688 - DNA, 26 bp, Artificial Sequence
  Description of Artificial Sequence: Synthetic oligonucleotide
ctgagcgcaagatggtcaagggctcc

SEQ ID NO: 183689 - DNA, 26 bp, Artificial Sequence
  Description of Artificial Sequence: Synthetic oligonucleotide
tgagcgcaagatggtcaagggctccg

SEQ ID NO: 183690 - DNA, 25 bp, Artificial Sequence
  Description of Artificial Sequence: Synthetic oligonucleotide
gagcgcaagatggtcaagggctccg

SEQ ID NO: 183691 - DNA, 25 bp, Artificial Sequence
  Description of Artificial Sequence: Synthetic oligonucleotide
agcgcaagatggtcaagggctccgg

SEQ ID NO: 183692 - DNA, 24 bp, Artificial Sequence
  Description of Artificial Sequence: Synthetic oligonucleotide
gcgcaagatggtcaagggctccgg

SEQ ID NO: 183693 - DNA, 26 bp, Artificial Sequence
  Description of Artificial Sequence: Synthetic oligonucleotide
cgcaagatggtcaagggctccggctt

SEQ ID NO: 183694 - DNA, 26 bp, Artificial Sequence
  Description of Artificial Sequence: Synthetic oligonucleotide
gcaagatggtcaagggctccggcttc

SEQ ID NO: 183695 - DNA, 27 bp, Artificial Sequence
  Description of Artificial Sequence: Synthetic oligonucleotide
caagatggtcaagggctccggcttcca

SEQ ID NO: 183696 - DNA, 27 bp, Artificial Sequence
  Description of Artificial Sequence: Synthetic oligonucleotide
aagatggtcaagggctccggcttccac

SEQ ID NO: 183697 - DNA, 26 bp, Artificial Sequence
  Description of Artificial Sequence: Synthetic oligonucleotide
agatggtcaagggctccggcttccac

SEQ ID NO: 183698 - DNA, 25 bp, Artificial Sequence
  Description of Artificial Sequence: Synthetic oligonucleotide
gatggtcaagggctccggcttccac

SEQ ID NO: 183699 - DNA, 26 bp, Artificial Sequence
  Description of Artificial Sequence: Synthetic oligonucleotide
atggtcaagggctccggcttccacct

SEQ ID NO: 183700 - DNA, 25 bp, Artificial Sequence
  Description of Artificial Sequence: Synthetic oligonucleotide
tggtcaagggctccggcttccacct

SEQ ID NO: 183701 - DNA, 24 bp, Artificial Sequence
  Description of Artificial Sequence: Synthetic oligonucleotide
ggtcaagggctccggcttccacct

SEQ ID NO: 183702 - DNA, 24 bp, Artificial Sequence
  Description of Artificial Sequence: Synthetic oligonucleotide
gtcaagggctccggcttccacctg

SEQ ID NO: 183703 - DNA, 25 bp, Artificial Sequence
  Description of Artificial Sequence: Synthetic oligonucleotide
tcaagggctccggcttccacctgga

SEQ ID NO: 183704 - DNA, 24 bp, Artificial Sequence
  Description of Artificial Sequence: Synthetic oligonucleotide
caagggctccggcttccacctgga

SEQ ID NO: 183705 - DNA, 24 bp, Artificial Sequence
  Description of Artificial Sequence: Synthetic oligonucleotide
aagggctccggcttccacctggac

SEQ ID NO: 183706 - DNA, 23 bp, Artificial Sequence
  Description of Artificial Sequence: Synthetic oligonucleotide
agggctccggcttccacctggac

SEQ ID NO: 183707 - DNA, 22 bp, Artificial Sequence
  Description of Artificial Sequence: Synthetic oligonucleotide
gggctccggcttccacctggac

SEQ ID NO: 183708 - DNA, 23 bp, Artificial Sequence
  Description of Artificial Sequence: Synthetic oligonucleotide
ggctccggcttccacctggacct

SEQ ID NO: 183709 - DNA, 23 bp, Artificial Sequence
  Description of Artificial Sequence: Synthetic oligonucleotide
gctccggcttccacctggacctg

SEQ ID NO: 183710 - DNA, 24 bp, Artificial Sequence
  Description of Artificial Sequence: Synthetic oligonucleotide
ctccggcttccacctggacctgct

SEQ ID NO: 183711 - DNA, 24 bp, Artificial Sequence
  Description of Artificial Sequence: Synthetic oligonucleotide
tccggcttccacctggacctgctg

SEQ ID NO: 183712 - DNA, 23 bp, Artificial Sequence
  Description of Artificial Sequence: Synthetic oligonucleotide
ccggcttccacctggacctgctg

SEQ ID NO: 183713 - DNA, 24 bp, Artificial Sequence
  Description of Artificial Sequence: Synthetic oligonucleotide
cggcttccacctggacctgctgct

SEQ ID NO: 183714 - DNA, 24 bp, Artificial Sequence
  Description of Artificial Sequence: Synthetic oligonucleotide
ggcttccacctggacctgctgctg

SEQ ID NO: 183715 - DNA, 26 bp, Artificial Sequence
  Description of Artificial Sequence: Synthetic oligonucleotide
gcttccacctggacctgctgctggta

SEQ ID NO: 183716 - DNA, 27 bp, Artificial Sequence
  Description of Artificial Sequence: Synthetic oligonucleotide
cttccacctggacctgctgctggtagt

SEQ ID NO: 183717 - DNA, 28 bp, Artificial Sequence
  Description of Artificial Sequence: Synthetic oligonucleotide
ttccacctggacctgctgctggtagtag

SEQ ID NO: 183718 - DNA, 27 bp, Artificial Sequence
  Description of Artificial Sequence: Synthetic oligonucleotide
tccacctggacctgctgctggtagtag

SEQ ID NO: 183719 - DNA, 26 bp, Artificial Sequence
  Description of Artificial Sequence: Synthetic oligonucleotide
ccacctggacctgctgctggtagtag

SEQ ID NO: 183720 - DNA, 26 bp, Artificial Sequence
  Description of Artificial Sequence: Synthetic oligonucleotide
cacctggacctgctgctggtagtagg

SEQ ID NO: 183721 - DNA, 27 bp, Artificial Sequence
  Description of Artificial Sequence: Synthetic oligonucleotide
acctggacctgctgctggtagtaggca

SEQ ID NO: 183722 - DNA, 27 bp, Artificial Sequence
  Description of Artificial Sequence: Synthetic oligonucleotide
cctggacctgctgctggtagtaggcat

SEQ ID NO: 183723 - DNA, 27 bp, Artificial Sequence
  Description of Artificial Sequence: Synthetic oligonucleotide
ctggacctgctgctggtagtaggcatg

SEQ ID NO: 183724 - DNA, 27 bp, Artificial Sequence
  Description of Artificial Sequence: Synthetic oligonucleotide
tggacctgctgctggtagtaggcatgg

SEQ ID NO: 183725 - DNA, 26 bp, Artificial Sequence
  Description of Artificial Sequence: Synthetic oligonucleotide
ggacctgctgctggtagtaggcatgg

SEQ ID NO: 183726 - DNA, 27 bp, Artificial Sequence
  Description of Artificial Sequence: Synthetic oligonucleotide
gacctgctgctggtagtaggcatgggt

SEQ ID NO: 183727 - DNA, 27 bp, Artificial Sequence
  Description of Artificial Sequence: Synthetic oligonucleotide
acctgctgctggtagtaggcatgggtg

SEQ ID NO: 183728 - DNA, 26 bp, Artificial Sequence
  Description of Artificial Sequence: Synthetic oligonucleotide
cctgctgctggtagtaggcatgggtg

SEQ ID NO: 183729 - DNA, 26 bp, Artificial Sequence
  Description of Artificial Sequence: Synthetic oligonucleotide
ctgctgctggtagtaggcatgggtgg

SEQ ID NO: 183730 - DNA, 26 bp, Artificial Sequence
  Description of Artificial Sequence: Synthetic oligonucleotide
tgctgctggtagtaggcatgggtggg

SEQ ID NO: 183731 - DNA, 25 bp, Artificial Sequence
  Description of Artificial Sequence: Synthetic oligonucleotide
gctgctggtagtaggcatgggtggg

SEQ ID NO: 183732 - DNA, 26 bp, Artificial Sequence
  Description of Artificial Sequence: Synthetic oligonucleotide
ctgctggtagtaggcatgggtggggt

SEQ ID NO: 183733 - DNA, 26 bp, Artificial Sequence
  Description of Artificial Sequence: Synthetic oligonucleotide
tgctggtagtaggcatgggtggggtg

SEQ ID NO: 183734 - DNA, 25 bp, Artificial Sequence
  Description of Artificial Sequence: Synthetic oligonucleotide
gctggtagtaggcatgggtggggtg

SEQ ID NO: 183735 - DNA, 25 bp, Artificial Sequence
  Description of Artificial Sequence: Synthetic oligonucleotide
ctggtagtaggcatgggtggggtgg

SEQ ID NO: 183736 - DNA, 25 bp, Artificial Sequence
  Description of Artificial Sequence: Synthetic oligonucleotide
tggtagtaggcatgggtggggtggc

SEQ ID NO: 183737 - DNA, 24 bp, Artificial Sequence
  Description of Artificial Sequence: Synthetic oligonucleotide
ggtagtaggcatgggtggggtggc

SEQ ID NO: 183738 - DNA, 24 bp, Artificial Sequence
  Description of Artificial Sequence: Synthetic oligonucleotide
gtagtaggcatgggtggggtggcc

SEQ ID NO: 183739 - DNA, 24 bp, Artificial Sequence
  Description of Artificial Sequence: Synthetic oligonucleotide
tagtaggcatgggtggggtggccg

SEQ ID NO: 183740 - DNA, 23 bp, Artificial Sequence
  Description of Artificial Sequence: Synthetic oligonucleotide
agtaggcatgggtggggtggccg

SEQ ID NO: 183741 - DNA, 22 bp, Artificial Sequence
  Description of Artificial Sequence: Synthetic oligonucleotide
gtaggcatgggtggggtggccg

SEQ ID NO: 183742 - DNA, 22 bp, Artificial Sequence
  Description of Artificial Sequence: Synthetic oligonucleotide
taggcatgggtggggtggccgc

SEQ ID NO: 183743 - DNA, 21 bp, Artificial Sequence
  Description of Artificial Sequence: Synthetic oligonucleotide
aggcatgggtggggtggccgc

SEQ ID NO: 183744 - DNA, 20 bp, Artificial Sequence
  Description of Artificial Sequence: Synthetic oligonucleotide
ggcatgggtggggtggccgc

SEQ ID NO: 183745 - DNA, 20 bp, Artificial Sequence
  Description of Artificial Sequence: Synthetic oligonucleotide
gcatgggtggggtggccgcc

SEQ ID NO: 183746 - DNA, 21 bp, Artificial Sequence
  Description of Artificial Sequence: Synthetic oligonucleotide
catgggtggggtggccgccct

SEQ ID NO: 183747 - DNA, 24 bp, Artificial Sequence
  Description of Artificial Sequence: Synthetic oligonucleotide
atgggtggggtggccgccctcttt

SEQ ID NO: 183748 - DNA, 23 bp, Artificial Sequence
  Description of Artificial Sequence: Synthetic oligonucleotide
tgggtggggtggccgccctcttt

SEQ ID NO: 183749 - DNA, 22 bp, Artificial Sequence
  Description of Artificial Sequence: Synthetic oligonucleotide
gggtggggtggccgccctcttt

SEQ ID NO: 183750 - DNA, 22 bp, Artificial Sequence
  Description of Artificial Sequence: Synthetic oligonucleotide
ggtggggtggccgccctctttg

SEQ ID NO: 183751 - DNA, 22 bp, Artificial Sequence
  Description of Artificial Sequence: Synthetic oligonucleotide
gtggggtggccgccctctttgg

SEQ ID NO: 183752 - DNA, 24 bp, Artificial Sequence
  Description of Artificial Sequence: Synthetic oligonucleotide
tggggtggccgccctctttgggat

SEQ ID NO: 183753 - DNA, 23 bp, Artificial Sequence
  Description of Artificial Sequence: Synthetic oligonucleotide
ggggtggccgccctctttgggat

SEQ ID NO: 183754 - DNA, 23 bp, Artificial Sequence
  Description of Artificial Sequence: Synthetic oligonucleotide
gggtggccgccctctttgggatg

SEQ ID NO: 183755 - DNA, 23 bp, Artificial Sequence
  Description of Artificial Sequence: Synthetic oligonucleotide
ggtggccgccctctttgggatgc

SEQ ID NO: 183756 - DNA, 23 bp, Artificial Sequence
  Description of Artificial Sequence: Synthetic oligonucleotide
gtggccgccctctttgggatgcc

SEQ ID NO: 183757 - DNA, 24 bp, Artificial Sequence
  Description of Artificial Sequence: Synthetic oligonucleotide
tggccgccctctttgggatgccct

SEQ ID NO: 183758 - DNA, 23 bp, Artificial Sequence
  Description of Artificial Sequence: Synthetic oligonucleotide
ggccgccctctttgggatgccct

SEQ ID NO: 183759 - DNA, 23 bp, Artificial Sequence
  Description of Artificial Sequence: Synthetic oligonucleotide
gccgccctctttgggatgccctg

SEQ ID NO: 183760 - DNA, 23 bp, Artificial Sequence
  Description of Artificial Sequence: Synthetic oligonucleotide
ccgccctctttgggatgccctgg

SEQ ID NO: 183761 - DNA, 24 bp, Artificial Sequence
  Description of Artificial Sequence: Synthetic oligonucleotide
cgccctctttgggatgccctggct

SEQ ID NO: 183762 - DNA, 25 bp, Artificial Sequence
  Description of Artificial Sequence: Synthetic oligonucleotide
gccctctttgggatgccctggctca

SEQ ID NO: 183763 - DNA, 26 bp, Artificial Sequence
  Description of Artificial Sequence: Synthetic oligonucleotide
ccctctttgggatgccctggctcagt

SEQ ID NO: 183764 - DNA, 26 bp, Artificial Sequence
  Description of Artificial Sequence: Synthetic oligonucleotide
cctctttgggatgccctggctcagtg

SEQ ID NO: 183765 - DNA, 26 bp, Artificial Sequence
  Description of Artificial Sequence: Synthetic oligonucleotide
ctctttgggatgccctggctcagtgc

SEQ ID NO: 183766 - DNA, 27 bp, Artificial Sequence
  Description of Artificial Sequence: Synthetic oligonucleotide
tctttgggatgccctggctcagtgcca

SEQ ID NO: 183767 - DNA, 26 bp, Artificial Sequence
  Description of Artificial Sequence: Synthetic oligonucleotide
ctttgggatgccctggctcagtgcca

SEQ ID NO: 183768 - DNA, 26 bp, Artificial Sequence
  Description of Artificial Sequence: Synthetic oligonucleotide
tttgggatgccctggctcagtgccac

SEQ ID NO: 183769 - DNA, 25 bp, Artificial Sequence
  Description of Artificial Sequence: Synthetic oligonucleotide
ttgggatgccctggctcagtgccac

SEQ ID NO: 183770 - DNA, 24 bp, Artificial Sequence
  Description of Artificial Sequence: Synthetic oligonucleotide
tgggatgccctggctcagtgccac

SEQ ID NO: 183771 - DNA, 23 bp, Artificial Sequence
  Description of Artificial Sequence: Synthetic oligonucleotide
gggatgccctggctcagtgccac

SEQ ID NO: 183772 - DNA, 24 bp, Artificial Sequence
  Description of Artificial Sequence: Synthetic oligonucleotide
ggatgccctggctcagtgccacca

SEQ ID NO: 183773 - DNA, 24 bp, Artificial Sequence
  Description of Artificial Sequence: Synthetic oligonucleotide
gatgccctggctcagtgccaccac

SEQ ID NO: 183774 - DNA, 24 bp, Artificial Sequence
  Description of Artificial Sequence: Synthetic oligonucleotide
atgccctggctcagtgccaccacc

SEQ ID NO: 183775 - DNA, 23 bp, Artificial Sequence
  Description of Artificial Sequence: Synthetic oligonucleotide
tgccctggctcagtgccaccacc

SEQ ID NO: 183776 - DNA, 22 bp, Artificial Sequence
  Description of Artificial Sequence: Synthetic oligonucleotide
gccctggctcagtgccaccacc

SEQ ID NO: 183777 - DNA, 23 bp, Artificial Sequence
  Description of Artificial Sequence: Synthetic oligonucleotide
ccctggctcagtgccaccaccgt

SEQ ID NO: 183778 - DNA, 23 bp, Artificial Sequence
  Description of Artificial Sequence: Synthetic oligonucleotide
cctggctcagtgccaccaccgtg

SEQ ID NO: 183779 - DNA, 23 bp, Artificial Sequence
  Description of Artificial Sequence: Synthetic oligonucleotide
ctggctcagtgccaccaccgtgc

SEQ ID NO: 183780 - DNA, 25 bp, Artificial Sequence
  Description of Artificial Sequence: Synthetic oligonucleotide
tggctcagtgccaccaccgtgcgtt

SEQ ID NO: 183781 - DNA, 24 bp, Artificial Sequence
  Description of Artificial Sequence: Synthetic oligonucleotide
ggctcagtgccaccaccgtgcgtt

SEQ ID NO: 183782 - DNA, 24 bp, Artificial Sequence
  Description of Artificial Sequence: Synthetic oligonucleotide
gctcagtgccaccaccgtgcgttc

SEQ ID NO: 183783 - DNA, 24 bp, Artificial Sequence
  Description of Artificial Sequence: Synthetic oligonucleotide
ctcagtgccaccaccgtgcgttcc

SEQ ID NO: 183784 - DNA, 25 bp, Artificial Sequence
  Description of Artificial Sequence: Synthetic oligonucleotide
tcagtgccaccaccgtgcgttccgt

SEQ ID NO: 183785 - DNA, 24 bp, Artificial Sequence
  Description of Artificial Sequence: Synthetic oligonucleotide
cagtgccaccaccgtgcgttccgt

SEQ ID NO: 183786 - DNA, 25 bp, Artificial Sequence
  Description of Artificial Sequence: Synthetic oligonucleotide
agtgccaccaccgtgcgttccgtca

SEQ ID NO: 183787 - DNA, 24 bp, Artificial Sequence
  Description of Artificial Sequence: Synthetic oligonucleotide
gtgccaccaccgtgcgttccgtca

SEQ ID NO: 183788 - DNA, 24 bp, Artificial Sequence
  Description of Artificial Sequence: Synthetic oligonucleotide
tgccaccaccgtgcgttccgtcac

SEQ ID NO: 183789 - DNA, 23 bp, Artificial Sequence
  Description of Artificial Sequence: Synthetic oligonucleotide
gccaccaccgtgcgttccgtcac

SEQ ID NO: 183790 - DNA, 23 bp, Artificial Sequence
  Description of Artificial Sequence: Synthetic oligonucleotide
ccaccaccgtgcgttccgtcacc

SEQ ID NO: 183791 - DNA, 25 bp, Artificial Sequence
  Description of Artificial Sequence: Synthetic oligonucleotide
caccaccgtgcgttccgtcacccat

SEQ ID NO: 183792 - DNA, 25 bp, Artificial Sequence
  Description of Artificial Sequence: Synthetic oligonucleotide
accaccgtgcgttccgtcacccatg

SEQ ID NO: 183793 - DNA, 24 bp, Artificial Sequence
  Description of Artificial Sequence: Synthetic oligonucleotide
ccaccgtgcgttccgtcacccatg

SEQ ID NO: 183794 - DNA, 24 bp, Artificial Sequence
  Description of Artificial Sequence: Synthetic oligonucleotide
caccgtgcgttccgtcacccatgc

SEQ ID NO: 183795 - DNA, 26 bp, Artificial Sequence
  Description of Artificial Sequence: Synthetic oligonucleotide
accgtgcgttccgtcacccatgccaa

SEQ ID NO: 183796 - DNA, 25 bp, Artificial Sequence
  Description of Artificial Sequence: Synthetic oligonucleotide
ccgtgcgttccgtcacccatgccaa

SEQ ID NO: 183797 - DNA, 25 bp, Artificial Sequence
  Description of Artificial Sequence: Synthetic oligonucleotide
cgtgcgttccgtcacccatgccaac

SEQ ID NO: 183798 - DNA, 25 bp, Artificial Sequence
  Description of Artificial Sequence: Synthetic oligonucleotide
gtgcgttccgtcacccatgccaacg

SEQ ID NO: 183799 - DNA, 25 bp, Artificial Sequence
  Description of Artificial Sequence: Synthetic oligonucleotide
tgcgttccgtcacccatgccaacgc

SEQ ID NO: 183800 - DNA, 24 bp, Artificial Sequence
  Description of Artificial Sequence: Synthetic oligonucleotide
gcgttccgtcacccatgccaacgc

SEQ ID NO: 183801 - DNA, 24 bp, Artificial Sequence
  Description of Artificial Sequence: Synthetic oligonucleotide
cgttccgtcacccatgccaacgcc

SEQ ID NO: 183802 - DNA, 25 bp, Artificial Sequence
  Description of Artificial Sequence: Synthetic oligonucleotide
gttccgtcacccatgccaacgccct

SEQ ID NO: 183803 - DNA, 26 bp, Artificial Sequence
  Description of Artificial Sequence: Synthetic oligonucleotide
ttccgtcacccatgccaacgccctca

SEQ ID NO: 183804 - DNA, 25 bp, Artificial Sequence
  Description of Artificial Sequence: Synthetic oligonucleotide
tccgtcacccatgccaacgccctca

SEQ ID NO: 183805 - DNA, 24 bp, Artificial Sequence
  Description of Artificial Sequence: Synthetic oligonucleotide
ccgtcacccatgccaacgccctca

SEQ ID NO: 183806 - DNA, 25 bp, Artificial Sequence
  Description of Artificial Sequence: Synthetic oligonucleotide
cgtcacccatgccaacgccctcact

SEQ ID NO: 183807 - DNA, 26 bp, Artificial Sequence
  Description of Artificial Sequence: Synthetic oligonucleotide
gtcacccatgccaacgccctcactgt

SEQ ID NO: 183808 - DNA, 27 bp, Artificial Sequence
  Description of Artificial Sequence: Synthetic oligonucleotide
tcacccatgccaacgccctcactgtca

SEQ ID NO: 183809 - DNA, 27 bp, Artificial Sequence
  Description of Artificial Sequence: Synthetic oligonucleotide
cacccatgccaacgccctcactgtcat

SEQ ID NO: 183810 - DNA, 27 bp, Artificial Sequence
  Description of Artificial Sequence: Synthetic oligonucleotide
acccatgccaacgccctcactgtcatg

SEQ ID NO: 183811 - DNA, 26 bp, Artificial Sequence
  Description of Artificial Sequence: Synthetic oligonucleotide
cccatgccaacgccctcactgtcatg

SEQ ID NO: 183812 - DNA, 26 bp, Artificial Sequence
  Description of Artificial Sequence: Synthetic oligonucleotide
ccatgccaacgccctcactgtcatgg

SEQ ID NO: 183813 - DNA, 26 bp, Artificial Sequence
  Description of Artificial Sequence: Synthetic oligonucleotide
catgccaacgccctcactgtcatggg

SEQ ID NO: 183814 - DNA, 27 bp, Artificial Sequence
  Description of Artificial Sequence: Synthetic oligonucleotide
atgccaacgccctcactgtcatgggca

SEQ ID NO: 183815 - DNA, 27 bp, Artificial Sequence
  Description of Artificial Sequence: Synthetic oligonucleotide
tgccaacgccctcactgtcatgggcaa

SEQ ID NO: 183816 - DNA, 27 bp, Artificial Sequence
  Description of Artificial Sequence: Synthetic oligonucleotide
gccaacgccctcactgtcatgggcaaa

SEQ ID NO: 183817 - DNA, 27 bp, Artificial Sequence
  Description of Artificial Sequence: Synthetic oligonucleotide
ccaacgccctcactgtcatgggcaaag

SEQ ID NO: 183818 - DNA, 27 bp, Artificial Sequence
  Description of Artificial Sequence: Synthetic oligonucleotide
caacgccctcactgtcatgggcaaagc

SEQ ID NO: 183819 - DNA, 27 bp, Artificial Sequence
  Description of Artificial Sequence: Synthetic oligonucleotide
aacgccctcactgtcatgggcaaagcc

SEQ ID NO: 183820 - DNA, 27 bp, Artificial Sequence
  Description of Artificial Sequence: Synthetic oligonucleotide
acgccctcactgtcatgggcaaagcca

SEQ ID NO: 183821 - DNA, 26 bp, Artificial Sequence
  Description of Artificial Sequence: Synthetic oligonucleotide
cgccctcactgtcatgggcaaagcca

SEQ ID NO: 183822 - DNA, 26 bp, Artificial Sequence
  Description of Artificial Sequence: Synthetic oligonucleotide
gccctcactgtcatgggcaaagccag

SEQ ID NO: 183823 - DNA, 27 bp, Artificial Sequence
  Description of Artificial Sequence: Synthetic oligonucleotide
ccctcactgtcatgggcaaagccagca

SEQ ID NO: 183824 - DNA, 27 bp, Artificial Sequence
  Description of Artificial Sequence: Synthetic oligonucleotide
cctcactgtcatgggcaaagccagcac

SEQ ID NO: 183825 - DNA, 27 bp, Artificial Sequence
  Description of Artificial Sequence: Synthetic oligonucleotide
ctcactgtcatgggcaaagccagcacc

SEQ ID NO: 183826 - DNA, 27 bp, Artificial Sequence
  Description of Artificial Sequence: Synthetic oligonucleotide
tcactgtcatgggcaaagccagcaccc

SEQ ID NO: 183827 - DNA, 26 bp, Artificial Sequence
  Description of Artificial Sequence: Synthetic oligonucleotide
cactgtcatgggcaaagccagcaccc

SEQ ID NO: 183828 - DNA, 27 bp, Artificial Sequence
  Description of Artificial Sequence: Synthetic oligonucleotide
actgtcatgggcaaagccagcacccca

SEQ ID NO: 183829 - DNA, 26 bp, Artificial Sequence
  Description of Artificial Sequence: Synthetic oligonucleotide
ctgtcatgggcaaagccagcacccca

SEQ ID NO: 183830 - DNA, 26 bp, Artificial Sequence
  Description of Artificial Sequence: Synthetic oligonucleotide
tgtcatgggcaaagccagcaccccag

SEQ ID NO: 183831 - DNA, 25 bp, Artificial Sequence
  Description of Artificial Sequence: Synthetic oligonucleotide
gtcatgggcaaagccagcaccccag

SEQ ID NO: 183832 - DNA, 25 bp, Artificial Sequence
  Description of Artificial Sequence: Synthetic oligonucleotide
tcatgggcaaagccagcaccccagg

SEQ ID NO: 183833 - DNA, 24 bp, Artificial Sequence
  Description of Artificial Sequence: Synthetic oligonucleotide
catgggcaaagccagcaccccagg

SEQ ID NO: 183834 - DNA, 24 bp, Artificial Sequence
  Description of Artificial Sequence: Synthetic oligonucleotide
atgggcaaagccagcaccccaggg

SEQ ID NO: 183835 - DNA, 23 bp, Artificial Sequence
  Description of Artificial Sequence: Synthetic oligonucleotide
tgggcaaagccagcaccccaggg

SEQ ID NO: 183836 - DNA, 22 bp, Artificial Sequence
  Description of Artificial Sequence: Synthetic oligonucleotide
gggcaaagccagcaccccaggg

SEQ ID NO: 183837 - DNA, 22 bp, Artificial Sequence
  Description of Artificial Sequence: Synthetic oligonucleotide
ggcaaagccagcaccccagggg

SEQ ID NO: 183838 - DNA, 23 bp, Artificial Sequence
  Description of Artificial Sequence: Synthetic oligonucleotide
gcaaagccagcaccccaggggct

SEQ ID NO: 183839 - DNA, 23 bp, Artificial Sequence
  Description of Artificial Sequence: Synthetic oligonucleotide
caaagccagcaccccaggggctg

SEQ ID NO: 183840 - DNA, 24 bp, Artificial Sequence
  Description of Artificial Sequence: Synthetic oligonucleotide
aaagccagcaccccaggggctgca

SEQ ID NO: 183841 - DNA, 23 bp, Artificial Sequence
  Description of Artificial Sequence: Synthetic oligonucleotide
aagccagcaccccaggggctgca

SEQ ID NO: 183842 - DNA, 22 bp, Artificial Sequence
  Description of Artificial Sequence: Synthetic oligonucleotide
agccagcaccccaggggctgca

SEQ ID NO: 183843 - DNA, 21 bp, Artificial Sequence
  Description of Artificial Sequence: Synthetic oligonucleotide
gccagcaccccaggggctgca

SEQ ID NO: 183844 - DNA, 21 bp, Artificial Sequence
  Description of Artificial Sequence: Synthetic oligonucleotide
ccagcaccccaggggctgcag

SEQ ID NO: 183845 - DNA, 21 bp, Artificial Sequence
  Description of Artificial Sequence: Synthetic oligonucleotide
cagcaccccaggggctgcagc

SEQ ID NO: 183846 - DNA, 21 bp, Artificial Sequence
  Description of Artificial Sequence: Synthetic oligonucleotide
agcaccccaggggctgcagcc

SEQ ID NO: 183847 - DNA, 20 bp, Artificial Sequence
  Description of Artificial Sequence: Synthetic oligonucleotide
gcaccccaggggctgcagcc

SEQ ID NO: 183848 - DNA, 21 bp, Artificial Sequence
  Description of Artificial Sequence: Synthetic oligonucleotide
caccccaggggctgcagccca

SEQ ID NO: 183849 - DNA, 23 bp, Artificial Sequence
  Description of Artificial Sequence: Synthetic oligonucleotide
accccaggggctgcagcccagat

SEQ ID NO: 183850 - DNA, 22 bp, Artificial Sequence
  Description of Artificial Sequence: Synthetic oligonucleotide
ccccaggggctgcagcccagat

SEQ ID NO: 183851 - DNA, 22 bp, Artificial Sequence
  Description of Artificial Sequence: Synthetic oligonucleotide
cccaggggctgcagcccagatc

SEQ ID NO: 183852 - DNA, 23 bp, Artificial Sequence
  Description of Artificial Sequence: Synthetic oligonucleotide
ccaggggctgcagcccagatcca

SEQ ID NO: 183853 - DNA, 23 bp, Artificial Sequence
  Description of Artificial Sequence: Synthetic oligonucleotide
caggggctgcagcccagatccag

SEQ ID NO: 183854 - DNA, 24 bp, Artificial Sequence
  Description of Artificial Sequence: Synthetic oligonucleotide
aggggctgcagcccagatccagga

SEQ ID NO: 183855 - DNA, 23 bp, Artificial Sequence
  Description of Artificial Sequence: Synthetic oligonucleotide
ggggctgcagcccagatccagga

SEQ ID NO: 183856 - DNA, 23 bp, Artificial Sequence
  Description of Artificial Sequence: Synthetic oligonucleotide
gggctgcagcccagatccaggag

SEQ ID NO: 183857 - DNA, 24 bp, Artificial Sequence
  Description of Artificial Sequence: Synthetic oligonucleotide
ggctgcagcccagatccaggaggt

SEQ ID NO: 183858 - DNA, 27 bp, Artificial Sequence
  Description of Artificial Sequence: Synthetic oligonucleotide
gctgcagcccagatccaggaggtcaaa

SEQ ID NO: 183859 - DNA, 27 bp, Artificial Sequence
  Description of Artificial Sequence: Synthetic oligonucleotide
ctgcagcccagatccaggaggtcaaag

SEQ ID NO: 183860 - DNA, 28 bp, Artificial Sequence
  Description of Artificial Sequence: Synthetic oligonucleotide
tgcagcccagatccaggaggtcaaagag

SEQ ID NO: 183861 - DNA, 27 bp, Artificial Sequence
  Description of Artificial Sequence: Synthetic oligonucleotide
gcagcccagatccaggaggtcaaagag

SEQ ID NO: 183862 - DNA, 27 bp, Artificial Sequence
  Description of Artificial Sequence: Synthetic oligonucleotide
cagcccagatccaggaggtcaaagagc

SEQ ID NO: 183863 - DNA, 28 bp, Artificial Sequence
  Description of Artificial Sequence: Synthetic oligonucleotide
agcccagatccaggaggtcaaagagcag

SEQ ID NO: 183864 - DNA, 27 bp, Artificial Sequence
  Description of Artificial Sequence: Synthetic oligonucleotide
gcccagatccaggaggtcaaagagcag

SEQ ID NO: 183865 - DNA, 27 bp, Artificial Sequence
  Description of Artificial Sequence: Synthetic oligonucleotide
cccagatccaggaggtcaaagagcagc

SEQ ID NO: 183866 - DNA, 27 bp, Artificial Sequence
  Description of Artificial Sequence: Synthetic oligonucleotide
ccagatccaggaggtcaaagagcagcg

SEQ ID NO: 183867 - DNA, 27 bp, Artificial Sequence
  Description of Artificial Sequence: Synthetic oligonucleotide
cagatccaggaggtcaaagagcagcgg

SEQ ID NO: 183868 - DNA, 29 bp, Artificial Sequence
  Description of Artificial Sequence: Synthetic oligonucleotide
agatccaggaggtcaaagagcagcggatc

SEQ ID NO: 183869 - DNA, 28 bp, Artificial Sequence
  Description of Artificial Sequence: Synthetic oligonucleotide
gatccaggaggtcaaagagcagcggatc

SEQ ID NO: 183870 - DNA, 29 bp, Artificial Sequence
  Description of Artificial Sequence: Synthetic oligonucleotide
atccaggaggtcaaagagcagcggatcag

SEQ ID NO: 183871 - DNA, 28 bp, Artificial Sequence
  Description of Artificial Sequence: Synthetic oligonucleotide
tccaggaggtcaaagagcagcggatcag

SEQ ID NO: 183872 - DNA, 27 bp, Artificial Sequence
  Description of Artificial Sequence: Synthetic oligonucleotide
ccaggaggtcaaagagcagcggatcag

SEQ ID NO: 183873 - DNA, 28 bp, Artificial Sequence
  Description of Artificial Sequence: Synthetic oligonucleotide
caggaggtcaaagagcagcggatcagtg

SEQ ID NO: 183874 - DNA, 28 bp, Artificial Sequence
  Description of Artificial Sequence: Synthetic oligonucleotide
aggaggtcaaagagcagcggatcagtgg

SEQ ID NO: 183875 - DNA, 27 bp, Artificial Sequence
  Description of Artificial Sequence: Synthetic oligonucleotide
ggaggtcaaagagcagcggatcagtgg

SEQ ID NO: 183876 - DNA, 28 bp, Artificial Sequence
  Description of Artificial Sequence: Synthetic oligonucleotide
gaggtcaaagagcagcggatcagtggac

SEQ ID NO: 183877 - DNA, 29 bp, Artificial Sequence
  Description of Artificial Sequence: Synthetic oligonucleotide
aggtcaaagagcagcggatcagtggactc

SEQ ID NO: 183878 - DNA, 28 bp, Artificial Sequence
  Description of Artificial Sequence: Synthetic oligonucleotide
ggtcaaagagcagcggatcagtggactc

SEQ ID NO: 183879 - DNA, 28 bp, Artificial Sequence
  Description of Artificial Sequence: Synthetic oligonucleotide
gtcaaagagcagcggatcagtggactcc

SEQ ID NO: 183880 - DNA, 29 bp, Artificial Sequence
  Description of Artificial Sequence: Synthetic oligonucleotide
tcaaagagcagcggatcagtggactcctg

SEQ ID NO: 183881 - DNA, 28 bp, Artificial Sequence
  Description of Artificial Sequence: Synthetic oligonucleotide
caaagagcagcggatcagtggactcctg

SEQ ID NO: 183882 - DNA, 28 bp, Artificial Sequence
  Description of Artificial Sequence: Synthetic oligonucleotide
aaagagcagcggatcagtggactcctgg

SEQ ID NO: 183883 - DNA, 27 bp, Artificial Sequence
  Description of Artificial Sequence: Synthetic oligonucleotide
aagagcagcggatcagtggactcctgg

SEQ ID NO: 183884 - DNA, 27 bp, Artificial Sequence
  Description of Artificial Sequence: Synthetic oligonucleotide
agagcagcggatcagtggactcctggt

SEQ ID NO: 183885 - DNA, 26 bp, Artificial Sequence
  Description of Artificial Sequence: Synthetic oligonucleotide
gagcagcggatcagtggactcctggt

SEQ ID NO: 183886 - DNA, 26 bp, Artificial Sequence
  Description of Artificial Sequence: Synthetic oligonucleotide
agcagcggatcagtggactcctggtc

SEQ ID NO: 183887 - DNA, 25 bp, Artificial Sequence
  Description of Artificial Sequence: Synthetic oligonucleotide
gcagcggatcagtggactcctggtc

SEQ ID NO: 183888 - DNA, 25 bp, Artificial Sequence
  Description of Artificial Sequence: Synthetic oligonucleotide
cagcggatcagtggactcctggtcg

SEQ ID NO: 183889 - DNA, 26 bp, Artificial Sequence
  Description of Artificial Sequence: Synthetic oligonucleotide
agcggatcagtggactcctggtcgct

SEQ ID NO: 183890 - DNA, 25 bp, Artificial Sequence
  Description of Artificial Sequence: Synthetic oligonucleotide
gcggatcagtggactcctggtcgct

SEQ ID NO: 183891 - DNA, 26 bp, Artificial Sequence
  Description of Artificial Sequence: Synthetic oligonucleotide
cggatcagtggactcctggtcgctgt

SEQ ID NO: 183892 - DNA, 26 bp, Artificial Sequence
  Description of Artificial Sequence: Synthetic oligonucleotide
ggatcagtggactcctggtcgctgtg

SEQ ID NO: 183893 - DNA, 27 bp, Artificial Sequence
  Description of Artificial Sequence: Synthetic oligonucleotide
gatcagtggactcctggtcgctgtgct

SEQ ID NO: 183894 - DNA, 28 bp, Artificial Sequence
  Description of Artificial Sequence: Synthetic oligonucleotide
atcagtggactcctggtcgctgtgcttg

SEQ ID NO: 183895 - DNA, 27 bp, Artificial Sequence
  Description of Artificial Sequence: Synthetic oligonucleotide
tcagtggactcctggtcgctgtgcttg

SEQ ID NO: 183896 - DNA, 27 bp, Artificial Sequence
  Description of Artificial Sequence: Synthetic oligonucleotide
cagtggactcctggtcgctgtgcttgt

SEQ ID NO: 183897 - DNA, 27 bp, Artificial Sequence
  Description of Artificial Sequence: Synthetic oligonucleotide
agtggactcctggtcgctgtgcttgtg

SEQ ID NO: 183898 - DNA, 26 bp, Artificial Sequence
  Description of Artificial Sequence: Synthetic oligonucleotide
gtggactcctggtcgctgtgcttgtg

SEQ ID NO: 183899 - DNA, 26 bp, Artificial Sequence
  Description of Artificial Sequence: Synthetic oligonucleotide
tggactcctggtcgctgtgcttgtgg

SEQ ID NO: 183900 - DNA, 25 bp, Artificial Sequence
  Description of Artificial Sequence: Synthetic oligonucleotide
ggactcctggtcgctgtgcttgtgg

SEQ ID NO: 183901 - DNA, 25 bp, Artificial Sequence
  Description of Artificial Sequence: Synthetic oligonucleotide
gactcctggtcgctgtgcttgtggg

SEQ ID NO: 183902 - DNA, 25 bp, Artificial Sequence
  Description of Artificial Sequence: Synthetic oligonucleotide
actcctggtcgctgtgcttgtgggc

SEQ ID NO: 183903 - DNA, 24 bp, Artificial Sequence
  Description of Artificial Sequence: Synthetic oligonucleotide
ctcctggtcgctgtgcttgtgggc

SEQ ID NO: 183904 - DNA, 25 bp, Artificial Sequence
  Description of Artificial Sequence: Synthetic oligonucleotide
tcctggtcgctgtgcttgtgggcct

SEQ ID NO: 183905 - DNA, 24 bp, Artificial Sequence
  Description of Artificial Sequence: Synthetic oligonucleotide
cctggtcgctgtgcttgtgggcct

SEQ ID NO: 183906 - DNA, 25 bp, Artificial Sequence
  Description of Artificial Sequence: Synthetic oligonucleotide
ctggtcgctgtgcttgtgggcctgt

SEQ ID NO: 183907 - DNA, 25 bp, Artificial Sequence
  Description of Artificial Sequence: Synthetic oligonucleotide
tggtcgctgtgcttgtgggcctgtc

SEQ ID NO: 183908 - DNA, 24 bp, Artificial Sequence
  Description of Artificial Sequence: Synthetic oligonucleotide
ggtcgctgtgcttgtgggcctgtc

SEQ ID NO: 183909 - DNA, 26 bp, Artificial Sequence
  Description of Artificial Sequence: Synthetic oligonucleotide
gtcgctgtgcttgtgggcctgtccat

SEQ ID NO: 183910 - DNA, 26 bp, Artificial Sequence
  Description of Artificial Sequence: Synthetic oligonucleotide
tcgctgtgcttgtgggcctgtccatc

SEQ ID NO: 183911 - DNA, 25 bp, Artificial Sequence
  Description of Artificial Sequence: Synthetic oligonucleotide
cgctgtgcttgtgggcctgtccatc

SEQ ID NO: 183912 - DNA, 26 bp, Artificial Sequence
  Description of Artificial Sequence: Synthetic oligonucleotide
gctgtgcttgtgggcctgtccatcct

SEQ ID NO: 183913 - DNA, 27 bp, Artificial Sequence
  Description of Artificial Sequence: Synthetic oligonucleotide
ctgtgcttgtgggcctgtccatcctca

SEQ ID NO: 183914 - DNA, 28 bp, Artificial Sequence
  Description of Artificial Sequence: Synthetic oligonucleotide
tgtgcttgtgggcctgtccatcctcatg

SEQ ID NO: 183915 - DNA, 27 bp, Artificial Sequence
  Description of Artificial Sequence: Synthetic oligonucleotide
gtgcttgtgggcctgtccatcctcatg

SEQ ID NO: 183916 - DNA, 27 bp, Artificial Sequence
  Description of Artificial Sequence: Synthetic oligonucleotide
tgcttgtgggcctgtccatcctcatgg

SEQ ID NO: 183917 - DNA, 27 bp, Artificial Sequence
  Description of Artificial Sequence: Synthetic oligonucleotide
gcttgtgggcctgtccatcctcatgga

SEQ ID NO: 183918 - DNA, 27 bp, Artificial Sequence
  Description of Artificial Sequence: Synthetic oligonucleotide
cttgtgggcctgtccatcctcatggag

SEQ ID NO: 183919 - DNA, 27 bp, Artificial Sequence
  Description of Artificial Sequence: Synthetic oligonucleotide
ttgtgggcctgtccatcctcatggagc

SEQ ID NO: 183920 - DNA, 26 bp, Artificial Sequence
  Description of Artificial Sequence: Synthetic oligonucleotide
tgtgggcctgtccatcctcatggagc

SEQ ID NO: 183921 - DNA, 25 bp, Artificial Sequence
  Description of Artificial Sequence: Synthetic oligonucleotide
gtgggcctgtccatcctcatggagc

SEQ ID NO: 183922 - DNA, 25 bp, Artificial Sequence
  Description of Artificial Sequence: Synthetic oligonucleotide
tgggcctgtccatcctcatggagcc

SEQ ID NO: 183923 - DNA, 24 bp, Artificial Sequence
  Description of Artificial Sequence: Synthetic oligonucleotide
gggcctgtccatcctcatggagcc

SEQ ID NO: 183924 - DNA, 26 bp, Artificial Sequence
  Description of Artificial Sequence: Synthetic oligonucleotide
ggcctgtccatcctcatggagcccat

SEQ ID NO: 183925 - DNA, 26 bp, Artificial Sequence
  Description of Artificial Sequence: Synthetic oligonucleotide
gcctgtccatcctcatggagcccatc

SEQ ID NO: 183926 - DNA, 27 bp, Artificial Sequence
  Description of Artificial Sequence: Synthetic oligonucleotide
cctgtccatcctcatggagcccatcct

SEQ ID NO: 183927 - DNA, 27 bp, Artificial Sequence
  Description of Artificial Sequence: Synthetic oligonucleotide
ctgtccatcctcatggagcccatcctg

SEQ ID NO: 183928 - DNA, 28 bp, Artificial Sequence
  Description of Artificial Sequence: Synthetic oligonucleotide
tgtccatcctcatggagcccatcctgtc

SEQ ID NO: 183929 - DNA, 27 bp, Artificial Sequence
  Description of Artificial Sequence: Synthetic oligonucleotide
gtccatcctcatggagcccatcctgtc

SEQ ID NO: 183930 - DNA, 27 bp, Artificial Sequence
  Description of Artificial Sequence: Synthetic oligonucleotide
tccatcctcatggagcccatcctgtcc

SEQ ID NO: 183931 - DNA, 26 bp, Artificial Sequence
  Description of Artificial Sequence: Synthetic oligonucleotide
ccatcctcatggagcccatcctgtcc

SEQ ID NO: 183932 - DNA, 26 bp, Artificial Sequence
  Description of Artificial Sequence: Synthetic oligonucleotide
catcctcatggagcccatcctgtccc

SEQ ID NO: 183933 - DNA, 26 bp, Artificial Sequence
  Description of Artificial Sequence: Synthetic oligonucleotide
atcctcatggagcccatcctgtcccg

SEQ ID NO: 183934 - DNA, 25 bp, Artificial Sequence
  Description of Artificial Sequence: Synthetic oligonucleotide
tcctcatggagcccatcctgtcccg

SEQ ID NO: 183935 - DNA, 24 bp, Artificial Sequence
  Description of Artificial Sequence: Synthetic oligonucleotide
cctcatggagcccatcctgtcccg

SEQ ID NO: 183936 - DNA, 26 bp, Artificial Sequence
  Description of Artificial Sequence: Synthetic oligonucleotide
ctcatggagcccatcctgtcccgcat

SEQ ID NO: 183937 - DNA, 26 bp, Artificial Sequence
  Description of Artificial Sequence: Synthetic oligonucleotide
tcatggagcccatcctgtcccgcatc

SEQ ID NO: 183938 - DNA, 25 bp, Artificial Sequence
  Description of Artificial Sequence: Synthetic oligonucleotide
catggagcccatcctgtcccgcatc

SEQ ID NO: 183939 - DNA, 25 bp, Artificial Sequence
  Description of Artificial Sequence: Synthetic oligonucleotide
atggagcccatcctgtcccgcatcc

SEQ ID NO: 183940 - DNA, 24 bp, Artificial Sequence
  Description of Artificial Sequence: Synthetic oligonucleotide
tggagcccatcctgtcccgcatcc

SEQ ID NO: 183941 - DNA, 23 bp, Artificial Sequence
  Description of Artificial Sequence: Synthetic oligonucleotide
ggagcccatcctgtcccgcatcc

SEQ ID NO: 183942 - DNA, 23 bp, Artificial Sequence
  Description of Artificial Sequence: Synthetic oligonucleotide
gagcccatcctgtcccgcatccc

SEQ ID NO: 183943 - DNA, 23 bp, Artificial Sequence
  Description of Artificial Sequence: Synthetic oligonucleotide
agcccatcctgtcccgcatcccc

SEQ ID NO: 183944 - DNA, 22 bp, Artificial Sequence
  Description of Artificial Sequence: Synthetic oligonucleotide
gcccatcctgtcccgcatcccc

SEQ ID NO: 183945 - DNA, 23 bp, Artificial Sequence
  Description of Artificial Sequence: Synthetic oligonucleotide
cccatcctgtcccgcatccccct

SEQ ID NO: 183946 - DNA, 23 bp, Artificial Sequence
  Description of Artificial Sequence: Synthetic oligonucleotide
ccatcctgtcccgcatccccctg

SEQ ID NO: 183947 - DNA, 23 bp, Artificial Sequence
  Description of Artificial Sequence: Synthetic oligonucleotide
catcctgtcccgcatccccctgg

SEQ ID NO: 183948 - DNA, 24 bp, Artificial Sequence
  Description of Artificial Sequence: Synthetic oligonucleotide
atcctgtcccgcatccccctggct

SEQ ID NO: 183949 - DNA, 23 bp, Artificial Sequence
  Description of Artificial Sequence: Synthetic oligonucleotide
tcctgtcccgcatccccctggct

SEQ ID NO: 183950 - DNA, 22 bp, Artificial Sequence
  Description of Artificial Sequence: Synthetic oligonucleotide
cctgtcccgcatccccctggct

SEQ ID NO: 183951 - DNA, 24 bp, Artificial Sequence
  Description of Artificial Sequence: Synthetic oligonucleotide
ctgtcccgcatccccctggctgta

SEQ ID NO: 183952 - DNA, 25 bp, Artificial Sequence
  Description of Artificial Sequence: Synthetic oligonucleotide
tgtcccgcatccccctggctgtact

SEQ ID NO: 183953 - DNA, 24 bp, Artificial Sequence
  Description of Artificial Sequence: Synthetic oligonucleotide
gtcccgcatccccctggctgtact

SEQ ID NO: 183954 - DNA, 27 bp, Artificial Sequence
  Description of Artificial Sequence: Synthetic oligonucleotide
tcccgcatccccctggctgtactgttt

SEQ ID NO: 183955 - DNA, 26 bp, Artificial Sequence
  Description of Artificial Sequence: Synthetic oligonucleotide
cccgcatccccctggctgtactgttt

SEQ ID NO: 183956 - DNA, 26 bp, Artificial Sequence
  Description of Artificial Sequence: Synthetic oligonucleotide
ccgcatccccctggctgtactgtttg

SEQ ID NO: 183957 - DNA, 26 bp, Artificial Sequence
  Description of Artificial Sequence: Synthetic oligonucleotide
cgcatccccctggctgtactgtttgg

SEQ ID NO: 183958 - DNA, 27 bp, Artificial Sequence
  Description of Artificial Sequence: Synthetic oligonucleotide
gcatccccctggctgtactgtttggca

SEQ ID NO: 183959 - DNA, 28 bp, Artificial Sequence
  Description of Artificial Sequence: Synthetic oligonucleotide
catccccctggctgtactgtttggcatc

SEQ ID NO: 183960 - DNA, 30 bp, Artificial Sequence
  Description of Artificial Sequence: Synthetic oligonucleotide
atccccctggctgtactgtttggcatcttc

SEQ ID NO: 183961 - DNA, 29 bp, Artificial Sequence
  Description of Artificial Sequence: Synthetic oligonucleotide
tccccctggctgtactgtttggcatcttc

SEQ ID NO: 183962 - DNA, 28 bp, Artificial Sequence
  Description of Artificial Sequence: Synthetic oligonucleotide
ccccctggctgtactgtttggcatcttc

SEQ ID NO: 183963 - DNA, 28 bp, Artificial Sequence
  Description of Artificial Sequence: Synthetic oligonucleotide
cccctggctgtactgtttggcatcttcc

SEQ ID NO: 183964 - DNA, 29 bp, Artificial Sequence
  Description of Artificial Sequence: Synthetic oligonucleotide
ccctggctgtactgtttggcatcttcctc

SEQ ID NO: 183965 - DNA, 31 bp, Artificial Sequence
  Description of Artificial Sequence: Synthetic oligonucleotide
cctggctgtactgtttggcatcttcctctac

SEQ ID NO: 183966 - DNA, 33 bp, Artificial Sequence
  Description of Artificial Sequence: Synthetic oligonucleotide
ctggctgtactgtttggcatcttcctctacatg

SEQ ID NO: 183967 - DNA, 33 bp, Artificial Sequence
  Description of Artificial Sequence: Synthetic oligonucleotide
tggctgtactgtttggcatcttcctctacatgg

SEQ ID NO: 183968 - DNA, 32 bp, Artificial Sequence
  Description of Artificial Sequence: Synthetic oligonucleotide
ggctgtactgtttggcatcttcctctacatgg

SEQ ID NO: 183969 - DNA, 32 bp, Artificial Sequence
  Description of Artificial Sequence: Synthetic oligonucleotide
gctgtactgtttggcatcttcctctacatggg

SEQ ID NO: 183970 - DNA, 32 bp, Artificial Sequence
  Description of Artificial Sequence: Synthetic oligonucleotide
ctgtactgtttggcatcttcctctacatgggg

SEQ ID NO: 183971 - DNA, 32 bp, Artificial Sequence
  Description of Artificial Sequence: Synthetic oligonucleotide
tgtactgtttggcatcttcctctacatggggg

SEQ ID NO: 183972 - DNA, 31 bp, Artificial Sequence
  Description of Artificial Sequence: Synthetic oligonucleotide
gtactgtttggcatcttcctctacatggggg

SEQ ID NO: 183973 - DNA, 32 bp, Artificial Sequence
  Description of Artificial Sequence: Synthetic oligonucleotide
tactgtttggcatcttcctctacatgggggtc

SEQ ID NO: 183974 - DNA, 31 bp, Artificial Sequence
  Description of Artificial Sequence: Synthetic oligonucleotide
actgtttggcatcttcctctacatgggggtc

SEQ ID NO: 183975 - DNA, 30 bp, Artificial Sequence
  Description of Artificial Sequence: Synthetic oligonucleotide
ctgtttggcatcttcctctacatgggggtc

SEQ ID NO: 183976 - DNA, 31 bp, Artificial Sequence
  Description of Artificial Sequence: Synthetic oligonucleotide
tgtttggcatcttcctctacatgggggtcac

SEQ ID NO: 183977 - DNA, 30 bp, Artificial Sequence
  Description of Artificial Sequence: Synthetic oligonucleotide
gtttggcatcttcctctacatgggggtcac

SEQ ID NO: 183978 - DNA, 30 bp, Artificial Sequence
  Description of Artificial Sequence: Synthetic oligonucleotide
tttggcatcttcctctacatgggggtcacg

SEQ ID NO: 183979 - DNA, 29 bp, Artificial Sequence
  Description of Artificial Sequence: Synthetic oligonucleotide
ttggcatcttcctctacatgggggtcacg

SEQ ID NO: 183980 - DNA, 28 bp, Artificial Sequence
  Description of Artificial Sequence: Synthetic oligonucleotide
tggcatcttcctctacatgggggtcacg

SEQ ID NO: 183981 - DNA, 27 bp, Artificial Sequence
  Description of Artificial Sequence: Synthetic oligonucleotide
ggcatcttcctctacatgggggtcacg

SEQ ID NO: 183982 - DNA, 28 bp, Artificial Sequence
  Description of Artificial Sequence: Synthetic oligonucleotide
gcatcttcctctacatgggggtcacgtc

SEQ ID NO: 183983 - DNA, 28 bp, Artificial Sequence
  Description of Artificial Sequence: Synthetic oligonucleotide
catcttcctctacatgggggtcacgtcg

SEQ ID NO: 183984 - DNA, 28 bp, Artificial Sequence
  Description of Artificial Sequence: Synthetic oligonucleotide
atcttcctctacatgggggtcacgtcgc

SEQ ID NO: 183985 - DNA, 27 bp, Artificial Sequence
  Description of Artificial Sequence: Synthetic oligonucleotide
tcttcctctacatgggggtcacgtcgc

SEQ ID NO: 183986 - DNA, 27 bp, Artificial Sequence
  Description of Artificial Sequence: Synthetic oligonucleotide
cttcctctacatgggggtcacgtcgct

SEQ ID NO: 183987 - DNA, 27 bp, Artificial Sequence
  Description of Artificial Sequence: Synthetic oligonucleotide
ttcctctacatgggggtcacgtcgctc

SEQ ID NO: 183988 - DNA, 27 bp, Artificial Sequence
  Description of Artificial Sequence: Synthetic oligonucleotide
tcctctacatgggggtcacgtcgctca

SEQ ID NO: 183989 - DNA, 26 bp, Artificial Sequence
  Description of Artificial Sequence: Synthetic oligonucleotide
cctctacatgggggtcacgtcgctca

SEQ ID NO: 183990 - DNA, 26 bp, Artificial Sequence
  Description of Artificial Sequence: Synthetic oligonucleotide
ctctacatgggggtcacgtcgctcag

SEQ ID NO: 183991 - DNA, 26 bp, Artificial Sequence
  Description of Artificial Sequence: Synthetic oligonucleotide
tctacatgggggtcacgtcgctcagc

SEQ ID NO: 183992 - DNA, 25 bp, Artificial Sequence
  Description of Artificial Sequence: Synthetic oligonucleotide
ctacatgggggtcacgtcgctcagc

SEQ ID NO: 183993 - DNA, 25 bp, Artificial Sequence
  Description of Artificial Sequence: Synthetic oligonucleotide
tacatgggggtcacgtcgctcagcg

SEQ ID NO: 183994 - DNA, 24 bp, Artificial Sequence
  Description of Artificial Sequence: Synthetic oligonucleotide
acatgggggtcacgtcgctcagcg

SEQ ID NO: 183995 - DNA, 23 bp, Artificial Sequence
  Description of Artificial Sequence: Synthetic oligonucleotide
catgggggtcacgtcgctcagcg

SEQ ID NO: 183996 - DNA, 23 bp, Artificial Sequence
  Description of Artificial Sequence: Synthetic oligonucleotide
atgggggtcacgtcgctcagcgg

SEQ ID NO: 183997 - DNA, 22 bp, Artificial Sequence
  Description of Artificial Sequence: Synthetic oligonucleotide
tgggggtcacgtcgctcagcgg

SEQ ID NO: 183998 - DNA, 21 bp, Artificial Sequence
  Description of Artificial Sequence: Synthetic oligonucleotide
gggggtcacgtcgctcagcgg

SEQ ID NO: 183999 - DNA, 23 bp, Artificial Sequence
  Description of Artificial Sequence: Synthetic oligonucleotide
ggggtcacgtcgctcagcggcat

SEQ ID NO: 184000 - DNA, 23 bp, Artificial Sequence
  Description of Artificial Sequence: Synthetic oligonucleotide
gggtcacgtcgctcagcggcatc

SEQ ID NO: 184001 - DNA, 24 bp, Artificial Sequence
  Description of Artificial Sequence: Synthetic oligonucleotide
ggtcacgtcgctcagcggcatcca

SEQ ID NO: 184002 - DNA, 24 bp, Artificial Sequence
  Description of Artificial Sequence: Synthetic oligonucleotide
gtcacgtcgctcagcggcatccag

SEQ ID NO: 184003 - DNA, 25 bp, Artificial Sequence
  Description of Artificial Sequence: Synthetic oligonucleotide
tcacgtcgctcagcggcatccagct

SEQ ID NO: 184004 - DNA, 24 bp, Artificial Sequence
  Description of Artificial Sequence: Synthetic oligonucleotide
cacgtcgctcagcggcatccagct

SEQ ID NO: 184005 - DNA, 27 bp, Artificial Sequence
  Description of Artificial Sequence: Synthetic oligonucleotide
acgtcgctcagcggcatccagctcttt

SEQ ID NO: 184006 - DNA, 26 bp, Artificial Sequence
  Description of Artificial Sequence: Synthetic oligonucleotide
cgtcgctcagcggcatccagctcttt

SEQ ID NO: 184007 - DNA, 27 bp, Artificial Sequence
  Description of Artificial Sequence: Synthetic oligonucleotide
gtcgctcagcggcatccagctctttga

SEQ ID NO: 184008 - DNA, 27 bp, Artificial Sequence
  Description of Artificial Sequence: Synthetic oligonucleotide
tcgctcagcggcatccagctctttgac

SEQ ID NO: 184009 - DNA, 26 bp, Artificial Sequence
  Description of Artificial Sequence: Synthetic oligonucleotide
cgctcagcggcatccagctctttgac

SEQ ID NO: 184010 - DNA, 26 bp, Artificial Sequence
  Description of Artificial Sequence: Synthetic oligonucleotide
gctcagcggcatccagctctttgacc

SEQ ID NO: 184011 - DNA, 26 bp, Artificial Sequence
  Description of Artificial Sequence: Synthetic oligonucleotide
ctcagcggcatccagctctttgaccg

SEQ ID NO: 184012 - DNA, 27 bp, Artificial Sequence
  Description of Artificial Sequence: Synthetic oligonucleotide
tcagcggcatccagctctttgaccgca

SEQ ID NO: 184013 - DNA, 27 bp, Artificial Sequence
  Description of Artificial Sequence: Synthetic oligonucleotide
cagcggcatccagctctttgaccgcat

SEQ ID NO: 184014 - DNA, 27 bp, Artificial Sequence
  Description of Artificial Sequence: Synthetic oligonucleotide
agcggcatccagctctttgaccgcatc

SEQ ID NO: 184015 - DNA, 27 bp, Artificial Sequence
  Description of Artificial Sequence: Synthetic oligonucleotide
gcggcatccagctctttgaccgcatct

SEQ ID NO: 184016 - DNA, 28 bp, Artificial Sequence
  Description of Artificial Sequence: Synthetic oligonucleotide
cggcatccagctctttgaccgcatcttg

SEQ ID NO: 184017 - DNA, 28 bp, Artificial Sequence
  Description of Artificial Sequence: Synthetic oligonucleotide
ggcatccagctctttgaccgcatcttgc

SEQ ID NO: 184018 - DNA, 30 bp, Artificial Sequence
  Description of Artificial Sequence: Synthetic oligonucleotide
gcatccagctctttgaccgcatcttgcttc

SEQ ID NO: 184019 - DNA, 31 bp, Artificial Sequence
  Description of Artificial Sequence: Synthetic oligonucleotide
catccagctctttgaccgcatcttgcttctg

SEQ ID NO: 184020 - DNA, 33 bp, Artificial Sequence
  Description of Artificial Sequence: Synthetic oligonucleotide
atccagctctttgaccgcatcttgcttctgttc

SEQ ID NO: 184021 - DNA, 32 bp, Artificial Sequence
  Description of Artificial Sequence: Synthetic oligonucleotide
tccagctctttgaccgcatcttgcttctgttc

SEQ ID NO: 184022 - DNA, 31 bp, Artificial Sequence
  Description of Artificial Sequence: Synthetic oligonucleotide
ccagctctttgaccgcatcttgcttctgttc

SEQ ID NO: 184023 - DNA, 33 bp, Artificial Sequence
  Description of Artificial Sequence: Synthetic oligonucleotide
cagctctttgaccgcatcttgcttctgttcaag

SEQ ID NO: 184024 - DNA, 33 bp, Artificial Sequence
  Description of Artificial Sequence: Synthetic oligonucleotide
agctctttgaccgcatcttgcttctgttcaagc

SEQ ID NO: 184025 - DNA, 32 bp, Artificial Sequence
  Description of Artificial Sequence: Synthetic oligonucleotide
gctctttgaccgcatcttgcttctgttcaagc

SEQ ID NO: 184026 - DNA, 32 bp, Artificial Sequence
  Description of Artificial Sequence: Synthetic oligonucleotide
ctctttgaccgcatcttgcttctgttcaagcc

SEQ ID NO: 184027 - DNA, 33 bp, Artificial Sequence
  Description of Artificial Sequence: Synthetic oligonucleotide
tctttgaccgcatcttgcttctgttcaagccac

SEQ ID NO: 184028 - DNA, 32 bp, Artificial Sequence
  Description of Artificial Sequence: Synthetic oligonucleotide
ctttgaccgcatcttgcttctgttcaagccac

SEQ ID NO: 184029 - DNA, 32 bp, Artificial Sequence
  Description of Artificial Sequence: Synthetic oligonucleotide
tttgaccgcatcttgcttctgttcaagccacc

SEQ ID NO: 184030 - DNA, 31 bp, Artificial Sequence
  Description of Artificial Sequence: Synthetic oligonucleotide
ttgaccgcatcttgcttctgttcaagccacc

SEQ ID NO: 184031 - DNA, 30 bp, Artificial Sequence
  Description of Artificial Sequence: Synthetic oligonucleotide
tgaccgcatcttgcttctgttcaagccacc

SEQ ID NO: 184032 - DNA, 29 bp, Artificial Sequence
  Description of Artificial Sequence: Synthetic oligonucleotide
gaccgcatcttgcttctgttcaagccacc

SEQ ID NO: 184033 - DNA, 29 bp, Artificial Sequence
  Description of Artificial Sequence: Synthetic oligonucleotide
accgcatcttgcttctgttcaagccaccc

SEQ ID NO: 184034 - DNA, 28 bp, Artificial Sequence
  Description of Artificial Sequence: Synthetic oligonucleotide
ccgcatcttgcttctgttcaagccaccc

SEQ ID NO: 184035 - DNA, 30 bp, Artificial Sequence
  Description of Artificial Sequence: Synthetic oligonucleotide
cgcatcttgcttctgttcaagccacccaag

SEQ ID NO: 184036 - DNA, 33 bp, Artificial Sequence
  Description of Artificial Sequence: Synthetic oligonucleotide
gcatcttgcttctgttcaagccacccaagtatc

SEQ ID NO: 184037 - DNA, 34 bp, Artificial Sequence
  Description of Artificial Sequence: Synthetic oligonucleotide
catcttgcttctgttcaagccacccaagtatcac

SEQ ID NO: 184038 - DNA, 34 bp, Artificial Sequence
  Description of Artificial Sequence: Synthetic oligonucleotide
atcttgcttctgttcaagccacccaagtatcacc

SEQ ID NO: 184039 - DNA, 33 bp, Artificial Sequence
  Description of Artificial Sequence: Synthetic oligonucleotide
tcttgcttctgttcaagccacccaagtatcacc

SEQ ID NO: 184040 - DNA, 32 bp, Artificial Sequence
  Description of Artificial Sequence: Synthetic oligonucleotide
cttgcttctgttcaagccacccaagtatcacc

SEQ ID NO: 184041 - DNA, 32 bp, Artificial Sequence
  Description of Artificial Sequence: Synthetic oligonucleotide
ttgcttctgttcaagccacccaagtatcaccc

SEQ ID NO: 184042 - DNA, 31 bp, Artificial Sequence
  Description of Artificial Sequence: Synthetic oligonucleotide
tgcttctgttcaagccacccaagtatcaccc

SEQ ID NO: 184043 - DNA, 30 bp, Artificial Sequence
  Description of Artificial Sequence: Synthetic oligonucleotide
gcttctgttcaagccacccaagtatcaccc

SEQ ID NO: 184044 - DNA, 31 bp, Artificial Sequence
  Description of Artificial Sequence: Synthetic oligonucleotide
cttctgttcaagccacccaagtatcacccag

SEQ ID NO: 184045 - DNA, 33 bp, Artificial Sequence
  Description of Artificial Sequence: Synthetic oligonucleotide
ttctgttcaagccacccaagtatcacccagatg

SEQ ID NO: 184046 - DNA, 32 bp, Artificial Sequence
  Description of Artificial Sequence: Synthetic oligonucleotide
tctgttcaagccacccaagtatcacccagatg

SEQ ID NO: 184047 - DNA, 31 bp, Artificial Sequence
  Description of Artificial Sequence: Synthetic oligonucleotide
ctgttcaagccacccaagtatcacccagatg

SEQ ID NO: 184048 - DNA, 32 bp, Artificial Sequence
  Description of Artificial Sequence: Synthetic oligonucleotide
tgttcaagccacccaagtatcacccagatgtg

SEQ ID NO: 184049 - DNA, 31 bp, Artificial Sequence
  Description of Artificial Sequence: Synthetic oligonucleotide
gttcaagccacccaagtatcacccagatgtg

SEQ ID NO: 184050 - DNA, 31 bp, Artificial Sequence
  Description of Artificial Sequence: Synthetic oligonucleotide
ttcaagccacccaagtatcacccagatgtgc

SEQ ID NO: 184051 - DNA, 30 bp, Artificial Sequence
  Description of Artificial Sequence: Synthetic oligonucleotide
tcaagccacccaagtatcacccagatgtgc

SEQ ID NO: 184052 - DNA, 29 bp, Artificial Sequence
  Description of Artificial Sequence: Synthetic oligonucleotide
caagccacccaagtatcacccagatgtgc

SEQ ID NO: 184053 - DNA, 29 bp, Artificial Sequence
  Description of Artificial Sequence: Synthetic oligonucleotide
aagccacccaagtatcacccagatgtgcc

SEQ ID NO: 184054 - DNA, 28 bp, Artificial Sequence
  Description of Artificial Sequence: Synthetic oligonucleotide
agccacccaagtatcacccagatgtgcc

SEQ ID NO: 184055 - DNA, 27 bp, Artificial Sequence
  Description of Artificial Sequence: Synthetic oligonucleotide
gccacccaagtatcacccagatgtgcc

SEQ ID NO: 184056 - DNA, 27 bp, Artificial Sequence
  Description of Artificial Sequence: Synthetic oligonucleotide
ccacccaagtatcacccagatgtgccc

SEQ ID NO: 184057 - DNA, 29 bp, Artificial Sequence
  Description of Artificial Sequence: Synthetic oligonucleotide
cacccaagtatcacccagatgtgccctac

SEQ ID NO: 184058 - DNA, 29 bp, Artificial Sequence
  Description of Artificial Sequence: Synthetic oligonucleotide
acccaagtatcacccagatgtgccctacg

SEQ ID NO: 184059 - DNA, 28 bp, Artificial Sequence
  Description of Artificial Sequence: Synthetic oligonucleotide
cccaagtatcacccagatgtgccctacg

SEQ ID NO: 184060 - DNA, 29 bp, Artificial Sequence
  Description of Artificial Sequence: Synthetic oligonucleotide
ccaagtatcacccagatgtgccctacgtc

SEQ ID NO: 184061 - DNA, 31 bp, Artificial Sequence
  Description of Artificial Sequence: Synthetic oligonucleotide
caagtatcacccagatgtgccctacgtcaag

SEQ ID NO: 184062 - DNA, 31 bp, Artificial Sequence
  Description of Artificial Sequence: Synthetic oligonucleotide
aagtatcacccagatgtgccctacgtcaagc

SEQ ID NO: 184063 - DNA, 30 bp, Artificial Sequence
  Description of Artificial Sequence: Synthetic oligonucleotide
agtatcacccagatgtgccctacgtcaagc

SEQ ID NO: 184064 - DNA, 29 bp, Artificial Sequence
  Description of Artificial Sequence: Synthetic oligonucleotide
gtatcacccagatgtgccctacgtcaagc

SEQ ID NO: 184065 - DNA, 29 bp, Artificial Sequence
  Description of Artificial Sequence: Synthetic oligonucleotide
tatcacccagatgtgccctacgtcaagcg

SEQ ID NO: 184066 - DNA, 28 bp, Artificial Sequence
  Description of Artificial Sequence: Synthetic oligonucleotide
atcacccagatgtgccctacgtcaagcg

SEQ ID NO: 184067 - DNA, 27 bp, Artificial Sequence
  Description of Artificial Sequence: Synthetic oligonucleotide
tcacccagatgtgccctacgtcaagcg

SEQ ID NO: 184068 - DNA, 26 bp, Artificial Sequence
  Description of Artificial Sequence: Synthetic oligonucleotide
cacccagatgtgccctacgtcaagcg

SEQ ID NO: 184069 - DNA, 26 bp, Artificial Sequence
  Description of Artificial Sequence: Synthetic oligonucleotide
acccagatgtgccctacgtcaagcgg

SEQ ID NO: 184070 - DNA, 25 bp, Artificial Sequence
  Description of Artificial Sequence: Synthetic oligonucleotide
cccagatgtgccctacgtcaagcgg

SEQ ID NO: 184071 - DNA, 26 bp, Artificial Sequence
  Description of Artificial Sequence: Synthetic oligonucleotide
ccagatgtgccctacgtcaagcgggt

SEQ ID NO: 184072 - DNA, 27 bp, Artificial Sequence
  Description of Artificial Sequence: Synthetic oligonucleotide
cagatgtgccctacgtcaagcgggtga

SEQ ID NO: 184073 - DNA, 28 bp, Artificial Sequence
  Description of Artificial Sequence: Synthetic oligonucleotide
agatgtgccctacgtcaagcgggtgaag

SEQ ID NO: 184074 - DNA, 27 bp, Artificial Sequence
  Description of Artificial Sequence: Synthetic oligonucleotide
gatgtgccctacgtcaagcgggtgaag

SEQ ID NO: 184075 - DNA, 28 bp, Artificial Sequence
  Description of Artificial Sequence: Synthetic oligonucleotide
atgtgccctacgtcaagcgggtgaagac

SEQ ID NO: 184076 - DNA, 27 bp, Artificial Sequence
  Description of Artificial Sequence: Synthetic oligonucleotide
tgtgccctacgtcaagcgggtgaagac

SEQ ID NO: 184077 - DNA, 26 bp, Artificial Sequence
  Description of Artificial Sequence: Synthetic oligonucleotide
gtgccctacgtcaagcgggtgaagac

SEQ ID NO: 184078 - DNA, 27 bp, Artificial Sequence
  Description of Artificial Sequence: Synthetic oligonucleotide
tgccctacgtcaagcgggtgaagacct

SEQ ID NO: 184079 - DNA, 26 bp, Artificial Sequence
  Description of Artificial Sequence: Synthetic oligonucleotide
gccctacgtcaagcgggtgaagacct

SEQ ID NO: 184080 - DNA, 26 bp, Artificial Sequence
  Description of Artificial Sequence: Synthetic oligonucleotide
ccctacgtcaagcgggtgaagacctg

SEQ ID NO: 184081 - DNA, 26 bp, Artificial Sequence
  Description of Artificial Sequence: Synthetic oligonucleotide
cctacgtcaagcgggtgaagacctgg

SEQ ID NO: 184082 - DNA, 26 bp, Artificial Sequence
  Description of Artificial Sequence: Synthetic oligonucleotide
ctacgtcaagcgggtgaagacctggc

SEQ ID NO: 184083 - DNA, 26 bp, Artificial Sequence
  Description of Artificial Sequence: Synthetic oligonucleotide
tacgtcaagcgggtgaagacctggcg

SEQ ID NO: 184084 - DNA, 25 bp, Artificial Sequence
  Description of Artificial Sequence: Synthetic oligonucleotide
acgtcaagcgggtgaagacctggcg

SEQ ID NO: 184085 - DNA, 24 bp, Artificial Sequence
  Description of Artificial Sequence: Synthetic oligonucleotide
cgtcaagcgggtgaagacctggcg

SEQ ID NO: 184086 - DNA, 26 bp, Artificial Sequence
  Description of Artificial Sequence: Synthetic oligonucleotide
gtcaagcgggtgaagacctggcgcat

SEQ ID NO: 184087 - DNA, 26 bp, Artificial Sequence
  Description of Artificial Sequence: Synthetic oligonucleotide
tcaagcgggtgaagacctggcgcatg

SEQ ID NO: 184088 - DNA, 25 bp, Artificial Sequence
  Description of Artificial Sequence: Synthetic oligonucleotide
caagcgggtgaagacctggcgcatg

SEQ ID NO: 184089 - DNA, 26 bp, Artificial Sequence
  Description of Artificial Sequence: Synthetic oligonucleotide
aagcgggtgaagacctggcgcatgca

SEQ ID NO: 184090 - DNA, 25 bp, Artificial Sequence
  Description of Artificial Sequence: Synthetic oligonucleotide
agcgggtgaagacctggcgcatgca

SEQ ID NO: 184091 - DNA, 24 bp, Artificial Sequence
  Description of Artificial Sequence: Synthetic oligonucleotide
gcgggtgaagacctggcgcatgca

SEQ ID NO: 184092 - DNA, 27 bp, Artificial Sequence
  Description of Artificial Sequence: Synthetic oligonucleotide
cgggtgaagacctggcgcatgcactta

SEQ ID NO: 184093 - DNA, 29 bp, Artificial Sequence
  Description of Artificial Sequence: Synthetic oligonucleotide
gggtgaagacctggcgcatgcacttattc

SEQ ID NO: 184094 - DNA, 30 bp, Artificial Sequence
  Description of Artificial Sequence: Synthetic oligonucleotide
ggtgaagacctggcgcatgcacttattcac

SEQ ID NO: 184095 - DNA, 30 bp, Artificial Sequence
  Description of Artificial Sequence: Synthetic oligonucleotide
gtgaagacctggcgcatgcacttattcacg

SEQ ID NO: 184096 - DNA, 30 bp, Artificial Sequence
  Description of Artificial Sequence: Synthetic oligonucleotide
tgaagacctggcgcatgcacttattcacgg

SEQ ID NO: 184097 - DNA, 29 bp, Artificial Sequence
  Description of Artificial Sequence: Synthetic oligonucleotide
gaagacctggcgcatgcacttattcacgg

SEQ ID NO: 184098 - DNA, 29 bp, Artificial Sequence
  Description of Artificial Sequence: Synthetic oligonucleotide
aagacctggcgcatgcacttattcacggg

SEQ ID NO: 184099 - DNA, 28 bp, Artificial Sequence
  Description of Artificial Sequence: Synthetic oligonucleotide
agacctggcgcatgcacttattcacggg

SEQ ID NO: 184100 - DNA, 27 bp, Artificial Sequence
  Description of Artificial Sequence: Synthetic oligonucleotide
gacctggcgcatgcacttattcacggg

SEQ ID NO: 184101 - DNA, 27 bp, Artificial Sequence
  Description of Artificial Sequence: Synthetic oligonucleotide
acctggcgcatgcacttattcacgggc

SEQ ID NO: 184102 - DNA, 27 bp, Artificial Sequence
  Description of Artificial Sequence: Synthetic oligonucleotide
cctggcgcatgcacttattcacgggca

SEQ ID NO: 184103 - DNA, 28 bp, Artificial Sequence
  Description of Artificial Sequence: Synthetic oligonucleotide
ctggcgcatgcacttattcacgggcatc

SEQ ID NO: 184104 - DNA, 28 bp, Artificial Sequence
  Description of Artificial Sequence: Synthetic oligonucleotide
tggcgcatgcacttattcacgggcatcc

SEQ ID NO: 184105 - DNA, 27 bp, Artificial Sequence
  Description of Artificial Sequence: Synthetic oligonucleotide
ggcgcatgcacttattcacgggcatcc

SEQ ID NO: 184106 - DNA, 28 bp, Artificial Sequence
  Description of Artificial Sequence: Synthetic oligonucleotide
gcgcatgcacttattcacgggcatccag

SEQ ID NO: 184107 - DNA, 30 bp, Artificial Sequence
  Description of Artificial Sequence: Synthetic oligonucleotide
cgcatgcacttattcacgggcatccagatc

SEQ ID NO: 184108 - DNA, 32 bp, Artificial Sequence
  Description of Artificial Sequence: Synthetic oligonucleotide
gcatgcacttattcacgggcatccagatcatc

SEQ ID NO: 184109 - DNA, 33 bp, Artificial Sequence
  Description of Artificial Sequence: Synthetic oligonucleotide
catgcacttattcacgggcatccagatcatctg

SEQ ID NO: 184110 - DNA, 33 bp, Artificial Sequence
  Description of Artificial Sequence: Synthetic oligonucleotide
atgcacttattcacgggcatccagatcatctgc

SEQ ID NO: 184111 - DNA, 32 bp, Artificial Sequence
  Description of Artificial Sequence: Synthetic oligonucleotide
tgcacttattcacgggcatccagatcatctgc

SEQ ID NO: 184112 - DNA, 31 bp, Artificial Sequence
  Description of Artificial Sequence: Synthetic oligonucleotide
gcacttattcacgggcatccagatcatctgc

SEQ ID NO: 184113 - DNA, 31 bp, Artificial Sequence
  Description of Artificial Sequence: Synthetic oligonucleotide
cacttattcacgggcatccagatcatctgcc

SEQ ID NO: 184114 - DNA, 32 bp, Artificial Sequence
  Description of Artificial Sequence: Synthetic oligonucleotide
acttattcacgggcatccagatcatctgcctg

SEQ ID NO: 184115 - DNA, 31 bp, Artificial Sequence
  Description of Artificial Sequence: Synthetic oligonucleotide
cttattcacgggcatccagatcatctgcctg

SEQ ID NO: 184116 - DNA, 31 bp, Artificial Sequence
  Description of Artificial Sequence: Synthetic oligonucleotide
ttattcacgggcatccagatcatctgcctgg

SEQ ID NO: 184117 - DNA, 30 bp, Artificial Sequence
  Description of Artificial Sequence: Synthetic oligonucleotide
tattcacgggcatccagatcatctgcctgg

SEQ ID NO: 184118 - DNA, 29 bp, Artificial Sequence
  Description of Artificial Sequence: Synthetic oligonucleotide
attcacgggcatccagatcatctgcctgg

SEQ ID NO: 184119 - DNA, 28 bp, Artificial Sequence
  Description of Artificial Sequence: Synthetic oligonucleotide
ttcacgggcatccagatcatctgcctgg

SEQ ID NO: 184120 - DNA, 27 bp, Artificial Sequence
  Description of Artificial Sequence: Synthetic oligonucleotide
tcacgggcatccagatcatctgcctgg

SEQ ID NO: 184121 - DNA, 26 bp, Artificial Sequence
  Description of Artificial Sequence: Synthetic oligonucleotide
cacgggcatccagatcatctgcctgg

SEQ ID NO: 184122 - DNA, 27 bp, Artificial Sequence
  Description of Artificial Sequence: Synthetic oligonucleotide
acgggcatccagatcatctgcctggca

SEQ ID NO: 184123 - DNA, 26 bp, Artificial Sequence
  Description of Artificial Sequence: Synthetic oligonucleotide
cgggcatccagatcatctgcctggca

SEQ ID NO: 184124 - DNA, 27 bp, Artificial Sequence
  Description of Artificial Sequence: Synthetic oligonucleotide
gggcatccagatcatctgcctggcagt

SEQ ID NO: 184125 - DNA, 27 bp, Artificial Sequence
  Description of Artificial Sequence: Synthetic oligonucleotide
ggcatccagatcatctgcctggcagtg

SEQ ID NO: 184126 - DNA, 27 bp, Artificial Sequence
  Description of Artificial Sequence: Synthetic oligonucleotide
gcatccagatcatctgcctggcagtgc

SEQ ID NO: 184127 - DNA, 28 bp, Artificial Sequence
  Description of Artificial Sequence: Synthetic oligonucleotide
catccagatcatctgcctggcagtgctg

SEQ ID NO: 184128 - DNA, 29 bp, Artificial Sequence
  Description of Artificial Sequence: Synthetic oligonucleotide
atccagatcatctgcctggcagtgctgtg

SEQ ID NO: 184129 - DNA, 28 bp, Artificial Sequence
  Description of Artificial Sequence: Synthetic oligonucleotide
tccagatcatctgcctggcagtgctgtg

SEQ ID NO: 184130 - DNA, 27 bp, Artificial Sequence
  Description of Artificial Sequence: Synthetic oligonucleotide
ccagatcatctgcctggcagtgctgtg

SEQ ID NO: 184131 - DNA, 27 bp, Artificial Sequence
  Description of Artificial Sequence: Synthetic oligonucleotide
cagatcatctgcctggcagtgctgtgg

SEQ ID NO: 184132 - DNA, 27 bp, Artificial Sequence
  Description of Artificial Sequence: Synthetic oligonucleotide
agatcatctgcctggcagtgctgtggg

SEQ ID NO: 184133 - DNA, 27 bp, Artificial Sequence
  Description of Artificial Sequence: Synthetic oligonucleotide
gatcatctgcctggcagtgctgtgggt

SEQ ID NO: 184134 - DNA, 27 bp, Artificial Sequence
  Description of Artificial Sequence: Synthetic oligonucleotide
atcatctgcctggcagtgctgtgggtg

SEQ ID NO: 184135 - DNA, 26 bp, Artificial Sequence
  Description of Artificial Sequence: Synthetic oligonucleotide
tcatctgcctggcagtgctgtgggtg

SEQ ID NO: 184136 - DNA, 25 bp, Artificial Sequence
  Description of Artificial Sequence: Synthetic oligonucleotide
catctgcctggcagtgctgtgggtg

SEQ ID NO: 184137 - DNA, 26 bp, Artificial Sequence
  Description of Artificial Sequence: Synthetic oligonucleotide
atctgcctggcagtgctgtgggtggt

SEQ ID NO: 184138 - DNA, 25 bp, Artificial Sequence
  Description of Artificial Sequence: Synthetic oligonucleotide
tctgcctggcagtgctgtgggtggt

SEQ ID NO: 184139 - DNA, 24 bp, Artificial Sequence
  Description of Artificial Sequence: Synthetic oligonucleotide
ctgcctggcagtgctgtgggtggt

SEQ ID NO: 184140 - DNA, 26 bp, Artificial Sequence
  Description of Artificial Sequence: Synthetic oligonucleotide
tgcctggcagtgctgtgggtggtgaa

SEQ ID NO: 184141 - DNA, 25 bp, Artificial Sequence
  Description of Artificial Sequence: Synthetic oligonucleotide
gcctggcagtgctgtgggtggtgaa

SEQ ID NO: 184142 - DNA, 26 bp, Artificial Sequence
  Description of Artificial Sequence: Synthetic oligonucleotide
cctggcagtgctgtgggtggtgaagt

SEQ ID NO: 184143 - DNA, 26 bp, Artificial Sequence
  Description of Artificial Sequence: Synthetic oligonucleotide
ctggcagtgctgtgggtggtgaagtc

SEQ ID NO: 184144 - DNA, 27 bp, Artificial Sequence
  Description of Artificial Sequence: Synthetic oligonucleotide
tggcagtgctgtgggtggtgaagtcca

SEQ ID NO: 184145 - DNA, 26 bp, Artificial Sequence
  Description of Artificial Sequence: Synthetic oligonucleotide
ggcagtgctgtgggtggtgaagtcca

SEQ ID NO: 184146 - DNA, 26 bp, Artificial Sequence
  Description of Artificial Sequence: Synthetic oligonucleotide
gcagtgctgtgggtggtgaagtccac

SEQ ID NO: 184147 - DNA, 26 bp, Artificial Sequence
  Description of Artificial Sequence: Synthetic oligonucleotide
cagtgctgtgggtggtgaagtccacg

SEQ ID NO: 184148 - DNA, 26 bp, Artificial Sequence
  Description of Artificial Sequence: Synthetic oligonucleotide
agtgctgtgggtggtgaagtccacgc

SEQ ID NO: 184149 - DNA, 25 bp, Artificial Sequence
  Description of Artificial Sequence: Synthetic oligonucleotide
gtgctgtgggtggtgaagtccacgc

SEQ ID NO: 184150 - DNA, 25 bp, Artificial Sequence
  Description of Artificial Sequence: Synthetic oligonucleotide
tgctgtgggtggtgaagtccacgcc

SEQ ID NO: 184151 - DNA, 24 bp, Artificial Sequence
  Description of Artificial Sequence: Synthetic oligonucleotide
gctgtgggtggtgaagtccacgcc

SEQ ID NO: 184152 - DNA, 24 bp, Artificial Sequence
  Description of Artificial Sequence: Synthetic oligonucleotide
ctgtgggtggtgaagtccacgccg

SEQ ID NO: 184153 - DNA, 24 bp, Artificial Sequence
  Description of Artificial Sequence: Synthetic oligonucleotide
tgtgggtggtgaagtccacgccgg

SEQ ID NO: 184154 - DNA, 23 bp, Artificial Sequence
  Description of Artificial Sequence: Synthetic oligonucleotide
gtgggtggtgaagtccacgccgg

SEQ ID NO: 184155 - DNA, 23 bp, Artificial Sequence
  Description of Artificial Sequence: Synthetic oligonucleotide
tgggtggtgaagtccacgccggc

SEQ ID NO: 184156 - DNA, 22 bp, Artificial Sequence
  Description of Artificial Sequence: Synthetic oligonucleotide
gggtggtgaagtccacgccggc

SEQ ID NO: 184157 - DNA, 23 bp, Artificial Sequence
  Description of Artificial Sequence: Synthetic oligonucleotide
ggtggtgaagtccacgccggcct

SEQ ID NO: 184158 - DNA, 23 bp, Artificial Sequence
  Description of Artificial Sequence: Synthetic oligonucleotide
gtggtgaagtccacgccggcctc

SEQ ID NO: 184159 - DNA, 23 bp, Artificial Sequence
  Description of Artificial Sequence: Synthetic oligonucleotide
tggtgaagtccacgccggcctcc

SEQ ID NO: 184160 - DNA, 22 bp, Artificial Sequence
  Description of Artificial Sequence: Synthetic oligonucleotide
ggtgaagtccacgccggcctcc

SEQ ID NO: 184161 - DNA, 23 bp, Artificial Sequence
  Description of Artificial Sequence: Synthetic oligonucleotide
gtgaagtccacgccggcctccct

SEQ ID NO: 184162 - DNA, 23 bp, Artificial Sequence
  Description of Artificial Sequence: Synthetic oligonucleotide
tgaagtccacgccggcctccctg

SEQ ID NO: 184163 - DNA, 22 bp, Artificial Sequence
  Description of Artificial Sequence: Synthetic oligonucleotide
gaagtccacgccggcctccctg

SEQ ID NO: 184164 - DNA, 22 bp, Artificial Sequence
  Description of Artificial Sequence: Synthetic oligonucleotide
aagtccacgccggcctccctgg

SEQ ID NO: 184165 - DNA, 21 bp, Artificial Sequence
  Description of Artificial Sequence: Synthetic oligonucleotide
agtccacgccggcctccctgg

SEQ ID NO: 184166 - DNA, 20 bp, Artificial Sequence
  Description of Artificial Sequence: Synthetic oligonucleotide
gtccacgccggcctccctgg

SEQ ID NO: 184167 - DNA, 20 bp, Artificial Sequence
  Description of Artificial Sequence: Synthetic oligonucleotide
tccacgccggcctccctggc

SEQ ID NO: 184168 - DNA, 20 bp, Artificial Sequence
  Description of Artificial Sequence: Synthetic oligonucleotide
ccacgccggcctccctggct

SEQ ID NO: 184169 - DNA, 20 bp, Artificial Sequence
  Description of Artificial Sequence: Synthetic oligonucleotide
cacgccggcctccctggcct

SEQ ID NO: 184170 - DNA, 20 bp, Artificial Sequence
  Description of Artificial Sequence: Synthetic oligonucleotide
acgccggcctccctggccct

SEQ ID NO: 184171 - DNA, 20 bp, Artificial Sequence
  Description of Artificial Sequence: Synthetic oligonucleotide
cgccggcctccctggccctt

SEQ ID NO: 184172 - DNA, 20 bp, Artificial Sequence
  Description of Artificial Sequence: Synthetic oligonucleotide
gccggcctccctggccctgt

SEQ ID NO: 184173 - DNA, 20 bp, Artificial Sequence
  Description of Artificial Sequence: Synthetic oligonucleotide
ccggcctccctggccctgct

SEQ ID NO: 184174 - DNA, 20 bp, Artificial Sequence
  Description of Artificial Sequence: Synthetic oligonucleotide
cggcctccctggccctgcct

SEQ ID NO: 184175 - DNA, 21 bp, Artificial Sequence
  Description of Artificial Sequence: Synthetic oligonucleotide
ggcctccctggccctgccctt

SEQ ID NO: 184176 - DNA, 21 bp, Artificial Sequence
  Description of Artificial Sequence: Synthetic oligonucleotide
gcctccctggccctgcccttc

SEQ ID NO: 184177 - DNA, 22 bp, Artificial Sequence
  Description of Artificial Sequence: Synthetic oligonucleotide
cctccctggccctgcccttcgt

SEQ ID NO: 184178 - DNA, 22 bp, Artificial Sequence
  Description of Artificial Sequence: Synthetic oligonucleotide
ctccctggccctgcccttcgtc

SEQ ID NO: 184179 - DNA, 23 bp, Artificial Sequence
  Description of Artificial Sequence: Synthetic oligonucleotide
tccctggccctgcccttcgtcct

SEQ ID NO: 184180 - DNA, 22 bp, Artificial Sequence
  Description of Artificial Sequence: Synthetic oligonucleotide
ccctggccctgcccttcgtcct

SEQ ID NO: 184181 - DNA, 24 bp, Artificial Sequence
  Description of Artificial Sequence: Synthetic oligonucleotide
cctggccctgcccttcgtcctcat

SEQ ID NO: 184182 - DNA, 24 bp, Artificial Sequence
  Description of Artificial Sequence: Synthetic oligonucleotide
ctggccctgcccttcgtcctcatc

SEQ ID NO: 184183 - DNA, 25 bp, Artificial Sequence
  Description of Artificial Sequence: Synthetic oligonucleotide
tggccctgcccttcgtcctcatcct

SEQ ID NO: 184184 - DNA, 24 bp, Artificial Sequence
  Description of Artificial Sequence: Synthetic oligonucleotide
ggccctgcccttcgtcctcatcct

SEQ ID NO: 184185 - DNA, 25 bp, Artificial Sequence
  Description of Artificial Sequence: Synthetic oligonucleotide
gccctgcccttcgtcctcatcctca

SEQ ID NO: 184186 - DNA, 26 bp, Artificial Sequence
  Description of Artificial Sequence: Synthetic oligonucleotide
ccctgcccttcgtcctcatcctcact

SEQ ID NO: 184187 - DNA, 27 bp, Artificial Sequence
  Description of Artificial Sequence: Synthetic oligonucleotide
cctgcccttcgtcctcatcctcactgt

SEQ ID NO: 184188 - DNA, 27 bp, Artificial Sequence
  Description of Artificial Sequence: Synthetic oligonucleotide
ctgcccttcgtcctcatcctcactgtg

SEQ ID NO: 184189 - DNA, 27 bp, Artificial Sequence
  Description of Artificial Sequence: Synthetic oligonucleotide
tgcccttcgtcctcatcctcactgtgc

SEQ ID NO: 184190 - DNA, 26 bp, Artificial Sequence
  Description of Artificial Sequence: Synthetic oligonucleotide
gcccttcgtcctcatcctcactgtgc

SEQ ID NO: 184191 - DNA, 26 bp, Artificial Sequence
  Description of Artificial Sequence: Synthetic oligonucleotide
cccttcgtcctcatcctcactgtgcc

SEQ ID NO: 184192 - DNA, 26 bp, Artificial Sequence
  Description of Artificial Sequence: Synthetic oligonucleotide
ccttcgtcctcatcctcactgtgccg

SEQ ID NO: 184193 - DNA, 27 bp, Artificial Sequence
  Description of Artificial Sequence: Synthetic oligonucleotide
cttcgtcctcatcctcactgtgccgct

SEQ ID NO: 184194 - DNA, 27 bp, Artificial Sequence
  Description of Artificial Sequence: Synthetic oligonucleotide
ttcgtcctcatcctcactgtgccgctg

SEQ ID NO: 184195 - DNA, 26 bp, Artificial Sequence
  Description of Artificial Sequence: Synthetic oligonucleotide
tcgtcctcatcctcactgtgccgctg

SEQ ID NO: 184196 - DNA, 25 bp, Artificial Sequence
  Description of Artificial Sequence: Synthetic oligonucleotide
cgtcctcatcctcactgtgccgctg

SEQ ID NO: 184197 - DNA, 25 bp, Artificial Sequence
  Description of Artificial Sequence: Synthetic oligonucleotide
gtcctcatcctcactgtgccgctgc

SEQ ID NO: 184198 - DNA, 25 bp, Artificial Sequence
  Description of Artificial Sequence: Synthetic oligonucleotide
tcctcatcctcactgtgccgctgcg

SEQ ID NO: 184199 - DNA, 24 bp, Artificial Sequence
  Description of Artificial Sequence: Synthetic oligonucleotide
cctcatcctcactgtgccgctgcg

SEQ ID NO: 184200 - DNA, 24 bp, Artificial Sequence
  Description of Artificial Sequence: Synthetic oligonucleotide
ctcatcctcactgtgccgctgcgg

SEQ ID NO: 184201 - DNA, 24 bp, Artificial Sequence
  Description of Artificial Sequence: Synthetic oligonucleotide
tcatcctcactgtgccgctgcggc

SEQ ID NO: 184202 - DNA, 23 bp, Artificial Sequence
  Description of Artificial Sequence: Synthetic oligonucleotide
catcctcactgtgccgctgcggc

SEQ ID NO: 184203 - DNA, 23 bp, Artificial Sequence
  Description of Artificial Sequence: Synthetic oligonucleotide
atcctcactgtgccgctgcggcg

SEQ ID NO: 184204 - DNA, 22 bp, Artificial Sequence
  Description of Artificial Sequence: Synthetic oligonucleotide
tcctcactgtgccgctgcggcg

SEQ ID NO: 184205 - DNA, 21 bp, Artificial Sequence
  Description of Artificial Sequence: Synthetic oligonucleotide
cctcactgtgccgctgcggcg

SEQ ID NO: 184206 - DNA, 21 bp, Artificial Sequence
  Description of Artificial Sequence: Synthetic oligonucleotide
ctcactgtgccgctgcggcgc

SEQ ID NO: 184207 - DNA, 22 bp, Artificial Sequence
  Description of Artificial Sequence: Synthetic oligonucleotide
tcactgtgccgctgcggcgcgt

SEQ ID NO: 184208 - DNA, 21 bp, Artificial Sequence
  Description of Artificial Sequence: Synthetic oligonucleotide
cactgtgccgctgcggcgcgt

SEQ ID NO: 184209 - DNA, 21 bp, Artificial Sequence
  Description of Artificial Sequence: Synthetic oligonucleotide
actgtgccgctgcggcgcgtc

SEQ ID NO: 184210 - DNA, 20 bp, Artificial Sequence
  Description of Artificial Sequence: Synthetic oligonucleotide
ctgtgccgctgcggcgcgtc

SEQ ID NO: 184211 - DNA, 21 bp, Artificial Sequence
  Description of Artificial Sequence: Synthetic oligonucleotide
tgtgccgctgcggcgcgtcct

SEQ ID NO: 184212 - DNA, 20 bp, Artificial Sequence
  Description of Artificial Sequence: Synthetic oligonucleotide
gtgccgctgcggcgcgtcct

SEQ ID NO: 184213 - DNA, 20 bp, Artificial Sequence
  Description of Artificial Sequence: Synthetic oligonucleotide
tgccgctgcggcgcgtcctg

SEQ ID NO: 184214 - DNA, 20 bp, Artificial Sequence
  Description of Artificial Sequence: Synthetic oligonucleotide
gccgctgcggcgcgtcctgt

SEQ ID NO: 184215 - DNA, 20 bp, Artificial Sequence
  Description of Artificial Sequence: Synthetic oligonucleotide
ccgctgcggcgcgtcctgct

SEQ ID NO: 184216 - DNA, 20 bp, Artificial Sequence
  Description of Artificial Sequence: Synthetic oligonucleotide
cgctgcggcgcgtcctgctg

SEQ ID NO: 184217 - DNA, 20 bp, Artificial Sequence
  Description of Artificial Sequence: Synthetic oligonucleotide
gctgcggcgcgtcctgctgc

SEQ ID NO: 184218 - DNA, 20 bp, Artificial Sequence
  Description of Artificial Sequence: Synthetic oligonucleotide
ctgcggcgcgtcctgctgcc

SEQ ID NO: 184219 - DNA, 20 bp, Artificial Sequence
  Description of Artificial Sequence: Synthetic oligonucleotide
tgcggcgcgtcctgctgccg

SEQ ID NO: 184220 - DNA, 20 bp, Artificial Sequence
  Description of Artificial Sequence: Synthetic oligonucleotide
gcggcgcgtcctgctgccgt

SEQ ID NO: 184221 - DNA, 20 bp, Artificial Sequence
  Description of Artificial Sequence: Synthetic oligonucleotide
cggcgcgtcctgctgccgct

SEQ ID NO: 184222 - DNA, 22 bp, Artificial Sequence
  Description of Artificial Sequence: Synthetic oligonucleotide
ggcgcgtcctgctgccgctcat

SEQ ID NO: 184223 - DNA, 24 bp, Artificial Sequence
  Description of Artificial Sequence: Synthetic oligonucleotide
gcgcgtcctgctgccgctcatctt

SEQ ID NO: 184224 - DNA, 25 bp, Artificial Sequence
  Description of Artificial Sequence: Synthetic oligonucleotide
cgcgtcctgctgccgctcatcttca

SEQ ID NO: 184225 - DNA, 25 bp, Artificial Sequence
  Description of Artificial Sequence: Synthetic oligonucleotide
gcgtcctgctgccgctcatcttcag

SEQ ID NO: 184226 - DNA, 27 bp, Artificial Sequence
  Description of Artificial Sequence: Synthetic oligonucleotide
cgtcctgctgccgctcatcttcaggaa

SEQ ID NO: 184227 - DNA, 27 bp, Artificial Sequence
  Description of Artificial Sequence: Synthetic oligonucleotide
gtcctgctgccgctcatcttcaggaac

SEQ ID NO: 184228 - DNA, 27 bp, Artificial Sequence
  Description of Artificial Sequence: Synthetic oligonucleotide
tcctgctgccgctcatcttcaggaacg

SEQ ID NO: 184229 - DNA, 27 bp, Artificial Sequence
  Description of Artificial Sequence: Synthetic oligonucleotide
cctgctgccgctcatcttcaggaacgt

SEQ ID NO: 184230 - DNA, 27 bp, Artificial Sequence
  Description of Artificial Sequence: Synthetic oligonucleotide
ctgctgccgctcatcttcaggaacgtg

SEQ ID NO: 184231 - DNA, 27 bp, Artificial Sequence
  Description of Artificial Sequence: Synthetic oligonucleotide
tgctgccgctcatcttcaggaacgtgg

SEQ ID NO: 184232 - DNA, 27 bp, Artificial Sequence
  Description of Artificial Sequence: Synthetic oligonucleotide
gctgccgctcatcttcaggaacgtgga

SEQ ID NO: 184233 - DNA, 27 bp, Artificial Sequence
  Description of Artificial Sequence: Synthetic oligonucleotide
ctgccgctcatcttcaggaacgtggag

SEQ ID NO: 184234 - DNA, 27 bp, Artificial Sequence
  Description of Artificial Sequence: Synthetic oligonucleotide
tgccgctcatcttcaggaacgtggagc

SEQ ID NO: 184235 - DNA, 27 bp, Artificial Sequence
  Description of Artificial Sequence: Synthetic oligonucleotide
gccgctcatcttcaggaacgtggagct

SEQ ID NO: 184236 - DNA, 28 bp, Artificial Sequence
  Description of Artificial Sequence: Synthetic oligonucleotide
ccgctcatcttcaggaacgtggagcttc

SEQ ID NO: 184237 - DNA, 29 bp, Artificial Sequence
  Description of Artificial Sequence: Synthetic oligonucleotide
cgctcatcttcaggaacgtggagcttcag

SEQ ID NO: 184238 - DNA, 30 bp, Artificial Sequence
  Description of Artificial Sequence: Synthetic oligonucleotide
gctcatcttcaggaacgtggagcttcagtg

SEQ ID NO: 184239 - DNA, 31 bp, Artificial Sequence
  Description of Artificial Sequence: Synthetic oligonucleotide
ctcatcttcaggaacgtggagcttcagtgtc

SEQ ID NO: 184240 - DNA, 32 bp, Artificial Sequence
  Description of Artificial Sequence: Synthetic oligonucleotide
tcatcttcaggaacgtggagcttcagtgtctg

SEQ ID NO: 184241 - DNA, 31 bp, Artificial Sequence
  Description of Artificial Sequence: Synthetic oligonucleotide
catcttcaggaacgtggagcttcagtgtctg

SEQ ID NO: 184242 - DNA, 31 bp, Artificial Sequence
  Description of Artificial Sequence: Synthetic oligonucleotide
atcttcaggaacgtggagcttcagtgtctgg

SEQ ID NO: 184243 - DNA, 30 bp, Artificial Sequence
  Description of Artificial Sequence: Synthetic oligonucleotide
tcttcaggaacgtggagcttcagtgtctgg

SEQ ID NO: 184244 - DNA, 29 bp, Artificial Sequence
  Description of Artificial Sequence: Synthetic oligonucleotide
cttcaggaacgtggagcttcagtgtctgg

SEQ ID NO: 184245 - DNA, 31 bp, Artificial Sequence
  Description of Artificial Sequence: Synthetic oligonucleotide
ttcaggaacgtggagcttcagtgtctggatg

SEQ ID NO: 184246 - DNA, 30 bp, Artificial Sequence
  Description of Artificial Sequence: Synthetic oligonucleotide
tcaggaacgtggagcttcagtgtctggatg

SEQ ID NO: 184247 - DNA, 29 bp, Artificial Sequence
  Description of Artificial Sequence: Synthetic oligonucleotide
caggaacgtggagcttcagtgtctggatg

SEQ ID NO: 184248 - DNA, 29 bp, Artificial Sequence
  Description of Artificial Sequence: Synthetic oligonucleotide
aggaacgtggagcttcagtgtctggatgc

SEQ ID NO: 184249 - DNA, 28 bp, Artificial Sequence
  Description of Artificial Sequence: Synthetic oligonucleotide
ggaacgtggagcttcagtgtctggatgc

SEQ ID NO: 184250 - DNA, 29 bp, Artificial Sequence
  Description of Artificial Sequence: Synthetic oligonucleotide
gaacgtggagcttcagtgtctggatgctg

SEQ ID NO: 184251 - DNA, 31 bp, Artificial Sequence
  Description of Artificial Sequence: Synthetic oligonucleotide
aacgtggagcttcagtgtctggatgctgatg

SEQ ID NO: 184252 - DNA, 30 bp, Artificial Sequence
  Description of Artificial Sequence: Synthetic oligonucleotide
acgtggagcttcagtgtctggatgctgatg

SEQ ID NO: 184253 - DNA, 29 bp, Artificial Sequence
  Description of Artificial Sequence: Synthetic oligonucleotide
cgtggagcttcagtgtctggatgctgatg

SEQ ID NO: 184254 - DNA, 31 bp, Artificial Sequence
  Description of Artificial Sequence: Synthetic oligonucleotide
gtggagcttcagtgtctggatgctgatgatg

SEQ ID NO: 184255 - DNA, 31 bp, Artificial Sequence
  Description of Artificial Sequence: Synthetic oligonucleotide
tggagcttcagtgtctggatgctgatgatgc

SEQ ID NO: 184256 - DNA, 30 bp, Artificial Sequence
  Description of Artificial Sequence: Synthetic oligonucleotide
ggagcttcagtgtctggatgctgatgatgc

SEQ ID NO: 184257 - DNA, 30 bp, Artificial Sequence
  Description of Artificial Sequence: Synthetic oligonucleotide
gagcttcagtgtctggatgctgatgatgcc

SEQ ID NO: 184258 - DNA, 32 bp, Artificial Sequence
  Description of Artificial Sequence: Synthetic oligonucleotide
agcttcagtgtctggatgctgatgatgccaag

SEQ ID NO: 184259 - DNA, 31 bp, Artificial Sequence
  Description of Artificial Sequence: Synthetic oligonucleotide
gcttcagtgtctggatgctgatgatgccaag

SEQ ID NO: 184260 - DNA, 31 bp, Artificial Sequence
  Description of Artificial Sequence: Synthetic oligonucleotide
cttcagtgtctggatgctgatgatgccaagg

SEQ ID NO: 184261 - DNA, 31 bp, Artificial Sequence
  Description of Artificial Sequence: Synthetic oligonucleotide
ttcagtgtctggatgctgatgatgccaaggc

SEQ ID NO: 184262 - DNA, 30 bp, Artificial Sequence
  Description of Artificial Sequence: Synthetic oligonucleotide
tcagtgtctggatgctgatgatgccaaggc

SEQ ID NO: 184263 - DNA, 29 bp, Artificial Sequence
  Description of Artificial Sequence: Synthetic oligonucleotide
cagtgtctggatgctgatgatgccaaggc

SEQ ID NO: 184264 - DNA, 31 bp, Artificial Sequence
  Description of Artificial Sequence: Synthetic oligonucleotide
agtgtctggatgctgatgatgccaaggcaac

SEQ ID NO: 184265 - DNA, 30 bp, Artificial Sequence
  Description of Artificial Sequence: Synthetic oligonucleotide
gtgtctggatgctgatgatgccaaggcaac

SEQ ID NO: 184266 - DNA, 30 bp, Artificial Sequence
  Description of Artificial Sequence: Synthetic oligonucleotide
tgtctggatgctgatgatgccaaggcaacc

SEQ ID NO: 184267 - DNA, 29 bp, Artificial Sequence
  Description of Artificial Sequence: Synthetic oligonucleotide
gtctggatgctgatgatgccaaggcaacc

SEQ ID NO: 184268 - DNA, 32 bp, Artificial Sequence
  Description of Artificial Sequence: Synthetic oligonucleotide
tctggatgctgatgatgccaaggcaacctttg

SEQ ID NO: 184269 - DNA, 31 bp, Artificial Sequence
  Description of Artificial Sequence: Synthetic oligonucleotide
ctggatgctgatgatgccaaggcaacctttg

SEQ ID NO: 184270 - DNA, 33 bp, Artificial Sequence
  Description of Artificial Sequence: Synthetic oligonucleotide
tggatgctgatgatgccaaggcaacctttgatg

SEQ ID NO: 184271 - DNA, 32 bp, Artificial Sequence
  Description of Artificial Sequence: Synthetic oligonucleotide
ggatgctgatgatgccaaggcaacctttgatg

SEQ ID NO: 184272 - DNA, 33 bp, Artificial Sequence
  Description of Artificial Sequence: Synthetic oligonucleotide
gatgctgatgatgccaaggcaacctttgatgag

SEQ ID NO: 184273 - DNA, 33 bp, Artificial Sequence
  Description of Artificial Sequence: Synthetic oligonucleotide
atgctgatgatgccaaggcaacctttgatgagg

SEQ ID NO: 184274 - DNA, 32 bp, Artificial Sequence
  Description of Artificial Sequence: Synthetic oligonucleotide
tgctgatgatgccaaggcaacctttgatgagg

SEQ ID NO: 184275 - DNA, 31 bp, Artificial Sequence
  Description of Artificial Sequence: Synthetic oligonucleotide
gctgatgatgccaaggcaacctttgatgagg

SEQ ID NO: 184276 - DNA, 32 bp, Artificial Sequence
  Description of Artificial Sequence: Synthetic oligonucleotide
ctgatgatgccaaggcaacctttgatgaggag

SEQ ID NO: 184277 - DNA, 32 bp, Artificial Sequence
  Description of Artificial Sequence: Synthetic oligonucleotide
tgatgatgccaaggcaacctttgatgaggagg

SEQ ID NO: 184278 - DNA, 31 bp, Artificial Sequence
  Description of Artificial Sequence: Synthetic oligonucleotide
gatgatgccaaggcaacctttgatgaggagg

SEQ ID NO: 184279 - DNA, 33 bp, Artificial Sequence
  Description of Artificial Sequence: Synthetic oligonucleotide
atgatgccaaggcaacctttgatgaggaggaag

SEQ ID NO: 184280 - DNA, 32 bp, Artificial Sequence
  Description of Artificial Sequence: Synthetic oligonucleotide
tgatgccaaggcaacctttgatgaggaggaag

SEQ ID NO: 184281 - DNA, 31 bp, Artificial Sequence
  Description of Artificial Sequence: Synthetic oligonucleotide
gatgccaaggcaacctttgatgaggaggaag

SEQ ID NO: 184282 - DNA, 31 bp, Artificial Sequence
  Description of Artificial Sequence: Synthetic oligonucleotide
atgccaaggcaacctttgatgaggaggaagg

SEQ ID NO: 184283 - DNA, 30 bp, Artificial Sequence
  Description of Artificial Sequence: Synthetic oligonucleotide
tgccaaggcaacctttgatgaggaggaagg

SEQ ID NO: 184284 - DNA, 29 bp, Artificial Sequence
  Description of Artificial Sequence: Synthetic oligonucleotide
gccaaggcaacctttgatgaggaggaagg

SEQ ID NO: 184285 - DNA, 30 bp, Artificial Sequence
  Description of Artificial Sequence: Synthetic oligonucleotide
ccaaggcaacctttgatgaggaggaaggtc

SEQ ID NO: 184286 - DNA, 30 bp, Artificial Sequence
  Description of Artificial Sequence: Synthetic oligonucleotide
caaggcaacctttgatgaggaggaaggtcg

SEQ ID NO: 184287 - DNA, 30 bp, Artificial Sequence
  Description of Artificial Sequence: Synthetic oligonucleotide
aaggcaacctttgatgaggaggaaggtcgg

SEQ ID NO: 184288 - DNA, 29 bp, Artificial Sequence
  Description of Artificial Sequence: Synthetic oligonucleotide
aggcaacctttgatgaggaggaaggtcgg

SEQ ID NO: 184289 - DNA, 28 bp, Artificial Sequence
  Description of Artificial Sequence: Synthetic oligonucleotide
ggcaacctttgatgaggaggaaggtcgg

SEQ ID NO: 184290 - DNA, 28 bp, Artificial Sequence
  Description of Artificial Sequence: Synthetic oligonucleotide
gcaacctttgatgaggaggaaggtcggg

SEQ ID NO: 184291 - DNA, 30 bp, Artificial Sequence
  Description of Artificial Sequence: Synthetic oligonucleotide
caacctttgatgaggaggaaggtcgggatg

SEQ ID NO: 184292 - DNA, 34 bp, Artificial Sequence
  Description of Artificial Sequence: Synthetic oligonucleotide
aacctttgatgaggaggaaggtcgggatgaatac

SEQ ID NO: 184293 - DNA, 33 bp, Artificial Sequence
  Description of Artificial Sequence: Synthetic oligonucleotide
acctttgatgaggaggaaggtcgggatgaatac

SEQ ID NO: 184294 - DNA, 32 bp, Artificial Sequence
  Description of Artificial Sequence: Synthetic oligonucleotide
cctttgatgaggaggaaggtcgggatgaatac

SEQ ID NO: 184295 - DNA, 32 bp, Artificial Sequence
  Description of Artificial Sequence: Synthetic oligonucleotide
ctttgatgaggaggaaggtcgggatgaatacg

SEQ ID NO: 184296 - DNA, 33 bp, Artificial Sequence
  Description of Artificial Sequence: Synthetic oligonucleotide
tttgatgaggaggaaggtcgggatgaatacgac

SEQ ID NO: 184297 - DNA, 32 bp, Artificial Sequence
  Description of Artificial Sequence: Synthetic oligonucleotide
ttgatgaggaggaaggtcgggatgaatacgac

SEQ ID NO: 184298 - DNA, 31 bp, Artificial Sequence
  Description of Artificial Sequence: Synthetic oligonucleotide
tgatgaggaggaaggtcgggatgaatacgac

SEQ ID NO: 184299 - DNA, 30 bp, Artificial Sequence
  Description of Artificial Sequence: Synthetic oligonucleotide
gatgaggaggaaggtcgggatgaatacgac

SEQ ID NO: 184300 - DNA, 30 bp, Artificial Sequence
  Description of Artificial Sequence: Synthetic oligonucleotide
atgaggaggaaggtcgggatgaatacgacg

SEQ ID NO: 184301 - DNA, 29 bp, Artificial Sequence
  Description of Artificial Sequence: Synthetic oligonucleotide
tgaggaggaaggtcgggatgaatacgacg

SEQ ID NO: 184302 - DNA, 28 bp, Artificial Sequence
  Description of Artificial Sequence: Synthetic oligonucleotide
gaggaggaaggtcgggatgaatacgacg

SEQ ID NO: 184303 - DNA, 30 bp, Artificial Sequence
  Description of Artificial Sequence: Synthetic oligonucleotide
aggaggaaggtcgggatgaatacgacgaag

SEQ ID NO: 184304 - DNA, 29 bp, Artificial Sequence
  Description of Artificial Sequence: Synthetic oligonucleotide
ggaggaaggtcgggatgaatacgacgaag

SEQ ID NO: 184305 - DNA, 30 bp, Artificial Sequence
  Description of Artificial Sequence: Synthetic oligonucleotide
gaggaaggtcgggatgaatacgacgaagtg

SEQ ID NO: 184306 - DNA, 30 bp, Artificial Sequence
  Description of Artificial Sequence: Synthetic oligonucleotide
aggaaggtcgggatgaatacgacgaagtgg

SEQ ID NO: 184307 - DNA, 29 bp, Artificial Sequence
  Description of Artificial Sequence: Synthetic oligonucleotide
ggaaggtcgggatgaatacgacgaagtgg

SEQ ID NO: 184308 - DNA, 29 bp, Artificial Sequence
  Description of Artificial Sequence: Synthetic oligonucleotide
gaaggtcgggatgaatacgacgaagtggc

SEQ ID NO: 184309 - DNA, 29 bp, Artificial Sequence
  Description of Artificial Sequence: Synthetic oligonucleotide
aaggtcgggatgaatacgacgaagtggcc

SEQ ID NO: 184310 - DNA, 28 bp, Artificial Sequence
  Description of Artificial Sequence: Synthetic oligonucleotide
aggtcgggatgaatacgacgaagtggcc

SEQ ID NO: 184311 - DNA, 27 bp, Artificial Sequence
  Description of Artificial Sequence: Synthetic oligonucleotide
ggtcgggatgaatacgacgaagtggcc

SEQ ID NO: 184312 - DNA, 29 bp, Artificial Sequence
  Description of Artificial Sequence: Synthetic oligonucleotide
gtcgggatgaatacgacgaagtggccatg

SEQ ID NO: 184313 - DNA, 29 bp, Artificial Sequence
  Description of Artificial Sequence: Synthetic oligonucleotide
tcgggatgaatacgacgaagtggccatgc

SEQ ID NO: 184314 - DNA, 28 bp, Artificial Sequence
  Description of Artificial Sequence: Synthetic oligonucleotide
cgggatgaatacgacgaagtggccatgc

SEQ ID NO: 184315 - DNA, 28 bp, Artificial Sequence
  Description of Artificial Sequence: Synthetic oligonucleotide
gggatgaatacgacgaagtggccatgcc

SEQ ID NO: 184316 - DNA, 29 bp, Artificial Sequence
  Description of Artificial Sequence: Synthetic oligonucleotide
ggatgaatacgacgaagtggccatgcctg

SEQ ID NO: 184317 - DNA, 30 bp, Artificial Sequence
  Description of Artificial Sequence: Synthetic oligonucleotide
gatgaatacgacgaagtggccatgcctgtg

SEQ ID NO: 184318 - DNA, 31 bp, Artificial Sequence
  Description of Artificial Sequence: Synthetic oligonucleotide
atgaatacgacgaagtggccatgcctgtgtg

SEQ ID NO: 184319 - DNA, 30 bp, Artificial Sequence
  Description of Artificial Sequence: Synthetic oligonucleotide
tgaatacgacgaagtggccatgcctgtgtg

SEQ ID NO: 184320 - DNA, 29 bp, Artificial Sequence
  Description of Artificial Sequence: Synthetic oligonucleotide
gaatacgacgaagtggccatgcctgtgtg

SEQ ID NO: 184321 - DNA, 32 bp, Artificial Sequence
  Description of Artificial Sequence: Synthetic oligonucleotide
aggtttatctttgaagaccagatccggcctcc

SEQ ID NO: 184322 - DNA, 31 bp, Artificial Sequence
  Description of Artificial Sequence: Synthetic oligonucleotide
ggtttatctttgaagaccagatccggcctcc

SEQ ID NO: 184323 - DNA, 31 bp, Artificial Sequence
  Description of Artificial Sequence: Synthetic oligonucleotide
gtttatctttgaagaccagatccggcctccg

SEQ ID NO: 184324 - DNA, 35 bp, Artificial Sequence
  Description of Artificial Sequence: Synthetic oligonucleotide
tttatctttgaagaccagatccggcctccgatttc

SEQ ID NO: 184325 - DNA, 34 bp, Artificial Sequence
  Description of Artificial Sequence: Synthetic oligonucleotide
ttatctttgaagaccagatccggcctccgatttc

SEQ ID NO: 184326 - DNA, 33 bp, Artificial Sequence
  Description of Artificial Sequence: Synthetic oligonucleotide
tatctttgaagaccagatccggcctccgatttc

SEQ ID NO: 184327 - DNA, 32 bp, Artificial Sequence
  Description of Artificial Sequence: Synthetic oligonucleotide
atctttgaagaccagatccggcctccgatttc

SEQ ID NO: 184328 - DNA, 31 bp, Artificial Sequence
  Description of Artificial Sequence: Synthetic oligonucleotide
tctttgaagaccagatccggcctccgatttc

SEQ ID NO: 184329 - DNA, 30 bp, Artificial Sequence
  Description of Artificial Sequence: Synthetic oligonucleotide
ctttgaagaccagatccggcctccgatttc

SEQ ID NO: 184330 - DNA, 30 bp, Artificial Sequence
  Description of Artificial Sequence: Synthetic oligonucleotide
tttgaagaccagatccggcctccgatttcc

SEQ ID NO: 184331 - DNA, 29 bp, Artificial Sequence
  Description of Artificial Sequence: Synthetic oligonucleotide
ttgaagaccagatccggcctccgatttcc

SEQ ID NO: 184332 - DNA, 28 bp, Artificial Sequence
  Description of Artificial Sequence: Synthetic oligonucleotide
tgaagaccagatccggcctccgatttcc

SEQ ID NO: 184333 - DNA, 27 bp, Artificial Sequence
  Description of Artificial Sequence: Synthetic oligonucleotide
gaagaccagatccggcctccgatttcc

SEQ ID NO: 184334 - DNA, 28 bp, Artificial Sequence
  Description of Artificial Sequence: Synthetic oligonucleotide
aagaccagatccggcctccgatttcctc

SEQ ID NO: 184335 - DNA, 27 bp, Artificial Sequence
  Description of Artificial Sequence: Synthetic oligonucleotide
agaccagatccggcctccgatttcctc

SEQ ID NO: 184336 - DNA, 27 bp, Artificial Sequence
  Description of Artificial Sequence: Synthetic oligonucleotide
gaccagatccggcctccgatttcctct

SEQ ID NO: 184337 - DNA, 27 bp, Artificial Sequence
  Description of Artificial Sequence: Synthetic oligonucleotide
accagatccggcctccgatttcctctc

SEQ ID NO: 184338 - DNA, 26 bp, Artificial Sequence
  Description of Artificial Sequence: Synthetic oligonucleotide
ccagatccggcctccgatttcctctc

SEQ ID NO: 184339 - DNA, 26 bp, Artificial Sequence
  Description of Artificial Sequence: Synthetic oligonucleotide
cagatccggcctccgatttcctctcc

SEQ ID NO: 184340 - DNA, 26 bp, Artificial Sequence
  Description of Artificial Sequence: Synthetic oligonucleotide
agatccggcctccgatttcctctccg

SEQ ID NO: 184341 - DNA, 25 bp, Artificial Sequence
  Description of Artificial Sequence: Synthetic oligonucleotide
gatccggcctccgatttcctctccg

SEQ ID NO: 184342 - DNA, 27 bp, Artificial Sequence
  Description of Artificial Sequence: Synthetic oligonucleotide
atccggcctccgatttcctctccgctt

SEQ ID NO: 184343 - DNA, 26 bp, Artificial Sequence
  Description of Artificial Sequence: Synthetic oligonucleotide
tccggcctccgatttcctctccgctt

SEQ ID NO: 184344 - DNA, 25 bp, Artificial Sequence
  Description of Artificial Sequence: Synthetic oligonucleotide
ccggcctccgatttcctctccgctt

SEQ ID NO: 184345 - DNA, 25 bp, Artificial Sequence
  Description of Artificial Sequence: Synthetic oligonucleotide
cggcctccgatttcctctccgcttg

SEQ ID NO: 184346 - DNA, 27 bp, Artificial Sequence
  Description of Artificial Sequence: Synthetic oligonucleotide
ggcctccgatttcctctccgcttgcaa

SEQ ID NO: 184347 - DNA, 27 bp, Artificial Sequence
  Description of Artificial Sequence: Synthetic oligonucleotide
gcctccgatttcctctccgcttgcaac

SEQ ID NO: 184348 - DNA, 27 bp, Artificial Sequence
  Description of Artificial Sequence: Synthetic oligonucleotide
cctccgatttcctctccgcttgcaacc

SEQ ID NO: 184349 - DNA, 28 bp, Artificial Sequence
  Description of Artificial Sequence: Synthetic oligonucleotide
ctccgatttcctctccgcttgcaacctc

SEQ ID NO: 184350 - DNA, 28 bp, Artificial Sequence
  Description of Artificial Sequence: Synthetic oligonucleotide
tccgatttcctctccgcttgcaacctcc

SEQ ID NO: 184351 - DNA, 27 bp, Artificial Sequence
  Description of Artificial Sequence: Synthetic oligonucleotide
ccgatttcctctccgcttgcaacctcc

SEQ ID NO: 184352 - DNA, 27 bp, Artificial Sequence
  Description of Artificial Sequence: Synthetic oligonucleotide
cgatttcctctccgcttgcaacctccg

SEQ ID NO: 184353 - DNA, 27 bp, Artificial Sequence
  Description of Artificial Sequence: Synthetic oligonucleotide
gatttcctctccgcttgcaacctccgg

SEQ ID NO: 184354 - DNA, 27 bp, Artificial Sequence
  Description of Artificial Sequence: Synthetic oligonucleotide
atttcctctccgcttgcaacctccggg

SEQ ID NO: 184355 - DNA, 27 bp, Artificial Sequence
  Description of Artificial Sequence: Synthetic oligonucleotide
tttcctctccgcttgcaacctccggga

SEQ ID NO: 184356 - DNA, 26 bp, Artificial Sequence
  Description of Artificial Sequence: Synthetic oligonucleotide
ttcctctccgcttgcaacctccggga

SEQ ID NO: 184357 - DNA, 25 bp, Artificial Sequence
  Description of Artificial Sequence: Synthetic oligonucleotide
tcctctccgcttgcaacctccggga

SEQ ID NO: 184358 - DNA, 24 bp, Artificial Sequence
  Description of Artificial Sequence: Synthetic oligonucleotide
cctctccgcttgcaacctccggga

SEQ ID NO: 184359 - DNA, 24 bp, Artificial Sequence
  Description of Artificial Sequence: Synthetic oligonucleotide
ctctccgcttgcaacctccgggac

SEQ ID NO: 184360 - DNA, 26 bp, Artificial Sequence
  Description of Artificial Sequence: Synthetic oligonucleotide
tctccgcttgcaacctccgggaccat

SEQ ID NO: 184361 - DNA, 25 bp, Artificial Sequence
  Description of Artificial Sequence: Synthetic oligonucleotide
ctccgcttgcaacctccgggaccat

SEQ ID NO: 184362 - DNA, 27 bp, Artificial Sequence
  Description of Artificial Sequence: Synthetic oligonucleotide
tccgcttgcaacctccgggaccatctt

SEQ ID NO: 184363 - DNA, 26 bp, Artificial Sequence
  Description of Artificial Sequence: Synthetic oligonucleotide
ccgcttgcaacctccgggaccatctt

SEQ ID NO: 184364 - DNA, 27 bp, Artificial Sequence
  Description of Artificial Sequence: Synthetic oligonucleotide
cgcttgcaacctccgggaccatcttct

SEQ ID NO: 184365 - DNA, 27 bp, Artificial Sequence
  Description of Artificial Sequence: Synthetic oligonucleotide
gcttgcaacctccgggaccatcttctc

SEQ ID NO: 184366 - DNA, 27 bp, Artificial Sequence
  Description of Artificial Sequence: Synthetic oligonucleotide
cttgcaacctccgggaccatcttctcg

SEQ ID NO: 184367 - DNA, 27 bp, Artificial Sequence
  Description of Artificial Sequence: Synthetic oligonucleotide
ttgcaacctccgggaccatcttctcgg

SEQ ID NO: 184368 - DNA, 26 bp, Artificial Sequence
  Description of Artificial Sequence: Synthetic oligonucleotide
tgcaacctccgggaccatcttctcgg

SEQ ID NO: 184369 - DNA, 25 bp, Artificial Sequence
  Description of Artificial Sequence: Synthetic oligonucleotide
gcaacctccgggaccatcttctcgg

SEQ ID NO: 184370 - DNA, 25 bp, Artificial Sequence
  Description of Artificial Sequence: Synthetic oligonucleotide
caacctccgggaccatcttctcggc

SEQ ID NO: 184371 - DNA, 35 bp, Artificial Sequence
  Description of Artificial Sequence: Synthetic oligonucleotide
aacctttgatgaggaggaaggtcgggatgaatatg

SEQ ID NO: 184372 - DNA, 34 bp, Artificial Sequence
  Description of Artificial Sequence: Synthetic oligonucleotide
acctttgatgaggaggaaggtcgggatgaatatg

SEQ ID NO: 184373 - DNA, 33 bp, Artificial Sequence
  Description of Artificial Sequence: Synthetic oligonucleotide
cctttgatgaggaggaaggtcgggatgaatatg

SEQ ID NO: 184374 - DNA, 34 bp, Artificial Sequence
  Description of Artificial Sequence: Synthetic oligonucleotide
ctttgatgaggaggaaggtcgggatgaatatgac

SEQ ID NO: 184375 - DNA, 34 bp, Artificial Sequence
  Description of Artificial Sequence: Synthetic oligonucleotide
tttgatgaggaggaaggtcgggatgaatatgacg

SEQ ID NO: 184376 - DNA, 33 bp, Artificial Sequence
  Description of Artificial Sequence: Synthetic oligonucleotide
ttgatgaggaggaaggtcgggatgaatatgacg

SEQ ID NO: 184377 - DNA, 32 bp, Artificial Sequence
  Description of Artificial Sequence: Synthetic oligonucleotide
tgatgaggaggaaggtcgggatgaatatgacg

SEQ ID NO: 184378 - DNA, 31 bp, Artificial Sequence
  Description of Artificial Sequence: Synthetic oligonucleotide
gatgaggaggaaggtcgggatgaatatgacg

SEQ ID NO: 184379 - DNA, 33 bp, Artificial Sequence
  Description of Artificial Sequence: Synthetic oligonucleotide
atgaggaggaaggtcgggatgaatatgacgaag

SEQ ID NO: 184380 - DNA, 32 bp, Artificial Sequence
  Description of Artificial Sequence: Synthetic oligonucleotide
tgaggaggaaggtcgggatgaatatgacgaag

SEQ ID NO: 184381 - DNA, 31 bp, Artificial Sequence
  Description of Artificial Sequence: Synthetic oligonucleotide
gaggaggaaggtcgggatgaatatgacgaag

SEQ ID NO: 184382 - DNA, 32 bp, Artificial Sequence
  Description of Artificial Sequence: Synthetic oligonucleotide
aggaggaaggtcgggatgaatatgacgaagtg

SEQ ID NO: 184383 - DNA, 31 bp, Artificial Sequence
  Description of Artificial Sequence: Synthetic oligonucleotide
ggaggaaggtcgggatgaatatgacgaagtg

SEQ ID NO: 184384 - DNA, 31 bp, Artificial Sequence
  Description of Artificial Sequence: Synthetic oligonucleotide
gaggaaggtcgggatgaatatgacgaagtgg

SEQ ID NO: 184385 - DNA, 31 bp, Artificial Sequence
  Description of Artificial Sequence: Synthetic oligonucleotide
aggaaggtcgggatgaatatgacgaagtggc

SEQ ID NO: 184386 - DNA, 30 bp, Artificial Sequence
  Description of Artificial Sequence: Synthetic oligonucleotide
ggaaggtcgggatgaatatgacgaagtggc

SEQ ID NO: 184387 - DNA, 30 bp, Artificial Sequence
  Description of Artificial Sequence: Synthetic oligonucleotide
gaaggtcgggatgaatatgacgaagtggcc

SEQ ID NO: 184388 - DNA, 32 bp, Artificial Sequence
  Description of Artificial Sequence: Synthetic oligonucleotide
aaggtcgggatgaatatgacgaagtggccatg

SEQ ID NO: 184389 - DNA, 31 bp, Artificial Sequence
  Description of Artificial Sequence: Synthetic oligonucleotide
aggtcgggatgaatatgacgaagtggccatg

SEQ ID NO: 184390 - DNA, 30 bp, Artificial Sequence
  Description of Artificial Sequence: Synthetic oligonucleotide
ggtcgggatgaatatgacgaagtggccatg

SEQ ID NO: 184391 - DNA, 30 bp, Artificial Sequence
  Description of Artificial Sequence: Synthetic oligonucleotide
gtcgggatgaatatgacgaagtggccatgc

SEQ ID NO: 184392 - DNA, 30 bp, Artificial Sequence
  Description of Artificial Sequence: Synthetic oligonucleotide
tcgggatgaatatgacgaagtggccatgcc

SEQ ID NO: 184393 - DNA, 29 bp, Artificial Sequence
  Description of Artificial Sequence: Synthetic oligonucleotide
cgggatgaatatgacgaagtggccatgcc

SEQ ID NO: 184394 - DNA, 30 bp, Artificial Sequence
  Description of Artificial Sequence: Synthetic oligonucleotide
gggatgaatatgacgaagtggccatgcctg

SEQ ID NO: 184395 - DNA, 31 bp, Artificial Sequence
  Description of Artificial Sequence: Synthetic oligonucleotide
ggatgaatatgacgaagtggccatgcctgtg

SEQ ID NO: 184396 - DNA, 32 bp, Artificial Sequence
  Description of Artificial Sequence: Synthetic oligonucleotide
gatgaatatgacgaagtggccatgcctgtgtg

SEQ ID NO: 184397 - DNA, 32 bp, Artificial Sequence
  Description of Artificial Sequence: Synthetic oligonucleotide
agcaggaggaatatgaagacccagacatccac

SEQ ID NO: 184398 - DNA, 31 bp, Artificial Sequence
  Description of Artificial Sequence: Synthetic oligonucleotide
gcaggaggaatatgaagacccagacatccac

SEQ ID NO: 184399 - DNA, 31 bp, Artificial Sequence
  Description of Artificial Sequence: Synthetic oligonucleotide
caggaggaatatgaagacccagacatccacg

SEQ ID NO: 184400 - DNA, 32 bp, Artificial Sequence
  Description of Artificial Sequence: Synthetic oligonucleotide
aggaggaatatgaagacccagacatccacgag

SEQ ID NO: 184401 - DNA, 31 bp, Artificial Sequence
  Description of Artificial Sequence: Synthetic oligonucleotide
ggaggaatatgaagacccagacatccacgag

SEQ ID NO: 184402 - DNA, 32 bp, Artificial Sequence
  Description of Artificial Sequence: Synthetic oligonucleotide
gaggaatatgaagacccagacatccacgagtc

SEQ ID NO: 184403 - DNA, 32 bp, Artificial Sequence
  Description of Artificial Sequence: Synthetic oligonucleotide
aggaatatgaagacccagacatccacgagtcc

SEQ ID NO: 184404 - DNA, 31 bp, Artificial Sequence
  Description of Artificial Sequence: Synthetic oligonucleotide
ggaatatgaagacccagacatccacgagtcc

SEQ ID NO: 184405 - DNA, 31 bp, Artificial Sequence
  Description of Artificial Sequence: Synthetic oligonucleotide
gaatatgaagacccagacatccacgagtccc

SEQ ID NO: 184406 - DNA, 32 bp, Artificial Sequence
  Description of Artificial Sequence: Synthetic oligonucleotide
aatatgaagacccagacatccacgagtcccag

SEQ ID NO: 184407 - DNA, 31 bp, Artificial Sequence
  Description of Artificial Sequence: Synthetic oligonucleotide
atatgaagacccagacatccacgagtcccag

SEQ ID NO: 184408 - DNA, 30 bp, Artificial Sequence
  Description of Artificial Sequence: Synthetic oligonucleotide
tatgaagacccagacatccacgagtcccag

SEQ ID NO: 184409 - DNA, 29 bp, Artificial Sequence
  Description of Artificial Sequence: Synthetic oligonucleotide
atgaagacccagacatccacgagtcccag

SEQ ID NO: 184410 - DNA, 28 bp, Artificial Sequence
  Description of Artificial Sequence: Synthetic oligonucleotide
tgaagacccagacatccacgagtcccag

SEQ ID NO: 184411 - DNA, 27 bp, Artificial Sequence
  Description of Artificial Sequence: Synthetic oligonucleotide
gaagacccagacatccacgagtcccag

SEQ ID NO: 184412 - DNA, 29 bp, Artificial Sequence
  Description of Artificial Sequence: Synthetic oligonucleotide
aagacccagacatccacgagtcccagatg

SEQ ID NO: 184413 - DNA, 28 bp, Artificial Sequence
  Description of Artificial Sequence: Synthetic oligonucleotide
agacccagacatccacgagtcccagatg

SEQ ID NO: 184414 - DNA, 27 bp, Artificial Sequence
  Description of Artificial Sequence: Synthetic oligonucleotide
gacccagacatccacgagtcccagatg

SEQ ID NO: 184415 - DNA, 27 bp, Artificial Sequence
  Description of Artificial Sequence: Synthetic oligonucleotide
acccagacatccacgagtcccagatgg

SEQ ID NO: 184416 - DNA, 27 bp, Artificial Sequence
  Description of Artificial Sequence: Synthetic oligonucleotide
cccagacatccacgagtcccagatgga

SEQ ID NO: 184417 - DNA, 27 bp, Artificial Sequence
  Description of Artificial Sequence: Synthetic oligonucleotide
ccagacatccacgagtcccagatggag

SEQ ID NO: 184418 - DNA, 27 bp, Artificial Sequence
  Description of Artificial Sequence: Synthetic oligonucleotide
cagacatccacgagtcccagatggagg

SEQ ID NO: 184419 - DNA, 28 bp, Artificial Sequence
  Description of Artificial Sequence: Synthetic oligonucleotide
agacatccacgagtcccagatggaggag

SEQ ID NO: 184420 - DNA, 27 bp, Artificial Sequence
  Description of Artificial Sequence: Synthetic oligonucleotide
gacatccacgagtcccagatggaggag

SEQ ID NO: 184421 - DNA, 27 bp, Artificial Sequence
  Description of Artificial Sequence: Synthetic oligonucleotide
acatccacgagtcccagatggaggagc

SEQ ID NO: 184422 - DNA, 26 bp, Artificial Sequence
  Description of Artificial Sequence: Synthetic oligonucleotide
catccacgagtcccagatggaggagc

SEQ ID NO: 184423 - DNA, 26 bp, Artificial Sequence
  Description of Artificial Sequence: Synthetic oligonucleotide
atccacgagtcccagatggaggagcc

SEQ ID NO: 184424 - DNA, 25 bp, Artificial Sequence
  Description of Artificial Sequence: Synthetic oligonucleotide
tccacgagtcccagatggaggagcc

SEQ ID NO: 184425 - DNA, 24 bp, Artificial Sequence
  Description of Artificial Sequence: Synthetic oligonucleotide
ccacgagtcccagatggaggagcc

SEQ ID NO: 184426 - DNA, 24 bp, Artificial Sequence
  Description of Artificial Sequence: Synthetic oligonucleotide
cacgagtcccagatggaggagccg

SEQ ID NO: 184427 - DNA, 24 bp, Artificial Sequence
  Description of Artificial Sequence: Synthetic oligonucleotide
acgagtcccagatggaggagccgg

SEQ ID NO: 184428 - DNA, 24 bp, Artificial Sequence
  Description of Artificial Sequence: Synthetic oligonucleotide
agatggaggagccggcagctcacg

SEQ ID NO: 184429 - DNA, 23 bp, Artificial Sequence
  Description of Artificial Sequence: Synthetic oligonucleotide
gatggaggagccggcagctcacg

SEQ ID NO: 184430 - DNA, 23 bp, Artificial Sequence
  Description of Artificial Sequence: Synthetic oligonucleotide
atggaggagccggcagctcacgc

SEQ ID NO: 184431 - DNA, 22 bp, Artificial Sequence
  Description of Artificial Sequence: Synthetic oligonucleotide
tggaggagccggcagctcacgc

SEQ ID NO: 184432 - DNA, 21 bp, Artificial Sequence
  Description of Artificial Sequence: Synthetic oligonucleotide
ggaggagccggcagctcacgc

SEQ ID NO: 184433 - DNA, 22 bp, Artificial Sequence
  Description of Artificial Sequence: Synthetic oligonucleotide
gaggagccggcagctcacgcca

SEQ ID NO: 184434 - DNA, 22 bp, Artificial Sequence
  Description of Artificial Sequence: Synthetic oligonucleotide
aggagccggcagctcacgccac

SEQ ID NO: 184435 - DNA, 21 bp, Artificial Sequence
  Description of Artificial Sequence: Synthetic oligonucleotide
ggagccggcagctcacgccac

SEQ ID NO: 184436 - DNA, 21 bp, Artificial Sequence
  Description of Artificial Sequence: Synthetic oligonucleotide
gagccggcagctcacgccacc

SEQ ID NO: 184437 - DNA, 22 bp, Artificial Sequence
  Description of Artificial Sequence: Synthetic oligonucleotide
agccggcagctcacgccaccga

SEQ ID NO: 184438 - DNA, 21 bp, Artificial Sequence
  Description of Artificial Sequence: Synthetic oligonucleotide
gccggcagctcacgccaccga

SEQ ID NO: 184439 - DNA, 21 bp, Artificial Sequence
  Description of Artificial Sequence: Synthetic oligonucleotide
ccggcagctcacgccaccgag

SEQ ID NO: 184440 - DNA, 21 bp, Artificial Sequence
  Description of Artificial Sequence: Synthetic oligonucleotide
cggcagctcacgccaccgagg

SEQ ID NO: 184441 - DNA, 23 bp, Artificial Sequence
  Description of Artificial Sequence: Synthetic oligonucleotide
ggcagctcacgccaccgaggcaa

SEQ ID NO: 184442 - DNA, 24 bp, Artificial Sequence
  Description of Artificial Sequence: Synthetic oligonucleotide
gcagctcacgccaccgaggcaaca

SEQ ID NO: 184443 - DNA, 24 bp, Artificial Sequence
  Description of Artificial Sequence: Synthetic oligonucleotide
cagctcacgccaccgaggcaacag

SEQ ID NO: 184444 - DNA, 24 bp, Artificial Sequence
  Description of Artificial Sequence: Synthetic oligonucleotide
agctcacgccaccgaggcaacagc

SEQ ID NO: 184445 - DNA, 23 bp, Artificial Sequence
  Description of Artificial Sequence: Synthetic oligonucleotide
gctcacgccaccgaggcaacagc

SEQ ID NO: 184446 - DNA, 24 bp, Artificial Sequence
  Description of Artificial Sequence: Synthetic oligonucleotide
ctcacgccaccgaggcaacagcca

SEQ ID NO: 184447 - DNA, 25 bp, Artificial Sequence
  Description of Artificial Sequence: Synthetic oligonucleotide
tcacgccaccgaggcaacagccaca

SEQ ID NO: 184448 - DNA, 24 bp, Artificial Sequence
  Description of Artificial Sequence: Synthetic oligonucleotide
cacgccaccgaggcaacagccaca

SEQ ID NO: 184449 - DNA, 25 bp, Artificial Sequence
  Description of Artificial Sequence: Synthetic oligonucleotide
acgccaccgaggcaacagccacaga

SEQ ID NO: 184450 - DNA, 24 bp, Artificial Sequence
  Description of Artificial Sequence: Synthetic oligonucleotide
cgccaccgaggcaacagccacaga

SEQ ID NO: 184451 - DNA, 26 bp, Artificial Sequence
  Description of Artificial Sequence: Synthetic oligonucleotide
gccaccgaggcaacagccacagacta

SEQ ID NO: 184452 - DNA, 26 bp, Artificial Sequence
  Description of Artificial Sequence: Synthetic oligonucleotide
ccaccgaggcaacagccacagactac

SEQ ID NO: 184453 - DNA, 31 bp, Artificial Sequence
  Description of Artificial Sequence: Synthetic oligonucleotide
ctgcgtagagtcttcaccaagggtactgttc

SEQ ID NO: 184454 - DNA, 32 bp, Artificial Sequence
  Description of Artificial Sequence: Synthetic oligonucleotide
tgcgtagagtcttcaccaagggtactgttctc

SEQ ID NO: 184455 - DNA, 31 bp, Artificial Sequence
  Description of Artificial Sequence: Synthetic oligonucleotide
gcgtagagtcttcaccaagggtactgttctc

SEQ ID NO: 184456 - DNA, 31 bp, Artificial Sequence
  Description of Artificial Sequence: Synthetic oligonucleotide
cgtagagtcttcaccaagggtactgttctcc

SEQ ID NO: 184457 - DNA, 33 bp, Artificial Sequence
  Description of Artificial Sequence: Synthetic oligonucleotide
gtagagtcttcaccaagggtactgttctcctag

SEQ ID NO: 184458 - DNA, 34 bp, Artificial Sequence
  Description of Artificial Sequence: Synthetic oligonucleotide
tagagtcttcaccaagggtactgttctcctagac

SEQ ID NO: 184459 - DNA, 33 bp, Artificial Sequence
  Description of Artificial Sequence: Synthetic oligonucleotide
agagtcttcaccaagggtactgttctcctagac

SEQ ID NO: 184460 - DNA, 32 bp, Artificial Sequence
  Description of Artificial Sequence: Synthetic oligonucleotide
gagtcttcaccaagggtactgttctcctagac

SEQ ID NO: 184461 - DNA, 32 bp, Artificial Sequence
  Description of Artificial Sequence: Synthetic oligonucleotide
agtcttcaccaagggtactgttctcctagacc

SEQ ID NO: 184462 - DNA, 31 bp, Artificial Sequence
  Description of Artificial Sequence: Synthetic oligonucleotide
gtcttcaccaagggtactgttctcctagacc

SEQ ID NO: 184463 - DNA, 32 bp, Artificial Sequence
  Description of Artificial Sequence: Synthetic oligonucleotide
tcttcaccaagggtactgttctcctagacctg

SEQ ID NO: 184464 - DNA, 31 bp, Artificial Sequence
  Description of Artificial Sequence: Synthetic oligonucleotide
cttcaccaagggtactgttctcctagacctg

SEQ ID NO: 184465 - DNA, 31 bp, Artificial Sequence
  Description of Artificial Sequence: Synthetic oligonucleotide
ttcaccaagggtactgttctcctagacctgc

SEQ ID NO: 184466 - DNA, 30 bp, Artificial Sequence
  Description of Artificial Sequence: Synthetic oligonucleotide
tcaccaagggtactgttctcctagacctgc

SEQ ID NO: 184467 - DNA, 29 bp, Artificial Sequence
  Description of Artificial Sequence: Synthetic oligonucleotide
caccaagggtactgttctcctagacctgc

SEQ ID NO: 184468 - DNA, 31 bp, Artificial Sequence
  Description of Artificial Sequence: Synthetic oligonucleotide
accaagggtactgttctcctagacctgcaag

SEQ ID NO: 184469 - DNA, 30 bp, Artificial Sequence
  Description of Artificial Sequence: Synthetic oligonucleotide
ccaagggtactgttctcctagacctgcaag

SEQ ID NO: 184470 - DNA, 31 bp, Artificial Sequence
  Description of Artificial Sequence: Synthetic oligonucleotide
caagggtactgttctcctagacctgcaagag

SEQ ID NO: 184471 - DNA, 32 bp, Artificial Sequence
  Description of Artificial Sequence: Synthetic oligonucleotide
aagggtactgttctcctagacctgcaagagac

SEQ ID NO: 184472 - DNA, 31 bp, Artificial Sequence
  Description of Artificial Sequence: Synthetic oligonucleotide
agggtactgttctcctagacctgcaagagac

SEQ ID NO: 184473 - DNA, 30 bp, Artificial Sequence
  Description of Artificial Sequence: Synthetic oligonucleotide
gggtactgttctcctagacctgcaagagac

SEQ ID NO: 184474 - DNA, 30 bp, Artificial Sequence
  Description of Artificial Sequence: Synthetic oligonucleotide
ggtactgttctcctagacctgcaagagacc

SEQ ID NO: 184475 - DNA, 31 bp, Artificial Sequence
  Description of Artificial Sequence: Synthetic oligonucleotide
gtactgttctcctagacctgcaagagacctc

SEQ ID NO: 184476 - DNA, 31 bp, Artificial Sequence
  Description of Artificial Sequence: Synthetic oligonucleotide
tactgttctcctagacctgcaagagacctcc

SEQ ID NO: 184477 - DNA, 30 bp, Artificial Sequence
  Description of Artificial Sequence: Synthetic oligonucleotide
actgttctcctagacctgcaagagacctcc

SEQ ID NO: 184478 - DNA, 29 bp, Artificial Sequence
  Description of Artificial Sequence: Synthetic oligonucleotide
ctgttctcctagacctgcaagagacctcc

SEQ ID NO: 184479 - DNA, 29 bp, Artificial Sequence
  Description of Artificial Sequence: Synthetic oligonucleotide
tgttctcctagacctgcaagagacctccc

SEQ ID NO: 184480 - DNA, 28 bp, Artificial Sequence
  Description of Artificial Sequence: Synthetic oligonucleotide
gttctcctagacctgcaagagacctccc

SEQ ID NO: 184481 - DNA, 29 bp, Artificial Sequence
  Description of Artificial Sequence: Synthetic oligonucleotide
ttctcctagacctgcaagagacctccctg

SEQ ID NO: 184482 - DNA, 28 bp, Artificial Sequence
  Description of Artificial Sequence: Synthetic oligonucleotide
tctcctagacctgcaagagacctccctg

SEQ ID NO: 184483 - DNA, 29 bp, Artificial Sequence
  Description of Artificial Sequence: Synthetic oligonucleotide
agcccagatccaggaggtcaaagagcatc

SEQ ID NO: 184484 - DNA, 28 bp, Artificial Sequence
  Description of Artificial Sequence: Synthetic oligonucleotide
gcccagatccaggaggtcaaagagcatc

SEQ ID NO: 184485 - DNA, 28 bp, Artificial Sequence
  Description of Artificial Sequence: Synthetic oligonucleotide
cccagatccaggaggtcaaagagcatcg

SEQ ID NO: 184486 - DNA, 28 bp, Artificial Sequence
  Description of Artificial Sequence: Synthetic oligonucleotide
ccagatccaggaggtcaaagagcatcgg

SEQ ID NO: 184487 - DNA, 30 bp, Artificial Sequence
  Description of Artificial Sequence: Synthetic oligonucleotide
cagatccaggaggtcaaagagcatcggatc

SEQ ID NO: 184488 - DNA, 31 bp, Artificial Sequence
  Description of Artificial Sequence: Synthetic oligonucleotide
agatccaggaggtcaaagagcatcggatcag

SEQ ID NO: 184489 - DNA, 30 bp, Artificial Sequence
  Description of Artificial Sequence: Synthetic oligonucleotide
gatccaggaggtcaaagagcatcggatcag

SEQ ID NO: 184490 - DNA, 31 bp, Artificial Sequence
  Description of Artificial Sequence: Synthetic oligonucleotide
atccaggaggtcaaagagcatcggatcagtg

SEQ ID NO: 184491 - DNA, 30 bp, Artificial Sequence
  Description of Artificial Sequence: Synthetic oligonucleotide
tccaggaggtcaaagagcatcggatcagtg

SEQ ID NO: 184492 - DNA, 29 bp, Artificial Sequence
  Description of Artificial Sequence: Synthetic oligonucleotide
ccaggaggtcaaagagcatcggatcagtg

SEQ ID NO: 184493 - DNA, 29 bp, Artificial Sequence
  Description of Artificial Sequence: Synthetic oligonucleotide
caggaggtcaaagagcatcggatcagtgg

SEQ ID NO: 184494 - DNA, 30 bp, Artificial Sequence
  Description of Artificial Sequence: Synthetic oligonucleotide
aggaggtcaaagagcatcggatcagtggac

SEQ ID NO: 184495 - DNA, 29 bp, Artificial Sequence
  Description of Artificial Sequence: Synthetic oligonucleotide
ggaggtcaaagagcatcggatcagtggac

SEQ ID NO: 184496 - DNA, 30 bp, Artificial Sequence
  Description of Artificial Sequence: Synthetic oligonucleotide
gaggtcaaagagcatcggatcagtggactc

SEQ ID NO: 184497 - DNA, 30 bp, Artificial Sequence
  Description of Artificial Sequence: Synthetic oligonucleotide
aggtcaaagagcatcggatcagtggactcc

SEQ ID NO: 184498 - DNA, 29 bp, Artificial Sequence
  Description of Artificial Sequence: Synthetic oligonucleotide
ggtcaaagagcatcggatcagtggactcc

SEQ ID NO: 184499 - DNA, 30 bp, Artificial Sequence
  Description of Artificial Sequence: Synthetic oligonucleotide
gtcaaagagcatcggatcagtggactcctg

SEQ ID NO: 184500 - DNA, 30 bp, Artificial Sequence
  Description of Artificial Sequence: Synthetic oligonucleotide
tcaaagagcatcggatcagtggactcctgg

SEQ ID NO: 184501 - DNA, 29 bp, Artificial Sequence
  Description of Artificial Sequence: Synthetic oligonucleotide
caaagagcatcggatcagtggactcctgg

SEQ ID NO: 184502 - DNA, 30 bp, Artificial Sequence
  Description of Artificial Sequence: Synthetic oligonucleotide
aaagagcatcggatcagtggactcctggtc

SEQ ID NO: 184503 - DNA, 29 bp, Artificial Sequence
  Description of Artificial Sequence: Synthetic oligonucleotide
aagagcatcggatcagtggactcctggtc

SEQ ID NO: 184504 - DNA, 28 bp, Artificial Sequence
  Description of Artificial Sequence: Synthetic oligonucleotide
agagcatcggatcagtggactcctggtc

SEQ ID NO: 184505 - DNA, 27 bp, Artificial Sequence
  Description of Artificial Sequence: Synthetic oligonucleotide
gagcatcggatcagtggactcctggtc

SEQ ID NO: 184506 - DNA, 27 bp, Artificial Sequence
  Description of Artificial Sequence: Synthetic oligonucleotide
agcatcggatcagtggactcctggtcg

SEQ ID NO: 184507 - DNA, 26 bp, Artificial Sequence
  Description of Artificial Sequence: Synthetic oligonucleotide
gcatcggatcagtggactcctggtcg

SEQ ID NO: 184508 - DNA, 27 bp, Artificial Sequence
  Description of Artificial Sequence: Synthetic oligonucleotide
catcggatcagtggactcctggtcgct

SEQ ID NO: 184509 - DNA, 27 bp, Artificial Sequence
  Description of Artificial Sequence: Synthetic oligonucleotide
atcggatcagtggactcctggtcgctg

SEQ ID NO: 184510 - DNA, 27 bp, Artificial Sequence
  Description of Artificial Sequence: Synthetic oligonucleotide
tcggatcagtggactcctggtcgctgt

SEQ ID NO: 184511 - DNA, 29 bp, Artificial Sequence
  Description of Artificial Sequence: Synthetic oligonucleotide
tgagacactgtgctgacgggctcattgag

SEQ ID NO: 184512 - DNA, 28 bp, Artificial Sequence
  Description of Artificial Sequence: Synthetic oligonucleotide
gagacactgtgctgacgggctcattgag

SEQ ID NO: 184513 - DNA, 28 bp, Artificial Sequence
  Description of Artificial Sequence: Synthetic oligonucleotide
agacactgtgctgacgggctcattgagc

SEQ ID NO: 184514 - DNA, 27 bp, Artificial Sequence
  Description of Artificial Sequence: Synthetic oligonucleotide
gacactgtgctgacgggctcattgagc

SEQ ID NO: 184515 - DNA, 28 bp, Artificial Sequence
  Description of Artificial Sequence: Synthetic oligonucleotide
acactgtgctgacgggctcattgagctc

SEQ ID NO: 184516 - DNA, 27 bp, Artificial Sequence
  Description of Artificial Sequence: Synthetic oligonucleotide
cactgtgctgacgggctcattgagctc

SEQ ID NO: 184517 - DNA, 28 bp, Artificial Sequence
  Description of Artificial Sequence: Synthetic oligonucleotide
actgtgctgacgggctcattgagctcac

SEQ ID NO: 184518 - DNA, 27 bp, Artificial Sequence
  Description of Artificial Sequence: Synthetic oligonucleotide
ctgtgctgacgggctcattgagctcac

SEQ ID NO: 184519 - DNA, 27 bp, Artificial Sequence
  Description of Artificial Sequence: Synthetic oligonucleotide
tgtgctgacgggctcattgagctcacg

SEQ ID NO: 184520 - DNA, 27 bp, Artificial Sequence
  Description of Artificial Sequence: Synthetic oligonucleotide
gtgctgacgggctcattgagctcacga

SEQ ID NO: 184521 - DNA, 27 bp, Artificial Sequence
  Description of Artificial Sequence: Synthetic oligonucleotide
tgctgacgggctcattgagctcacgac

SEQ ID NO: 184522 - DNA, 27 bp, Artificial Sequence
  Description of Artificial Sequence: Synthetic oligonucleotide
gctgacgggctcattgagctcacgaca

SEQ ID NO: 184523 - DNA, 27 bp, Artificial Sequence
  Description of Artificial Sequence: Synthetic oligonucleotide
ctgacgggctcattgagctcacgacac

SEQ ID NO: 184524 - DNA, 27 bp, Artificial Sequence
  Description of Artificial Sequence: Synthetic oligonucleotide
tgacgggctcattgagctcacgacacc

SEQ ID NO: 184525 - DNA, 26 bp, Artificial Sequence
  Description of Artificial Sequence: Synthetic oligonucleotide
gacgggctcattgagctcacgacacc

SEQ ID NO: 184526 - DNA, 27 bp, Artificial Sequence
  Description of Artificial Sequence: Synthetic oligonucleotide
acgggctcattgagctcacgacaccga

SEQ ID NO: 184527 - DNA, 26 bp, Artificial Sequence
  Description of Artificial Sequence: Synthetic oligonucleotide
cgggctcattgagctcacgacaccga

SEQ ID NO: 184528 - DNA, 26 bp, Artificial Sequence
  Description of Artificial Sequence: Synthetic oligonucleotide
gggctcattgagctcacgacaccgag

SEQ ID NO: 184529 - DNA, 26 bp, Artificial Sequence
  Description of Artificial Sequence: Synthetic oligonucleotide
ggctcattgagctcacgacaccgagg

SEQ ID NO: 184530 - DNA, 27 bp, Artificial Sequence
  Description of Artificial Sequence: Synthetic oligonucleotide
gctcattgagctcacgacaccgaggca

SEQ ID NO: 184531 - DNA, 28 bp, Artificial Sequence
  Description of Artificial Sequence: Synthetic oligonucleotide
ctcattgagctcacgacaccgaggcaac

SEQ ID NO: 184532 - DNA, 29 bp, Artificial Sequence
  Description of Artificial Sequence: Synthetic oligonucleotide
tcattgagctcacgacaccgaggcaacag

SEQ ID NO: 184533 - DNA, 28 bp, Artificial Sequence
  Description of Artificial Sequence: Synthetic oligonucleotide
cattgagctcacgacaccgaggcaacag

SEQ ID NO: 184534 - DNA, 28 bp, Artificial Sequence
  Description of Artificial Sequence: Synthetic oligonucleotide
attgagctcacgacaccgaggcaacagc

SEQ ID NO: 184535 - DNA, 27 bp, Artificial Sequence
  Description of Artificial Sequence: Synthetic oligonucleotide
ttgagctcacgacaccgaggcaacagc

SEQ ID NO: 184536 - DNA, 26 bp, Artificial Sequence
  Description of Artificial Sequence: Synthetic oligonucleotide
tgagctcacgacaccgaggcaacagc

SEQ ID NO: 184537 - DNA, 25 bp, Artificial Sequence
  Description of Artificial Sequence: Synthetic oligonucleotide
gagctcacgacaccgaggcaacagc

SEQ ID NO: 184538 - DNA, 26 bp, Artificial Sequence
  Description of Artificial Sequence: Synthetic oligonucleotide
acaccacatcacacccgggtacccac

SEQ ID NO: 184539 - DNA, 25 bp, Artificial Sequence
  Description of Artificial Sequence: Synthetic oligonucleotide
caccacatcacacccgggtacccac

SEQ ID NO: 184540 - DNA, 26 bp, Artificial Sequence
  Description of Artificial Sequence: Synthetic oligonucleotide
accacatcacacccgggtacccacga

SEQ ID NO: 184541 - DNA, 25 bp, Artificial Sequence
  Description of Artificial Sequence: Synthetic oligonucleotide
ccacatcacacccgggtacccacga

SEQ ID NO: 184542 - DNA, 25 bp, Artificial Sequence
  Description of Artificial Sequence: Synthetic oligonucleotide
cacatcacacccgggtacccacgag

SEQ ID NO: 184543 - DNA, 26 bp, Artificial Sequence
  Description of Artificial Sequence: Synthetic oligonucleotide
acatcacacccgggtacccacgaggt

SEQ ID NO: 184544 - DNA, 25 bp, Artificial Sequence
  Description of Artificial Sequence: Synthetic oligonucleotide
catcacacccgggtacccacgaggt

SEQ ID NO: 184545 - DNA, 27 bp, Artificial Sequence
  Description of Artificial Sequence: Synthetic oligonucleotide
atcacacccgggtacccacgaggtcta

SEQ ID NO: 184546 - DNA, 27 bp, Artificial Sequence
  Description of Artificial Sequence: Synthetic oligonucleotide
tcacacccgggtacccacgaggtctat

SEQ ID NO: 184547 - DNA, 26 bp, Artificial Sequence
  Description of Artificial Sequence: Synthetic oligonucleotide
cacacccgggtacccacgaggtctat

SEQ ID NO: 184548 - DNA, 27 bp, Artificial Sequence
  Description of Artificial Sequence: Synthetic oligonucleotide
acacccgggtacccacgaggtctatgt

SEQ ID NO: 184549 - DNA, 26 bp, Artificial Sequence
  Description of Artificial Sequence: Synthetic oligonucleotide
cacccgggtacccacgaggtctatgt

SEQ ID NO: 184550 - DNA, 26 bp, Artificial Sequence
  Description of Artificial Sequence: Synthetic oligonucleotide
acccgggtacccacgaggtctatgtg

SEQ ID NO: 184551 - DNA, 25 bp, Artificial Sequence
  Description of Artificial Sequence: Synthetic oligonucleotide
cccgggtacccacgaggtctatgtg

SEQ ID NO: 184552 - DNA, 26 bp, Artificial Sequence
  Description of Artificial Sequence: Synthetic oligonucleotide
ccgggtacccacgaggtctatgtgga

SEQ ID NO: 184553 - DNA, 26 bp, Artificial Sequence
  Description of Artificial Sequence: Synthetic oligonucleotide
cgggtacccacgaggtctatgtggag

SEQ ID NO: 184554 - DNA, 27 bp, Artificial Sequence
  Description of Artificial Sequence: Synthetic oligonucleotide
gggtacccacgaggtctatgtggagct

SEQ ID NO: 184555 - DNA, 27 bp, Artificial Sequence
  Description of Artificial Sequence: Synthetic oligonucleotide
ggtacccacgaggtctatgtggagctg

SEQ ID NO: 184556 - DNA, 27 bp, Artificial Sequence
  Description of Artificial Sequence: Synthetic oligonucleotide
gtacccacgaggtctatgtggagctgc

SEQ ID NO: 184557 - DNA, 28 bp, Artificial Sequence
  Description of Artificial Sequence: Synthetic oligonucleotide
tacccacgaggtctatgtggagctgcag

SEQ ID NO: 184558 - DNA, 27 bp, Artificial Sequence
  Description of Artificial Sequence: Synthetic oligonucleotide
acccacgaggtctatgtggagctgcag

SEQ ID NO: 184559 - DNA, 26 bp, Artificial Sequence
  Description of Artificial Sequence: Synthetic oligonucleotide
cccacgaggtctatgtggagctgcag

SEQ ID NO: 184560 - DNA, 27 bp, Artificial Sequence
  Description of Artificial Sequence: Synthetic oligonucleotide
ccacgaggtctatgtggagctgcagga

SEQ ID NO: 184561 - DNA, 27 bp, Artificial Sequence
  Description of Artificial Sequence: Synthetic oligonucleotide
cacgaggtctatgtggagctgcaggag

SEQ ID NO: 184562 - DNA, 27 bp, Artificial Sequence
  Description of Artificial Sequence: Synthetic oligonucleotide
acgaggtctatgtggagctgcaggagc

SEQ ID NO: 184563 - DNA, 27 bp, Artificial Sequence
  Description of Artificial Sequence: Synthetic oligonucleotide
cgaggtctatgtggagctgcaggagct

SEQ ID NO: 184564 - DNA, 27 bp, Artificial Sequence
  Description of Artificial Sequence: Synthetic oligonucleotide
gaggtctatgtggagctgcaggagctg

SEQ ID NO: 184565 - DNA, 26 bp, Artificial Sequence
  Description of Artificial Sequence: Synthetic oligonucleotide
ccggattcagaggccacgttggtgct

SEQ ID NO: 184566 - DNA, 26 bp, Artificial Sequence
  Description of Artificial Sequence: Synthetic oligonucleotide
cggattcagaggccacgttggtgctc

SEQ ID NO: 184567 - DNA, 27 bp, Artificial Sequence
  Description of Artificial Sequence: Synthetic oligonucleotide
ggattcagaggccacgttggtgctcgt

SEQ ID NO: 184568 - DNA, 27 bp, Artificial Sequence
  Description of Artificial Sequence: Synthetic oligonucleotide
gattcagaggccacgttggtgctcgtg

SEQ ID NO: 184569 - DNA, 27 bp, Artificial Sequence
  Description of Artificial Sequence: Synthetic oligonucleotide
attcagaggccacgttggtgctcgtgg

SEQ ID NO: 184570 - DNA, 26 bp, Artificial Sequence
  Description of Artificial Sequence: Synthetic oligonucleotide
ttcagaggccacgttggtgctcgtgg

SEQ ID NO: 184571 - DNA, 25 bp, Artificial Sequence
  Description of Artificial Sequence: Synthetic oligonucleotide
tcagaggccacgttggtgctcgtgg

SEQ ID NO: 184572 - DNA, 24 bp, Artificial Sequence
  Description of Artificial Sequence: Synthetic oligonucleotide
cagaggccacgttggtgctcgtgg

SEQ ID NO: 184573 - DNA, 24 bp, Artificial Sequence
  Description of Artificial Sequence: Synthetic oligonucleotide
agaggccacgttggtgctcgtggg

SEQ ID NO: 184574 - DNA, 23 bp, Artificial Sequence
  Description of Artificial Sequence: Synthetic oligonucleotide
gaggccacgttggtgctcgtggg

SEQ ID NO: 184575 - DNA, 23 bp, Artificial Sequence
  Description of Artificial Sequence: Synthetic oligonucleotide
aggccacgttggtgctcgtgggc

SEQ ID NO: 184576 - DNA, 22 bp, Artificial Sequence
  Description of Artificial Sequence: Synthetic oligonucleotide
ggccacgttggtgctcgtgggc

SEQ ID NO: 184577 - DNA, 22 bp, Artificial Sequence
  Description of Artificial Sequence: Synthetic oligonucleotide
gccacgttggtgctcgtgggcc

SEQ ID NO: 184578 - DNA, 22 bp, Artificial Sequence
  Description of Artificial Sequence: Synthetic oligonucleotide
ccacgttggtgctcgtgggccg

SEQ ID NO: 184579 - DNA, 22 bp, Artificial Sequence
  Description of Artificial Sequence: Synthetic oligonucleotide
cacgttggtgctcgtgggccgc

SEQ ID NO: 184580 - DNA, 22 bp, Artificial Sequence
  Description of Artificial Sequence: Synthetic oligonucleotide
acgttggtgctcgtgggccgcg

SEQ ID NO: 184581 - DNA, 21 bp, Artificial Sequence
  Description of Artificial Sequence: Synthetic oligonucleotide
cgttggtgctcgtgggccgcg

SEQ ID NO: 184582 - DNA, 21 bp, Artificial Sequence
  Description of Artificial Sequence: Synthetic oligonucleotide
gttggtgctcgtgggccgcgc

SEQ ID NO: 184583 - DNA, 21 bp, Artificial Sequence
  Description of Artificial Sequence: Synthetic oligonucleotide
ttggtgctcgtgggccgcgcc

SEQ ID NO: 184584 - DNA, 20 bp, Artificial Sequence
  Description of Artificial Sequence: Synthetic oligonucleotide
tggtgctcgtgggccgcgcc

SEQ ID NO: 184585 - DNA, 20 bp, Artificial Sequence
  Description of Artificial Sequence: Synthetic oligonucleotide
ggtgctcgtgggccgcgcct

SEQ ID NO: 184586 - DNA, 20 bp, Artificial Sequence
  Description of Artificial Sequence: Synthetic oligonucleotide
gtgctcgtgggccgcgccga

SEQ ID NO: 184587 - DNA, 22 bp, Artificial Sequence
  Description of Artificial Sequence: Synthetic oligonucleotide
tgctcgtgggccgcgccgactt

SEQ ID NO: 184588 - DNA, 21 bp, Artificial Sequence
  Description of Artificial Sequence: Synthetic oligonucleotide
gctcgtgggccgcgccgactt

SEQ ID NO: 184589 - DNA, 21 bp, Artificial Sequence
  Description of Artificial Sequence: Synthetic oligonucleotide
ctcgtgggccgcgccgacttc

SEQ ID NO: 184590 - DNA, 22 bp, Artificial Sequence
  Description of Artificial Sequence: Synthetic oligonucleotide
tcgtgggccgcgccgacttcct

SEQ ID NO: 184591 - DNA, 21 bp, Artificial Sequence
  Description of Artificial Sequence: Synthetic oligonucleotide
cgtgggccgcgccgacttcct

SEQ ID NO: 184592 - DNA, 39 bp, Artificial Sequence
  Description of Artificial Sequence: Synthetic oligonucleotide
atgggtccattgatcaacagatgcaagaagattcttctc

SEQ ID NO: 184593 - DNA, 38 bp, Artificial Sequence
  Description of Artificial Sequence: Synthetic oligonucleotide
tgggtccattgatcaacagatgcaagaagattcttctc

SEQ ID NO: 184594 - DNA, 37 bp, Artificial Sequence
  Description of Artificial Sequence: Synthetic oligonucleotide
gggtccattgatcaacagatgcaagaagattcttctc

SEQ ID NO: 184595 - DNA, 37 bp, Artificial Sequence
  Description of Artificial Sequence: Synthetic oligonucleotide
ggtccattgatcaacagatgcaagaagattcttctcc

SEQ ID NO: 184596 - DNA, 37 bp, Artificial Sequence
  Description of Artificial Sequence: Synthetic oligonucleotide
gtccattgatcaacagatgcaagaagattcttctccc

SEQ ID NO: 184597 - DNA, 39 bp, Artificial Sequence
  Description of Artificial Sequence: Synthetic oligonucleotide
tccattgatcaacagatgcaagaagattcttctcccaac

SEQ ID NO: 184598 - DNA, 38 bp, Artificial Sequence
  Description of Artificial Sequence: Synthetic oligonucleotide
ccattgatcaacagatgcaagaagattcttctcccaac

SEQ ID NO: 184599 - DNA, 40 bp, Artificial Sequence
  Description of Artificial Sequence: Synthetic oligonucleotide
cattgatcaacagatgcaagaagattcttctcccaactac

SEQ ID NO: 184600 - DNA, 41 bp, Artificial Sequence
  Description of Artificial Sequence: Synthetic oligonucleotide
attgatcaacagatgcaagaagattcttctcccaactactg

SEQ ID NO: 184601 - DNA, 40 bp, Artificial Sequence
  Description of Artificial Sequence: Synthetic oligonucleotide
ttgatcaacagatgcaagaagattcttctcccaactactg

SEQ ID NO: 184602 - DNA, 39 bp, Artificial Sequence
  Description of Artificial Sequence: Synthetic oligonucleotide
tgatcaacagatgcaagaagattcttctcccaactactg

SEQ ID NO: 184603 - DNA, 38 bp, Artificial Sequence
  Description of Artificial Sequence: Synthetic oligonucleotide
gatcaacagatgcaagaagattcttctcccaactactg

SEQ ID NO: 184604 - DNA, 40 bp, Artificial Sequence
  Description of Artificial Sequence: Synthetic oligonucleotide
atcaacagatgcaagaagattcttctcccaactactgtac

SEQ ID NO: 184605 - DNA, 39 bp, Artificial Sequence
  Description of Artificial Sequence: Synthetic oligonucleotide
tcaacagatgcaagaagattcttctcccaactactgtac

SEQ ID NO: 184606 - DNA, 38 bp, Artificial Sequence
  Description of Artificial Sequence: Synthetic oligonucleotide
caacagatgcaagaagattcttctcccaactactgtac

SEQ ID NO: 184607 - DNA, 38 bp, Artificial Sequence
  Description of Artificial Sequence: Synthetic oligonucleotide
aacagatgcaagaagattcttctcccaactactgtacc

SEQ ID NO: 184608 - DNA, 37 bp, Artificial Sequence
  Description of Artificial Sequence: Synthetic oligonucleotide
acagatgcaagaagattcttctcccaactactgtacc

SEQ ID NO: 184609 - DNA, 36 bp, Artificial Sequence
  Description of Artificial Sequence: Synthetic oligonucleotide
cagatgcaagaagattcttctcccaactactgtacc

SEQ ID NO: 184610 - DNA, 37 bp, Artificial Sequence
  Description of Artificial Sequence: Synthetic oligonucleotide
agatgcaagaagattcttctcccaactactgtacctc

SEQ ID NO: 184611 - DNA, 36 bp, Artificial Sequence
  Description of Artificial Sequence: Synthetic oligonucleotide
gatgcaagaagattcttctcccaactactgtacctc

SEQ ID NO: 184612 - DNA, 36 bp, Artificial Sequence
  Description of Artificial Sequence: Synthetic oligonucleotide
atgcaagaagattcttctcccaactactgtacctcc

SEQ ID NO: 184613 - DNA, 35 bp, Artificial Sequence
  Description of Artificial Sequence: Synthetic oligonucleotide
tgcaagaagattcttctcccaactactgtacctcc

SEQ ID NO: 184614 - DNA, 34 bp, Artificial Sequence
  Description of Artificial Sequence: Synthetic oligonucleotide
gcaagaagattcttctcccaactactgtacctcc

SEQ ID NO: 184615 - DNA, 35 bp, Artificial Sequence
  Description of Artificial Sequence: Synthetic oligonucleotide
caagaagattcttctcccaactactgtacctcctg

SEQ ID NO: 184616 - DNA, 35 bp, Artificial Sequence
  Description of Artificial Sequence: Synthetic oligonucleotide
aagaagattcttctcccaactactgtacctcctgc

SEQ ID NO: 184617 - DNA, 34 bp, Artificial Sequence
  Description of Artificial Sequence: Synthetic oligonucleotide
agaagattcttctcccaactactgtacctcctgc

SEQ ID NO: 184618 - DNA, 33 bp, Artificial Sequence
  Description of Artificial Sequence: Synthetic oligonucleotide
gaagattcttctcccaactactgtacctcctgc

SEQ ID NO: 184619 - DNA, 35 bp, Artificial Sequence
  Description of Artificial Sequence: Synthetic oligonucleotide
aagattcttctcccaactactgtacctcctgcaac

SEQ ID NO: 184620 - DNA, 34 bp, Artificial Sequence
  Description of Artificial Sequence: Synthetic oligonucleotide
agattcttctcccaactactgtacctcctgcaac

SEQ ID NO: 184621 - DNA, 33 bp, Artificial Sequence
  Description of Artificial Sequence: Synthetic oligonucleotide
gattcttctcccaactactgtacctcctgcaac

SEQ ID NO: 184622 - DNA, 33 bp, Artificial Sequence
  Description of Artificial Sequence: Synthetic oligonucleotide
attcttctcccaactactgtacctcctgcaacg

SEQ ID NO: 184623 - DNA, 32 bp, Artificial Sequence
  Description of Artificial Sequence: Synthetic oligonucleotide
ttcttctcccaactactgtacctcctgcaacg

SEQ ID NO: 184624 - DNA, 31 bp, Artificial Sequence
  Description of Artificial Sequence: Synthetic oligonucleotide
tcttctcccaactactgtacctcctgcaacg

SEQ ID NO: 184625 - DNA, 30 bp, Artificial Sequence
  Description of Artificial Sequence: Synthetic oligonucleotide
cttctcccaactactgtacctcctgcaacg

SEQ ID NO: 184626 - DNA, 32 bp, Artificial Sequence
  Description of Artificial Sequence: Synthetic oligonucleotide
ttctcccaactactgtacctcctgcaacgatg

SEQ ID NO: 184627 - DNA, 31 bp, Artificial Sequence
  Description of Artificial Sequence: Synthetic oligonucleotide
tctcccaactactgtacctcctgcaacgatg

SEQ ID NO: 184628 - DNA, 30 bp, Artificial Sequence
  Description of Artificial Sequence: Synthetic oligonucleotide
ctcccaactactgtacctcctgcaacgatg

SEQ ID NO: 184629 - DNA, 31 bp, Artificial Sequence
  Description of Artificial Sequence: Synthetic oligonucleotide
tcccaactactgtacctcctgcaacgatgag

SEQ ID NO: 184630 - DNA, 30 bp, Artificial Sequence
  Description of Artificial Sequence: Synthetic oligonucleotide
cccaactactgtacctcctgcaacgatgag

SEQ ID NO: 184631 - DNA, 33 bp, Artificial Sequence
  Description of Artificial Sequence: Synthetic oligonucleotide
ccaactactgtacctcctgcaacgatgagaatc

SEQ ID NO: 184632 - DNA, 34 bp, Artificial Sequence
  Description of Artificial Sequence: Synthetic oligonucleotide
caactactgtacctcctgcaacgatgagaatctg

SEQ ID NO: 184633 - DNA, 34 bp, Artificial Sequence
  Description of Artificial Sequence: Synthetic oligonucleotide
aactactgtacctcctgcaacgatgagaatctgg

SEQ ID NO: 184634 - DNA, 33 bp, Artificial Sequence
  Description of Artificial Sequence: Synthetic oligonucleotide
actactgtacctcctgcaacgatgagaatctgg

SEQ ID NO: 184635 - DNA, 32 bp, Artificial Sequence
  Description of Artificial Sequence: Synthetic oligonucleotide
ctactgtacctcctgcaacgatgagaatctgg

SEQ ID NO: 184636 - DNA, 32 bp, Artificial Sequence
  Description of Artificial Sequence: Synthetic oligonucleotide
tactgtacctcctgcaacgatgagaatctggc

SEQ ID NO: 184637 - DNA, 31 bp, Artificial Sequence
  Description of Artificial Sequence: Synthetic oligonucleotide
actgtacctcctgcaacgatgagaatctggc

SEQ ID NO: 184638 - DNA, 30 bp, Artificial Sequence
  Description of Artificial Sequence: Synthetic oligonucleotide
ctgtacctcctgcaacgatgagaatctggc

SEQ ID NO: 184639 - DNA, 31 bp, Artificial Sequence
  Description of Artificial Sequence: Synthetic oligonucleotide
tgtacctcctgcaacgatgagaatctggctc

SEQ ID NO: 184640 - DNA, 30 bp, Artificial Sequence
  Description of Artificial Sequence: Synthetic oligonucleotide
gtacctcctgcaacgatgagaatctggctc

SEQ ID NO: 184641 - DNA, 30 bp, Artificial Sequence
  Description of Artificial Sequence: Synthetic oligonucleotide
tacctcctgcaacgatgagaatctggctcc

SEQ ID NO: 184642 - DNA, 29 bp, Artificial Sequence
  Description of Artificial Sequence: Synthetic oligonucleotide
acctcctgcaacgatgagaatctggctcc

SEQ ID NO: 184643 - DNA, 28 bp, Artificial Sequence
  Description of Artificial Sequence: Synthetic oligonucleotide
cctcctgcaacgatgagaatctggctcc

SEQ ID NO: 184644 - DNA, 30 bp, Artificial Sequence
  Description of Artificial Sequence: Synthetic oligonucleotide
ctcctgcaacgatgagaatctggctccttg

SEQ ID NO: 184645 - DNA, 30 bp, Artificial Sequence
  Description of Artificial Sequence: Synthetic oligonucleotide
tcctgcaacgatgagaatctggctccttgg

SEQ ID NO: 184646 - DNA, 29 bp, Artificial Sequence
  Description of Artificial Sequence: Synthetic oligonucleotide
cctgcaacgatgagaatctggctccttgg

SEQ ID NO: 184647 - DNA, 30 bp, Artificial Sequence
  Description of Artificial Sequence: Synthetic oligonucleotide
ctgcaacgatgagaatctggctccttggag

SEQ ID NO: 184648 - DNA, 30 bp, Artificial Sequence
  Description of Artificial Sequence: Synthetic oligonucleotide
tgcaacgatgagaatctggctccttggagg

SEQ ID NO: 184649 - DNA, 29 bp, Artificial Sequence
  Description of Artificial Sequence: Synthetic oligonucleotide
gcaacgatgagaatctggctccttggagg

SEQ ID NO: 184650 - DNA, 29 bp, Artificial Sequence
  Description of Artificial Sequence: Synthetic oligonucleotide
caacgatgagaatctggctccttggaggc

SEQ ID NO: 184651 - DNA, 29 bp, Artificial Sequence
  Description of Artificial Sequence: Synthetic oligonucleotide
aacgatgagaatctggctccttggaggcc

SEQ ID NO: 184652 - DNA, 28 bp, Artificial Sequence
  Description of Artificial Sequence: Synthetic oligonucleotide
acgatgagaatctggctccttggaggcc

SEQ ID NO: 184653 - DNA, 27 bp, Artificial Sequence
  Description of Artificial Sequence: Synthetic oligonucleotide
cgatgagaatctggctccttggaggcc

SEQ ID NO: 184654 - DNA, 28 bp, Artificial Sequence
  Description of Artificial Sequence: Synthetic oligonucleotide
gatgagaatctggctccttggaggcctg

SEQ ID NO: 184655 - DNA, 28 bp, Artificial Sequence
  Description of Artificial Sequence: Synthetic oligonucleotide
atgagaatctggctccttggaggcctgc

SEQ ID NO: 184656 - DNA, 27 bp, Artificial Sequence
  Description of Artificial Sequence: Synthetic oligonucleotide
tgagaatctggctccttggaggcctgc

SEQ ID NO: 184657 - DNA, 27 bp, Artificial Sequence
  Description of Artificial Sequence: Synthetic oligonucleotide
gagaatctggctccttggaggcctgct

SEQ ID NO: 184658 - DNA, 27 bp, Artificial Sequence
  Description of Artificial Sequence: Synthetic oligonucleotide
agaatctggctccttggaggcctgctg

SEQ ID NO: 184659 - DNA, 26 bp, Artificial Sequence
  Description of Artificial Sequence: Synthetic oligonucleotide
gaatctggctccttggaggcctgctg

SEQ ID NO: 184660 - DNA, 26 bp, Artificial Sequence
  Description of Artificial Sequence: Synthetic oligonucleotide
aatctggctccttggaggcctgctgc

SEQ ID NO: 184661 - DNA, 25 bp, Artificial Sequence
  Description of Artificial Sequence: Synthetic oligonucleotide
atctggctccttggaggcctgctgc

SEQ ID NO: 184662 - DNA, 24 bp, Artificial Sequence
  Description of Artificial Sequence: Synthetic oligonucleotide
tctggctccttggaggcctgctgc

SEQ ID NO: 184663 - DNA, 23 bp, Artificial Sequence
  Description of Artificial Sequence: Synthetic oligonucleotide
ctggctccttggaggcctgctgc

SEQ ID NO: 184664 - DNA, 26 bp, Artificial Sequence
  Description of Artificial Sequence: Synthetic oligonucleotide
tggctccttggaggcctgctgccatt

SEQ ID NO: 184665 - DNA, 25 bp, Artificial Sequence
  Description of Artificial Sequence: Synthetic oligonucleotide
ggctccttggaggcctgctgccatt

SEQ ID NO: 184666 - DNA, 25 bp, Artificial Sequence
  Description of Artificial Sequence: Synthetic oligonucleotide
gctccttggaggcctgctgccattc

SEQ ID NO: 184667 - DNA, 26 bp, Artificial Sequence
  Description of Artificial Sequence: Synthetic oligonucleotide
ctccttggaggcctgctgccattcct

SEQ ID NO: 184668 - DNA, 26 bp, Artificial Sequence
  Description of Artificial Sequence: Synthetic oligonucleotide
tccttggaggcctgctgccattcctg

SEQ ID NO: 184669 - DNA, 25 bp, Artificial Sequence
  Description of Artificial Sequence: Synthetic oligonucleotide
ccttggaggcctgctgccattcctg

SEQ ID NO: 184670 - DNA, 26 bp, Artificial Sequence
  Description of Artificial Sequence: Synthetic oligonucleotide
cttggaggcctgctgccattcctgct

SEQ ID NO: 184671 - DNA, 26 bp, Artificial Sequence
  Description of Artificial Sequence: Synthetic oligonucleotide
ttggaggcctgctgccattcctgctg

SEQ ID NO: 184672 - DNA, 25 bp, Artificial Sequence
  Description of Artificial Sequence: Synthetic oligonucleotide
tggaggcctgctgccattcctgctg

SEQ ID NO: 184673 - DNA, 24 bp, Artificial Sequence
  Description of Artificial Sequence: Synthetic oligonucleotide
ggaggcctgctgccattcctgctg

SEQ ID NO: 184674 - DNA, 25 bp, Artificial Sequence
  Description of Artificial Sequence: Synthetic oligonucleotide
gaggcctgctgccattcctgctgct

SEQ ID NO: 184675 - DNA, 25 bp, Artificial Sequence
  Description of Artificial Sequence: Synthetic oligonucleotide
aggcctgctgccattcctgctgctc

SEQ ID NO: 184676 - DNA, 24 bp, Artificial Sequence
  Description of Artificial Sequence: Synthetic oligonucleotide
ggcctgctgccattcctgctgctc

SEQ ID NO: 184677 - DNA, 25 bp, Artificial Sequence
  Description of Artificial Sequence: Synthetic oligonucleotide
gcctgctgccattcctgctgctcct

SEQ ID NO: 184678 - DNA, 26 bp, Artificial Sequence
  Description of Artificial Sequence: Synthetic oligonucleotide
cctgctgccattcctgctgctcctct

SEQ ID NO: 184679 - DNA, 27 bp, Artificial Sequence
  Description of Artificial Sequence: Synthetic oligonucleotide
ctgctgccattcctgctgctcctctct

SEQ ID NO: 184680 - DNA, 27 bp, Artificial Sequence
  Description of Artificial Sequence: Synthetic oligonucleotide
tgctgccattcctgctgctcctctctg

SEQ ID NO: 184681 - DNA, 26 bp, Artificial Sequence
  Description of Artificial Sequence: Synthetic oligonucleotide
gctgccattcctgctgctcctctctg

SEQ ID NO: 184682 - DNA, 26 bp, Artificial Sequence
  Description of Artificial Sequence: Synthetic oligonucleotide
ctgccattcctgctgctcctctctgg

SEQ ID NO: 184683 - DNA, 26 bp, Artificial Sequence
  Description of Artificial Sequence: Synthetic oligonucleotide
tgccattcctgctgctcctctctggc

SEQ ID NO: 184684 - DNA, 25 bp, Artificial Sequence
  Description of Artificial Sequence: Synthetic oligonucleotide
gccattcctgctgctcctctctggc

SEQ ID NO: 184685 - DNA, 26 bp, Artificial Sequence
  Description of Artificial Sequence: Synthetic oligonucleotide
ccattcctgctgctcctctctggcct

SEQ ID NO: 184686 - DNA, 26 bp, Artificial Sequence
  Description of Artificial Sequence: Synthetic oligonucleotide
cattcctgctgctcctctctggcctg

SEQ ID NO: 184687 - DNA, 27 bp, Artificial Sequence
  Description of Artificial Sequence: Synthetic oligonucleotide
attcctgctgctcctctctggcctgca

SEQ ID NO: 184688 - DNA, 26 bp, Artificial Sequence
  Description of Artificial Sequence: Synthetic oligonucleotide
ttcctgctgctcctctctggcctgca

SEQ ID NO: 184689 - DNA, 25 bp, Artificial Sequence
  Description of Artificial Sequence: Synthetic oligonucleotide
tcctgctgctcctctctggcctgca

SEQ ID NO: 184690 - DNA, 24 bp, Artificial Sequence
  Description of Artificial Sequence: Synthetic oligonucleotide
cctgctgctcctctctggcctgca

SEQ ID NO: 184691 - DNA, 25 bp, Artificial Sequence
  Description of Artificial Sequence: Synthetic oligonucleotide
ctgctgctcctctctggcctgcaga

SEQ ID NO: 184692 - DNA, 26 bp, Artificial Sequence
  Description of Artificial Sequence: Synthetic oligonucleotide
tgctgctcctctctggcctgcagaga

SEQ ID NO: 184693 - DNA, 25 bp, Artificial Sequence
  Description of Artificial Sequence: Synthetic oligonucleotide
gctgctcctctctggcctgcagaga

SEQ ID NO: 184694 - DNA, 25 bp, Artificial Sequence
  Description of Artificial Sequence: Synthetic oligonucleotide
ctgctcctctctggcctgcagagac

SEQ ID NO: 184695 - DNA, 25 bp, Artificial Sequence
  Description of Artificial Sequence: Synthetic oligonucleotide
tgctcctctctggcctgcagagacc

SEQ ID NO: 184696 - DNA, 24 bp, Artificial Sequence
  Description of Artificial Sequence: Synthetic oligonucleotide
gctcctctctggcctgcagagacc

SEQ ID NO: 184697 - DNA, 25 bp, Artificial Sequence
  Description of Artificial Sequence: Synthetic oligonucleotide
ctcctctctggcctgcagagaccca

SEQ ID NO: 184698 - DNA, 26 bp, Artificial Sequence
  Description of Artificial Sequence: Synthetic oligonucleotide
tcctctctggcctgcagagacccaca

SEQ ID NO: 184699 - DNA, 25 bp, Artificial Sequence
  Description of Artificial Sequence: Synthetic oligonucleotide
cctctctggcctgcagagacccaca

SEQ ID NO: 184700 - DNA, 26 bp, Artificial Sequence
  Description of Artificial Sequence: Synthetic oligonucleotide
ctctctggcctgcagagacccacaga

SEQ ID NO: 184701 - DNA, 26 bp, Artificial Sequence
  Description of Artificial Sequence: Synthetic oligonucleotide
tctctggcctgcagagacccacagag

SEQ ID NO: 184702 - DNA, 25 bp, Artificial Sequence
  Description of Artificial Sequence: Synthetic oligonucleotide
ctctggcctgcagagacccacagag

SEQ ID NO: 184703 - DNA, 25 bp, Artificial Sequence
  Description of Artificial Sequence: Synthetic oligonucleotide
tctggcctgcagagacccacagagg

SEQ ID NO: 184704 - DNA, 24 bp, Artificial Sequence
  Description of Artificial Sequence: Synthetic oligonucleotide
ctggcctgcagagacccacagagg

SEQ ID NO: 184705 - DNA, 26 bp, Artificial Sequence
  Description of Artificial Sequence: Synthetic oligonucleotide
tggcctgcagagacccacagagggtt

SEQ ID NO: 184706 - DNA, 25 bp, Artificial Sequence
  Description of Artificial Sequence: Synthetic oligonucleotide
ggcctgcagagacccacagagggtt

SEQ ID NO: 184707 - DNA, 26 bp, Artificial Sequence
  Description of Artificial Sequence: Synthetic oligonucleotide
gcctgcagagacccacagagggttct

SEQ ID NO: 184708 - DNA, 27 bp, Artificial Sequence
  Description of Artificial Sequence: Synthetic oligonucleotide
cctgcagagacccacagagggttctga

SEQ ID NO: 184709 - DNA, 27 bp, Artificial Sequence
  Description of Artificial Sequence: Synthetic oligonucleotide
ctgcagagacccacagagggttctgag

SEQ ID NO: 184710 - DNA, 27 bp, Artificial Sequence
  Description of Artificial Sequence: Synthetic oligonucleotide
tgcagagacccacagagggttctgagg

SEQ ID NO: 184711 - DNA, 27 bp, Artificial Sequence
  Description of Artificial Sequence: Synthetic oligonucleotide
gcagagacccacagagggttctgaggt

SEQ ID NO: 184712 - DNA, 28 bp, Artificial Sequence
  Description of Artificial Sequence: Synthetic oligonucleotide
cagagacccacagagggttctgaggttg

SEQ ID NO: 184713 - DNA, 28 bp, Artificial Sequence
  Description of Artificial Sequence: Synthetic oligonucleotide
agagacccacagagggttctgaggttgc

SEQ ID NO: 184714 - DNA, 27 bp, Artificial Sequence
  Description of Artificial Sequence: Synthetic oligonucleotide
gagacccacagagggttctgaggttgc

SEQ ID NO: 184715 - DNA, 36 bp, Artificial Sequence
  Description of Artificial Sequence: Synthetic oligonucleotide
agacccacagagggttctgaggttgcaattaaaatc

SEQ ID NO: 184716 - DNA, 35 bp, Artificial Sequence
  Description of Artificial Sequence: Synthetic oligonucleotide
gacccacagagggttctgaggttgcaattaaaatc

SEQ ID NO: 184717 - DNA, 35 bp, Artificial Sequence
  Description of Artificial Sequence: Synthetic oligonucleotide
acccacagagggttctgaggttgcaattaaaatcg

SEQ ID NO: 184718 - DNA, 34 bp, Artificial Sequence
  Description of Artificial Sequence: Synthetic oligonucleotide
cccacagagggttctgaggttgcaattaaaatcg

SEQ ID NO: 184719 - DNA, 35 bp, Artificial Sequence
  Description of Artificial Sequence: Synthetic oligonucleotide
ccacagagggttctgaggttgcaattaaaatcgac

SEQ ID NO: 184720 - DNA, 37 bp, Artificial Sequence
  Description of Artificial Sequence: Synthetic oligonucleotide
cacagagggttctgaggttgcaattaaaatcgacttc

SEQ ID NO: 184721 - DNA, 37 bp, Artificial Sequence
  Description of Artificial Sequence: Synthetic oligonucleotide
acagagggttctgaggttgcaattaaaatcgacttcg

SEQ ID NO: 184722 - DNA, 36 bp, Artificial Sequence
  Description of Artificial Sequence: Synthetic oligonucleotide
cagagggttctgaggttgcaattaaaatcgacttcg

SEQ ID NO: 184723 - DNA, 37 bp, Artificial Sequence
  Description of Artificial Sequence: Synthetic oligonucleotide
agagggttctgaggttgcaattaaaatcgacttcgac

SEQ ID NO: 184724 - DNA, 36 bp, Artificial Sequence
  Description of Artificial Sequence: Synthetic oligonucleotide
gagggttctgaggttgcaattaaaatcgacttcgac

SEQ ID NO: 184725 - DNA, 38 bp, Artificial Sequence
  Description of Artificial Sequence: Synthetic oligonucleotide
agggttctgaggttgcaattaaaatcgacttcgacttc

SEQ ID NO: 184726 - DNA, 37 bp, Artificial Sequence
  Description of Artificial Sequence: Synthetic oligonucleotide
gggttctgaggttgcaattaaaatcgacttcgacttc

SEQ ID NO: 184727 - DNA, 37 bp, Artificial Sequence
  Description of Artificial Sequence: Synthetic oligonucleotide
ggttctgaggttgcaattaaaatcgacttcgacttcg

SEQ ID NO: 184728 - DNA, 37 bp, Artificial Sequence
  Description of Artificial Sequence: Synthetic oligonucleotide
gttctgaggttgcaattaaaatcgacttcgacttcgc

SEQ ID NO: 184729 - DNA, 38 bp, Artificial Sequence
  Description of Artificial Sequence: Synthetic oligonucleotide
ttctgaggttgcaattaaaatcgacttcgacttcgcac

SEQ ID NO: 184730 - DNA, 37 bp, Artificial Sequence
  Description of Artificial Sequence: Synthetic oligonucleotide
tctgaggttgcaattaaaatcgacttcgacttcgcac

SEQ ID NO: 184731 - DNA, 36 bp, Artificial Sequence
  Description of Artificial Sequence: Synthetic oligonucleotide
ctgaggttgcaattaaaatcgacttcgacttcgcac

SEQ ID NO: 184732 - DNA, 36 bp, Artificial Sequence
  Description of Artificial Sequence: Synthetic oligonucleotide
tgaggttgcaattaaaatcgacttcgacttcgcacc

SEQ ID NO: 184733 - DNA, 35 bp, Artificial Sequence
  Description of Artificial Sequence: Synthetic oligonucleotide
gaggttgcaattaaaatcgacttcgacttcgcacc

SEQ ID NO: 184734 - DNA, 36 bp, Artificial Sequence
  Description of Artificial Sequence: Synthetic oligonucleotide
aggttgcaattaaaatcgacttcgacttcgcaccag

SEQ ID NO: 184735 - DNA, 35 bp, Artificial Sequence
  Description of Artificial Sequence: Synthetic oligonucleotide
ggttgcaattaaaatcgacttcgacttcgcaccag

SEQ ID NO: 184736 - DNA, 35 bp, Artificial Sequence
  Description of Artificial Sequence: Synthetic oligonucleotide
gttgcaattaaaatcgacttcgacttcgcaccagg

SEQ ID NO: 184737 - DNA, 37 bp, Artificial Sequence
  Description of Artificial Sequence: Synthetic oligonucleotide
ttgcaattaaaatcgacttcgacttcgcaccaggttc

SEQ ID NO: 184738 - DNA, 36 bp, Artificial Sequence
  Description of Artificial Sequence: Synthetic oligonucleotide
tgcaattaaaatcgacttcgacttcgcaccaggttc

SEQ ID NO: 184739 - DNA, 35 bp, Artificial Sequence
  Description of Artificial Sequence: Synthetic oligonucleotide
gcaattaaaatcgacttcgacttcgcaccaggttc

SEQ ID NO: 184740 - DNA, 39 bp, Artificial Sequence
  Description of Artificial Sequence: Synthetic oligonucleotide
caattaaaatcgacttcgacttcgcaccaggttcttttg

SEQ ID NO: 184741 - DNA, 41 bp, Artificial Sequence
  Description of Artificial Sequence: Synthetic oligonucleotide
aattaaaatcgacttcgacttcgcaccaggttcttttgatg

SEQ ID NO: 184742 - DNA, 40 bp, Artificial Sequence
  Description of Artificial Sequence: Synthetic oligonucleotide
attaaaatcgacttcgacttcgcaccaggttcttttgatg

SEQ ID NO: 184743 - DNA, 39 bp, Artificial Sequence
  Description of Artificial Sequence: Synthetic oligonucleotide
ttaaaatcgacttcgacttcgcaccaggttcttttgatg

SEQ ID NO: 184744 - DNA, 38 bp, Artificial Sequence
  Description of Artificial Sequence: Synthetic oligonucleotide
taaaatcgacttcgacttcgcaccaggttcttttgatg

SEQ ID NO: 184745 - DNA, 37 bp, Artificial Sequence
  Description of Artificial Sequence: Synthetic oligonucleotide
aaaatcgacttcgacttcgcaccaggttcttttgatg

SEQ ID NO: 184746 - DNA, 36 bp, Artificial Sequence
  Description of Artificial Sequence: Synthetic oligonucleotide
aaatcgacttcgacttcgcaccaggttcttttgatg

SEQ ID NO: 184747 - DNA, 35 bp, Artificial Sequence
  Description of Artificial Sequence: Synthetic oligonucleotide
aatcgacttcgacttcgcaccaggttcttttgatg

SEQ ID NO: 184748 - DNA, 34 bp, Artificial Sequence
  Description of Artificial Sequence: Synthetic oligonucleotide
atcgacttcgacttcgcaccaggttcttttgatg

SEQ ID NO: 184749 - DNA, 33 bp, Artificial Sequence
  Description of Artificial Sequence: Synthetic oligonucleotide
tcgacttcgacttcgcaccaggttcttttgatg

SEQ ID NO: 184750 - DNA, 32 bp, Artificial Sequence
  Description of Artificial Sequence: Synthetic oligonucleotide
cgacttcgacttcgcaccaggttcttttgatg

SEQ ID NO: 184751 - DNA, 34 bp, Artificial Sequence
  Description of Artificial Sequence: Synthetic oligonucleotide
gacttcgacttcgcaccaggttcttttgatgatc

SEQ ID NO: 184752 - DNA, 35 bp, Artificial Sequence
  Description of Artificial Sequence: Synthetic oligonucleotide
acttcgacttcgcaccaggttcttttgatgatcag

SEQ ID NO: 184753 - DNA, 34 bp, Artificial Sequence
  Description of Artificial Sequence: Synthetic oligonucleotide
cttcgacttcgcaccaggttcttttgatgatcag

SEQ ID NO: 184754 - DNA, 36 bp, Artificial Sequence
  Description of Artificial Sequence: Synthetic oligonucleotide
ttcgacttcgcaccaggttcttttgatgatcagtac

SEQ ID NO: 184755 - DNA, 35 bp, Artificial Sequence
  Description of Artificial Sequence: Synthetic oligonucleotide
tcgacttcgcaccaggttcttttgatgatcagtac

SEQ ID NO: 184756 - DNA, 34 bp, Artificial Sequence
  Description of Artificial Sequence: Synthetic oligonucleotide
cgacttcgcaccaggttcttttgatgatcagtac

SEQ ID NO: 184757 - DNA, 34 bp, Artificial Sequence
  Description of Artificial Sequence: Synthetic oligonucleotide
gacttcgcaccaggttcttttgatgatcagtacc

SEQ ID NO: 184758 - DNA, 36 bp, Artificial Sequence
  Description of Artificial Sequence: Synthetic oligonucleotide
acttcgcaccaggttcttttgatgatcagtaccaag

SEQ ID NO: 184759 - DNA, 35 bp, Artificial Sequence
  Description of Artificial Sequence: Synthetic oligonucleotide
cttcgcaccaggttcttttgatgatcagtaccaag

SEQ ID NO: 184760 - DNA, 35 bp, Artificial Sequence
  Description of Artificial Sequence: Synthetic oligonucleotide
ttcgcaccaggttcttttgatgatcagtaccaagg

SEQ ID NO: 184761 - DNA, 34 bp, Artificial Sequence
  Description of Artificial Sequence: Synthetic oligonucleotide
tcgcaccaggttcttttgatgatcagtaccaagg

SEQ ID NO: 184762 - DNA, 33 bp, Artificial Sequence
  Description of Artificial Sequence: Synthetic oligonucleotide
cgcaccaggttcttttgatgatcagtaccaagg

SEQ ID NO: 184763 - DNA, 33 bp, Artificial Sequence
  Description of Artificial Sequence: Synthetic oligonucleotide
gcaccaggttcttttgatgatcagtaccaaggc

SEQ ID NO: 184764 - DNA, 34 bp, Artificial Sequence
  Description of Artificial Sequence: Synthetic oligonucleotide
caccaggttcttttgatgatcagtaccaaggctg

SEQ ID NO: 184765 - DNA, 36 bp, Artificial Sequence
  Description of Artificial Sequence: Synthetic oligonucleotide
accaggttcttttgatgatcagtaccaaggctgtag

SEQ ID NO: 184766 - DNA, 35 bp, Artificial Sequence
  Description of Artificial Sequence: Synthetic oligonucleotide
ccaggttcttttgatgatcagtaccaaggctgtag

SEQ ID NO: 184767 - DNA, 35 bp, Artificial Sequence
  Description of Artificial Sequence: Synthetic oligonucleotide
caggttcttttgatgatcagtaccaaggctgtagc

SEQ ID NO: 184768 - DNA, 38 bp, Artificial Sequence
  Description of Artificial Sequence: Synthetic oligonucleotide
aggttcttttgatgatcagtaccaaggctgtagcaaac

SEQ ID NO: 184769 - DNA, 37 bp, Artificial Sequence
  Description of Artificial Sequence: Synthetic oligonucleotide
ggttcttttgatgatcagtaccaaggctgtagcaaac

SEQ ID NO: 184770 - DNA, 38 bp, Artificial Sequence
  Description of Artificial Sequence: Synthetic oligonucleotide
gttcttttgatgatcagtaccaaggctgtagcaaacag

SEQ ID NO: 184771 - DNA, 38 bp, Artificial Sequence
  Description of Artificial Sequence: Synthetic oligonucleotide
ttcttttgatgatcagtaccaaggctgtagcaaacagg

SEQ ID NO: 184772 - DNA, 37 bp, Artificial Sequence
  Description of Artificial Sequence: Synthetic oligonucleotide
tcttttgatgatcagtaccaaggctgtagcaaacagg

SEQ ID NO: 184773 - DNA, 36 bp, Artificial Sequence
  Description of Artificial Sequence: Synthetic oligonucleotide
cttttgatgatcagtaccaaggctgtagcaaacagg

SEQ ID NO: 184774 - DNA, 40 bp, Artificial Sequence
  Description of Artificial Sequence: Synthetic oligonucleotide
ttttgatgatcagtaccaaggctgtagcaaacaggttatg

SEQ ID NO: 184775 - DNA, 39 bp, Artificial Sequence
  Description of Artificial Sequence: Synthetic oligonucleotide
tttgatgatcagtaccaaggctgtagcaaacaggttatg

SEQ ID NO: 184776 - DNA, 38 bp, Artificial Sequence
  Description of Artificial Sequence: Synthetic oligonucleotide
ttgatgatcagtaccaaggctgtagcaaacaggttatg

SEQ ID NO: 184777 - DNA, 37 bp, Artificial Sequence
  Description of Artificial Sequence: Synthetic oligonucleotide
tgatgatcagtaccaaggctgtagcaaacaggttatg

SEQ ID NO: 184778 - DNA, 36 bp, Artificial Sequence
  Description of Artificial Sequence: Synthetic oligonucleotide
gatgatcagtaccaaggctgtagcaaacaggttatg

SEQ ID NO: 184779 - DNA, 36 bp, Artificial Sequence
  Description of Artificial Sequence: Synthetic oligonucleotide
atgatcagtaccaaggctgtagcaaacaggttatgg

SEQ ID NO: 184780 - DNA, 35 bp, Artificial Sequence
  Description of Artificial Sequence: Synthetic oligonucleotide
tgatcagtaccaaggctgtagcaaacaggttatgg

SEQ ID NO: 184781 - DNA, 34 bp, Artificial Sequence
  Description of Artificial Sequence: Synthetic oligonucleotide
gatcagtaccaaggctgtagcaaacaggttatgg

SEQ ID NO: 184782 - DNA, 35 bp, Artificial Sequence
  Description of Artificial Sequence: Synthetic oligonucleotide
atcagtaccaaggctgtagcaaacaggttatggag

SEQ ID NO: 184783 - DNA, 34 bp, Artificial Sequence
  Description of Artificial Sequence: Synthetic oligonucleotide
tcagtaccaaggctgtagcaaacaggttatggag

SEQ ID NO: 184784 - DNA, 33 bp, Artificial Sequence
  Description of Artificial Sequence: Synthetic oligonucleotide
cagtaccaaggctgtagcaaacaggttatggag

SEQ ID NO: 184785 - DNA, 36 bp, Artificial Sequence
  Description of Artificial Sequence: Synthetic oligonucleotide
agtaccaaggctgtagcaaacaggttatggagaaac

SEQ ID NO: 184786 - DNA, 35 bp, Artificial Sequence
  Description of Artificial Sequence: Synthetic oligonucleotide
gtaccaaggctgtagcaaacaggttatggagaaac

SEQ ID NO: 184787 - DNA, 38 bp, Artificial Sequence
  Description of Artificial Sequence: Synthetic oligonucleotide
taccaaggctgtagcaaacaggttatggagaaactaac

SEQ ID NO: 184788 - DNA, 37 bp, Artificial Sequence
  Description of Artificial Sequence: Synthetic oligonucleotide
accaaggctgtagcaaacaggttatggagaaactaac

SEQ ID NO: 184789 - DNA, 36 bp, Artificial Sequence
  Description of Artificial Sequence: Synthetic oligonucleotide
ccaaggctgtagcaaacaggttatggagaaactaac

SEQ ID NO: 184790 - DNA, 37 bp, Artificial Sequence
  Description of Artificial Sequence: Synthetic oligonucleotide
caaggctgtagcaaacaggttatggagaaactaactc

SEQ ID NO: 184791 - DNA, 39 bp, Artificial Sequence
  Description of Artificial Sequence: Synthetic oligonucleotide
aaggctgtagcaaacaggttatggagaaactaactcaag

SEQ ID NO: 184792 - DNA, 38 bp, Artificial Sequence
  Description of Artificial Sequence: Synthetic oligonucleotide
aggctgtagcaaacaggttatggagaaactaactcaag

SEQ ID NO: 184793 - DNA, 37 bp, Artificial Sequence
  Description of Artificial Sequence: Synthetic oligonucleotide
ggctgtagcaaacaggttatggagaaactaactcaag

SEQ ID NO: 184794 - DNA, 37 bp, Artificial Sequence
  Description of Artificial Sequence: Synthetic oligonucleotide
gctgtagcaaacaggttatggagaaactaactcaagg

SEQ ID NO: 184795 - DNA, 37 bp, Artificial Sequence
  Description of Artificial Sequence: Synthetic oligonucleotide
ctgtagcaaacaggttatggagaaactaactcaaggg

SEQ ID NO: 184796 - DNA, 37 bp, Artificial Sequence
  Description of Artificial Sequence: Synthetic oligonucleotide
tgtagcaaacaggttatggagaaactaactcaagggg

SEQ ID NO: 184797 - DNA, 36 bp, Artificial Sequence
  Description of Artificial Sequence: Synthetic oligonucleotide
gtagcaaacaggttatggagaaactaactcaagggg

SEQ ID NO: 184798 - DNA, 43 bp, Artificial Sequence
  Description of Artificial Sequence: Synthetic oligonucleotide
tagcaaacaggttatggagaaactaactcaaggggattatttc

SEQ ID NO: 184799 - DNA, 42 bp, Artificial Sequence
  Description of Artificial Sequence: Synthetic oligonucleotide
agcaaacaggttatggagaaactaactcaaggggattatttc

SEQ ID NO: 184800 - DNA, 41 bp, Artificial Sequence
  Description of Artificial Sequence: Synthetic oligonucleotide
gcaaacaggttatggagaaactaactcaaggggattatttc

SEQ ID NO: 184801 - DNA, 42 bp, Artificial Sequence
  Description of Artificial Sequence: Synthetic oligonucleotide
caaacaggttatggagaaactaactcaaggggattatttcac

SEQ ID NO: 184802 - DNA, 46 bp, Artificial Sequence
  Description of Artificial Sequence: Synthetic oligonucleotide
aaacaggttatggagaaactaactcaaggggattatttcacaaaag

SEQ ID NO: 184803 - DNA, 45 bp, Artificial Sequence
  Description of Artificial Sequence: Synthetic oligonucleotide
aacaggttatggagaaactaactcaaggggattatttcacaaaag

SEQ ID NO: 184804 - DNA, 44 bp, Artificial Sequence
  Description of Artificial Sequence: Synthetic oligonucleotide
acaggttatggagaaactaactcaaggggattatttcacaaaag

SEQ ID NO: 184805 - DNA, 43 bp, Artificial Sequence
  Description of Artificial Sequence: Synthetic oligonucleotide
caggttatggagaaactaactcaaggggattatttcacaaaag

SEQ ID NO: 184806 - DNA, 44 bp, Artificial Sequence
  Description of Artificial Sequence: Synthetic oligonucleotide
aggttatggagaaactaactcaaggggattatttcacaaaagac

SEQ ID NO: 184807 - DNA, 43 bp, Artificial Sequence
  Description of Artificial Sequence: Synthetic oligonucleotide
ggttatggagaaactaactcaaggggattatttcacaaaagac

SEQ ID NO: 184808 - DNA, 46 bp, Artificial Sequence
  Description of Artificial Sequence: Synthetic oligonucleotide
gttatggagaaactaactcaaggggattatttcacaaaagacatag

SEQ ID NO: 184809 - DNA, 48 bp, Artificial Sequence
  Description of Artificial Sequence: Synthetic oligonucleotide
ttatggagaaactaactcaaggggattatttcacaaaagacatagaag

SEQ ID NO: 184810 - DNA, 47 bp, Artificial Sequence
  Description of Artificial Sequence: Synthetic oligonucleotide
tatggagaaactaactcaaggggattatttcacaaaagacatagaag

SEQ ID NO: 184811 - DNA, 46 bp, Artificial Sequence
  Description of Artificial Sequence: Synthetic oligonucleotide
atggagaaactaactcaaggggattatttcacaaaagacatagaag

SEQ ID NO: 184812 - DNA, 45 bp, Artificial Sequence
  Description of Artificial Sequence: Synthetic oligonucleotide
tggagaaactaactcaaggggattatttcacaaaagacatagaag

SEQ ID NO: 184813 - DNA, 44 bp, Artificial Sequence
  Description of Artificial Sequence: Synthetic oligonucleotide
ggagaaactaactcaaggggattatttcacaaaagacatagaag

SEQ ID NO: 184814 - DNA, 44 bp, Artificial Sequence
  Description of Artificial Sequence: Synthetic oligonucleotide
gagaaactaactcaaggggattatttcacaaaagacatagaagc

SEQ ID NO: 184815 - DNA, 44 bp, Artificial Sequence
  Description of Artificial Sequence: Synthetic oligonucleotide
agaaactaactcaaggggattatttcacaaaagacatagaagcc

SEQ ID NO: 184816 - DNA, 43 bp, Artificial Sequence
  Description of Artificial Sequence: Synthetic oligonucleotide
gaaactaactcaaggggattatttcacaaaagacatagaagcc

SEQ ID NO: 184817 - DNA, 43 bp, Artificial Sequence
  Description of Artificial Sequence: Synthetic oligonucleotide
aaactaactcaaggggattatttcacaaaagacatagaagccc

SEQ ID NO: 184818 - DNA, 42 bp, Artificial Sequence
  Description of Artificial Sequence: Synthetic oligonucleotide
aactaactcaaggggattatttcacaaaagacatagaagccc

SEQ ID NO: 184819 - DNA, 41 bp, Artificial Sequence
  Description of Artificial Sequence: Synthetic oligonucleotide
actaactcaaggggattatttcacaaaagacatagaagccc

SEQ ID NO: 184820 - DNA, 40 bp, Artificial Sequence
  Description of Artificial Sequence: Synthetic oligonucleotide
ctaactcaaggggattatttcacaaaagacatagaagccc

SEQ ID NO: 184821 - DNA, 41 bp, Artificial Sequence
  Description of Artificial Sequence: Synthetic oligonucleotide
taactcaaggggattatttcacaaaagacatagaagcccag

SEQ ID NO: 184822 - DNA, 40 bp, Artificial Sequence
  Description of Artificial Sequence: Synthetic oligonucleotide
aactcaaggggattatttcacaaaagacatagaagcccag

SEQ ID NO: 184823 - DNA, 39 bp, Artificial Sequence
  Description of Artificial Sequence: Synthetic oligonucleotide
actcaaggggattatttcacaaaagacatagaagcccag

SEQ ID NO: 184824 - DNA, 38 bp, Artificial Sequence
  Description of Artificial Sequence: Synthetic oligonucleotide
ctcaaggggattatttcacaaaagacatagaagcccag

SEQ ID NO: 184825 - DNA, 40 bp, Artificial Sequence
  Description of Artificial Sequence: Synthetic oligonucleotide
tcaaggggattatttcacaaaagacatagaagcccagaag

SEQ ID NO: 184826 - DNA, 39 bp, Artificial Sequence
  Description of Artificial Sequence: Synthetic oligonucleotide
caaggggattatttcacaaaagacatagaagcccagaag

SEQ ID NO: 184827 - DNA, 49 bp, Artificial Sequence
  Description of Artificial Sequence: Synthetic oligonucleotide
aaggggattatttcacaaaagacatagaagcccagaagaattattttag

SEQ ID NO: 184828 - DNA, 48 bp, Artificial Sequence
  Description of Artificial Sequence: Synthetic oligonucleotide
aggggattatttcacaaaagacatagaagcccagaagaattattttag

SEQ ID NO: 184829 - DNA, 47 bp, Artificial Sequence
  Description of Artificial Sequence: Synthetic oligonucleotide
ggggattatttcacaaaagacatagaagcccagaagaattattttag

SEQ ID NO: 184830 - DNA, 47 bp, Artificial Sequence
  Description of Artificial Sequence: Synthetic oligonucleotide
gggattatttcacaaaagacatagaagcccagaagaattattttagg

SEQ ID NO: 184831 - DNA, 49 bp, Artificial Sequence
  Description of Artificial Sequence: Synthetic oligonucleotide
ggattatttcacaaaagacatagaagcccagaagaattattttaggatg

SEQ ID NO: 184832 - DNA, 50 bp, Artificial Sequence
  Description of Artificial Sequence: Synthetic oligonucleotide
gattatttcacaaaagacatagaagcccagaagaattattttaggatgtg

SEQ ID NO: 184833 - DNA, 50 bp, Artificial Sequence
  Description of Artificial Sequence: Synthetic oligonucleotide
attatttcacaaaagacatagaagcccagaagaattattttaggatgtgg

SEQ ID NO: 184834 - DNA, 49 bp, Artificial Sequence
  Description of Artificial Sequence: Synthetic oligonucleotide
ttatttcacaaaagacatagaagcccagaagaattattttaggatgtgg

SEQ ID NO: 184835 - DNA, 48 bp, Artificial Sequence
  Description of Artificial Sequence: Synthetic oligonucleotide
tatttcacaaaagacatagaagcccagaagaattattttaggatgtgg

SEQ ID NO: 184836 - DNA, 47 bp, Artificial Sequence
  Description of Artificial Sequence: Synthetic oligonucleotide
atttcacaaaagacatagaagcccagaagaattattttaggatgtgg

SEQ ID NO: 184837 - DNA, 46 bp, Artificial Sequence
  Description of Artificial Sequence: Synthetic oligonucleotide
tttcacaaaagacatagaagcccagaagaattattttaggatgtgg

SEQ ID NO: 184838 - DNA, 45 bp, Artificial Sequence
  Description of Artificial Sequence: Synthetic oligonucleotide
ttcacaaaagacatagaagcccagaagaattattttaggatgtgg

SEQ ID NO: 184839 - DNA, 44 bp, Artificial Sequence
  Description of Artificial Sequence: Synthetic oligonucleotide
tcacaaaagacatagaagcccagaagaattattttaggatgtgg

SEQ ID NO: 184840 - DNA, 43 bp, Artificial Sequence
  Description of Artificial Sequence: Synthetic oligonucleotide
cacaaaagacatagaagcccagaagaattattttaggatgtgg

SEQ ID NO: 184841 - DNA, 43 bp, Artificial Sequence
  Description of Artificial Sequence: Synthetic oligonucleotide
acaaaagacatagaagcccagaagaattattttaggatgtggc

SEQ ID NO: 184842 - DNA, 42 bp, Artificial Sequence
  Description of Artificial Sequence: Synthetic oligonucleotide
caaaagacatagaagcccagaagaattattttaggatgtggc

SEQ ID NO: 184843 - DNA, 47 bp, Artificial Sequence
  Description of Artificial Sequence: Synthetic oligonucleotide
aaaagacatagaagcccagaagaattattttaggatgtggcaaaaag

SEQ ID NO: 184844 - DNA, 46 bp, Artificial Sequence
  Description of Artificial Sequence: Synthetic oligonucleotide
aaagacatagaagcccagaagaattattttaggatgtggcaaaaag

SEQ ID NO: 184845 - DNA, 45 bp, Artificial Sequence
  Description of Artificial Sequence: Synthetic oligonucleotide
aagacatagaagcccagaagaattattttaggatgtggcaaaaag

SEQ ID NO: 184846 - DNA, 44 bp, Artificial Sequence
  Description of Artificial Sequence: Synthetic oligonucleotide
agacatagaagcccagaagaattattttaggatgtggcaaaaag

SEQ ID NO: 184847 - DNA, 43 bp, Artificial Sequence
  Description of Artificial Sequence: Synthetic oligonucleotide
gacatagaagcccagaagaattattttaggatgtggcaaaaag

SEQ ID NO: 184848 - DNA, 43 bp, Artificial Sequence
  Description of Artificial Sequence: Synthetic oligonucleotide
acatagaagcccagaagaattattttaggatgtggcaaaaagc

SEQ ID NO: 184849 - DNA, 42 bp, Artificial Sequence
  Description of Artificial Sequence: Synthetic oligonucleotide
catagaagcccagaagaattattttaggatgtggcaaaaagc

SEQ ID NO: 184850 - DNA, 42 bp, Artificial Sequence
  Description of Artificial Sequence: Synthetic oligonucleotide
atagaagcccagaagaattattttaggatgtggcaaaaagcc

SEQ ID NO: 184851 - DNA, 41 bp, Artificial Sequence
  Description of Artificial Sequence: Synthetic oligonucleotide
tagaagcccagaagaattattttaggatgtggcaaaaagcc

SEQ ID NO: 184852 - DNA, 40 bp, Artificial Sequence
  Description of Artificial Sequence: Synthetic oligonucleotide
agaagcccagaagaattattttaggatgtggcaaaaagcc

SEQ ID NO: 184853 - DNA, 39 bp, Artificial Sequence
  Description of Artificial Sequence: Synthetic oligonucleotide
gaagcccagaagaattattttaggatgtggcaaaaagcc

SEQ ID NO: 184854 - DNA, 39 bp, Artificial Sequence
  Description of Artificial Sequence: Synthetic oligonucleotide
aagcccagaagaattattttaggatgtggcaaaaagccc

SEQ ID NO: 184855 - DNA, 38 bp, Artificial Sequence
  Description of Artificial Sequence: Synthetic oligonucleotide
agcccagaagaattattttaggatgtggcaaaaagccc

SEQ ID NO: 184856 - DNA, 37 bp, Artificial Sequence
  Description of Artificial Sequence: Synthetic oligonucleotide
gcccagaagaattattttaggatgtggcaaaaagccc

SEQ ID NO: 184857 - DNA, 38 bp, Artificial Sequence
  Description of Artificial Sequence: Synthetic oligonucleotide
cccagaagaattattttaggatgtggcaaaaagcccac

SEQ ID NO: 184858 - DNA, 41 bp, Artificial Sequence
  Description of Artificial Sequence: Synthetic oligonucleotide
ccagaagaattattttaggatgtggcaaaaagcccacttag

SEQ ID NO: 184859 - DNA, 41 bp, Artificial Sequence
  Description of Artificial Sequence: Synthetic oligonucleotide
cagaagaattattttaggatgtggcaaaaagcccacttagc

SEQ ID NO: 184860 - DNA, 41 bp, Artificial Sequence
  Description of Artificial Sequence: Synthetic oligonucleotide
agaagaattattttaggatgtggcaaaaagcccacttagcc

SEQ ID NO: 184861 - DNA, 40 bp, Artificial Sequence
  Description of Artificial Sequence: Synthetic oligonucleotide
gaagaattattttaggatgtggcaaaaagcccacttagcc

SEQ ID NO: 184862 - DNA, 41 bp, Artificial Sequence
  Description of Artificial Sequence: Synthetic oligonucleotide
aagaattattttaggatgtggcaaaaagcccacttagcctg

SEQ ID NO: 184863 - DNA, 40 bp, Artificial Sequence
  Description of Artificial Sequence: Synthetic oligonucleotide
agaattattttaggatgtggcaaaaagcccacttagcctg

SEQ ID NO: 184864 - DNA, 39 bp, Artificial Sequence
  Description of Artificial Sequence: Synthetic oligonucleotide
gaattattttaggatgtggcaaaaagcccacttagcctg

SEQ ID NO: 184865 - DNA, 39 bp, Artificial Sequence
  Description of Artificial Sequence: Synthetic oligonucleotide
aattattttaggatgtggcaaaaagcccacttagcctgg

SEQ ID NO: 184866 - DNA, 38 bp, Artificial Sequence
  Description of Artificial Sequence: Synthetic oligonucleotide
attattttaggatgtggcaaaaagcccacttagcctgg

SEQ ID NO: 184867 - DNA, 37 bp, Artificial Sequence
  Description of Artificial Sequence: Synthetic oligonucleotide
ttattttaggatgtggcaaaaagcccacttagcctgg

SEQ ID NO: 184868 - DNA, 36 bp, Artificial Sequence
  Description of Artificial Sequence: Synthetic oligonucleotide
tattttaggatgtggcaaaaagcccacttagcctgg

SEQ ID NO: 184869 - DNA, 35 bp, Artificial Sequence
  Description of Artificial Sequence: Synthetic oligonucleotide
attttaggatgtggcaaaaagcccacttagcctgg

SEQ ID NO: 184870 - DNA, 34 bp, Artificial Sequence
  Description of Artificial Sequence: Synthetic oligonucleotide
ttttaggatgtggcaaaaagcccacttagcctgg

SEQ ID NO: 184871 - DNA, 33 bp, Artificial Sequence
  Description of Artificial Sequence: Synthetic oligonucleotide
tttaggatgtggcaaaaagcccacttagcctgg

SEQ ID NO: 184872 - DNA, 32 bp, Artificial Sequence
  Description of Artificial Sequence: Synthetic oligonucleotide
ttaggatgtggcaaaaagcccacttagcctgg

SEQ ID NO: 184873 - DNA, 31 bp, Artificial Sequence
  Description of Artificial Sequence: Synthetic oligonucleotide
taggatgtggcaaaaagcccacttagcctgg

SEQ ID NO: 184874 - DNA, 30 bp, Artificial Sequence
  Description of Artificial Sequence: Synthetic oligonucleotide
aggatgtggcaaaaagcccacttagcctgg

SEQ ID NO: 184875 - DNA, 29 bp, Artificial Sequence
  Description of Artificial Sequence: Synthetic oligonucleotide
ggatgtggcaaaaagcccacttagcctgg

SEQ ID NO: 184876 - DNA, 29 bp, Artificial Sequence
  Description of Artificial Sequence: Synthetic oligonucleotide
gatgtggcaaaaagcccacttagcctggc

SEQ ID NO: 184877 - DNA, 33 bp, Artificial Sequence
  Description of Artificial Sequence: Synthetic oligonucleotide
atgtggcaaaaagcccacttagcctggcttaac

SEQ ID NO: 184878 - DNA, 32 bp, Artificial Sequence
  Description of Artificial Sequence: Synthetic oligonucleotide
tgtggcaaaaagcccacttagcctggcttaac

SEQ ID NO: 184879 - DNA, 31 bp, Artificial Sequence
  Description of Artificial Sequence: Synthetic oligonucleotide
gtggcaaaaagcccacttagcctggcttaac

SEQ ID NO: 184880 - DNA, 31 bp, Artificial Sequence
  Description of Artificial Sequence: Synthetic oligonucleotide
tggcaaaaagcccacttagcctggcttaacc

SEQ ID NO: 184881 - DNA, 30 bp, Artificial Sequence
  Description of Artificial Sequence: Synthetic oligonucleotide
ggcaaaaagcccacttagcctggcttaacc

SEQ ID NO: 184882 - DNA, 32 bp, Artificial Sequence
  Description of Artificial Sequence: Synthetic oligonucleotide
gcaaaaagcccacttagcctggcttaaccaag

SEQ ID NO: 184883 - DNA, 32 bp, Artificial Sequence
  Description of Artificial Sequence: Synthetic oligonucleotide
caaaaagcccacttagcctggcttaaccaagg

SEQ ID NO: 184884 - DNA, 36 bp, Artificial Sequence
  Description of Artificial Sequence: Synthetic oligonucleotide
aaaaagcccacttagcctggcttaaccaaggaaaag

SEQ ID NO: 184885 - DNA, 35 bp, Artificial Sequence
  Description of Artificial Sequence: Synthetic oligonucleotide
aaaagcccacttagcctggcttaaccaaggaaaag

SEQ ID NO: 184886 - DNA, 34 bp, Artificial Sequence
  Description of Artificial Sequence: Synthetic oligonucleotide
aaagcccacttagcctggcttaaccaaggaaaag

SEQ ID NO: 184887 - DNA, 33 bp, Artificial Sequence
  Description of Artificial Sequence: Synthetic oligonucleotide
aagcccacttagcctggcttaaccaaggaaaag

SEQ ID NO: 184888 - DNA, 32 bp, Artificial Sequence
  Description of Artificial Sequence: Synthetic oligonucleotide
agcccacttagcctggcttaaccaaggaaaag

SEQ ID NO: 184889 - DNA, 31 bp, Artificial Sequence
  Description of Artificial Sequence: Synthetic oligonucleotide
gcccacttagcctggcttaaccaaggaaaag

SEQ ID NO: 184890 - DNA, 33 bp, Artificial Sequence
  Description of Artificial Sequence: Synthetic oligonucleotide
cccacttagcctggcttaaccaaggaaaagttc

SEQ ID NO: 184891 - DNA, 35 bp, Artificial Sequence
  Description of Artificial Sequence: Synthetic oligonucleotide
ccacttagcctggcttaaccaaggaaaagttctac

SEQ ID NO: 184892 - DNA, 35 bp, Artificial Sequence
  Description of Artificial Sequence: Synthetic oligonucleotide
cacttagcctggcttaaccaaggaaaagttctacc

SEQ ID NO: 184893 - DNA, 35 bp, Artificial Sequence
  Description of Artificial Sequence: Synthetic oligonucleotide
acttagcctggcttaaccaaggaaaagttctaccc

SEQ ID NO: 184894 - DNA, 34 bp, Artificial Sequence
  Description of Artificial Sequence: Synthetic oligonucleotide
cttagcctggcttaaccaaggaaaagttctaccc

SEQ ID NO: 184895 - DNA, 34 bp, Artificial Sequence
  Description of Artificial Sequence: Synthetic oligonucleotide
ttagcctggcttaaccaaggaaaagttctacccc

SEQ ID NO: 184896 - DNA, 33 bp, Artificial Sequence
  Description of Artificial Sequence: Synthetic oligonucleotide
tagcctggcttaaccaaggaaaagttctacccc

SEQ ID NO: 184897 - DNA, 32 bp, Artificial Sequence
  Description of Artificial Sequence: Synthetic oligonucleotide
agcctggcttaaccaaggaaaagttctacccc

SEQ ID NO: 184898 - DNA, 31 bp, Artificial Sequence
  Description of Artificial Sequence: Synthetic oligonucleotide
gcctggcttaaccaaggaaaagttctacccc

SEQ ID NO: 184899 - DNA, 32 bp, Artificial Sequence
  Description of Artificial Sequence: Synthetic oligonucleotide
cctggcttaaccaaggaaaagttctaccccag

SEQ ID NO: 184900 - DNA, 34 bp, Artificial Sequence
  Description of Artificial Sequence: Synthetic oligonucleotide
ctggcttaaccaaggaaaagttctaccccagaac

SEQ ID NO: 184901 - DNA, 36 bp, Artificial Sequence
  Description of Artificial Sequence: Synthetic oligonucleotide
tggcttaaccaaggaaaagttctaccccagaacatg

SEQ ID NO: 184902 - DNA, 35 bp, Artificial Sequence
  Description of Artificial Sequence: Synthetic oligonucleotide
ggcttaaccaaggaaaagttctaccccagaacatg

SEQ ID NO: 184903 - DNA, 36 bp, Artificial Sequence
  Description of Artificial Sequence: Synthetic oligonucleotide
gcttaaccaaggaaaagttctaccccagaacatgac

SEQ ID NO: 184904 - DNA, 38 bp, Artificial Sequence
  Description of Artificial Sequence: Synthetic oligonucleotide
cttaaccaaggaaaagttctaccccagaacatgactac

SEQ ID NO: 184905 - DNA, 38 bp, Artificial Sequence
  Description of Artificial Sequence: Synthetic oligonucleotide
ttaaccaaggaaaagttctaccccagaacatgactacc

SEQ ID NO: 184906 - DNA, 37 bp, Artificial Sequence
  Description of Artificial Sequence: Synthetic oligonucleotide
taaccaaggaaaagttctaccccagaacatgactacc

SEQ ID NO: 184907 - DNA, 36 bp, Artificial Sequence
  Description of Artificial Sequence: Synthetic oligonucleotide
aaccaaggaaaagttctaccccagaacatgactacc

SEQ ID NO: 184908 - DNA, 35 bp, Artificial Sequence
  Description of Artificial Sequence: Synthetic oligonucleotide
accaaggaaaagttctaccccagaacatgactacc

SEQ ID NO: 184909 - DNA, 34 bp, Artificial Sequence
  Description of Artificial Sequence: Synthetic oligonucleotide
ccaaggaaaagttctaccccagaacatgactacc

SEQ ID NO: 184910 - DNA, 35 bp, Artificial Sequence
  Description of Artificial Sequence: Synthetic oligonucleotide
caaggaaaagttctaccccagaacatgactaccac

SEQ ID NO: 184911 - DNA, 36 bp, Artificial Sequence
  Description of Artificial Sequence: Synthetic oligonucleotide
aaggaaaagttctaccccagaacatgactaccacac

SEQ ID NO: 184912 - DNA, 35 bp, Artificial Sequence
  Description of Artificial Sequence: Synthetic oligonucleotide
aggaaaagttctaccccagaacatgactaccacac

SEQ ID NO: 184913 - DNA, 34 bp, Artificial Sequence
  Description of Artificial Sequence: Synthetic oligonucleotide
ggaaaagttctaccccagaacatgactaccacac

SEQ ID NO: 184914 - DNA, 35 bp, Artificial Sequence
  Description of Artificial Sequence: Synthetic oligonucleotide
gaaaagttctaccccagaacatgactaccacacac

SEQ ID NO: 184915 - DNA, 35 bp, Artificial Sequence
  Description of Artificial Sequence: Synthetic oligonucleotide
aaaagttctaccccagaacatgactaccacacacg

SEQ ID NO: 184916 - DNA, 34 bp, Artificial Sequence
  Description of Artificial Sequence: Synthetic oligonucleotide
aaagttctaccccagaacatgactaccacacacg

SEQ ID NO: 184917 - DNA, 33 bp, Artificial Sequence
  Description of Artificial Sequence: Synthetic oligonucleotide
aagttctaccccagaacatgactaccacacacg

SEQ ID NO: 184918 - DNA, 32 bp, Artificial Sequence
  Description of Artificial Sequence: Synthetic oligonucleotide
agttctaccccagaacatgactaccacacacg

SEQ ID NO: 184919 - DNA, 31 bp, Artificial Sequence
  Description of Artificial Sequence: Synthetic oligonucleotide
gttctaccccagaacatgactaccacacacg

SEQ ID NO: 184920 - DNA, 31 bp, Artificial Sequence
  Description of Artificial Sequence: Synthetic oligonucleotide
ttctaccccagaacatgactaccacacacgc

SEQ ID NO: 184921 - DNA, 30 bp, Artificial Sequence
  Description of Artificial Sequence: Synthetic oligonucleotide
tctaccccagaacatgactaccacacacgc

SEQ ID NO: 184922 - DNA, 29 bp, Artificial Sequence
  Description of Artificial Sequence: Synthetic oligonucleotide
ctaccccagaacatgactaccacacacgc

SEQ ID NO: 184923 - DNA, 30 bp, Artificial Sequence
  Description of Artificial Sequence: Synthetic oligonucleotide
taccccagaacatgactaccacacacgctg

SEQ ID NO: 184924 - DNA, 29 bp, Artificial Sequence
  Description of Artificial Sequence: Synthetic oligonucleotide
accccagaacatgactaccacacacgctg

SEQ ID NO: 184925 - DNA, 28 bp, Artificial Sequence
  Description of Artificial Sequence: Synthetic oligonucleotide
ccccagaacatgactaccacacacgctg

SEQ ID NO: 184926 - DNA, 29 bp, Artificial Sequence
  Description of Artificial Sequence: Synthetic oligonucleotide
cccagaacatgactaccacacacgctgtg

SEQ ID NO: 184927 - DNA, 29 bp, Artificial Sequence
  Description of Artificial Sequence: Synthetic oligonucleotide
ccagaacatgactaccacacacgctgtgg

SEQ ID NO: 184928 - DNA, 29 bp, Artificial Sequence
  Description of Artificial Sequence: Synthetic oligonucleotide
cagaacatgactaccacacacgctgtggc

SEQ ID NO: 184929 - DNA, 35 bp, Artificial Sequence
  Description of Artificial Sequence: Synthetic oligonucleotide
agaacatgactaccacacacgctgtggctattttg

SEQ ID NO: 184930 - DNA, 34 bp, Artificial Sequence
  Description of Artificial Sequence: Synthetic oligonucleotide
gaacatgactaccacacacgctgtggctattttg

SEQ ID NO: 184931 - DNA, 41 bp, Artificial Sequence
  Description of Artificial Sequence: Synthetic oligonucleotide
aacatgactaccacacacgctgtggctattttgttttatac

SEQ ID NO: 184932 - DNA, 40 bp, Artificial Sequence
  Description of Artificial Sequence: Synthetic oligonucleotide
acatgactaccacacacgctgtggctattttgttttatac

SEQ ID NO: 184933 - DNA, 39 bp, Artificial Sequence
  Description of Artificial Sequence: Synthetic oligonucleotide
catgactaccacacacgctgtggctattttgttttatac

SEQ ID NO: 184934 - DNA, 42 bp, Artificial Sequence
  Description of Artificial Sequence: Synthetic oligonucleotide
atgactaccacacacgctgtggctattttgttttatacattg

SEQ ID NO: 184935 - DNA, 41 bp, Artificial Sequence
  Description of Artificial Sequence: Synthetic oligonucleotide
tgactaccacacacgctgtggctattttgttttatacattg

SEQ ID NO: 184936 - DNA, 40 bp, Artificial Sequence
  Description of Artificial Sequence: Synthetic oligonucleotide
gactaccacacacgctgtggctattttgttttatacattg

SEQ ID NO: 184937 - DNA, 42 bp, Artificial Sequence
  Description of Artificial Sequence: Synthetic oligonucleotide
actaccacacacgctgtggctattttgttttatacattgaac

SEQ ID NO: 184938 - DNA, 41 bp, Artificial Sequence
  Description of Artificial Sequence: Synthetic oligonucleotide
ctaccacacacgctgtggctattttgttttatacattgaac

SEQ ID NO: 184939 - DNA, 42 bp, Artificial Sequence
  Description of Artificial Sequence: Synthetic oligonucleotide
taccacacacgctgtggctattttgttttatacattgaacag

SEQ ID NO: 184940 - DNA, 41 bp, Artificial Sequence
  Description of Artificial Sequence: Synthetic oligonucleotide
accacacacgctgtggctattttgttttatacattgaacag

SEQ ID NO: 184941 - DNA, 40 bp, Artificial Sequence
  Description of Artificial Sequence: Synthetic oligonucleotide
ccacacacgctgtggctattttgttttatacattgaacag

SEQ ID NO: 184942 - DNA, 40 bp, Artificial Sequence
  Description of Artificial Sequence: Synthetic oligonucleotide
cacacacgctgtggctattttgttttatacattgaacagc

SEQ ID NO: 184943 - DNA, 43 bp, Artificial Sequence
  Description of Artificial Sequence: Synthetic oligonucleotide
acacacgctgtggctattttgttttatacattgaacagcaatg

SEQ ID NO: 184944 - DNA, 42 bp, Artificial Sequence
  Description of Artificial Sequence: Synthetic oligonucleotide
cacacgctgtggctattttgttttatacattgaacagcaatg

SEQ ID NO: 184945 - DNA, 44 bp, Artificial Sequence
  Description of Artificial Sequence: Synthetic oligonucleotide
acacgctgtggctattttgttttatacattgaacagcaatgttc

SEQ ID NO: 184946 - DNA, 43 bp, Artificial Sequence
  Description of Artificial Sequence: Synthetic oligonucleotide
cacgctgtggctattttgttttatacattgaacagcaatgttc

SEQ ID NO: 184947 - DNA, 46 bp, Artificial Sequence
  Description of Artificial Sequence: Synthetic oligonucleotide
acgctgtggctattttgttttatacattgaacagcaatgttcattc

SEQ ID NO: 184948 - DNA, 45 bp, Artificial Sequence
  Description of Artificial Sequence: Synthetic oligonucleotide
cgctgtggctattttgttttatacattgaacagcaatgttcattc

SEQ ID NO: 184949 - DNA, 46 bp, Artificial Sequence
  Description of Artificial Sequence: Synthetic oligonucleotide
gctgtggctattttgttttatacattgaacagcaatgttcattctg

SEQ ID NO: 184950 - DNA, 47 bp, Artificial Sequence
  Description of Artificial Sequence: Synthetic oligonucleotide
ctgtggctattttgttttatacattgaacagcaatgttcattctgac

SEQ ID NO: 184951 - DNA, 51 bp, Artificial Sequence
  Description of Artificial Sequence: Synthetic oligonucleotide
tgtggctattttgttttatacattgaacagcaatgttcattctgactttac

SEQ ID NO: 184952 - DNA, 50 bp, Artificial Sequence
  Description of Artificial Sequence: Synthetic oligonucleotide
gtggctattttgttttatacattgaacagcaatgttcattctgactttac

SEQ ID NO: 184953 - DNA, 52 bp, Artificial Sequence
  Description of Artificial Sequence: Synthetic oligonucleotide
tggctattttgttttatacattgaacagcaatgttcattctgactttactag

SEQ ID NO: 184954 - DNA, 51 bp, Artificial Sequence
  Description of Artificial Sequence: Synthetic oligonucleotide
ggctattttgttttatacattgaacagcaatgttcattctgactttactag

SEQ ID NO: 184955 - DNA, 52 bp, Artificial Sequence
  Description of Artificial Sequence: Synthetic oligonucleotide
gctattttgttttatacattgaacagcaatgttcattctgactttactagag

SEQ ID NO: 184956 - DNA, 52 bp, Artificial Sequence
  Description of Artificial Sequence: Synthetic oligonucleotide
ctattttgttttatacattgaacagcaatgttcattctgactttactagagc

SEQ ID NO: 184957 - DNA, 52 bp, Artificial Sequence
  Description of Artificial Sequence: Synthetic oligonucleotide
tattttgttttatacattgaacagcaatgttcattctgactttactagagcc

SEQ ID NO: 184958 - DNA, 51 bp, Artificial Sequence
  Description of Artificial Sequence: Synthetic oligonucleotide
attttgttttatacattgaacagcaatgttcattctgactttactagagcc

SEQ ID NO: 184959 - DNA, 50 bp, Artificial Sequence
  Description of Artificial Sequence: Synthetic oligonucleotide
ttttgttttatacattgaacagcaatgttcattctgactttactagagcc

SEQ ID NO: 184960 - DNA, 49 bp, Artificial Sequence
  Description of Artificial Sequence: Synthetic oligonucleotide
tttgttttatacattgaacagcaatgttcattctgactttactagagcc

SEQ ID NO: 184961 - DNA, 48 bp, Artificial Sequence
  Description of Artificial Sequence: Synthetic oligonucleotide
ttgttttatacattgaacagcaatgttcattctgactttactagagcc

SEQ ID NO: 184962 - DNA, 47 bp, Artificial Sequence
  Description of Artificial Sequence: Synthetic oligonucleotide
tgttttatacattgaacagcaatgttcattctgactttactagagcc

SEQ ID NO: 184963 - DNA, 46 bp, Artificial Sequence
  Description of Artificial Sequence: Synthetic oligonucleotide
gttttatacattgaacagcaatgttcattctgactttactagagcc

SEQ ID NO: 184964 - DNA, 48 bp, Artificial Sequence
  Description of Artificial Sequence: Synthetic oligonucleotide
ttttatacattgaacagcaatgttcattctgactttactagagccatg

SEQ ID NO: 184965 - DNA, 47 bp, Artificial Sequence
  Description of Artificial Sequence: Synthetic oligonucleotide
tttatacattgaacagcaatgttcattctgactttactagagccatg

SEQ ID NO: 184966 - DNA, 46 bp, Artificial Sequence
  Description of Artificial Sequence: Synthetic oligonucleotide
ttatacattgaacagcaatgttcattctgactttactagagccatg

SEQ ID NO: 184967 - DNA, 45 bp, Artificial Sequence
  Description of Artificial Sequence: Synthetic oligonucleotide
tatacattgaacagcaatgttcattctgactttactagagccatg

SEQ ID NO: 184968 - DNA, 44 bp, Artificial Sequence
  Description of Artificial Sequence: Synthetic oligonucleotide
atacattgaacagcaatgttcattctgactttactagagccatg

SEQ ID NO: 184969 - DNA, 43 bp, Artificial Sequence
  Description of Artificial Sequence: Synthetic oligonucleotide
tacattgaacagcaatgttcattctgactttactagagccatg

SEQ ID NO: 184970 - DNA, 42 bp, Artificial Sequence
  Description of Artificial Sequence: Synthetic oligonucleotide
acattgaacagcaatgttcattctgactttactagagccatg

SEQ ID NO: 184971 - DNA, 41 bp, Artificial Sequence
  Description of Artificial Sequence: Synthetic oligonucleotide
cattgaacagcaatgttcattctgactttactagagccatg

SEQ ID NO: 184972 - DNA, 41 bp, Artificial Sequence
  Description of Artificial Sequence: Synthetic oligonucleotide
attgaacagcaatgttcattctgactttactagagccatgg

SEQ ID NO: 184973 - DNA, 40 bp, Artificial Sequence
  Description of Artificial Sequence: Synthetic oligonucleotide
ttgaacagcaatgttcattctgactttactagagccatgg

SEQ ID NO: 184974 - DNA, 39 bp, Artificial Sequence
  Description of Artificial Sequence: Synthetic oligonucleotide
tgaacagcaatgttcattctgactttactagagccatgg

SEQ ID NO: 184975 - DNA, 38 bp, Artificial Sequence
  Description of Artificial Sequence: Synthetic oligonucleotide
gaacagcaatgttcattctgactttactagagccatgg

SEQ ID NO: 184976 - DNA, 38 bp, Artificial Sequence
  Description of Artificial Sequence: Synthetic oligonucleotide
aacagcaatgttcattctgactttactagagccatggc

SEQ ID NO: 184977 - DNA, 37 bp, Artificial Sequence
  Description of Artificial Sequence: Synthetic oligonucleotide
acagcaatgttcattctgactttactagagccatggc

SEQ ID NO: 184978 - DNA, 36 bp, Artificial Sequence
  Description of Artificial Sequence: Synthetic oligonucleotide
cagcaatgttcattctgactttactagagccatggc

SEQ ID NO: 184979 - DNA, 36 bp, Artificial Sequence
  Description of Artificial Sequence: Synthetic oligonucleotide
agcaatgttcattctgactttactagagccatggcc

SEQ ID NO: 184980 - DNA, 35 bp, Artificial Sequence
  Description of Artificial Sequence: Synthetic oligonucleotide
gcaatgttcattctgactttactagagccatggcc

SEQ ID NO: 184981 - DNA, 36 bp, Artificial Sequence
  Description of Artificial Sequence: Synthetic oligonucleotide
caatgttcattctgactttactagagccatggcctc

SEQ ID NO: 184982 - DNA, 37 bp, Artificial Sequence
  Description of Artificial Sequence: Synthetic oligonucleotide
aatgttcattctgactttactagagccatggcctctg

SEQ ID NO: 184983 - DNA, 36 bp, Artificial Sequence
  Description of Artificial Sequence: Synthetic oligonucleotide
atgttcattctgactttactagagccatggcctctg

SEQ ID NO: 184984 - DNA, 35 bp, Artificial Sequence
  Description of Artificial Sequence: Synthetic oligonucleotide
tgttcattctgactttactagagccatggcctctg

SEQ ID NO: 184985 - DNA, 34 bp, Artificial Sequence
  Description of Artificial Sequence: Synthetic oligonucleotide
gttcattctgactttactagagccatggcctctg

SEQ ID NO: 184986 - DNA, 36 bp, Artificial Sequence
  Description of Artificial Sequence: Synthetic oligonucleotide
ttcattctgactttactagagccatggcctctgttg

SEQ ID NO: 184987 - DNA, 35 bp, Artificial Sequence
  Description of Artificial Sequence: Synthetic oligonucleotide
tcattctgactttactagagccatggcctctgttg

SEQ ID NO: 184988 - DNA, 34 bp, Artificial Sequence
  Description of Artificial Sequence: Synthetic oligonucleotide
cattctgactttactagagccatggcctctgttg

SEQ ID NO: 184989 - DNA, 34 bp, Artificial Sequence
  Description of Artificial Sequence: Synthetic oligonucleotide
attctgactttactagagccatggcctctgttgc

SEQ ID NO: 184990 - DNA, 33 bp, Artificial Sequence
  Description of Artificial Sequence: Synthetic oligonucleotide
ttctgactttactagagccatggcctctgttgc

SEQ ID NO: 184991 - DNA, 32 bp, Artificial Sequence
  Description of Artificial Sequence: Synthetic oligonucleotide
tctgactttactagagccatggcctctgttgc

SEQ ID NO: 184992 - DNA, 31 bp, Artificial Sequence
  Description of Artificial Sequence: Synthetic oligonucleotide
ctgactttactagagccatggcctctgttgc

SEQ ID NO: 184993 - DNA, 31 bp, Artificial Sequence
  Description of Artificial Sequence: Synthetic oligonucleotide
tgactttactagagccatggcctctgttgcc

SEQ ID NO: 184994 - DNA, 30 bp, Artificial Sequence
  Description of Artificial Sequence: Synthetic oligonucleotide
gactttactagagccatggcctctgttgcc

SEQ ID NO: 184995 - DNA, 31 bp, Artificial Sequence
  Description of Artificial Sequence: Synthetic oligonucleotide
actttactagagccatggcctctgttgccag

SEQ ID NO: 184996 - DNA, 30 bp, Artificial Sequence
  Description of Artificial Sequence: Synthetic oligonucleotide
ctttactagagccatggcctctgttgccag

SEQ ID NO: 184997 - DNA, 30 bp, Artificial Sequence
  Description of Artificial Sequence: Synthetic oligonucleotide
tttactagagccatggcctctgttgccagg

SEQ ID NO: 184998 - DNA, 29 bp, Artificial Sequence
  Description of Artificial Sequence: Synthetic oligonucleotide
ttactagagccatggcctctgttgccagg

SEQ ID NO: 184999 - DNA, 28 bp, Artificial Sequence
  Description of Artificial Sequence: Synthetic oligonucleotide
tactagagccatggcctctgttgccagg

SEQ ID NO: 185000 - DNA, 27 bp, Artificial Sequence
  Description of Artificial Sequence: Synthetic oligonucleotide
actagagccatggcctctgttgccagg

SEQ ID NO: 185001 - DNA, 27 bp, Artificial Sequence
  Description of Artificial Sequence: Synthetic oligonucleotide
ctagagccatggcctctgttgccagga

SEQ ID NO: 185002 - DNA, 27 bp, Artificial Sequence
  Description of Artificial Sequence: Synthetic oligonucleotide
tagagccatggcctctgttgccaggac

SEQ ID NO: 185003 - DNA, 27 bp, Artificial Sequence
  Description of Artificial Sequence: Synthetic oligonucleotide
agagccatggcctctgttgccaggact

SEQ ID NO: 185004 - DNA, 26 bp, Artificial Sequence
  Description of Artificial Sequence: Synthetic oligonucleotide
gagccatggcctctgttgccaggact

SEQ ID NO: 185005 - DNA, 26 bp, Artificial Sequence
  Description of Artificial Sequence: Synthetic oligonucleotide
agccatggcctctgttgccaggactc

SEQ ID NO: 185006 - DNA, 25 bp, Artificial Sequence
  Description of Artificial Sequence: Synthetic oligonucleotide
gccatggcctctgttgccaggactc

SEQ ID NO: 185007 - DNA, 26 bp, Artificial Sequence
  Description of Artificial Sequence: Synthetic oligonucleotide
ccatggcctctgttgccaggactcca

SEQ ID NO: 185008 - DNA, 27 bp, Artificial Sequence
  Description of Artificial Sequence: Synthetic oligonucleotide
catggcctctgttgccaggactccaca

SEQ ID NO: 185009 - DNA, 27 bp, Artificial Sequence
  Description of Artificial Sequence: Synthetic oligonucleotide
atggcctctgttgccaggactccacag

SEQ ID NO: 185010 - DNA, 26 bp, Artificial Sequence
  Description of Artificial Sequence: Synthetic oligonucleotide
tggcctctgttgccaggactccacag

SEQ ID NO: 185011 - DNA, 25 bp, Artificial Sequence
  Description of Artificial Sequence: Synthetic oligonucleotide
ggcctctgttgccaggactccacag

SEQ ID NO: 185012 - DNA, 26 bp, Artificial Sequence
  Description of Artificial Sequence: Synthetic oligonucleotide
gcctctgttgccaggactccacagca

SEQ ID NO: 185013 - DNA, 27 bp, Artificial Sequence
  Description of Artificial Sequence: Synthetic oligonucleotide
cctctgttgccaggactccacagcagt

SEQ ID NO: 185014 - DNA, 29 bp, Artificial Sequence
  Description of Artificial Sequence: Synthetic oligonucleotide
ctctgttgccaggactccacagcagtatg

SEQ ID NO: 185015 - DNA, 31 bp, Artificial Sequence
  Description of Artificial Sequence: Synthetic oligonucleotide
tctgttgccaggactccacagcagtatgaac

SEQ ID NO: 185016 - DNA, 30 bp, Artificial Sequence
  Description of Artificial Sequence: Synthetic oligonucleotide
ctgttgccaggactccacagcagtatgaac

SEQ ID NO: 185017 - DNA, 30 bp, Artificial Sequence
  Description of Artificial Sequence: Synthetic oligonucleotide
tgttgccaggactccacagcagtatgaacg

SEQ ID NO: 185018 - DNA, 29 bp, Artificial Sequence
  Description of Artificial Sequence: Synthetic oligonucleotide
gttgccaggactccacagcagtatgaacg

SEQ ID NO: 185019 - DNA, 31 bp, Artificial Sequence
  Description of Artificial Sequence: Synthetic oligonucleotide
ttgccaggactccacagcagtatgaacgttc

SEQ ID NO: 185020 - DNA, 30 bp, Artificial Sequence
  Description of Artificial Sequence: Synthetic oligonucleotide
tgccaggactccacagcagtatgaacgttc

SEQ ID NO: 185021 - DNA, 29 bp, Artificial Sequence
  Description of Artificial Sequence: Synthetic oligonucleotide
gccaggactccacagcagtatgaacgttc

SEQ ID NO: 185022 - DNA, 32 bp, Artificial Sequence
  Description of Artificial Sequence: Synthetic oligonucleotide
ccaggactccacagcagtatgaacgttcattc

SEQ ID NO: 185023 - DNA, 32 bp, Artificial Sequence
  Description of Artificial Sequence: Synthetic oligonucleotide
caggactccacagcagtatgaacgttcattcc

SEQ ID NO: 185024 - DNA, 33 bp, Artificial Sequence
  Description of Artificial Sequence: Synthetic oligonucleotide
aggactccacagcagtatgaacgttcattccac

SEQ ID NO: 185025 - DNA, 32 bp, Artificial Sequence
  Description of Artificial Sequence: Synthetic oligonucleotide
ggactccacagcagtatgaacgttcattccac

SEQ ID NO: 185026 - DNA, 34 bp, Artificial Sequence
  Description of Artificial Sequence: Synthetic oligonucleotide
gactccacagcagtatgaacgttcattccacttc

SEQ ID NO: 185027 - DNA, 43 bp, Artificial Sequence
  Description of Artificial Sequence: Synthetic oligonucleotide
actccacagcagtatgaacgttcattccacttcaaatatttac

SEQ ID NO: 185028 - DNA, 42 bp, Artificial Sequence
  Description of Artificial Sequence: Synthetic oligonucleotide
ctccacagcagtatgaacgttcattccacttcaaatatttac

SEQ ID NO: 185029 - DNA, 43 bp, Artificial Sequence
  Description of Artificial Sequence: Synthetic oligonucleotide
tccacagcagtatgaacgttcattccacttcaaatatttacac

SEQ ID NO: 185030 - DNA, 42 bp, Artificial Sequence
  Description of Artificial Sequence: Synthetic oligonucleotide
ccacagcagtatgaacgttcattccacttcaaatatttacac

SEQ ID NO: 185031 - DNA, 44 bp, Artificial Sequence
  Description of Artificial Sequence: Synthetic oligonucleotide
cacagcagtatgaacgttcattccacttcaaatatttacactac

SEQ ID NO: 185032 - DNA, 46 bp, Artificial Sequence
  Description of Artificial Sequence: Synthetic oligonucleotide
acagcagtatgaacgttcattccacttcaaatatttacactactac

SEQ ID NO: 185033 - DNA, 45 bp, Artificial Sequence
  Description of Artificial Sequence: Synthetic oligonucleotide
cagcagtatgaacgttcattccacttcaaatatttacactactac

SEQ ID NO: 185034 - DNA, 45 bp, Artificial Sequence
  Description of Artificial Sequence: Synthetic oligonucleotide
agcagtatgaacgttcattccacttcaaatatttacactactacc

SEQ ID NO: 185035 - DNA, 44 bp, Artificial Sequence
  Description of Artificial Sequence: Synthetic oligonucleotide
gcagtatgaacgttcattccacttcaaatatttacactactacc

SEQ ID NO: 185036 - DNA, 45 bp, Artificial Sequence
  Description of Artificial Sequence: Synthetic oligonucleotide
cagtatgaacgttcattccacttcaaatatttacactactacctc

SEQ ID NO: 185037 - DNA, 46 bp, Artificial Sequence
  Description of Artificial Sequence: Synthetic oligonucleotide
agtatgaacgttcattccacttcaaatatttacactactacctcac

SEQ ID NO: 185038 - DNA, 45 bp, Artificial Sequence
  Description of Artificial Sequence: Synthetic oligonucleotide
gtatgaacgttcattccacttcaaatatttacactactacctcac

SEQ ID NO: 185039 - DNA, 45 bp, Artificial Sequence
  Description of Artificial Sequence: Synthetic oligonucleotide
tatgaacgttcattccacttcaaatatttacactactacctcacc

SEQ ID NO: 185040 - DNA, 44 bp, Artificial Sequence
  Description of Artificial Sequence: Synthetic oligonucleotide
atgaacgttcattccacttcaaatatttacactactacctcacc

SEQ ID NO: 185041 - DNA, 43 bp, Artificial Sequence
  Description of Artificial Sequence: Synthetic oligonucleotide
tgaacgttcattccacttcaaatatttacactactacctcacc

SEQ ID NO: 185042 - DNA, 42 bp, Artificial Sequence
  Description of Artificial Sequence: Synthetic oligonucleotide
gaacgttcattccacttcaaatatttacactactacctcacc

SEQ ID NO: 185043 - DNA, 43 bp, Artificial Sequence
  Description of Artificial Sequence: Synthetic oligonucleotide
aacgttcattccacttcaaatatttacactactacctcacctc

SEQ ID NO: 185044 - DNA, 42 bp, Artificial Sequence
  Description of Artificial Sequence: Synthetic oligonucleotide
acgttcattccacttcaaatatttacactactacctcacctc

SEQ ID NO: 185045 - DNA, 41 bp, Artificial Sequence
  Description of Artificial Sequence: Synthetic oligonucleotide
cgttcattccacttcaaatatttacactactacctcacctc

SEQ ID NO: 185046 - DNA, 42 bp, Artificial Sequence
  Description of Artificial Sequence: Synthetic oligonucleotide
gttcattccacttcaaatatttacactactacctcacctcag

SEQ ID NO: 185047 - DNA, 42 bp, Artificial Sequence
  Description of Artificial Sequence: Synthetic oligonucleotide
ttcattccacttcaaatatttacactactacctcacctcagc

SEQ ID NO: 185048 - DNA, 41 bp, Artificial Sequence
  Description of Artificial Sequence: Synthetic oligonucleotide
tcattccacttcaaatatttacactactacctcacctcagc

SEQ ID NO: 185049 - DNA, 40 bp, Artificial Sequence
  Description of Artificial Sequence: Synthetic oligonucleotide
cattccacttcaaatatttacactactacctcacctcagc

SEQ ID NO: 185050 - DNA, 43 bp, Artificial Sequence
  Description of Artificial Sequence: Synthetic oligonucleotide
attccacttcaaatatttacactactacctcacctcagcaatc

SEQ ID NO: 185051 - DNA, 42 bp, Artificial Sequence
  Description of Artificial Sequence: Synthetic oligonucleotide
ttccacttcaaatatttacactactacctcacctcagcaatc

SEQ ID NO: 185052 - DNA, 41 bp, Artificial Sequence
  Description of Artificial Sequence: Synthetic oligonucleotide
tccacttcaaatatttacactactacctcacctcagcaatc

SEQ ID NO: 185053 - DNA, 40 bp, Artificial Sequence
  Description of Artificial Sequence: Synthetic oligonucleotide
ccacttcaaatatttacactactacctcacctcagcaatc

SEQ ID NO: 185054 - DNA, 40 bp, Artificial Sequence
  Description of Artificial Sequence: Synthetic oligonucleotide
cacttcaaatatttacactactacctcacctcagcaatcc

SEQ ID NO: 185055 - DNA, 41 bp, Artificial Sequence
  Description of Artificial Sequence: Synthetic oligonucleotide
acttcaaatatttacactactacctcacctcagcaatccag

SEQ ID NO: 185056 - DNA, 40 bp, Artificial Sequence
  Description of Artificial Sequence: Synthetic oligonucleotide
cttcaaatatttacactactacctcacctcagcaatccag

SEQ ID NO: 185057 - DNA, 40 bp, Artificial Sequence
  Description of Artificial Sequence: Synthetic oligonucleotide
ttcaaatatttacactactacctcacctcagcaatccagc

SEQ ID NO: 185058 - DNA, 39 bp, Artificial Sequence
  Description of Artificial Sequence: Synthetic oligonucleotide
tcaaatatttacactactacctcacctcagcaatccagc

SEQ ID NO: 185059 - DNA, 38 bp, Artificial Sequence
  Description of Artificial Sequence: Synthetic oligonucleotide
caaatatttacactactacctcacctcagcaatccagc

SEQ ID NO: 185060 - DNA, 39 bp, Artificial Sequence
  Description of Artificial Sequence: Synthetic oligonucleotide
aaatatttacactactacctcacctcagcaatccagctg

SEQ ID NO: 185061 - DNA, 38 bp, Artificial Sequence
  Description of Artificial Sequence: Synthetic oligonucleotide
aatatttacactactacctcacctcagcaatccagctg

SEQ ID NO: 185062 - DNA, 37 bp, Artificial Sequence
  Description of Artificial Sequence: Synthetic oligonucleotide
atatttacactactacctcacctcagcaatccagctg

SEQ ID NO: 185063 - DNA, 36 bp, Artificial Sequence
  Description of Artificial Sequence: Synthetic oligonucleotide
tatttacactactacctcacctcagcaatccagctg

SEQ ID NO: 185064 - DNA, 35 bp, Artificial Sequence
  Description of Artificial Sequence: Synthetic oligonucleotide
atttacactactacctcacctcagcaatccagctg

SEQ ID NO: 185065 - DNA, 34 bp, Artificial Sequence
  Description of Artificial Sequence: Synthetic oligonucleotide
tttacactactacctcacctcagcaatccagctg

SEQ ID NO: 185066 - DNA, 33 bp, Artificial Sequence
  Description of Artificial Sequence: Synthetic oligonucleotide
ttacactactacctcacctcagcaatccagctg

SEQ ID NO: 185067 - DNA, 32 bp, Artificial Sequence
  Description of Artificial Sequence: Synthetic oligonucleotide
tacactactacctcacctcagcaatccagctg

SEQ ID NO: 185068 - DNA, 31 bp, Artificial Sequence
  Description of Artificial Sequence: Synthetic oligonucleotide
acactactacctcacctcagcaatccagctg

SEQ ID NO: 185069 - DNA, 30 bp, Artificial Sequence
  Description of Artificial Sequence: Synthetic oligonucleotide
cactactacctcacctcagcaatccagctg

SEQ ID NO: 185070 - DNA, 30 bp, Artificial Sequence
  Description of Artificial Sequence: Synthetic oligonucleotide
actactacctcacctcagcaatccagctgc

SEQ ID NO: 185071 - DNA, 29 bp, Artificial Sequence
  Description of Artificial Sequence: Synthetic oligonucleotide
ctactacctcacctcagcaatccagctgc

SEQ ID NO: 185072 - DNA, 30 bp, Artificial Sequence
  Description of Artificial Sequence: Synthetic oligonucleotide
tactacctcacctcagcaatccagctgctg

SEQ ID NO: 185073 - DNA, 29 bp, Artificial Sequence
  Description of Artificial Sequence: Synthetic oligonucleotide
actacctcacctcagcaatccagctgctg

SEQ ID NO: 185074 - DNA, 28 bp, Artificial Sequence
  Description of Artificial Sequence: Synthetic oligonucleotide
ctacctcacctcagcaatccagctgctg

SEQ ID NO: 185075 - DNA, 29 bp, Artificial Sequence
  Description of Artificial Sequence: Synthetic oligonucleotide
tacctcacctcagcaatccagctgctgag

SEQ ID NO: 185076 - DNA, 28 bp, Artificial Sequence
  Description of Artificial Sequence: Synthetic oligonucleotide
acctcacctcagcaatccagctgctgag

SEQ ID NO: 185077 - DNA, 27 bp, Artificial Sequence
  Description of Artificial Sequence: Synthetic oligonucleotide
cctcacctcagcaatccagctgctgag

SEQ ID NO: 185078 - DNA, 27 bp, Artificial Sequence
  Description of Artificial Sequence: Synthetic oligonucleotide
ctcacctcagcaatccagctgctgagg

SEQ ID NO: 185079 - DNA, 30 bp, Artificial Sequence
  Description of Artificial Sequence: Synthetic oligonucleotide
tcacctcagcaatccagctgctgaggaaag

SEQ ID NO: 185080 - DNA, 29 bp, Artificial Sequence
  Description of Artificial Sequence: Synthetic oligonucleotide
cacctcagcaatccagctgctgaggaaag

SEQ ID NO: 185081 - DNA, 30 bp, Artificial Sequence
  Description of Artificial Sequence: Synthetic oligonucleotide
acctcagcaatccagctgctgaggaaagac

SEQ ID NO: 185082 - DNA, 29 bp, Artificial Sequence
  Description of Artificial Sequence: Synthetic oligonucleotide
cctcagcaatccagctgctgaggaaagac

SEQ ID NO: 185083 - DNA, 30 bp, Artificial Sequence
  Description of Artificial Sequence: Synthetic oligonucleotide
ctcagcaatccagctgctgaggaaagacag

SEQ ID NO: 185084 - DNA, 30 bp, Artificial Sequence
  Description of Artificial Sequence: Synthetic oligonucleotide
tcagcaatccagctgctgaggaaagacagc

SEQ ID NO: 185085 - DNA, 29 bp, Artificial Sequence
  Description of Artificial Sequence: Synthetic oligonucleotide
cagcaatccagctgctgaggaaagacagc

SEQ ID NO: 185086 - DNA, 31 bp, Artificial Sequence
  Description of Artificial Sequence: Synthetic oligonucleotide
agcaatccagctgctgaggaaagacagcatc

SEQ ID NO: 185087 - DNA, 30 bp, Artificial Sequence
  Description of Artificial Sequence: Synthetic oligonucleotide
gcaatccagctgctgaggaaagacagcatc

SEQ ID NO: 185088 - DNA, 32 bp, Artificial Sequence
  Description of Artificial Sequence: Synthetic oligonucleotide
caatccagctgctgaggaaagacagcatcatg

SEQ ID NO: 185089 - DNA, 32 bp, Artificial Sequence
  Description of Artificial Sequence: Synthetic oligonucleotide
aatccagctgctgaggaaagacagcatcatgg

SEQ ID NO: 185090 - DNA, 31 bp, Artificial Sequence
  Description of Artificial Sequence: Synthetic oligonucleotide
atccagctgctgaggaaagacagcatcatgg

SEQ ID NO: 185091 - DNA, 30 bp, Artificial Sequence
  Description of Artificial Sequence: Synthetic oligonucleotide
tccagctgctgaggaaagacagcatcatgg

SEQ ID NO: 185092 - DNA, 29 bp, Artificial Sequence
  Description of Artificial Sequence: Synthetic oligonucleotide
ccagctgctgaggaaagacagcatcatgg

SEQ ID NO: 185093 - DNA, 30 bp, Artificial Sequence
  Description of Artificial Sequence: Synthetic oligonucleotide
cagctgctgaggaaagacagcatcatggag

SEQ ID NO: 185094 - DNA, 33 bp, Artificial Sequence
  Description of Artificial Sequence: Synthetic oligonucleotide
agctgctgaggaaagacagcatcatggagaatg

SEQ ID NO: 185095 - DNA, 32 bp, Artificial Sequence
  Description of Artificial Sequence: Synthetic oligonucleotide
gctgctgaggaaagacagcatcatggagaatg

SEQ ID NO: 185096 - DNA, 32 bp, Artificial Sequence
  Description of Artificial Sequence: Synthetic oligonucleotide
ctgctgaggaaagacagcatcatggagaatgg

SEQ ID NO: 185097 - DNA, 32 bp, Artificial Sequence
  Description of Artificial Sequence: Synthetic oligonucleotide
tgctgaggaaagacagcatcatggagaatggc

SEQ ID NO: 185098 - DNA, 31 bp, Artificial Sequence
  Description of Artificial Sequence: Synthetic oligonucleotide
gctgaggaaagacagcatcatggagaatggc

SEQ ID NO: 185099 - DNA, 32 bp, Artificial Sequence
  Description of Artificial Sequence: Synthetic oligonucleotide
ctgaggaaagacagcatcatggagaatggcac

SEQ ID NO: 185100 - DNA, 33 bp, Artificial Sequence
  Description of Artificial Sequence: Synthetic oligonucleotide
tgaggaaagacagcatcatggagaatggcactc

SEQ ID NO: 185101 - DNA, 32 bp, Artificial Sequence
  Description of Artificial Sequence: Synthetic oligonucleotide
gaggaaagacagcatcatggagaatggcactc

SEQ ID NO: 185102 - DNA, 33 bp, Artificial Sequence
  Description of Artificial Sequence: Synthetic oligonucleotide
aggaaagacagcatcatggagaatggcactctg

SEQ ID NO: 185103 - DNA, 32 bp, Artificial Sequence
  Description of Artificial Sequence: Synthetic oligonucleotide
ggaaagacagcatcatggagaatggcactctg

SEQ ID NO: 185104 - DNA, 33 bp, Artificial Sequence
  Description of Artificial Sequence: Synthetic oligonucleotide
gaaagacagcatcatggagaatggcactctgtg

SEQ ID NO: 185105 - DNA, 33 bp, Artificial Sequence
  Description of Artificial Sequence: Synthetic oligonucleotide
aaagacagcatcatggagaatggcactctgtgc

SEQ ID NO: 185106 - DNA, 32 bp, Artificial Sequence
  Description of Artificial Sequence: Synthetic oligonucleotide
aagacagcatcatggagaatggcactctgtgc

SEQ ID NO: 185107 - DNA, 31 bp, Artificial Sequence
  Description of Artificial Sequence: Synthetic oligonucleotide
agacagcatcatggagaatggcactctgtgc

SEQ ID NO: 185108 - DNA, 30 bp, Artificial Sequence
  Description of Artificial Sequence: Synthetic oligonucleotide
gacagcatcatggagaatggcactctgtgc

SEQ ID NO: 185109 - DNA, 33 bp, Artificial Sequence
  Description of Artificial Sequence: Synthetic oligonucleotide
acagcatcatggagaatggcactctgtgctatg

SEQ ID NO: 185110 - DNA, 32 bp, Artificial Sequence
  Description of Artificial Sequence: Synthetic oligonucleotide
cagcatcatggagaatggcactctgtgctatg

SEQ ID NO: 185111 - DNA, 33 bp, Artificial Sequence
  Description of Artificial Sequence: Synthetic oligonucleotide
agcatcatggagaatggcactctgtgctatgag

SEQ ID NO: 185112 - DNA, 32 bp, Artificial Sequence
  Description of Artificial Sequence: Synthetic oligonucleotide
gcatcatggagaatggcactctgtgctatgag

SEQ ID NO: 185113 - DNA, 32 bp, Artificial Sequence
  Description of Artificial Sequence: Synthetic oligonucleotide
catcatggagaatggcactctgtgctatgagg

SEQ ID NO: 185114 - DNA, 33 bp, Artificial Sequence
  Description of Artificial Sequence: Synthetic oligonucleotide
atcatggagaatggcactctgtgctatgaggtg

SEQ ID NO: 185115 - DNA, 32 bp, Artificial Sequence
  Description of Artificial Sequence: Synthetic oligonucleotide
tcatggagaatggcactctgtgctatgaggtg

SEQ ID NO: 185116 - DNA, 31 bp, Artificial Sequence
  Description of Artificial Sequence: Synthetic oligonucleotide
catggagaatggcactctgtgctatgaggtg

SEQ ID NO: 185117 - DNA, 31 bp, Artificial Sequence
  Description of Artificial Sequence: Synthetic oligonucleotide
atggagaatggcactctgtgctatgaggtgc

SEQ ID NO: 185118 - DNA, 30 bp, Artificial Sequence
  Description of Artificial Sequence: Synthetic oligonucleotide
tggagaatggcactctgtgctatgaggtgc

SEQ ID NO: 185119 - DNA, 29 bp, Artificial Sequence
  Description of Artificial Sequence: Synthetic oligonucleotide
ggagaatggcactctgtgctatgaggtgc

SEQ ID NO: 185120 - DNA, 35 bp, Artificial Sequence
  Description of Artificial Sequence: Synthetic oligonucleotide
gagaatggcactctgtgctatgaggtgcattatag

SEQ ID NO: 185121 - DNA, 35 bp, Artificial Sequence
  Description of Artificial Sequence: Synthetic oligonucleotide
agaatggcactctgtgctatgaggtgcattatagg

SEQ ID NO: 185122 - DNA, 34 bp, Artificial Sequence
  Description of Artificial Sequence: Synthetic oligonucleotide
gaatggcactctgtgctatgaggtgcattatagg

SEQ ID NO: 185123 - DNA, 35 bp, Artificial Sequence
  Description of Artificial Sequence: Synthetic oligonucleotide
aatggcactctgtgctatgaggtgcattataggac

SEQ ID NO: 185124 - DNA, 34 bp, Artificial Sequence
  Description of Artificial Sequence: Synthetic oligonucleotide
atggcactctgtgctatgaggtgcattataggac

SEQ ID NO: 185125 - DNA, 33 bp, Artificial Sequence
  Description of Artificial Sequence: Synthetic oligonucleotide
tggcactctgtgctatgaggtgcattataggac

SEQ ID NO: 185126 - DNA, 32 bp, Artificial Sequence
  Description of Artificial Sequence: Synthetic oligonucleotide
ggcactctgtgctatgaggtgcattataggac

SEQ ID NO: 185127 - DNA, 32 bp, Artificial Sequence
  Description of Artificial Sequence: Synthetic oligonucleotide
gcactctgtgctatgaggtgcattataggacg

SEQ ID NO: 185128 - DNA, 34 bp, Artificial Sequence
  Description of Artificial Sequence: Synthetic oligonucleotide
cactctgtgctatgaggtgcattataggacgaag

SEQ ID NO: 185129 - DNA, 34 bp, Artificial Sequence
  Description of Artificial Sequence: Synthetic oligonucleotide
actctgtgctatgaggtgcattataggacgaagg

SEQ ID NO: 185130 - DNA, 33 bp, Artificial Sequence
  Description of Artificial Sequence: Synthetic oligonucleotide
ctctgtgctatgaggtgcattataggacgaagg

SEQ ID NO: 185131 - DNA, 35 bp, Artificial Sequence
  Description of Artificial Sequence: Synthetic oligonucleotide
tctgtgctatgaggtgcattataggacgaaggatg

SEQ ID NO: 185132 - DNA, 34 bp, Artificial Sequence
  Description of Artificial Sequence: Synthetic oligonucleotide
ctgtgctatgaggtgcattataggacgaaggatg

SEQ ID NO: 185133 - DNA, 35 bp, Artificial Sequence
  Description of Artificial Sequence: Synthetic oligonucleotide
tgtgctatgaggtgcattataggacgaaggatgtc

SEQ ID NO: 185134 - DNA, 34 bp, Artificial Sequence
  Description of Artificial Sequence: Synthetic oligonucleotide
gtgctatgaggtgcattataggacgaaggatgtc

SEQ ID NO: 185135 - DNA, 34 bp, Artificial Sequence
  Description of Artificial Sequence: Synthetic oligonucleotide
tgctatgaggtgcattataggacgaaggatgtcc

SEQ ID NO: 185136 - DNA, 33 bp, Artificial Sequence
  Description of Artificial Sequence: Synthetic oligonucleotide
gctatgaggtgcattataggacgaaggatgtcc

SEQ ID NO: 185137 - DNA, 34 bp, Artificial Sequence
  Description of Artificial Sequence: Synthetic oligonucleotide
ctatgaggtgcattataggacgaaggatgtccac

SEQ ID NO: 185138 - DNA, 40 bp, Artificial Sequence
  Description of Artificial Sequence: Synthetic oligonucleotide
tatgaggtgcattataggacgaaggatgtccactttaatg

SEQ ID NO: 185139 - DNA, 39 bp, Artificial Sequence
  Description of Artificial Sequence: Synthetic oligonucleotide
atgaggtgcattataggacgaaggatgtccactttaatg

SEQ ID NO: 185140 - DNA, 38 bp, Artificial Sequence
  Description of Artificial Sequence: Synthetic oligonucleotide
tgaggtgcattataggacgaaggatgtccactttaatg

SEQ ID NO: 185141 - DNA, 37 bp, Artificial Sequence
  Description of Artificial Sequence: Synthetic oligonucleotide
gaggtgcattataggacgaaggatgtccactttaatg

SEQ ID NO: 185142 - DNA, 37 bp, Artificial Sequence
  Description of Artificial Sequence: Synthetic oligonucleotide
aggtgcattataggacgaaggatgtccactttaatgc

SEQ ID NO: 185143 - DNA, 36 bp, Artificial Sequence
  Description of Artificial Sequence: Synthetic oligonucleotide
ggtgcattataggacgaaggatgtccactttaatgc

SEQ ID NO: 185144 - DNA, 36 bp, Artificial Sequence
  Description of Artificial Sequence: Synthetic oligonucleotide
gtgcattataggacgaaggatgtccactttaatgcc

SEQ ID NO: 185145 - DNA, 38 bp, Artificial Sequence
  Description of Artificial Sequence: Synthetic oligonucleotide
tgcattataggacgaaggatgtccactttaatgcctac

SEQ ID NO: 185146 - DNA, 37 bp, Artificial Sequence
  Description of Artificial Sequence: Synthetic oligonucleotide
gcattataggacgaaggatgtccactttaatgcctac

SEQ ID NO: 185147 - DNA, 38 bp, Artificial Sequence
  Description of Artificial Sequence: Synthetic oligonucleotide
cattataggacgaaggatgtccactttaatgcctacac

SEQ ID NO: 185148 - DNA, 39 bp, Artificial Sequence
  Description of Artificial Sequence: Synthetic oligonucleotide
attataggacgaaggatgtccactttaatgcctacacag

SEQ ID NO: 185149 - DNA, 38 bp, Artificial Sequence
  Description of Artificial Sequence: Synthetic oligonucleotide
ttataggacgaaggatgtccactttaatgcctacacag

SEQ ID NO: 185150 - DNA, 37 bp, Artificial Sequence
  Description of Artificial Sequence: Synthetic oligonucleotide
tataggacgaaggatgtccactttaatgcctacacag

SEQ ID NO: 185151 - DNA, 36 bp, Artificial Sequence
  Description of Artificial Sequence: Synthetic oligonucleotide
ataggacgaaggatgtccactttaatgcctacacag

SEQ ID NO: 185152 - DNA, 35 bp, Artificial Sequence
  Description of Artificial Sequence: Synthetic oligonucleotide
taggacgaaggatgtccactttaatgcctacacag

SEQ ID NO: 185153 - DNA, 34 bp, Artificial Sequence
  Description of Artificial Sequence: Synthetic oligonucleotide
aggacgaaggatgtccactttaatgcctacacag

SEQ ID NO: 185154 - DNA, 33 bp, Artificial Sequence
  Description of Artificial Sequence: Synthetic oligonucleotide
ggacgaaggatgtccactttaatgcctacacag

SEQ ID NO: 185155 - DNA, 33 bp, Artificial Sequence
  Description of Artificial Sequence: Synthetic oligonucleotide
gacgaaggatgtccactttaatgcctacacagg

SEQ ID NO: 185156 - DNA, 33 bp, Artificial Sequence
  Description of Artificial Sequence: Synthetic oligonucleotide
acgaaggatgtccactttaatgcctacacaggg

SEQ ID NO: 185157 - DNA, 32 bp, Artificial Sequence
  Description of Artificial Sequence: Synthetic oligonucleotide
cgaaggatgtccactttaatgcctacacaggg

SEQ ID NO: 185158 - DNA, 32 bp, Artificial Sequence
  Description of Artificial Sequence: Synthetic oligonucleotide
gaaggatgtccactttaatgcctacacagggg

SEQ ID NO: 185159 - DNA, 32 bp, Artificial Sequence
  Description of Artificial Sequence: Synthetic oligonucleotide
aaggatgtccactttaatgcctacacaggggc

SEQ ID NO: 185160 - DNA, 31 bp, Artificial Sequence
  Description of Artificial Sequence: Synthetic oligonucleotide
aggatgtccactttaatgcctacacaggggc

SEQ ID NO: 185161 - DNA, 30 bp, Artificial Sequence
  Description of Artificial Sequence: Synthetic oligonucleotide
ggatgtccactttaatgcctacacaggggc

SEQ ID NO: 185162 - DNA, 30 bp, Artificial Sequence
  Description of Artificial Sequence: Synthetic oligonucleotide
gatgtccactttaatgcctacacaggggcc

SEQ ID NO: 185163 - DNA, 31 bp, Artificial Sequence
  Description of Artificial Sequence: Synthetic oligonucleotide
atgtccactttaatgcctacacaggggccac

SEQ ID NO: 185164 - DNA, 30 bp, Artificial Sequence
  Description of Artificial Sequence: Synthetic oligonucleotide
tgtccactttaatgcctacacaggggccac

SEQ ID NO: 185165 - DNA, 29 bp, Artificial Sequence
  Description of Artificial Sequence: Synthetic oligonucleotide
gtccactttaatgcctacacaggggccac

SEQ ID NO: 185166 - DNA, 29 bp, Artificial Sequence
  Description of Artificial Sequence: Synthetic oligonucleotide
tccactttaatgcctacacaggggccacc

SEQ ID NO: 185167 - DNA, 28 bp, Artificial Sequence
  Description of Artificial Sequence: Synthetic oligonucleotide
ccactttaatgcctacacaggggccacc

SEQ ID NO: 185168 - DNA, 31 bp, Artificial Sequence
  Description of Artificial Sequence: Synthetic oligonucleotide
cactttaatgcctacacaggggccaccattc

SEQ ID NO: 185169 - DNA, 31 bp, Artificial Sequence
  Description of Artificial Sequence: Synthetic oligonucleotide
actttaatgcctacacaggggccaccattcg

SEQ ID NO: 185170 - DNA, 30 bp, Artificial Sequence
  Description of Artificial Sequence: Synthetic oligonucleotide
ctttaatgcctacacaggggccaccattcg

SEQ ID NO: 185171 - DNA, 34 bp, Artificial Sequence
  Description of Artificial Sequence: Synthetic oligonucleotide
tttaatgcctacacaggggccaccattcgatttg

SEQ ID NO: 185172 - DNA, 33 bp, Artificial Sequence
  Description of Artificial Sequence: Synthetic oligonucleotide
ttaatgcctacacaggggccaccattcgatttg

SEQ ID NO: 185173 - DNA, 32 bp, Artificial Sequence
  Description of Artificial Sequence: Synthetic oligonucleotide
taatgcctacacaggggccaccattcgatttg

SEQ ID NO: 185174 - DNA, 31 bp, Artificial Sequence
  Description of Artificial Sequence: Synthetic oligonucleotide
aatgcctacacaggggccaccattcgatttg

SEQ ID NO: 185175 - DNA, 30 bp, Artificial Sequence
  Description of Artificial Sequence: Synthetic oligonucleotide
atgcctacacaggggccaccattcgatttg

SEQ ID NO: 185176 - DNA, 29 bp, Artificial Sequence
  Description of Artificial Sequence: Synthetic oligonucleotide
tgcctacacaggggccaccattcgatttg

SEQ ID NO: 185177 - DNA, 28 bp, Artificial Sequence
  Description of Artificial Sequence: Synthetic oligonucleotide
gcctacacaggggccaccattcgatttg

SEQ ID NO: 185178 - DNA, 28 bp, Artificial Sequence
  Description of Artificial Sequence: Synthetic oligonucleotide
cctacacaggggccaccattcgatttgg

SEQ ID NO: 185179 - DNA, 28 bp, Artificial Sequence
  Description of Artificial Sequence: Synthetic oligonucleotide
ctacacaggggccaccattcgatttggc

SEQ ID NO: 185180 - DNA, 28 bp, Artificial Sequence
  Description of Artificial Sequence: Synthetic oligonucleotide
tacacaggggccaccattcgatttggcc

SEQ ID NO: 185181 - DNA, 27 bp, Artificial Sequence
  Description of Artificial Sequence: Synthetic oligonucleotide
acacaggggccaccattcgatttggcc

SEQ ID NO: 185182 - DNA, 27 bp, Artificial Sequence
  Description of Artificial Sequence: Synthetic oligonucleotide
cacaggggccaccattcgatttggcca

SEQ ID NO: 185183 - DNA, 30 bp, Artificial Sequence
  Description of Artificial Sequence: Synthetic oligonucleotide
acaggggccaccattcgatttggccaattc

SEQ ID NO: 185184 - DNA, 29 bp, Artificial Sequence
  Description of Artificial Sequence: Synthetic oligonucleotide
caggggccaccattcgatttggccaattc

SEQ ID NO: 185185 - DNA, 29 bp, Artificial Sequence
  Description of Artificial Sequence: Synthetic oligonucleotide
aggggccaccattcgatttggccaattcc

SEQ ID NO: 185186 - DNA, 28 bp, Artificial Sequence
  Description of Artificial Sequence: Synthetic oligonucleotide
ggggccaccattcgatttggccaattcc

SEQ ID NO: 185187 - DNA, 29 bp, Artificial Sequence
  Description of Artificial Sequence: Synthetic oligonucleotide
gggccaccattcgatttggccaattcctc

SEQ ID NO: 185188 - DNA, 30 bp, Artificial Sequence
  Description of Artificial Sequence: Synthetic oligonucleotide
ggccaccattcgatttggccaattcctctc

SEQ ID NO: 185189 - DNA, 30 bp, Artificial Sequence
  Description of Artificial Sequence: Synthetic oligonucleotide
gccaccattcgatttggccaattcctctcc

SEQ ID NO: 185190 - DNA, 31 bp, Artificial Sequence
  Description of Artificial Sequence: Synthetic oligonucleotide
ccaccattcgatttggccaattcctctccac

SEQ ID NO: 185191 - DNA, 33 bp, Artificial Sequence
  Description of Artificial Sequence: Synthetic oligonucleotide
caccattcgatttggccaattcctctccacatc

SEQ ID NO: 185192 - DNA, 33 bp, Artificial Sequence
  Description of Artificial Sequence: Synthetic oligonucleotide
accattcgatttggccaattcctctccacatcc

SEQ ID NO: 185193 - DNA, 32 bp, Artificial Sequence
  Description of Artificial Sequence: Synthetic oligonucleotide
ccattcgatttggccaattcctctccacatcc

SEQ ID NO: 185194 - DNA, 32 bp, Artificial Sequence
  Description of Artificial Sequence: Synthetic oligonucleotide
cattcgatttggccaattcctctccacatccc

SEQ ID NO: 185195 - DNA, 33 bp, Artificial Sequence
  Description of Artificial Sequence: Synthetic oligonucleotide
attcgatttggccaattcctctccacatccctc

SEQ ID NO: 185196 - DNA, 32 bp, Artificial Sequence
  Description of Artificial Sequence: Synthetic oligonucleotide
ttcgatttggccaattcctctccacatccctc

SEQ ID NO: 185197 - DNA, 31 bp, Artificial Sequence
  Description of Artificial Sequence: Synthetic oligonucleotide
tcgatttggccaattcctctccacatccctc

SEQ ID NO: 185198 - DNA, 30 bp, Artificial Sequence
  Description of Artificial Sequence: Synthetic oligonucleotide
cgatttggccaattcctctccacatccctc

SEQ ID NO: 185199 - DNA, 30 bp, Artificial Sequence
  Description of Artificial Sequence: Synthetic oligonucleotide
gatttggccaattcctctccacatccctcc

SEQ ID NO: 185200 - DNA, 31 bp, Artificial Sequence
  Description of Artificial Sequence: Synthetic oligonucleotide
atttggccaattcctctccacatccctcctg

SEQ ID NO: 185201 - DNA, 30 bp, Artificial Sequence
  Description of Artificial Sequence: Synthetic oligonucleotide
tttggccaattcctctccacatccctcctg

SEQ ID NO: 185202 - DNA, 29 bp, Artificial Sequence
  Description of Artificial Sequence: Synthetic oligonucleotide
ttggccaattcctctccacatccctcctg

SEQ ID NO: 185203 - DNA, 28 bp, Artificial Sequence
  Description of Artificial Sequence: Synthetic oligonucleotide
tggccaattcctctccacatccctcctg

SEQ ID NO: 185204 - DNA, 27 bp, Artificial Sequence
  Description of Artificial Sequence: Synthetic oligonucleotide
ggccaattcctctccacatccctcctg

SEQ ID NO: 185205 - DNA, 30 bp, Artificial Sequence
  Description of Artificial Sequence: Synthetic oligonucleotide
gccaattcctctccacatccctcctgaaag

SEQ ID NO: 185206 - DNA, 32 bp, Artificial Sequence
  Description of Artificial Sequence: Synthetic oligonucleotide
ccaattcctctccacatccctcctgaaagaag

SEQ ID NO: 185207 - DNA, 33 bp, Artificial Sequence
  Description of Artificial Sequence: Synthetic oligonucleotide
caattcctctccacatccctcctgaaagaagag

SEQ ID NO: 185208 - DNA, 33 bp, Artificial Sequence
  Description of Artificial Sequence: Synthetic oligonucleotide
aattcctctccacatccctcctgaaagaagagg

SEQ ID NO: 185209 - DNA, 32 bp, Artificial Sequence
  Description of Artificial Sequence: Synthetic oligonucleotide
attcctctccacatccctcctgaaagaagagg

SEQ ID NO: 185210 - DNA, 31 bp, Artificial Sequence
  Description of Artificial Sequence: Synthetic oligonucleotide
ttcctctccacatccctcctgaaagaagagg

SEQ ID NO: 185211 - DNA, 30 bp, Artificial Sequence
  Description of Artificial Sequence: Synthetic oligonucleotide
tcctctccacatccctcctgaaagaagagg

SEQ ID NO: 185212 - DNA, 29 bp, Artificial Sequence
  Description of Artificial Sequence: Synthetic oligonucleotide
cctctccacatccctcctgaaagaagagg

SEQ ID NO: 185213 - DNA, 29 bp, Artificial Sequence
  Description of Artificial Sequence: Synthetic oligonucleotide
ctctccacatccctcctgaaagaagaggc

SEQ ID NO: 185214 - DNA, 30 bp, Artificial Sequence
  Description of Artificial Sequence: Synthetic oligonucleotide
tctccacatccctcctgaaagaagaggcac

SEQ ID NO: 185215 - DNA, 29 bp, Artificial Sequence
  Description of Artificial Sequence: Synthetic oligonucleotide
ctccacatccctcctgaaagaagaggcac

SEQ ID NO: 185216 - DNA, 30 bp, Artificial Sequence
  Description of Artificial Sequence: Synthetic oligonucleotide
tccacatccctcctgaaagaagaggcacag

SEQ ID NO: 185217 - DNA, 29 bp, Artificial Sequence
  Description of Artificial Sequence: Synthetic oligonucleotide
ccacatccctcctgaaagaagaggcacag

SEQ ID NO: 185218 - DNA, 29 bp, Artificial Sequence
  Description of Artificial Sequence: Synthetic oligonucleotide
cacatccctcctgaaagaagaggcacagg

SEQ ID NO: 185219 - DNA, 30 bp, Artificial Sequence
  Description of Artificial Sequence: Synthetic oligonucleotide
acatccctcctgaaagaagaggcacaggag

SEQ ID NO: 185220 - DNA, 29 bp, Artificial Sequence
  Description of Artificial Sequence: Synthetic oligonucleotide
catccctcctgaaagaagaggcacaggag

SEQ ID NO: 185221 - DNA, 32 bp, Artificial Sequence
  Description of Artificial Sequence: Synthetic oligonucleotide
atccctcctgaaagaagaggcacaggagtttg

SEQ ID NO: 185222 - DNA, 31 bp, Artificial Sequence
  Description of Artificial Sequence: Synthetic oligonucleotide
tccctcctgaaagaagaggcacaggagtttg

SEQ ID NO: 185223 - DNA, 30 bp, Artificial Sequence
  Description of Artificial Sequence: Synthetic oligonucleotide
ccctcctgaaagaagaggcacaggagtttg

SEQ ID NO: 185224 - DNA, 30 bp, Artificial Sequence
  Description of Artificial Sequence: Synthetic oligonucleotide
cctcctgaaagaagaggcacaggagtttgg

SEQ ID NO: 185225 - DNA, 30 bp, Artificial Sequence
  Description of Artificial Sequence: Synthetic oligonucleotide
ctcctgaaagaagaggcacaggagtttggg

SEQ ID NO: 185226 - DNA, 32 bp, Artificial Sequence
  Description of Artificial Sequence: Synthetic oligonucleotide
tcctgaaagaagaggcacaggagtttgggaac

SEQ ID NO: 185227 - DNA, 31 bp, Artificial Sequence
  Description of Artificial Sequence: Synthetic oligonucleotide
cctgaaagaagaggcacaggagtttgggaac

SEQ ID NO: 185228 - DNA, 31 bp, Artificial Sequence
  Description of Artificial Sequence: Synthetic oligonucleotide
ctgaaagaagaggcacaggagtttgggaacc

SEQ ID NO: 185229 - DNA, 32 bp, Artificial Sequence
  Description of Artificial Sequence: Synthetic oligonucleotide
tgaaagaagaggcacaggagtttgggaaccag

SEQ ID NO: 185230 - DNA, 31 bp, Artificial Sequence
  Description of Artificial Sequence: Synthetic oligonucleotide
gaaagaagaggcacaggagtttgggaaccag

SEQ ID NO: 185231 - DNA, 32 bp, Artificial Sequence
  Description of Artificial Sequence: Synthetic oligonucleotide
aaagaagaggcacaggagtttgggaaccagac

SEQ ID NO: 185232 - DNA, 31 bp, Artificial Sequence
  Description of Artificial Sequence: Synthetic oligonucleotide
aagaagaggcacaggagtttgggaaccagac

SEQ ID NO: 185233 - DNA, 30 bp, Artificial Sequence
  Description of Artificial Sequence: Synthetic oligonucleotide
agaagaggcacaggagtttgggaaccagac

SEQ ID NO: 185234 - DNA, 29 bp, Artificial Sequence
  Description of Artificial Sequence: Synthetic oligonucleotide
gaagaggcacaggagtttgggaaccagac

SEQ ID NO: 185235 - DNA, 30 bp, Artificial Sequence
  Description of Artificial Sequence: Synthetic oligonucleotide
aagaggcacaggagtttgggaaccagacac

SEQ ID NO: 185236 - DNA, 29 bp, Artificial Sequence
  Description of Artificial Sequence: Synthetic oligonucleotide
agaggcacaggagtttgggaaccagacac

SEQ ID NO: 185237 - DNA, 28 bp, Artificial Sequence
  Description of Artificial Sequence: Synthetic oligonucleotide
gaggcacaggagtttgggaaccagacac

SEQ ID NO: 185238 - DNA, 34 bp, Artificial Sequence
  Description of Artificial Sequence: Synthetic oligonucleotide
aggcacaggagtttgggaaccagacactatttac

SEQ ID NO: 185239 - DNA, 33 bp, Artificial Sequence
  Description of Artificial Sequence: Synthetic oligonucleotide
ggcacaggagtttgggaaccagacactatttac

SEQ ID NO: 185240 - DNA, 33 bp, Artificial Sequence
  Description of Artificial Sequence: Synthetic oligonucleotide
gcacaggagtttgggaaccagacactatttacc

SEQ ID NO: 185241 - DNA, 38 bp, Artificial Sequence
  Description of Artificial Sequence: Synthetic oligonucleotide
cacaggagtttgggaaccagacactatttaccatattc

SEQ ID NO: 185242 - DNA, 39 bp, Artificial Sequence
  Description of Artificial Sequence: Synthetic oligonucleotide
acaggagtttgggaaccagacactatttaccatattcac

SEQ ID NO: 185243 - DNA, 38 bp, Artificial Sequence
  Description of Artificial Sequence: Synthetic oligonucleotide
caggagtttgggaaccagacactatttaccatattcac

SEQ ID NO: 185244 - DNA, 38 bp, Artificial Sequence
  Description of Artificial Sequence: Synthetic oligonucleotide
aggagtttgggaaccagacactatttaccatattcacc

SEQ ID NO: 185245 - DNA, 37 bp, Artificial Sequence
  Description of Artificial Sequence: Synthetic oligonucleotide
ggagtttgggaaccagacactatttaccatattcacc

SEQ ID NO: 185246 - DNA, 38 bp, Artificial Sequence
  Description of Artificial Sequence: Synthetic oligonucleotide
gagtttgggaaccagacactatttaccatattcacctg

SEQ ID NO: 185247 - DNA, 38 bp, Artificial Sequence
  Description of Artificial Sequence: Synthetic oligonucleotide
agtttgggaaccagacactatttaccatattcacctgc

SEQ ID NO: 185248 - DNA, 37 bp, Artificial Sequence
  Description of Artificial Sequence: Synthetic oligonucleotide
gtttgggaaccagacactatttaccatattcacctgc

SEQ ID NO: 185249 - DNA, 37 bp, Artificial Sequence
  Description of Artificial Sequence: Synthetic oligonucleotide
tttgggaaccagacactatttaccatattcacctgcc

SEQ ID NO: 185250 - DNA, 36 bp, Artificial Sequence
  Description of Artificial Sequence: Synthetic oligonucleotide
ttgggaaccagacactatttaccatattcacctgcc

SEQ ID NO: 185251 - DNA, 35 bp, Artificial Sequence
  Description of Artificial Sequence: Synthetic oligonucleotide
tgggaaccagacactatttaccatattcacctgcc

SEQ ID NO: 185252 - DNA, 34 bp, Artificial Sequence
  Description of Artificial Sequence: Synthetic oligonucleotide
gggaaccagacactatttaccatattcacctgcc

SEQ ID NO: 185253 - DNA, 35 bp, Artificial Sequence
  Description of Artificial Sequence: Synthetic oligonucleotide
ggaaccagacactatttaccatattcacctgcctg

SEQ ID NO: 185254 - DNA, 35 bp, Artificial Sequence
  Description of Artificial Sequence: Synthetic oligonucleotide
gaaccagacactatttaccatattcacctgcctgg

SEQ ID NO: 185255 - DNA, 35 bp, Artificial Sequence
  Description of Artificial Sequence: Synthetic oligonucleotide
aaccagacactatttaccatattcacctgcctggg

SEQ ID NO: 185256 - DNA, 34 bp, Artificial Sequence
  Description of Artificial Sequence: Synthetic oligonucleotide
accagacactatttaccatattcacctgcctggg

SEQ ID NO: 185257 - DNA, 33 bp, Artificial Sequence
  Description of Artificial Sequence: Synthetic oligonucleotide
ccagacactatttaccatattcacctgcctggg

SEQ ID NO: 185258 - DNA, 34 bp, Artificial Sequence
  Description of Artificial Sequence: Synthetic oligonucleotide
cagacactatttaccatattcacctgcctgggtg

SEQ ID NO: 185259 - DNA, 34 bp, Artificial Sequence
  Description of Artificial Sequence: Synthetic oligonucleotide
agacactatttaccatattcacctgcctgggtgc

SEQ ID NO: 185260 - DNA, 33 bp, Artificial Sequence
  Description of Artificial Sequence: Synthetic oligonucleotide
gacactatttaccatattcacctgcctgggtgc

SEQ ID NO: 185261 - DNA, 34 bp, Artificial Sequence
  Description of Artificial Sequence: Synthetic oligonucleotide
acactatttaccatattcacctgcctgggtgcac

SEQ ID NO: 185262 - DNA, 33 bp, Artificial Sequence
  Description of Artificial Sequence: Synthetic oligonucleotide
cactatttaccatattcacctgcctgggtgcac

SEQ ID NO: 185263 - DNA, 33 bp, Artificial Sequence
  Description of Artificial Sequence: Synthetic oligonucleotide
actatttaccatattcacctgcctgggtgcacc

SEQ ID NO: 185264 - DNA, 32 bp, Artificial Sequence
  Description of Artificial Sequence: Synthetic oligonucleotide
ctatttaccatattcacctgcctgggtgcacc

SEQ ID NO: 185265 - DNA, 33 bp, Artificial Sequence
  Description of Artificial Sequence: Synthetic oligonucleotide
tatttaccatattcacctgcctgggtgcacctg

SEQ ID NO: 185266 - DNA, 32 bp, Artificial Sequence
  Description of Artificial Sequence: Synthetic oligonucleotide
atttaccatattcacctgcctgggtgcacctg

SEQ ID NO: 185267 - DNA, 31 bp, Artificial Sequence
  Description of Artificial Sequence: Synthetic oligonucleotide
tttaccatattcacctgcctgggtgcacctg

SEQ ID NO: 185268 - DNA, 30 bp, Artificial Sequence
  Description of Artificial Sequence: Synthetic oligonucleotide
ttaccatattcacctgcctgggtgcacctg

SEQ ID NO: 185269 - DNA, 29 bp, Artificial Sequence
  Description of Artificial Sequence: Synthetic oligonucleotide
taccatattcacctgcctgggtgcacctg

SEQ ID NO: 185270 - DNA, 28 bp, Artificial Sequence
  Description of Artificial Sequence: Synthetic oligonucleotide
accatattcacctgcctgggtgcacctg

SEQ ID NO: 185271 - DNA, 27 bp, Artificial Sequence
  Description of Artificial Sequence: Synthetic oligonucleotide
ccatattcacctgcctgggtgcacctg

SEQ ID NO: 185272 - DNA, 29 bp, Artificial Sequence
  Description of Artificial Sequence: Synthetic oligonucleotide
catattcacctgcctgggtgcacctgtac

SEQ ID NO: 185273 - DNA, 30 bp, Artificial Sequence
  Description of Artificial Sequence: Synthetic oligonucleotide
atattcacctgcctgggtgcacctgtacag

SEQ ID NO: 185274 - DNA, 29 bp, Artificial Sequence
  Description of Artificial Sequence: Synthetic oligonucleotide
tattcacctgcctgggtgcacctgtacag

SEQ ID NO: 185275 - DNA, 28 bp, Artificial Sequence
  Description of Artificial Sequence: Synthetic oligonucleotide
attcacctgcctgggtgcacctgtacag

SEQ ID NO: 185276 - DNA, 27 bp, Artificial Sequence
  Description of Artificial Sequence: Synthetic oligonucleotide
ttcacctgcctgggtgcacctgtacag

SEQ ID NO: 185277 - DNA, 27 bp, Artificial Sequence
  Description of Artificial Sequence: Synthetic oligonucleotide
tcacctgcctgggtgcacctgtacagt

SEQ ID NO: 185278 - DNA, 27 bp, Artificial Sequence
  Description of Artificial Sequence: Synthetic oligonucleotide
cacctgcctgggtgcacctgtacagta

SEQ ID NO: 185279 - DNA, 27 bp, Artificial Sequence
  Description of Artificial Sequence: Synthetic oligonucleotide
acctgcctgggtgcacctgtacagtac

SEQ ID NO: 185280 - DNA, 27 bp, Artificial Sequence
  Description of Artificial Sequence: Synthetic oligonucleotide
cctgcctgggtgcacctgtacagtact

SEQ ID NO: 185281 - DNA, 28 bp, Artificial Sequence
  Description of Artificial Sequence: Synthetic oligonucleotide
ctgcctgggtgcacctgtacagtacttc

SEQ ID NO: 185282 - DNA, 29 bp, Artificial Sequence
  Description of Artificial Sequence: Synthetic oligonucleotide
tgcctgggtgcacctgtacagtacttctc

SEQ ID NO: 185283 - DNA, 28 bp, Artificial Sequence
  Description of Artificial Sequence: Synthetic oligonucleotide
gcctgggtgcacctgtacagtacttctc

SEQ ID NO: 185284 - DNA, 28 bp, Artificial Sequence
  Description of Artificial Sequence: Synthetic oligonucleotide
cctgggtgcacctgtacagtacttctcc

SEQ ID NO: 185285 - DNA, 28 bp, Artificial Sequence
  Description of Artificial Sequence: Synthetic oligonucleotide
ctgggtgcacctgtacagtacttctccc

SEQ ID NO: 185286 - DNA, 29 bp, Artificial Sequence
  Description of Artificial Sequence: Synthetic oligonucleotide
tgggtgcacctgtacagtacttctccctc

SEQ ID NO: 185287 - DNA, 28 bp, Artificial Sequence
  Description of Artificial Sequence: Synthetic oligonucleotide
gggtgcacctgtacagtacttctccctc

SEQ ID NO: 185288 - DNA, 30 bp, Artificial Sequence
  Description of Artificial Sequence: Synthetic oligonucleotide
ggtgcacctgtacagtacttctccctcaag

SEQ ID NO: 185289 - DNA, 32 bp, Artificial Sequence
  Description of Artificial Sequence: Synthetic oligonucleotide
gtgcacctgtacagtacttctccctcaagaag

SEQ ID NO: 185290 - DNA, 32 bp, Artificial Sequence
  Description of Artificial Sequence: Synthetic oligonucleotide
tgcacctgtacagtacttctccctcaagaagg

SEQ ID NO: 185291 - DNA, 31 bp, Artificial Sequence
  Description of Artificial Sequence: Synthetic oligonucleotide
gcacctgtacagtacttctccctcaagaagg

SEQ ID NO: 185292 - DNA, 33 bp, Artificial Sequence
  Description of Artificial Sequence: Synthetic oligonucleotide
cacctgtacagtacttctccctcaagaaggaag

SEQ ID NO: 185293 - DNA, 34 bp, Artificial Sequence
  Description of Artificial Sequence: Synthetic oligonucleotide
acctgtacagtacttctccctcaagaaggaagtc

SEQ ID NO: 185294 - DNA, 33 bp, Artificial Sequence
  Description of Artificial Sequence: Synthetic oligonucleotide
cctgtacagtacttctccctcaagaaggaagtc

SEQ ID NO: 185295 - DNA, 35 bp, Artificial Sequence
  Description of Artificial Sequence: Synthetic oligonucleotide
ctgtacagtacttctccctcaagaaggaagtcttg

SEQ ID NO: 185296 - DNA, 37 bp, Artificial Sequence
  Description of Artificial Sequence: Synthetic oligonucleotide
tgtacagtacttctccctcaagaaggaagtcttgatc

SEQ ID NO: 185297 - DNA, 36 bp, Artificial Sequence
  Description of Artificial Sequence: Synthetic oligonucleotide
gtacagtacttctccctcaagaaggaagtcttgatc

SEQ ID NO: 185298 - DNA, 36 bp, Artificial Sequence
  Description of Artificial Sequence: Synthetic oligonucleotide
tacagtacttctccctcaagaaggaagtcttgatcc

SEQ ID NO: 185299 - DNA, 35 bp, Artificial Sequence
  Description of Artificial Sequence: Synthetic oligonucleotide
acagtacttctccctcaagaaggaagtcttgatcc

SEQ ID NO: 185300 - DNA, 34 bp, Artificial Sequence
  Description of Artificial Sequence: Synthetic oligonucleotide
cagtacttctccctcaagaaggaagtcttgatcc

SEQ ID NO: 185301 - DNA, 34 bp, Artificial Sequence
  Description of Artificial Sequence: Synthetic oligonucleotide
agtacttctccctcaagaaggaagtcttgatccc

SEQ ID NO: 185302 - DNA, 33 bp, Artificial Sequence
  Description of Artificial Sequence: Synthetic oligonucleotide
gtacttctccctcaagaaggaagtcttgatccc

SEQ ID NO: 185303 - DNA, 34 bp, Artificial Sequence
  Description of Artificial Sequence: Synthetic oligonucleotide
tacttctccctcaagaaggaagtcttgatccctc

SEQ ID NO: 185304 - DNA, 33 bp, Artificial Sequence
  Description of Artificial Sequence: Synthetic oligonucleotide
acttctccctcaagaaggaagtcttgatccctc

SEQ ID NO: 185305 - DNA, 32 bp, Artificial Sequence
  Description of Artificial Sequence: Synthetic oligonucleotide
cttctccctcaagaaggaagtcttgatccctc

SEQ ID NO: 185306 - DNA, 32 bp, Artificial Sequence
  Description of Artificial Sequence: Synthetic oligonucleotide
ttctccctcaagaaggaagtcttgatccctcc

SEQ ID NO: 185307 - DNA, 31 bp, Artificial Sequence
  Description of Artificial Sequence: Synthetic oligonucleotide
tctccctcaagaaggaagtcttgatccctcc

SEQ ID NO: 185308 - DNA, 30 bp, Artificial Sequence
  Description of Artificial Sequence: Synthetic oligonucleotide
ctccctcaagaaggaagtcttgatccctcc

SEQ ID NO: 185309 - DNA, 30 bp, Artificial Sequence
  Description of Artificial Sequence: Synthetic oligonucleotide
tccctcaagaaggaagtcttgatccctccc

SEQ ID NO: 185310 - DNA, 29 bp, Artificial Sequence
  Description of Artificial Sequence: Synthetic oligonucleotide
ccctcaagaaggaagtcttgatccctccc

SEQ ID NO: 185311 - DNA, 32 bp, Artificial Sequence
  Description of Artificial Sequence: Synthetic oligonucleotide
cctcaagaaggaagtcttgatccctccctatg

SEQ ID NO: 185312 - DNA, 33 bp, Artificial Sequence
  Description of Artificial Sequence: Synthetic oligonucleotide
ctcaagaaggaagtcttgatccctccctatgag

SEQ ID NO: 185313 - DNA, 33 bp, Artificial Sequence
  Description of Artificial Sequence: Synthetic oligonucleotide
tcaagaaggaagtcttgatccctccctatgagc

SEQ ID NO: 185314 - DNA, 32 bp, Artificial Sequence
  Description of Artificial Sequence: Synthetic oligonucleotide
caagaaggaagtcttgatccctccctatgagc

SEQ ID NO: 185315 - DNA, 33 bp, Artificial Sequence
  Description of Artificial Sequence: Synthetic oligonucleotide
aagaaggaagtcttgatccctccctatgagctg

SEQ ID NO: 185316 - DNA, 32 bp, Artificial Sequence
  Description of Artificial Sequence: Synthetic oligonucleotide
agaaggaagtcttgatccctccctatgagctg

SEQ ID NO: 185317 - DNA, 31 bp, Artificial Sequence
  Description of Artificial Sequence: Synthetic oligonucleotide
gaaggaagtcttgatccctccctatgagctg

SEQ ID NO: 185318 - DNA, 37 bp, Artificial Sequence
  Description of Artificial Sequence: Synthetic oligonucleotide
aaggaagtcttgatccctccctatgagctgtttaaag

SEQ ID NO: 185319 - DNA, 36 bp, Artificial Sequence
  Description of Artificial Sequence: Synthetic oligonucleotide
aggaagtcttgatccctccctatgagctgtttaaag

SEQ ID NO: 185320 - DNA, 35 bp, Artificial Sequence
  Description of Artificial Sequence: Synthetic oligonucleotide
ggaagtcttgatccctccctatgagctgtttaaag

SEQ ID NO: 185321 - DNA, 45 bp, Artificial Sequence
  Description of Artificial Sequence: Synthetic oligonucleotide
gaagtcttgatccctccctatgagctgtttaaagttataaatatg

SEQ ID NO: 185322 - DNA, 46 bp, Artificial Sequence
  Description of Artificial Sequence: Synthetic oligonucleotide
aagtcttgatccctccctatgagctgtttaaagttataaatatgag

SEQ ID NO: 185323 - DNA, 45 bp, Artificial Sequence
  Description of Artificial Sequence: Synthetic oligonucleotide
agtcttgatccctccctatgagctgtttaaagttataaatatgag

SEQ ID NO: 185324 - DNA, 44 bp, Artificial Sequence
  Description of Artificial Sequence: Synthetic oligonucleotide
gtcttgatccctccctatgagctgtttaaagttataaatatgag

SEQ ID NO: 185325 - DNA, 44 bp, Artificial Sequence
  Description of Artificial Sequence: Synthetic oligonucleotide
tcttgatccctccctatgagctgtttaaagttataaatatgagc

SEQ ID NO: 185326 - DNA, 43 bp, Artificial Sequence
  Description of Artificial Sequence: Synthetic oligonucleotide
cttgatccctccctatgagctgtttaaagttataaatatgagc

SEQ ID NO: 185327 - DNA, 45 bp, Artificial Sequence
  Description of Artificial Sequence: Synthetic oligonucleotide
ttgatccctccctatgagctgtttaaagttataaatatgagctac

SEQ ID NO: 185328 - DNA, 44 bp, Artificial Sequence
  Description of Artificial Sequence: Synthetic oligonucleotide
tgatccctccctatgagctgtttaaagttataaatatgagctac

SEQ ID NO: 185329 - DNA, 43 bp, Artificial Sequence
  Description of Artificial Sequence: Synthetic oligonucleotide
gatccctccctatgagctgtttaaagttataaatatgagctac

SEQ ID NO: 185330 - DNA, 43 bp, Artificial Sequence
  Description of Artificial Sequence: Synthetic oligonucleotide
atccctccctatgagctgtttaaagttataaatatgagctacc

SEQ ID NO: 185331 - DNA, 42 bp, Artificial Sequence
  Description of Artificial Sequence: Synthetic oligonucleotide
tccctccctatgagctgtttaaagttataaatatgagctacc

SEQ ID NO: 185332 - DNA, 41 bp, Artificial Sequence
  Description of Artificial Sequence: Synthetic oligonucleotide
ccctccctatgagctgtttaaagttataaatatgagctacc

SEQ ID NO: 185333 - DNA, 42 bp, Artificial Sequence
  Description of Artificial Sequence: Synthetic oligonucleotide
cctccctatgagctgtttaaagttataaatatgagctaccac

SEQ ID NO: 185334 - DNA, 42 bp, Artificial Sequence
  Description of Artificial Sequence: Synthetic oligonucleotide
ctccctatgagctgtttaaagttataaatatgagctaccacc

SEQ ID NO: 185335 - DNA, 42 bp, Artificial Sequence
  Description of Artificial Sequence: Synthetic oligonucleotide
tccctatgagctgtttaaagttataaatatgagctaccaccc

SEQ ID NO: 185336 - DNA, 41 bp, Artificial Sequence
  Description of Artificial Sequence: Synthetic oligonucleotide
ccctatgagctgtttaaagttataaatatgagctaccaccc

SEQ ID NO: 185337 - DNA, 43 bp, Artificial Sequence
  Description of Artificial Sequence: Synthetic oligonucleotide
cctatgagctgtttaaagttataaatatgagctaccacccaag

SEQ ID NO: 185338 - DNA, 44 bp, Artificial Sequence
  Description of Artificial Sequence: Synthetic oligonucleotide
ctatgagctgtttaaagttataaatatgagctaccacccaagag

SEQ ID NO: 185339 - DNA, 44 bp, Artificial Sequence
  Description of Artificial Sequence: Synthetic oligonucleotide
tatgagctgtttaaagttataaatatgagctaccacccaagagg

SEQ ID NO: 185340 - DNA, 43 bp, Artificial Sequence
  Description of Artificial Sequence: Synthetic oligonucleotide
atgagctgtttaaagttataaatatgagctaccacccaagagg

SEQ ID NO: 185341 - DNA, 42 bp, Artificial Sequence
  Description of Artificial Sequence: Synthetic oligonucleotide
tgagctgtttaaagttataaatatgagctaccacccaagagg

SEQ ID NO: 185342 - DNA, 41 bp, Artificial Sequence
  Description of Artificial Sequence: Synthetic oligonucleotide
gagctgtttaaagttataaatatgagctaccacccaagagg

SEQ ID NO: 185343 - DNA, 42 bp, Artificial Sequence
  Description of Artificial Sequence: Synthetic oligonucleotide
agctgtttaaagttataaatatgagctaccacccaagaggag

SEQ ID NO: 185344 - DNA, 41 bp, Artificial Sequence
  Description of Artificial Sequence: Synthetic oligonucleotide
gctgtttaaagttataaatatgagctaccacccaagaggag

SEQ ID NO: 185345 - DNA, 42 bp, Artificial Sequence
  Description of Artificial Sequence: Synthetic oligonucleotide
ctgtttaaagttataaatatgagctaccacccaagaggagac

SEQ ID NO: 185346 - DNA, 43 bp, Artificial Sequence
  Description of Artificial Sequence: Synthetic oligonucleotide
tgtttaaagttataaatatgagctaccacccaagaggagactg

SEQ ID NO: 185347 - DNA, 42 bp, Artificial Sequence
  Description of Artificial Sequence: Synthetic oligonucleotide
gtttaaagttataaatatgagctaccacccaagaggagactg

SEQ ID NO: 185348 - DNA, 42 bp, Artificial Sequence
  Description of Artificial Sequence: Synthetic oligonucleotide
tttaaagttataaatatgagctaccacccaagaggagactgg

SEQ ID NO: 185349 - DNA, 41 bp, Artificial Sequence
  Description of Artificial Sequence: Synthetic oligonucleotide
ttaaagttataaatatgagctaccacccaagaggagactgg

SEQ ID NO: 185350 - DNA, 40 bp, Artificial Sequence
  Description of Artificial Sequence: Synthetic oligonucleotide
taaagttataaatatgagctaccacccaagaggagactgg

SEQ ID NO: 185351 - DNA, 39 bp, Artificial Sequence
  Description of Artificial Sequence: Synthetic oligonucleotide
aaagttataaatatgagctaccacccaagaggagactgg

SEQ ID NO: 185352 - DNA, 38 bp, Artificial Sequence
  Description of Artificial Sequence: Synthetic oligonucleotide
aagttataaatatgagctaccacccaagaggagactgg

SEQ ID NO: 185353 - DNA, 37 bp, Artificial Sequence
  Description of Artificial Sequence: Synthetic oligonucleotide
agttataaatatgagctaccacccaagaggagactgg

SEQ ID NO: 185354 - DNA, 36 bp, Artificial Sequence
  Description of Artificial Sequence: Synthetic oligonucleotide
gttataaatatgagctaccacccaagaggagactgg

SEQ ID NO: 185355 - DNA, 38 bp, Artificial Sequence
  Description of Artificial Sequence: Synthetic oligonucleotide
ttataaatatgagctaccacccaagaggagactggttg

SEQ ID NO: 185356 - DNA, 37 bp, Artificial Sequence
  Description of Artificial Sequence: Synthetic oligonucleotide
tataaatatgagctaccacccaagaggagactggttg

SEQ ID NO: 185357 - DNA, 36 bp, Artificial Sequence
  Description of Artificial Sequence: Synthetic oligonucleotide
ataaatatgagctaccacccaagaggagactggttg

SEQ ID NO: 185358 - DNA, 35 bp, Artificial Sequence
  Description of Artificial Sequence: Synthetic oligonucleotide
taaatatgagctaccacccaagaggagactggttg

SEQ ID NO: 185359 - DNA, 34 bp, Artificial Sequence
  Description of Artificial Sequence: Synthetic oligonucleotide
aaatatgagctaccacccaagaggagactggttg

SEQ ID NO: 185360 - DNA, 33 bp, Artificial Sequence
  Description of Artificial Sequence: Synthetic oligonucleotide
aatatgagctaccacccaagaggagactggttg

SEQ ID NO: 185361 - DNA, 32 bp, Artificial Sequence
  Description of Artificial Sequence: Synthetic oligonucleotide
atatgagctaccacccaagaggagactggttg

SEQ ID NO: 185362 - DNA, 31 bp, Artificial Sequence
  Description of Artificial Sequence: Synthetic oligonucleotide
tatgagctaccacccaagaggagactggttg

SEQ ID NO: 185363 - DNA, 30 bp, Artificial Sequence
  Description of Artificial Sequence: Synthetic oligonucleotide
atgagctaccacccaagaggagactggttg

SEQ ID NO: 185364 - DNA, 29 bp, Artificial Sequence
  Description of Artificial Sequence: Synthetic oligonucleotide
tgagctaccacccaagaggagactggttg

SEQ ID NO: 185365 - DNA, 28 bp, Artificial Sequence
  Description of Artificial Sequence: Synthetic oligonucleotide
gagctaccacccaagaggagactggttg

SEQ ID NO: 185366 - DNA, 28 bp, Artificial Sequence
  Description of Artificial Sequence: Synthetic oligonucleotide
agctaccacccaagaggagactggttgc

SEQ ID NO: 185367 - DNA, 27 bp, Artificial Sequence
  Description of Artificial Sequence: Synthetic oligonucleotide
gctaccacccaagaggagactggttgc

SEQ ID NO: 185368 - DNA, 28 bp, Artificial Sequence
  Description of Artificial Sequence: Synthetic oligonucleotide
ctaccacccaagaggagactggttgcag

SEQ ID NO: 185369 - DNA, 30 bp, Artificial Sequence
  Description of Artificial Sequence: Synthetic oligonucleotide
taccacccaagaggagactggttgcagttg

SEQ ID NO: 185370 - DNA, 29 bp, Artificial Sequence
  Description of Artificial Sequence: Synthetic oligonucleotide
accacccaagaggagactggttgcagttg

SEQ ID NO: 185371 - DNA, 28 bp, Artificial Sequence
  Description of Artificial Sequence: Synthetic oligonucleotide
ccacccaagaggagactggttgcagttg

SEQ ID NO: 185372 - DNA, 29 bp, Artificial Sequence
  Description of Artificial Sequence: Synthetic oligonucleotide
cacccaagaggagactggttgcagttgag

SEQ ID NO: 185373 - DNA, 29 bp, Artificial Sequence
  Description of Artificial Sequence: Synthetic oligonucleotide
acccaagaggagactggttgcagttgagg

SEQ ID NO: 185374 - DNA, 28 bp, Artificial Sequence
  Description of Artificial Sequence: Synthetic oligonucleotide
cccaagaggagactggttgcagttgagg

SEQ ID NO: 185375 - DNA, 29 bp, Artificial Sequence
  Description of Artificial Sequence: Synthetic oligonucleotide
ccaagaggagactggttgcagttgaggtc

SEQ ID NO: 185376 - DNA, 31 bp, Artificial Sequence
  Description of Artificial Sequence: Synthetic oligonucleotide
caagaggagactggttgcagttgaggtcaac

SEQ ID NO: 185377 - DNA, 32 bp, Artificial Sequence
  Description of Artificial Sequence: Synthetic oligonucleotide
aagaggagactggttgcagttgaggtcaactg

SEQ ID NO: 185378 - DNA, 31 bp, Artificial Sequence
  Description of Artificial Sequence: Synthetic oligonucleotide
agaggagactggttgcagttgaggtcaactg

SEQ ID NO: 185379 - DNA, 30 bp, Artificial Sequence
  Description of Artificial Sequence: Synthetic oligonucleotide
gaggagactggttgcagttgaggtcaactg

SEQ ID NO: 185380 - DNA, 30 bp, Artificial Sequence
  Description of Artificial Sequence: Synthetic oligonucleotide
aggagactggttgcagttgaggtcaactgg

SEQ ID NO: 185381 - DNA, 29 bp, Artificial Sequence
  Description of Artificial Sequence: Synthetic oligonucleotide
ggagactggttgcagttgaggtcaactgg

SEQ ID NO: 185382 - DNA, 29 bp, Artificial Sequence
  Description of Artificial Sequence: Synthetic oligonucleotide
gagactggttgcagttgaggtcaactggg

SEQ ID NO: 185383 - DNA, 31 bp, Artificial Sequence
  Description of Artificial Sequence: Synthetic oligonucleotide
agactggttgcagttgaggtcaactgggaac

SEQ ID NO: 185384 - DNA, 30 bp, Artificial Sequence
  Description of Artificial Sequence: Synthetic oligonucleotide
gactggttgcagttgaggtcaactgggaac

SEQ ID NO: 185385 - DNA, 30 bp, Artificial Sequence
  Description of Artificial Sequence: Synthetic oligonucleotide
actggttgcagttgaggtcaactgggaacc

SEQ ID NO: 185386 - DNA, 29 bp, Artificial Sequence
  Description of Artificial Sequence: Synthetic oligonucleotide
ctggttgcagttgaggtcaactgggaacc

SEQ ID NO: 185387 - DNA, 30 bp, Artificial Sequence
  Description of Artificial Sequence: Synthetic oligonucleotide
tggttgcagttgaggtcaactgggaacctg

SEQ ID NO: 185388 - DNA, 29 bp, Artificial Sequence
  Description of Artificial Sequence: Synthetic oligonucleotide
ggttgcagttgaggtcaactgggaacctg

SEQ ID NO: 185389 - DNA, 30 bp, Artificial Sequence
  Description of Artificial Sequence: Synthetic oligonucleotide
gttgcagttgaggtcaactgggaacctgag

SEQ ID NO: 185390 - DNA, 30 bp, Artificial Sequence
  Description of Artificial Sequence: Synthetic oligonucleotide
ttgcagttgaggtcaactgggaacctgagc

SEQ ID NO: 185391 - DNA, 29 bp, Artificial Sequence
  Description of Artificial Sequence: Synthetic oligonucleotide
tgcagttgaggtcaactgggaacctgagc

SEQ ID NO: 185392 - DNA, 28 bp, Artificial Sequence
  Description of Artificial Sequence: Synthetic oligonucleotide
gcagttgaggtcaactgggaacctgagc

SEQ ID NO: 185393 - DNA, 29 bp, Artificial Sequence
  Description of Artificial Sequence: Synthetic oligonucleotide
cagttgaggtcaactgggaacctgagcac

SEQ ID NO: 185394 - DNA, 35 bp, Artificial Sequence
  Description of Artificial Sequence: Synthetic oligonucleotide
agttgaggtcaactgggaacctgagcacatataac

SEQ ID NO: 185395 - DNA, 34 bp, Artificial Sequence
  Description of Artificial Sequence: Synthetic oligonucleotide
gttgaggtcaactgggaacctgagcacatataac

SEQ ID NO: 185396 - DNA, 35 bp, Artificial Sequence
  Description of Artificial Sequence: Synthetic oligonucleotide
ttgaggtcaactgggaacctgagcacatataactg

SEQ ID NO: 185397 - DNA, 34 bp, Artificial Sequence
  Description of Artificial Sequence: Synthetic oligonucleotide
tgaggtcaactgggaacctgagcacatataactg

SEQ ID NO: 185398 - DNA, 33 bp, Artificial Sequence
  Description of Artificial Sequence: Synthetic oligonucleotide
gaggtcaactgggaacctgagcacatataactg

SEQ ID NO: 185399 - DNA, 34 bp, Artificial Sequence
  Description of Artificial Sequence: Synthetic oligonucleotide
aggtcaactgggaacctgagcacatataactgtc

SEQ ID NO: 185400 - DNA, 33 bp, Artificial Sequence
  Description of Artificial Sequence: Synthetic oligonucleotide
ggtcaactgggaacctgagcacatataactgtc

SEQ ID NO: 185401 - DNA, 34 bp, Artificial Sequence
  Description of Artificial Sequence: Synthetic oligonucleotide
gtcaactgggaacctgagcacatataactgtcag

SEQ ID NO: 185402 - DNA, 34 bp, Artificial Sequence
  Description of Artificial Sequence: Synthetic oligonucleotide
tcaactgggaacctgagcacatataactgtcagc

SEQ ID NO: 185403 - DNA, 33 bp, Artificial Sequence
  Description of Artificial Sequence: Synthetic oligonucleotide
caactgggaacctgagcacatataactgtcagc

SEQ ID NO: 185404 - DNA, 34 bp, Artificial Sequence
  Description of Artificial Sequence: Synthetic oligonucleotide
aactgggaacctgagcacatataactgtcagctg

SEQ ID NO: 185405 - DNA, 33 bp, Artificial Sequence
  Description of Artificial Sequence: Synthetic oligonucleotide
actgggaacctgagcacatataactgtcagctg

SEQ ID NO: 185406 - DNA, 32 bp, Artificial Sequence
  Description of Artificial Sequence: Synthetic oligonucleotide
ctgggaacctgagcacatataactgtcagctg

SEQ ID NO: 185407 - DNA, 32 bp, Artificial Sequence
  Description of Artificial Sequence: Synthetic oligonucleotide
tgggaacctgagcacatataactgtcagctgc

SEQ ID NO: 185408 - DNA, 31 bp, Artificial Sequence
  Description of Artificial Sequence: Synthetic oligonucleotide
gggaacctgagcacatataactgtcagctgc

SEQ ID NO: 185409 - DNA, 36 bp, Artificial Sequence
  Description of Artificial Sequence: Synthetic oligonucleotide
ggaacctgagcacatataactgtcagctgctaaaag

SEQ ID NO: 185410 - DNA, 36 bp, Artificial Sequence
  Description of Artificial Sequence: Synthetic oligonucleotide
gaacctgagcacatataactgtcagctgctaaaagc

SEQ ID NO: 185411 - DNA, 38 bp, Artificial Sequence
  Description of Artificial Sequence: Synthetic oligonucleotide
aacctgagcacatataactgtcagctgctaaaagcttc

SEQ ID NO: 185412 - DNA, 37 bp, Artificial Sequence
  Description of Artificial Sequence: Synthetic oligonucleotide
acctgagcacatataactgtcagctgctaaaagcttc

SEQ ID NO: 185413 - DNA, 36 bp, Artificial Sequence
  Description of Artificial Sequence: Synthetic oligonucleotide
cctgagcacatataactgtcagctgctaaaagcttc

SEQ ID NO: 185414 - DNA, 36 bp, Artificial Sequence
  Description of Artificial Sequence: Synthetic oligonucleotide
ctgagcacatataactgtcagctgctaaaagcttcc

SEQ ID NO: 185415 - DNA, 37 bp, Artificial Sequence
  Description of Artificial Sequence: Synthetic oligonucleotide
tgagcacatataactgtcagctgctaaaagcttccag

SEQ ID NO: 185416 - DNA, 36 bp, Artificial Sequence
  Description of Artificial Sequence: Synthetic oligonucleotide
gagcacatataactgtcagctgctaaaagcttccag

SEQ ID NO: 185417 - DNA, 36 bp, Artificial Sequence
  Description of Artificial Sequence: Synthetic oligonucleotide
agcacatataactgtcagctgctaaaagcttccagc

SEQ ID NO: 185418 - DNA, 35 bp, Artificial Sequence
  Description of Artificial Sequence: Synthetic oligonucleotide
gcacatataactgtcagctgctaaaagcttccagc

SEQ ID NO: 185419 - DNA, 37 bp, Artificial Sequence
  Description of Artificial Sequence: Synthetic oligonucleotide
cacatataactgtcagctgctaaaagcttccagcaag

SEQ ID NO: 185420 - DNA, 41 bp, Artificial Sequence
  Description of Artificial Sequence: Synthetic oligonucleotide
acatataactgtcagctgctaaaagcttccagcaagaaatg

SEQ ID NO: 185421 - DNA, 40 bp, Artificial Sequence
  Description of Artificial Sequence: Synthetic oligonucleotide
catataactgtcagctgctaaaagcttccagcaagaaatg

SEQ ID NO: 185422 - DNA, 40 bp, Artificial Sequence
  Description of Artificial Sequence: Synthetic oligonucleotide
atataactgtcagctgctaaaagcttccagcaagaaatgc

SEQ ID NO: 185423 - DNA, 39 bp, Artificial Sequence
  Description of Artificial Sequence: Synthetic oligonucleotide
tataactgtcagctgctaaaagcttccagcaagaaatgc

SEQ ID NO: 185424 - DNA, 38 bp, Artificial Sequence
  Description of Artificial Sequence: Synthetic oligonucleotide
ataactgtcagctgctaaaagcttccagcaagaaatgc

SEQ ID NO: 185425 - DNA, 37 bp, Artificial Sequence
  Description of Artificial Sequence: Synthetic oligonucleotide
taactgtcagctgctaaaagcttccagcaagaaatgc

SEQ ID NO: 185426 - DNA, 36 bp, Artificial Sequence
  Description of Artificial Sequence: Synthetic oligonucleotide
aactgtcagctgctaaaagcttccagcaagaaatgc

SEQ ID NO: 185427 - DNA, 35 bp, Artificial Sequence
  Description of Artificial Sequence: Synthetic oligonucleotide
actgtcagctgctaaaagcttccagcaagaaatgc

SEQ ID NO: 185428 - DNA, 34 bp, Artificial Sequence
  Description of Artificial Sequence: Synthetic oligonucleotide
ctgtcagctgctaaaagcttccagcaagaaatgc

SEQ ID NO: 185429 - DNA, 36 bp, Artificial Sequence
  Description of Artificial Sequence: Synthetic oligonucleotide
tgtcagctgctaaaagcttccagcaagaaatgcatc

SEQ ID NO: 185430 - DNA, 35 bp, Artificial Sequence
  Description of Artificial Sequence: Synthetic oligonucleotide
gtcagctgctaaaagcttccagcaagaaatgcatc

SEQ ID NO: 185431 - DNA, 35 bp, Artificial Sequence
  Description of Artificial Sequence: Synthetic oligonucleotide
tcagctgctaaaagcttccagcaagaaatgcatcc

SEQ ID NO: 185432 - DNA, 34 bp, Artificial Sequence
  Description of Artificial Sequence: Synthetic oligonucleotide
cagctgctaaaagcttccagcaagaaatgcatcc

SEQ ID NO: 185433 - DNA, 34 bp, Artificial Sequence
  Description of Artificial Sequence: Synthetic oligonucleotide
agctgctaaaagcttccagcaagaaatgcatccc

SEQ ID NO: 185434 - DNA, 33 bp, Artificial Sequence
  Description of Artificial Sequence: Synthetic oligonucleotide
gctgctaaaagcttccagcaagaaatgcatccc

SEQ ID NO: 185435 - DNA, 34 bp, Artificial Sequence
  Description of Artificial Sequence: Synthetic oligonucleotide
ctgctaaaagcttccagcaagaaatgcatccctg

SEQ ID NO: 185436 - DNA, 36 bp, Artificial Sequence
  Description of Artificial Sequence: Synthetic oligonucleotide
tgctaaaagcttccagcaagaaatgcatccctgatc

SEQ ID NO: 185437 - DNA, 35 bp, Artificial Sequence
  Description of Artificial Sequence: Synthetic oligonucleotide
gctaaaagcttccagcaagaaatgcatccctgatc

SEQ ID NO: 185438 - DNA, 35 bp, Artificial Sequence
  Description of Artificial Sequence: Synthetic oligonucleotide
ctaaaagcttccagcaagaaatgcatccctgatcc

SEQ ID NO: 185439 - DNA, 39 bp, Artificial Sequence
  Description of Artificial Sequence: Synthetic oligonucleotide
taaaagcttccagcaagaaatgcatccctgatcctatag

SEQ ID NO: 185440 - DNA, 38 bp, Artificial Sequence
  Description of Artificial Sequence: Synthetic oligonucleotide
aaaagcttccagcaagaaatgcatccctgatcctatag

SEQ ID NO: 185441 - DNA, 37 bp, Artificial Sequence
  Description of Artificial Sequence: Synthetic oligonucleotide
aaagcttccagcaagaaatgcatccctgatcctatag

SEQ ID NO: 185442 - DNA, 36 bp, Artificial Sequence
  Description of Artificial Sequence: Synthetic oligonucleotide
aagcttccagcaagaaatgcatccctgatcctatag

SEQ ID NO: 185443 - DNA, 35 bp, Artificial Sequence
  Description of Artificial Sequence: Synthetic oligonucleotide
agcttccagcaagaaatgcatccctgatcctatag

SEQ ID NO: 185444 - DNA, 34 bp, Artificial Sequence
  Description of Artificial Sequence: Synthetic oligonucleotide
gcttccagcaagaaatgcatccctgatcctatag

SEQ ID NO: 185445 - DNA, 34 bp, Artificial Sequence
  Description of Artificial Sequence: Synthetic oligonucleotide
cttccagcaagaaatgcatccctgatcctatagc

SEQ ID NO: 185446 - DNA, 38 bp, Artificial Sequence
  Description of Artificial Sequence: Synthetic oligonucleotide
ttccagcaagaaatgcatccctgatcctatagctattg

SEQ ID NO: 185447 - DNA, 37 bp, Artificial Sequence
  Description of Artificial Sequence: Synthetic oligonucleotide
tccagcaagaaatgcatccctgatcctatagctattg

SEQ ID NO: 185448 - DNA, 36 bp, Artificial Sequence
  Description of Artificial Sequence: Synthetic oligonucleotide
ccagcaagaaatgcatccctgatcctatagctattg

SEQ ID NO: 185449 - DNA, 36 bp, Artificial Sequence
  Description of Artificial Sequence: Synthetic oligonucleotide
cagcaagaaatgcatccctgatcctatagctattgc

SEQ ID NO: 185450 - DNA, 38 bp, Artificial Sequence
  Description of Artificial Sequence: Synthetic oligonucleotide
agcaagaaatgcatccctgatcctatagctattgcatc

SEQ ID NO: 185451 - DNA, 37 bp, Artificial Sequence
  Description of Artificial Sequence: Synthetic oligonucleotide
gcaagaaatgcatccctgatcctatagctattgcatc

SEQ ID NO: 185452 - DNA, 38 bp, Artificial Sequence
  Description of Artificial Sequence: Synthetic oligonucleotide
caagaaatgcatccctgatcctatagctattgcatctc

SEQ ID NO: 185453 - DNA, 39 bp, Artificial Sequence
  Description of Artificial Sequence: Synthetic oligonucleotide
aagaaatgcatccctgatcctatagctattgcatctctc

SEQ ID NO: 185454 - DNA, 38 bp, Artificial Sequence
  Description of Artificial Sequence: Synthetic oligonucleotide
agaaatgcatccctgatcctatagctattgcatctctc

SEQ ID NO: 185455 - DNA, 37 bp, Artificial Sequence
  Description of Artificial Sequence: Synthetic oligonucleotide
gaaatgcatccctgatcctatagctattgcatctctc

SEQ ID NO: 185456 - DNA, 38 bp, Artificial Sequence
  Description of Artificial Sequence: Synthetic oligonucleotide
aaatgcatccctgatcctatagctattgcatctctctc

SEQ ID NO: 185457 - DNA, 37 bp, Artificial Sequence
  Description of Artificial Sequence: Synthetic oligonucleotide
aatgcatccctgatcctatagctattgcatctctctc

SEQ ID NO: 185458 - DNA, 36 bp, Artificial Sequence
  Description of Artificial Sequence: Synthetic oligonucleotide
atgcatccctgatcctatagctattgcatctctctc

SEQ ID NO: 185459 - DNA, 35 bp, Artificial Sequence
  Description of Artificial Sequence: Synthetic oligonucleotide
tgcatccctgatcctatagctattgcatctctctc

SEQ ID NO: 185460 - DNA, 34 bp, Artificial Sequence
  Description of Artificial Sequence: Synthetic oligonucleotide
gcatccctgatcctatagctattgcatctctctc

SEQ ID NO: 185461 - DNA, 34 bp, Artificial Sequence
  Description of Artificial Sequence: Synthetic oligonucleotide
catccctgatcctatagctattgcatctctctcc

SEQ ID NO: 185462 - DNA, 39 bp, Artificial Sequence
  Description of Artificial Sequence: Synthetic oligonucleotide
atccctgatcctatagctattgcatctctctcctttttg

SEQ ID NO: 185463 - DNA, 38 bp, Artificial Sequence
  Description of Artificial Sequence: Synthetic oligonucleotide
tccctgatcctatagctattgcatctctctcctttttg

SEQ ID NO: 185464 - DNA, 37 bp, Artificial Sequence
  Description of Artificial Sequence: Synthetic oligonucleotide
ccctgatcctatagctattgcatctctctcctttttg

SEQ ID NO: 185465 - DNA, 38 bp, Artificial Sequence
  Description of Artificial Sequence: Synthetic oligonucleotide
cctgatcctatagctattgcatctctctcctttttgac

SEQ ID NO: 185466 - DNA, 38 bp, Artificial Sequence
  Description of Artificial Sequence: Synthetic oligonucleotide
ctgatcctatagctattgcatctctctcctttttgacc

SEQ ID NO: 185467 - DNA, 39 bp, Artificial Sequence
  Description of Artificial Sequence: Synthetic oligonucleotide
tgatcctatagctattgcatctctctcctttttgaccag

SEQ ID NO: 185468 - DNA, 38 bp, Artificial Sequence
  Description of Artificial Sequence: Synthetic oligonucleotide
gatcctatagctattgcatctctctcctttttgaccag

SEQ ID NO: 185469 - DNA, 39 bp, Artificial Sequence
  Description of Artificial Sequence: Synthetic oligonucleotide
atcctatagctattgcatctctctcctttttgaccagtg

SEQ ID NO: 185470 - DNA, 38 bp, Artificial Sequence
  Description of Artificial Sequence: Synthetic oligonucleotide
tcctatagctattgcatctctctcctttttgaccagtg

SEQ ID NO: 185471 - DNA, 37 bp, Artificial Sequence
  Description of Artificial Sequence: Synthetic oligonucleotide
cctatagctattgcatctctctcctttttgaccagtg

SEQ ID NO: 185472 - DNA, 38 bp, Artificial Sequence
  Description of Artificial Sequence: Synthetic oligonucleotide
ctatagctattgcatctctctcctttttgaccagtgtc

SEQ ID NO: 185473 - DNA, 40 bp, Artificial Sequence
  Description of Artificial Sequence: Synthetic oligonucleotide
tatagctattgcatctctctcctttttgaccagtgtcatc

SEQ ID NO: 185474 - DNA, 39 bp, Artificial Sequence
  Description of Artificial Sequence: Synthetic oligonucleotide
atagctattgcatctctctcctttttgaccagtgtcatc

SEQ ID NO: 185475 - DNA, 38 bp, Artificial Sequence
  Description of Artificial Sequence: Synthetic oligonucleotide
tagctattgcatctctctcctttttgaccagtgtcatc

SEQ ID NO: 185476 - DNA, 37 bp, Artificial Sequence
  Description of Artificial Sequence: Synthetic oligonucleotide
agctattgcatctctctcctttttgaccagtgtcatc

SEQ ID NO: 185477 - DNA, 36 bp, Artificial Sequence
  Description of Artificial Sequence: Synthetic oligonucleotide
gctattgcatctctctcctttttgaccagtgtcatc

SEQ ID NO: 185478 - DNA, 38 bp, Artificial Sequence
  Description of Artificial Sequence: Synthetic oligonucleotide
ctattgcatctctctcctttttgaccagtgtcatcatc

SEQ ID NO: 185479 - DNA, 42 bp, Artificial Sequence
  Description of Artificial Sequence: Synthetic oligonucleotide
tattgcatctctctcctttttgaccagtgtcatcatcttttc

SEQ ID NO: 185480 - DNA, 41 bp, Artificial Sequence
  Description of Artificial Sequence: Synthetic oligonucleotide
attgcatctctctcctttttgaccagtgtcatcatcttttc

SEQ ID NO: 185481 - DNA, 40 bp, Artificial Sequence
  Description of Artificial Sequence: Synthetic oligonucleotide
ttgcatctctctcctttttgaccagtgtcatcatcttttc

SEQ ID NO: 185482 - DNA, 39 bp, Artificial Sequence
  Description of Artificial Sequence: Synthetic oligonucleotide
tgcatctctctcctttttgaccagtgtcatcatcttttc

SEQ ID NO: 185483 - DNA, 38 bp, Artificial Sequence
  Description of Artificial Sequence: Synthetic oligonucleotide
gcatctctctcctttttgaccagtgtcatcatcttttc

SEQ ID NO: 185484 - DNA, 38 bp, Artificial Sequence
  Description of Artificial Sequence: Synthetic oligonucleotide
catctctctcctttttgaccagtgtcatcatcttttcc

SEQ ID NO: 185485 - DNA, 42 bp, Artificial Sequence
  Description of Artificial Sequence: Synthetic oligonucleotide
atctctctcctttttgaccagtgtcatcatcttttccaaaag

SEQ ID NO: 185486 - DNA, 41 bp, Artificial Sequence
  Description of Artificial Sequence: Synthetic oligonucleotide
tctctctcctttttgaccagtgtcatcatcttttccaaaag

SEQ ID NO: 185487 - DNA, 40 bp, Artificial Sequence
  Description of Artificial Sequence: Synthetic oligonucleotide
ctctctcctttttgaccagtgtcatcatcttttccaaaag

SEQ ID NO: 185488 - DNA, 40 bp, Artificial Sequence
  Description of Artificial Sequence: Synthetic oligonucleotide
tctctcctttttgaccagtgtcatcatcttttccaaaagc

SEQ ID NO: 185489 - DNA, 39 bp, Artificial Sequence
  Description of Artificial Sequence: Synthetic oligonucleotide
ctctcctttttgaccagtgtcatcatcttttccaaaagc

SEQ ID NO: 185490 - DNA, 40 bp, Artificial Sequence
  Description of Artificial Sequence: Synthetic oligonucleotide
tctcctttttgaccagtgtcatcatcttttccaaaagcag

SEQ ID NO: 185491 - DNA, 39 bp, Artificial Sequence
  Description of Artificial Sequence: Synthetic oligonucleotide
ctcctttttgaccagtgtcatcatcttttccaaaagcag

SEQ ID NO: 185492 - DNA, 40 bp, Artificial Sequence
  Description of Artificial Sequence: Synthetic oligonucleotide
tcctttttgaccagtgtcatcatcttttccaaaagcagag

SEQ ID NO: 185493 - DNA, 39 bp, Artificial Sequence
  Description of Artificial Sequence: Synthetic oligonucleotide
cctttttgaccagtgtcatcatcttttccaaaagcagag

SEQ ID NO: 185494 - DNA, 39 bp, Artificial Sequence
  Description of Artificial Sequence: Synthetic oligonucleotide
aacatgactaccacacacgctgtggctattttgttttac

SEQ ID NO: 185495 - DNA, 38 bp, Artificial Sequence
  Description of Artificial Sequence: Synthetic oligonucleotide
acatgactaccacacacgctgtggctattttgttttac

SEQ ID NO: 185496 - DNA, 37 bp, Artificial Sequence
  Description of Artificial Sequence: Synthetic oligonucleotide
catgactaccacacacgctgtggctattttgttttac

SEQ ID NO: 185497 - DNA, 38 bp, Artificial Sequence
  Description of Artificial Sequence: Synthetic oligonucleotide
atgactaccacacacgctgtggctattttgttttacac

SEQ ID NO: 185498 - DNA, 37 bp, Artificial Sequence
  Description of Artificial Sequence: Synthetic oligonucleotide
tgactaccacacacgctgtggctattttgttttacac

SEQ ID NO: 185499 - DNA, 36 bp, Artificial Sequence
  Description of Artificial Sequence: Synthetic oligonucleotide
gactaccacacacgctgtggctattttgttttacac

SEQ ID NO: 185500 - DNA, 39 bp, Artificial Sequence
  Description of Artificial Sequence: Synthetic oligonucleotide
actaccacacacgctgtggctattttgttttacacattg

SEQ ID NO: 185501 - DNA, 38 bp, Artificial Sequence
  Description of Artificial Sequence: Synthetic oligonucleotide
ctaccacacacgctgtggctattttgttttacacattg

SEQ ID NO: 185502 - DNA, 40 bp, Artificial Sequence
  Description of Artificial Sequence: Synthetic oligonucleotide
taccacacacgctgtggctattttgttttacacattgaac

SEQ ID NO: 185503 - DNA, 39 bp, Artificial Sequence
  Description of Artificial Sequence: Synthetic oligonucleotide
accacacacgctgtggctattttgttttacacattgaac

SEQ ID NO: 185504 - DNA, 38 bp, Artificial Sequence
  Description of Artificial Sequence: Synthetic oligonucleotide
ccacacacgctgtggctattttgttttacacattgaac

SEQ ID NO: 185505 - DNA, 39 bp, Artificial Sequence
  Description of Artificial Sequence: Synthetic oligonucleotide
cacacacgctgtggctattttgttttacacattgaacag

SEQ ID NO: 185506 - DNA, 39 bp, Artificial Sequence
  Description of Artificial Sequence: Synthetic oligonucleotide
acacacgctgtggctattttgttttacacattgaacagc

SEQ ID NO: 185507 - DNA, 38 bp, Artificial Sequence
  Description of Artificial Sequence: Synthetic oligonucleotide
cacacgctgtggctattttgttttacacattgaacagc

SEQ ID NO: 185508 - DNA, 41 bp, Artificial Sequence
  Description of Artificial Sequence: Synthetic oligonucleotide
acacgctgtggctattttgttttacacattgaacagcaatg

SEQ ID NO: 185509 - DNA, 40 bp, Artificial Sequence
  Description of Artificial Sequence: Synthetic oligonucleotide
cacgctgtggctattttgttttacacattgaacagcaatg

SEQ ID NO: 185510 - DNA, 42 bp, Artificial Sequence
  Description of Artificial Sequence: Synthetic oligonucleotide
acgctgtggctattttgttttacacattgaacagcaatgttc

SEQ ID NO: 185511 - DNA, 41 bp, Artificial Sequence
  Description of Artificial Sequence: Synthetic oligonucleotide
cgctgtggctattttgttttacacattgaacagcaatgttc

SEQ ID NO: 185512 - DNA, 44 bp, Artificial Sequence
  Description of Artificial Sequence: Synthetic oligonucleotide
gctgtggctattttgttttacacattgaacagcaatgttcattc

SEQ ID NO: 185513 - DNA, 45 bp, Artificial Sequence
  Description of Artificial Sequence: Synthetic oligonucleotide
ctgtggctattttgttttacacattgaacagcaatgttcattctg

SEQ ID NO: 185514 - DNA, 46 bp, Artificial Sequence
  Description of Artificial Sequence: Synthetic oligonucleotide
tgtggctattttgttttacacattgaacagcaatgttcattctgac

SEQ ID NO: 185515 - DNA, 45 bp, Artificial Sequence
  Description of Artificial Sequence: Synthetic oligonucleotide
gtggctattttgttttacacattgaacagcaatgttcattctgac

SEQ ID NO: 185516 - DNA, 49 bp, Artificial Sequence
  Description of Artificial Sequence: Synthetic oligonucleotide
tggctattttgttttacacattgaacagcaatgttcattctgactttac

SEQ ID NO: 185517 - DNA, 48 bp, Artificial Sequence
  Description of Artificial Sequence: Synthetic oligonucleotide
ggctattttgttttacacattgaacagcaatgttcattctgactttac

SEQ ID NO: 185518 - DNA, 50 bp, Artificial Sequence
  Description of Artificial Sequence: Synthetic oligonucleotide
gctattttgttttacacattgaacagcaatgttcattctgactttactag

SEQ ID NO: 185519 - DNA, 51 bp, Artificial Sequence
  Description of Artificial Sequence: Synthetic oligonucleotide
ctattttgttttacacattgaacagcaatgttcattctgactttactagag

SEQ ID NO: 185520 - DNA, 51 bp, Artificial Sequence
  Description of Artificial Sequence: Synthetic oligonucleotide
tattttgttttacacattgaacagcaatgttcattctgactttactagagc

SEQ ID NO: 185521 - DNA, 50 bp, Artificial Sequence
  Description of Artificial Sequence: Synthetic oligonucleotide
attttgttttacacattgaacagcaatgttcattctgactttactagagc

SEQ ID NO: 185522 - DNA, 49 bp, Artificial Sequence
  Description of Artificial Sequence: Synthetic oligonucleotide
ttttgttttacacattgaacagcaatgttcattctgactttactagagc

SEQ ID NO: 185523 - DNA, 48 bp, Artificial Sequence
  Description of Artificial Sequence: Synthetic oligonucleotide
tttgttttacacattgaacagcaatgttcattctgactttactagagc

SEQ ID NO: 185524 - DNA, 47 bp, Artificial Sequence
  Description of Artificial Sequence: Synthetic oligonucleotide
ttgttttacacattgaacagcaatgttcattctgactttactagagc

SEQ ID NO: 185525 - DNA, 46 bp, Artificial Sequence
  Description of Artificial Sequence: Synthetic oligonucleotide
tgttttacacattgaacagcaatgttcattctgactttactagagc

SEQ ID NO: 185526 - DNA, 45 bp, Artificial Sequence
  Description of Artificial Sequence: Synthetic oligonucleotide
gttttacacattgaacagcaatgttcattctgactttactagagc

SEQ ID NO: 185527 - DNA, 45 bp, Artificial Sequence
  Description of Artificial Sequence: Synthetic oligonucleotide
ttttacacattgaacagcaatgttcattctgactttactagagcc

SEQ ID NO: 185528 - DNA, 44 bp, Artificial Sequence
  Description of Artificial Sequence: Synthetic oligonucleotide
tttacacattgaacagcaatgttcattctgactttactagagcc

SEQ ID NO: 185529 - DNA, 43 bp, Artificial Sequence
  Description of Artificial Sequence: Synthetic oligonucleotide
ttacacattgaacagcaatgttcattctgactttactagagcc

SEQ ID NO: 185530 - DNA, 42 bp, Artificial Sequence
  Description of Artificial Sequence: Synthetic oligonucleotide
tacacattgaacagcaatgttcattctgactttactagagcc

SEQ ID NO: 185531 - DNA, 41 bp, Artificial Sequence
  Description of Artificial Sequence: Synthetic oligonucleotide
acacattgaacagcaatgttcattctgactttactagagcc

SEQ ID NO: 185532 - DNA, 40 bp, Artificial Sequence
  Description of Artificial Sequence: Synthetic oligonucleotide
cacattgaacagcaatgttcattctgactttactagagcc

SEQ ID NO: 185533 - DNA, 31 bp, Artificial Sequence
  Description of Artificial Sequence: Synthetic oligonucleotide
gggccaccattcgatttggccaattcctttc

SEQ ID NO: 185534 - DNA, 31 bp, Artificial Sequence
  Description of Artificial Sequence: Synthetic oligonucleotide
ggccaccattcgatttggccaattcctttcc

SEQ ID NO: 185535 - DNA, 32 bp, Artificial Sequence
  Description of Artificial Sequence: Synthetic oligonucleotide
gccaccattcgatttggccaattcctttccac

SEQ ID NO: 185536 - DNA, 34 bp, Artificial Sequence
  Description of Artificial Sequence: Synthetic oligonucleotide
ccaccattcgatttggccaattcctttccacatc

SEQ ID NO: 185537 - DNA, 34 bp, Artificial Sequence
  Description of Artificial Sequence: Synthetic oligonucleotide
caccattcgatttggccaattcctttccacatcc

SEQ ID NO: 185538 - DNA, 34 bp, Artificial Sequence
  Description of Artificial Sequence: Synthetic oligonucleotide
accattcgatttggccaattcctttccacatccc

SEQ ID NO: 185539 - DNA, 33 bp, Artificial Sequence
  Description of Artificial Sequence: Synthetic oligonucleotide
ccattcgatttggccaattcctttccacatccc

SEQ ID NO: 185540 - DNA, 34 bp, Artificial Sequence
  Description of Artificial Sequence: Synthetic oligonucleotide
cattcgatttggccaattcctttccacatccctc

SEQ ID NO: 185541 - DNA, 34 bp, Artificial Sequence
  Description of Artificial Sequence: Synthetic oligonucleotide
attcgatttggccaattcctttccacatccctcc

SEQ ID NO: 185542 - DNA, 33 bp, Artificial Sequence
  Description of Artificial Sequence: Synthetic oligonucleotide
ttcgatttggccaattcctttccacatccctcc

SEQ ID NO: 185543 - DNA, 32 bp, Artificial Sequence
  Description of Artificial Sequence: Synthetic oligonucleotide
tcgatttggccaattcctttccacatccctcc

SEQ ID NO: 185544 - DNA, 31 bp, Artificial Sequence
  Description of Artificial Sequence: Synthetic oligonucleotide
cgatttggccaattcctttccacatccctcc

SEQ ID NO: 185545 - DNA, 32 bp, Artificial Sequence
  Description of Artificial Sequence: Synthetic oligonucleotide
gatttggccaattcctttccacatccctcctg

SEQ ID NO: 185546 - DNA, 35 bp, Artificial Sequence
  Description of Artificial Sequence: Synthetic oligonucleotide
atttggccaattcctttccacatccctcctgaaag

SEQ ID NO: 185547 - DNA, 34 bp, Artificial Sequence
  Description of Artificial Sequence: Synthetic oligonucleotide
tttggccaattcctttccacatccctcctgaaag

SEQ ID NO: 185548 - DNA, 33 bp, Artificial Sequence
  Description of Artificial Sequence: Synthetic oligonucleotide
ttggccaattcctttccacatccctcctgaaag

SEQ ID NO: 185549 - DNA, 32 bp, Artificial Sequence
  Description of Artificial Sequence: Synthetic oligonucleotide
tggccaattcctttccacatccctcctgaaag

SEQ ID NO: 185550 - DNA, 31 bp, Artificial Sequence
  Description of Artificial Sequence: Synthetic oligonucleotide
ggccaattcctttccacatccctcctgaaag

SEQ ID NO: 185551 - DNA, 33 bp, Artificial Sequence
  Description of Artificial Sequence: Synthetic oligonucleotide
gccaattcctttccacatccctcctgaaagaag

SEQ ID NO: 185552 - DNA, 34 bp, Artificial Sequence
  Description of Artificial Sequence: Synthetic oligonucleotide
ccaattcctttccacatccctcctgaaagaagag

SEQ ID NO: 185553 - DNA, 34 bp, Artificial Sequence
  Description of Artificial Sequence: Synthetic oligonucleotide
caattcctttccacatccctcctgaaagaagagg

SEQ ID NO: 185554 - DNA, 34 bp, Artificial Sequence
  Description of Artificial Sequence: Synthetic oligonucleotide
aattcctttccacatccctcctgaaagaagaggc

SEQ ID NO: 185555 - DNA, 33 bp, Artificial Sequence
  Description of Artificial Sequence: Synthetic oligonucleotide
attcctttccacatccctcctgaaagaagaggc

SEQ ID NO: 185556 - DNA, 32 bp, Artificial Sequence
  Description of Artificial Sequence: Synthetic oligonucleotide
ttcctttccacatccctcctgaaagaagaggc

SEQ ID NO: 185557 - DNA, 31 bp, Artificial Sequence
  Description of Artificial Sequence: Synthetic oligonucleotide
tcctttccacatccctcctgaaagaagaggc

SEQ ID NO: 185558 - DNA, 30 bp, Artificial Sequence
  Description of Artificial Sequence: Synthetic oligonucleotide
cctttccacatccctcctgaaagaagaggc

SEQ ID NO: 185559 - DNA, 31 bp, Artificial Sequence
  Description of Artificial Sequence: Synthetic oligonucleotide
ctttccacatccctcctgaaagaagaggcac

SEQ ID NO: 185560 - DNA, 32 bp, Artificial Sequence
  Description of Artificial Sequence: Synthetic oligonucleotide
tttccacatccctcctgaaagaagaggcacag

SEQ ID NO: 185561 - DNA, 31 bp, Artificial Sequence
  Description of Artificial Sequence: Synthetic oligonucleotide
ttccacatccctcctgaaagaagaggcacag

SEQ ID NO: 185562 - DNA, 44 bp, Artificial Sequence
  Description of Artificial Sequence: Synthetic oligonucleotide
agctgtttaaagttataaatatgagctaccacccaagaggaaac

SEQ ID NO: 185563 - DNA, 43 bp, Artificial Sequence
  Description of Artificial Sequence: Synthetic oligonucleotide
gctgtttaaagttataaatatgagctaccacccaagaggaaac

SEQ ID NO: 185564 - DNA, 44 bp, Artificial Sequence
  Description of Artificial Sequence: Synthetic oligonucleotide
ctgtttaaagttataaatatgagctaccacccaagaggaaactg

SEQ ID NO: 185565 - DNA, 44 bp, Artificial Sequence
  Description of Artificial Sequence: Synthetic oligonucleotide
tgtttaaagttataaatatgagctaccacccaagaggaaactgg

SEQ ID NO: 185566 - DNA, 43 bp, Artificial Sequence
  Description of Artificial Sequence: Synthetic oligonucleotide
gtttaaagttataaatatgagctaccacccaagaggaaactgg

SEQ ID NO: 185567 - DNA, 45 bp, Artificial Sequence
  Description of Artificial Sequence: Synthetic oligonucleotide
tttaaagttataaatatgagctaccacccaagaggaaactggttg

SEQ ID NO: 185568 - DNA, 44 bp, Artificial Sequence
  Description of Artificial Sequence: Synthetic oligonucleotide
ttaaagttataaatatgagctaccacccaagaggaaactggttg

SEQ ID NO: 185569 - DNA, 43 bp, Artificial Sequence
  Description of Artificial Sequence: Synthetic oligonucleotide
taaagttataaatatgagctaccacccaagaggaaactggttg

SEQ ID NO: 185570 - DNA, 42 bp, Artificial Sequence
  Description of Artificial Sequence: Synthetic oligonucleotide
aaagttataaatatgagctaccacccaagaggaaactggttg

SEQ ID NO: 185571 - DNA, 41 bp, Artificial Sequence
  Description of Artificial Sequence: Synthetic oligonucleotide
aagttataaatatgagctaccacccaagaggaaactggttg

SEQ ID NO: 185572 - DNA, 40 bp, Artificial Sequence
  Description of Artificial Sequence: Synthetic oligonucleotide
agttataaatatgagctaccacccaagaggaaactggttg

SEQ ID NO: 185573 - DNA, 39 bp, Artificial Sequence
  Description of Artificial Sequence: Synthetic oligonucleotide
gttataaatatgagctaccacccaagaggaaactggttg

SEQ ID NO: 185574 - DNA, 39 bp, Artificial Sequence
  Description of Artificial Sequence: Synthetic oligonucleotide
ttataaatatgagctaccacccaagaggaaactggttgc

SEQ ID NO: 185575 - DNA, 38 bp, Artificial Sequence
  Description of Artificial Sequence: Synthetic oligonucleotide
tataaatatgagctaccacccaagaggaaactggttgc

SEQ ID NO: 185576 - DNA, 37 bp, Artificial Sequence
  Description of Artificial Sequence: Synthetic oligonucleotide
ataaatatgagctaccacccaagaggaaactggttgc

SEQ ID NO: 185577 - DNA, 36 bp, Artificial Sequence
  Description of Artificial Sequence: Synthetic oligonucleotide
taaatatgagctaccacccaagaggaaactggttgc

SEQ ID NO: 185578 - DNA, 35 bp, Artificial Sequence
  Description of Artificial Sequence: Synthetic oligonucleotide
aaatatgagctaccacccaagaggaaactggttgc

SEQ ID NO: 185579 - DNA, 34 bp, Artificial Sequence
  Description of Artificial Sequence: Synthetic oligonucleotide
aatatgagctaccacccaagaggaaactggttgc

SEQ ID NO: 185580 - DNA, 33 bp, Artificial Sequence
  Description of Artificial Sequence: Synthetic oligonucleotide
atatgagctaccacccaagaggaaactggttgc

SEQ ID NO: 185581 - DNA, 32 bp, Artificial Sequence
  Description of Artificial Sequence: Synthetic oligonucleotide
tatgagctaccacccaagaggaaactggttgc

SEQ ID NO: 185582 - DNA, 31 bp, Artificial Sequence
  Description of Artificial Sequence: Synthetic oligonucleotide
atgagctaccacccaagaggaaactggttgc

SEQ ID NO: 185583 - DNA, 30 bp, Artificial Sequence
  Description of Artificial Sequence: Synthetic oligonucleotide
tgagctaccacccaagaggaaactggttgc

SEQ ID NO: 185584 - DNA, 29 bp, Artificial Sequence
  Description of Artificial Sequence: Synthetic oligonucleotide
gagctaccacccaagaggaaactggttgc

SEQ ID NO: 185585 - DNA, 30 bp, Artificial Sequence
  Description of Artificial Sequence: Synthetic oligonucleotide
agctaccacccaagaggaaactggttgcag

SEQ ID NO: 185586 - DNA, 29 bp, Artificial Sequence
  Description of Artificial Sequence: Synthetic oligonucleotide
gctaccacccaagaggaaactggttgcag

SEQ ID NO: 185587 - DNA, 31 bp, Artificial Sequence
  Description of Artificial Sequence: Synthetic oligonucleotide
ctaccacccaagaggaaactggttgcagttg

SEQ ID NO: 185588 - DNA, 32 bp, Artificial Sequence
  Description of Artificial Sequence: Synthetic oligonucleotide
taccacccaagaggaaactggttgcagttgag

SEQ ID NO: 185589 - DNA, 31 bp, Artificial Sequence
  Description of Artificial Sequence: Synthetic oligonucleotide
accacccaagaggaaactggttgcagttgag

SEQ ID NO: 185590 - DNA, 30 bp, Artificial Sequence
  Description of Artificial Sequence: Synthetic oligonucleotide
ccacccaagaggaaactggttgcagttgag

SEQ ID NO: 185591 - DNA, 30 bp, Artificial Sequence
  Description of Artificial Sequence: Synthetic oligonucleotide
cacccaagaggaaactggttgcagttgagg

SEQ ID NO: 185592 - DNA, 31 bp, Artificial Sequence
  Description of Artificial Sequence: Synthetic oligonucleotide
acccaagaggaaactggttgcagttgaggtc

SEQ ID NO: 185593 - DNA, 30 bp, Artificial Sequence
  Description of Artificial Sequence: Synthetic oligonucleotide
cccaagaggaaactggttgcagttgaggtc

SEQ ID NO: 185594 - DNA, 32 bp, Artificial Sequence
  Description of Artificial Sequence: Synthetic oligonucleotide
ccaagaggaaactggttgcagttgaggtcaac

SEQ ID NO: 185595 - DNA, 33 bp, Artificial Sequence
  Description of Artificial Sequence: Synthetic oligonucleotide
caagaggaaactggttgcagttgaggtcaactg

SEQ ID NO: 185596 - DNA, 33 bp, Artificial Sequence
  Description of Artificial Sequence: Synthetic oligonucleotide
aagaggaaactggttgcagttgaggtcaactgg

SEQ ID NO: 185597 - DNA, 32 bp, Artificial Sequence
  Description of Artificial Sequence: Synthetic oligonucleotide
agaggaaactggttgcagttgaggtcaactgg

SEQ ID NO: 185598 - DNA, 31 bp, Artificial Sequence
  Description of Artificial Sequence: Synthetic oligonucleotide
gaggaaactggttgcagttgaggtcaactgg

SEQ ID NO: 185599 - DNA, 31 bp, Artificial Sequence
  Description of Artificial Sequence: Synthetic oligonucleotide
aggaaactggttgcagttgaggtcaactggg

SEQ ID NO: 185600 - DNA, 30 bp, Artificial Sequence
  Description of Artificial Sequence: Synthetic oligonucleotide
ggaaactggttgcagttgaggtcaactggg

SEQ ID NO: 185601 - DNA, 32 bp, Artificial Sequence
  Description of Artificial Sequence: Synthetic oligonucleotide
gaaactggttgcagttgaggtcaactgggaac

SEQ ID NO: 185602 - DNA, 32 bp, Artificial Sequence
  Description of Artificial Sequence: Synthetic oligonucleotide
aaactggttgcagttgaggtcaactgggaacc

SEQ ID NO: 185603 - DNA, 31 bp, Artificial Sequence
  Description of Artificial Sequence: Synthetic oligonucleotide
aactggttgcagttgaggtcaactgggaacc

SEQ ID NO: 185604 - DNA, 27 bp, Artificial Sequence
  Description of Artificial Sequence: Synthetic oligonucleotide
ccatggcctctgttgccaggactccat

SEQ ID NO: 185605 - DNA, 28 bp, Artificial Sequence
  Description of Artificial Sequence: Synthetic oligonucleotide
catggcctctgttgccaggactccatag

SEQ ID NO: 185606 - DNA, 28 bp, Artificial Sequence
  Description of Artificial Sequence: Synthetic oligonucleotide
atggcctctgttgccaggactccatagc

SEQ ID NO: 185607 - DNA, 27 bp, Artificial Sequence
  Description of Artificial Sequence: Synthetic oligonucleotide
tggcctctgttgccaggactccatagc

SEQ ID NO: 185608 - DNA, 27 bp, Artificial Sequence
  Description of Artificial Sequence: Synthetic oligonucleotide
ggcctctgttgccaggactccatagca

SEQ ID NO: 185609 - DNA, 27 bp, Artificial Sequence
  Description of Artificial Sequence: Synthetic oligonucleotide
gcctctgttgccaggactccatagcag

SEQ ID NO: 185610 - DNA, 30 bp, Artificial Sequence
  Description of Artificial Sequence: Synthetic oligonucleotide
cctctgttgccaggactccatagcagtatg

SEQ ID NO: 185611 - DNA, 32 bp, Artificial Sequence
  Description of Artificial Sequence: Synthetic oligonucleotide
ctctgttgccaggactccatagcagtatgaac

SEQ ID NO: 185612 - DNA, 32 bp, Artificial Sequence
  Description of Artificial Sequence: Synthetic oligonucleotide
tctgttgccaggactccatagcagtatgaacg

SEQ ID NO: 185613 - DNA, 31 bp, Artificial Sequence
  Description of Artificial Sequence: Synthetic oligonucleotide
ctgttgccaggactccatagcagtatgaacg

SEQ ID NO: 185614 - DNA, 33 bp, Artificial Sequence
  Description of Artificial Sequence: Synthetic oligonucleotide
tgttgccaggactccatagcagtatgaacgttc

SEQ ID NO: 185615 - DNA, 32 bp, Artificial Sequence
  Description of Artificial Sequence: Synthetic oligonucleotide
gttgccaggactccatagcagtatgaacgttc

SEQ ID NO: 185616 - DNA, 35 bp, Artificial Sequence
  Description of Artificial Sequence: Synthetic oligonucleotide
ttgccaggactccatagcagtatgaacgttcattc

SEQ ID NO: 185617 - DNA, 34 bp, Artificial Sequence
  Description of Artificial Sequence: Synthetic oligonucleotide
tgccaggactccatagcagtatgaacgttcattc

SEQ ID NO: 185618 - DNA, 33 bp, Artificial Sequence
  Description of Artificial Sequence: Synthetic oligonucleotide
gccaggactccatagcagtatgaacgttcattc

SEQ ID NO: 185619 - DNA, 33 bp, Artificial Sequence
  Description of Artificial Sequence: Synthetic oligonucleotide
ccaggactccatagcagtatgaacgttcattcc

SEQ ID NO: 185620 - DNA, 34 bp, Artificial Sequence
  Description of Artificial Sequence: Synthetic oligonucleotide
caggactccatagcagtatgaacgttcattccac

SEQ ID NO: 185621 - DNA, 36 bp, Artificial Sequence
  Description of Artificial Sequence: Synthetic oligonucleotide
aggactccatagcagtatgaacgttcattccacttc

SEQ ID NO: 185622 - DNA, 35 bp, Artificial Sequence
  Description of Artificial Sequence: Synthetic oligonucleotide
ggactccatagcagtatgaacgttcattccacttc

SEQ ID NO: 185623 - DNA, 44 bp, Artificial Sequence
  Description of Artificial Sequence: Synthetic oligonucleotide
gactccatagcagtatgaacgttcattccacttcaaatatttac

SEQ ID NO: 185624 - DNA, 45 bp, Artificial Sequence
  Description of Artificial Sequence: Synthetic oligonucleotide
actccatagcagtatgaacgttcattccacttcaaatatttacac

SEQ ID NO: 185625 - DNA, 44 bp, Artificial Sequence
  Description of Artificial Sequence: Synthetic oligonucleotide
ctccatagcagtatgaacgttcattccacttcaaatatttacac

SEQ ID NO: 185626 - DNA, 46 bp, Artificial Sequence
  Description of Artificial Sequence: Synthetic oligonucleotide
tccatagcagtatgaacgttcattccacttcaaatatttacactac

SEQ ID NO: 185627 - DNA, 45 bp, Artificial Sequence
  Description of Artificial Sequence: Synthetic oligonucleotide
ccatagcagtatgaacgttcattccacttcaaatatttacactac

SEQ ID NO: 185628 - DNA, 47 bp, Artificial Sequence
  Description of Artificial Sequence: Synthetic oligonucleotide
catagcagtatgaacgttcattccacttcaaatatttacactactac

SEQ ID NO: 185629 - DNA, 47 bp, Artificial Sequence
  Description of Artificial Sequence: Synthetic oligonucleotide
atagcagtatgaacgttcattccacttcaaatatttacactactacc

SEQ ID NO: 185630 - DNA, 46 bp, Artificial Sequence
  Description of Artificial Sequence: Synthetic oligonucleotide
tagcagtatgaacgttcattccacttcaaatatttacactactacc

SEQ ID NO: 185631 - DNA, 37 bp, Artificial Sequence
  Description of Artificial Sequence: Synthetic oligonucleotide
caaaaagcccacttagcctggcttaaccaagtaaaag

SEQ ID NO: 185632 - DNA, 39 bp, Artificial Sequence
  Description of Artificial Sequence: Synthetic oligonucleotide
aaaaagcccacttagcctggcttaaccaagtaaaagttc

SEQ ID NO: 185633 - DNA, 38 bp, Artificial Sequence
  Description of Artificial Sequence: Synthetic oligonucleotide
aaaagcccacttagcctggcttaaccaagtaaaagttc

SEQ ID NO: 185634 - DNA, 37 bp, Artificial Sequence
  Description of Artificial Sequence: Synthetic oligonucleotide
aaagcccacttagcctggcttaaccaagtaaaagttc

SEQ ID NO: 185635 - DNA, 36 bp, Artificial Sequence
  Description of Artificial Sequence: Synthetic oligonucleotide
aagcccacttagcctggcttaaccaagtaaaagttc

SEQ ID NO: 185636 - DNA, 35 bp, Artificial Sequence
  Description of Artificial Sequence: Synthetic oligonucleotide
agcccacttagcctggcttaaccaagtaaaagttc

SEQ ID NO: 185637 - DNA, 34 bp, Artificial Sequence
  Description of Artificial Sequence: Synthetic oligonucleotide
gcccacttagcctggcttaaccaagtaaaagttc

SEQ ID NO: 185638 - DNA, 36 bp, Artificial Sequence
  Description of Artificial Sequence: Synthetic oligonucleotide
cccacttagcctggcttaaccaagtaaaagttctac

SEQ ID NO: 185639 - DNA, 36 bp, Artificial Sequence
  Description of Artificial Sequence: Synthetic oligonucleotide
ccacttagcctggcttaaccaagtaaaagttctacc

SEQ ID NO: 185640 - DNA, 36 bp, Artificial Sequence
  Description of Artificial Sequence: Synthetic oligonucleotide
cacttagcctggcttaaccaagtaaaagttctaccc

SEQ ID NO: 185641 - DNA, 36 bp, Artificial Sequence
  Description of Artificial Sequence: Synthetic oligonucleotide
acttagcctggcttaaccaagtaaaagttctacccc

SEQ ID NO: 185642 - DNA, 35 bp, Artificial Sequence
  Description of Artificial Sequence: Synthetic oligonucleotide
cttagcctggcttaaccaagtaaaagttctacccc

SEQ ID NO: 185643 - DNA, 36 bp, Artificial Sequence
  Description of Artificial Sequence: Synthetic oligonucleotide
ttagcctggcttaaccaagtaaaagttctaccccag

SEQ ID NO: 185644 - DNA, 35 bp, Artificial Sequence
  Description of Artificial Sequence: Synthetic oligonucleotide
tagcctggcttaaccaagtaaaagttctaccccag

SEQ ID NO: 185645 - DNA, 34 bp, Artificial Sequence
  Description of Artificial Sequence: Synthetic oligonucleotide
agcctggcttaaccaagtaaaagttctaccccag

SEQ ID NO: 185646 - DNA, 33 bp, Artificial Sequence
  Description of Artificial Sequence: Synthetic oligonucleotide
gcctggcttaaccaagtaaaagttctaccccag

SEQ ID NO: 185647 - DNA, 35 bp, Artificial Sequence
  Description of Artificial Sequence: Synthetic oligonucleotide
cctggcttaaccaagtaaaagttctaccccagaac

SEQ ID NO: 185648 - DNA, 37 bp, Artificial Sequence
  Description of Artificial Sequence: Synthetic oligonucleotide
ctggcttaaccaagtaaaagttctaccccagaacatg

SEQ ID NO: 185649 - DNA, 38 bp, Artificial Sequence
  Description of Artificial Sequence: Synthetic oligonucleotide
tggcttaaccaagtaaaagttctaccccagaacatgac

SEQ ID NO: 185650 - DNA, 37 bp, Artificial Sequence
  Description of Artificial Sequence: Synthetic oligonucleotide
ggcttaaccaagtaaaagttctaccccagaacatgac

SEQ ID NO: 185651 - DNA, 39 bp, Artificial Sequence
  Description of Artificial Sequence: Synthetic oligonucleotide
gcttaaccaagtaaaagttctaccccagaacatgactac

SEQ ID NO: 185652 - DNA, 39 bp, Artificial Sequence
  Description of Artificial Sequence: Synthetic oligonucleotide
cttaaccaagtaaaagttctaccccagaacatgactacc

SEQ ID NO: 185653 - DNA, 40 bp, Artificial Sequence
  Description of Artificial Sequence: Synthetic oligonucleotide
ttaaccaagtaaaagttctaccccagaacatgactaccac

SEQ ID NO: 185654 - DNA, 39 bp, Artificial Sequence
  Description of Artificial Sequence: Synthetic oligonucleotide
taaccaagtaaaagttctaccccagaacatgactaccac

SEQ ID NO: 185655 - DNA, 38 bp, Artificial Sequence
  Description of Artificial Sequence: Synthetic oligonucleotide
aaccaagtaaaagttctaccccagaacatgactaccac

SEQ ID NO: 185656 - DNA, 37 bp, Artificial Sequence
  Description of Artificial Sequence: Synthetic oligonucleotide
accaagtaaaagttctaccccagaacatgactaccac

SEQ ID NO: 185657 - DNA, 36 bp, Artificial Sequence
  Description of Artificial Sequence: Synthetic oligonucleotide
ccaagtaaaagttctaccccagaacatgactaccac

SEQ ID NO: 185658 - DNA, 37 bp, Artificial Sequence
  Description of Artificial Sequence: Synthetic oligonucleotide
caagtaaaagttctaccccagaacatgactaccacac

SEQ ID NO: 185659 - DNA, 38 bp, Artificial Sequence
  Description of Artificial Sequence: Synthetic oligonucleotide
aagtaaaagttctaccccagaacatgactaccacacac

SEQ ID NO: 185660 - DNA, 37 bp, Artificial Sequence
  Description of Artificial Sequence: Synthetic oligonucleotide
agtaaaagttctaccccagaacatgactaccacacac

SEQ ID NO: 185661 - DNA, 36 bp, Artificial Sequence
  Description of Artificial Sequence: Synthetic oligonucleotide
gtaaaagttctaccccagaacatgactaccacacac

SEQ ID NO: 185662 - DNA, 36 bp, Artificial Sequence
  Description of Artificial Sequence: Synthetic oligonucleotide
taaaagttctaccccagaacatgactaccacacacg

SEQ ID NO: 185663 - DNA, 38 bp, Artificial Sequence
  Description of Artificial Sequence: Synthetic oligonucleotide
caagaaatgcatccctgatcctatagctattgcatctg

SEQ ID NO: 185664 - DNA, 39 bp, Artificial Sequence
  Description of Artificial Sequence: Synthetic oligonucleotide
aagaaatgcatccctgatcctatagctattgcatctgtc

SEQ ID NO: 185665 - DNA, 38 bp, Artificial Sequence
  Description of Artificial Sequence: Synthetic oligonucleotide
agaaatgcatccctgatcctatagctattgcatctgtc

SEQ ID NO: 185666 - DNA, 37 bp, Artificial Sequence
  Description of Artificial Sequence: Synthetic oligonucleotide
gaaatgcatccctgatcctatagctattgcatctgtc

SEQ ID NO: 185667 - DNA, 38 bp, Artificial Sequence
  Description of Artificial Sequence: Synthetic oligonucleotide
aaatgcatccctgatcctatagctattgcatctgtctc

SEQ ID NO: 185668 - DNA, 37 bp, Artificial Sequence
  Description of Artificial Sequence: Synthetic oligonucleotide
aatgcatccctgatcctatagctattgcatctgtctc

SEQ ID NO: 185669 - DNA, 36 bp, Artificial Sequence
  Description of Artificial Sequence: Synthetic oligonucleotide
atgcatccctgatcctatagctattgcatctgtctc

SEQ ID NO: 185670 - DNA, 35 bp, Artificial Sequence
  Description of Artificial Sequence: Synthetic oligonucleotide
tgcatccctgatcctatagctattgcatctgtctc

SEQ ID NO: 185671 - DNA, 34 bp, Artificial Sequence
  Description of Artificial Sequence: Synthetic oligonucleotide
gcatccctgatcctatagctattgcatctgtctc

SEQ ID NO: 185672 - DNA, 34 bp, Artificial Sequence
  Description of Artificial Sequence: Synthetic oligonucleotide
catccctgatcctatagctattgcatctgtctcc

SEQ ID NO: 185673 - DNA, 39 bp, Artificial Sequence
  Description of Artificial Sequence: Synthetic oligonucleotide
atccctgatcctatagctattgcatctgtctcctttttg

SEQ ID NO: 185674 - DNA, 38 bp, Artificial Sequence
  Description of Artificial Sequence: Synthetic oligonucleotide
tccctgatcctatagctattgcatctgtctcctttttg

SEQ ID NO: 185675 - DNA, 37 bp, Artificial Sequence
  Description of Artificial Sequence: Synthetic oligonucleotide
ccctgatcctatagctattgcatctgtctcctttttg

SEQ ID NO: 185676 - DNA, 38 bp, Artificial Sequence
  Description of Artificial Sequence: Synthetic oligonucleotide
cctgatcctatagctattgcatctgtctcctttttgac

SEQ ID NO: 185677 - DNA, 38 bp, Artificial Sequence
  Description of Artificial Sequence: Synthetic oligonucleotide
ctgatcctatagctattgcatctgtctcctttttgacc

SEQ ID NO: 185678 - DNA, 39 bp, Artificial Sequence
  Description of Artificial Sequence: Synthetic oligonucleotide
tgatcctatagctattgcatctgtctcctttttgaccag

SEQ ID NO: 185679 - DNA, 38 bp, Artificial Sequence
  Description of Artificial Sequence: Synthetic oligonucleotide
gatcctatagctattgcatctgtctcctttttgaccag

SEQ ID NO: 185680 - DNA, 39 bp, Artificial Sequence
  Description of Artificial Sequence: Synthetic oligonucleotide
atcctatagctattgcatctgtctcctttttgaccagtg

SEQ ID NO: 185681 - DNA, 38 bp, Artificial Sequence
  Description of Artificial Sequence: Synthetic oligonucleotide
tcctatagctattgcatctgtctcctttttgaccagtg

SEQ ID NO: 185682 - DNA, 37 bp, Artificial Sequence
  Description of Artificial Sequence: Synthetic oligonucleotide
cctatagctattgcatctgtctcctttttgaccagtg

SEQ ID NO: 185683 - DNA, 38 bp, Artificial Sequence
  Description of Artificial Sequence: Synthetic oligonucleotide
ctatagctattgcatctgtctcctttttgaccagtgtc

SEQ ID NO: 185684 - DNA, 40 bp, Artificial Sequence
  Description of Artificial Sequence: Synthetic oligonucleotide
tatagctattgcatctgtctcctttttgaccagtgtcatc

SEQ ID NO: 185685 - DNA, 39 bp, Artificial Sequence
  Description of Artificial Sequence: Synthetic oligonucleotide
atagctattgcatctgtctcctttttgaccagtgtcatc

SEQ ID NO: 185686 - DNA, 38 bp, Artificial Sequence
  Description of Artificial Sequence: Synthetic oligonucleotide
tagctattgcatctgtctcctttttgaccagtgtcatc

SEQ ID NO: 185687 - DNA, 37 bp, Artificial Sequence
  Description of Artificial Sequence: Synthetic oligonucleotide
agctattgcatctgtctcctttttgaccagtgtcatc

SEQ ID NO: 185688 - DNA, 36 bp, Artificial Sequence
  Description of Artificial Sequence: Synthetic oligonucleotide
gctattgcatctgtctcctttttgaccagtgtcatc

SEQ ID NO: 185689 - DNA, 38 bp, Artificial Sequence
  Description of Artificial Sequence: Synthetic oligonucleotide
ctattgcatctgtctcctttttgaccagtgtcatcatc

SEQ ID NO: 185690 - DNA, 42 bp, Artificial Sequence
  Description of Artificial Sequence: Synthetic oligonucleotide
tattgcatctgtctcctttttgaccagtgtcatcatcttttc

SEQ ID NO: 185691 - DNA, 41 bp, Artificial Sequence
  Description of Artificial Sequence: Synthetic oligonucleotide
attgcatctgtctcctttttgaccagtgtcatcatcttttc

SEQ ID NO: 185692 - DNA, 40 bp, Artificial Sequence
  Description of Artificial Sequence: Synthetic oligonucleotide
ttgcatctgtctcctttttgaccagtgtcatcatcttttc

SEQ ID NO: 185693 - DNA, 39 bp, Artificial Sequence
  Description of Artificial Sequence: Synthetic oligonucleotide
tgcatctgtctcctttttgaccagtgtcatcatcttttc

SEQ ID NO: 185694 - DNA, 38 bp, Artificial Sequence
  Description of Artificial Sequence: Synthetic oligonucleotide
gcatctgtctcctttttgaccagtgtcatcatcttttc

SEQ ID NO: 185695 - DNA, 38 bp, Artificial Sequence
  Description of Artificial Sequence: Synthetic oligonucleotide
catctgtctcctttttgaccagtgtcatcatcttttcc

SEQ ID NO: 185696 - DNA, 42 bp, Artificial Sequence
  Description of Artificial Sequence: Synthetic oligonucleotide
atctgtctcctttttgaccagtgtcatcatcttttccaaaag

SEQ ID NO: 185697 - DNA, 41 bp, Artificial Sequence
  Description of Artificial Sequence: Synthetic oligonucleotide
tctgtctcctttttgaccagtgtcatcatcttttccaaaag

SEQ ID NO: 185698 - DNA, 40 bp, Artificial Sequence
  Description of Artificial Sequence: Synthetic oligonucleotide
ctgtctcctttttgaccagtgtcatcatcttttccaaaag

SEQ ID NO: 185699 - DNA, 40 bp, Artificial Sequence
  Description of Artificial Sequence: Synthetic oligonucleotide
tgtctcctttttgaccagtgtcatcatcttttccaaaagc

SEQ ID NO: 185700 - DNA, 39 bp, Artificial Sequence
  Description of Artificial Sequence: Synthetic oligonucleotide
gtctcctttttgaccagtgtcatcatcttttccaaaagc

SEQ ID NO: 185701 - DNA, 39 bp, Artificial Sequence
  Description of Artificial Sequence: Synthetic oligonucleotide
cttaaccaaggaaaagttctaccccagaacatgactatc

SEQ ID NO: 185702 - DNA, 40 bp, Artificial Sequence
  Description of Artificial Sequence: Synthetic oligonucleotide
ttaaccaaggaaaagttctaccccagaacatgactatcac

SEQ ID NO: 185703 - DNA, 39 bp, Artificial Sequence
  Description of Artificial Sequence: Synthetic oligonucleotide
taaccaaggaaaagttctaccccagaacatgactatcac

SEQ ID NO: 185704 - DNA, 38 bp, Artificial Sequence
  Description of Artificial Sequence: Synthetic oligonucleotide
aaccaaggaaaagttctaccccagaacatgactatcac

SEQ ID NO: 185705 - DNA, 37 bp, Artificial Sequence
  Description of Artificial Sequence: Synthetic oligonucleotide
accaaggaaaagttctaccccagaacatgactatcac

SEQ ID NO: 185706 - DNA, 36 bp, Artificial Sequence
  Description of Artificial Sequence: Synthetic oligonucleotide
ccaaggaaaagttctaccccagaacatgactatcac

SEQ ID NO: 185707 - DNA, 37 bp, Artificial Sequence
  Description of Artificial Sequence: Synthetic oligonucleotide
caaggaaaagttctaccccagaacatgactatcacac

SEQ ID NO: 185708 - DNA, 38 bp, Artificial Sequence
  Description of Artificial Sequence: Synthetic oligonucleotide
aaggaaaagttctaccccagaacatgactatcacacac

SEQ ID NO: 185709 - DNA, 37 bp, Artificial Sequence
  Description of Artificial Sequence: Synthetic oligonucleotide
aggaaaagttctaccccagaacatgactatcacacac

SEQ ID NO: 185710 - DNA, 36 bp, Artificial Sequence
  Description of Artificial Sequence: Synthetic oligonucleotide
ggaaaagttctaccccagaacatgactatcacacac

SEQ ID NO: 185711 - DNA, 36 bp, Artificial Sequence
  Description of Artificial Sequence: Synthetic oligonucleotide
gaaaagttctaccccagaacatgactatcacacacg

SEQ ID NO: 185712 - DNA, 36 bp, Artificial Sequence
  Description of Artificial Sequence: Synthetic oligonucleotide
aaaagttctaccccagaacatgactatcacacacgc

SEQ ID NO: 185713 - DNA, 35 bp, Artificial Sequence
  Description of Artificial Sequence: Synthetic oligonucleotide
aaagttctaccccagaacatgactatcacacacgc

SEQ ID NO: 185714 - DNA, 34 bp, Artificial Sequence
  Description of Artificial Sequence: Synthetic oligonucleotide
aagttctaccccagaacatgactatcacacacgc

SEQ ID NO: 185715 - DNA, 33 bp, Artificial Sequence
  Description of Artificial Sequence: Synthetic oligonucleotide
agttctaccccagaacatgactatcacacacgc

SEQ ID NO: 185716 - DNA, 32 bp, Artificial Sequence
  Description of Artificial Sequence: Synthetic oligonucleotide
gttctaccccagaacatgactatcacacacgc

SEQ ID NO: 185717 - DNA, 33 bp, Artificial Sequence
  Description of Artificial Sequence: Synthetic oligonucleotide
ttctaccccagaacatgactatcacacacgctg

SEQ ID NO: 185718 - DNA, 32 bp, Artificial Sequence
  Description of Artificial Sequence: Synthetic oligonucleotide
tctaccccagaacatgactatcacacacgctg

SEQ ID NO: 185719 - DNA, 31 bp, Artificial Sequence
  Description of Artificial Sequence: Synthetic oligonucleotide
ctaccccagaacatgactatcacacacgctg

SEQ ID NO: 185720 - DNA, 32 bp, Artificial Sequence
  Description of Artificial Sequence: Synthetic oligonucleotide
taccccagaacatgactatcacacacgctgtg

SEQ ID NO: 185721 - DNA, 31 bp, Artificial Sequence
  Description of Artificial Sequence: Synthetic oligonucleotide
accccagaacatgactatcacacacgctgtg

SEQ ID NO: 185722 - DNA, 30 bp, Artificial Sequence
  Description of Artificial Sequence: Synthetic oligonucleotide
ccccagaacatgactatcacacacgctgtg

SEQ ID NO: 185723 - DNA, 30 bp, Artificial Sequence
  Description of Artificial Sequence: Synthetic oligonucleotide
cccagaacatgactatcacacacgctgtgg

SEQ ID NO: 185724 - DNA, 30 bp, Artificial Sequence
  Description of Artificial Sequence: Synthetic oligonucleotide
ccagaacatgactatcacacacgctgtggc

SEQ ID NO: 185725 - DNA, 36 bp, Artificial Sequence
  Description of Artificial Sequence: Synthetic oligonucleotide
cagaacatgactatcacacacgctgtggctattttg

SEQ ID NO: 185726 - DNA, 43 bp, Artificial Sequence
  Description of Artificial Sequence: Synthetic oligonucleotide
agaacatgactatcacacacgctgtggctattttgttttatac

SEQ ID NO: 185727 - DNA, 42 bp, Artificial Sequence
  Description of Artificial Sequence: Synthetic oligonucleotide
gaacatgactatcacacacgctgtggctattttgttttatac

SEQ ID NO: 185728 - DNA, 45 bp, Artificial Sequence
  Description of Artificial Sequence: Synthetic oligonucleotide
aacatgactatcacacacgctgtggctattttgttttatacattg

SEQ ID NO: 185729 - DNA, 44 bp, Artificial Sequence
  Description of Artificial Sequence: Synthetic oligonucleotide
acatgactatcacacacgctgtggctattttgttttatacattg

SEQ ID NO: 185730 - DNA, 43 bp, Artificial Sequence
  Description of Artificial Sequence: Synthetic oligonucleotide
catgactatcacacacgctgtggctattttgttttatacattg

SEQ ID NO: 185731 - DNA, 45 bp, Artificial Sequence
  Description of Artificial Sequence: Synthetic oligonucleotide
atgactatcacacacgctgtggctattttgttttatacattgaac

SEQ ID NO: 185732 - DNA, 44 bp, Artificial Sequence
  Description of Artificial Sequence: Synthetic oligonucleotide
tgactatcacacacgctgtggctattttgttttatacattgaac

SEQ ID NO: 185733 - DNA, 43 bp, Artificial Sequence
  Description of Artificial Sequence: Synthetic oligonucleotide
gactatcacacacgctgtggctattttgttttatacattgaac

SEQ ID NO: 185734 - DNA, 44 bp, Artificial Sequence
  Description of Artificial Sequence: Synthetic oligonucleotide
actatcacacacgctgtggctattttgttttatacattgaacag

SEQ ID NO: 185735 - DNA, 43 bp, Artificial Sequence
  Description of Artificial Sequence: Synthetic oligonucleotide
ctatcacacacgctgtggctattttgttttatacattgaacag

SEQ ID NO: 185736 - DNA, 43 bp, Artificial Sequence
  Description of Artificial Sequence: Synthetic oligonucleotide
tatcacacacgctgtggctattttgttttatacattgaacagc

SEQ ID NO: 185737 - DNA, 42 bp, Artificial Sequence
  Description of Artificial Sequence: Synthetic oligonucleotide
atcacacacgctgtggctattttgttttatacattgaacagc

SEQ ID NO: 185738 - DNA, 41 bp, Artificial Sequence
  Description of Artificial Sequence: Synthetic oligonucleotide
tcacacacgctgtggctattttgttttatacattgaacagc

SEQ ID NO: 185739 - DNA, 44 bp, Artificial Sequence
  Description of Artificial Sequence: Synthetic oligonucleotide
ttgatccctccctatgagctgtttaaagttataaatatgagctg

SEQ ID NO: 185740 - DNA, 43 bp, Artificial Sequence
  Description of Artificial Sequence: Synthetic oligonucleotide
tgatccctccctatgagctgtttaaagttataaatatgagctg

SEQ ID NO: 185741 - DNA, 42 bp, Artificial Sequence
  Description of Artificial Sequence: Synthetic oligonucleotide
gatccctccctatgagctgtttaaagttataaatatgagctg

SEQ ID NO: 185742 - DNA, 42 bp, Artificial Sequence
  Description of Artificial Sequence: Synthetic oligonucleotide
atccctccctatgagctgtttaaagttataaatatgagctgc

SEQ ID NO: 185743 - DNA, 41 bp, Artificial Sequence
  Description of Artificial Sequence: Synthetic oligonucleotide
tccctccctatgagctgtttaaagttataaatatgagctgc

SEQ ID NO: 185744 - DNA, 40 bp, Artificial Sequence
  Description of Artificial Sequence: Synthetic oligonucleotide
ccctccctatgagctgtttaaagttataaatatgagctgc

SEQ ID NO: 185745 - DNA, 40 bp, Artificial Sequence
  Description of Artificial Sequence: Synthetic oligonucleotide
cctccctatgagctgtttaaagttataaatatgagctgcc

SEQ ID NO: 185746 - DNA, 41 bp, Artificial Sequence
  Description of Artificial Sequence: Synthetic oligonucleotide
ctccctatgagctgtttaaagttataaatatgagctgccac

SEQ ID NO: 185747 - DNA, 41 bp, Artificial Sequence
  Description of Artificial Sequence: Synthetic oligonucleotide
tccctatgagctgtttaaagttataaatatgagctgccacc

SEQ ID NO: 185748 - DNA, 40 bp, Artificial Sequence
  Description of Artificial Sequence: Synthetic oligonucleotide
ccctatgagctgtttaaagttataaatatgagctgccacc

SEQ ID NO: 185749 - DNA, 40 bp, Artificial Sequence
  Description of Artificial Sequence: Synthetic oligonucleotide
cctatgagctgtttaaagttataaatatgagctgccaccc

SEQ ID NO: 185750 - DNA, 42 bp, Artificial Sequence
  Description of Artificial Sequence: Synthetic oligonucleotide
ctatgagctgtttaaagttataaatatgagctgccacccaag

SEQ ID NO: 185751 - DNA, 43 bp, Artificial Sequence
  Description of Artificial Sequence: Synthetic oligonucleotide
tatgagctgtttaaagttataaatatgagctgccacccaagag

SEQ ID NO: 185752 - DNA, 42 bp, Artificial Sequence
  Description of Artificial Sequence: Synthetic oligonucleotide
atgagctgtttaaagttataaatatgagctgccacccaagag

SEQ ID NO: 185753 - DNA, 41 bp, Artificial Sequence
  Description of Artificial Sequence: Synthetic oligonucleotide
tgagctgtttaaagttataaatatgagctgccacccaagag

SEQ ID NO: 185754 - DNA, 40 bp, Artificial Sequence
  Description of Artificial Sequence: Synthetic oligonucleotide
gagctgtttaaagttataaatatgagctgccacccaagag

SEQ ID NO: 185755 - DNA, 40 bp, Artificial Sequence
  Description of Artificial Sequence: Synthetic oligonucleotide
agctgtttaaagttataaatatgagctgccacccaagagg

SEQ ID NO: 185756 - DNA, 39 bp, Artificial Sequence
  Description of Artificial Sequence: Synthetic oligonucleotide
gctgtttaaagttataaatatgagctgccacccaagagg

SEQ ID NO: 185757 - DNA, 42 bp, Artificial Sequence
  Description of Artificial Sequence: Synthetic oligonucleotide
ctgtttaaagttataaatatgagctgccacccaagaggaaac

SEQ ID NO: 185758 - DNA, 43 bp, Artificial Sequence
  Description of Artificial Sequence: Synthetic oligonucleotide
tgtttaaagttataaatatgagctgccacccaagaggaaactg

SEQ ID NO: 185759 - DNA, 42 bp, Artificial Sequence
  Description of Artificial Sequence: Synthetic oligonucleotide
gtttaaagttataaatatgagctgccacccaagaggaaactg

SEQ ID NO: 185760 - DNA, 42 bp, Artificial Sequence
  Description of Artificial Sequence: Synthetic oligonucleotide
tttaaagttataaatatgagctgccacccaagaggaaactgg

SEQ ID NO: 185761 - DNA, 41 bp, Artificial Sequence
  Description of Artificial Sequence: Synthetic oligonucleotide
ttaaagttataaatatgagctgccacccaagaggaaactgg

SEQ ID NO: 185762 - DNA, 40 bp, Artificial Sequence
  Description of Artificial Sequence: Synthetic oligonucleotide
taaagttataaatatgagctgccacccaagaggaaactgg

SEQ ID NO: 185763 - DNA, 39 bp, Artificial Sequence
  Description of Artificial Sequence: Synthetic oligonucleotide
aaagttataaatatgagctgccacccaagaggaaactgg

SEQ ID NO: 185764 - DNA, 38 bp, Artificial Sequence
  Description of Artificial Sequence: Synthetic oligonucleotide
aagttataaatatgagctgccacccaagaggaaactgg

SEQ ID NO: 185765 - DNA, 37 bp, Artificial Sequence
  Description of Artificial Sequence: Synthetic oligonucleotide
agttataaatatgagctgccacccaagaggaaactgg

SEQ ID NO: 185766 - DNA, 36 bp, Artificial Sequence
  Description of Artificial Sequence: Synthetic oligonucleotide
gttataaatatgagctgccacccaagaggaaactgg

SEQ ID NO: 185767 - DNA, 38 bp, Artificial Sequence
  Description of Artificial Sequence: Synthetic oligonucleotide
ttataaatatgagctgccacccaagaggaaactggttg

SEQ ID NO: 185768 - DNA, 37 bp, Artificial Sequence
  Description of Artificial Sequence: Synthetic oligonucleotide
tataaatatgagctgccacccaagaggaaactggttg

SEQ ID NO: 185769 - DNA, 36 bp, Artificial Sequence
  Description of Artificial Sequence: Synthetic oligonucleotide
ataaatatgagctgccacccaagaggaaactggttg

SEQ ID NO: 185770 - DNA, 35 bp, Artificial Sequence
  Description of Artificial Sequence: Synthetic oligonucleotide
taaatatgagctgccacccaagaggaaactggttg

SEQ ID NO: 185771 - DNA, 34 bp, Artificial Sequence
  Description of Artificial Sequence: Synthetic oligonucleotide
aaatatgagctgccacccaagaggaaactggttg

SEQ ID NO: 185772 - DNA, 33 bp, Artificial Sequence
  Description of Artificial Sequence: Synthetic oligonucleotide
aatatgagctgccacccaagaggaaactggttg

SEQ ID NO: 185773 - DNA, 32 bp, Artificial Sequence
  Description of Artificial Sequence: Synthetic oligonucleotide
atatgagctgccacccaagaggaaactggttg

SEQ ID NO: 185774 - DNA, 31 bp, Artificial Sequence
  Description of Artificial Sequence: Synthetic oligonucleotide
tatgagctgccacccaagaggaaactggttg

SEQ ID NO: 185775 - DNA, 30 bp, Artificial Sequence
  Description of Artificial Sequence: Synthetic oligonucleotide
atgagctgccacccaagaggaaactggttg

SEQ ID NO: 185776 - DNA, 29 bp, Artificial Sequence
  Description of Artificial Sequence: Synthetic oligonucleotide
tgagctgccacccaagaggaaactggttg

SEQ ID NO: 185777 - DNA, 28 bp, Artificial Sequence
  Description of Artificial Sequence: Synthetic oligonucleotide
gagctgccacccaagaggaaactggttg

SEQ ID NO: 185778 - DNA, 28 bp, Artificial Sequence
  Description of Artificial Sequence: Synthetic oligonucleotide
agctgccacccaagaggaaactggttgc

SEQ ID NO: 185779 - DNA, 27 bp, Artificial Sequence
  Description of Artificial Sequence: Synthetic oligonucleotide
gctgccacccaagaggaaactggttgc

SEQ ID NO: 185780 - DNA, 28 bp, Artificial Sequence
  Description of Artificial Sequence: Synthetic oligonucleotide
ctgccacccaagaggaaactggttgcag

SEQ ID NO: 185781 - DNA, 30 bp, Artificial Sequence
  Description of Artificial Sequence: Synthetic oligonucleotide
tgccacccaagaggaaactggttgcagttg

SEQ ID NO: 185782 - DNA, 29 bp, Artificial Sequence
  Description of Artificial Sequence: Synthetic oligonucleotide
gccacccaagaggaaactggttgcagttg

SEQ ID NO: 185783 - DNA, 35 bp, Artificial Sequence
  Description of Artificial Sequence: Synthetic oligonucleotide
caggttgcaattaaaatcgacttcgacttcgcacc

SEQ ID NO: 185784 - DNA, 36 bp, Artificial Sequence
  Description of Artificial Sequence: Synthetic oligonucleotide
cccacttagcctggcttaaccaaggaaaagttttac

SEQ ID NO: 185785 - DNA, 36 bp, Artificial Sequence
  Description of Artificial Sequence: Synthetic oligonucleotide
ccacttagcctggcttaaccaaggaaaagttttacc

SEQ ID NO: 185786 - DNA, 36 bp, Artificial Sequence
  Description of Artificial Sequence: Synthetic oligonucleotide
cacttagcctggcttaaccaaggaaaagttttaccc

SEQ ID NO: 185787 - DNA, 36 bp, Artificial Sequence
  Description of Artificial Sequence: Synthetic oligonucleotide
acttagcctggcttaaccaaggaaaagttttacccc

SEQ ID NO: 185788 - DNA, 35 bp, Artificial Sequence
  Description of Artificial Sequence: Synthetic oligonucleotide
cttagcctggcttaaccaaggaaaagttttacccc

SEQ ID NO: 185789 - DNA, 36 bp, Artificial Sequence
  Description of Artificial Sequence: Synthetic oligonucleotide
ttagcctggcttaaccaaggaaaagttttaccccag

SEQ ID NO: 185790 - DNA, 35 bp, Artificial Sequence
  Description of Artificial Sequence: Synthetic oligonucleotide
tagcctggcttaaccaaggaaaagttttaccccag

SEQ ID NO: 185791 - DNA, 34 bp, Artificial Sequence
  Description of Artificial Sequence: Synthetic oligonucleotide
agcctggcttaaccaaggaaaagttttaccccag

SEQ ID NO: 185792 - DNA, 33 bp, Artificial Sequence
  Description of Artificial Sequence: Synthetic oligonucleotide
gcctggcttaaccaaggaaaagttttaccccag

SEQ ID NO: 185793 - DNA, 35 bp, Artificial Sequence
  Description of Artificial Sequence: Synthetic oligonucleotide
cctggcttaaccaaggaaaagttttaccccagaac

SEQ ID NO: 185794 - DNA, 37 bp, Artificial Sequence
  Description of Artificial Sequence: Synthetic oligonucleotide
ctggcttaaccaaggaaaagttttaccccagaacatg

SEQ ID NO: 185795 - DNA, 38 bp, Artificial Sequence
  Description of Artificial Sequence: Synthetic oligonucleotide
tggcttaaccaaggaaaagttttaccccagaacatgag

SEQ ID NO: 185796 - DNA, 37 bp, Artificial Sequence
  Description of Artificial Sequence: Synthetic oligonucleotide
ggcttaaccaaggaaaagttttaccccagaacatgag

SEQ ID NO: 185797 - DNA, 39 bp, Artificial Sequence
  Description of Artificial Sequence: Synthetic oligonucleotide
gcttaaccaaggaaaagttttaccccagaacatgagtac

SEQ ID NO: 185798 - DNA, 39 bp, Artificial Sequence
  Description of Artificial Sequence: Synthetic oligonucleotide
cttaaccaaggaaaagttttaccccagaacatgagtacc

SEQ ID NO: 185799 - DNA, 40 bp, Artificial Sequence
  Description of Artificial Sequence: Synthetic oligonucleotide
ttaaccaaggaaaagttttaccccagaacatgagtaccac

SEQ ID NO: 185800 - DNA, 39 bp, Artificial Sequence
  Description of Artificial Sequence: Synthetic oligonucleotide
taaccaaggaaaagttttaccccagaacatgagtaccac

SEQ ID NO: 185801 - DNA, 38 bp, Artificial Sequence
  Description of Artificial Sequence: Synthetic oligonucleotide
aaccaaggaaaagttttaccccagaacatgagtaccac

SEQ ID NO: 185802 - DNA, 37 bp, Artificial Sequence
  Description of Artificial Sequence: Synthetic oligonucleotide
accaaggaaaagttttaccccagaacatgagtaccac

SEQ ID NO: 185803 - DNA, 36 bp, Artificial Sequence
  Description of Artificial Sequence: Synthetic oligonucleotide
ccaaggaaaagttttaccccagaacatgagtaccac

SEQ ID NO: 185804 - DNA, 37 bp, Artificial Sequence
  Description of Artificial Sequence: Synthetic oligonucleotide
caaggaaaagttttaccccagaacatgagtaccacac

SEQ ID NO: 185805 - DNA, 38 bp, Artificial Sequence
  Description of Artificial Sequence: Synthetic oligonucleotide
aaggaaaagttttaccccagaacatgagtaccacacac

SEQ ID NO: 185806 - DNA, 37 bp, Artificial Sequence
  Description of Artificial Sequence: Synthetic oligonucleotide
aggaaaagttttaccccagaacatgagtaccacacac

SEQ ID NO: 185807 - DNA, 36 bp, Artificial Sequence
  Description of Artificial Sequence: Synthetic oligonucleotide
ggaaaagttttaccccagaacatgagtaccacacac

SEQ ID NO: 185808 - DNA, 36 bp, Artificial Sequence
  Description of Artificial Sequence: Synthetic oligonucleotide
gaaaagttttaccccagaacatgagtaccacacacg

SEQ ID NO: 185809 - DNA, 36 bp, Artificial Sequence
  Description of Artificial Sequence: Synthetic oligonucleotide
aaaagttttaccccagaacatgagtaccacacacgc

SEQ ID NO: 185810 - DNA, 35 bp, Artificial Sequence
  Description of Artificial Sequence: Synthetic oligonucleotide
aaagttttaccccagaacatgagtaccacacacgc

SEQ ID NO: 185811 - DNA, 34 bp, Artificial Sequence
  Description of Artificial Sequence: Synthetic oligonucleotide
aagttttaccccagaacatgagtaccacacacgc

SEQ ID NO: 185812 - DNA, 33 bp, Artificial Sequence
  Description of Artificial Sequence: Synthetic oligonucleotide
agttttaccccagaacatgagtaccacacacgc

SEQ ID NO: 185813 - DNA, 32 bp, Artificial Sequence
  Description of Artificial Sequence: Synthetic oligonucleotide
gttttaccccagaacatgagtaccacacacgc

SEQ ID NO: 185814 - DNA, 33 bp, Artificial Sequence
  Description of Artificial Sequence: Synthetic oligonucleotide
ttttaccccagaacatgagtaccacacacgctg

SEQ ID NO: 185815 - DNA, 32 bp, Artificial Sequence
  Description of Artificial Sequence: Synthetic oligonucleotide
tttaccccagaacatgagtaccacacacgctg

SEQ ID NO: 185816 - DNA, 31 bp, Artificial Sequence
  Description of Artificial Sequence: Synthetic oligonucleotide
ttaccccagaacatgagtaccacacacgctg

SEQ ID NO: 185817 - DNA, 30 bp, Artificial Sequence
  Description of Artificial Sequence: Synthetic oligonucleotide
taccccagaacatgagtaccacacacgctg

SEQ ID NO: 185818 - DNA, 29 bp, Artificial Sequence
  Description of Artificial Sequence: Synthetic oligonucleotide
accccagaacatgagtaccacacacgctg

SEQ ID NO: 185819 - DNA, 28 bp, Artificial Sequence
  Description of Artificial Sequence: Synthetic oligonucleotide
ccccagaacatgagtaccacacacgctg

SEQ ID NO: 185820 - DNA, 29 bp, Artificial Sequence
  Description of Artificial Sequence: Synthetic oligonucleotide
cccagaacatgagtaccacacacgctgtg

SEQ ID NO: 185821 - DNA, 29 bp, Artificial Sequence
  Description of Artificial Sequence: Synthetic oligonucleotide
ccagaacatgagtaccacacacgctgtgg

SEQ ID NO: 185822 - DNA, 29 bp, Artificial Sequence
  Description of Artificial Sequence: Synthetic oligonucleotide
cagaacatgagtaccacacacgctgtggc

SEQ ID NO: 185823 - DNA, 35 bp, Artificial Sequence
  Description of Artificial Sequence: Synthetic oligonucleotide
agaacatgagtaccacacacgctgtggctattttg

SEQ ID NO: 185824 - DNA, 34 bp, Artificial Sequence
  Description of Artificial Sequence: Synthetic oligonucleotide
gaacatgagtaccacacacgctgtggctattttg

SEQ ID NO: 185825 - DNA, 39 bp, Artificial Sequence
  Description of Artificial Sequence: Synthetic oligonucleotide
aacatgagtaccacacacgctgtggctattttgttttac

SEQ ID NO: 185826 - DNA, 38 bp, Artificial Sequence
  Description of Artificial Sequence: Synthetic oligonucleotide
acatgagtaccacacacgctgtggctattttgttttac

SEQ ID NO: 185827 - DNA, 37 bp, Artificial Sequence
  Description of Artificial Sequence: Synthetic oligonucleotide
catgagtaccacacacgctgtggctattttgttttac

SEQ ID NO: 185828 - DNA, 38 bp, Artificial Sequence
  Description of Artificial Sequence: Synthetic oligonucleotide
atgagtaccacacacgctgtggctattttgttttacac

SEQ ID NO: 185829 - DNA, 37 bp, Artificial Sequence
  Description of Artificial Sequence: Synthetic oligonucleotide
tgagtaccacacacgctgtggctattttgttttacac

SEQ ID NO: 185830 - DNA, 36 bp, Artificial Sequence
  Description of Artificial Sequence: Synthetic oligonucleotide
gagtaccacacacgctgtggctattttgttttacac

SEQ ID NO: 185831 - DNA, 39 bp, Artificial Sequence
  Description of Artificial Sequence: Synthetic oligonucleotide
agtaccacacacgctgtggctattttgttttacacattg

SEQ ID NO: 185832 - DNA, 38 bp, Artificial Sequence
  Description of Artificial Sequence: Synthetic oligonucleotide
gtaccacacacgctgtggctattttgttttacacattg

SEQ ID NO: 185833 - DNA, 26 bp, Artificial Sequence
  Description of Artificial Sequence: Synthetic oligonucleotide
atggggaactgtctgcacagggcgga

SEQ ID NO: 185834 - DNA, 25 bp, Artificial Sequence
  Description of Artificial Sequence: Synthetic oligonucleotide
tggggaactgtctgcacagggcgga

SEQ ID NO: 185835 - DNA, 24 bp, Artificial Sequence
  Description of Artificial Sequence: Synthetic oligonucleotide
ggggaactgtctgcacagggcgga

SEQ ID NO: 185836 - DNA, 24 bp, Artificial Sequence
  Description of Artificial Sequence: Synthetic oligonucleotide
gggaactgtctgcacagggcggag

SEQ ID NO: 185837 - DNA, 25 bp, Artificial Sequence
  Description of Artificial Sequence: Synthetic oligonucleotide
ggaactgtctgcacagggcggagct

SEQ ID NO: 185838 - DNA, 26 bp, Artificial Sequence
  Description of Artificial Sequence: Synthetic oligonucleotide
gaactgtctgcacagggcggagctct

SEQ ID NO: 185839 - DNA, 26 bp, Artificial Sequence
  Description of Artificial Sequence: Synthetic oligonucleotide
aactgtctgcacagggcggagctctc

SEQ ID NO: 185840 - DNA, 25 bp, Artificial Sequence
  Description of Artificial Sequence: Synthetic oligonucleotide
actgtctgcacagggcggagctctc

SEQ ID NO: 185841 - DNA, 24 bp, Artificial Sequence
  Description of Artificial Sequence: Synthetic oligonucleotide
ctgtctgcacagggcggagctctc

SEQ ID NO: 185842 - DNA, 24 bp, Artificial Sequence
  Description of Artificial Sequence: Synthetic oligonucleotide
tgtctgcacagggcggagctctcc

SEQ ID NO: 185843 - DNA, 23 bp, Artificial Sequence
  Description of Artificial Sequence: Synthetic oligonucleotide
gtctgcacagggcggagctctcc

SEQ ID NO: 185844 - DNA, 23 bp, Artificial Sequence
  Description of Artificial Sequence: Synthetic oligonucleotide
tctgcacagggcggagctctccc

SEQ ID NO: 185845 - DNA, 22 bp, Artificial Sequence
  Description of Artificial Sequence: Synthetic oligonucleotide
ctgcacagggcggagctctccc

SEQ ID NO: 185846 - DNA, 22 bp, Artificial Sequence
  Description of Artificial Sequence: Synthetic oligonucleotide
tgcacagggcggagctctcccc

SEQ ID NO: 185847 - DNA, 21 bp, Artificial Sequence
  Description of Artificial Sequence: Synthetic oligonucleotide
gcacagggcggagctctcccc

SEQ ID NO: 185848 - DNA, 22 bp, Artificial Sequence
  Description of Artificial Sequence: Synthetic oligonucleotide
cacagggcggagctctccccct

SEQ ID NO: 185849 - DNA, 24 bp, Artificial Sequence
  Description of Artificial Sequence: Synthetic oligonucleotide
acagggcggagctctccccctcaa

SEQ ID NO: 185850 - DNA, 23 bp, Artificial Sequence
  Description of Artificial Sequence: Synthetic oligonucleotide
cagggcggagctctccccctcaa

SEQ ID NO: 185851 - DNA, 24 bp, Artificial Sequence
  Description of Artificial Sequence: Synthetic oligonucleotide
agggcggagctctccccctcaact

SEQ ID NO: 185852 - DNA, 23 bp, Artificial Sequence
  Description of Artificial Sequence: Synthetic oligonucleotide
gggcggagctctccccctcaact

SEQ ID NO: 185853 - DNA, 24 bp, Artificial Sequence
  Description of Artificial Sequence: Synthetic oligonucleotide
ggcggagctctccccctcaactga

SEQ ID NO: 185854 - DNA, 26 bp, Artificial Sequence
  Description of Artificial Sequence: Synthetic oligonucleotide
gcggagctctccccctcaactgagaa

SEQ ID NO: 185855 - DNA, 27 bp, Artificial Sequence
  Description of Artificial Sequence: Synthetic oligonucleotide
cggagctctccccctcaactgagaact

SEQ ID NO: 185856 - DNA, 27 bp, Artificial Sequence
  Description of Artificial Sequence: Synthetic oligonucleotide
ggagctctccccctcaactgagaactc

SEQ ID NO: 185857 - DNA, 29 bp, Artificial Sequence
  Description of Artificial Sequence: Synthetic oligonucleotide
gagctctccccctcaactgagaactcaag

SEQ ID NO: 185858 - DNA, 30 bp, Artificial Sequence
  Description of Artificial Sequence: Synthetic oligonucleotide
agctctccccctcaactgagaactcaagtc

SEQ ID NO: 185859 - DNA, 29 bp, Artificial Sequence
  Description of Artificial Sequence: Synthetic oligonucleotide
gctctccccctcaactgagaactcaagtc

SEQ ID NO: 185860 - DNA, 30 bp, Artificial Sequence
  Description of Artificial Sequence: Synthetic oligonucleotide
ctctccccctcaactgagaactcaagtcag

SEQ ID NO: 185861 - DNA, 30 bp, Artificial Sequence
  Description of Artificial Sequence: Synthetic oligonucleotide
tctccccctcaactgagaactcaagtcagc

SEQ ID NO: 185862 - DNA, 29 bp, Artificial Sequence
  Description of Artificial Sequence: Synthetic oligonucleotide
ctccccctcaactgagaactcaagtcagc

SEQ ID NO: 185863 - DNA, 30 bp, Artificial Sequence
  Description of Artificial Sequence: Synthetic oligonucleotide
tccccctcaactgagaactcaagtcagctg

SEQ ID NO: 185864 - DNA, 29 bp, Artificial Sequence
  Description of Artificial Sequence: Synthetic oligonucleotide
ccccctcaactgagaactcaagtcagctg

SEQ ID NO: 185865 - DNA, 29 bp, Artificial Sequence
  Description of Artificial Sequence: Synthetic oligonucleotide
cccctcaactgagaactcaagtcagctgg

SEQ ID NO: 185866 - DNA, 30 bp, Artificial Sequence
  Description of Artificial Sequence: Synthetic oligonucleotide
ccctcaactgagaactcaagtcagctggac

SEQ ID NO: 185867 - DNA, 32 bp, Artificial Sequence
  Description of Artificial Sequence: Synthetic oligonucleotide
cctcaactgagaactcaagtcagctggacttc

SEQ ID NO: 185868 - DNA, 32 bp, Artificial Sequence
  Description of Artificial Sequence: Synthetic oligonucleotide
ctcaactgagaactcaagtcagctggacttcg

SEQ ID NO: 185869 - DNA, 34 bp, Artificial Sequence
  Description of Artificial Sequence: Synthetic oligonucleotide
tcaactgagaactcaagtcagctggacttcgaag

SEQ ID NO: 185870 - DNA, 33 bp, Artificial Sequence
  Description of Artificial Sequence: Synthetic oligonucleotide
caactgagaactcaagtcagctggacttcgaag

SEQ ID NO: 185871 - DNA, 35 bp, Artificial Sequence
  Description of Artificial Sequence: Synthetic oligonucleotide
aactgagaactcaagtcagctggacttcgaagatg

SEQ ID NO: 185872 - DNA, 34 bp, Artificial Sequence
  Description of Artificial Sequence: Synthetic oligonucleotide
actgagaactcaagtcagctggacttcgaagatg

SEQ ID NO: 185873 - DNA, 33 bp, Artificial Sequence
  Description of Artificial Sequence: Synthetic oligonucleotide
ctgagaactcaagtcagctggacttcgaagatg

SEQ ID NO: 185874 - DNA, 36 bp, Artificial Sequence
  Description of Artificial Sequence: Synthetic oligonucleotide
tgagaactcaagtcagctggacttcgaagatgtatg

SEQ ID NO: 185875 - DNA, 35 bp, Artificial Sequence
  Description of Artificial Sequence: Synthetic oligonucleotide
gagaactcaagtcagctggacttcgaagatgtatg

SEQ ID NO: 185876 - DNA, 35 bp, Artificial Sequence
  Description of Artificial Sequence: Synthetic oligonucleotide
agaactcaagtcagctggacttcgaagatgtatgg

SEQ ID NO: 185877 - DNA, 34 bp, Artificial Sequence
  Description of Artificial Sequence: Synthetic oligonucleotide
gaactcaagtcagctggacttcgaagatgtatgg

SEQ ID NO: 185878 - DNA, 38 bp, Artificial Sequence
  Description of Artificial Sequence: Synthetic oligonucleotide
aactcaagtcagctggacttcgaagatgtatggaattc

SEQ ID NO: 185879 - DNA, 37 bp, Artificial Sequence
  Description of Artificial Sequence: Synthetic oligonucleotide
actcaagtcagctggacttcgaagatgtatggaattc

SEQ ID NO: 185880 - DNA, 36 bp, Artificial Sequence
  Description of Artificial Sequence: Synthetic oligonucleotide
ctcaagtcagctggacttcgaagatgtatggaattc

SEQ ID NO: 185881 - DNA, 38 bp, Artificial Sequence
  Description of Artificial Sequence: Synthetic oligonucleotide
tcaagtcagctggacttcgaagatgtatggaattcttc

SEQ ID NO: 185882 - DNA, 37 bp, Artificial Sequence
  Description of Artificial Sequence: Synthetic oligonucleotide
caagtcagctggacttcgaagatgtatggaattcttc

SEQ ID NO: 185883 - DNA, 37 bp, Artificial Sequence
  Description of Artificial Sequence: Synthetic oligonucleotide
aagtcagctggacttcgaagatgtatggaattcttcc

SEQ ID NO: 185884 - DNA, 36 bp, Artificial Sequence
  Description of Artificial Sequence: Synthetic oligonucleotide
agtcagctggacttcgaagatgtatggaattcttcc

SEQ ID NO: 185885 - DNA, 35 bp, Artificial Sequence
  Description of Artificial Sequence: Synthetic oligonucleotide
gtcagctggacttcgaagatgtatggaattcttcc

SEQ ID NO: 185886 - DNA, 38 bp, Artificial Sequence
  Description of Artificial Sequence: Synthetic oligonucleotide
tcagctggacttcgaagatgtatggaattcttcctatg

SEQ ID NO: 185887 - DNA, 37 bp, Artificial Sequence
  Description of Artificial Sequence: Synthetic oligonucleotide
cagctggacttcgaagatgtatggaattcttcctatg

SEQ ID NO: 185888 - DNA, 37 bp, Artificial Sequence
  Description of Artificial Sequence: Synthetic oligonucleotide
agctggacttcgaagatgtatggaattcttcctatgg

SEQ ID NO: 185889 - DNA, 36 bp, Artificial Sequence
  Description of Artificial Sequence: Synthetic oligonucleotide
gctggacttcgaagatgtatggaattcttcctatgg

SEQ ID NO: 185890 - DNA, 37 bp, Artificial Sequence
  Description of Artificial Sequence: Synthetic oligonucleotide
ctggacttcgaagatgtatggaattcttcctatggtg

SEQ ID NO: 185891 - DNA, 38 bp, Artificial Sequence
  Description of Artificial Sequence: Synthetic oligonucleotide
tggacttcgaagatgtatggaattcttcctatggtgtg

SEQ ID NO: 185892 - DNA, 37 bp, Artificial Sequence
  Description of Artificial Sequence: Synthetic oligonucleotide
ggacttcgaagatgtatggaattcttcctatggtgtg

SEQ ID NO: 185893 - DNA, 40 bp, Artificial Sequence
  Description of Artificial Sequence: Synthetic oligonucleotide
gacttcgaagatgtatggaattcttcctatggtgtgaatg

SEQ ID NO: 185894 - DNA, 43 bp, Artificial Sequence
  Description of Artificial Sequence: Synthetic oligonucleotide
acttcgaagatgtatggaattcttcctatggtgtgaatgattc

SEQ ID NO: 185895 - DNA, 42 bp, Artificial Sequence
  Description of Artificial Sequence: Synthetic oligonucleotide
cttcgaagatgtatggaattcttcctatggtgtgaatgattc

SEQ ID NO: 185896 - DNA, 42 bp, Artificial Sequence
  Description of Artificial Sequence: Synthetic oligonucleotide
ttcgaagatgtatggaattcttcctatggtgtgaatgattcc

SEQ ID NO: 185897 - DNA, 41 bp, Artificial Sequence
  Description of Artificial Sequence: Synthetic oligonucleotide
tcgaagatgtatggaattcttcctatggtgtgaatgattcc

SEQ ID NO: 185898 - DNA, 40 bp, Artificial Sequence
  Description of Artificial Sequence: Synthetic oligonucleotide
cgaagatgtatggaattcttcctatggtgtgaatgattcc

SEQ ID NO: 185899 - DNA, 42 bp, Artificial Sequence
  Description of Artificial Sequence: Synthetic oligonucleotide
gaagatgtatggaattcttcctatggtgtgaatgattccttc

SEQ ID NO: 185900 - DNA, 42 bp, Artificial Sequence
  Description of Artificial Sequence: Synthetic oligonucleotide
aagatgtatggaattcttcctatggtgtgaatgattccttcc

SEQ ID NO: 185901 - DNA, 41 bp, Artificial Sequence
  Description of Artificial Sequence: Synthetic oligonucleotide
agatgtatggaattcttcctatggtgtgaatgattccttcc

SEQ ID NO: 185902 - DNA, 40 bp, Artificial Sequence
  Description of Artificial Sequence: Synthetic oligonucleotide
gatgtatggaattcttcctatggtgtgaatgattccttcc

SEQ ID NO: 185903 - DNA, 40 bp, Artificial Sequence
  Description of Artificial Sequence: Synthetic oligonucleotide
atgtatggaattcttcctatggtgtgaatgattccttccc

SEQ ID NO: 185904 - DNA, 39 bp, Artificial Sequence
  Description of Artificial Sequence: Synthetic oligonucleotide
tgtatggaattcttcctatggtgtgaatgattccttccc

SEQ ID NO: 185905 - DNA, 38 bp, Artificial Sequence
  Description of Artificial Sequence: Synthetic oligonucleotide
gtatggaattcttcctatggtgtgaatgattccttccc

SEQ ID NO: 185906 - DNA, 39 bp, Artificial Sequence
  Description of Artificial Sequence: Synthetic oligonucleotide
tatggaattcttcctatggtgtgaatgattccttcccag

SEQ ID NO: 185907 - DNA, 38 bp, Artificial Sequence
  Description of Artificial Sequence: Synthetic oligonucleotide
atggaattcttcctatggtgtgaatgattccttcccag

SEQ ID NO: 185908 - DNA, 37 bp, Artificial Sequence
  Description of Artificial Sequence: Synthetic oligonucleotide
tggaattcttcctatggtgtgaatgattccttcccag

SEQ ID NO: 185909 - DNA, 36 bp, Artificial Sequence
  Description of Artificial Sequence: Synthetic oligonucleotide
ggaattcttcctatggtgtgaatgattccttcccag

SEQ ID NO: 185910 - DNA, 38 bp, Artificial Sequence
  Description of Artificial Sequence: Synthetic oligonucleotide
gaattcttcctatggtgtgaatgattccttcccagatg

SEQ ID NO: 185911 - DNA, 38 bp, Artificial Sequence
  Description of Artificial Sequence: Synthetic oligonucleotide
aattcttcctatggtgtgaatgattccttcccagatgg

SEQ ID NO: 185912 - DNA, 37 bp, Artificial Sequence
  Description of Artificial Sequence: Synthetic oligonucleotide
attcttcctatggtgtgaatgattccttcccagatgg

SEQ ID NO: 185913 - DNA, 36 bp, Artificial Sequence
  Description of Artificial Sequence: Synthetic oligonucleotide
ttcttcctatggtgtgaatgattccttcccagatgg

SEQ ID NO: 185914 - DNA, 35 bp, Artificial Sequence
  Description of Artificial Sequence: Synthetic oligonucleotide
tcttcctatggtgtgaatgattccttcccagatgg

SEQ ID NO: 185915 - DNA, 34 bp, Artificial Sequence
  Description of Artificial Sequence: Synthetic oligonucleotide
cttcctatggtgtgaatgattccttcccagatgg

SEQ ID NO: 185916 - DNA, 35 bp, Artificial Sequence
  Description of Artificial Sequence: Synthetic oligonucleotide
ttcctatggtgtgaatgattccttcccagatggag

SEQ ID NO: 185917 - DNA, 34 bp, Artificial Sequence
  Description of Artificial Sequence: Synthetic oligonucleotide
tcctatggtgtgaatgattccttcccagatggag

SEQ ID NO: 185918 - DNA, 33 bp, Artificial Sequence
  Description of Artificial Sequence: Synthetic oligonucleotide
cctatggtgtgaatgattccttcccagatggag

SEQ ID NO: 185919 - DNA, 34 bp, Artificial Sequence
  Description of Artificial Sequence: Synthetic oligonucleotide
ctatggtgtgaatgattccttcccagatggagac

SEQ ID NO: 185920 - DNA, 37 bp, Artificial Sequence
  Description of Artificial Sequence: Synthetic oligonucleotide
tatggtgtgaatgattccttcccagatggagactatg

SEQ ID NO: 185921 - DNA, 36 bp, Artificial Sequence
  Description of Artificial Sequence: Synthetic oligonucleotide
atggtgtgaatgattccttcccagatggagactatg

SEQ ID NO: 185922 - DNA, 35 bp, Artificial Sequence
  Description of Artificial Sequence: Synthetic oligonucleotide
tggtgtgaatgattccttcccagatggagactatg

SEQ ID NO: 185923 - DNA, 34 bp, Artificial Sequence
  Description of Artificial Sequence: Synthetic oligonucleotide
ggtgtgaatgattccttcccagatggagactatg

SEQ ID NO: 185924 - DNA, 34 bp, Artificial Sequence
  Description of Artificial Sequence: Synthetic oligonucleotide
gtgtgaatgattccttcccagatggagactatgg

SEQ ID NO: 185925 - DNA, 35 bp, Artificial Sequence
  Description of Artificial Sequence: Synthetic oligonucleotide
tgtgaatgattccttcccagatggagactatggtg

SEQ ID NO: 185926 - DNA, 34 bp, Artificial Sequence
  Description of Artificial Sequence: Synthetic oligonucleotide
gtgaatgattccttcccagatggagactatggtg

SEQ ID NO: 185927 - DNA, 34 bp, Artificial Sequence
  Description of Artificial Sequence: Synthetic oligonucleotide
tgaatgattccttcccagatggagactatggtgc

SEQ ID NO: 185928 - DNA, 33 bp, Artificial Sequence
  Description of Artificial Sequence: Synthetic oligonucleotide
gaatgattccttcccagatggagactatggtgc

SEQ ID NO: 185929 - DNA, 33 bp, Artificial Sequence
  Description of Artificial Sequence: Synthetic oligonucleotide
aatgattccttcccagatggagactatggtgcc

SEQ ID NO: 185930 - DNA, 32 bp, Artificial Sequence
  Description of Artificial Sequence: Synthetic oligonucleotide
atgattccttcccagatggagactatggtgcc

SEQ ID NO: 185931 - DNA, 31 bp, Artificial Sequence
  Description of Artificial Sequence: Synthetic oligonucleotide
tgattccttcccagatggagactatggtgcc

SEQ ID NO: 185932 - DNA, 30 bp, Artificial Sequence
  Description of Artificial Sequence: Synthetic oligonucleotide
gattccttcccagatggagactatggtgcc

SEQ ID NO: 185933 - DNA, 32 bp, Artificial Sequence
  Description of Artificial Sequence: Synthetic oligonucleotide
attccttcccagatggagactatggtgccaac

SEQ ID NO: 185934 - DNA, 31 bp, Artificial Sequence
  Description of Artificial Sequence: Synthetic oligonucleotide
ttccttcccagatggagactatggtgccaac

SEQ ID NO: 185935 - DNA, 30 bp, Artificial Sequence
  Description of Artificial Sequence: Synthetic oligonucleotide
tccttcccagatggagactatggtgccaac

SEQ ID NO: 185936 - DNA, 29 bp, Artificial Sequence
  Description of Artificial Sequence: Synthetic oligonucleotide
ccttcccagatggagactatggtgccaac

SEQ ID NO: 185937 - DNA, 29 bp, Artificial Sequence
  Description of Artificial Sequence: Synthetic oligonucleotide
cttcccagatggagactatggtgccaacc

SEQ ID NO: 185938 - DNA, 30 bp, Artificial Sequence
  Description of Artificial Sequence: Synthetic oligonucleotide
ttcccagatggagactatggtgccaacctg

SEQ ID NO: 185939 - DNA, 29 bp, Artificial Sequence
  Description of Artificial Sequence: Synthetic oligonucleotide
tcccagatggagactatggtgccaacctg

SEQ ID NO: 185940 - DNA, 28 bp, Artificial Sequence
  Description of Artificial Sequence: Synthetic oligonucleotide
cccagatggagactatggtgccaacctg

SEQ ID NO: 185941 - DNA, 28 bp, Artificial Sequence
  Description of Artificial Sequence: Synthetic oligonucleotide
ccagatggagactatggtgccaacctgg

SEQ ID NO: 185942 - DNA, 30 bp, Artificial Sequence
  Description of Artificial Sequence: Synthetic oligonucleotide
cagatggagactatggtgccaacctggaag

SEQ ID NO: 185943 - DNA, 30 bp, Artificial Sequence
  Description of Artificial Sequence: Synthetic oligonucleotide
agatggagactatggtgccaacctggaagc

SEQ ID NO: 185944 - DNA, 29 bp, Artificial Sequence
  Description of Artificial Sequence: Synthetic oligonucleotide
gatggagactatggtgccaacctggaagc

SEQ ID NO: 185945 - DNA, 30 bp, Artificial Sequence
  Description of Artificial Sequence: Synthetic oligonucleotide
atggagactatggtgccaacctggaagcag

SEQ ID NO: 185946 - DNA, 29 bp, Artificial Sequence
  Description of Artificial Sequence: Synthetic oligonucleotide
tggagactatggtgccaacctggaagcag

SEQ ID NO: 185947 - DNA, 28 bp, Artificial Sequence
  Description of Artificial Sequence: Synthetic oligonucleotide
ggagactatggtgccaacctggaagcag

SEQ ID NO: 185948 - DNA, 28 bp, Artificial Sequence
  Description of Artificial Sequence: Synthetic oligonucleotide
gagactatggtgccaacctggaagcagc

SEQ ID NO: 185949 - DNA, 29 bp, Artificial Sequence
  Description of Artificial Sequence: Synthetic oligonucleotide
agactatggtgccaacctggaagcagctg

SEQ ID NO: 185950 - DNA, 28 bp, Artificial Sequence
  Description of Artificial Sequence: Synthetic oligonucleotide
gactatggtgccaacctggaagcagctg

SEQ ID NO: 185951 - DNA, 28 bp, Artificial Sequence
  Description of Artificial Sequence: Synthetic oligonucleotide
actatggtgccaacctggaagcagctgc

SEQ ID NO: 185952 - DNA, 27 bp, Artificial Sequence
  Description of Artificial Sequence: Synthetic oligonucleotide
ctatggtgccaacctggaagcagctgc

SEQ ID NO: 185953 - DNA, 27 bp, Artificial Sequence
  Description of Artificial Sequence: Synthetic oligonucleotide
tatggtgccaacctggaagcagctgcc

SEQ ID NO: 185954 - DNA, 26 bp, Artificial Sequence
  Description of Artificial Sequence: Synthetic oligonucleotide
atggtgccaacctggaagcagctgcc

SEQ ID NO: 185955 - DNA, 25 bp, Artificial Sequence
  Description of Artificial Sequence: Synthetic oligonucleotide
tggtgccaacctggaagcagctgcc

SEQ ID NO: 185956 - DNA, 24 bp, Artificial Sequence
  Description of Artificial Sequence: Synthetic oligonucleotide
ggtgccaacctggaagcagctgcc

SEQ ID NO: 185957 - DNA, 24 bp, Artificial Sequence
  Description of Artificial Sequence: Synthetic oligonucleotide
gtgccaacctggaagcagctgccc

SEQ ID NO: 185958 - DNA, 24 bp, Artificial Sequence
  Description of Artificial Sequence: Synthetic oligonucleotide
tgccaacctggaagcagctgcccc

SEQ ID NO: 185959 - DNA, 23 bp, Artificial Sequence
  Description of Artificial Sequence: Synthetic oligonucleotide
gccaacctggaagcagctgcccc

SEQ ID NO: 185960 - DNA, 24 bp, Artificial Sequence
  Description of Artificial Sequence: Synthetic oligonucleotide
ccaacctggaagcagctgccccct

SEQ ID NO: 185961 - DNA, 24 bp, Artificial Sequence
  Description of Artificial Sequence: Synthetic oligonucleotide
caacctggaagcagctgccccctg

SEQ ID NO: 185962 - DNA, 24 bp, Artificial Sequence
  Description of Artificial Sequence: Synthetic oligonucleotide
aacctggaagcagctgccccctgc

SEQ ID NO: 185963 - DNA, 23 bp, Artificial Sequence
  Description of Artificial Sequence: Synthetic oligonucleotide
acctggaagcagctgccccctgc

SEQ ID NO: 185964 - DNA, 22 bp, Artificial Sequence
  Description of Artificial Sequence: Synthetic oligonucleotide
cctggaagcagctgccccctgc

SEQ ID NO: 185965 - DNA, 23 bp, Artificial Sequence
  Description of Artificial Sequence: Synthetic oligonucleotide
ctggaagcagctgccccctgcca

SEQ ID NO: 185966 - DNA, 24 bp, Artificial Sequence
  Description of Artificial Sequence: Synthetic oligonucleotide
tggaagcagctgccccctgccact

SEQ ID NO: 185967 - DNA, 23 bp, Artificial Sequence
  Description of Artificial Sequence: Synthetic oligonucleotide
ggaagcagctgccccctgccact

SEQ ID NO: 185968 - DNA, 23 bp, Artificial Sequence
  Description of Artificial Sequence: Synthetic oligonucleotide
gaagcagctgccccctgccactc

SEQ ID NO: 185969 - DNA, 24 bp, Artificial Sequence
  Description of Artificial Sequence: Synthetic oligonucleotide
aagcagctgccccctgccactcct

SEQ ID NO: 185970 - DNA, 23 bp, Artificial Sequence
  Description of Artificial Sequence: Synthetic oligonucleotide
agcagctgccccctgccactcct

SEQ ID NO: 185971 - DNA, 22 bp, Artificial Sequence
  Description of Artificial Sequence: Synthetic oligonucleotide
gcagctgccccctgccactcct

SEQ ID NO: 185972 - DNA, 25 bp, Artificial Sequence
  Description of Artificial Sequence: Synthetic oligonucleotide
cagctgccccctgccactcctgtaa

SEQ ID NO: 185973 - DNA, 25 bp, Artificial Sequence
  Description of Artificial Sequence: Synthetic oligonucleotide
agctgccccctgccactcctgtaac

SEQ ID NO: 185974 - DNA, 24 bp, Artificial Sequence
  Description of Artificial Sequence: Synthetic oligonucleotide
gctgccccctgccactcctgtaac

SEQ ID NO: 185975 - DNA, 25 bp, Artificial Sequence
  Description of Artificial Sequence: Synthetic oligonucleotide
ctgccccctgccactcctgtaacct

SEQ ID NO: 185976 - DNA, 25 bp, Artificial Sequence
  Description of Artificial Sequence: Synthetic oligonucleotide
tgccccctgccactcctgtaacctg

SEQ ID NO: 185977 - DNA, 24 bp, Artificial Sequence
  Description of Artificial Sequence: Synthetic oligonucleotide
gccccctgccactcctgtaacctg

SEQ ID NO: 185978 - DNA, 25 bp, Artificial Sequence
  Description of Artificial Sequence: Synthetic oligonucleotide
ccccctgccactcctgtaacctgct

SEQ ID NO: 185979 - DNA, 25 bp, Artificial Sequence
  Description of Artificial Sequence: Synthetic oligonucleotide
cccctgccactcctgtaacctgctg

SEQ ID NO: 185980 - DNA, 27 bp, Artificial Sequence
  Description of Artificial Sequence: Synthetic oligonucleotide
ccctgccactcctgtaacctgctggat

SEQ ID NO: 185981 - DNA, 27 bp, Artificial Sequence
  Description of Artificial Sequence: Synthetic oligonucleotide
cctgccactcctgtaacctgctggatg

SEQ ID NO: 185982 - DNA, 28 bp, Artificial Sequence
  Description of Artificial Sequence: Synthetic oligonucleotide
ctgccactcctgtaacctgctggatgac

SEQ ID NO: 185983 - DNA, 29 bp, Artificial Sequence
  Description of Artificial Sequence: Synthetic oligonucleotide
tgccactcctgtaacctgctggatgactc

SEQ ID NO: 185984 - DNA, 28 bp, Artificial Sequence
  Description of Artificial Sequence: Synthetic oligonucleotide
gccactcctgtaacctgctggatgactc

SEQ ID NO: 185985 - DNA, 29 bp, Artificial Sequence
  Description of Artificial Sequence: Synthetic oligonucleotide
ccactcctgtaacctgctggatgactctg

SEQ ID NO: 185986 - DNA, 29 bp, Artificial Sequence
  Description of Artificial Sequence: Synthetic oligonucleotide
cactcctgtaacctgctggatgactctgc

SEQ ID NO: 185987 - DNA, 30 bp, Artificial Sequence
  Description of Artificial Sequence: Synthetic oligonucleotide
actcctgtaacctgctggatgactctgcac

SEQ ID NO: 185988 - DNA, 29 bp, Artificial Sequence
  Description of Artificial Sequence: Synthetic oligonucleotide
ctcctgtaacctgctggatgactctgcac

SEQ ID NO: 185989 - DNA, 30 bp, Artificial Sequence
  Description of Artificial Sequence: Synthetic oligonucleotide
tcctgtaacctgctggatgactctgcactg

SEQ ID NO: 185990 - DNA, 29 bp, Artificial Sequence
  Description of Artificial Sequence: Synthetic oligonucleotide
cctgtaacctgctggatgactctgcactg

SEQ ID NO: 185991 - DNA, 29 bp, Artificial Sequence
  Description of Artificial Sequence: Synthetic oligonucleotide
ctgtaacctgctggatgactctgcactgc

SEQ ID NO: 185992 - DNA, 29 bp, Artificial Sequence
  Description of Artificial Sequence: Synthetic oligonucleotide
tgtaacctgctggatgactctgcactgcc

SEQ ID NO: 185993 - DNA, 28 bp, Artificial Sequence
  Description of Artificial Sequence: Synthetic oligonucleotide
gtaacctgctggatgactctgcactgcc

SEQ ID NO: 185994 - DNA, 28 bp, Artificial Sequence
  Description of Artificial Sequence: Synthetic oligonucleotide
taacctgctggatgactctgcactgccc

SEQ ID NO: 185995 - DNA, 27 bp, Artificial Sequence
  Description of Artificial Sequence: Synthetic oligonucleotide
aacctgctggatgactctgcactgccc

SEQ ID NO: 185996 - DNA, 27 bp, Artificial Sequence
  Description of Artificial Sequence: Synthetic oligonucleotide
acctgctggatgactctgcactgccct

SEQ ID NO: 185997 - DNA, 27 bp, Artificial Sequence
  Description of Artificial Sequence: Synthetic oligonucleotide
cctgctggatgactctgcactgccctt

SEQ ID NO: 185998 - DNA, 27 bp, Artificial Sequence
  Description of Artificial Sequence: Synthetic oligonucleotide
ctgctggatgactctgcactgcccttc

SEQ ID NO: 185999 - DNA, 29 bp, Artificial Sequence
  Description of Artificial Sequence: Synthetic oligonucleotide
tgctggatgactctgcactgcccttcttc

SEQ ID NO: 186000 - DNA, 28 bp, Artificial Sequence
  Description of Artificial Sequence: Synthetic oligonucleotide
gctggatgactctgcactgcccttcttc

SEQ ID NO: 186001 - DNA, 30 bp, Artificial Sequence
  Description of Artificial Sequence: Synthetic oligonucleotide
ctggatgactctgcactgcccttcttcatc

SEQ ID NO: 186002 - DNA, 30 bp, Artificial Sequence
  Description of Artificial Sequence: Synthetic oligonucleotide
tggatgactctgcactgcccttcttcatcc

SEQ ID NO: 186003 - DNA, 29 bp, Artificial Sequence
  Description of Artificial Sequence: Synthetic oligonucleotide
ggatgactctgcactgcccttcttcatcc

SEQ ID NO: 186004 - DNA, 30 bp, Artificial Sequence
  Description of Artificial Sequence: Synthetic oligonucleotide
gatgactctgcactgcccttcttcatcctc

SEQ ID NO: 186005 - DNA, 31 bp, Artificial Sequence
  Description of Artificial Sequence: Synthetic oligonucleotide
atgactctgcactgcccttcttcatcctcac

SEQ ID NO: 186006 - DNA, 30 bp, Artificial Sequence
  Description of Artificial Sequence: Synthetic oligonucleotide
tgactctgcactgcccttcttcatcctcac

SEQ ID NO: 186007 - DNA, 29 bp, Artificial Sequence
  Description of Artificial Sequence: Synthetic oligonucleotide
gactctgcactgcccttcttcatcctcac

SEQ ID NO: 186008 - DNA, 29 bp, Artificial Sequence
  Description of Artificial Sequence: Synthetic oligonucleotide
actctgcactgcccttcttcatcctcacc

SEQ ID NO: 186009 - DNA, 28 bp, Artificial Sequence
  Description of Artificial Sequence: Synthetic oligonucleotide
ctctgcactgcccttcttcatcctcacc

SEQ ID NO: 186010 - DNA, 29 bp, Artificial Sequence
  Description of Artificial Sequence: Synthetic oligonucleotide
tctgcactgcccttcttcatcctcaccag

SEQ ID NO: 186011 - DNA, 28 bp, Artificial Sequence
  Description of Artificial Sequence: Synthetic oligonucleotide
ctgcactgcccttcttcatcctcaccag

SEQ ID NO: 186012 - DNA, 29 bp, Artificial Sequence
  Description of Artificial Sequence: Synthetic oligonucleotide
tgcactgcccttcttcatcctcaccagtg

SEQ ID NO: 186013 - DNA, 28 bp, Artificial Sequence
  Description of Artificial Sequence: Synthetic oligonucleotide
gcactgcccttcttcatcctcaccagtg

SEQ ID NO: 186014 - DNA, 29 bp, Artificial Sequence
  Description of Artificial Sequence: Synthetic oligonucleotide
cactgcccttcttcatcctcaccagtgtc

SEQ ID NO: 186015 - DNA, 29 bp, Artificial Sequence
  Description of Artificial Sequence: Synthetic oligonucleotide
actgcccttcttcatcctcaccagtgtcc

SEQ ID NO: 186016 - DNA, 28 bp, Artificial Sequence
  Description of Artificial Sequence: Synthetic oligonucleotide
ctgcccttcttcatcctcaccagtgtcc

SEQ ID NO: 186017 - DNA, 29 bp, Artificial Sequence
  Description of Artificial Sequence: Synthetic oligonucleotide
tgcccttcttcatcctcaccagtgtcctg

SEQ ID NO: 186018 - DNA, 28 bp, Artificial Sequence
  Description of Artificial Sequence: Synthetic oligonucleotide
gcccttcttcatcctcaccagtgtcctg

SEQ ID NO: 186019 - DNA, 28 bp, Artificial Sequence
  Description of Artificial Sequence: Synthetic oligonucleotide
cccttcttcatcctcaccagtgtcctgg

SEQ ID NO: 186020 - DNA, 28 bp, Artificial Sequence
  Description of Artificial Sequence: Synthetic oligonucleotide
ccttcttcatcctcaccagtgtcctggg

SEQ ID NO: 186021 - DNA, 31 bp, Artificial Sequence
  Description of Artificial Sequence: Synthetic oligonucleotide
cttcttcatcctcaccagtgtcctgggtatc

SEQ ID NO: 186022 - DNA, 31 bp, Artificial Sequence
  Description of Artificial Sequence: Synthetic oligonucleotide
ttcttcatcctcaccagtgtcctgggtatcc

SEQ ID NO: 186023 - DNA, 30 bp, Artificial Sequence
  Description of Artificial Sequence: Synthetic oligonucleotide
tcttcatcctcaccagtgtcctgggtatcc

SEQ ID NO: 186024 - DNA, 29 bp, Artificial Sequence
  Description of Artificial Sequence: Synthetic oligonucleotide
cttcatcctcaccagtgtcctgggtatcc

SEQ ID NO: 186025 - DNA, 31 bp, Artificial Sequence
  Description of Artificial Sequence: Synthetic oligonucleotide
ttcatcctcaccagtgtcctgggtatcctag

SEQ ID NO: 186026 - DNA, 30 bp, Artificial Sequence
  Description of Artificial Sequence: Synthetic oligonucleotide
tcatcctcaccagtgtcctgggtatcctag

SEQ ID NO: 186027 - DNA, 29 bp, Artificial Sequence
  Description of Artificial Sequence: Synthetic oligonucleotide
catcctcaccagtgtcctgggtatcctag

SEQ ID NO: 186028 - DNA, 29 bp, Artificial Sequence
  Description of Artificial Sequence: Synthetic oligonucleotide
atcctcaccagtgtcctgggtatcctagc

SEQ ID NO: 186029 - DNA, 28 bp, Artificial Sequence
  Description of Artificial Sequence: Synthetic oligonucleotide
tcctcaccagtgtcctgggtatcctagc

SEQ ID NO: 186030 - DNA, 27 bp, Artificial Sequence
  Description of Artificial Sequence: Synthetic oligonucleotide
cctcaccagtgtcctgggtatcctagc

SEQ ID NO: 186031 - DNA, 29 bp, Artificial Sequence
  Description of Artificial Sequence: Synthetic oligonucleotide
ctcaccagtgtcctgggtatcctagctag

SEQ ID NO: 186032 - DNA, 29 bp, Artificial Sequence
  Description of Artificial Sequence: Synthetic oligonucleotide
tcaccagtgtcctgggtatcctagctagc

SEQ ID NO: 186033 - DNA, 28 bp, Artificial Sequence
  Description of Artificial Sequence: Synthetic oligonucleotide
caccagtgtcctgggtatcctagctagc

SEQ ID NO: 186034 - DNA, 29 bp, Artificial Sequence
  Description of Artificial Sequence: Synthetic oligonucleotide
accagtgtcctgggtatcctagctagcag

SEQ ID NO: 186035 - DNA, 28 bp, Artificial Sequence
  Description of Artificial Sequence: Synthetic oligonucleotide
ccagtgtcctgggtatcctagctagcag

SEQ ID NO: 186036 - DNA, 28 bp, Artificial Sequence
  Description of Artificial Sequence: Synthetic oligonucleotide
cagtgtcctgggtatcctagctagcagc

SEQ ID NO: 186037 - DNA, 29 bp, Artificial Sequence
  Description of Artificial Sequence: Synthetic oligonucleotide
agtgtcctgggtatcctagctagcagcac

SEQ ID NO: 186038 - DNA, 28 bp, Artificial Sequence
  Description of Artificial Sequence: Synthetic oligonucleotide
gtgtcctgggtatcctagctagcagcac

SEQ ID NO: 186039 - DNA, 29 bp, Artificial Sequence
  Description of Artificial Sequence: Synthetic oligonucleotide
tgtcctgggtatcctagctagcagcactg

SEQ ID NO: 186040 - DNA, 28 bp, Artificial Sequence
  Description of Artificial Sequence: Synthetic oligonucleotide
gtcctgggtatcctagctagcagcactg

SEQ ID NO: 186041 - DNA, 29 bp, Artificial Sequence
  Description of Artificial Sequence: Synthetic oligonucleotide
tcctgggtatcctagctagcagcactgtc

SEQ ID NO: 186042 - DNA, 28 bp, Artificial Sequence
  Description of Artificial Sequence: Synthetic oligonucleotide
cctgggtatcctagctagcagcactgtc

SEQ ID NO: 186043 - DNA, 28 bp, Artificial Sequence
  Description of Artificial Sequence: Synthetic oligonucleotide
ctgggtatcctagctagcagcactgtcc

SEQ ID NO: 186044 - DNA, 29 bp, Artificial Sequence
  Description of Artificial Sequence: Synthetic oligonucleotide
tgggtatcctagctagcagcactgtcctc

SEQ ID NO: 186045 - DNA, 28 bp, Artificial Sequence
  Description of Artificial Sequence: Synthetic oligonucleotide
gggtatcctagctagcagcactgtcctc

SEQ ID NO: 186046 - DNA, 30 bp, Artificial Sequence
  Description of Artificial Sequence: Synthetic oligonucleotide
ggtatcctagctagcagcactgtcctcttc

SEQ ID NO: 186047 - DNA, 32 bp, Artificial Sequence
  Description of Artificial Sequence: Synthetic oligonucleotide
gtatcctagctagcagcactgtcctcttcatg

SEQ ID NO: 186048 - DNA, 32 bp, Artificial Sequence
  Description of Artificial Sequence: Synthetic oligonucleotide
tatcctagctagcagcactgtcctcttcatgc

SEQ ID NO: 186049 - DNA, 31 bp, Artificial Sequence
  Description of Artificial Sequence: Synthetic oligonucleotide
atcctagctagcagcactgtcctcttcatgc

SEQ ID NO: 186050 - DNA, 30 bp, Artificial Sequence
  Description of Artificial Sequence: Synthetic oligonucleotide
tcctagctagcagcactgtcctcttcatgc

SEQ ID NO: 186051 - DNA, 29 bp, Artificial Sequence
  Description of Artificial Sequence: Synthetic oligonucleotide
cctagctagcagcactgtcctcttcatgc

SEQ ID NO: 186052 - DNA, 33 bp, Artificial Sequence
  Description of Artificial Sequence: Synthetic oligonucleotide
ctagctagcagcactgtcctcttcatgcttttc

SEQ ID NO: 186053 - DNA, 34 bp, Artificial Sequence
  Description of Artificial Sequence: Synthetic oligonucleotide
tagctagcagcactgtcctcttcatgcttttcag

SEQ ID NO: 186054 - DNA, 33 bp, Artificial Sequence
  Description of Artificial Sequence: Synthetic oligonucleotide
agctagcagcactgtcctcttcatgcttttcag

SEQ ID NO: 186055 - DNA, 32 bp, Artificial Sequence
  Description of Artificial Sequence: Synthetic oligonucleotide
gctagcagcactgtcctcttcatgcttttcag

SEQ ID NO: 186056 - DNA, 33 bp, Artificial Sequence
  Description of Artificial Sequence: Synthetic oligonucleotide
ctagcagcactgtcctcttcatgcttttcagac

SEQ ID NO: 186057 - DNA, 33 bp, Artificial Sequence
  Description of Artificial Sequence: Synthetic oligonucleotide
tagcagcactgtcctcttcatgcttttcagacc

SEQ ID NO: 186058 - DNA, 32 bp, Artificial Sequence
  Description of Artificial Sequence: Synthetic oligonucleotide
agcagcactgtcctcttcatgcttttcagacc

SEQ ID NO: 186059 - DNA, 31 bp, Artificial Sequence
  Description of Artificial Sequence: Synthetic oligonucleotide
gcagcactgtcctcttcatgcttttcagacc

SEQ ID NO: 186060 - DNA, 32 bp, Artificial Sequence
  Description of Artificial Sequence: Synthetic oligonucleotide
cagcactgtcctcttcatgcttttcagacctc

SEQ ID NO: 186061 - DNA, 33 bp, Artificial Sequence
  Description of Artificial Sequence: Synthetic oligonucleotide
agcactgtcctcttcatgcttttcagacctctc

SEQ ID NO: 186062 - DNA, 32 bp, Artificial Sequence
  Description of Artificial Sequence: Synthetic oligonucleotide
gcactgtcctcttcatgcttttcagacctctc

SEQ ID NO: 186063 - DNA, 34 bp, Artificial Sequence
  Description of Artificial Sequence: Synthetic oligonucleotide
cactgtcctcttcatgcttttcagacctctcttc

SEQ ID NO: 186064 - DNA, 34 bp, Artificial Sequence
  Description of Artificial Sequence: Synthetic oligonucleotide
actgtcctcttcatgcttttcagacctctcttcc

SEQ ID NO: 186065 - DNA, 33 bp, Artificial Sequence
  Description of Artificial Sequence: Synthetic oligonucleotide
ctgtcctcttcatgcttttcagacctctcttcc

SEQ ID NO: 186066 - DNA, 33 bp, Artificial Sequence
  Description of Artificial Sequence: Synthetic oligonucleotide
tgtcctcttcatgcttttcagacctctcttccg

SEQ ID NO: 186067 - DNA, 32 bp, Artificial Sequence
  Description of Artificial Sequence: Synthetic oligonucleotide
gtcctcttcatgcttttcagacctctcttccg

SEQ ID NO: 186068 - DNA, 32 bp, Artificial Sequence
  Description of Artificial Sequence: Synthetic oligonucleotide
tcctcttcatgcttttcagacctctcttccgc

SEQ ID NO: 186069 - DNA, 31 bp, Artificial Sequence
  Description of Artificial Sequence: Synthetic oligonucleotide
cctcttcatgcttttcagacctctcttccgc

SEQ ID NO: 186070 - DNA, 32 bp, Artificial Sequence
  Description of Artificial Sequence: Synthetic oligonucleotide
ctcttcatgcttttcagacctctcttccgctg

SEQ ID NO: 186071 - DNA, 32 bp, Artificial Sequence
  Description of Artificial Sequence: Synthetic oligonucleotide
tcttcatgcttttcagacctctcttccgctgg

SEQ ID NO: 186072 - DNA, 31 bp, Artificial Sequence
  Description of Artificial Sequence: Synthetic oligonucleotide
cttcatgcttttcagacctctcttccgctgg

SEQ ID NO: 186073 - DNA, 31 bp, Artificial Sequence
  Description of Artificial Sequence: Synthetic oligonucleotide
ttcatgcttttcagacctctcttccgctggc

SEQ ID NO: 186074 - DNA, 30 bp, Artificial Sequence
  Description of Artificial Sequence: Synthetic oligonucleotide
tcatgcttttcagacctctcttccgctggc

SEQ ID NO: 186075 - DNA, 29 bp, Artificial Sequence
  Description of Artificial Sequence: Synthetic oligonucleotide
catgcttttcagacctctcttccgctggc

SEQ ID NO: 186076 - DNA, 30 bp, Artificial Sequence
  Description of Artificial Sequence: Synthetic oligonucleotide
atgcttttcagacctctcttccgctggcag

SEQ ID NO: 186077 - DNA, 29 bp, Artificial Sequence
  Description of Artificial Sequence: Synthetic oligonucleotide
tgcttttcagacctctcttccgctggcag

SEQ ID NO: 186078 - DNA, 28 bp, Artificial Sequence
  Description of Artificial Sequence: Synthetic oligonucleotide
gcttttcagacctctcttccgctggcag

SEQ ID NO: 186079 - DNA, 28 bp, Artificial Sequence
  Description of Artificial Sequence: Synthetic oligonucleotide
cttttcagacctctcttccgctggcagc

SEQ ID NO: 186080 - DNA, 29 bp, Artificial Sequence
  Description of Artificial Sequence: Synthetic oligonucleotide
ttttcagacctctcttccgctggcagctc

SEQ ID NO: 186081 - DNA, 28 bp, Artificial Sequence
  Description of Artificial Sequence: Synthetic oligonucleotide
tttcagacctctcttccgctggcagctc

SEQ ID NO: 186082 - DNA, 27 bp, Artificial Sequence
  Description of Artificial Sequence: Synthetic oligonucleotide
ttcagacctctcttccgctggcagctc

SEQ ID NO: 186083 - DNA, 27 bp, Artificial Sequence
  Description of Artificial Sequence: Synthetic oligonucleotide
tcagacctctcttccgctggcagctct

SEQ ID NO: 186084 - DNA, 26 bp, Artificial Sequence
  Description of Artificial Sequence: Synthetic oligonucleotide
cagacctctcttccgctggcagctct

SEQ ID NO: 186085 - DNA, 26 bp, Artificial Sequence
  Description of Artificial Sequence: Synthetic oligonucleotide
agacctctcttccgctggcagctctg

SEQ ID NO: 186086 - DNA, 25 bp, Artificial Sequence
  Description of Artificial Sequence: Synthetic oligonucleotide
gacctctcttccgctggcagctctg

SEQ ID NO: 186087 - DNA, 25 bp, Artificial Sequence
  Description of Artificial Sequence: Synthetic oligonucleotide
acctctcttccgctggcagctctgc

SEQ ID NO: 186088 - DNA, 24 bp, Artificial Sequence
  Description of Artificial Sequence: Synthetic oligonucleotide
cctctcttccgctggcagctctgc

SEQ ID NO: 186089 - DNA, 24 bp, Artificial Sequence
  Description of Artificial Sequence: Synthetic oligonucleotide
ctctcttccgctggcagctctgcc

SEQ ID NO: 186090 - DNA, 25 bp, Artificial Sequence
  Description of Artificial Sequence: Synthetic oligonucleotide
tctcttccgctggcagctctgccct

SEQ ID NO: 186091 - DNA, 24 bp, Artificial Sequence
  Description of Artificial Sequence: Synthetic oligonucleotide
ctcttccgctggcagctctgccct

SEQ ID NO: 186092 - DNA, 24 bp, Artificial Sequence
  Description of Artificial Sequence: Synthetic oligonucleotide
tcttccgctggcagctctgccctg

SEQ ID NO: 186093 - DNA, 23 bp, Artificial Sequence
  Description of Artificial Sequence: Synthetic oligonucleotide
cttccgctggcagctctgccctg

SEQ ID NO: 186094 - DNA, 23 bp, Artificial Sequence
  Description of Artificial Sequence: Synthetic oligonucleotide
ttccgctggcagctctgccctgg

SEQ ID NO: 186095 - DNA, 22 bp, Artificial Sequence
  Description of Artificial Sequence: Synthetic oligonucleotide
tccgctggcagctctgccctgg

SEQ ID NO: 186096 - DNA, 21 bp, Artificial Sequence
  Description of Artificial Sequence: Synthetic oligonucleotide
ccgctggcagctctgccctgg

SEQ ID NO: 186097 - DNA, 22 bp, Artificial Sequence
  Description of Artificial Sequence: Synthetic oligonucleotide
cgctggcagctctgccctggct

SEQ ID NO: 186098 - DNA, 22 bp, Artificial Sequence
  Description of Artificial Sequence: Synthetic oligonucleotide
gctggcagctctgccctggctg

SEQ ID NO: 186099 - DNA, 22 bp, Artificial Sequence
  Description of Artificial Sequence: Synthetic oligonucleotide
ctggcagctctgccctggctgg

SEQ ID NO: 186100 - DNA, 22 bp, Artificial Sequence
  Description of Artificial Sequence: Synthetic oligonucleotide
tggcagctctgccctggctggc

SEQ ID NO: 186101 - DNA, 21 bp, Artificial Sequence
  Description of Artificial Sequence: Synthetic oligonucleotide
ggcagctctgccctggctggc

SEQ ID NO: 186102 - DNA, 22 bp, Artificial Sequence
  Description of Artificial Sequence: Synthetic oligonucleotide
gcagctctgccctggctggcct

SEQ ID NO: 186103 - DNA, 23 bp, Artificial Sequence
  Description of Artificial Sequence: Synthetic oligonucleotide
cagctctgccctggctggcctgt

SEQ ID NO: 186104 - DNA, 23 bp, Artificial Sequence
  Description of Artificial Sequence: Synthetic oligonucleotide
agctctgccctggctggcctgtc

SEQ ID NO: 186105 - DNA, 22 bp, Artificial Sequence
  Description of Artificial Sequence: Synthetic oligonucleotide
gctctgccctggctggcctgtc

SEQ ID NO: 186106 - DNA, 23 bp, Artificial Sequence
  Description of Artificial Sequence: Synthetic oligonucleotide
ctctgccctggctggcctgtcct

SEQ ID NO: 186107 - DNA, 23 bp, Artificial Sequence
  Description of Artificial Sequence: Synthetic oligonucleotide
tctgccctggctggcctgtcctg

SEQ ID NO: 186108 - DNA, 22 bp, Artificial Sequence
  Description of Artificial Sequence: Synthetic oligonucleotide
ctgccctggctggcctgtcctg

SEQ ID NO: 186109 - DNA, 22 bp, Artificial Sequence
  Description of Artificial Sequence: Synthetic oligonucleotide
tgccctggctggcctgtcctgg

SEQ ID NO: 186110 - DNA, 21 bp, Artificial Sequence
  Description of Artificial Sequence: Synthetic oligonucleotide
gccctggctggcctgtcctgg

SEQ ID NO: 186111 - DNA, 22 bp, Artificial Sequence
  Description of Artificial Sequence: Synthetic oligonucleotide
ccctggctggcctgtcctggca

SEQ ID NO: 186112 - DNA, 23 bp, Artificial Sequence
  Description of Artificial Sequence: Synthetic oligonucleotide
cctggctggcctgtcctggcaca

SEQ ID NO: 186113 - DNA, 23 bp, Artificial Sequence
  Description of Artificial Sequence: Synthetic oligonucleotide
ctggctggcctgtcctggcacag

SEQ ID NO: 186114 - DNA, 24 bp, Artificial Sequence
  Description of Artificial Sequence: Synthetic oligonucleotide
tggctggcctgtcctggcacagct

SEQ ID NO: 186115 - DNA, 23 bp, Artificial Sequence
  Description of Artificial Sequence: Synthetic oligonucleotide
ggctggcctgtcctggcacagct

SEQ ID NO: 186116 - DNA, 23 bp, Artificial Sequence
  Description of Artificial Sequence: Synthetic oligonucleotide
gctggcctgtcctggcacagctg

SEQ ID NO: 186117 - DNA, 23 bp, Artificial Sequence
  Description of Artificial Sequence: Synthetic oligonucleotide
ctggcctgtcctggcacagctgg

SEQ ID NO: 186118 - DNA, 24 bp, Artificial Sequence
  Description of Artificial Sequence: Synthetic oligonucleotide
tggcctgtcctggcacagctggct

SEQ ID NO: 186119 - DNA, 23 bp, Artificial Sequence
  Description of Artificial Sequence: Synthetic oligonucleotide
ggcctgtcctggcacagctggct

SEQ ID NO: 186120 - DNA, 24 bp, Artificial Sequence
  Description of Artificial Sequence: Synthetic oligonucleotide
gcctgtcctggcacagctggctgt

SEQ ID NO: 186121 - DNA, 24 bp, Artificial Sequence
  Description of Artificial Sequence: Synthetic oligonucleotide
cctgtcctggcacagctggctgtg

SEQ ID NO: 186122 - DNA, 24 bp, Artificial Sequence
  Description of Artificial Sequence: Synthetic oligonucleotide
ctgtcctggcacagctggctgtgg

SEQ ID NO: 186123 - DNA, 24 bp, Artificial Sequence
  Description of Artificial Sequence: Synthetic oligonucleotide
tgtcctggcacagctggctgtggg

SEQ ID NO: 186124 - DNA, 23 bp, Artificial Sequence
  Description of Artificial Sequence: Synthetic oligonucleotide
gtcctggcacagctggctgtggg

SEQ ID NO: 186125 - DNA, 24 bp, Artificial Sequence
  Description of Artificial Sequence: Synthetic oligonucleotide
tcctggcacagctggctgtgggca

SEQ ID NO: 186126 - DNA, 23 bp, Artificial Sequence
  Description of Artificial Sequence: Synthetic oligonucleotide
cctggcacagctggctgtgggca

SEQ ID NO: 186127 - DNA, 24 bp, Artificial Sequence
  Description of Artificial Sequence: Synthetic oligonucleotide
ctggcacagctggctgtgggcagt

SEQ ID NO: 186128 - DNA, 24 bp, Artificial Sequence
  Description of Artificial Sequence: Synthetic oligonucleotide
tggcacagctggctgtgggcagtg

SEQ ID NO: 186129 - DNA, 23 bp, Artificial Sequence
  Description of Artificial Sequence: Synthetic oligonucleotide
ggcacagctggctgtgggcagtg

SEQ ID NO: 186130 - DNA, 23 bp, Artificial Sequence
  Description of Artificial Sequence: Synthetic oligonucleotide
gcacagctggctgtgggcagtgc

SEQ ID NO: 186131 - DNA, 23 bp, Artificial Sequence
  Description of Artificial Sequence: Synthetic oligonucleotide
cacagctggctgtgggcagtgcc

SEQ ID NO: 186132 - DNA, 24 bp, Artificial Sequence
  Description of Artificial Sequence: Synthetic oligonucleotide
acagctggctgtgggcagtgccct

SEQ ID NO: 186133 - DNA, 23 bp, Artificial Sequence
  Description of Artificial Sequence: Synthetic oligonucleotide
cagctggctgtgggcagtgccct

SEQ ID NO: 186134 - DNA, 25 bp, Artificial Sequence
  Description of Artificial Sequence: Synthetic oligonucleotide
agctggctgtgggcagtgccctctt

SEQ ID NO: 186135 - DNA, 24 bp, Artificial Sequence
  Description of Artificial Sequence: Synthetic oligonucleotide
gctggctgtgggcagtgccctctt

SEQ ID NO: 186136 - DNA, 25 bp, Artificial Sequence
  Description of Artificial Sequence: Synthetic oligonucleotide
ctggctgtgggcagtgccctcttca

SEQ ID NO: 186137 - DNA, 25 bp, Artificial Sequence
  Description of Artificial Sequence: Synthetic oligonucleotide
tggctgtgggcagtgccctcttcag

SEQ ID NO: 186138 - DNA, 24 bp, Artificial Sequence
  Description of Artificial Sequence: Synthetic oligonucleotide
ggctgtgggcagtgccctcttcag

SEQ ID NO: 186139 - DNA, 27 bp, Artificial Sequence
  Description of Artificial Sequence: Synthetic oligonucleotide
gctgtgggcagtgccctcttcagcatt

SEQ ID NO: 186140 - DNA, 27 bp, Artificial Sequence
  Description of Artificial Sequence: Synthetic oligonucleotide
ctgtgggcagtgccctcttcagcattg

SEQ ID NO: 186141 - DNA, 28 bp, Artificial Sequence
  Description of Artificial Sequence: Synthetic oligonucleotide
tgtgggcagtgccctcttcagcattgtg

SEQ ID NO: 186142 - DNA, 27 bp, Artificial Sequence
  Description of Artificial Sequence: Synthetic oligonucleotide
gtgggcagtgccctcttcagcattgtg

SEQ ID NO: 186143 - DNA, 27 bp, Artificial Sequence
  Description of Artificial Sequence: Synthetic oligonucleotide
tgggcagtgccctcttcagcattgtgg

SEQ ID NO: 186144 - DNA, 27 bp, Artificial Sequence
  Description of Artificial Sequence: Synthetic oligonucleotide
gggcagtgccctcttcagcattgtggt

SEQ ID NO: 186145 - DNA, 27 bp, Artificial Sequence
  Description of Artificial Sequence: Synthetic oligonucleotide
ggcagtgccctcttcagcattgtggtg

SEQ ID NO: 186146 - DNA, 27 bp, Artificial Sequence
  Description of Artificial Sequence: Synthetic oligonucleotide
gcagtgccctcttcagcattgtggtgc

SEQ ID NO: 186147 - DNA, 27 bp, Artificial Sequence
  Description of Artificial Sequence: Synthetic oligonucleotide
cagtgccctcttcagcattgtggtgcc

SEQ ID NO: 186148 - DNA, 27 bp, Artificial Sequence
  Description of Artificial Sequence: Synthetic oligonucleotide
agtgccctcttcagcattgtggtgccc

SEQ ID NO: 186149 - DNA, 26 bp, Artificial Sequence
  Description of Artificial Sequence: Synthetic oligonucleotide
gtgccctcttcagcattgtggtgccc

SEQ ID NO: 186150 - DNA, 27 bp, Artificial Sequence
  Description of Artificial Sequence: Synthetic oligonucleotide
tgccctcttcagcattgtggtgcccgt

SEQ ID NO: 186151 - DNA, 26 bp, Artificial Sequence
  Description of Artificial Sequence: Synthetic oligonucleotide
gccctcttcagcattgtggtgcccgt

SEQ ID NO: 186152 - DNA, 27 bp, Artificial Sequence
  Description of Artificial Sequence: Synthetic oligonucleotide
ccctcttcagcattgtggtgcccgtct

SEQ ID NO: 186153 - DNA, 28 bp, Artificial Sequence
  Description of Artificial Sequence: Synthetic oligonucleotide
cctcttcagcattgtggtgcccgtcttg

SEQ ID NO: 186154 - DNA, 28 bp, Artificial Sequence
  Description of Artificial Sequence: Synthetic oligonucleotide
ctcttcagcattgtggtgcccgtcttgg

SEQ ID NO: 186155 - DNA, 28 bp, Artificial Sequence
  Description of Artificial Sequence: Synthetic oligonucleotide
tcttcagcattgtggtgcccgtcttggc

SEQ ID NO: 186156 - DNA, 27 bp, Artificial Sequence
  Description of Artificial Sequence: Synthetic oligonucleotide
cttcagcattgtggtgcccgtcttggc

SEQ ID NO: 186157 - DNA, 27 bp, Artificial Sequence
  Description of Artificial Sequence: Synthetic oligonucleotide
ttcagcattgtggtgcccgtcttggcc

SEQ ID NO: 186158 - DNA, 26 bp, Artificial Sequence
  Description of Artificial Sequence: Synthetic oligonucleotide
tcagcattgtggtgcccgtcttggcc

SEQ ID NO: 186159 - DNA, 25 bp, Artificial Sequence
  Description of Artificial Sequence: Synthetic oligonucleotide
cagcattgtggtgcccgtcttggcc

SEQ ID NO: 186160 - DNA, 25 bp, Artificial Sequence
  Description of Artificial Sequence: Synthetic oligonucleotide
agcattgtggtgcccgtcttggccc

SEQ ID NO: 186161 - DNA, 24 bp, Artificial Sequence
  Description of Artificial Sequence: Synthetic oligonucleotide
gcattgtggtgcccgtcttggccc

SEQ ID NO: 186162 - DNA, 25 bp, Artificial Sequence
  Description of Artificial Sequence: Synthetic oligonucleotide
cattgtggtgcccgtcttggcccca

SEQ ID NO: 186163 - DNA, 25 bp, Artificial Sequence
  Description of Artificial Sequence: Synthetic oligonucleotide
attgtggtgcccgtcttggccccag

SEQ ID NO: 186164 - DNA, 24 bp, Artificial Sequence
  Description of Artificial Sequence: Synthetic oligonucleotide
ttgtggtgcccgtcttggccccag

SEQ ID NO: 186165 - DNA, 23 bp, Artificial Sequence
  Description of Artificial Sequence: Synthetic oligonucleotide
tgtggtgcccgtcttggccccag

SEQ ID NO: 186166 - DNA, 22 bp, Artificial Sequence
  Description of Artificial Sequence: Synthetic oligonucleotide
gtggtgcccgtcttggccccag

SEQ ID NO: 186167 - DNA, 22 bp, Artificial Sequence
  Description of Artificial Sequence: Synthetic oligonucleotide
tggtgcccgtcttggccccagg

SEQ ID NO: 186168 - DNA, 21 bp, Artificial Sequence
  Description of Artificial Sequence: Synthetic oligonucleotide
ggtgcccgtcttggccccagg

SEQ ID NO: 186169 - DNA, 21 bp, Artificial Sequence
  Description of Artificial Sequence: Synthetic oligonucleotide
gtgcccgtcttggccccaggg

SEQ ID NO: 186170 - DNA, 23 bp, Artificial Sequence
  Description of Artificial Sequence: Synthetic oligonucleotide
tgcccgtcttggccccagggcta

SEQ ID NO: 186171 - DNA, 22 bp, Artificial Sequence
  Description of Artificial Sequence: Synthetic oligonucleotide
gcccgtcttggccccagggcta

SEQ ID NO: 186172 - DNA, 22 bp, Artificial Sequence
  Description of Artificial Sequence: Synthetic oligonucleotide
cccgtcttggccccagggctag

SEQ ID NO: 186173 - DNA, 24 bp, Artificial Sequence
  Description of Artificial Sequence: Synthetic oligonucleotide
ccgtcttggccccagggctaggta

SEQ ID NO: 186174 - DNA, 24 bp, Artificial Sequence
  Description of Artificial Sequence: Synthetic oligonucleotide
cgtcttggccccagggctaggtag

SEQ ID NO: 186175 - DNA, 25 bp, Artificial Sequence
  Description of Artificial Sequence: Synthetic oligonucleotide
gtcttggccccagggctaggtagca

SEQ ID NO: 186176 - DNA, 26 bp, Artificial Sequence
  Description of Artificial Sequence: Synthetic oligonucleotide
tcttggccccagggctaggtagcact

SEQ ID NO: 186177 - DNA, 25 bp, Artificial Sequence
  Description of Artificial Sequence: Synthetic oligonucleotide
cttggccccagggctaggtagcact

SEQ ID NO: 186178 - DNA, 25 bp, Artificial Sequence
  Description of Artificial Sequence: Synthetic oligonucleotide
ttggccccagggctaggtagcactc

SEQ ID NO: 186179 - DNA, 24 bp, Artificial Sequence
  Description of Artificial Sequence: Synthetic oligonucleotide
tggccccagggctaggtagcactc

SEQ ID NO: 186180 - DNA, 23 bp, Artificial Sequence
  Description of Artificial Sequence: Synthetic oligonucleotide
ggccccagggctaggtagcactc

SEQ ID NO: 186181 - DNA, 23 bp, Artificial Sequence
  Description of Artificial Sequence: Synthetic oligonucleotide
gccccagggctaggtagcactcg

SEQ ID NO: 186182 - DNA, 24 bp, Artificial Sequence
  Description of Artificial Sequence: Synthetic oligonucleotide
ccccagggctaggtagcactcgca

SEQ ID NO: 186183 - DNA, 24 bp, Artificial Sequence
  Description of Artificial Sequence: Synthetic oligonucleotide
cccagggctaggtagcactcgcag

SEQ ID NO: 186184 - DNA, 25 bp, Artificial Sequence
  Description of Artificial Sequence: Synthetic oligonucleotide
ccagggctaggtagcactcgcagct

SEQ ID NO: 186185 - DNA, 26 bp, Artificial Sequence
  Description of Artificial Sequence: Synthetic oligonucleotide
cagggctaggtagcactcgcagctct

SEQ ID NO: 186186 - DNA, 26 bp, Artificial Sequence
  Description of Artificial Sequence: Synthetic oligonucleotide
agggctaggtagcactcgcagctctg

SEQ ID NO: 186187 - DNA, 25 bp, Artificial Sequence
  Description of Artificial Sequence: Synthetic oligonucleotide
gggctaggtagcactcgcagctctg

SEQ ID NO: 186188 - DNA, 25 bp, Artificial Sequence
  Description of Artificial Sequence: Synthetic oligonucleotide
ggctaggtagcactcgcagctctgc

SEQ ID NO: 186189 - DNA, 25 bp, Artificial Sequence
  Description of Artificial Sequence: Synthetic oligonucleotide
gctaggtagcactcgcagctctgcc

SEQ ID NO: 186190 - DNA, 26 bp, Artificial Sequence
  Description of Artificial Sequence: Synthetic oligonucleotide
ctaggtagcactcgcagctctgccct

SEQ ID NO: 186191 - DNA, 27 bp, Artificial Sequence
  Description of Artificial Sequence: Synthetic oligonucleotide
taggtagcactcgcagctctgccctgt

SEQ ID NO: 186192 - DNA, 26 bp, Artificial Sequence
  Description of Artificial Sequence: Synthetic oligonucleotide
aggtagcactcgcagctctgccctgt

SEQ ID NO: 186193 - DNA, 25 bp, Artificial Sequence
  Description of Artificial Sequence: Synthetic oligonucleotide
ggtagcactcgcagctctgccctgt

SEQ ID NO: 186194 - DNA, 27 bp, Artificial Sequence
  Description of Artificial Sequence: Synthetic oligonucleotide
gtagcactcgcagctctgccctgtgta

SEQ ID NO: 186195 - DNA, 27 bp, Artificial Sequence
  Description of Artificial Sequence: Synthetic oligonucleotide
tagcactcgcagctctgccctgtgtag

SEQ ID NO: 186196 - DNA, 26 bp, Artificial Sequence
  Description of Artificial Sequence: Synthetic oligonucleotide
agcactcgcagctctgccctgtgtag

SEQ ID NO: 186197 - DNA, 25 bp, Artificial Sequence
  Description of Artificial Sequence: Synthetic oligonucleotide
gcactcgcagctctgccctgtgtag

SEQ ID NO: 186198 - DNA, 25 bp, Artificial Sequence
  Description of Artificial Sequence: Synthetic oligonucleotide
cactcgcagctctgccctgtgtagc

SEQ ID NO: 186199 - DNA, 26 bp, Artificial Sequence
  Description of Artificial Sequence: Synthetic oligonucleotide
actcgcagctctgccctgtgtagcct

SEQ ID NO: 186200 - DNA, 25 bp, Artificial Sequence
  Description of Artificial Sequence: Synthetic oligonucleotide
ctcgcagctctgccctgtgtagcct

SEQ ID NO: 186201 - DNA, 25 bp, Artificial Sequence
  Description of Artificial Sequence: Synthetic oligonucleotide
tcgcagctctgccctgtgtagcctg

SEQ ID NO: 186202 - DNA, 24 bp, Artificial Sequence
  Description of Artificial Sequence: Synthetic oligonucleotide
cgcagctctgccctgtgtagcctg

SEQ ID NO: 186203 - DNA, 24 bp, Artificial Sequence
  Description of Artificial Sequence: Synthetic oligonucleotide
gcagctctgccctgtgtagcctgg

SEQ ID NO: 186204 - DNA, 24 bp, Artificial Sequence
  Description of Artificial Sequence: Synthetic oligonucleotide
cagctctgccctgtgtagcctggg

SEQ ID NO: 186205 - DNA, 26 bp, Artificial Sequence
  Description of Artificial Sequence: Synthetic oligonucleotide
agctctgccctgtgtagcctgggcta

SEQ ID NO: 186206 - DNA, 25 bp, Artificial Sequence
  Description of Artificial Sequence: Synthetic oligonucleotide
gctctgccctgtgtagcctgggcta

SEQ ID NO: 186207 - DNA, 26 bp, Artificial Sequence
  Description of Artificial Sequence: Synthetic oligonucleotide
ctctgccctgtgtagcctgggctact

SEQ ID NO: 186208 - DNA, 27 bp, Artificial Sequence
  Description of Artificial Sequence: Synthetic oligonucleotide
tctgccctgtgtagcctgggctactgt

SEQ ID NO: 186209 - DNA, 26 bp, Artificial Sequence
  Description of Artificial Sequence: Synthetic oligonucleotide
ctgccctgtgtagcctgggctactgt

SEQ ID NO: 186210 - DNA, 27 bp, Artificial Sequence
  Description of Artificial Sequence: Synthetic oligonucleotide
tgccctgtgtagcctgggctactgtgt

SEQ ID NO: 186211 - DNA, 26 bp, Artificial Sequence
  Description of Artificial Sequence: Synthetic oligonucleotide
gccctgtgtagcctgggctactgtgt

SEQ ID NO: 186212 - DNA, 27 bp, Artificial Sequence
  Description of Artificial Sequence: Synthetic oligonucleotide
ccctgtgtagcctgggctactgtgtct

SEQ ID NO: 186213 - DNA, 27 bp, Artificial Sequence
  Description of Artificial Sequence: Synthetic oligonucleotide
cctgtgtagcctgggctactgtgtctg

SEQ ID NO: 186214 - DNA, 27 bp, Artificial Sequence
  Description of Artificial Sequence: Synthetic oligonucleotide
ctgtgtagcctgggctactgtgtctgg

SEQ ID NO: 186215 - DNA, 30 bp, Artificial Sequence
  Description of Artificial Sequence: Synthetic oligonucleotide
tgtgtagcctgggctactgtgtctggtatg

SEQ ID NO: 186216 - DNA, 29 bp, Artificial Sequence
  Description of Artificial Sequence: Synthetic oligonucleotide
gtgtagcctgggctactgtgtctggtatg

SEQ ID NO: 186217 - DNA, 29 bp, Artificial Sequence
  Description of Artificial Sequence: Synthetic oligonucleotide
tgtagcctgggctactgtgtctggtatgg

SEQ ID NO: 186218 - DNA, 28 bp, Artificial Sequence
  Description of Artificial Sequence: Synthetic oligonucleotide
gtagcctgggctactgtgtctggtatgg

SEQ ID NO: 186219 - DNA, 28 bp, Artificial Sequence
  Description of Artificial Sequence: Synthetic oligonucleotide
tagcctgggctactgtgtctggtatggc

SEQ ID NO: 186220 - DNA, 27 bp, Artificial Sequence
  Description of Artificial Sequence: Synthetic oligonucleotide
agcctgggctactgtgtctggtatggc

SEQ ID NO: 186221 - DNA, 27 bp, Artificial Sequence
  Description of Artificial Sequence: Synthetic oligonucleotide
gcctgggctactgtgtctggtatggct

SEQ ID NO: 186222 - DNA, 27 bp, Artificial Sequence
  Description of Artificial Sequence: Synthetic oligonucleotide
cctgggctactgtgtctggtatggctc

SEQ ID NO: 186223 - DNA, 28 bp, Artificial Sequence
  Description of Artificial Sequence: Synthetic oligonucleotide
ctgggctactgtgtctggtatggctcag

SEQ ID NO: 186224 - DNA, 28 bp, Artificial Sequence
  Description of Artificial Sequence: Synthetic oligonucleotide
tgggctactgtgtctggtatggctcagc

SEQ ID NO: 186225 - DNA, 27 bp, Artificial Sequence
  Description of Artificial Sequence: Synthetic oligonucleotide
gggctactgtgtctggtatggctcagc

SEQ ID NO: 186226 - DNA, 27 bp, Artificial Sequence
  Description of Artificial Sequence: Synthetic oligonucleotide
ggctactgtgtctggtatggctcagcc

SEQ ID NO: 186227 - DNA, 30 bp, Artificial Sequence
  Description of Artificial Sequence: Synthetic oligonucleotide
gctactgtgtctggtatggctcagcctttg

SEQ ID NO: 186228 - DNA, 30 bp, Artificial Sequence
  Description of Artificial Sequence: Synthetic oligonucleotide
ctactgtgtctggtatggctcagcctttgc

SEQ ID NO: 186229 - DNA, 30 bp, Artificial Sequence
  Description of Artificial Sequence: Synthetic oligonucleotide
tactgtgtctggtatggctcagcctttgcc

SEQ ID NO: 186230 - DNA, 29 bp, Artificial Sequence
  Description of Artificial Sequence: Synthetic oligonucleotide
actgtgtctggtatggctcagcctttgcc

SEQ ID NO: 186231 - DNA, 28 bp, Artificial Sequence
  Description of Artificial Sequence: Synthetic oligonucleotide
ctgtgtctggtatggctcagcctttgcc

SEQ ID NO: 186232 - DNA, 28 bp, Artificial Sequence
  Description of Artificial Sequence: Synthetic oligonucleotide
tgtgtctggtatggctcagcctttgccc

SEQ ID NO: 186233 - DNA, 27 bp, Artificial Sequence
  Description of Artificial Sequence: Synthetic oligonucleotide
gtgtctggtatggctcagcctttgccc

SEQ ID NO: 186234 - DNA, 28 bp, Artificial Sequence
  Description of Artificial Sequence: Synthetic oligonucleotide
tgtctggtatggctcagcctttgcccag

SEQ ID NO: 186235 - DNA, 27 bp, Artificial Sequence
  Description of Artificial Sequence: Synthetic oligonucleotide
gtctggtatggctcagcctttgcccag

SEQ ID NO: 186236 - DNA, 27 bp, Artificial Sequence
  Description of Artificial Sequence: Synthetic oligonucleotide
tctggtatggctcagcctttgcccagg

SEQ ID NO: 186237 - DNA, 26 bp, Artificial Sequence
  Description of Artificial Sequence: Synthetic oligonucleotide
ctggtatggctcagcctttgcccagg

SEQ ID NO: 186238 - DNA, 27 bp, Artificial Sequence
  Description of Artificial Sequence: Synthetic oligonucleotide
tggtatggctcagcctttgcccaggct

SEQ ID NO: 186239 - DNA, 27 bp, Artificial Sequence
  Description of Artificial Sequence: Synthetic oligonucleotide
ggtatggctcagcctttgcccaggctt

SEQ ID NO: 186240 - DNA, 28 bp, Artificial Sequence
  Description of Artificial Sequence: Synthetic oligonucleotide
gtatggctcagcctttgcccaggctttg

SEQ ID NO: 186241 - DNA, 28 bp, Artificial Sequence
  Description of Artificial Sequence: Synthetic oligonucleotide
tatggctcagcctttgcccaggctttgc

SEQ ID NO: 186242 - DNA, 27 bp, Artificial Sequence
  Description of Artificial Sequence: Synthetic oligonucleotide
atggctcagcctttgcccaggctttgc

SEQ ID NO: 186243 - DNA, 27 bp, Artificial Sequence
  Description of Artificial Sequence: Synthetic oligonucleotide
tggctcagcctttgcccaggctttgct

SEQ ID NO: 186244 - DNA, 26 bp, Artificial Sequence
  Description of Artificial Sequence: Synthetic oligonucleotide
ggctcagcctttgcccaggctttgct

SEQ ID NO: 186245 - DNA, 26 bp, Artificial Sequence
  Description of Artificial Sequence: Synthetic oligonucleotide
gctcagcctttgcccaggctttgctg

SEQ ID NO: 186246 - DNA, 27 bp, Artificial Sequence
  Description of Artificial Sequence: Synthetic oligonucleotide
ctcagcctttgcccaggctttgctgct

SEQ ID NO: 186247 - DNA, 28 bp, Artificial Sequence
  Description of Artificial Sequence: Synthetic oligonucleotide
tcagcctttgcccaggctttgctgctag

SEQ ID NO: 186248 - DNA, 27 bp, Artificial Sequence
  Description of Artificial Sequence: Synthetic oligonucleotide
cagcctttgcccaggctttgctgctag

SEQ ID NO: 186249 - DNA, 27 bp, Artificial Sequence
  Description of Artificial Sequence: Synthetic oligonucleotide
agcctttgcccaggctttgctgctagg

SEQ ID NO: 186250 - DNA, 26 bp, Artificial Sequence
  Description of Artificial Sequence: Synthetic oligonucleotide
gcctttgcccaggctttgctgctagg

SEQ ID NO: 186251 - DNA, 27 bp, Artificial Sequence
  Description of Artificial Sequence: Synthetic oligonucleotide
cctttgcccaggctttgctgctagggt

SEQ ID NO: 186252 - DNA, 27 bp, Artificial Sequence
  Description of Artificial Sequence: Synthetic oligonucleotide
ctttgcccaggctttgctgctagggtg

SEQ ID NO: 186253 - DNA, 27 bp, Artificial Sequence
  Description of Artificial Sequence: Synthetic oligonucleotide
tttgcccaggctttgctgctagggtgc

SEQ ID NO: 186254 - DNA, 26 bp, Artificial Sequence
  Description of Artificial Sequence: Synthetic oligonucleotide
ttgcccaggctttgctgctagggtgc

SEQ ID NO: 186255 - DNA, 25 bp, Artificial Sequence
  Description of Artificial Sequence: Synthetic oligonucleotide
tgcccaggctttgctgctagggtgc

SEQ ID NO: 186256 - DNA, 24 bp, Artificial Sequence
  Description of Artificial Sequence: Synthetic oligonucleotide
gcccaggctttgctgctagggtgc

SEQ ID NO: 186257 - DNA, 26 bp, Artificial Sequence
  Description of Artificial Sequence: Synthetic oligonucleotide
cccaggctttgctgctagggtgccat

SEQ ID NO: 186258 - DNA, 26 bp, Artificial Sequence
  Description of Artificial Sequence: Synthetic oligonucleotide
ccaggctttgctgctagggtgccatg

SEQ ID NO: 186259 - DNA, 26 bp, Artificial Sequence
  Description of Artificial Sequence: Synthetic oligonucleotide
caggctttgctgctagggtgccatgc

SEQ ID NO: 186260 - DNA, 27 bp, Artificial Sequence
  Description of Artificial Sequence: Synthetic oligonucleotide
aggctttgctgctagggtgccatgcct

SEQ ID NO: 186261 - DNA, 26 bp, Artificial Sequence
  Description of Artificial Sequence: Synthetic oligonucleotide
ggctttgctgctagggtgccatgcct

SEQ ID NO: 186262 - DNA, 26 bp, Artificial Sequence
  Description of Artificial Sequence: Synthetic oligonucleotide
gctttgctgctagggtgccatgcctc

SEQ ID NO: 186263 - DNA, 26 bp, Artificial Sequence
  Description of Artificial Sequence: Synthetic oligonucleotide
ctttgctgctagggtgccatgcctcc

SEQ ID NO: 186264 - DNA, 27 bp, Artificial Sequence
  Description of Artificial Sequence: Synthetic oligonucleotide
tttgctgctagggtgccatgcctccct

SEQ ID NO: 186265 - DNA, 26 bp, Artificial Sequence
  Description of Artificial Sequence: Synthetic oligonucleotide
ttgctgctagggtgccatgcctccct

SEQ ID NO: 186266 - DNA, 25 bp, Artificial Sequence
  Description of Artificial Sequence: Synthetic oligonucleotide
tgctgctagggtgccatgcctccct

SEQ ID NO: 186267 - DNA, 24 bp, Artificial Sequence
  Description of Artificial Sequence: Synthetic oligonucleotide
gctgctagggtgccatgcctccct

SEQ ID NO: 186268 - DNA, 24 bp, Artificial Sequence
  Description of Artificial Sequence: Synthetic oligonucleotide
ctgctagggtgccatgcctccctg

SEQ ID NO: 186269 - DNA, 24 bp, Artificial Sequence
  Description of Artificial Sequence: Synthetic oligonucleotide
tgctagggtgccatgcctccctgg

SEQ ID NO: 186270 - DNA, 23 bp, Artificial Sequence
  Description of Artificial Sequence: Synthetic oligonucleotide
gctagggtgccatgcctccctgg

SEQ ID NO: 186271 - DNA, 23 bp, Artificial Sequence
  Description of Artificial Sequence: Synthetic oligonucleotide
ctagggtgccatgcctccctggg

SEQ ID NO: 186272 - DNA, 23 bp, Artificial Sequence
  Description of Artificial Sequence: Synthetic oligonucleotide
tagggtgccatgcctccctgggc

SEQ ID NO: 186273 - DNA, 22 bp, Artificial Sequence
  Description of Artificial Sequence: Synthetic oligonucleotide
agggtgccatgcctccctgggc

SEQ ID NO: 186274 - DNA, 21 bp, Artificial Sequence
  Description of Artificial Sequence: Synthetic oligonucleotide
gggtgccatgcctccctgggc

SEQ ID NO: 186275 - DNA, 22 bp, Artificial Sequence
  Description of Artificial Sequence: Synthetic oligonucleotide
ggtgccatgcctccctgggcca

SEQ ID NO: 186276 - DNA, 23 bp, Artificial Sequence
  Description of Artificial Sequence: Synthetic oligonucleotide
gtgccatgcctccctgggccaca

SEQ ID NO: 186277 - DNA, 24 bp, Artificial Sequence
  Description of Artificial Sequence: Synthetic oligonucleotide
tgccatgcctccctgggccacaga

SEQ ID NO: 186278 - DNA, 23 bp, Artificial Sequence
  Description of Artificial Sequence: Synthetic oligonucleotide
gccatgcctccctgggccacaga

SEQ ID NO: 186279 - DNA, 24 bp, Artificial Sequence
  Description of Artificial Sequence: Synthetic oligonucleotide
ccatgcctccctgggccacagact

SEQ ID NO: 186280 - DNA, 24 bp, Artificial Sequence
  Description of Artificial Sequence: Synthetic oligonucleotide
catgcctccctgggccacagactg

SEQ ID NO: 186281 - DNA, 24 bp, Artificial Sequence
  Description of Artificial Sequence: Synthetic oligonucleotide
atgcctccctgggccacagactgg

SEQ ID NO: 186282 - DNA, 23 bp, Artificial Sequence
  Description of Artificial Sequence: Synthetic oligonucleotide
tgcctccctgggccacagactgg

SEQ ID NO: 186283 - DNA, 22 bp, Artificial Sequence
  Description of Artificial Sequence: Synthetic oligonucleotide
gcctccctgggccacagactgg

SEQ ID NO: 186284 - DNA, 23 bp, Artificial Sequence
  Description of Artificial Sequence: Synthetic oligonucleotide
cctccctgggccacagactgggt

SEQ ID NO: 186285 - DNA, 23 bp, Artificial Sequence
  Description of Artificial Sequence: Synthetic oligonucleotide
ctccctgggccacagactgggtg

SEQ ID NO: 186286 - DNA, 24 bp, Artificial Sequence
  Description of Artificial Sequence: Synthetic oligonucleotide
tccctgggccacagactgggtgca

SEQ ID NO: 186287 - DNA, 23 bp, Artificial Sequence
  Description of Artificial Sequence: Synthetic oligonucleotide
ccctgggccacagactgggtgca

SEQ ID NO: 186288 - DNA, 23 bp, Artificial Sequence
  Description of Artificial Sequence: Synthetic oligonucleotide
cctgggccacagactgggtgcag

SEQ ID NO: 186289 - DNA, 23 bp, Artificial Sequence
  Description of Artificial Sequence: Synthetic oligonucleotide
ctgggccacagactgggtgcagg

SEQ ID NO: 186290 - DNA, 23 bp, Artificial Sequence
  Description of Artificial Sequence: Synthetic oligonucleotide
tgggccacagactgggtgcaggc

SEQ ID NO: 186291 - DNA, 22 bp, Artificial Sequence
  Description of Artificial Sequence: Synthetic oligonucleotide
gggccacagactgggtgcaggc

SEQ ID NO: 186292 - DNA, 23 bp, Artificial Sequence
  Description of Artificial Sequence: Synthetic oligonucleotide
ggccacagactgggtgcaggcca

SEQ ID NO: 186293 - DNA, 23 bp, Artificial Sequence
  Description of Artificial Sequence: Synthetic oligonucleotide
gccacagactgggtgcaggccag

SEQ ID NO: 186294 - DNA, 24 bp, Artificial Sequence
  Description of Artificial Sequence: Synthetic oligonucleotide
ccacagactgggtgcaggccaggt

SEQ ID NO: 186295 - DNA, 24 bp, Artificial Sequence
  Description of Artificial Sequence: Synthetic oligonucleotide
cacagactgggtgcaggccaggtc

SEQ ID NO: 186296 - DNA, 24 bp, Artificial Sequence
  Description of Artificial Sequence: Synthetic oligonucleotide
acagactgggtgcaggccaggtcc

SEQ ID NO: 186297 - DNA, 23 bp, Artificial Sequence
  Description of Artificial Sequence: Synthetic oligonucleotide
cagactgggtgcaggccaggtcc

SEQ ID NO: 186298 - DNA, 24 bp, Artificial Sequence
  Description of Artificial Sequence: Synthetic oligonucleotide
agactgggtgcaggccaggtccca

SEQ ID NO: 186299 - DNA, 23 bp, Artificial Sequence
  Description of Artificial Sequence: Synthetic oligonucleotide
gactgggtgcaggccaggtccca

SEQ ID NO: 186300 - DNA, 23 bp, Artificial Sequence
  Description of Artificial Sequence: Synthetic oligonucleotide
actgggtgcaggccaggtcccag

SEQ ID NO: 186301 - DNA, 22 bp, Artificial Sequence
  Description of Artificial Sequence: Synthetic oligonucleotide
ctgggtgcaggccaggtcccag

SEQ ID NO: 186302 - DNA, 22 bp, Artificial Sequence
  Description of Artificial Sequence: Synthetic oligonucleotide
tgggtgcaggccaggtcccagg

SEQ ID NO: 186303 - DNA, 21 bp, Artificial Sequence
  Description of Artificial Sequence: Synthetic oligonucleotide
gggtgcaggccaggtcccagg

SEQ ID NO: 186304 - DNA, 21 bp, Artificial Sequence
  Description of Artificial Sequence: Synthetic oligonucleotide
ggtgcaggccaggtcccaggc

SEQ ID NO: 186305 - DNA, 22 bp, Artificial Sequence
  Description of Artificial Sequence: Synthetic oligonucleotide
gtgcaggccaggtcccaggcct

SEQ ID NO: 186306 - DNA, 23 bp, Artificial Sequence
  Description of Artificial Sequence: Synthetic oligonucleotide
tgcaggccaggtcccaggcctca

SEQ ID NO: 186307 - DNA, 22 bp, Artificial Sequence
  Description of Artificial Sequence: Synthetic oligonucleotide
gcaggccaggtcccaggcctca

SEQ ID NO: 186308 - DNA, 22 bp, Artificial Sequence
  Description of Artificial Sequence: Synthetic oligonucleotide
caggccaggtcccaggcctcac

SEQ ID NO: 186309 - DNA, 22 bp, Artificial Sequence
  Description of Artificial Sequence: Synthetic oligonucleotide
aggccaggtcccaggcctcacc

SEQ ID NO: 186310 - DNA, 21 bp, Artificial Sequence
  Description of Artificial Sequence: Synthetic oligonucleotide
ggccaggtcccaggcctcacc

SEQ ID NO: 186311 - DNA, 22 bp, Artificial Sequence
  Description of Artificial Sequence: Synthetic oligonucleotide
gccaggtcccaggcctcaccct

SEQ ID NO: 186312 - DNA, 22 bp, Artificial Sequence
  Description of Artificial Sequence: Synthetic oligonucleotide
ccaggtcccaggcctcaccctg

SEQ ID NO: 186313 - DNA, 22 bp, Artificial Sequence
  Description of Artificial Sequence: Synthetic oligonucleotide
caggtcccaggcctcaccctgg

SEQ ID NO: 186314 - DNA, 22 bp, Artificial Sequence
  Description of Artificial Sequence: Synthetic oligonucleotide
aggtcccaggcctcaccctggg

SEQ ID NO: 186315 - DNA, 21 bp, Artificial Sequence
  Description of Artificial Sequence: Synthetic oligonucleotide
ggtcccaggcctcaccctggg

SEQ ID NO: 186316 - DNA, 21 bp, Artificial Sequence
  Description of Artificial Sequence: Synthetic oligonucleotide
gtcccaggcctcaccctgggg

SEQ ID NO: 186317 - DNA, 22 bp, Artificial Sequence
  Description of Artificial Sequence: Synthetic oligonucleotide
tcccaggcctcaccctggggct

SEQ ID NO: 186318 - DNA, 21 bp, Artificial Sequence
  Description of Artificial Sequence: Synthetic oligonucleotide
cccaggcctcaccctggggct

SEQ ID NO: 186319 - DNA, 22 bp, Artificial Sequence
  Description of Artificial Sequence: Synthetic oligonucleotide
ccaggcctcaccctggggctca

SEQ ID NO: 186320 - DNA, 23 bp, Artificial Sequence
  Description of Artificial Sequence: Synthetic oligonucleotide
caggcctcaccctggggctcact

SEQ ID NO: 186321 - DNA, 24 bp, Artificial Sequence
  Description of Artificial Sequence: Synthetic oligonucleotide
aggcctcaccctggggctcactgt

SEQ ID NO: 186322 - DNA, 23 bp, Artificial Sequence
  Description of Artificial Sequence: Synthetic oligonucleotide
ggcctcaccctggggctcactgt

SEQ ID NO: 186323 - DNA, 23 bp, Artificial Sequence
  Description of Artificial Sequence: Synthetic oligonucleotide
gcctcaccctggggctcactgtg

SEQ ID NO: 186324 - DNA, 23 bp, Artificial Sequence
  Description of Artificial Sequence: Synthetic oligonucleotide
cctcaccctggggctcactgtgg

SEQ ID NO: 186325 - DNA, 27 bp, Artificial Sequence
  Description of Artificial Sequence: Synthetic oligonucleotide
ctcaccctggggctcactgtgggaatt

SEQ ID NO: 186326 - DNA, 28 bp, Artificial Sequence
  Description of Artificial Sequence: Synthetic oligonucleotide
tcaccctggggctcactgtgggaatttg

SEQ ID NO: 186327 - DNA, 27 bp, Artificial Sequence
  Description of Artificial Sequence: Synthetic oligonucleotide
caccctggggctcactgtgggaatttg

SEQ ID NO: 186328 - DNA, 27 bp, Artificial Sequence
  Description of Artificial Sequence: Synthetic oligonucleotide
accctggggctcactgtgggaatttgg

SEQ ID NO: 186329 - DNA, 26 bp, Artificial Sequence
  Description of Artificial Sequence: Synthetic oligonucleotide
ccctggggctcactgtgggaatttgg

SEQ ID NO: 186330 - DNA, 26 bp, Artificial Sequence
  Description of Artificial Sequence: Synthetic oligonucleotide
cctggggctcactgtgggaatttggg

SEQ ID NO: 186331 - DNA, 27 bp, Artificial Sequence
  Description of Artificial Sequence: Synthetic oligonucleotide
ctggggctcactgtgggaatttgggga

SEQ ID NO: 186332 - DNA, 27 bp, Artificial Sequence
  Description of Artificial Sequence: Synthetic oligonucleotide
tggggctcactgtgggaatttggggag

SEQ ID NO: 186333 - DNA, 27 bp, Artificial Sequence
  Description of Artificial Sequence: Synthetic oligonucleotide
ggggctcactgtgggaatttggggagt

SEQ ID NO: 186334 - DNA, 27 bp, Artificial Sequence
  Description of Artificial Sequence: Synthetic oligonucleotide
gggctcactgtgggaatttggggagtg

SEQ ID NO: 186335 - DNA, 27 bp, Artificial Sequence
  Description of Artificial Sequence: Synthetic oligonucleotide
ggctcactgtgggaatttggggagtgg

SEQ ID NO: 186336 - DNA, 27 bp, Artificial Sequence
  Description of Artificial Sequence: Synthetic oligonucleotide
gctcactgtgggaatttggggagtggc

SEQ ID NO: 186337 - DNA, 28 bp, Artificial Sequence
  Description of Artificial Sequence: Synthetic oligonucleotide
ctcactgtgggaatttggggagtggctg

SEQ ID NO: 186338 - DNA, 28 bp, Artificial Sequence
  Description of Artificial Sequence: Synthetic oligonucleotide
tcactgtgggaatttggggagtggctgc

SEQ ID NO: 186339 - DNA, 27 bp, Artificial Sequence
  Description of Artificial Sequence: Synthetic oligonucleotide
cactgtgggaatttggggagtggctgc

SEQ ID NO: 186340 - DNA, 27 bp, Artificial Sequence
  Description of Artificial Sequence: Synthetic oligonucleotide
actgtgggaatttggggagtggctgcc

SEQ ID NO: 186341 - DNA, 26 bp, Artificial Sequence
  Description of Artificial Sequence: Synthetic oligonucleotide
ctgtgggaatttggggagtggctgcc

SEQ ID NO: 186342 - DNA, 27 bp, Artificial Sequence
  Description of Artificial Sequence: Synthetic oligonucleotide
tgtgggaatttggggagtggctgccct

SEQ ID NO: 186343 - DNA, 27 bp, Artificial Sequence
  Description of Artificial Sequence: Synthetic oligonucleotide
gtgggaatttggggagtggctgcccta

SEQ ID NO: 186344 - DNA, 27 bp, Artificial Sequence
  Description of Artificial Sequence: Synthetic oligonucleotide
tgggaatttggggagtggctgccctac

SEQ ID NO: 186345 - DNA, 27 bp, Artificial Sequence
  Description of Artificial Sequence: Synthetic oligonucleotide
gggaatttggggagtggctgccctact

SEQ ID NO: 186346 - DNA, 27 bp, Artificial Sequence
  Description of Artificial Sequence: Synthetic oligonucleotide
ggaatttggggagtggctgccctactg

SEQ ID NO: 186347 - DNA, 28 bp, Artificial Sequence
  Description of Artificial Sequence: Synthetic oligonucleotide
gaatttggggagtggctgccctactgac

SEQ ID NO: 186348 - DNA, 29 bp, Artificial Sequence
  Description of Artificial Sequence: Synthetic oligonucleotide
aatttggggagtggctgccctactgacac

SEQ ID NO: 186349 - DNA, 28 bp, Artificial Sequence
  Description of Artificial Sequence: Synthetic oligonucleotide
atttggggagtggctgccctactgacac

SEQ ID NO: 186350 - DNA, 27 bp, Artificial Sequence
  Description of Artificial Sequence: Synthetic oligonucleotide
tttggggagtggctgccctactgacac

SEQ ID NO: 186351 - DNA, 27 bp, Artificial Sequence
  Description of Artificial Sequence: Synthetic oligonucleotide
ttggggagtggctgccctactgacact

SEQ ID NO: 186352 - DNA, 26 bp, Artificial Sequence
  Description of Artificial Sequence: Synthetic oligonucleotide
tggggagtggctgccctactgacact

SEQ ID NO: 186353 - DNA, 25 bp, Artificial Sequence
  Description of Artificial Sequence: Synthetic oligonucleotide
ggggagtggctgccctactgacact

SEQ ID NO: 186354 - DNA, 25 bp, Artificial Sequence
  Description of Artificial Sequence: Synthetic oligonucleotide
gggagtggctgccctactgacactg

SEQ ID NO: 186355 - DNA, 25 bp, Artificial Sequence
  Description of Artificial Sequence: Synthetic oligonucleotide
ggagtggctgccctactgacactgc

SEQ ID NO: 186356 - DNA, 26 bp, Artificial Sequence
  Description of Artificial Sequence: Synthetic oligonucleotide
gagtggctgccctactgacactgcct

SEQ ID NO: 186357 - DNA, 27 bp, Artificial Sequence
  Description of Artificial Sequence: Synthetic oligonucleotide
agtggctgccctactgacactgcctgt

SEQ ID NO: 186358 - DNA, 26 bp, Artificial Sequence
  Description of Artificial Sequence: Synthetic oligonucleotide
gtggctgccctactgacactgcctgt

SEQ ID NO: 186359 - DNA, 27 bp, Artificial Sequence
  Description of Artificial Sequence: Synthetic oligonucleotide
tggctgccctactgacactgcctgtca

SEQ ID NO: 186360 - DNA, 26 bp, Artificial Sequence
  Description of Artificial Sequence: Synthetic oligonucleotide
ggctgccctactgacactgcctgtca

SEQ ID NO: 186361 - DNA, 26 bp, Artificial Sequence
  Description of Artificial Sequence: Synthetic oligonucleotide
gctgccctactgacactgcctgtcac

SEQ ID NO: 186362 - DNA, 26 bp, Artificial Sequence
  Description of Artificial Sequence: Synthetic oligonucleotide
ctgccctactgacactgcctgtcacc

SEQ ID NO: 186363 - DNA, 27 bp, Artificial Sequence
  Description of Artificial Sequence: Synthetic oligonucleotide
tgccctactgacactgcctgtcaccct

SEQ ID NO: 186364 - DNA, 26 bp, Artificial Sequence
  Description of Artificial Sequence: Synthetic oligonucleotide
gccctactgacactgcctgtcaccct

SEQ ID NO: 186365 - DNA, 26 bp, Artificial Sequence
  Description of Artificial Sequence: Synthetic oligonucleotide
ccctactgacactgcctgtcaccctg

SEQ ID NO: 186366 - DNA, 26 bp, Artificial Sequence
  Description of Artificial Sequence: Synthetic oligonucleotide
cctactgacactgcctgtcaccctgg

SEQ ID NO: 186367 - DNA, 26 bp, Artificial Sequence
  Description of Artificial Sequence: Synthetic oligonucleotide
ctactgacactgcctgtcaccctggc

SEQ ID NO: 186368 - DNA, 27 bp, Artificial Sequence
  Description of Artificial Sequence: Synthetic oligonucleotide
tactgacactgcctgtcaccctggcca

SEQ ID NO: 186369 - DNA, 26 bp, Artificial Sequence
  Description of Artificial Sequence: Synthetic oligonucleotide
actgacactgcctgtcaccctggcca

SEQ ID NO: 186370 - DNA, 25 bp, Artificial Sequence
  Description of Artificial Sequence: Synthetic oligonucleotide
ctgacactgcctgtcaccctggcca

SEQ ID NO: 186371 - DNA, 26 bp, Artificial Sequence
  Description of Artificial Sequence: Synthetic oligonucleotide
tgacactgcctgtcaccctggccagt

SEQ ID NO: 186372 - DNA, 25 bp, Artificial Sequence
  Description of Artificial Sequence: Synthetic oligonucleotide
gacactgcctgtcaccctggccagt

SEQ ID NO: 186373 - DNA, 25 bp, Artificial Sequence
  Description of Artificial Sequence: Synthetic oligonucleotide
acactgcctgtcaccctggccagtg

SEQ ID NO: 186374 - DNA, 24 bp, Artificial Sequence
  Description of Artificial Sequence: Synthetic oligonucleotide
cactgcctgtcaccctggccagtg

SEQ ID NO: 186375 - DNA, 25 bp, Artificial Sequence
  Description of Artificial Sequence: Synthetic oligonucleotide
actgcctgtcaccctggccagtggt

SEQ ID NO: 186376 - DNA, 24 bp, Artificial Sequence
  Description of Artificial Sequence: Synthetic oligonucleotide
ctgcctgtcaccctggccagtggt

SEQ ID NO: 186377 - DNA, 24 bp, Artificial Sequence
  Description of Artificial Sequence: Synthetic oligonucleotide
tgcctgtcaccctggccagtggtg

SEQ ID NO: 186378 - DNA, 23 bp, Artificial Sequence
  Description of Artificial Sequence: Synthetic oligonucleotide
gcctgtcaccctggccagtggtg

SEQ ID NO: 186379 - DNA, 25 bp, Artificial Sequence
  Description of Artificial Sequence: Synthetic oligonucleotide
cctgtcaccctggccagtggtgctt

SEQ ID NO: 186380 - DNA, 26 bp, Artificial Sequence
  Description of Artificial Sequence: Synthetic oligonucleotide
ctgtcaccctggccagtggtgcttct

SEQ ID NO: 186381 - DNA, 26 bp, Artificial Sequence
  Description of Artificial Sequence: Synthetic oligonucleotide
tgtcaccctggccagtggtgcttctg

SEQ ID NO: 186382 - DNA, 25 bp, Artificial Sequence
  Description of Artificial Sequence: Synthetic oligonucleotide
gtcaccctggccagtggtgcttctg

SEQ ID NO: 186383 - DNA, 26 bp, Artificial Sequence
  Description of Artificial Sequence: Synthetic oligonucleotide
tcaccctggccagtggtgcttctggt

SEQ ID NO: 186384 - DNA, 25 bp, Artificial Sequence
  Description of Artificial Sequence: Synthetic oligonucleotide
caccctggccagtggtgcttctggt

SEQ ID NO: 186385 - DNA, 25 bp, Artificial Sequence
  Description of Artificial Sequence: Synthetic oligonucleotide
accctggccagtggtgcttctggtg

SEQ ID NO: 186386 - DNA, 24 bp, Artificial Sequence
  Description of Artificial Sequence: Synthetic oligonucleotide
ccctggccagtggtgcttctggtg

SEQ ID NO: 186387 - DNA, 25 bp, Artificial Sequence
  Description of Artificial Sequence: Synthetic oligonucleotide
cctggccagtggtgcttctggtgga

SEQ ID NO: 186388 - DNA, 26 bp, Artificial Sequence
  Description of Artificial Sequence: Synthetic oligonucleotide
ctggccagtggtgcttctggtggact

SEQ ID NO: 186389 - DNA, 27 bp, Artificial Sequence
  Description of Artificial Sequence: Synthetic oligonucleotide
tggccagtggtgcttctggtggactct

SEQ ID NO: 186390 - DNA, 26 bp, Artificial Sequence
  Description of Artificial Sequence: Synthetic oligonucleotide
ggccagtggtgcttctggtggactct

SEQ ID NO: 186391 - DNA, 26 bp, Artificial Sequence
  Description of Artificial Sequence: Synthetic oligonucleotide
gccagtggtgcttctggtggactctg

SEQ ID NO: 186392 - DNA, 27 bp, Artificial Sequence
  Description of Artificial Sequence: Synthetic oligonucleotide
ccagtggtgcttctggtggactctgca

SEQ ID NO: 186393 - DNA, 27 bp, Artificial Sequence
  Description of Artificial Sequence: Synthetic oligonucleotide
cagtggtgcttctggtggactctgcac

SEQ ID NO: 186394 - DNA, 27 bp, Artificial Sequence
  Description of Artificial Sequence: Synthetic oligonucleotide
agtggtgcttctggtggactctgcacc

SEQ ID NO: 186395 - DNA, 26 bp, Artificial Sequence
  Description of Artificial Sequence: Synthetic oligonucleotide
gtggtgcttctggtggactctgcacc

SEQ ID NO: 186396 - DNA, 27 bp, Artificial Sequence
  Description of Artificial Sequence: Synthetic oligonucleotide
tggtgcttctggtggactctgcaccct

SEQ ID NO: 186397 - DNA, 26 bp, Artificial Sequence
  Description of Artificial Sequence: Synthetic oligonucleotide
ggtgcttctggtggactctgcaccct

SEQ ID NO: 186398 - DNA, 27 bp, Artificial Sequence
  Description of Artificial Sequence: Synthetic oligonucleotide
gtgcttctggtggactctgcaccctga

SEQ ID NO: 186399 - DNA, 31 bp, Artificial Sequence
  Description of Artificial Sequence: Synthetic oligonucleotide
tgcttctggtggactctgcaccctgatatac

SEQ ID NO: 186400 - DNA, 30 bp, Artificial Sequence
  Description of Artificial Sequence: Synthetic oligonucleotide
gcttctggtggactctgcaccctgatatac

SEQ ID NO: 186401 - DNA, 31 bp, Artificial Sequence
  Description of Artificial Sequence: Synthetic oligonucleotide
cttctggtggactctgcaccctgatatacag

SEQ ID NO: 186402 - DNA, 31 bp, Artificial Sequence
  Description of Artificial Sequence: Synthetic oligonucleotide
ttctggtggactctgcaccctgatatacagc

SEQ ID NO: 186403 - DNA, 30 bp, Artificial Sequence
  Description of Artificial Sequence: Synthetic oligonucleotide
tctggtggactctgcaccctgatatacagc

SEQ ID NO: 186404 - DNA, 29 bp, Artificial Sequence
  Description of Artificial Sequence: Synthetic oligonucleotide
ctggtggactctgcaccctgatatacagc

SEQ ID NO: 186405 - DNA, 30 bp, Artificial Sequence
  Description of Artificial Sequence: Synthetic oligonucleotide
tggtggactctgcaccctgatatacagcac

SEQ ID NO: 186406 - DNA, 29 bp, Artificial Sequence
  Description of Artificial Sequence: Synthetic oligonucleotide
ggtggactctgcaccctgatatacagcac

SEQ ID NO: 186407 - DNA, 29 bp, Artificial Sequence
  Description of Artificial Sequence: Synthetic oligonucleotide
gtggactctgcaccctgatatacagcacg

SEQ ID NO: 186408 - DNA, 29 bp, Artificial Sequence
  Description of Artificial Sequence: Synthetic oligonucleotide
tggactctgcaccctgatatacagcacgg

SEQ ID NO: 186409 - DNA, 28 bp, Artificial Sequence
  Description of Artificial Sequence: Synthetic oligonucleotide
ggactctgcaccctgatatacagcacgg

SEQ ID NO: 186410 - DNA, 29 bp, Artificial Sequence
  Description of Artificial Sequence: Synthetic oligonucleotide
gactctgcaccctgatatacagcacggag

SEQ ID NO: 186411 - DNA, 29 bp, Artificial Sequence
  Description of Artificial Sequence: Synthetic oligonucleotide
actctgcaccctgatatacagcacggagc

SEQ ID NO: 186412 - DNA, 28 bp, Artificial Sequence
  Description of Artificial Sequence: Synthetic oligonucleotide
ctctgcaccctgatatacagcacggagc

SEQ ID NO: 186413 - DNA, 29 bp, Artificial Sequence
  Description of Artificial Sequence: Synthetic oligonucleotide
tctgcaccctgatatacagcacggagctg

SEQ ID NO: 186414 - DNA, 28 bp, Artificial Sequence
  Description of Artificial Sequence: Synthetic oligonucleotide
ctgcaccctgatatacagcacggagctg

SEQ ID NO: 186415 - DNA, 30 bp, Artificial Sequence
  Description of Artificial Sequence: Synthetic oligonucleotide
tgcaccctgatatacagcacggagctgaag

SEQ ID NO: 186416 - DNA, 29 bp, Artificial Sequence
  Description of Artificial Sequence: Synthetic oligonucleotide
gcaccctgatatacagcacggagctgaag

SEQ ID NO: 186417 - DNA, 29 bp, Artificial Sequence
  Description of Artificial Sequence: Synthetic oligonucleotide
caccctgatatacagcacggagctgaagg

SEQ ID NO: 186418 - DNA, 29 bp, Artificial Sequence
  Description of Artificial Sequence: Synthetic oligonucleotide
accctgatatacagcacggagctgaaggc

SEQ ID NO: 186419 - DNA, 28 bp, Artificial Sequence
  Description of Artificial Sequence: Synthetic oligonucleotide
ccctgatatacagcacggagctgaaggc

SEQ ID NO: 186420 - DNA, 31 bp, Artificial Sequence
  Description of Artificial Sequence: Synthetic oligonucleotide
cctgatatacagcacggagctgaaggctttg

SEQ ID NO: 186421 - DNA, 31 bp, Artificial Sequence
  Description of Artificial Sequence: Synthetic oligonucleotide
ctgatatacagcacggagctgaaggctttgc

SEQ ID NO: 186422 - DNA, 32 bp, Artificial Sequence
  Description of Artificial Sequence: Synthetic oligonucleotide
tgatatacagcacggagctgaaggctttgcag

SEQ ID NO: 186423 - DNA, 31 bp, Artificial Sequence
  Description of Artificial Sequence: Synthetic oligonucleotide
gatatacagcacggagctgaaggctttgcag

SEQ ID NO: 186424 - DNA, 31 bp, Artificial Sequence
  Description of Artificial Sequence: Synthetic oligonucleotide
atatacagcacggagctgaaggctttgcagg

SEQ ID NO: 186425 - DNA, 30 bp, Artificial Sequence
  Description of Artificial Sequence: Synthetic oligonucleotide
tatacagcacggagctgaaggctttgcagg

SEQ ID NO: 186426 - DNA, 29 bp, Artificial Sequence
  Description of Artificial Sequence: Synthetic oligonucleotide
atacagcacggagctgaaggctttgcagg

SEQ ID NO: 186427 - DNA, 28 bp, Artificial Sequence
  Description of Artificial Sequence: Synthetic oligonucleotide
tacagcacggagctgaaggctttgcagg

SEQ ID NO: 186428 - DNA, 27 bp, Artificial Sequence
  Description of Artificial Sequence: Synthetic oligonucleotide
acagcacggagctgaaggctttgcagg

SEQ ID NO: 186429 - DNA, 26 bp, Artificial Sequence
  Description of Artificial Sequence: Synthetic oligonucleotide
cagcacggagctgaaggctttgcagg

SEQ ID NO: 186430 - DNA, 26 bp, Artificial Sequence
  Description of Artificial Sequence: Synthetic oligonucleotide
agcacggagctgaaggctttgcaggc

SEQ ID NO: 186431 - DNA, 25 bp, Artificial Sequence
  Description of Artificial Sequence: Synthetic oligonucleotide
gcacggagctgaaggctttgcaggc

SEQ ID NO: 186432 - DNA, 26 bp, Artificial Sequence
  Description of Artificial Sequence: Synthetic oligonucleotide
cacggagctgaaggctttgcaggcca

SEQ ID NO: 186433 - DNA, 27 bp, Artificial Sequence
  Description of Artificial Sequence: Synthetic oligonucleotide
acggagctgaaggctttgcaggccaca

SEQ ID NO: 186434 - DNA, 26 bp, Artificial Sequence
  Description of Artificial Sequence: Synthetic oligonucleotide
cggagctgaaggctttgcaggccaca

SEQ ID NO: 186435 - DNA, 27 bp, Artificial Sequence
  Description of Artificial Sequence: Synthetic oligonucleotide
ggagctgaaggctttgcaggccacaca

SEQ ID NO: 186436 - DNA, 27 bp, Artificial Sequence
  Description of Artificial Sequence: Synthetic oligonucleotide
gagctgaaggctttgcaggccacacac

SEQ ID NO: 186437 - DNA, 28 bp, Artificial Sequence
  Description of Artificial Sequence: Synthetic oligonucleotide
agctgaaggctttgcaggccacacacac

SEQ ID NO: 186438 - DNA, 27 bp, Artificial Sequence
  Description of Artificial Sequence: Synthetic oligonucleotide
gctgaaggctttgcaggccacacacac

SEQ ID NO: 186439 - DNA, 28 bp, Artificial Sequence
  Description of Artificial Sequence: Synthetic oligonucleotide
ctgaaggctttgcaggccacacacactg

SEQ ID NO: 186440 - DNA, 30 bp, Artificial Sequence
  Description of Artificial Sequence: Synthetic oligonucleotide
tgaaggctttgcaggccacacacactgtag

SEQ ID NO: 186441 - DNA, 29 bp, Artificial Sequence
  Description of Artificial Sequence: Synthetic oligonucleotide
gaaggctttgcaggccacacacactgtag

SEQ ID NO: 186442 - DNA, 29 bp, Artificial Sequence
  Description of Artificial Sequence: Synthetic oligonucleotide
aaggctttgcaggccacacacactgtagc

SEQ ID NO: 186443 - DNA, 28 bp, Artificial Sequence
  Description of Artificial Sequence: Synthetic oligonucleotide
aggctttgcaggccacacacactgtagc

SEQ ID NO: 186444 - DNA, 27 bp, Artificial Sequence
  Description of Artificial Sequence: Synthetic oligonucleotide
ggctttgcaggccacacacactgtagc

SEQ ID NO: 186445 - DNA, 27 bp, Artificial Sequence
  Description of Artificial Sequence: Synthetic oligonucleotide
gctttgcaggccacacacactgtagcc

SEQ ID NO: 186446 - DNA, 28 bp, Artificial Sequence
  Description of Artificial Sequence: Synthetic oligonucleotide
ctttgcaggccacacacactgtagcctg

SEQ ID NO: 186447 - DNA, 29 bp, Artificial Sequence
  Description of Artificial Sequence: Synthetic oligonucleotide
tttgcaggccacacacactgtagcctgtc

SEQ ID NO: 186448 - DNA, 28 bp, Artificial Sequence
  Description of Artificial Sequence: Synthetic oligonucleotide
ttgcaggccacacacactgtagcctgtc

SEQ ID NO: 186449 - DNA, 27 bp, Artificial Sequence
  Description of Artificial Sequence: Synthetic oligonucleotide
tgcaggccacacacactgtagcctgtc

SEQ ID NO: 186450 - DNA, 27 bp, Artificial Sequence
  Description of Artificial Sequence: Synthetic oligonucleotide
gcaggccacacacactgtagcctgtct

SEQ ID NO: 186451 - DNA, 28 bp, Artificial Sequence
  Description of Artificial Sequence: Synthetic oligonucleotide
caggccacacacactgtagcctgtcttg

SEQ ID NO: 186452 - DNA, 28 bp, Artificial Sequence
  Description of Artificial Sequence: Synthetic oligonucleotide
aggccacacacactgtagcctgtcttgc

SEQ ID NO: 186453 - DNA, 27 bp, Artificial Sequence
  Description of Artificial Sequence: Synthetic oligonucleotide
ggccacacacactgtagcctgtcttgc

SEQ ID NO: 186454 - DNA, 27 bp, Artificial Sequence
  Description of Artificial Sequence: Synthetic oligonucleotide
gccacacacactgtagcctgtcttgcc

SEQ ID NO: 186455 - DNA, 29 bp, Artificial Sequence
  Description of Artificial Sequence: Synthetic oligonucleotide
ccacacacactgtagcctgtcttgccatc

SEQ ID NO: 186456 - DNA, 32 bp, Artificial Sequence
  Description of Artificial Sequence: Synthetic oligonucleotide
cacacacactgtagcctgtcttgccatctttg

SEQ ID NO: 186457 - DNA, 33 bp, Artificial Sequence
  Description of Artificial Sequence: Synthetic oligonucleotide
acacacactgtagcctgtcttgccatctttgtc

SEQ ID NO: 186458 - DNA, 32 bp, Artificial Sequence
  Description of Artificial Sequence: Synthetic oligonucleotide
cacacactgtagcctgtcttgccatctttgtc

SEQ ID NO: 186459 - DNA, 34 bp, Artificial Sequence
  Description of Artificial Sequence: Synthetic oligonucleotide
acacactgtagcctgtcttgccatctttgtcttg

SEQ ID NO: 186460 - DNA, 33 bp, Artificial Sequence
  Description of Artificial Sequence: Synthetic oligonucleotide
cacactgtagcctgtcttgccatctttgtcttg

SEQ ID NO: 186461 - DNA, 35 bp, Artificial Sequence
  Description of Artificial Sequence: Synthetic oligonucleotide
acactgtagcctgtcttgccatctttgtcttgttg

SEQ ID NO: 186462 - DNA, 34 bp, Artificial Sequence
  Description of Artificial Sequence: Synthetic oligonucleotide
cactgtagcctgtcttgccatctttgtcttgttg

SEQ ID NO: 186463 - DNA, 34 bp, Artificial Sequence
  Description of Artificial Sequence: Synthetic oligonucleotide
actgtagcctgtcttgccatctttgtcttgttgc

SEQ ID NO: 186464 - DNA, 33 bp, Artificial Sequence
  Description of Artificial Sequence: Synthetic oligonucleotide
ctgtagcctgtcttgccatctttgtcttgttgc

SEQ ID NO: 186465 - DNA, 33 bp, Artificial Sequence
  Description of Artificial Sequence: Synthetic oligonucleotide
tgtagcctgtcttgccatctttgtcttgttgcc

SEQ ID NO: 186466 - DNA, 32 bp, Artificial Sequence
  Description of Artificial Sequence: Synthetic oligonucleotide
gtagcctgtcttgccatctttgtcttgttgcc

SEQ ID NO: 186467 - DNA, 35 bp, Artificial Sequence
  Description of Artificial Sequence: Synthetic oligonucleotide
tagcctgtcttgccatctttgtcttgttgccattg

SEQ ID NO: 186468 - DNA, 34 bp, Artificial Sequence
  Description of Artificial Sequence: Synthetic oligonucleotide
agcctgtcttgccatctttgtcttgttgccattg

SEQ ID NO: 186469 - DNA, 33 bp, Artificial Sequence
  Description of Artificial Sequence: Synthetic oligonucleotide
gcctgtcttgccatctttgtcttgttgccattg

SEQ ID NO: 186470 - DNA, 33 bp, Artificial Sequence
  Description of Artificial Sequence: Synthetic oligonucleotide
cctgtcttgccatctttgtcttgttgccattgg

SEQ ID NO: 186471 - DNA, 33 bp, Artificial Sequence
  Description of Artificial Sequence: Synthetic oligonucleotide
ctgtcttgccatctttgtcttgttgccattggg

SEQ ID NO: 186472 - DNA, 36 bp, Artificial Sequence
  Description of Artificial Sequence: Synthetic oligonucleotide
tgtcttgccatctttgtcttgttgccattgggtttg

SEQ ID NO: 186473 - DNA, 35 bp, Artificial Sequence
  Description of Artificial Sequence: Synthetic oligonucleotide
gtcttgccatctttgtcttgttgccattgggtttg

SEQ ID NO: 186474 - DNA, 38 bp, Artificial Sequence
  Description of Artificial Sequence: Synthetic oligonucleotide
tcttgccatctttgtcttgttgccattgggtttgtttg

SEQ ID NO: 186475 - DNA, 37 bp, Artificial Sequence
  Description of Artificial Sequence: Synthetic oligonucleotide
cttgccatctttgtcttgttgccattgggtttgtttg

SEQ ID NO: 186476 - DNA, 37 bp, Artificial Sequence
  Description of Artificial Sequence: Synthetic oligonucleotide
ttgccatctttgtcttgttgccattgggtttgtttgg

SEQ ID NO: 186477 - DNA, 36 bp, Artificial Sequence
  Description of Artificial Sequence: Synthetic oligonucleotide
tgccatctttgtcttgttgccattgggtttgtttgg

SEQ ID NO: 186478 - DNA, 35 bp, Artificial Sequence
  Description of Artificial Sequence: Synthetic oligonucleotide
gccatctttgtcttgttgccattgggtttgtttgg

SEQ ID NO: 186479 - DNA, 36 bp, Artificial Sequence
  Description of Artificial Sequence: Synthetic oligonucleotide
ccatctttgtcttgttgccattgggtttgtttggag

SEQ ID NO: 186480 - DNA, 36 bp, Artificial Sequence
  Description of Artificial Sequence: Synthetic oligonucleotide
catctttgtcttgttgccattgggtttgtttggagc

SEQ ID NO: 186481 - DNA, 36 bp, Artificial Sequence
  Description of Artificial Sequence: Synthetic oligonucleotide
atctttgtcttgttgccattgggtttgtttggagcc

SEQ ID NO: 186482 - DNA, 35 bp, Artificial Sequence
  Description of Artificial Sequence: Synthetic oligonucleotide
tctttgtcttgttgccattgggtttgtttggagcc

SEQ ID NO: 186483 - DNA, 34 bp, Artificial Sequence
  Description of Artificial Sequence: Synthetic oligonucleotide
ctttgtcttgttgccattgggtttgtttggagcc

SEQ ID NO: 186484 - DNA, 36 bp, Artificial Sequence
  Description of Artificial Sequence: Synthetic oligonucleotide
tttgtcttgttgccattgggtttgtttggagccaag

SEQ ID NO: 186485 - DNA, 35 bp, Artificial Sequence
  Description of Artificial Sequence: Synthetic oligonucleotide
ttgtcttgttgccattgggtttgtttggagccaag

SEQ ID NO: 186486 - DNA, 34 bp, Artificial Sequence
  Description of Artificial Sequence: Synthetic oligonucleotide
tgtcttgttgccattgggtttgtttggagccaag

SEQ ID NO: 186487 - DNA, 33 bp, Artificial Sequence
  Description of Artificial Sequence: Synthetic oligonucleotide
gtcttgttgccattgggtttgtttggagccaag

SEQ ID NO: 186488 - DNA, 33 bp, Artificial Sequence
  Description of Artificial Sequence: Synthetic oligonucleotide
tcttgttgccattgggtttgtttggagccaagg

SEQ ID NO: 186489 - DNA, 32 bp, Artificial Sequence
  Description of Artificial Sequence: Synthetic oligonucleotide
cttgttgccattgggtttgtttggagccaagg

SEQ ID NO: 186490 - DNA, 32 bp, Artificial Sequence
  Description of Artificial Sequence: Synthetic oligonucleotide
ttgttgccattgggtttgtttggagccaaggg

SEQ ID NO: 186491 - DNA, 31 bp, Artificial Sequence
  Description of Artificial Sequence: Synthetic oligonucleotide
tgttgccattgggtttgtttggagccaaggg

SEQ ID NO: 186492 - DNA, 30 bp, Artificial Sequence
  Description of Artificial Sequence: Synthetic oligonucleotide
gttgccattgggtttgtttggagccaaggg

SEQ ID NO: 186493 - DNA, 30 bp, Artificial Sequence
  Description of Artificial Sequence: Synthetic oligonucleotide
ttgccattgggtttgtttggagccaagggg

SEQ ID NO: 186494 - DNA, 29 bp, Artificial Sequence
  Description of Artificial Sequence: Synthetic oligonucleotide
tgccattgggtttgtttggagccaagggg

SEQ ID NO: 186495 - DNA, 28 bp, Artificial Sequence
  Description of Artificial Sequence: Synthetic oligonucleotide
gccattgggtttgtttggagccaagggg

SEQ ID NO: 186496 - DNA, 28 bp, Artificial Sequence
  Description of Artificial Sequence: Synthetic oligonucleotide
ccattgggtttgtttggagccaaggggc

SEQ ID NO: 186497 - DNA, 29 bp, Artificial Sequence
  Description of Artificial Sequence: Synthetic oligonucleotide
cattgggtttgtttggagccaaggggctg

SEQ ID NO: 186498 - DNA, 31 bp, Artificial Sequence
  Description of Artificial Sequence: Synthetic oligonucleotide
attgggtttgtttggagccaaggggctgaag

SEQ ID NO: 186499 - DNA, 30 bp, Artificial Sequence
  Description of Artificial Sequence: Synthetic oligonucleotide
ttgggtttgtttggagccaaggggctgaag

SEQ ID NO: 186500 - DNA, 29 bp, Artificial Sequence
  Description of Artificial Sequence: Synthetic oligonucleotide
tgggtttgtttggagccaaggggctgaag

SEQ ID NO: 186501 - DNA, 28 bp, Artificial Sequence
  Description of Artificial Sequence: Synthetic oligonucleotide
gggtttgtttggagccaaggggctgaag

SEQ ID NO: 186502 - DNA, 30 bp, Artificial Sequence
  Description of Artificial Sequence: Synthetic oligonucleotide
ggtttgtttggagccaaggggctgaagaag

SEQ ID NO: 186503 - DNA, 30 bp, Artificial Sequence
  Description of Artificial Sequence: Synthetic oligonucleotide
gtttgtttggagccaaggggctgaagaagg

SEQ ID NO: 186504 - DNA, 30 bp, Artificial Sequence
  Description of Artificial Sequence: Synthetic oligonucleotide
tttgtttggagccaaggggctgaagaaggc

SEQ ID NO: 186505 - DNA, 29 bp, Artificial Sequence
  Description of Artificial Sequence: Synthetic oligonucleotide
ttgtttggagccaaggggctgaagaaggc

SEQ ID NO: 186506 - DNA, 28 bp, Artificial Sequence
  Description of Artificial Sequence: Synthetic oligonucleotide
tgtttggagccaaggggctgaagaaggc

SEQ ID NO: 186507 - DNA, 27 bp, Artificial Sequence
  Description of Artificial Sequence: Synthetic oligonucleotide
gtttggagccaaggggctgaagaaggc

SEQ ID NO: 186508 - DNA, 30 bp, Artificial Sequence
  Description of Artificial Sequence: Synthetic oligonucleotide
tttggagccaaggggctgaagaaggcattg

SEQ ID NO: 186509 - DNA, 29 bp, Artificial Sequence
  Description of Artificial Sequence: Synthetic oligonucleotide
ttggagccaaggggctgaagaaggcattg

SEQ ID NO: 186510 - DNA, 28 bp, Artificial Sequence
  Description of Artificial Sequence: Synthetic oligonucleotide
tggagccaaggggctgaagaaggcattg

SEQ ID NO: 186511 - DNA, 27 bp, Artificial Sequence
  Description of Artificial Sequence: Synthetic oligonucleotide
ggagccaaggggctgaagaaggcattg

SEQ ID NO: 186512 - DNA, 27 bp, Artificial Sequence
  Description of Artificial Sequence: Synthetic oligonucleotide
gagccaaggggctgaagaaggcattgg

SEQ ID NO: 186513 - DNA, 27 bp, Artificial Sequence
  Description of Artificial Sequence: Synthetic oligonucleotide
agccaaggggctgaagaaggcattggg

SEQ ID NO: 186514 - DNA, 27 bp, Artificial Sequence
  Description of Artificial Sequence: Synthetic oligonucleotide
gccaaggggctgaagaaggcattgggt

SEQ ID NO: 186515 - DNA, 29 bp, Artificial Sequence
  Description of Artificial Sequence: Synthetic oligonucleotide
ccaaggggctgaagaaggcattgggtatg

SEQ ID NO: 186516 - DNA, 29 bp, Artificial Sequence
  Description of Artificial Sequence: Synthetic oligonucleotide
caaggggctgaagaaggcattgggtatgg

SEQ ID NO: 186517 - DNA, 29 bp, Artificial Sequence
  Description of Artificial Sequence: Synthetic oligonucleotide
aaggggctgaagaaggcattgggtatggg

SEQ ID NO: 186518 - DNA, 28 bp, Artificial Sequence
  Description of Artificial Sequence: Synthetic oligonucleotide
aggggctgaagaaggcattgggtatggg

SEQ ID NO: 186519 - DNA, 27 bp, Artificial Sequence
  Description of Artificial Sequence: Synthetic oligonucleotide
ggggctgaagaaggcattgggtatggg

SEQ ID NO: 186520 - DNA, 27 bp, Artificial Sequence
  Description of Artificial Sequence: Synthetic oligonucleotide
gggctgaagaaggcattgggtatgggg

SEQ ID NO: 186521 - DNA, 27 bp, Artificial Sequence
  Description of Artificial Sequence: Synthetic oligonucleotide
ggctgaagaaggcattgggtatggggc

SEQ ID NO: 186522 - DNA, 27 bp, Artificial Sequence
  Description of Artificial Sequence: Synthetic oligonucleotide
gctgaagaaggcattgggtatggggcc

SEQ ID NO: 186523 - DNA, 28 bp, Artificial Sequence
  Description of Artificial Sequence: Synthetic oligonucleotide
ctgaagaaggcattgggtatggggccag

SEQ ID NO: 186524 - DNA, 28 bp, Artificial Sequence
  Description of Artificial Sequence: Synthetic oligonucleotide
tgaagaaggcattgggtatggggccagg

SEQ ID NO: 186525 - DNA, 27 bp, Artificial Sequence
  Description of Artificial Sequence: Synthetic oligonucleotide
gaagaaggcattgggtatggggccagg

SEQ ID NO: 186526 - DNA, 27 bp, Artificial Sequence
  Description of Artificial Sequence: Synthetic oligonucleotide
aagaaggcattgggtatggggccaggc

SEQ ID NO: 186527 - DNA, 26 bp, Artificial Sequence
  Description of Artificial Sequence: Synthetic oligonucleotide
agaaggcattgggtatggggccaggc

SEQ ID NO: 186528 - DNA, 25 bp, Artificial Sequence
  Description of Artificial Sequence: Synthetic oligonucleotide
gaaggcattgggtatggggccaggc

SEQ ID NO: 186529 - DNA, 25 bp, Artificial Sequence
  Description of Artificial Sequence: Synthetic oligonucleotide
aaggcattgggtatggggccaggcc

SEQ ID NO: 186530 - DNA, 24 bp, Artificial Sequence
  Description of Artificial Sequence: Synthetic oligonucleotide
aggcattgggtatggggccaggcc

SEQ ID NO: 186531 - DNA, 23 bp, Artificial Sequence
  Description of Artificial Sequence: Synthetic oligonucleotide
ggcattgggtatggggccaggcc

SEQ ID NO: 186532 - DNA, 23 bp, Artificial Sequence
  Description of Artificial Sequence: Synthetic oligonucleotide
gcattgggtatggggccaggccc

SEQ ID NO: 186533 - DNA, 24 bp, Artificial Sequence
  Description of Artificial Sequence: Synthetic oligonucleotide
cattgggtatggggccaggcccct

SEQ ID NO: 186534 - DNA, 24 bp, Artificial Sequence
  Description of Artificial Sequence: Synthetic oligonucleotide
attgggtatggggccaggcccctg

SEQ ID NO: 186535 - DNA, 23 bp, Artificial Sequence
  Description of Artificial Sequence: Synthetic oligonucleotide
ttgggtatggggccaggcccctg

SEQ ID NO: 186536 - DNA, 22 bp, Artificial Sequence
  Description of Artificial Sequence: Synthetic oligonucleotide
tgggtatggggccaggcccctg

SEQ ID NO: 186537 - DNA, 21 bp, Artificial Sequence
  Description of Artificial Sequence: Synthetic oligonucleotide
gggtatggggccaggcccctg

SEQ ID NO: 186538 - DNA, 23 bp, Artificial Sequence
  Description of Artificial Sequence: Synthetic oligonucleotide
ggtatggggccaggcccctggat

SEQ ID NO: 186539 - DNA, 27 bp, Artificial Sequence
  Description of Artificial Sequence: Synthetic oligonucleotide
gtatggggccaggcccctggatgaata

SEQ ID NO: 186540 - DNA, 28 bp, Artificial Sequence
  Description of Artificial Sequence: Synthetic oligonucleotide
tatggggccaggcccctggatgaatatc

SEQ ID NO: 186541 - DNA, 27 bp, Artificial Sequence
  Description of Artificial Sequence: Synthetic oligonucleotide
atggggccaggcccctggatgaatatc

SEQ ID NO: 186542 - DNA, 26 bp, Artificial Sequence
  Description of Artificial Sequence: Synthetic oligonucleotide
tggggccaggcccctggatgaatatc

SEQ ID NO: 186543 - DNA, 25 bp, Artificial Sequence
  Description of Artificial Sequence: Synthetic oligonucleotide
ggggccaggcccctggatgaatatc

SEQ ID NO: 186544 - DNA, 26 bp, Artificial Sequence
  Description of Artificial Sequence: Synthetic oligonucleotide
gggccaggcccctggatgaatatcct

SEQ ID NO: 186545 - DNA, 27 bp, Artificial Sequence
  Description of Artificial Sequence: Synthetic oligonucleotide
ggccaggcccctggatgaatatcctgt

SEQ ID NO: 186546 - DNA, 27 bp, Artificial Sequence
  Description of Artificial Sequence: Synthetic oligonucleotide
gccaggcccctggatgaatatcctgtg

SEQ ID NO: 186547 - DNA, 27 bp, Artificial Sequence
  Description of Artificial Sequence: Synthetic oligonucleotide
ccaggcccctggatgaatatcctgtgg

SEQ ID NO: 186548 - DNA, 27 bp, Artificial Sequence
  Description of Artificial Sequence: Synthetic oligonucleotide
caggcccctggatgaatatcctgtggg

SEQ ID NO: 186549 - DNA, 27 bp, Artificial Sequence
  Description of Artificial Sequence: Synthetic oligonucleotide
aggcccctggatgaatatcctgtgggc

SEQ ID NO: 186550 - DNA, 26 bp, Artificial Sequence
  Description of Artificial Sequence: Synthetic oligonucleotide
ggcccctggatgaatatcctgtgggc

SEQ ID NO: 186551 - DNA, 27 bp, Artificial Sequence
  Description of Artificial Sequence: Synthetic oligonucleotide
gcccctggatgaatatcctgtgggcct

SEQ ID NO: 186552 - DNA, 27 bp, Artificial Sequence
  Description of Artificial Sequence: Synthetic oligonucleotide
cccctggatgaatatcctgtgggcctg

SEQ ID NO: 186553 - DNA, 27 bp, Artificial Sequence
  Description of Artificial Sequence: Synthetic oligonucleotide
ccctggatgaatatcctgtgggcctgg

SEQ ID NO: 186554 - DNA, 35 bp, Artificial Sequence
  Description of Artificial Sequence: Synthetic oligonucleotide
cctggatgaatatcctgtgggcctggtttattttc

SEQ ID NO: 186555 - DNA, 36 bp, Artificial Sequence
  Description of Artificial Sequence: Synthetic oligonucleotide
ctggatgaatatcctgtgggcctggtttattttctg

SEQ ID NO: 186556 - DNA, 36 bp, Artificial Sequence
  Description of Artificial Sequence: Synthetic oligonucleotide
tggatgaatatcctgtgggcctggtttattttctgg

SEQ ID NO: 186557 - DNA, 35 bp, Artificial Sequence
  Description of Artificial Sequence: Synthetic oligonucleotide
ggatgaatatcctgtgggcctggtttattttctgg

SEQ ID NO: 186558 - DNA, 36 bp, Artificial Sequence
  Description of Artificial Sequence: Synthetic oligonucleotide
gatgaatatcctgtgggcctggtttattttctggtg

SEQ ID NO: 186559 - DNA, 36 bp, Artificial Sequence
  Description of Artificial Sequence: Synthetic oligonucleotide
atgaatatcctgtgggcctggtttattttctggtgg

SEQ ID NO: 186560 - DNA, 35 bp, Artificial Sequence
  Description of Artificial Sequence: Synthetic oligonucleotide
tgaatatcctgtgggcctggtttattttctggtgg

SEQ ID NO: 186561 - DNA, 34 bp, Artificial Sequence
  Description of Artificial Sequence: Synthetic oligonucleotide
gaatatcctgtgggcctggtttattttctggtgg

SEQ ID NO: 186562 - DNA, 34 bp, Artificial Sequence
  Description of Artificial Sequence: Synthetic oligonucleotide
aatatcctgtgggcctggtttattttctggtggc

SEQ ID NO: 186563 - DNA, 33 bp, Artificial Sequence
  Description of Artificial Sequence: Synthetic oligonucleotide
atatcctgtgggcctggtttattttctggtggc

SEQ ID NO: 186564 - DNA, 32 bp, Artificial Sequence
  Description of Artificial Sequence: Synthetic oligonucleotide
tatcctgtgggcctggtttattttctggtggc

SEQ ID NO: 186565 - DNA, 31 bp, Artificial Sequence
  Description of Artificial Sequence: Synthetic oligonucleotide
atcctgtgggcctggtttattttctggtggc

SEQ ID NO: 186566 - DNA, 30 bp, Artificial Sequence
  Description of Artificial Sequence: Synthetic oligonucleotide
tcctgtgggcctggtttattttctggtggc

SEQ ID NO: 186567 - DNA, 29 bp, Artificial Sequence
  Description of Artificial Sequence: Synthetic oligonucleotide
cctgtgggcctggtttattttctggtggc

SEQ ID NO: 186568 - DNA, 29 bp, Artificial Sequence
  Description of Artificial Sequence: Synthetic oligonucleotide
ctgtgggcctggtttattttctggtggcc

SEQ ID NO: 186569 - DNA, 30 bp, Artificial Sequence
  Description of Artificial Sequence: Synthetic oligonucleotide
tgtgggcctggtttattttctggtggcctc

SEQ ID NO: 186570 - DNA, 29 bp, Artificial Sequence
  Description of Artificial Sequence: Synthetic oligonucleotide
gtgggcctggtttattttctggtggcctc

SEQ ID NO: 186571 - DNA, 31 bp, Artificial Sequence
  Description of Artificial Sequence: Synthetic oligonucleotide
tgggcctggtttattttctggtggcctcatg

SEQ ID NO: 186572 - DNA, 30 bp, Artificial Sequence
  Description of Artificial Sequence: Synthetic oligonucleotide
gggcctggtttattttctggtggcctcatg

SEQ ID NO: 186573 - DNA, 30 bp, Artificial Sequence
  Description of Artificial Sequence: Synthetic oligonucleotide
ggcctggtttattttctggtggcctcatgg

SEQ ID NO: 186574 - DNA, 30 bp, Artificial Sequence
  Description of Artificial Sequence: Synthetic oligonucleotide
gcctggtttattttctggtggcctcatggg

SEQ ID NO: 186575 - DNA, 30 bp, Artificial Sequence
  Description of Artificial Sequence: Synthetic oligonucleotide
cctggtttattttctggtggcctcatgggg

SEQ ID NO: 186576 - DNA, 31 bp, Artificial Sequence
  Description of Artificial Sequence: Synthetic oligonucleotide
ctggtttattttctggtggcctcatggggtg

SEQ ID NO: 186577 - DNA, 31 bp, Artificial Sequence
  Description of Artificial Sequence: Synthetic oligonucleotide
tggtttattttctggtggcctcatggggtgg

SEQ ID NO: 186578 - DNA, 30 bp, Artificial Sequence
  Description of Artificial Sequence: Synthetic oligonucleotide
ggtttattttctggtggcctcatggggtgg

SEQ ID NO: 186579 - DNA, 32 bp, Artificial Sequence
  Description of Artificial Sequence: Synthetic oligonucleotide
gtttattttctggtggcctcatggggtggttc

SEQ ID NO: 186580 - DNA, 34 bp, Artificial Sequence
  Description of Artificial Sequence: Synthetic oligonucleotide
tttattttctggtggcctcatggggtggttctag

SEQ ID NO: 186581 - DNA, 33 bp, Artificial Sequence
  Description of Artificial Sequence: Synthetic oligonucleotide
ttattttctggtggcctcatggggtggttctag

SEQ ID NO: 186582 - DNA, 32 bp, Artificial Sequence
  Description of Artificial Sequence: Synthetic oligonucleotide
tattttctggtggcctcatggggtggttctag

SEQ ID NO: 186583 - DNA, 31 bp, Artificial Sequence
  Description of Artificial Sequence: Synthetic oligonucleotide
attttctggtggcctcatggggtggttctag

SEQ ID NO: 186584 - DNA, 30 bp, Artificial Sequence
  Description of Artificial Sequence: Synthetic oligonucleotide
ttttctggtggcctcatggggtggttctag

SEQ ID NO: 186585 - DNA, 29 bp, Artificial Sequence
  Description of Artificial Sequence: Synthetic oligonucleotide
tttctggtggcctcatggggtggttctag

SEQ ID NO: 186586 - DNA, 28 bp, Artificial Sequence
  Description of Artificial Sequence: Synthetic oligonucleotide
ttctggtggcctcatggggtggttctag

SEQ ID NO: 186587 - DNA, 27 bp, Artificial Sequence
  Description of Artificial Sequence: Synthetic oligonucleotide
tctggtggcctcatggggtggttctag

SEQ ID NO: 186588 - DNA, 26 bp, Artificial Sequence
  Description of Artificial Sequence: Synthetic oligonucleotide
ctggtggcctcatggggtggttctag

SEQ ID NO: 186589 - DNA, 27 bp, Artificial Sequence
  Description of Artificial Sequence: Synthetic oligonucleotide
tggtggcctcatggggtggttctagga

SEQ ID NO: 186590 - DNA, 26 bp, Artificial Sequence
  Description of Artificial Sequence: Synthetic oligonucleotide
ggtggcctcatggggtggttctagga

SEQ ID NO: 186591 - DNA, 27 bp, Artificial Sequence
  Description of Artificial Sequence: Synthetic oligonucleotide
gtggcctcatggggtggttctaggact

SEQ ID NO: 186592 - DNA, 27 bp, Artificial Sequence
  Description of Artificial Sequence: Synthetic oligonucleotide
tggcctcatggggtggttctaggactg

SEQ ID NO: 186593 - DNA, 26 bp, Artificial Sequence
  Description of Artificial Sequence: Synthetic oligonucleotide
ggcctcatggggtggttctaggactg

SEQ ID NO: 186594 - DNA, 27 bp, Artificial Sequence
  Description of Artificial Sequence: Synthetic oligonucleotide
gcctcatggggtggttctaggactgga

SEQ ID NO: 186595 - DNA, 30 bp, Artificial Sequence
  Description of Artificial Sequence: Synthetic oligonucleotide
cctcatggggtggttctaggactggatttc

SEQ ID NO: 186596 - DNA, 30 bp, Artificial Sequence
  Description of Artificial Sequence: Synthetic oligonucleotide
ctcatggggtggttctaggactggatttcc

SEQ ID NO: 186597 - DNA, 31 bp, Artificial Sequence
  Description of Artificial Sequence: Synthetic oligonucleotide
tcatggggtggttctaggactggatttcctg

SEQ ID NO: 186598 - DNA, 30 bp, Artificial Sequence
  Description of Artificial Sequence: Synthetic oligonucleotide
catggggtggttctaggactggatttcctg

SEQ ID NO: 186599 - DNA, 30 bp, Artificial Sequence
  Description of Artificial Sequence: Synthetic oligonucleotide
atggggtggttctaggactggatttcctgg

SEQ ID NO: 186600 - DNA, 29 bp, Artificial Sequence
  Description of Artificial Sequence: Synthetic oligonucleotide
tggggtggttctaggactggatttcctgg

SEQ ID NO: 186601 - DNA, 28 bp, Artificial Sequence
  Description of Artificial Sequence: Synthetic oligonucleotide
ggggtggttctaggactggatttcctgg

SEQ ID NO: 186602 - DNA, 29 bp, Artificial Sequence
  Description of Artificial Sequence: Synthetic oligonucleotide
gggtggttctaggactggatttcctggtg

SEQ ID NO: 186603 - DNA, 30 bp, Artificial Sequence
  Description of Artificial Sequence: Synthetic oligonucleotide
ggtggttctaggactggatttcctggtgag

SEQ ID NO: 186604 - DNA, 30 bp, Artificial Sequence
  Description of Artificial Sequence: Synthetic oligonucleotide
gtggttctaggactggatttcctggtgagg

SEQ ID NO: 186605 - DNA, 31 bp, Artificial Sequence
  Description of Artificial Sequence: Synthetic oligonucleotide
tggttctaggactggatttcctggtgaggtc

SEQ ID NO: 186606 - DNA, 30 bp, Artificial Sequence
  Description of Artificial Sequence: Synthetic oligonucleotide
ggttctaggactggatttcctggtgaggtc

SEQ ID NO: 186607 - DNA, 30 bp, Artificial Sequence
  Description of Artificial Sequence: Synthetic oligonucleotide
gttctaggactggatttcctggtgaggtcc

SEQ ID NO: 186608 - DNA, 32 bp, Artificial Sequence
  Description of Artificial Sequence: Synthetic oligonucleotide
ttctaggactggatttcctggtgaggtccaag

SEQ ID NO: 186609 - DNA, 31 bp, Artificial Sequence
  Description of Artificial Sequence: Synthetic oligonucleotide
tctaggactggatttcctggtgaggtccaag

SEQ ID NO: 186610 - DNA, 30 bp, Artificial Sequence
  Description of Artificial Sequence: Synthetic oligonucleotide
ctaggactggatttcctggtgaggtccaag

SEQ ID NO: 186611 - DNA, 30 bp, Artificial Sequence
  Description of Artificial Sequence: Synthetic oligonucleotide
taggactggatttcctggtgaggtccaagc

SEQ ID NO: 186612 - DNA, 29 bp, Artificial Sequence
  Description of Artificial Sequence: Synthetic oligonucleotide
aggactggatttcctggtgaggtccaagc

SEQ ID NO: 186613 - DNA, 28 bp, Artificial Sequence
  Description of Artificial Sequence: Synthetic oligonucleotide
ggactggatttcctggtgaggtccaagc

SEQ ID NO: 186614 - DNA, 29 bp, Artificial Sequence
  Description of Artificial Sequence: Synthetic oligonucleotide
gactggatttcctggtgaggtccaagctg

SEQ ID NO: 186615 - DNA, 31 bp, Artificial Sequence
  Description of Artificial Sequence: Synthetic oligonucleotide
actggatttcctggtgaggtccaagctgttg

SEQ ID NO: 186616 - DNA, 30 bp, Artificial Sequence
  Description of Artificial Sequence: Synthetic oligonucleotide
ctggatttcctggtgaggtccaagctgttg

SEQ ID NO: 186617 - DNA, 30 bp, Artificial Sequence
  Description of Artificial Sequence: Synthetic oligonucleotide
tggatttcctggtgaggtccaagctgttgc

SEQ ID NO: 186618 - DNA, 29 bp, Artificial Sequence
  Description of Artificial Sequence: Synthetic oligonucleotide
ggatttcctggtgaggtccaagctgttgc

SEQ ID NO: 186619 - DNA, 30 bp, Artificial Sequence
  Description of Artificial Sequence: Synthetic oligonucleotide
gatttcctggtgaggtccaagctgttgctg

SEQ ID NO: 186620 - DNA, 32 bp, Artificial Sequence
  Description of Artificial Sequence: Synthetic oligonucleotide
atttcctggtgaggtccaagctgttgctgttg

SEQ ID NO: 186621 - DNA, 31 bp, Artificial Sequence
  Description of Artificial Sequence: Synthetic oligonucleotide
tttcctggtgaggtccaagctgttgctgttg

SEQ ID NO: 186622 - DNA, 30 bp, Artificial Sequence
  Description of Artificial Sequence: Synthetic oligonucleotide
ttcctggtgaggtccaagctgttgctgttg

SEQ ID NO: 186623 - DNA, 29 bp, Artificial Sequence
  Description of Artificial Sequence: Synthetic oligonucleotide
tcctggtgaggtccaagctgttgctgttg

SEQ ID NO: 186624 - DNA, 28 bp, Artificial Sequence
  Description of Artificial Sequence: Synthetic oligonucleotide
cctggtgaggtccaagctgttgctgttg

SEQ ID NO: 186625 - DNA, 29 bp, Artificial Sequence
  Description of Artificial Sequence: Synthetic oligonucleotide
ctggtgaggtccaagctgttgctgttgtc

SEQ ID NO: 186626 - DNA, 31 bp, Artificial Sequence
  Description of Artificial Sequence: Synthetic oligonucleotide
tggtgaggtccaagctgttgctgttgtcaac

SEQ ID NO: 186627 - DNA, 30 bp, Artificial Sequence
  Description of Artificial Sequence: Synthetic oligonucleotide
ggtgaggtccaagctgttgctgttgtcaac

SEQ ID NO: 186628 - DNA, 32 bp, Artificial Sequence
  Description of Artificial Sequence: Synthetic oligonucleotide
gtgaggtccaagctgttgctgttgtcaacatg

SEQ ID NO: 186629 - DNA, 33 bp, Artificial Sequence
  Description of Artificial Sequence: Synthetic oligonucleotide
tgaggtccaagctgttgctgttgtcaacatgtc

SEQ ID NO: 186630 - DNA, 32 bp, Artificial Sequence
  Description of Artificial Sequence: Synthetic oligonucleotide
gaggtccaagctgttgctgttgtcaacatgtc

SEQ ID NO: 186631 - DNA, 33 bp, Artificial Sequence
  Description of Artificial Sequence: Synthetic oligonucleotide
aggtccaagctgttgctgttgtcaacatgtctg

SEQ ID NO: 186632 - DNA, 32 bp, Artificial Sequence
  Description of Artificial Sequence: Synthetic oligonucleotide
ggtccaagctgttgctgttgtcaacatgtctg

SEQ ID NO: 186633 - DNA, 32 bp, Artificial Sequence
  Description of Artificial Sequence: Synthetic oligonucleotide
gtccaagctgttgctgttgtcaacatgtctgg

SEQ ID NO: 186634 - DNA, 32 bp, Artificial Sequence
  Description of Artificial Sequence: Synthetic oligonucleotide
tccaagctgttgctgttgtcaacatgtctggc

SEQ ID NO: 186635 - DNA, 31 bp, Artificial Sequence
  Description of Artificial Sequence: Synthetic oligonucleotide
ccaagctgttgctgttgtcaacatgtctggc

SEQ ID NO: 186636 - DNA, 31 bp, Artificial Sequence
  Description of Artificial Sequence: Synthetic oligonucleotide
caagctgttgctgttgtcaacatgtctggcc

SEQ ID NO: 186637 - DNA, 31 bp, Artificial Sequence
  Description of Artificial Sequence: Synthetic oligonucleotide
aagctgttgctgttgtcaacatgtctggccc

SEQ ID NO: 186638 - DNA, 30 bp, Artificial Sequence
  Description of Artificial Sequence: Synthetic oligonucleotide
agctgttgctgttgtcaacatgtctggccc

SEQ ID NO: 186639 - DNA, 29 bp, Artificial Sequence
  Description of Artificial Sequence: Synthetic oligonucleotide
gctgttgctgttgtcaacatgtctggccc

SEQ ID NO: 186640 - DNA, 30 bp, Artificial Sequence
  Description of Artificial Sequence: Synthetic oligonucleotide
ctgttgctgttgtcaacatgtctggcccag

SEQ ID NO: 186641 - DNA, 30 bp, Artificial Sequence
  Description of Artificial Sequence: Synthetic oligonucleotide
tgttgctgttgtcaacatgtctggcccagc

SEQ ID NO: 186642 - DNA, 29 bp, Artificial Sequence
  Description of Artificial Sequence: Synthetic oligonucleotide
gttgctgttgtcaacatgtctggcccagc

SEQ ID NO: 186643 - DNA, 30 bp, Artificial Sequence
  Description of Artificial Sequence: Synthetic oligonucleotide
ttgctgttgtcaacatgtctggcccagcag

SEQ ID NO: 186644 - DNA, 29 bp, Artificial Sequence
  Description of Artificial Sequence: Synthetic oligonucleotide
tgctgttgtcaacatgtctggcccagcag

SEQ ID NO: 186645 - DNA, 28 bp, Artificial Sequence
  Description of Artificial Sequence: Synthetic oligonucleotide
gctgttgtcaacatgtctggcccagcag

SEQ ID NO: 186646 - DNA, 28 bp, Artificial Sequence
  Description of Artificial Sequence: Synthetic oligonucleotide
ctgttgtcaacatgtctggcccagcagg

SEQ ID NO: 186647 - DNA, 28 bp, Artificial Sequence
  Description of Artificial Sequence: Synthetic oligonucleotide
tgttgtcaacatgtctggcccagcaggc

SEQ ID NO: 186648 - DNA, 27 bp, Artificial Sequence
  Description of Artificial Sequence: Synthetic oligonucleotide
gttgtcaacatgtctggcccagcaggc

SEQ ID NO: 186649 - DNA, 28 bp, Artificial Sequence
  Description of Artificial Sequence: Synthetic oligonucleotide
ttgtcaacatgtctggcccagcaggctc

SEQ ID NO: 186650 - DNA, 27 bp, Artificial Sequence
  Description of Artificial Sequence: Synthetic oligonucleotide
tgtcaacatgtctggcccagcaggctc

SEQ ID NO: 186651 - DNA, 27 bp, Artificial Sequence
  Description of Artificial Sequence: Synthetic oligonucleotide
gtcaacatgtctggcccagcaggctct

SEQ ID NO: 186652 - DNA, 27 bp, Artificial Sequence
  Description of Artificial Sequence: Synthetic oligonucleotide
tcaacatgtctggcccagcaggctctg

SEQ ID NO: 186653 - DNA, 26 bp, Artificial Sequence
  Description of Artificial Sequence: Synthetic oligonucleotide
caacatgtctggcccagcaggctctg

SEQ ID NO: 186654 - DNA, 27 bp, Artificial Sequence
  Description of Artificial Sequence: Synthetic oligonucleotide
aacatgtctggcccagcaggctctgga

SEQ ID NO: 186655 - DNA, 26 bp, Artificial Sequence
  Description of Artificial Sequence: Synthetic oligonucleotide
acatgtctggcccagcaggctctgga

SEQ ID NO: 186656 - DNA, 25 bp, Artificial Sequence
  Description of Artificial Sequence: Synthetic oligonucleotide
catgtctggcccagcaggctctgga

SEQ ID NO: 186657 - DNA, 25 bp, Artificial Sequence
  Description of Artificial Sequence: Synthetic oligonucleotide
atgtctggcccagcaggctctggac

SEQ ID NO: 186658 - DNA, 24 bp, Artificial Sequence
  Description of Artificial Sequence: Synthetic oligonucleotide
tgtctggcccagcaggctctggac

SEQ ID NO: 186659 - DNA, 23 bp, Artificial Sequence
  Description of Artificial Sequence: Synthetic oligonucleotide
gtctggcccagcaggctctggac

SEQ ID NO: 186660 - DNA, 24 bp, Artificial Sequence
  Description of Artificial Sequence: Synthetic oligonucleotide
tctggcccagcaggctctggacct

SEQ ID NO: 186661 - DNA, 23 bp, Artificial Sequence
  Description of Artificial Sequence: Synthetic oligonucleotide
ctggcccagcaggctctggacct

SEQ ID NO: 186662 - DNA, 23 bp, Artificial Sequence
  Description of Artificial Sequence: Synthetic oligonucleotide
tggcccagcaggctctggacctg

SEQ ID NO: 186663 - DNA, 22 bp, Artificial Sequence
  Description of Artificial Sequence: Synthetic oligonucleotide
ggcccagcaggctctggacctg

SEQ ID NO: 186664 - DNA, 23 bp, Artificial Sequence
  Description of Artificial Sequence: Synthetic oligonucleotide
gcccagcaggctctggacctgct

SEQ ID NO: 186665 - DNA, 23 bp, Artificial Sequence
  Description of Artificial Sequence: Synthetic oligonucleotide
cccagcaggctctggacctgctg

SEQ ID NO: 186666 - DNA, 24 bp, Artificial Sequence
  Description of Artificial Sequence: Synthetic oligonucleotide
ccagcaggctctggacctgctgct

SEQ ID NO: 186667 - DNA, 26 bp, Artificial Sequence
  Description of Artificial Sequence: Synthetic oligonucleotide
cagcaggctctggacctgctgctgaa

SEQ ID NO: 186668 - DNA, 26 bp, Artificial Sequence
  Description of Artificial Sequence: Synthetic oligonucleotide
agcaggctctggacctgctgctgaac

SEQ ID NO: 186669 - DNA, 25 bp, Artificial Sequence
  Description of Artificial Sequence: Synthetic oligonucleotide
gcaggctctggacctgctgctgaac

SEQ ID NO: 186670 - DNA, 26 bp, Artificial Sequence
  Description of Artificial Sequence: Synthetic oligonucleotide
caggctctggacctgctgctgaacct

SEQ ID NO: 186671 - DNA, 26 bp, Artificial Sequence
  Description of Artificial Sequence: Synthetic oligonucleotide
aggctctggacctgctgctgaacctg

SEQ ID NO: 186672 - DNA, 25 bp, Artificial Sequence
  Description of Artificial Sequence: Synthetic oligonucleotide
ggctctggacctgctgctgaacctg

SEQ ID NO: 186673 - DNA, 25 bp, Artificial Sequence
  Description of Artificial Sequence: Synthetic oligonucleotide
gctctggacctgctgctgaacctgg

SEQ ID NO: 186674 - DNA, 26 bp, Artificial Sequence
  Description of Artificial Sequence: Synthetic oligonucleotide
ctctggacctgctgctgaacctggca

SEQ ID NO: 186675 - DNA, 27 bp, Artificial Sequence
  Description of Artificial Sequence: Synthetic oligonucleotide
tctggacctgctgctgaacctggcaga

SEQ ID NO: 186676 - DNA, 27 bp, Artificial Sequence
  Description of Artificial Sequence: Synthetic oligonucleotide
ctggacctgctgctgaacctggcagaa

SEQ ID NO: 186677 - DNA, 27 bp, Artificial Sequence
  Description of Artificial Sequence: Synthetic oligonucleotide
tggacctgctgctgaacctggcagaag

SEQ ID NO: 186678 - DNA, 26 bp, Artificial Sequence
  Description of Artificial Sequence: Synthetic oligonucleotide
ggacctgctgctgaacctggcagaag

SEQ ID NO: 186679 - DNA, 26 bp, Artificial Sequence
  Description of Artificial Sequence: Synthetic oligonucleotide
gacctgctgctgaacctggcagaagc

SEQ ID NO: 186680 - DNA, 26 bp, Artificial Sequence
  Description of Artificial Sequence: Synthetic oligonucleotide
acctgctgctgaacctggcagaagcc

SEQ ID NO: 186681 - DNA, 25 bp, Artificial Sequence
  Description of Artificial Sequence: Synthetic oligonucleotide
cctgctgctgaacctggcagaagcc

SEQ ID NO: 186682 - DNA, 26 bp, Artificial Sequence
  Description of Artificial Sequence: Synthetic oligonucleotide
ctgctgctgaacctggcagaagccct

SEQ ID NO: 186683 - DNA, 26 bp, Artificial Sequence
  Description of Artificial Sequence: Synthetic oligonucleotide
tgctgctgaacctggcagaagccctg

SEQ ID NO: 186684 - DNA, 25 bp, Artificial Sequence
  Description of Artificial Sequence: Synthetic oligonucleotide
gctgctgaacctggcagaagccctg

SEQ ID NO: 186685 - DNA, 25 bp, Artificial Sequence
  Description of Artificial Sequence: Synthetic oligonucleotide
ctgctgaacctggcagaagccctgg

SEQ ID NO: 186686 - DNA, 27 bp, Artificial Sequence
  Description of Artificial Sequence: Synthetic oligonucleotide
tgctgaacctggcagaagccctggcaa

SEQ ID NO: 186687 - DNA, 27 bp, Artificial Sequence
  Description of Artificial Sequence: Synthetic oligonucleotide
gctgaacctggcagaagccctggcaat

SEQ ID NO: 186688 - DNA, 30 bp, Artificial Sequence
  Description of Artificial Sequence: Synthetic oligonucleotide
ctgaacctggcagaagccctggcaattttg

SEQ ID NO: 186689 - DNA, 30 bp, Artificial Sequence
  Description of Artificial Sequence: Synthetic oligonucleotide
tgaacctggcagaagccctggcaattttgc

SEQ ID NO: 186690 - DNA, 29 bp, Artificial Sequence
  Description of Artificial Sequence: Synthetic oligonucleotide
gaacctggcagaagccctggcaattttgc

SEQ ID NO: 186691 - DNA, 30 bp, Artificial Sequence
  Description of Artificial Sequence: Synthetic oligonucleotide
aacctggcagaagccctggcaattttgcac

SEQ ID NO: 186692 - DNA, 29 bp, Artificial Sequence
  Description of Artificial Sequence: Synthetic oligonucleotide
acctggcagaagccctggcaattttgcac

SEQ ID NO: 186693 - DNA, 28 bp, Artificial Sequence
  Description of Artificial Sequence: Synthetic oligonucleotide
cctggcagaagccctggcaattttgcac

SEQ ID NO: 186694 - DNA, 29 bp, Artificial Sequence
  Description of Artificial Sequence: Synthetic oligonucleotide
ctggcagaagccctggcaattttgcactg

SEQ ID NO: 186695 - DNA, 30 bp, Artificial Sequence
  Description of Artificial Sequence: Synthetic oligonucleotide
tggcagaagccctggcaattttgcactgtg

SEQ ID NO: 186696 - DNA, 29 bp, Artificial Sequence
  Description of Artificial Sequence: Synthetic oligonucleotide
ggcagaagccctggcaattttgcactgtg

SEQ ID NO: 186697 - DNA, 30 bp, Artificial Sequence
  Description of Artificial Sequence: Synthetic oligonucleotide
gcagaagccctggcaattttgcactgtgtg

SEQ ID NO: 186698 - DNA, 30 bp, Artificial Sequence
  Description of Artificial Sequence: Synthetic oligonucleotide
cagaagccctggcaattttgcactgtgtgg

SEQ ID NO: 186699 - DNA, 30 bp, Artificial Sequence
  Description of Artificial Sequence: Synthetic oligonucleotide
agaagccctggcaattttgcactgtgtggc

SEQ ID NO: 186700 - DNA, 29 bp, Artificial Sequence
  Description of Artificial Sequence: Synthetic oligonucleotide
gaagccctggcaattttgcactgtgtggc

SEQ ID NO: 186701 - DNA, 31 bp, Artificial Sequence
  Description of Artificial Sequence: Synthetic oligonucleotide
aagccctggcaattttgcactgtgtggctac

SEQ ID NO: 186702 - DNA, 30 bp, Artificial Sequence
  Description of Artificial Sequence: Synthetic oligonucleotide
agccctggcaattttgcactgtgtggctac

SEQ ID NO: 186703 - DNA, 29 bp, Artificial Sequence
  Description of Artificial Sequence: Synthetic oligonucleotide
gccctggcaattttgcactgtgtggctac

SEQ ID NO: 186704 - DNA, 29 bp, Artificial Sequence
  Description of Artificial Sequence: Synthetic oligonucleotide
ccctggcaattttgcactgtgtggctacg

SEQ ID NO: 186705 - DNA, 29 bp, Artificial Sequence
  Description of Artificial Sequence: Synthetic oligonucleotide
cctggcaattttgcactgtgtggctacgc

SEQ ID NO: 186706 - DNA, 29 bp, Artificial Sequence
  Description of Artificial Sequence: Synthetic oligonucleotide
ctggcaattttgcactgtgtggctacgcc

SEQ ID NO: 186707 - DNA, 29 bp, Artificial Sequence
  Description of Artificial Sequence: Synthetic oligonucleotide
tggcaattttgcactgtgtggctacgccc

SEQ ID NO: 186708 - DNA, 28 bp, Artificial Sequence
  Description of Artificial Sequence: Synthetic oligonucleotide
ggcaattttgcactgtgtggctacgccc

SEQ ID NO: 186709 - DNA, 28 bp, Artificial Sequence
  Description of Artificial Sequence: Synthetic oligonucleotide
gcaattttgcactgtgtggctacgcccc

SEQ ID NO: 186710 - DNA, 29 bp, Artificial Sequence
  Description of Artificial Sequence: Synthetic oligonucleotide
caattttgcactgtgtggctacgcccctg

SEQ ID NO: 186711 - DNA, 29 bp, Artificial Sequence
  Description of Artificial Sequence: Synthetic oligonucleotide
aattttgcactgtgtggctacgcccctgc

SEQ ID NO: 186712 - DNA, 28 bp, Artificial Sequence
  Description of Artificial Sequence: Synthetic oligonucleotide
attttgcactgtgtggctacgcccctgc

SEQ ID NO: 186713 - DNA, 27 bp, Artificial Sequence
  Description of Artificial Sequence: Synthetic oligonucleotide
ttttgcactgtgtggctacgcccctgc

SEQ ID NO: 186714 - DNA, 27 bp, Artificial Sequence
  Description of Artificial Sequence: Synthetic oligonucleotide
tttgcactgtgtggctacgcccctgct

SEQ ID NO: 186715 - DNA, 26 bp, Artificial Sequence
  Description of Artificial Sequence: Synthetic oligonucleotide
ttgcactgtgtggctacgcccctgct

SEQ ID NO: 186716 - DNA, 25 bp, Artificial Sequence
  Description of Artificial Sequence: Synthetic oligonucleotide
tgcactgtgtggctacgcccctgct

SEQ ID NO: 186717 - DNA, 24 bp, Artificial Sequence
  Description of Artificial Sequence: Synthetic oligonucleotide
gcactgtgtggctacgcccctgct

SEQ ID NO: 186718 - DNA, 24 bp, Artificial Sequence
  Description of Artificial Sequence: Synthetic oligonucleotide
cactgtgtggctacgcccctgctc

SEQ ID NO: 186719 - DNA, 25 bp, Artificial Sequence
  Description of Artificial Sequence: Synthetic oligonucleotide
actgtgtggctacgcccctgctcct

SEQ ID NO: 186720 - DNA, 24 bp, Artificial Sequence
  Description of Artificial Sequence: Synthetic oligonucleotide
ctgtgtggctacgcccctgctcct

SEQ ID NO: 186721 - DNA, 24 bp, Artificial Sequence
  Description of Artificial Sequence: Synthetic oligonucleotide
tgtgtggctacgcccctgctcctc

SEQ ID NO: 186722 - DNA, 23 bp, Artificial Sequence
  Description of Artificial Sequence: Synthetic oligonucleotide
gtgtggctacgcccctgctcctc

SEQ ID NO: 186723 - DNA, 23 bp, Artificial Sequence
  Description of Artificial Sequence: Synthetic oligonucleotide
tgtggctacgcccctgctcctcg

SEQ ID NO: 186724 - DNA, 22 bp, Artificial Sequence
  Description of Artificial Sequence: Synthetic oligonucleotide
gtggctacgcccctgctcctcg

SEQ ID NO: 186725 - DNA, 22 bp, Artificial Sequence
  Description of Artificial Sequence: Synthetic oligonucleotide
tggctacgcccctgctcctcgc

SEQ ID NO: 186726 - DNA, 21 bp, Artificial Sequence
  Description of Artificial Sequence: Synthetic oligonucleotide
ggctacgcccctgctcctcgc

SEQ ID NO: 186727 - DNA, 21 bp, Artificial Sequence
  Description of Artificial Sequence: Synthetic oligonucleotide
gctacgcccctgctcctcgcc

SEQ ID NO: 186728 - DNA, 25 bp, Artificial Sequence
  Description of Artificial Sequence: Synthetic oligonucleotide
ctacgcccctgctcctcgccctatt

SEQ ID NO: 186729 - DNA, 26 bp, Artificial Sequence
  Description of Artificial Sequence: Synthetic oligonucleotide
tacgcccctgctcctcgccctattct

SEQ ID NO: 186730 - DNA, 25 bp, Artificial Sequence
  Description of Artificial Sequence: Synthetic oligonucleotide
acgcccctgctcctcgccctattct

SEQ ID NO: 186731 - DNA, 24 bp, Artificial Sequence
  Description of Artificial Sequence: Synthetic oligonucleotide
cgcccctgctcctcgccctattct

SEQ ID NO: 186732 - DNA, 24 bp, Artificial Sequence
  Description of Artificial Sequence: Synthetic oligonucleotide
gcccctgctcctcgccctattctg

SEQ ID NO: 186733 - DNA, 24 bp, Artificial Sequence
  Description of Artificial Sequence: Synthetic oligonucleotide
cccctgctcctcgccctattctgc

SEQ ID NO: 186734 - DNA, 25 bp, Artificial Sequence
  Description of Artificial Sequence: Synthetic oligonucleotide
ccctgctcctcgccctattctgcca

SEQ ID NO: 186735 - DNA, 25 bp, Artificial Sequence
  Description of Artificial Sequence: Synthetic oligonucleotide
cctgctcctcgccctattctgccac

SEQ ID NO: 186736 - DNA, 26 bp, Artificial Sequence
  Description of Artificial Sequence: Synthetic oligonucleotide
ctgctcctcgccctattctgccacca

SEQ ID NO: 186737 - DNA, 26 bp, Artificial Sequence
  Description of Artificial Sequence: Synthetic oligonucleotide
tgctcctcgccctattctgccaccag

SEQ ID NO: 186738 - DNA, 25 bp, Artificial Sequence
  Description of Artificial Sequence: Synthetic oligonucleotide
gctcctcgccctattctgccaccag

SEQ ID NO: 186739 - DNA, 25 bp, Artificial Sequence
  Description of Artificial Sequence: Synthetic oligonucleotide
ctcctcgccctattctgccaccagg

SEQ ID NO: 186740 - DNA, 25 bp, Artificial Sequence
  Description of Artificial Sequence: Synthetic oligonucleotide
tcctcgccctattctgccaccaggc

SEQ ID NO: 186741 - DNA, 24 bp, Artificial Sequence
  Description of Artificial Sequence: Synthetic oligonucleotide
cctcgccctattctgccaccaggc

SEQ ID NO: 186742 - DNA, 25 bp, Artificial Sequence
  Description of Artificial Sequence: Synthetic oligonucleotide
ctcgccctattctgccaccaggcca

SEQ ID NO: 186743 - DNA, 25 bp, Artificial Sequence
  Description of Artificial Sequence: Synthetic oligonucleotide
tcgccctattctgccaccaggccac

SEQ ID NO: 186744 - DNA, 24 bp, Artificial Sequence
  Description of Artificial Sequence: Synthetic oligonucleotide
cgccctattctgccaccaggccac

SEQ ID NO: 186745 - DNA, 24 bp, Artificial Sequence
  Description of Artificial Sequence: Synthetic oligonucleotide
gccctattctgccaccaggccacc

SEQ ID NO: 186746 - DNA, 24 bp, Artificial Sequence
  Description of Artificial Sequence: Synthetic oligonucleotide
ccctattctgccaccaggccaccc

SEQ ID NO: 186747 - DNA, 24 bp, Artificial Sequence
  Description of Artificial Sequence: Synthetic oligonucleotide
cctattctgccaccaggccacccg

SEQ ID NO: 186748 - DNA, 25 bp, Artificial Sequence
  Description of Artificial Sequence: Synthetic oligonucleotide
ctattctgccaccaggccacccgca

SEQ ID NO: 186749 - DNA, 25 bp, Artificial Sequence
  Description of Artificial Sequence: Synthetic oligonucleotide
tattctgccaccaggccacccgcac

SEQ ID NO: 186750 - DNA, 24 bp, Artificial Sequence
  Description of Artificial Sequence: Synthetic oligonucleotide
attctgccaccaggccacccgcac

SEQ ID NO: 186751 - DNA, 23 bp, Artificial Sequence
  Description of Artificial Sequence: Synthetic oligonucleotide
ttctgccaccaggccacccgcac

SEQ ID NO: 186752 - DNA, 22 bp, Artificial Sequence
  Description of Artificial Sequence: Synthetic oligonucleotide
tctgccaccaggccacccgcac

SEQ ID NO: 186753 - DNA, 21 bp, Artificial Sequence
  Description of Artificial Sequence: Synthetic oligonucleotide
ctgccaccaggccacccgcac

SEQ ID NO: 186754 - DNA, 21 bp, Artificial Sequence
  Description of Artificial Sequence: Synthetic oligonucleotide
tgccaccaggccacccgcacc

SEQ ID NO: 186755 - DNA, 20 bp, Artificial Sequence
  Description of Artificial Sequence: Synthetic oligonucleotide
gccaccaggccacccgcacc

SEQ ID NO: 186756 - DNA, 21 bp, Artificial Sequence
  Description of Artificial Sequence: Synthetic oligonucleotide
ccaccaggccacccgcaccct

SEQ ID NO: 186757 - DNA, 23 bp, Artificial Sequence
  Description of Artificial Sequence: Synthetic oligonucleotide
caccaggccacccgcaccctctt

SEQ ID NO: 186758 - DNA, 23 bp, Artificial Sequence
  Description of Artificial Sequence: Synthetic oligonucleotide
accaggccacccgcaccctcttg

SEQ ID NO: 186759 - DNA, 22 bp, Artificial Sequence
  Description of Artificial Sequence: Synthetic oligonucleotide
ccaggccacccgcaccctcttg

SEQ ID NO: 186760 - DNA, 22 bp, Artificial Sequence
  Description of Artificial Sequence: Synthetic oligonucleotide
caggccacccgcaccctcttgc

SEQ ID NO: 186761 - DNA, 22 bp, Artificial Sequence
  Description of Artificial Sequence: Synthetic oligonucleotide
aggccacccgcaccctcttgcc

SEQ ID NO: 186762 - DNA, 21 bp, Artificial Sequence
  Description of Artificial Sequence: Synthetic oligonucleotide
ggccacccgcaccctcttgcc

SEQ ID NO: 186763 - DNA, 22 bp, Artificial Sequence
  Description of Artificial Sequence: Synthetic oligonucleotide
gccacccgcaccctcttgccct

SEQ ID NO: 186764 - DNA, 23 bp, Artificial Sequence
  Description of Artificial Sequence: Synthetic oligonucleotide
ccacccgcaccctcttgccctct

SEQ ID NO: 186765 - DNA, 24 bp, Artificial Sequence
  Description of Artificial Sequence: Synthetic oligonucleotide
cacccgcaccctcttgccctctct

SEQ ID NO: 186766 - DNA, 24 bp, Artificial Sequence
  Description of Artificial Sequence: Synthetic oligonucleotide
acccgcaccctcttgccctctctg

SEQ ID NO: 186767 - DNA, 23 bp, Artificial Sequence
  Description of Artificial Sequence: Synthetic oligonucleotide
cccgcaccctcttgccctctctg

SEQ ID NO: 186768 - DNA, 23 bp, Artificial Sequence
  Description of Artificial Sequence: Synthetic oligonucleotide
ccgcaccctcttgccctctctgc

SEQ ID NO: 186769 - DNA, 23 bp, Artificial Sequence
  Description of Artificial Sequence: Synthetic oligonucleotide
cgcaccctcttgccctctctgcc

SEQ ID NO: 186770 - DNA, 23 bp, Artificial Sequence
  Description of Artificial Sequence: Synthetic oligonucleotide
gcaccctcttgccctctctgccc

SEQ ID NO: 186771 - DNA, 24 bp, Artificial Sequence
  Description of Artificial Sequence: Synthetic oligonucleotide
caccctcttgccctctctgcccct

SEQ ID NO: 186772 - DNA, 24 bp, Artificial Sequence
  Description of Artificial Sequence: Synthetic oligonucleotide
accctcttgccctctctgcccctc

SEQ ID NO: 186773 - DNA, 23 bp, Artificial Sequence
  Description of Artificial Sequence: Synthetic oligonucleotide
ccctcttgccctctctgcccctc

SEQ ID NO: 186774 - DNA, 23 bp, Artificial Sequence
  Description of Artificial Sequence: Synthetic oligonucleotide
cctcttgccctctctgcccctcc

SEQ ID NO: 186775 - DNA, 24 bp, Artificial Sequence
  Description of Artificial Sequence: Synthetic oligonucleotide
ctcttgccctctctgcccctccct

SEQ ID NO: 186776 - DNA, 26 bp, Artificial Sequence
  Description of Artificial Sequence: Synthetic oligonucleotide
tcttgccctctctgcccctccctgaa

SEQ ID NO: 186777 - DNA, 25 bp, Artificial Sequence
  Description of Artificial Sequence: Synthetic oligonucleotide
cttgccctctctgcccctccctgaa

SEQ ID NO: 186778 - DNA, 25 bp, Artificial Sequence
  Description of Artificial Sequence: Synthetic oligonucleotide
ttgccctctctgcccctccctgaag

SEQ ID NO: 186779 - DNA, 24 bp, Artificial Sequence
  Description of Artificial Sequence: Synthetic oligonucleotide
tgccctctctgcccctccctgaag

SEQ ID NO: 186780 - DNA, 23 bp, Artificial Sequence
  Description of Artificial Sequence: Synthetic oligonucleotide
gccctctctgcccctccctgaag

SEQ ID NO: 186781 - DNA, 25 bp, Artificial Sequence
  Description of Artificial Sequence: Synthetic oligonucleotide
ccctctctgcccctccctgaaggat

SEQ ID NO: 186782 - DNA, 25 bp, Artificial Sequence
  Description of Artificial Sequence: Synthetic oligonucleotide
cctctctgcccctccctgaaggatg

SEQ ID NO: 186783 - DNA, 26 bp, Artificial Sequence
  Description of Artificial Sequence: Synthetic oligonucleotide
ctctctgcccctccctgaaggatggt

SEQ ID NO: 186784 - DNA, 27 bp, Artificial Sequence
  Description of Artificial Sequence: Synthetic oligonucleotide
tctctgcccctccctgaaggatggtct

SEQ ID NO: 186785 - DNA, 27 bp, Artificial Sequence
  Description of Artificial Sequence: Synthetic oligonucleotide
ctctgcccctccctgaaggatggtctt

SEQ ID NO: 186786 - DNA, 27 bp, Artificial Sequence
  Description of Artificial Sequence: Synthetic oligonucleotide
tctgcccctccctgaaggatggtcttc

SEQ ID NO: 186787 - DNA, 27 bp, Artificial Sequence
  Description of Artificial Sequence: Synthetic oligonucleotide
ctgcccctccctgaaggatggtcttct

SEQ ID NO: 186788 - DNA, 27 bp, Artificial Sequence
  Description of Artificial Sequence: Synthetic oligonucleotide
tgcccctccctgaaggatggtcttctc

SEQ ID NO: 186789 - DNA, 27 bp, Artificial Sequence
  Description of Artificial Sequence: Synthetic oligonucleotide
gcccctccctgaaggatggtcttctca

SEQ ID NO: 186790 - DNA, 28 bp, Artificial Sequence
  Description of Artificial Sequence: Synthetic oligonucleotide
cccctccctgaaggatggtcttctcatc

SEQ ID NO: 186791 - DNA, 29 bp, Artificial Sequence
  Description of Artificial Sequence: Synthetic oligonucleotide
ccctccctgaaggatggtcttctcatctg

SEQ ID NO: 186792 - DNA, 29 bp, Artificial Sequence
  Description of Artificial Sequence: Synthetic oligonucleotide
cctccctgaaggatggtcttctcatctgg

SEQ ID NO: 186793 - DNA, 30 bp, Artificial Sequence
  Description of Artificial Sequence: Synthetic oligonucleotide
ctccctgaaggatggtcttctcatctggac

SEQ ID NO: 186794 - DNA, 31 bp, Artificial Sequence
  Description of Artificial Sequence: Synthetic oligonucleotide
tccctgaaggatggtcttctcatctggacac

SEQ ID NO: 186795 - DNA, 30 bp, Artificial Sequence
  Description of Artificial Sequence: Synthetic oligonucleotide
ccctgaaggatggtcttctcatctggacac

SEQ ID NO: 186796 - DNA, 30 bp, Artificial Sequence
  Description of Artificial Sequence: Synthetic oligonucleotide
cctgaaggatggtcttctcatctggacacc

SEQ ID NO: 186797 - DNA, 30 bp, Artificial Sequence
  Description of Artificial Sequence: Synthetic oligonucleotide
ctgaaggatggtcttctcatctggacaccc

SEQ ID NO: 186798 - DNA, 32 bp, Artificial Sequence
  Description of Artificial Sequence: Synthetic oligonucleotide
tgaaggatggtcttctcatctggacacccttg

SEQ ID NO: 186799 - DNA, 31 bp, Artificial Sequence
  Description of Artificial Sequence: Synthetic oligonucleotide
gaaggatggtcttctcatctggacacccttg

SEQ ID NO: 186800 - DNA, 31 bp, Artificial Sequence
  Description of Artificial Sequence: Synthetic oligonucleotide
aaggatggtcttctcatctggacacccttgg

SEQ ID NO: 186801 - DNA, 30 bp, Artificial Sequence
  Description of Artificial Sequence: Synthetic oligonucleotide
aggatggtcttctcatctggacacccttgg

SEQ ID NO: 186802 - DNA, 29 bp, Artificial Sequence
  Description of Artificial Sequence: Synthetic oligonucleotide
ggatggtcttctcatctggacacccttgg

SEQ ID NO: 186803 - DNA, 31 bp, Artificial Sequence
  Description of Artificial Sequence: Synthetic oligonucleotide
gatggtcttctcatctggacacccttggaag

SEQ ID NO: 186804 - DNA, 31 bp, Artificial Sequence
  Description of Artificial Sequence: Synthetic oligonucleotide
atggtcttctcatctggacacccttggaagc

SEQ ID NO: 186805 - DNA, 30 bp, Artificial Sequence
  Description of Artificial Sequence: Synthetic oligonucleotide
tggtcttctcatctggacacccttggaagc

SEQ ID NO: 186806 - DNA, 29 bp, Artificial Sequence
  Description of Artificial Sequence: Synthetic oligonucleotide
ggtcttctcatctggacacccttggaagc

SEQ ID NO: 186807 - DNA, 33 bp, Artificial Sequence
  Description of Artificial Sequence: Synthetic oligonucleotide
gtcttctcatctggacacccttggaagcaaatc

SEQ ID NO: 186808 - DNA, 33 bp, Artificial Sequence
  Description of Artificial Sequence: Synthetic oligonucleotide
tcttctcatctggacacccttggaagcaaatcc

SEQ ID NO: 186809 - DNA, 32 bp, Artificial Sequence
  Description of Artificial Sequence: Synthetic oligonucleotide
cttctcatctggacacccttggaagcaaatcc

SEQ ID NO: 186810 - DNA, 34 bp, Artificial Sequence
  Description of Artificial Sequence: Synthetic oligonucleotide
ttctcatctggacacccttggaagcaaatcctag

SEQ ID NO: 186811 - DNA, 36 bp, Artificial Sequence
  Description of Artificial Sequence: Synthetic oligonucleotide
gtgtgaatgattccttcccagatggagactatgatg

SEQ ID NO: 186812 - DNA, 36 bp, Artificial Sequence
  Description of Artificial Sequence: Synthetic oligonucleotide
tgtgaatgattccttcccagatggagactatgatgc

SEQ ID NO: 186813 - DNA, 35 bp, Artificial Sequence
  Description of Artificial Sequence: Synthetic oligonucleotide
gtgaatgattccttcccagatggagactatgatgc

SEQ ID NO: 186814 - DNA, 35 bp, Artificial Sequence
  Description of Artificial Sequence: Synthetic oligonucleotide
tgaatgattccttcccagatggagactatgatgcc

SEQ ID NO: 186815 - DNA, 34 bp, Artificial Sequence
  Description of Artificial Sequence: Synthetic oligonucleotide
gaatgattccttcccagatggagactatgatgcc

SEQ ID NO: 186816 - DNA, 36 bp, Artificial Sequence
  Description of Artificial Sequence: Synthetic oligonucleotide
aatgattccttcccagatggagactatgatgccaac

SEQ ID NO: 186817 - DNA, 35 bp, Artificial Sequence
  Description of Artificial Sequence: Synthetic oligonucleotide
atgattccttcccagatggagactatgatgccaac

SEQ ID NO: 186818 - DNA, 34 bp, Artificial Sequence
  Description of Artificial Sequence: Synthetic oligonucleotide
tgattccttcccagatggagactatgatgccaac

SEQ ID NO: 186819 - DNA, 33 bp, Artificial Sequence
  Description of Artificial Sequence: Synthetic oligonucleotide
gattccttcccagatggagactatgatgccaac

SEQ ID NO: 186820 - DNA, 33 bp, Artificial Sequence
  Description of Artificial Sequence: Synthetic oligonucleotide
attccttcccagatggagactatgatgccaacc

SEQ ID NO: 186821 - DNA, 32 bp, Artificial Sequence
  Description of Artificial Sequence: Synthetic oligonucleotide
ttccttcccagatggagactatgatgccaacc

SEQ ID NO: 186822 - DNA, 31 bp, Artificial Sequence
  Description of Artificial Sequence: Synthetic oligonucleotide
tccttcccagatggagactatgatgccaacc

SEQ ID NO: 186823 - DNA, 30 bp, Artificial Sequence
  Description of Artificial Sequence: Synthetic oligonucleotide
ccttcccagatggagactatgatgccaacc

SEQ ID NO: 186824 - DNA, 31 bp, Artificial Sequence
  Description of Artificial Sequence: Synthetic oligonucleotide
cttcccagatggagactatgatgccaacctg

SEQ ID NO: 186825 - DNA, 31 bp, Artificial Sequence
  Description of Artificial Sequence: Synthetic oligonucleotide
ttcccagatggagactatgatgccaacctgg

SEQ ID NO: 186826 - DNA, 30 bp, Artificial Sequence
  Description of Artificial Sequence: Synthetic oligonucleotide
tcccagatggagactatgatgccaacctgg

SEQ ID NO: 186827 - DNA, 29 bp, Artificial Sequence
  Description of Artificial Sequence: Synthetic oligonucleotide
cccagatggagactatgatgccaacctgg

SEQ ID NO: 186828 - DNA, 31 bp, Artificial Sequence
  Description of Artificial Sequence: Synthetic oligonucleotide
ccagatggagactatgatgccaacctggaag

SEQ ID NO: 186829 - DNA, 31 bp, Artificial Sequence
  Description of Artificial Sequence: Synthetic oligonucleotide
cagatggagactatgatgccaacctggaagc

SEQ ID NO: 186830 - DNA, 32 bp, Artificial Sequence
  Description of Artificial Sequence: Synthetic oligonucleotide
agatggagactatgatgccaacctggaagcag

SEQ ID NO: 186831 - DNA, 31 bp, Artificial Sequence
  Description of Artificial Sequence: Synthetic oligonucleotide
gatggagactatgatgccaacctggaagcag

SEQ ID NO: 186832 - DNA, 31 bp, Artificial Sequence
  Description of Artificial Sequence: Synthetic oligonucleotide
atggagactatgatgccaacctggaagcagc

SEQ ID NO: 186833 - DNA, 30 bp, Artificial Sequence
  Description of Artificial Sequence: Synthetic oligonucleotide
tggagactatgatgccaacctggaagcagc

SEQ ID NO: 186834 - DNA, 29 bp, Artificial Sequence
  Description of Artificial Sequence: Synthetic oligonucleotide
ggagactatgatgccaacctggaagcagc

SEQ ID NO: 186835 - DNA, 30 bp, Artificial Sequence
  Description of Artificial Sequence: Synthetic oligonucleotide
gagactatgatgccaacctggaagcagctg

SEQ ID NO: 186836 - DNA, 30 bp, Artificial Sequence
  Description of Artificial Sequence: Synthetic oligonucleotide
agactatgatgccaacctggaagcagctgc

SEQ ID NO: 186837 - DNA, 29 bp, Artificial Sequence
  Description of Artificial Sequence: Synthetic oligonucleotide
gactatgatgccaacctggaagcagctgc

SEQ ID NO: 186838 - DNA, 29 bp, Artificial Sequence
  Description of Artificial Sequence: Synthetic oligonucleotide
actatgatgccaacctggaagcagctgcc

SEQ ID NO: 186839 - DNA, 28 bp, Artificial Sequence
  Description of Artificial Sequence: Synthetic oligonucleotide
ctatgatgccaacctggaagcagctgcc

SEQ ID NO: 186840 - DNA, 28 bp, Artificial Sequence
  Description of Artificial Sequence: Synthetic oligonucleotide
tatgatgccaacctggaagcagctgccc

SEQ ID NO: 186841 - DNA, 27 bp, Artificial Sequence
  Description of Artificial Sequence: Synthetic oligonucleotide
atgatgccaacctggaagcagctgccc

SEQ ID NO: 186842 - DNA, 26 bp, Artificial Sequence
  Description of Artificial Sequence: Synthetic oligonucleotide
tgatgccaacctggaagcagctgccc

SEQ ID NO: 186843 - DNA, 25 bp, Artificial Sequence
  Description of Artificial Sequence: Synthetic oligonucleotide
gatgccaacctggaagcagctgccc

SEQ ID NO: 186844 - DNA, 25 bp, Artificial Sequence
  Description of Artificial Sequence: Synthetic oligonucleotide
atgccaacctggaagcagctgcccc

SEQ ID NO: 186845 - DNA, 35 bp, Artificial Sequence
  Description of Artificial Sequence: Synthetic oligonucleotide
actgtcctcttcatgcttttcagacctctcttctg

SEQ ID NO: 186846 - DNA, 34 bp, Artificial Sequence
  Description of Artificial Sequence: Synthetic oligonucleotide
ctgtcctcttcatgcttttcagacctctcttctg

SEQ ID NO: 186847 - DNA, 34 bp, Artificial Sequence
  Description of Artificial Sequence: Synthetic oligonucleotide
tgtcctcttcatgcttttcagacctctcttctgc

SEQ ID NO: 186848 - DNA, 33 bp, Artificial Sequence
  Description of Artificial Sequence: Synthetic oligonucleotide
gtcctcttcatgcttttcagacctctcttctgc

SEQ ID NO: 186849 - DNA, 34 bp, Artificial Sequence
  Description of Artificial Sequence: Synthetic oligonucleotide
tcctcttcatgcttttcagacctctcttctgctg

SEQ ID NO: 186850 - DNA, 33 bp, Artificial Sequence
  Description of Artificial Sequence: Synthetic oligonucleotide
cctcttcatgcttttcagacctctcttctgctg

SEQ ID NO: 186851 - DNA, 33 bp, Artificial Sequence
  Description of Artificial Sequence: Synthetic oligonucleotide
ctcttcatgcttttcagacctctcttctgctgg

SEQ ID NO: 186852 - DNA, 33 bp, Artificial Sequence
  Description of Artificial Sequence: Synthetic oligonucleotide
tcttcatgcttttcagacctctcttctgctggc

SEQ ID NO: 186853 - DNA, 32 bp, Artificial Sequence
  Description of Artificial Sequence: Synthetic oligonucleotide
cttcatgcttttcagacctctcttctgctggc

SEQ ID NO: 186854 - DNA, 33 bp, Artificial Sequence
  Description of Artificial Sequence: Synthetic oligonucleotide
ttcatgcttttcagacctctcttctgctggcag

SEQ ID NO: 186855 - DNA, 32 bp, Artificial Sequence
  Description of Artificial Sequence: Synthetic oligonucleotide
tcatgcttttcagacctctcttctgctggcag

SEQ ID NO: 186856 - DNA, 31 bp, Artificial Sequence
  Description of Artificial Sequence: Synthetic oligonucleotide
catgcttttcagacctctcttctgctggcag

SEQ ID NO: 186857 - DNA, 31 bp, Artificial Sequence
  Description of Artificial Sequence: Synthetic oligonucleotide
atgcttttcagacctctcttctgctggcagc

SEQ ID NO: 186858 - DNA, 30 bp, Artificial Sequence
  Description of Artificial Sequence: Synthetic oligonucleotide
tgcttttcagacctctcttctgctggcagc

SEQ ID NO: 186859 - DNA, 29 bp, Artificial Sequence
  Description of Artificial Sequence: Synthetic oligonucleotide
gcttttcagacctctcttctgctggcagc

SEQ ID NO: 186860 - DNA, 30 bp, Artificial Sequence
  Description of Artificial Sequence: Synthetic oligonucleotide
cttttcagacctctcttctgctggcagctc

SEQ ID NO: 186861 - DNA, 31 bp, Artificial Sequence
  Description of Artificial Sequence: Synthetic oligonucleotide
ttttcagacctctcttctgctggcagctctg

SEQ ID NO: 186862 - DNA, 30 bp, Artificial Sequence
  Description of Artificial Sequence: Synthetic oligonucleotide
tttcagacctctcttctgctggcagctctg

SEQ ID NO: 186863 - DNA, 29 bp, Artificial Sequence
  Description of Artificial Sequence: Synthetic oligonucleotide
ttcagacctctcttctgctggcagctctg

SEQ ID NO: 186864 - DNA, 28 bp, Artificial Sequence
  Description of Artificial Sequence: Synthetic oligonucleotide
tcagacctctcttctgctggcagctctg

SEQ ID NO: 186865 - DNA, 27 bp, Artificial Sequence
  Description of Artificial Sequence: Synthetic oligonucleotide
cagacctctcttctgctggcagctctg

SEQ ID NO: 186866 - DNA, 27 bp, Artificial Sequence
  Description of Artificial Sequence: Synthetic oligonucleotide
agacctctcttctgctggcagctctgc

SEQ ID NO: 186867 - DNA, 26 bp, Artificial Sequence
  Description of Artificial Sequence: Synthetic oligonucleotide
gacctctcttctgctggcagctctgc

SEQ ID NO: 186868 - DNA, 26 bp, Artificial Sequence
  Description of Artificial Sequence: Synthetic oligonucleotide
acctctcttctgctggcagctctgcc

SEQ ID NO: 186869 - DNA, 25 bp, Artificial Sequence
  Description of Artificial Sequence: Synthetic oligonucleotide
cctctcttctgctggcagctctgcc

SEQ ID NO: 186870 - DNA, 26 bp, Artificial Sequence
  Description of Artificial Sequence: Synthetic oligonucleotide
ctctcttctgctggcagctctgccct

SEQ ID NO: 186871 - DNA, 26 bp, Artificial Sequence
  Description of Artificial Sequence: Synthetic oligonucleotide
tctcttctgctggcagctctgccctg

SEQ ID NO: 186872 - DNA, 25 bp, Artificial Sequence
  Description of Artificial Sequence: Synthetic oligonucleotide
ctcttctgctggcagctctgccctg

SEQ ID NO: 186873 - DNA, 25 bp, Artificial Sequence
  Description of Artificial Sequence: Synthetic oligonucleotide
tcttctgctggcagctctgccctgg

SEQ ID NO: 186874 - DNA, 24 bp, Artificial Sequence
  Description of Artificial Sequence: Synthetic oligonucleotide
cttctgctggcagctctgccctgg

SEQ ID NO: 186875 - DNA, 25 bp, Artificial Sequence
  Description of Artificial Sequence: Synthetic oligonucleotide
ttctgctggcagctctgccctggct

SEQ ID NO: 186876 - DNA, 24 bp, Artificial Sequence
  Description of Artificial Sequence: Synthetic oligonucleotide
tctgctggcagctctgccctggct

SEQ ID NO: 186877 - DNA, 23 bp, Artificial Sequence
  Description of Artificial Sequence: Synthetic oligonucleotide
ctgctggcagctctgccctggct

SEQ ID NO: 186878 - DNA, 23 bp, Artificial Sequence
  Description of Artificial Sequence: Synthetic oligonucleotide
tgctggcagctctgccctggctg

SEQ ID NO: 186879 - DNA, 24 bp, Artificial Sequence
  Description of Artificial Sequence: Synthetic oligonucleotide
tctgccctggctggcctgtcctga

SEQ ID NO: 186880 - DNA, 23 bp, Artificial Sequence
  Description of Artificial Sequence: Synthetic oligonucleotide
ctgccctggctggcctgtcctga

SEQ ID NO: 186881 - DNA, 24 bp, Artificial Sequence
  Description of Artificial Sequence: Synthetic oligonucleotide
tgccctggctggcctgtcctgaca

SEQ ID NO: 186882 - DNA, 23 bp, Artificial Sequence
  Description of Artificial Sequence: Synthetic oligonucleotide
gccctggctggcctgtcctgaca

SEQ ID NO: 186883 - DNA, 24 bp, Artificial Sequence
  Description of Artificial Sequence: Synthetic oligonucleotide
ccctggctggcctgtcctgacaca

SEQ ID NO: 186884 - DNA, 24 bp, Artificial Sequence
  Description of Artificial Sequence: Synthetic oligonucleotide
cctggctggcctgtcctgacacag

SEQ ID NO: 186885 - DNA, 25 bp, Artificial Sequence
  Description of Artificial Sequence: Synthetic oligonucleotide
ctggctggcctgtcctgacacagct

SEQ ID NO: 186886 - DNA, 25 bp, Artificial Sequence
  Description of Artificial Sequence: Synthetic oligonucleotide
tggctggcctgtcctgacacagctg

SEQ ID NO: 186887 - DNA, 24 bp, Artificial Sequence
  Description of Artificial Sequence: Synthetic oligonucleotide
ggctggcctgtcctgacacagctg

SEQ ID NO: 186888 - DNA, 24 bp, Artificial Sequence
  Description of Artificial Sequence: Synthetic oligonucleotide
gctggcctgtcctgacacagctgg

SEQ ID NO: 186889 - DNA, 25 bp, Artificial Sequence
  Description of Artificial Sequence: Synthetic oligonucleotide
ctggcctgtcctgacacagctggct

SEQ ID NO: 186890 - DNA, 26 bp, Artificial Sequence
  Description of Artificial Sequence: Synthetic oligonucleotide
tggcctgtcctgacacagctggctgt

SEQ ID NO: 186891 - DNA, 25 bp, Artificial Sequence
  Description of Artificial Sequence: Synthetic oligonucleotide
ggcctgtcctgacacagctggctgt

SEQ ID NO: 186892 - DNA, 25 bp, Artificial Sequence
  Description of Artificial Sequence: Synthetic oligonucleotide
gcctgtcctgacacagctggctgtg

SEQ ID NO: 186893 - DNA, 25 bp, Artificial Sequence
  Description of Artificial Sequence: Synthetic oligonucleotide
cctgtcctgacacagctggctgtgg

SEQ ID NO: 186894 - DNA, 25 bp, Artificial Sequence
  Description of Artificial Sequence: Synthetic oligonucleotide
ctgtcctgacacagctggctgtggg

SEQ ID NO: 186895 - DNA, 26 bp, Artificial Sequence
  Description of Artificial Sequence: Synthetic oligonucleotide
tgtcctgacacagctggctgtgggca

SEQ ID NO: 186896 - DNA, 25 bp, Artificial Sequence
  Description of Artificial Sequence: Synthetic oligonucleotide
gtcctgacacagctggctgtgggca

SEQ ID NO: 186897 - DNA, 26 bp, Artificial Sequence
  Description of Artificial Sequence: Synthetic oligonucleotide
tcctgacacagctggctgtgggcagt

SEQ ID NO: 186898 - DNA, 25 bp, Artificial Sequence
  Description of Artificial Sequence: Synthetic oligonucleotide
cctgacacagctggctgtgggcagt

SEQ ID NO: 186899 - DNA, 25 bp, Artificial Sequence
  Description of Artificial Sequence: Synthetic oligonucleotide
ctgacacagctggctgtgggcagtg

SEQ ID NO: 186900 - DNA, 25 bp, Artificial Sequence
  Description of Artificial Sequence: Synthetic oligonucleotide
tgacacagctggctgtgggcagtgc

SEQ ID NO: 186901 - DNA, 24 bp, Artificial Sequence
  Description of Artificial Sequence: Synthetic oligonucleotide
gacacagctggctgtgggcagtgc

SEQ ID NO: 186902 - DNA, 24 bp, Artificial Sequence
  Description of Artificial Sequence: Synthetic oligonucleotide
acacagctggctgtgggcagtgcc

SEQ ID NO: 186903 - DNA, 26 bp, Artificial Sequence
  Description of Artificial Sequence: Synthetic oligonucleotide
atggggaactgtctccacagggcgga

SEQ ID NO: 186904 - DNA, 25 bp, Artificial Sequence
  Description of Artificial Sequence: Synthetic oligonucleotide
tggggaactgtctccacagggcgga

SEQ ID NO: 186905 - DNA, 24 bp, Artificial Sequence
  Description of Artificial Sequence: Synthetic oligonucleotide
ggggaactgtctccacagggcgga

SEQ ID NO: 186906 - DNA, 24 bp, Artificial Sequence
  Description of Artificial Sequence: Synthetic oligonucleotide
gggaactgtctccacagggcggag

SEQ ID NO: 186907 - DNA, 25 bp, Artificial Sequence
  Description of Artificial Sequence: Synthetic oligonucleotide
ggaactgtctccacagggcggagct

SEQ ID NO: 186908 - DNA, 26 bp, Artificial Sequence
  Description of Artificial Sequence: Synthetic oligonucleotide
gaactgtctccacagggcggagctct

SEQ ID NO: 186909 - DNA, 26 bp, Artificial Sequence
  Description of Artificial Sequence: Synthetic oligonucleotide
aactgtctccacagggcggagctctc

SEQ ID NO: 186910 - DNA, 25 bp, Artificial Sequence
  Description of Artificial Sequence: Synthetic oligonucleotide
actgtctccacagggcggagctctc

SEQ ID NO: 186911 - DNA, 24 bp, Artificial Sequence
  Description of Artificial Sequence: Synthetic oligonucleotide
ctgtctccacagggcggagctctc

SEQ ID NO: 186912 - DNA, 24 bp, Artificial Sequence
  Description of Artificial Sequence: Synthetic oligonucleotide
tgtctccacagggcggagctctcc

SEQ ID NO: 186913 - DNA, 23 bp, Artificial Sequence
  Description of Artificial Sequence: Synthetic oligonucleotide
gtctccacagggcggagctctcc

SEQ ID NO: 186914 - DNA, 23 bp, Artificial Sequence
  Description of Artificial Sequence: Synthetic oligonucleotide
tctccacagggcggagctctccc

SEQ ID NO: 186915 - DNA, 22 bp, Artificial Sequence
  Description of Artificial Sequence: Synthetic oligonucleotide
ctccacagggcggagctctccc

SEQ ID NO: 186916 - DNA, 22 bp, Artificial Sequence
  Description of Artificial Sequence: Synthetic oligonucleotide
tccacagggcggagctctcccc

SEQ ID NO: 186917 - DNA, 21 bp, Artificial Sequence
  Description of Artificial Sequence: Synthetic oligonucleotide
ccacagggcggagctctcccc

SEQ ID NO: 186918 - DNA, 27 bp, Artificial Sequence
  Description of Artificial Sequence: Synthetic oligonucleotide
ccacacacactgtagcctgtcttgccg

SEQ ID NO: 186919 - DNA, 28 bp, Artificial Sequence
  Description of Artificial Sequence: Synthetic oligonucleotide
cacacacactgtagcctgtcttgccgtc

SEQ ID NO: 186920 - DNA, 31 bp, Artificial Sequence
  Description of Artificial Sequence: Synthetic oligonucleotide
acacacactgtagcctgtcttgccgtctttg

SEQ ID NO: 186921 - DNA, 30 bp, Artificial Sequence
  Description of Artificial Sequence: Synthetic oligonucleotide
cacacactgtagcctgtcttgccgtctttg

SEQ ID NO: 186922 - DNA, 31 bp, Artificial Sequence
  Description of Artificial Sequence: Synthetic oligonucleotide
acacactgtagcctgtcttgccgtctttgtc

SEQ ID NO: 186923 - DNA, 30 bp, Artificial Sequence
  Description of Artificial Sequence: Synthetic oligonucleotide
cacactgtagcctgtcttgccgtctttgtc

SEQ ID NO: 186924 - DNA, 32 bp, Artificial Sequence
  Description of Artificial Sequence: Synthetic oligonucleotide
acactgtagcctgtcttgccgtctttgtcttg

SEQ ID NO: 186925 - DNA, 31 bp, Artificial Sequence
  Description of Artificial Sequence: Synthetic oligonucleotide
cactgtagcctgtcttgccgtctttgtcttg

SEQ ID NO: 186926 - DNA, 33 bp, Artificial Sequence
  Description of Artificial Sequence: Synthetic oligonucleotide
actgtagcctgtcttgccgtctttgtcttgttg

SEQ ID NO: 186927 - DNA, 32 bp, Artificial Sequence
  Description of Artificial Sequence: Synthetic oligonucleotide
ctgtagcctgtcttgccgtctttgtcttgttg

SEQ ID NO: 186928 - DNA, 32 bp, Artificial Sequence
  Description of Artificial Sequence: Synthetic oligonucleotide
tgtagcctgtcttgccgtctttgtcttgttgc

SEQ ID NO: 186929 - DNA, 31 bp, Artificial Sequence
  Description of Artificial Sequence: Synthetic oligonucleotide
gtagcctgtcttgccgtctttgtcttgttgc

SEQ ID NO: 186930 - DNA, 31 bp, Artificial Sequence
  Description of Artificial Sequence: Synthetic oligonucleotide
tagcctgtcttgccgtctttgtcttgttgcc

SEQ ID NO: 186931 - DNA, 30 bp, Artificial Sequence
  Description of Artificial Sequence: Synthetic oligonucleotide
agcctgtcttgccgtctttgtcttgttgcc

SEQ ID NO: 186932 - DNA, 29 bp, Artificial Sequence
  Description of Artificial Sequence: Synthetic oligonucleotide
gcctgtcttgccgtctttgtcttgttgcc

SEQ ID NO: 186933 - DNA, 32 bp, Artificial Sequence
  Description of Artificial Sequence: Synthetic oligonucleotide
cctgtcttgccgtctttgtcttgttgccattg

SEQ ID NO: 186934 - DNA, 32 bp, Artificial Sequence
  Description of Artificial Sequence: Synthetic oligonucleotide
ctgtcttgccgtctttgtcttgttgccattgg

SEQ ID NO: 186935 - DNA, 32 bp, Artificial Sequence
  Description of Artificial Sequence: Synthetic oligonucleotide
tgtcttgccgtctttgtcttgttgccattggg

SEQ ID NO: 186936 - DNA, 31 bp, Artificial Sequence
  Description of Artificial Sequence: Synthetic oligonucleotide
gtcttgccgtctttgtcttgttgccattggg

SEQ ID NO: 186937 - DNA, 34 bp, Artificial Sequence
  Description of Artificial Sequence: Synthetic oligonucleotide
tcttgccgtctttgtcttgttgccattgggtttg

SEQ ID NO: 186938 - DNA, 33 bp, Artificial Sequence
  Description of Artificial Sequence: Synthetic oligonucleotide
cttgccgtctttgtcttgttgccattgggtttg

SEQ ID NO: 186939 - DNA, 36 bp, Artificial Sequence
  Description of Artificial Sequence: Synthetic oligonucleotide
ttgccgtctttgtcttgttgccattgggtttgtttg

SEQ ID NO: 186940 - DNA, 35 bp, Artificial Sequence
  Description of Artificial Sequence: Synthetic oligonucleotide
tgccgtctttgtcttgttgccattgggtttgtttg

SEQ ID NO: 186941 - DNA, 34 bp, Artificial Sequence
  Description of Artificial Sequence: Synthetic oligonucleotide
gccgtctttgtcttgttgccattgggtttgtttg

SEQ ID NO: 186942 - DNA, 34 bp, Artificial Sequence
  Description of Artificial Sequence: Synthetic oligonucleotide
ccgtctttgtcttgttgccattgggtttgtttgg

SEQ ID NO: 186943 - DNA, 35 bp, Artificial Sequence
  Description of Artificial Sequence: Synthetic oligonucleotide
cgtctttgtcttgttgccattgggtttgtttggag

SEQ ID NO: 186944 - DNA, 35 bp, Artificial Sequence
  Description of Artificial Sequence: Synthetic oligonucleotide
gtctttgtcttgttgccattgggtttgtttggagc

SEQ ID NO: 186945 - DNA, 25 bp, Artificial Sequence
  Description of Artificial Sequence: Synthetic oligonucleotide
gtatggggccaggcccctggatgaa

SEQ ID NO: 186946 - DNA, 27 bp, Artificial Sequence
  Description of Artificial Sequence: Synthetic oligonucleotide
tatggggccaggcccctggatgaacat

SEQ ID NO: 186947 - DNA, 26 bp, Artificial Sequence
  Description of Artificial Sequence: Synthetic oligonucleotide
atggggccaggcccctggatgaacat

SEQ ID NO: 186948 - DNA, 25 bp, Artificial Sequence
  Description of Artificial Sequence: Synthetic oligonucleotide
tggggccaggcccctggatgaacat

SEQ ID NO: 186949 - DNA, 24 bp, Artificial Sequence
  Description of Artificial Sequence: Synthetic oligonucleotide
ggggccaggcccctggatgaacat

SEQ ID NO: 186950 - DNA, 24 bp, Artificial Sequence
  Description of Artificial Sequence: Synthetic oligonucleotide
gggccaggcccctggatgaacatc

SEQ ID NO: 186951 - DNA, 25 bp, Artificial Sequence
  Description of Artificial Sequence: Synthetic oligonucleotide
ggccaggcccctggatgaacatcct

SEQ ID NO: 186952 - DNA, 26 bp, Artificial Sequence
  Description of Artificial Sequence: Synthetic oligonucleotide
gccaggcccctggatgaacatcctgt

SEQ ID NO: 186953 - DNA, 26 bp, Artificial Sequence
  Description of Artificial Sequence: Synthetic oligonucleotide
ccaggcccctggatgaacatcctgtg

SEQ ID NO: 186954 - DNA, 26 bp, Artificial Sequence
  Description of Artificial Sequence: Synthetic oligonucleotide
caggcccctggatgaacatcctgtgg

SEQ ID NO: 186955 - DNA, 26 bp, Artificial Sequence
  Description of Artificial Sequence: Synthetic oligonucleotide
aggcccctggatgaacatcctgtggg

SEQ ID NO: 186956 - DNA, 25 bp, Artificial Sequence
  Description of Artificial Sequence: Synthetic oligonucleotide
ggcccctggatgaacatcctgtggg

SEQ ID NO: 186957 - DNA, 25 bp, Artificial Sequence
  Description of Artificial Sequence: Synthetic oligonucleotide
gcccctggatgaacatcctgtgggc

SEQ ID NO: 186958 - DNA, 26 bp, Artificial Sequence
  Description of Artificial Sequence: Synthetic oligonucleotide
cccctggatgaacatcctgtgggcct

SEQ ID NO: 186959 - DNA, 26 bp, Artificial Sequence
  Description of Artificial Sequence: Synthetic oligonucleotide
ccctggatgaacatcctgtgggcctg

SEQ ID NO: 186960 - DNA, 27 bp, Artificial Sequence
  Description of Artificial Sequence: Synthetic oligonucleotide
cctggatgaacatcctgtgggcctggt

SEQ ID NO: 186961 - DNA, 34 bp, Artificial Sequence
  Description of Artificial Sequence: Synthetic oligonucleotide
ctggatgaacatcctgtgggcctggtttattttc

SEQ ID NO: 186962 - DNA, 35 bp, Artificial Sequence
  Description of Artificial Sequence: Synthetic oligonucleotide
tggatgaacatcctgtgggcctggtttattttctg

SEQ ID NO: 186963 - DNA, 34 bp, Artificial Sequence
  Description of Artificial Sequence: Synthetic oligonucleotide
ggatgaacatcctgtgggcctggtttattttctg

SEQ ID NO: 186964 - DNA, 34 bp, Artificial Sequence
  Description of Artificial Sequence: Synthetic oligonucleotide
gatgaacatcctgtgggcctggtttattttctgg

SEQ ID NO: 186965 - DNA, 35 bp, Artificial Sequence
  Description of Artificial Sequence: Synthetic oligonucleotide
atgaacatcctgtgggcctggtttattttctggtg

SEQ ID NO: 186966 - DNA, 34 bp, Artificial Sequence
  Description of Artificial Sequence: Synthetic oligonucleotide
tgaacatcctgtgggcctggtttattttctggtg

SEQ ID NO: 186967 - DNA, 33 bp, Artificial Sequence
  Description of Artificial Sequence: Synthetic oligonucleotide
gaacatcctgtgggcctggtttattttctggtg

SEQ ID NO: 186968 - DNA, 33 bp, Artificial Sequence
  Description of Artificial Sequence: Synthetic oligonucleotide
aacatcctgtgggcctggtttattttctggtgg

SEQ ID NO: 186969 - DNA, 32 bp, Artificial Sequence
  Description of Artificial Sequence: Synthetic oligonucleotide
acatcctgtgggcctggtttattttctggtgg

SEQ ID NO: 186970 - DNA, 31 bp, Artificial Sequence
  Description of Artificial Sequence: Synthetic oligonucleotide
catcctgtgggcctggtttattttctggtgg

SEQ ID NO: 186971 - DNA, 27 bp, Artificial Sequence
  Description of Artificial Sequence: Synthetic oligonucleotide
ctctctgcccctccctgaaggatggtt

SEQ ID NO: 186972 - DNA, 29 bp, Artificial Sequence
  Description of Artificial Sequence: Synthetic oligonucleotide
tctctgcccctccctgaaggatggttttc

SEQ ID NO: 186973 - DNA, 28 bp, Artificial Sequence
  Description of Artificial Sequence: Synthetic oligonucleotide
ctctgcccctccctgaaggatggttttc

SEQ ID NO: 186974 - DNA, 29 bp, Artificial Sequence
  Description of Artificial Sequence: Synthetic oligonucleotide
tctgcccctccctgaaggatggttttctc

SEQ ID NO: 186975 - DNA, 28 bp, Artificial Sequence
  Description of Artificial Sequence: Synthetic oligonucleotide
ctgcccctccctgaaggatggttttctc

SEQ ID NO: 186976 - DNA, 30 bp, Artificial Sequence
  Description of Artificial Sequence: Synthetic oligonucleotide
tgcccctccctgaaggatggttttctcatc

SEQ ID NO: 186977 - DNA, 29 bp, Artificial Sequence
  Description of Artificial Sequence: Synthetic oligonucleotide
gcccctccctgaaggatggttttctcatc

SEQ ID NO: 186978 - DNA, 30 bp, Artificial Sequence
  Description of Artificial Sequence: Synthetic oligonucleotide
cccctccctgaaggatggttttctcatctg

SEQ ID NO: 186979 - DNA, 30 bp, Artificial Sequence
  Description of Artificial Sequence: Synthetic oligonucleotide
ccctccctgaaggatggttttctcatctgg

SEQ ID NO: 186980 - DNA, 31 bp, Artificial Sequence
  Description of Artificial Sequence: Synthetic oligonucleotide
cctccctgaaggatggttttctcatctggac

SEQ ID NO: 186981 - DNA, 32 bp, Artificial Sequence
  Description of Artificial Sequence: Synthetic oligonucleotide
ctccctgaaggatggttttctcatctggacac

SEQ ID NO: 186982 - DNA, 32 bp, Artificial Sequence
  Description of Artificial Sequence: Synthetic oligonucleotide
tccctgaaggatggttttctcatctggacacc

SEQ ID NO: 186983 - DNA, 31 bp, Artificial Sequence
  Description of Artificial Sequence: Synthetic oligonucleotide
ccctgaaggatggttttctcatctggacacc

SEQ ID NO: 186984 - DNA, 31 bp, Artificial Sequence
  Description of Artificial Sequence: Synthetic oligonucleotide
cctgaaggatggttttctcatctggacaccc

SEQ ID NO: 186985 - DNA, 33 bp, Artificial Sequence
  Description of Artificial Sequence: Synthetic oligonucleotide
ctgaaggatggttttctcatctggacacccttg

SEQ ID NO: 186986 - DNA, 33 bp, Artificial Sequence
  Description of Artificial Sequence: Synthetic oligonucleotide
tgaaggatggttttctcatctggacacccttgg

SEQ ID NO: 186987 - DNA, 32 bp, Artificial Sequence
  Description of Artificial Sequence: Synthetic oligonucleotide
gaaggatggttttctcatctggacacccttgg

SEQ ID NO: 186988 - DNA, 34 bp, Artificial Sequence
  Description of Artificial Sequence: Synthetic oligonucleotide
aaggatggttttctcatctggacacccttggaag

SEQ ID NO: 186989 - DNA, 33 bp, Artificial Sequence
  Description of Artificial Sequence: Synthetic oligonucleotide
aggatggttttctcatctggacacccttggaag

SEQ ID NO: 186990 - DNA, 32 bp, Artificial Sequence
  Description of Artificial Sequence: Synthetic oligonucleotide
ggatggttttctcatctggacacccttggaag

SEQ ID NO: 186991 - DNA, 32 bp, Artificial Sequence
  Description of Artificial Sequence: Synthetic oligonucleotide
gatggttttctcatctggacacccttggaagc

SEQ ID NO: 186992 - DNA, 36 bp, Artificial Sequence
  Description of Artificial Sequence: Synthetic oligonucleotide
atggttttctcatctggacacccttggaagcaaatc

SEQ ID NO: 186993 - DNA, 35 bp, Artificial Sequence
  Description of Artificial Sequence: Synthetic oligonucleotide
tggttttctcatctggacacccttggaagcaaatc

SEQ ID NO: 186994 - DNA, 34 bp, Artificial Sequence
  Description of Artificial Sequence: Synthetic oligonucleotide
ggttttctcatctggacacccttggaagcaaatc

SEQ ID NO: 186995 - DNA, 34 bp, Artificial Sequence
  Description of Artificial Sequence: Synthetic oligonucleotide
gttttctcatctggacacccttggaagcaaatcc

SEQ ID NO: 186996 - DNA, 36 bp, Artificial Sequence
  Description of Artificial Sequence: Synthetic oligonucleotide
ttttctcatctggacacccttggaagcaaatcctag

SEQ ID NO: 186997 - DNA, 29 bp, Artificial Sequence
  Description of Artificial Sequence: Synthetic oligonucleotide
cagatggagactatggtgccaacctggag

SEQ ID NO: 186998 - DNA, 29 bp, Artificial Sequence
  Description of Artificial Sequence: Synthetic oligonucleotide
agatggagactatggtgccaacctggagg

SEQ ID NO: 186999 - DNA, 28 bp, Artificial Sequence
  Description of Artificial Sequence: Synthetic oligonucleotide
gatggagactatggtgccaacctggagg

SEQ ID NO: 187000 - DNA, 28 bp, Artificial Sequence
  Description of Artificial Sequence: Synthetic oligonucleotide
atggagactatggtgccaacctggaggc

SEQ ID NO: 187001 - DNA, 27 bp, Artificial Sequence
  Description of Artificial Sequence: Synthetic oligonucleotide
tggagactatggtgccaacctggaggc

SEQ ID NO: 187002 - DNA, 27 bp, Artificial Sequence
  Description of Artificial Sequence: Synthetic oligonucleotide
ggagactatggtgccaacctggaggca

SEQ ID NO: 187003 - DNA, 27 bp, Artificial Sequence
  Description of Artificial Sequence: Synthetic oligonucleotide
gagactatggtgccaacctggaggcag

SEQ ID NO: 187004 - DNA, 27 bp, Artificial Sequence
  Description of Artificial Sequence: Synthetic oligonucleotide
agactatggtgccaacctggaggcagc

SEQ ID NO: 187005 - DNA, 27 bp, Artificial Sequence
  Description of Artificial Sequence: Synthetic oligonucleotide
gactatggtgccaacctggaggcagct

SEQ ID NO: 187006 - DNA, 27 bp, Artificial Sequence
  Description of Artificial Sequence: Synthetic oligonucleotide
actatggtgccaacctggaggcagctg

SEQ ID NO: 187007 - DNA, 26 bp, Artificial Sequence
  Description of Artificial Sequence: Synthetic oligonucleotide
ctatggtgccaacctggaggcagctg

SEQ ID NO: 187008 - DNA, 26 bp, Artificial Sequence
  Description of Artificial Sequence: Synthetic oligonucleotide
tatggtgccaacctggaggcagctgc

SEQ ID NO: 187009 - DNA, 25 bp, Artificial Sequence
  Description of Artificial Sequence: Synthetic oligonucleotide
atggtgccaacctggaggcagctgc

SEQ ID NO: 187010 - DNA, 24 bp, Artificial Sequence
  Description of Artificial Sequence: Synthetic oligonucleotide
tggtgccaacctggaggcagctgc

SEQ ID NO: 187011 - DNA, 23 bp, Artificial Sequence
  Description of Artificial Sequence: Synthetic oligonucleotide
ggtgccaacctggaggcagctgc

SEQ ID NO: 187012 - DNA, 23 bp, Artificial Sequence
  Description of Artificial Sequence: Synthetic oligonucleotide
gtgccaacctggaggcagctgcc

SEQ ID NO: 187013 - DNA, 23 bp, Artificial Sequence
  Description of Artificial Sequence: Synthetic oligonucleotide
tgccaacctggaggcagctgccc

SEQ ID NO: 187014 - DNA, 22 bp, Artificial Sequence
  Description of Artificial Sequence: Synthetic oligonucleotide
gccaacctggaggcagctgccc

SEQ ID NO: 187015 - DNA, 22 bp, Artificial Sequence
  Description of Artificial Sequence: Synthetic oligonucleotide
ccaacctggaggcagctgcccc

SEQ ID NO: 187016 - DNA, 23 bp, Artificial Sequence
  Description of Artificial Sequence: Synthetic oligonucleotide
caacctggaggcagctgccccct

SEQ ID NO: 187017 - DNA, 23 bp, Artificial Sequence
  Description of Artificial Sequence: Synthetic oligonucleotide
aacctggaggcagctgccccctg

SEQ ID NO: 187018 - DNA, 22 bp, Artificial Sequence
  Description of Artificial Sequence: Synthetic oligonucleotide
acctggaggcagctgccccctg

SEQ ID NO: 187019 - DNA, 21 bp, Artificial Sequence
  Description of Artificial Sequence: Synthetic oligonucleotide
cctggaggcagctgccccctg

SEQ ID NO: 187020 - DNA, 21 bp, Artificial Sequence
  Description of Artificial Sequence: Synthetic oligonucleotide
ctggaggcagctgccccctgc

SEQ ID NO: 187021 - DNA, 22 bp, Artificial Sequence
  Description of Artificial Sequence: Synthetic oligonucleotide
tggaggcagctgccccctgcca

SEQ ID NO: 187022 - DNA, 21 bp, Artificial Sequence
  Description of Artificial Sequence: Synthetic oligonucleotide
ggaggcagctgccccctgcca

SEQ ID NO: 187023 - DNA, 22 bp, Artificial Sequence
  Description of Artificial Sequence: Synthetic oligonucleotide
gaggcagctgccccctgccact

SEQ ID NO: 187024 - DNA, 22 bp, Artificial Sequence
  Description of Artificial Sequence: Synthetic oligonucleotide
aggcagctgccccctgccactc

SEQ ID NO: 187025 - DNA, 21 bp, Artificial Sequence
  Description of Artificial Sequence: Synthetic oligonucleotide
ggcagctgccccctgccactc

SEQ ID NO: 187026 - DNA, 29 bp, Artificial Sequence
  Description of Artificial Sequence: Synthetic oligonucleotide
gatgactctgcactgcccttcttcatccc

SEQ ID NO: 187027 - DNA, 29 bp, Artificial Sequence
  Description of Artificial Sequence: Synthetic oligonucleotide
atgactctgcactgcccttcttcatcccc

SEQ ID NO: 187028 - DNA, 28 bp, Artificial Sequence
  Description of Artificial Sequence: Synthetic oligonucleotide
tgactctgcactgcccttcttcatcccc

SEQ ID NO: 187029 - DNA, 27 bp, Artificial Sequence
  Description of Artificial Sequence: Synthetic oligonucleotide
gactctgcactgcccttcttcatcccc

SEQ ID NO: 187030 - DNA, 28 bp, Artificial Sequence
  Description of Artificial Sequence: Synthetic oligonucleotide
actctgcactgcccttcttcatccccac

SEQ ID NO: 187031 - DNA, 27 bp, Artificial Sequence
  Description of Artificial Sequence: Synthetic oligonucleotide
ctctgcactgcccttcttcatccccac

SEQ ID NO: 187032 - DNA, 27 bp, Artificial Sequence
  Description of Artificial Sequence: Synthetic oligonucleotide
tctgcactgcccttcttcatccccacc

SEQ ID NO: 187033 - DNA, 27 bp, Artificial Sequence
  Description of Artificial Sequence: Synthetic oligonucleotide
ctgcactgcccttcttcatccccacca

SEQ ID NO: 187034 - DNA, 27 bp, Artificial Sequence
  Description of Artificial Sequence: Synthetic oligonucleotide
tgcactgcccttcttcatccccaccag

SEQ ID NO: 187035 - DNA, 27 bp, Artificial Sequence
  Description of Artificial Sequence: Synthetic oligonucleotide
gcactgcccttcttcatccccaccagt

SEQ ID NO: 187036 - DNA, 27 bp, Artificial Sequence
  Description of Artificial Sequence: Synthetic oligonucleotide
cactgcccttcttcatccccaccagtg

SEQ ID NO: 187037 - DNA, 28 bp, Artificial Sequence
  Description of Artificial Sequence: Synthetic oligonucleotide
actgcccttcttcatccccaccagtgtc

SEQ ID NO: 187038 - DNA, 27 bp, Artificial Sequence
  Description of Artificial Sequence: Synthetic oligonucleotide
ctgcccttcttcatccccaccagtgtc

SEQ ID NO: 187039 - DNA, 27 bp, Artificial Sequence
  Description of Artificial Sequence: Synthetic oligonucleotide
tgcccttcttcatccccaccagtgtcc

SEQ ID NO: 187040 - DNA, 27 bp, Artificial Sequence
  Description of Artificial Sequence: Synthetic oligonucleotide
gcccttcttcatccccaccagtgtcct

SEQ ID NO: 187041 - DNA, 27 bp, Artificial Sequence
  Description of Artificial Sequence: Synthetic oligonucleotide
cccttcttcatccccaccagtgtcctg

SEQ ID NO: 187042 - DNA, 27 bp, Artificial Sequence
  Description of Artificial Sequence: Synthetic oligonucleotide
ccttcttcatccccaccagtgtcctgg

SEQ ID NO: 187043 - DNA, 27 bp, Artificial Sequence
  Description of Artificial Sequence: Synthetic oligonucleotide
cttcttcatccccaccagtgtcctggg

SEQ ID NO: 187044 - DNA, 30 bp, Artificial Sequence
  Description of Artificial Sequence: Synthetic oligonucleotide
ttcttcatccccaccagtgtcctgggtatc

SEQ ID NO: 187045 - DNA, 29 bp, Artificial Sequence
  Description of Artificial Sequence: Synthetic oligonucleotide
tcttcatccccaccagtgtcctgggtatc

SEQ ID NO: 187046 - DNA, 28 bp, Artificial Sequence
  Description of Artificial Sequence: Synthetic oligonucleotide
cttcatccccaccagtgtcctgggtatc

SEQ ID NO: 187047 - DNA, 28 bp, Artificial Sequence
  Description of Artificial Sequence: Synthetic oligonucleotide
ttcatccccaccagtgtcctgggtatcc

SEQ ID NO: 187048 - DNA, 27 bp, Artificial Sequence
  Description of Artificial Sequence: Synthetic oligonucleotide
tcatccccaccagtgtcctgggtatcc

SEQ ID NO: 187049 - DNA, 27 bp, Artificial Sequence
  Description of Artificial Sequence: Synthetic oligonucleotide
catccccaccagtgtcctgggtatcct

SEQ ID NO: 187050 - DNA, 28 bp, Artificial Sequence
  Description of Artificial Sequence: Synthetic oligonucleotide
atccccaccagtgtcctgggtatcctag

SEQ ID NO: 187051 - DNA, 27 bp, Artificial Sequence
  Description of Artificial Sequence: Synthetic oligonucleotide
tccccaccagtgtcctgggtatcctag

SEQ ID NO: 187052 - DNA, 26 bp, Artificial Sequence
  Description of Artificial Sequence: Synthetic oligonucleotide
ccccaccagtgtcctgggtatcctag

SEQ ID NO: 187053 - DNA, 27 bp, Artificial Sequence
  Description of Artificial Sequence: Synthetic oligonucleotide
cccaccagtgtcctgggtatcctagct

SEQ ID NO: 187054 - DNA, 28 bp, Artificial Sequence
  Description of Artificial Sequence: Synthetic oligonucleotide
ccaccagtgtcctgggtatcctagctag

SEQ ID NO: 187055 - DNA, 22 bp, Artificial Sequence
  Description of Artificial Sequence: Synthetic oligonucleotide
cgctggcagctctgccctggca

SEQ ID NO: 187056 - DNA, 23 bp, Artificial Sequence
  Description of Artificial Sequence: Synthetic oligonucleotide
gctggcagctctgccctggcaca

SEQ ID NO: 187057 - DNA, 23 bp, Artificial Sequence
  Description of Artificial Sequence: Synthetic oligonucleotide
ctggcagctctgccctggcacag

SEQ ID NO: 187058 - DNA, 24 bp, Artificial Sequence
  Description of Artificial Sequence: Synthetic oligonucleotide
tggcagctctgccctggcacagct

SEQ ID NO: 187059 - DNA, 23 bp, Artificial Sequence
  Description of Artificial Sequence: Synthetic oligonucleotide
ggcagctctgccctggcacagct

SEQ ID NO: 187060 - DNA, 23 bp, Artificial Sequence
  Description of Artificial Sequence: Synthetic oligonucleotide
gcagctctgccctggcacagctg

SEQ ID NO: 187061 - DNA, 23 bp, Artificial Sequence
  Description of Artificial Sequence: Synthetic oligonucleotide
cagctctgccctggcacagctgg

SEQ ID NO: 187062 - DNA, 24 bp, Artificial Sequence
  Description of Artificial Sequence: Synthetic oligonucleotide
agctctgccctggcacagctggct

SEQ ID NO: 187063 - DNA, 23 bp, Artificial Sequence
  Description of Artificial Sequence: Synthetic oligonucleotide
gctctgccctggcacagctggct

SEQ ID NO: 187064 - DNA, 24 bp, Artificial Sequence
  Description of Artificial Sequence: Synthetic oligonucleotide
ctctgccctggcacagctggctgt

SEQ ID NO: 187065 - DNA, 24 bp, Artificial Sequence
  Description of Artificial Sequence: Synthetic oligonucleotide
tctgccctggcacagctggctgtg

SEQ ID NO: 187066 - DNA, 23 bp, Artificial Sequence
  Description of Artificial Sequence: Synthetic oligonucleotide
ctgccctggcacagctggctgtg

SEQ ID NO: 187067 - DNA, 23 bp, Artificial Sequence
  Description of Artificial Sequence: Synthetic oligonucleotide
tgccctggcacagctggctgtgg

SEQ ID NO: 187068 - DNA, 22 bp, Artificial Sequence
  Description of Artificial Sequence: Synthetic oligonucleotide
gccctggcacagctggctgtgg

SEQ ID NO: 187069 - DNA, 22 bp, Artificial Sequence
  Description of Artificial Sequence: Synthetic oligonucleotide
ccctggcacagctggctgtggg

SEQ ID NO: 187070 - DNA, 24 bp, Artificial Sequence
  Description of Artificial Sequence: Synthetic oligonucleotide
gtcttggccccagggctaggtagc

SEQ ID NO: 187071 - DNA, 27 bp, Artificial Sequence
  Description of Artificial Sequence: Synthetic oligonucleotide
atgtggtcgacgagaagccccaacagc

SEQ ID NO: 187072 - DNA, 27 bp, Artificial Sequence
  Description of Artificial Sequence: Synthetic oligonucleotide
tgtggtcgacgagaagccccaacagca

SEQ ID NO: 187073 - DNA, 26 bp, Artificial Sequence
  Description of Artificial Sequence: Synthetic oligonucleotide
gtggtcgacgagaagccccaacagca

SEQ ID NO: 187074 - DNA, 26 bp, Artificial Sequence
  Description of Artificial Sequence: Synthetic oligonucleotide
tggtcgacgagaagccccaacagcac

SEQ ID NO: 187075 - DNA, 25 bp, Artificial Sequence
  Description of Artificial Sequence: Synthetic oligonucleotide
ggtcgacgagaagccccaacagcac

SEQ ID NO: 187076 - DNA, 25 bp, Artificial Sequence
  Description of Artificial Sequence: Synthetic oligonucleotide
gtcgacgagaagccccaacagcacg

SEQ ID NO: 187077 - DNA, 25 bp, Artificial Sequence
  Description of Artificial Sequence: Synthetic oligonucleotide
tcgacgagaagccccaacagcacgg

SEQ ID NO: 187078 - DNA, 24 bp, Artificial Sequence
  Description of Artificial Sequence: Synthetic oligonucleotide
cgacgagaagccccaacagcacgg

SEQ ID NO: 187079 - DNA, 24 bp, Artificial Sequence
  Description of Artificial Sequence: Synthetic oligonucleotide
gacgagaagccccaacagcacggc

SEQ ID NO: 187080 - DNA, 25 bp, Artificial Sequence
  Description of Artificial Sequence: Synthetic oligonucleotide
acgagaagccccaacagcacggcgt

SEQ ID NO: 187081 - DNA, 24 bp, Artificial Sequence
  Description of Artificial Sequence: Synthetic oligonucleotide
cgagaagccccaacagcacggcgt

SEQ ID NO: 187082 - DNA, 24 bp, Artificial Sequence
  Description of Artificial Sequence: Synthetic oligonucleotide
gagaagccccaacagcacggcgtg

SEQ ID NO: 187083 - DNA, 24 bp, Artificial Sequence
  Description of Artificial Sequence: Synthetic oligonucleotide
agaagccccaacagcacggcgtgg

SEQ ID NO: 187084 - DNA, 23 bp, Artificial Sequence
  Description of Artificial Sequence: Synthetic oligonucleotide
gaagccccaacagcacggcgtgg

SEQ ID NO: 187085 - DNA, 23 bp, Artificial Sequence
  Description of Artificial Sequence: Synthetic oligonucleotide
aagccccaacagcacggcgtggc

SEQ ID NO: 187086 - DNA, 22 bp, Artificial Sequence
  Description of Artificial Sequence: Synthetic oligonucleotide
agccccaacagcacggcgtggc

SEQ ID NO: 187087 - DNA, 21 bp, Artificial Sequence
  Description of Artificial Sequence: Synthetic oligonucleotide
gccccaacagcacggcgtggc

SEQ ID NO: 187088 - DNA, 22 bp, Artificial Sequence
  Description of Artificial Sequence: Synthetic oligonucleotide
ccccaacagcacggcgtggcct

SEQ ID NO: 187089 - DNA, 23 bp, Artificial Sequence
  Description of Artificial Sequence: Synthetic oligonucleotide
cccaacagcacggcgtggcctct

SEQ ID NO: 187090 - DNA, 24 bp, Artificial Sequence
  Description of Artificial Sequence: Synthetic oligonucleotide
ccaacagcacggcgtggcctctca

SEQ ID NO: 187091 - DNA, 24 bp, Artificial Sequence
  Description of Artificial Sequence: Synthetic oligonucleotide
caacagcacggcgtggcctctcag

SEQ ID NO: 187092 - DNA, 24 bp, Artificial Sequence
  Description of Artificial Sequence: Synthetic oligonucleotide
aacagcacggcgtggcctctcagc

SEQ ID NO: 187093 - DNA, 23 bp, Artificial Sequence
  Description of Artificial Sequence: Synthetic oligonucleotide
acagcacggcgtggcctctcagc

SEQ ID NO: 187094 - DNA, 22 bp, Artificial Sequence
  Description of Artificial Sequence: Synthetic oligonucleotide
cagcacggcgtggcctctcagc

SEQ ID NO: 187095 - DNA, 23 bp, Artificial Sequence
  Description of Artificial Sequence: Synthetic oligonucleotide
agcacggcgtggcctctcagcct

SEQ ID NO: 187096 - DNA, 22 bp, Artificial Sequence
  Description of Artificial Sequence: Synthetic oligonucleotide
gcacggcgtggcctctcagcct

SEQ ID NO: 187097 - DNA, 22 bp, Artificial Sequence
  Description of Artificial Sequence: Synthetic oligonucleotide
cacggcgtggcctctcagcctc

SEQ ID NO: 187098 - DNA, 23 bp, Artificial Sequence
  Description of Artificial Sequence: Synthetic oligonucleotide
acggcgtggcctctcagcctcga

SEQ ID NO: 187099 - DNA, 22 bp, Artificial Sequence
  Description of Artificial Sequence: Synthetic oligonucleotide
cggcgtggcctctcagcctcga

SEQ ID NO: 187100 - DNA, 22 bp, Artificial Sequence
  Description of Artificial Sequence: Synthetic oligonucleotide
ggcgtggcctctcagcctcgag

SEQ ID NO: 187101 - DNA, 22 bp, Artificial Sequence
  Description of Artificial Sequence: Synthetic oligonucleotide
gcgtggcctctcagcctcgagc

SEQ ID NO: 187102 - DNA, 23 bp, Artificial Sequence
  Description of Artificial Sequence: Synthetic oligonucleotide
cgtggcctctcagcctcgagcct

SEQ ID NO: 187103 - DNA, 25 bp, Artificial Sequence
  Description of Artificial Sequence: Synthetic oligonucleotide
gtggcctctcagcctcgagcctgat

SEQ ID NO: 187104 - DNA, 25 bp, Artificial Sequence
  Description of Artificial Sequence: Synthetic oligonucleotide
tggcctctcagcctcgagcctgatc

SEQ ID NO: 187105 - DNA, 24 bp, Artificial Sequence
  Description of Artificial Sequence: Synthetic oligonucleotide
ggcctctcagcctcgagcctgatc

SEQ ID NO: 187106 - DNA, 24 bp, Artificial Sequence
  Description of Artificial Sequence: Synthetic oligonucleotide
gcctctcagcctcgagcctgatcc

SEQ ID NO: 187107 - DNA, 24 bp, Artificial Sequence
  Description of Artificial Sequence: Synthetic oligonucleotide
cctctcagcctcgagcctgatccg

SEQ ID NO: 187108 - DNA, 24 bp, Artificial Sequence
  Description of Artificial Sequence: Synthetic oligonucleotide
ctctcagcctcgagcctgatccgg

SEQ ID NO: 187109 - DNA, 24 bp, Artificial Sequence
  Description of Artificial Sequence: Synthetic oligonucleotide
tctcagcctcgagcctgatccggg

SEQ ID NO: 187110 - DNA, 23 bp, Artificial Sequence
  Description of Artificial Sequence: Synthetic oligonucleotide
ctcagcctcgagcctgatccggg

SEQ ID NO: 187111 - DNA, 25 bp, Artificial Sequence
  Description of Artificial Sequence: Synthetic oligonucleotide
tcagcctcgagcctgatccggggat

SEQ ID NO: 187112 - DNA, 24 bp, Artificial Sequence
  Description of Artificial Sequence: Synthetic oligonucleotide
cagcctcgagcctgatccggggat

SEQ ID NO: 187113 - DNA, 24 bp, Artificial Sequence
  Description of Artificial Sequence: Synthetic oligonucleotide
agcctcgagcctgatccggggatg

SEQ ID NO: 187114 - DNA, 23 bp, Artificial Sequence
  Description of Artificial Sequence: Synthetic oligonucleotide
gcctcgagcctgatccggggatg

SEQ ID NO: 187115 - DNA, 23 bp, Artificial Sequence
  Description of Artificial Sequence: Synthetic oligonucleotide
cctcgagcctgatccggggatgg

SEQ ID NO: 187116 - DNA, 23 bp, Artificial Sequence
  Description of Artificial Sequence: Synthetic oligonucleotide
ctcgagcctgatccggggatggc

SEQ ID NO: 187117 - DNA, 24 bp, Artificial Sequence
  Description of Artificial Sequence: Synthetic oligonucleotide
tcgagcctgatccggggatggcct

SEQ ID NO: 187118 - DNA, 23 bp, Artificial Sequence
  Description of Artificial Sequence: Synthetic oligonucleotide
cgagcctgatccggggatggcct

SEQ ID NO: 187119 - DNA, 24 bp, Artificial Sequence
  Description of Artificial Sequence: Synthetic oligonucleotide
gagcctgatccggggatggcctct

SEQ ID NO: 187120 - DNA, 24 bp, Artificial Sequence
  Description of Artificial Sequence: Synthetic oligonucleotide
agcctgatccggggatggcctctg

SEQ ID NO: 187121 - DNA, 23 bp, Artificial Sequence
  Description of Artificial Sequence: Synthetic oligonucleotide
gcctgatccggggatggcctctg

SEQ ID NO: 187122 - DNA, 23 bp, Artificial Sequence
  Description of Artificial Sequence: Synthetic oligonucleotide
cctgatccggggatggcctctgc

SEQ ID NO: 187123 - DNA, 24 bp, Artificial Sequence
  Description of Artificial Sequence: Synthetic oligonucleotide
ctgatccggggatggcctctgcct

SEQ ID NO: 187124 - DNA, 24 bp, Artificial Sequence
  Description of Artificial Sequence: Synthetic oligonucleotide
tgatccggggatggcctctgcctc

SEQ ID NO: 187125 - DNA, 23 bp, Artificial Sequence
  Description of Artificial Sequence: Synthetic oligonucleotide
gatccggggatggcctctgcctc

SEQ ID NO: 187126 - DNA, 24 bp, Artificial Sequence
  Description of Artificial Sequence: Synthetic oligonucleotide
atccggggatggcctctgcctcca

SEQ ID NO: 187127 - DNA, 23 bp, Artificial Sequence
  Description of Artificial Sequence: Synthetic oligonucleotide
tccggggatggcctctgcctcca

SEQ ID NO: 187128 - DNA, 22 bp, Artificial Sequence
  Description of Artificial Sequence: Synthetic oligonucleotide
ccggggatggcctctgcctcca

SEQ ID NO: 187129 - DNA, 22 bp, Artificial Sequence
  Description of Artificial Sequence: Synthetic oligonucleotide
cggggatggcctctgcctccac

SEQ ID NO: 187130 - DNA, 23 bp, Artificial Sequence
  Description of Artificial Sequence: Synthetic oligonucleotide
ggggatggcctctgcctccacca

SEQ ID NO: 187131 - DNA, 26 bp, Artificial Sequence
  Description of Artificial Sequence: Synthetic oligonucleotide
gggatggcctctgcctccaccacaat

SEQ ID NO: 187132 - DNA, 26 bp, Artificial Sequence
  Description of Artificial Sequence: Synthetic oligonucleotide
ggatggcctctgcctccaccacaatg

SEQ ID NO: 187133 - DNA, 27 bp, Artificial Sequence
  Description of Artificial Sequence: Synthetic oligonucleotide
gatggcctctgcctccaccacaatgca

SEQ ID NO: 187134 - DNA, 29 bp, Artificial Sequence
  Description of Artificial Sequence: Synthetic oligonucleotide
atggcctctgcctccaccacaatgcatac

SEQ ID NO: 187135 - DNA, 28 bp, Artificial Sequence
  Description of Artificial Sequence: Synthetic oligonucleotide
tggcctctgcctccaccacaatgcatac

SEQ ID NO: 187136 - DNA, 27 bp, Artificial Sequence
  Description of Artificial Sequence: Synthetic oligonucleotide
ggcctctgcctccaccacaatgcatac

SEQ ID NO: 187137 - DNA, 29 bp, Artificial Sequence
  Description of Artificial Sequence: Synthetic oligonucleotide
gcctctgcctccaccacaatgcatactac

SEQ ID NO: 187138 - DNA, 29 bp, Artificial Sequence
  Description of Artificial Sequence: Synthetic oligonucleotide
cctctgcctccaccacaatgcatactacc

SEQ ID NO: 187139 - DNA, 30 bp, Artificial Sequence
  Description of Artificial Sequence: Synthetic oligonucleotide
ctctgcctccaccacaatgcatactaccac

SEQ ID NO: 187140 - DNA, 30 bp, Artificial Sequence
  Description of Artificial Sequence: Synthetic oligonucleotide
tctgcctccaccacaatgcatactaccacc

SEQ ID NO: 187141 - DNA, 29 bp, Artificial Sequence
  Description of Artificial Sequence: Synthetic oligonucleotide
ctgcctccaccacaatgcatactaccacc

SEQ ID NO: 187142 - DNA, 32 bp, Artificial Sequence
  Description of Artificial Sequence: Synthetic oligonucleotide
tgcctccaccacaatgcatactaccaccattg

SEQ ID NO: 187143 - DNA, 31 bp, Artificial Sequence
  Description of Artificial Sequence: Synthetic oligonucleotide
gcctccaccacaatgcatactaccaccattg

SEQ ID NO: 187144 - DNA, 31 bp, Artificial Sequence
  Description of Artificial Sequence: Synthetic oligonucleotide
cctccaccacaatgcatactaccaccattgc

SEQ ID NO: 187145 - DNA, 32 bp, Artificial Sequence
  Description of Artificial Sequence: Synthetic oligonucleotide
ctccaccacaatgcatactaccaccattgcag

SEQ ID NO: 187146 - DNA, 33 bp, Artificial Sequence
  Description of Artificial Sequence: Synthetic oligonucleotide
tccaccacaatgcatactaccaccattgcagag

SEQ ID NO: 187147 - DNA, 32 bp, Artificial Sequence
  Description of Artificial Sequence: Synthetic oligonucleotide
ccaccacaatgcatactaccaccattgcagag

SEQ ID NO: 187148 - DNA, 32 bp, Artificial Sequence
  Description of Artificial Sequence: Synthetic oligonucleotide
caccacaatgcatactaccaccattgcagagc

SEQ ID NO: 187149 - DNA, 32 bp, Artificial Sequence
  Description of Artificial Sequence: Synthetic oligonucleotide
accacaatgcatactaccaccattgcagagcc

SEQ ID NO: 187150 - DNA, 31 bp, Artificial Sequence
  Description of Artificial Sequence: Synthetic oligonucleotide
ccacaatgcatactaccaccattgcagagcc

SEQ ID NO: 187151 - DNA, 32 bp, Artificial Sequence
  Description of Artificial Sequence: Synthetic oligonucleotide
cacaatgcatactaccaccattgcagagcctg

SEQ ID NO: 187152 - DNA, 34 bp, Artificial Sequence
  Description of Artificial Sequence: Synthetic oligonucleotide
acaatgcatactaccaccattgcagagcctgatc

SEQ ID NO: 187153 - DNA, 33 bp, Artificial Sequence
  Description of Artificial Sequence: Synthetic oligonucleotide
caatgcatactaccaccattgcagagcctgatc

SEQ ID NO: 187154 - DNA, 33 bp, Artificial Sequence
  Description of Artificial Sequence: Synthetic oligonucleotide
aatgcatactaccaccattgcagagcctgatcc

SEQ ID NO: 187155 - DNA, 32 bp, Artificial Sequence
  Description of Artificial Sequence: Synthetic oligonucleotide
atgcatactaccaccattgcagagcctgatcc

SEQ ID NO: 187156 - DNA, 31 bp, Artificial Sequence
  Description of Artificial Sequence: Synthetic oligonucleotide
tgcatactaccaccattgcagagcctgatcc

SEQ ID NO: 187157 - DNA, 30 bp, Artificial Sequence
  Description of Artificial Sequence: Synthetic oligonucleotide
gcatactaccaccattgcagagcctgatcc

SEQ ID NO: 187158 - DNA, 31 bp, Artificial Sequence
  Description of Artificial Sequence: Synthetic oligonucleotide
catactaccaccattgcagagcctgatccag

SEQ ID NO: 187159 - DNA, 31 bp, Artificial Sequence
  Description of Artificial Sequence: Synthetic oligonucleotide
atactaccaccattgcagagcctgatccagg

SEQ ID NO: 187160 - DNA, 30 bp, Artificial Sequence
  Description of Artificial Sequence: Synthetic oligonucleotide
tactaccaccattgcagagcctgatccagg

SEQ ID NO: 187161 - DNA, 29 bp, Artificial Sequence
  Description of Artificial Sequence: Synthetic oligonucleotide
actaccaccattgcagagcctgatccagg

SEQ ID NO: 187162 - DNA, 28 bp, Artificial Sequence
  Description of Artificial Sequence: Synthetic oligonucleotide
ctaccaccattgcagagcctgatccagg

SEQ ID NO: 187163 - DNA, 28 bp, Artificial Sequence
  Description of Artificial Sequence: Synthetic oligonucleotide
taccaccattgcagagcctgatccaggg

SEQ ID NO: 187164 - DNA, 27 bp, Artificial Sequence
  Description of Artificial Sequence: Synthetic oligonucleotide
accaccattgcagagcctgatccaggg

SEQ ID NO: 187165 - DNA, 27 bp, Artificial Sequence
  Description of Artificial Sequence: Synthetic oligonucleotide
ccaccattgcagagcctgatccaggga

SEQ ID NO: 187166 - DNA, 28 bp, Artificial Sequence
  Description of Artificial Sequence: Synthetic oligonucleotide
caccattgcagagcctgatccagggatg

SEQ ID NO: 187167 - DNA, 29 bp, Artificial Sequence
  Description of Artificial Sequence: Synthetic oligonucleotide
accattgcagagcctgatccagggatgtc

SEQ ID NO: 187168 - DNA, 28 bp, Artificial Sequence
  Description of Artificial Sequence: Synthetic oligonucleotide
ccattgcagagcctgatccagggatgtc

SEQ ID NO: 187169 - DNA, 29 bp, Artificial Sequence
  Description of Artificial Sequence: Synthetic oligonucleotide
cattgcagagcctgatccagggatgtctg

SEQ ID NO: 187170 - DNA, 29 bp, Artificial Sequence
  Description of Artificial Sequence: Synthetic oligonucleotide
attgcagagcctgatccagggatgtctgg

SEQ ID NO: 187171 - DNA, 28 bp, Artificial Sequence
  Description of Artificial Sequence: Synthetic oligonucleotide
ttgcagagcctgatccagggatgtctgg

SEQ ID NO: 187172 - DNA, 27 bp, Artificial Sequence
  Description of Artificial Sequence: Synthetic oligonucleotide
tgcagagcctgatccagggatgtctgg

SEQ ID NO: 187173 - DNA, 27 bp, Artificial Sequence
  Description of Artificial Sequence: Synthetic oligonucleotide
gcagagcctgatccagggatgtctgga

SEQ ID NO: 187174 - DNA, 28 bp, Artificial Sequence
  Description of Artificial Sequence: Synthetic oligonucleotide
cagagcctgatccagggatgtctggatg

SEQ ID NO: 187175 - DNA, 28 bp, Artificial Sequence
  Description of Artificial Sequence: Synthetic oligonucleotide
agagcctgatccagggatgtctggatgg

SEQ ID NO: 187176 - DNA, 27 bp, Artificial Sequence
  Description of Artificial Sequence: Synthetic oligonucleotide
gagcctgatccagggatgtctggatgg

SEQ ID NO: 187177 - DNA, 27 bp, Artificial Sequence
  Description of Artificial Sequence: Synthetic oligonucleotide
agcctgatccagggatgtctggatggc

SEQ ID NO: 187178 - DNA, 26 bp, Artificial Sequence
  Description of Artificial Sequence: Synthetic oligonucleotide
gcctgatccagggatgtctggatggc

SEQ ID NO: 187179 - DNA, 26 bp, Artificial Sequence
  Description of Artificial Sequence: Synthetic oligonucleotide
cctgatccagggatgtctggatggcc

SEQ ID NO: 187180 - DNA, 26 bp, Artificial Sequence
  Description of Artificial Sequence: Synthetic oligonucleotide
ctgatccagggatgtctggatggccg

SEQ ID NO: 187181 - DNA, 27 bp, Artificial Sequence
  Description of Artificial Sequence: Synthetic oligonucleotide
tgatccagggatgtctggatggccgga

SEQ ID NO: 187182 - DNA, 27 bp, Artificial Sequence
  Description of Artificial Sequence: Synthetic oligonucleotide
gatccagggatgtctggatggccggat

SEQ ID NO: 187183 - DNA, 27 bp, Artificial Sequence
  Description of Artificial Sequence: Synthetic oligonucleotide
atccagggatgtctggatggccggatg

SEQ ID NO: 187184 - DNA, 26 bp, Artificial Sequence
  Description of Artificial Sequence: Synthetic oligonucleotide
tccagggatgtctggatggccggatg

SEQ ID NO: 187185 - DNA, 25 bp, Artificial Sequence
  Description of Artificial Sequence: Synthetic oligonucleotide
ccagggatgtctggatggccggatg

SEQ ID NO: 187186 - DNA, 25 bp, Artificial Sequence
  Description of Artificial Sequence: Synthetic oligonucleotide
cagggatgtctggatggccggatgg

SEQ ID NO: 187187 - DNA, 26 bp, Artificial Sequence
  Description of Artificial Sequence: Synthetic oligonucleotide
agggatgtctggatggccggatggca

SEQ ID NO: 187188 - DNA, 25 bp, Artificial Sequence
  Description of Artificial Sequence: Synthetic oligonucleotide
gggatgtctggatggccggatggca

SEQ ID NO: 187189 - DNA, 27 bp, Artificial Sequence
  Description of Artificial Sequence: Synthetic oligonucleotide
ggatgtctggatggccggatggcagaa

SEQ ID NO: 187190 - DNA, 28 bp, Artificial Sequence
  Description of Artificial Sequence: Synthetic oligonucleotide
gatgtctggatggccggatggcagaatg

SEQ ID NO: 187191 - DNA, 28 bp, Artificial Sequence
  Description of Artificial Sequence: Synthetic oligonucleotide
atgtctggatggccggatggcagaatgg

SEQ ID NO: 187192 - DNA, 27 bp, Artificial Sequence
  Description of Artificial Sequence: Synthetic oligonucleotide
tgtctggatggccggatggcagaatgg

SEQ ID NO: 187193 - DNA, 27 bp, Artificial Sequence
  Description of Artificial Sequence: Synthetic oligonucleotide
gtctggatggccggatggcagaatgga

SEQ ID NO: 187194 - DNA, 27 bp, Artificial Sequence
  Description of Artificial Sequence: Synthetic oligonucleotide
tctggatggccggatggcagaatggag

SEQ ID NO: 187195 - DNA, 27 bp, Artificial Sequence
  Description of Artificial Sequence: Synthetic oligonucleotide
ctggatggccggatggcagaatggaga

SEQ ID NO: 187196 - DNA, 27 bp, Artificial Sequence
  Description of Artificial Sequence: Synthetic oligonucleotide
tggatggccggatggcagaatggagac

SEQ ID NO: 187197 - DNA, 26 bp, Artificial Sequence
  Description of Artificial Sequence: Synthetic oligonucleotide
ggatggccggatggcagaatggagac

SEQ ID NO: 187198 - DNA, 27 bp, Artificial Sequence
  Description of Artificial Sequence: Synthetic oligonucleotide
gatggccggatggcagaatggagacct

SEQ ID NO: 187199 - DNA, 27 bp, Artificial Sequence
  Description of Artificial Sequence: Synthetic oligonucleotide
atggccggatggcagaatggagacctc

SEQ ID NO: 187200 - DNA, 26 bp, Artificial Sequence
  Description of Artificial Sequence: Synthetic oligonucleotide
tggccggatggcagaatggagacctc

SEQ ID NO: 187201 - DNA, 25 bp, Artificial Sequence
  Description of Artificial Sequence: Synthetic oligonucleotide
ggccggatggcagaatggagacctc

SEQ ID NO: 187202 - DNA, 26 bp, Artificial Sequence
  Description of Artificial Sequence: Synthetic oligonucleotide
gccggatggcagaatggagacctcca

SEQ ID NO: 187203 - DNA, 26 bp, Artificial Sequence
  Description of Artificial Sequence: Synthetic oligonucleotide
ccggatggcagaatggagacctccac

SEQ ID NO: 187204 - DNA, 26 bp, Artificial Sequence
  Description of Artificial Sequence: Synthetic oligonucleotide
cggatggcagaatggagacctccacc

SEQ ID NO: 187205 - DNA, 26 bp, Artificial Sequence
  Description of Artificial Sequence: Synthetic oligonucleotide
ggatggcagaatggagacctccaccc

SEQ ID NO: 187206 - DNA, 26 bp, Artificial Sequence
  Description of Artificial Sequence: Synthetic oligonucleotide
gatggcagaatggagacctccacccc

SEQ ID NO: 187207 - DNA, 27 bp, Artificial Sequence
  Description of Artificial Sequence: Synthetic oligonucleotide
atggcagaatggagacctccaccccca

SEQ ID NO: 187208 - DNA, 26 bp, Artificial Sequence
  Description of Artificial Sequence: Synthetic oligonucleotide
tggcagaatggagacctccaccccca

SEQ ID NO: 187209 - DNA, 25 bp, Artificial Sequence
  Description of Artificial Sequence: Synthetic oligonucleotide
ggcagaatggagacctccaccccca

SEQ ID NO: 187210 - DNA, 25 bp, Artificial Sequence
  Description of Artificial Sequence: Synthetic oligonucleotide
gcagaatggagacctccacccccac

SEQ ID NO: 187211 - DNA, 27 bp, Artificial Sequence
  Description of Artificial Sequence: Synthetic oligonucleotide
cagaatggagacctccacccccaccat

SEQ ID NO: 187212 - DNA, 30 bp, Artificial Sequence
  Description of Artificial Sequence: Synthetic oligonucleotide
agaatggagacctccacccccaccataatg

SEQ ID NO: 187213 - DNA, 29 bp, Artificial Sequence
  Description of Artificial Sequence: Synthetic oligonucleotide
gaatggagacctccacccccaccataatg

SEQ ID NO: 187214 - DNA, 29 bp, Artificial Sequence
  Description of Artificial Sequence: Synthetic oligonucleotide
aatggagacctccacccccaccataatgg

SEQ ID NO: 187215 - DNA, 28 bp, Artificial Sequence
  Description of Artificial Sequence: Synthetic oligonucleotide
atggagacctccacccccaccataatgg

SEQ ID NO: 187216 - DNA, 27 bp, Artificial Sequence
  Description of Artificial Sequence: Synthetic oligonucleotide
tggagacctccacccccaccataatgg

SEQ ID NO: 187217 - DNA, 27 bp, Artificial Sequence
  Description of Artificial Sequence: Synthetic oligonucleotide
ggagacctccacccccaccataatgga

SEQ ID NO: 187218 - DNA, 27 bp, Artificial Sequence
  Description of Artificial Sequence: Synthetic oligonucleotide
gagacctccacccccaccataatggac

SEQ ID NO: 187219 - DNA, 30 bp, Artificial Sequence
  Description of Artificial Sequence: Synthetic oligonucleotide
agacctccacccccaccataatggacattg

SEQ ID NO: 187220 - DNA, 29 bp, Artificial Sequence
  Description of Artificial Sequence: Synthetic oligonucleotide
gacctccacccccaccataatggacattg

SEQ ID NO: 187221 - DNA, 30 bp, Artificial Sequence
  Description of Artificial Sequence: Synthetic oligonucleotide
acctccacccccaccataatggacattgtc

SEQ ID NO: 187222 - DNA, 29 bp, Artificial Sequence
  Description of Artificial Sequence: Synthetic oligonucleotide
cctccacccccaccataatggacattgtc

SEQ ID NO: 187223 - DNA, 29 bp, Artificial Sequence
  Description of Artificial Sequence: Synthetic oligonucleotide
ctccacccccaccataatggacattgtcg

SEQ ID NO: 187224 - DNA, 30 bp, Artificial Sequence
  Description of Artificial Sequence: Synthetic oligonucleotide
tccacccccaccataatggacattgtcgtc

SEQ ID NO: 187225 - DNA, 29 bp, Artificial Sequence
  Description of Artificial Sequence: Synthetic oligonucleotide
ccacccccaccataatggacattgtcgtc

SEQ ID NO: 187226 - DNA, 32 bp, Artificial Sequence
  Description of Artificial Sequence: Synthetic oligonucleotide
cacccccaccataatggacattgtcgtcattg

SEQ ID NO: 187227 - DNA, 32 bp, Artificial Sequence
  Description of Artificial Sequence: Synthetic oligonucleotide
acccccaccataatggacattgtcgtcattgc

SEQ ID NO: 187228 - DNA, 31 bp, Artificial Sequence
  Description of Artificial Sequence: Synthetic oligonucleotide
cccccaccataatggacattgtcgtcattgc

SEQ ID NO: 187229 - DNA, 32 bp, Artificial Sequence
  Description of Artificial Sequence: Synthetic oligonucleotide
ccccaccataatggacattgtcgtcattgcag

SEQ ID NO: 187230 - DNA, 32 bp, Artificial Sequence
  Description of Artificial Sequence: Synthetic oligonucleotide
cccaccataatggacattgtcgtcattgcagg

SEQ ID NO: 187231 - DNA, 33 bp, Artificial Sequence
  Description of Artificial Sequence: Synthetic oligonucleotide
ccaccataatggacattgtcgtcattgcaggtg

SEQ ID NO: 187232 - DNA, 34 bp, Artificial Sequence
  Description of Artificial Sequence: Synthetic oligonucleotide
caccataatggacattgtcgtcattgcaggtgtg

SEQ ID NO: 187233 - DNA, 37 bp, Artificial Sequence
  Description of Artificial Sequence: Synthetic oligonucleotide
accataatggacattgtcgtcattgcaggtgtgattg

SEQ ID NO: 187234 - DNA, 36 bp, Artificial Sequence
  Description of Artificial Sequence: Synthetic oligonucleotide
ccataatggacattgtcgtcattgcaggtgtgattg

SEQ ID NO: 187235 - DNA, 36 bp, Artificial Sequence
  Description of Artificial Sequence: Synthetic oligonucleotide
cataatggacattgtcgtcattgcaggtgtgattgc

SEQ ID NO: 187236 - DNA, 37 bp, Artificial Sequence
  Description of Artificial Sequence: Synthetic oligonucleotide
ataatggacattgtcgtcattgcaggtgtgattgctg

SEQ ID NO: 187237 - DNA, 36 bp, Artificial Sequence
  Description of Artificial Sequence: Synthetic oligonucleotide
taatggacattgtcgtcattgcaggtgtgattgctg

SEQ ID NO: 187238 - DNA, 35 bp, Artificial Sequence
  Description of Artificial Sequence: Synthetic oligonucleotide
aatggacattgtcgtcattgcaggtgtgattgctg

SEQ ID NO: 187239 - DNA, 34 bp, Artificial Sequence
  Description of Artificial Sequence: Synthetic oligonucleotide
atggacattgtcgtcattgcaggtgtgattgctg

SEQ ID NO: 187240 - DNA, 33 bp, Artificial Sequence
  Description of Artificial Sequence: Synthetic oligonucleotide
tggacattgtcgtcattgcaggtgtgattgctg

SEQ ID NO: 187241 - DNA, 32 bp, Artificial Sequence
  Description of Artificial Sequence: Synthetic oligonucleotide
ggacattgtcgtcattgcaggtgtgattgctg

SEQ ID NO: 187242 - DNA, 32 bp, Artificial Sequence
  Description of Artificial Sequence: Synthetic oligonucleotide
gacattgtcgtcattgcaggtgtgattgctgc

SEQ ID NO: 187243 - DNA, 33 bp, Artificial Sequence
  Description of Artificial Sequence: Synthetic oligonucleotide
acattgtcgtcattgcaggtgtgattgctgctg

SEQ ID NO: 187244 - DNA, 32 bp, Artificial Sequence
  Description of Artificial Sequence: Synthetic oligonucleotide
cattgtcgtcattgcaggtgtgattgctgctg

SEQ ID NO: 187245 - DNA, 33 bp, Artificial Sequence
  Description of Artificial Sequence: Synthetic oligonucleotide
attgtcgtcattgcaggtgtgattgctgctgtg

SEQ ID NO: 187246 - DNA, 32 bp, Artificial Sequence
  Description of Artificial Sequence: Synthetic oligonucleotide
ttgtcgtcattgcaggtgtgattgctgctgtg

SEQ ID NO: 187247 - DNA, 31 bp, Artificial Sequence
  Description of Artificial Sequence: Synthetic oligonucleotide
tgtcgtcattgcaggtgtgattgctgctgtg

SEQ ID NO: 187248 - DNA, 30 bp, Artificial Sequence
  Description of Artificial Sequence: Synthetic oligonucleotide
gtcgtcattgcaggtgtgattgctgctgtg

SEQ ID NO: 187249 - DNA, 30 bp, Artificial Sequence
  Description of Artificial Sequence: Synthetic oligonucleotide
tcgtcattgcaggtgtgattgctgctgtgg

SEQ ID NO: 187250 - DNA, 29 bp, Artificial Sequence
  Description of Artificial Sequence: Synthetic oligonucleotide
cgtcattgcaggtgtgattgctgctgtgg

SEQ ID NO: 187251 - DNA, 29 bp, Artificial Sequence
  Description of Artificial Sequence: Synthetic oligonucleotide
gtcattgcaggtgtgattgctgctgtggc

SEQ ID NO: 187252 - DNA, 29 bp, Artificial Sequence
  Description of Artificial Sequence: Synthetic oligonucleotide
tcattgcaggtgtgattgctgctgtggcc

SEQ ID NO: 187253 - DNA, 28 bp, Artificial Sequence
  Description of Artificial Sequence: Synthetic oligonucleotide
cattgcaggtgtgattgctgctgtggcc

SEQ ID NO: 187254 - DNA, 30 bp, Artificial Sequence
  Description of Artificial Sequence: Synthetic oligonucleotide
attgcaggtgtgattgctgctgtggccatc

SEQ ID NO: 187255 - DNA, 29 bp, Artificial Sequence
  Description of Artificial Sequence: Synthetic oligonucleotide
ttgcaggtgtgattgctgctgtggccatc

SEQ ID NO: 187256 - DNA, 28 bp, Artificial Sequence
  Description of Artificial Sequence: Synthetic oligonucleotide
tgcaggtgtgattgctgctgtggccatc

SEQ ID NO: 187257 - DNA, 27 bp, Artificial Sequence
  Description of Artificial Sequence: Synthetic oligonucleotide
gcaggtgtgattgctgctgtggccatc

SEQ ID NO: 187258 - DNA, 27 bp, Artificial Sequence
  Description of Artificial Sequence: Synthetic oligonucleotide
caggtgtgattgctgctgtggccatcg

SEQ ID NO: 187259 - DNA, 28 bp, Artificial Sequence
  Description of Artificial Sequence: Synthetic oligonucleotide
aggtgtgattgctgctgtggccatcgtc

SEQ ID NO: 187260 - DNA, 27 bp, Artificial Sequence
  Description of Artificial Sequence: Synthetic oligonucleotide
ggtgtgattgctgctgtggccatcgtc

SEQ ID NO: 187261 - DNA, 27 bp, Artificial Sequence
  Description of Artificial Sequence: Synthetic oligonucleotide
gtgtgattgctgctgtggccatcgtcc

SEQ ID NO: 187262 - DNA, 29 bp, Artificial Sequence
  Description of Artificial Sequence: Synthetic oligonucleotide
tgtgattgctgctgtggccatcgtcctag

SEQ ID NO: 187263 - DNA, 28 bp, Artificial Sequence
  Description of Artificial Sequence: Synthetic oligonucleotide
gtgattgctgctgtggccatcgtcctag

SEQ ID NO: 187264 - DNA, 29 bp, Artificial Sequence
  Description of Artificial Sequence: Synthetic oligonucleotide
tgattgctgctgtggccatcgtcctagtc

SEQ ID NO: 187265 - DNA, 28 bp, Artificial Sequence
  Description of Artificial Sequence: Synthetic oligonucleotide
gattgctgctgtggccatcgtcctagtc

SEQ ID NO: 187266 - DNA, 29 bp, Artificial Sequence
  Description of Artificial Sequence: Synthetic oligonucleotide
attgctgctgtggccatcgtcctagtctc

SEQ ID NO: 187267 - DNA, 28 bp, Artificial Sequence
  Description of Artificial Sequence: Synthetic oligonucleotide
ttgctgctgtggccatcgtcctagtctc

SEQ ID NO: 187268 - DNA, 27 bp, Artificial Sequence
  Description of Artificial Sequence: Synthetic oligonucleotide
tgctgctgtggccatcgtcctagtctc

SEQ ID NO: 187269 - DNA, 26 bp, Artificial Sequence
  Description of Artificial Sequence: Synthetic oligonucleotide
gctgctgtggccatcgtcctagtctc

SEQ ID NO: 187270 - DNA, 26 bp, Artificial Sequence
  Description of Artificial Sequence: Synthetic oligonucleotide
ctgctgtggccatcgtcctagtctcc

SEQ ID NO: 187271 - DNA, 27 bp, Artificial Sequence
  Description of Artificial Sequence: Synthetic oligonucleotide
tgctgtggccatcgtcctagtctccct

SEQ ID NO: 187272 - DNA, 26 bp, Artificial Sequence
  Description of Artificial Sequence: Synthetic oligonucleotide
gctgtggccatcgtcctagtctccct

SEQ ID NO: 187273 - DNA, 26 bp, Artificial Sequence
  Description of Artificial Sequence: Synthetic oligonucleotide
ctgtggccatcgtcctagtctccctc

SEQ ID NO: 187274 - DNA, 27 bp, Artificial Sequence
  Description of Artificial Sequence: Synthetic oligonucleotide
tgtggccatcgtcctagtctccctcct

SEQ ID NO: 187275 - DNA, 26 bp, Artificial Sequence
  Description of Artificial Sequence: Synthetic oligonucleotide
gtggccatcgtcctagtctccctcct

SEQ ID NO: 187276 - DNA, 27 bp, Artificial Sequence
  Description of Artificial Sequence: Synthetic oligonucleotide
tggccatcgtcctagtctccctcctct

SEQ ID NO: 187277 - DNA, 27 bp, Artificial Sequence
  Description of Artificial Sequence: Synthetic oligonucleotide
ggccatcgtcctagtctccctcctctt

SEQ ID NO: 187278 - DNA, 27 bp, Artificial Sequence
  Description of Artificial Sequence: Synthetic oligonucleotide
gccatcgtcctagtctccctcctcttc

SEQ ID NO: 187279 - DNA, 27 bp, Artificial Sequence
  Description of Artificial Sequence: Synthetic oligonucleotide
ccatcgtcctagtctccctcctcttcg

SEQ ID NO: 187280 - DNA, 28 bp, Artificial Sequence
  Description of Artificial Sequence: Synthetic oligonucleotide
catcgtcctagtctccctcctcttcgtc

SEQ ID NO: 187281 - DNA, 30 bp, Artificial Sequence
  Description of Artificial Sequence: Synthetic oligonucleotide
atcgtcctagtctccctcctcttcgtcatg

SEQ ID NO: 187282 - DNA, 29 bp, Artificial Sequence
  Description of Artificial Sequence: Synthetic oligonucleotide
tcgtcctagtctccctcctcttcgtcatg

SEQ ID NO: 187283 - DNA, 28 bp, Artificial Sequence
  Description of Artificial Sequence: Synthetic oligonucleotide
cgtcctagtctccctcctcttcgtcatg

SEQ ID NO: 187284 - DNA, 28 bp, Artificial Sequence
  Description of Artificial Sequence: Synthetic oligonucleotide
gtcctagtctccctcctcttcgtcatgc

SEQ ID NO: 187285 - DNA, 29 bp, Artificial Sequence
  Description of Artificial Sequence: Synthetic oligonucleotide
tcctagtctccctcctcttcgtcatgctg

SEQ ID NO: 187286 - DNA, 28 bp, Artificial Sequence
  Description of Artificial Sequence: Synthetic oligonucleotide
cctagtctccctcctcttcgtcatgctg

SEQ ID NO: 187287 - DNA, 28 bp, Artificial Sequence
  Description of Artificial Sequence: Synthetic oligonucleotide
ctagtctccctcctcttcgtcatgctgc

SEQ ID NO: 187288 - DNA, 28 bp, Artificial Sequence
  Description of Artificial Sequence: Synthetic oligonucleotide
tagtctccctcctcttcgtcatgctgcg

SEQ ID NO: 187289 - DNA, 27 bp, Artificial Sequence
  Description of Artificial Sequence: Synthetic oligonucleotide
agtctccctcctcttcgtcatgctgcg

SEQ ID NO: 187290 - DNA, 26 bp, Artificial Sequence
  Description of Artificial Sequence: Synthetic oligonucleotide
gtctccctcctcttcgtcatgctgcg

SEQ ID NO: 187291 - DNA, 27 bp, Artificial Sequence
  Description of Artificial Sequence: Synthetic oligonucleotide
tctccctcctcttcgtcatgctgcgct

SEQ ID NO: 187292 - DNA, 27 bp, Artificial Sequence
  Description of Artificial Sequence: Synthetic oligonucleotide
ctccctcctcttcgtcatgctgcgcta

SEQ ID NO: 187293 - DNA, 27 bp, Artificial Sequence
  Description of Artificial Sequence: Synthetic oligonucleotide
tccctcctcttcgtcatgctgcgctac

SEQ ID NO: 187294 - DNA, 27 bp, Artificial Sequence
  Description of Artificial Sequence: Synthetic oligonucleotide
ccctcctcttcgtcatgctgcgctaca

SEQ ID NO: 187295 - DNA, 28 bp, Artificial Sequence
  Description of Artificial Sequence: Synthetic oligonucleotide
cctcctcttcgtcatgctgcgctacatg

SEQ ID NO: 187296 - DNA, 30 bp, Artificial Sequence
  Description of Artificial Sequence: Synthetic oligonucleotide
ctcctcttcgtcatgctgcgctacatgtac

SEQ ID NO: 187297 - DNA, 30 bp, Artificial Sequence
  Description of Artificial Sequence: Synthetic oligonucleotide
tcctcttcgtcatgctgcgctacatgtacc

SEQ ID NO: 187298 - DNA, 29 bp, Artificial Sequence
  Description of Artificial Sequence: Synthetic oligonucleotide
cctcttcgtcatgctgcgctacatgtacc

SEQ ID NO: 187299 - DNA, 29 bp, Artificial Sequence
  Description of Artificial Sequence: Synthetic oligonucleotide
ctcttcgtcatgctgcgctacatgtaccg

SEQ ID NO: 187300 - DNA, 29 bp, Artificial Sequence
  Description of Artificial Sequence: Synthetic oligonucleotide
tcttcgtcatgctgcgctacatgtaccgg

SEQ ID NO: 187301 - DNA, 28 bp, Artificial Sequence
  Description of Artificial Sequence: Synthetic oligonucleotide
cttcgtcatgctgcgctacatgtaccgg

SEQ ID NO: 187302 - DNA, 28 bp, Artificial Sequence
  Description of Artificial Sequence: Synthetic oligonucleotide
ttcgtcatgctgcgctacatgtaccggc

SEQ ID NO: 187303 - DNA, 27 bp, Artificial Sequence
  Description of Artificial Sequence: Synthetic oligonucleotide
tcgtcatgctgcgctacatgtaccggc

SEQ ID NO: 187304 - DNA, 27 bp, Artificial Sequence
  Description of Artificial Sequence: Synthetic oligonucleotide
cgtcatgctgcgctacatgtaccggca

SEQ ID NO: 187305 - DNA, 27 bp, Artificial Sequence
  Description of Artificial Sequence: Synthetic oligonucleotide
gtcatgctgcgctacatgtaccggcac

SEQ ID NO: 187306 - DNA, 29 bp, Artificial Sequence
  Description of Artificial Sequence: Synthetic oligonucleotide
tcatgctgcgctacatgtaccggcacaag

SEQ ID NO: 187307 - DNA, 28 bp, Artificial Sequence
  Description of Artificial Sequence: Synthetic oligonucleotide
catgctgcgctacatgtaccggcacaag

SEQ ID NO: 187308 - DNA, 28 bp, Artificial Sequence
  Description of Artificial Sequence: Synthetic oligonucleotide
atgctgcgctacatgtaccggcacaagg

SEQ ID NO: 187309 - DNA, 27 bp, Artificial Sequence
  Description of Artificial Sequence: Synthetic oligonucleotide
tgctgcgctacatgtaccggcacaagg

SEQ ID NO: 187310 - DNA, 26 bp, Artificial Sequence
  Description of Artificial Sequence: Synthetic oligonucleotide
gctgcgctacatgtaccggcacaagg

SEQ ID NO: 187311 - DNA, 26 bp, Artificial Sequence
  Description of Artificial Sequence: Synthetic oligonucleotide
ctgcgctacatgtaccggcacaaggg

SEQ ID NO: 187312 - DNA, 27 bp, Artificial Sequence
  Description of Artificial Sequence: Synthetic oligonucleotide
tgcgctacatgtaccggcacaagggca

SEQ ID NO: 187313 - DNA, 26 bp, Artificial Sequence
  Description of Artificial Sequence: Synthetic oligonucleotide
gcgctacatgtaccggcacaagggca

SEQ ID NO: 187314 - DNA, 26 bp, Artificial Sequence
  Description of Artificial Sequence: Synthetic oligonucleotide
cgctacatgtaccggcacaagggcac

SEQ ID NO: 187315 - DNA, 27 bp, Artificial Sequence
  Description of Artificial Sequence: Synthetic oligonucleotide
gctacatgtaccggcacaagggcacgt

SEQ ID NO: 187316 - DNA, 28 bp, Artificial Sequence
  Description of Artificial Sequence: Synthetic oligonucleotide
ctacatgtaccggcacaagggcacgtac

SEQ ID NO: 187317 - DNA, 28 bp, Artificial Sequence
  Description of Artificial Sequence: Synthetic oligonucleotide
tacatgtaccggcacaagggcacgtacc

SEQ ID NO: 187318 - DNA, 27 bp, Artificial Sequence
  Description of Artificial Sequence: Synthetic oligonucleotide
acatgtaccggcacaagggcacgtacc

SEQ ID NO: 187319 - DNA, 27 bp, Artificial Sequence
  Description of Artificial Sequence: Synthetic oligonucleotide
catgtaccggcacaagggcacgtacca

SEQ ID NO: 187320 - DNA, 27 bp, Artificial Sequence
  Description of Artificial Sequence: Synthetic oligonucleotide
atgtaccggcacaagggcacgtaccac

SEQ ID NO: 187321 - DNA, 27 bp, Artificial Sequence
  Description of Artificial Sequence: Synthetic oligonucleotide
tgtaccggcacaagggcacgtaccaca

SEQ ID NO: 187322 - DNA, 26 bp, Artificial Sequence
  Description of Artificial Sequence: Synthetic oligonucleotide
gtaccggcacaagggcacgtaccaca

SEQ ID NO: 187323 - DNA, 26 bp, Artificial Sequence
  Description of Artificial Sequence: Synthetic oligonucleotide
taccggcacaagggcacgtaccacac

SEQ ID NO: 187324 - DNA, 25 bp, Artificial Sequence
  Description of Artificial Sequence: Synthetic oligonucleotide
accggcacaagggcacgtaccacac

SEQ ID NO: 187325 - DNA, 24 bp, Artificial Sequence
  Description of Artificial Sequence: Synthetic oligonucleotide
ccggcacaagggcacgtaccacac

SEQ ID NO: 187326 - DNA, 27 bp, Artificial Sequence
  Description of Artificial Sequence: Synthetic oligonucleotide
cggcacaagggcacgtaccacaccaat

SEQ ID NO: 187327 - DNA, 27 bp, Artificial Sequence
  Description of Artificial Sequence: Synthetic oligonucleotide
ggcacaagggcacgtaccacaccaatg

SEQ ID NO: 187328 - DNA, 28 bp, Artificial Sequence
  Description of Artificial Sequence: Synthetic oligonucleotide
gcacaagggcacgtaccacaccaatgag

SEQ ID NO: 187329 - DNA, 28 bp, Artificial Sequence
  Description of Artificial Sequence: Synthetic oligonucleotide
cacaagggcacgtaccacaccaatgagg

SEQ ID NO: 187330 - DNA, 28 bp, Artificial Sequence
  Description of Artificial Sequence: Synthetic oligonucleotide
acaagggcacgtaccacaccaatgaggc

SEQ ID NO: 187331 - DNA, 27 bp, Artificial Sequence
  Description of Artificial Sequence: Synthetic oligonucleotide
caagggcacgtaccacaccaatgaggc

SEQ ID NO: 187332 - DNA, 27 bp, Artificial Sequence
  Description of Artificial Sequence: Synthetic oligonucleotide
aagggcacgtaccacaccaatgaggcc

SEQ ID NO: 187333 - DNA, 27 bp, Artificial Sequence
  Description of Artificial Sequence: Synthetic oligonucleotide
agggcacgtaccacaccaatgaggcca

SEQ ID NO: 187334 - DNA, 27 bp, Artificial Sequence
  Description of Artificial Sequence: Synthetic oligonucleotide
gggcacgtaccacaccaatgaggccaa

SEQ ID NO: 187335 - DNA, 27 bp, Artificial Sequence
  Description of Artificial Sequence: Synthetic oligonucleotide
ggcacgtaccacaccaatgaggccaag

SEQ ID NO: 187336 - DNA, 27 bp, Artificial Sequence
  Description of Artificial Sequence: Synthetic oligonucleotide
gcacgtaccacaccaatgaggccaagg

SEQ ID NO: 187337 - DNA, 27 bp, Artificial Sequence
  Description of Artificial Sequence: Synthetic oligonucleotide
cacgtaccacaccaatgaggccaaggg

SEQ ID NO: 187338 - DNA, 27 bp, Artificial Sequence
  Description of Artificial Sequence: Synthetic oligonucleotide
acgtaccacaccaatgaggccaagggc

SEQ ID NO: 187339 - DNA, 27 bp, Artificial Sequence
  Description of Artificial Sequence: Synthetic oligonucleotide
cgtaccacaccaatgaggccaagggca

SEQ ID NO: 187340 - DNA, 27 bp, Artificial Sequence
  Description of Artificial Sequence: Synthetic oligonucleotide
gtaccacaccaatgaggccaagggcac

SEQ ID NO: 187341 - DNA, 27 bp, Artificial Sequence
  Description of Artificial Sequence: Synthetic oligonucleotide
taccacaccaatgaggccaagggcacg

SEQ ID NO: 187342 - DNA, 26 bp, Artificial Sequence
  Description of Artificial Sequence: Synthetic oligonucleotide
accacaccaatgaggccaagggcacg

SEQ ID NO: 187343 - DNA, 25 bp, Artificial Sequence
  Description of Artificial Sequence: Synthetic oligonucleotide
ccacaccaatgaggccaagggcacg

SEQ ID NO: 187344 - DNA, 26 bp, Artificial Sequence
  Description of Artificial Sequence: Synthetic oligonucleotide
cacaccaatgaggccaagggcacgga

SEQ ID NO: 187345 - DNA, 27 bp, Artificial Sequence
  Description of Artificial Sequence: Synthetic oligonucleotide
acaccaatgaggccaagggcacggagt

SEQ ID NO: 187346 - DNA, 27 bp, Artificial Sequence
  Description of Artificial Sequence: Synthetic oligonucleotide
caccaatgaggccaagggcacggagtt

SEQ ID NO: 187347 - DNA, 28 bp, Artificial Sequence
  Description of Artificial Sequence: Synthetic oligonucleotide
accaatgaggccaagggcacggagtttg

SEQ ID NO: 187348 - DNA, 27 bp, Artificial Sequence
  Description of Artificial Sequence: Synthetic oligonucleotide
ccaatgaggccaagggcacggagtttg

SEQ ID NO: 187349 - DNA, 27 bp, Artificial Sequence
  Description of Artificial Sequence: Synthetic oligonucleotide
caatgaggccaagggcacggagtttgc

SEQ ID NO: 187350 - DNA, 28 bp, Artificial Sequence
  Description of Artificial Sequence: Synthetic oligonucleotide
aatgaggccaagggcacggagtttgctg

SEQ ID NO: 187351 - DNA, 27 bp, Artificial Sequence
  Description of Artificial Sequence: Synthetic oligonucleotide
atgaggccaagggcacggagtttgctg

SEQ ID NO: 187352 - DNA, 27 bp, Artificial Sequence
  Description of Artificial Sequence: Synthetic oligonucleotide
tgaggccaagggcacggagtttgctga

SEQ ID NO: 187353 - DNA, 26 bp, Artificial Sequence
  Description of Artificial Sequence: Synthetic oligonucleotide
gaggccaagggcacggagtttgctga

SEQ ID NO: 187354 - DNA, 27 bp, Artificial Sequence
  Description of Artificial Sequence: Synthetic oligonucleotide
aggccaagggcacggagtttgctgaga

SEQ ID NO: 187355 - DNA, 26 bp, Artificial Sequence
  Description of Artificial Sequence: Synthetic oligonucleotide
ggccaagggcacggagtttgctgaga

SEQ ID NO: 187356 - DNA, 27 bp, Artificial Sequence
  Description of Artificial Sequence: Synthetic oligonucleotide
gccaagggcacggagtttgctgagagt

SEQ ID NO: 187357 - DNA, 27 bp, Artificial Sequence
  Description of Artificial Sequence: Synthetic oligonucleotide
ccaagggcacggagtttgctgagagtg

SEQ ID NO: 187358 - DNA, 27 bp, Artificial Sequence
  Description of Artificial Sequence: Synthetic oligonucleotide
caagggcacggagtttgctgagagtgc

SEQ ID NO: 187359 - DNA, 28 bp, Artificial Sequence
  Description of Artificial Sequence: Synthetic oligonucleotide
aagggcacggagtttgctgagagtgcag

SEQ ID NO: 187360 - DNA, 27 bp, Artificial Sequence
  Description of Artificial Sequence: Synthetic oligonucleotide
agggcacggagtttgctgagagtgcag

SEQ ID NO: 187361 - DNA, 27 bp, Artificial Sequence
  Description of Artificial Sequence: Synthetic oligonucleotide
gggcacggagtttgctgagagtgcaga

SEQ ID NO: 187362 - DNA, 28 bp, Artificial Sequence
  Description of Artificial Sequence: Synthetic oligonucleotide
ggcacggagtttgctgagagtgcagatg

SEQ ID NO: 187363 - DNA, 28 bp, Artificial Sequence
  Description of Artificial Sequence: Synthetic oligonucleotide
gcacggagtttgctgagagtgcagatgc

SEQ ID NO: 187364 - DNA, 29 bp, Artificial Sequence
  Description of Artificial Sequence: Synthetic oligonucleotide
cacggagtttgctgagagtgcagatgcag

SEQ ID NO: 187365 - DNA, 29 bp, Artificial Sequence
  Description of Artificial Sequence: Synthetic oligonucleotide
acggagtttgctgagagtgcagatgcagc

SEQ ID NO: 187366 - DNA, 28 bp, Artificial Sequence
  Description of Artificial Sequence: Synthetic oligonucleotide
cggagtttgctgagagtgcagatgcagc

SEQ ID NO: 187367 - DNA, 28 bp, Artificial Sequence
  Description of Artificial Sequence: Synthetic oligonucleotide
ggagtttgctgagagtgcagatgcagcc

SEQ ID NO: 187368 - DNA, 28 bp, Artificial Sequence
  Description of Artificial Sequence: Synthetic oligonucleotide
gagtttgctgagagtgcagatgcagccc

SEQ ID NO: 187369 - DNA, 29 bp, Artificial Sequence
  Description of Artificial Sequence: Synthetic oligonucleotide
agtttgctgagagtgcagatgcagccctg

SEQ ID NO: 187370 - DNA, 28 bp, Artificial Sequence
  Description of Artificial Sequence: Synthetic oligonucleotide
gtttgctgagagtgcagatgcagccctg

SEQ ID NO: 187371 - DNA, 28 bp, Artificial Sequence
  Description of Artificial Sequence: Synthetic oligonucleotide
tttgctgagagtgcagatgcagccctgc

SEQ ID NO: 187372 - DNA, 27 bp, Artificial Sequence
  Description of Artificial Sequence: Synthetic oligonucleotide
ttgctgagagtgcagatgcagccctgc

SEQ ID NO: 187373 - DNA, 27 bp, Artificial Sequence
  Description of Artificial Sequence: Synthetic oligonucleotide
tgctgagagtgcagatgcagccctgca

SEQ ID NO: 187374 - DNA, 26 bp, Artificial Sequence
  Description of Artificial Sequence: Synthetic oligonucleotide
gctgagagtgcagatgcagccctgca

SEQ ID NO: 187375 - DNA, 26 bp, Artificial Sequence
  Description of Artificial Sequence: Synthetic oligonucleotide
ctgagagtgcagatgcagccctgcag

SEQ ID NO: 187376 - DNA, 26 bp, Artificial Sequence
  Description of Artificial Sequence: Synthetic oligonucleotide
tgagagtgcagatgcagccctgcagg

SEQ ID NO: 187377 - DNA, 25 bp, Artificial Sequence
  Description of Artificial Sequence: Synthetic oligonucleotide
gagagtgcagatgcagccctgcagg

SEQ ID NO: 187378 - DNA, 26 bp, Artificial Sequence
  Description of Artificial Sequence: Synthetic oligonucleotide
agagtgcagatgcagccctgcaggga

SEQ ID NO: 187379 - DNA, 25 bp, Artificial Sequence
  Description of Artificial Sequence: Synthetic oligonucleotide
gagtgcagatgcagccctgcaggga

SEQ ID NO: 187380 - DNA, 26 bp, Artificial Sequence
  Description of Artificial Sequence: Synthetic oligonucleotide
agtgcagatgcagccctgcagggaga

SEQ ID NO: 187381 - DNA, 25 bp, Artificial Sequence
  Description of Artificial Sequence: Synthetic oligonucleotide
gtgcagatgcagccctgcagggaga

SEQ ID NO: 187382 - DNA, 25 bp, Artificial Sequence
  Description of Artificial Sequence: Synthetic oligonucleotide
tgcagatgcagccctgcagggagac

SEQ ID NO: 187383 - DNA, 24 bp, Artificial Sequence
  Description of Artificial Sequence: Synthetic oligonucleotide
gcagatgcagccctgcagggagac

SEQ ID NO: 187384 - DNA, 24 bp, Artificial Sequence
  Description of Artificial Sequence: Synthetic oligonucleotide
cagatgcagccctgcagggagacc

SEQ ID NO: 187385 - DNA, 25 bp, Artificial Sequence
  Description of Artificial Sequence: Synthetic oligonucleotide
agatgcagccctgcagggagaccct

SEQ ID NO: 187386 - DNA, 24 bp, Artificial Sequence
  Description of Artificial Sequence: Synthetic oligonucleotide
gatgcagccctgcagggagaccct

SEQ ID NO: 187387 - DNA, 24 bp, Artificial Sequence
  Description of Artificial Sequence: Synthetic oligonucleotide
atgcagccctgcagggagaccctg

SEQ ID NO: 187388 - DNA, 23 bp, Artificial Sequence
  Description of Artificial Sequence: Synthetic oligonucleotide
tgcagccctgcagggagaccctg

SEQ ID NO: 187389 - DNA, 22 bp, Artificial Sequence
  Description of Artificial Sequence: Synthetic oligonucleotide
gcagccctgcagggagaccctg

SEQ ID NO: 187390 - DNA, 22 bp, Artificial Sequence
  Description of Artificial Sequence: Synthetic oligonucleotide
cagccctgcagggagaccctgc

SEQ ID NO: 187391 - DNA, 22 bp, Artificial Sequence
  Description of Artificial Sequence: Synthetic oligonucleotide
agccctgcagggagaccctgcc

SEQ ID NO: 187392 - DNA, 21 bp, Artificial Sequence
  Description of Artificial Sequence: Synthetic oligonucleotide
gccctgcagggagaccctgcc

SEQ ID NO: 187393 - DNA, 22 bp, Artificial Sequence
  Description of Artificial Sequence: Synthetic oligonucleotide
ccctgcagggagaccctgccct

SEQ ID NO: 187394 - DNA, 22 bp, Artificial Sequence
  Description of Artificial Sequence: Synthetic oligonucleotide
cctgcagggagaccctgccctc

SEQ ID NO: 187395 - DNA, 24 bp, Artificial Sequence
  Description of Artificial Sequence: Synthetic oligonucleotide
ctgcagggagaccctgccctccaa

SEQ ID NO: 187396 - DNA, 26 bp, Artificial Sequence
  Description of Artificial Sequence: Synthetic oligonucleotide
tgcagggagaccctgccctccaagat

SEQ ID NO: 187397 - DNA, 25 bp, Artificial Sequence
  Description of Artificial Sequence: Synthetic oligonucleotide
gcagggagaccctgccctccaagat

SEQ ID NO: 187398 - DNA, 25 bp, Artificial Sequence
  Description of Artificial Sequence: Synthetic oligonucleotide
cagggagaccctgccctccaagatg

SEQ ID NO: 187399 - DNA, 26 bp, Artificial Sequence
  Description of Artificial Sequence: Synthetic oligonucleotide
agggagaccctgccctccaagatgct

SEQ ID NO: 187400 - DNA, 25 bp, Artificial Sequence
  Description of Artificial Sequence: Synthetic oligonucleotide
gggagaccctgccctccaagatgct

SEQ ID NO: 187401 - DNA, 25 bp, Artificial Sequence
  Description of Artificial Sequence: Synthetic oligonucleotide
ggagaccctgccctccaagatgctg

SEQ ID NO: 187402 - DNA, 26 bp, Artificial Sequence
  Description of Artificial Sequence: Synthetic oligonucleotide
gagaccctgccctccaagatgctggt

SEQ ID NO: 187403 - DNA, 27 bp, Artificial Sequence
  Description of Artificial Sequence: Synthetic oligonucleotide
agaccctgccctccaagatgctggtga

SEQ ID NO: 187404 - DNA, 27 bp, Artificial Sequence
  Description of Artificial Sequence: Synthetic oligonucleotide
gaccctgccctccaagatgctggtgat

SEQ ID NO: 187405 - DNA, 28 bp, Artificial Sequence
  Description of Artificial Sequence: Synthetic oligonucleotide
accctgccctccaagatgctggtgatag

SEQ ID NO: 187406 - DNA, 27 bp, Artificial Sequence
  Description of Artificial Sequence: Synthetic oligonucleotide
ccctgccctccaagatgctggtgatag

SEQ ID NO: 187407 - DNA, 27 bp, Artificial Sequence
  Description of Artificial Sequence: Synthetic oligonucleotide
cctgccctccaagatgctggtgatagc

SEQ ID NO: 187408 - DNA, 28 bp, Artificial Sequence
  Description of Artificial Sequence: Synthetic oligonucleotide
ctgccctccaagatgctggtgatagcag

SEQ ID NO: 187409 - DNA, 28 bp, Artificial Sequence
  Description of Artificial Sequence: Synthetic oligonucleotide
tgccctccaagatgctggtgatagcagc

SEQ ID NO: 187410 - DNA, 27 bp, Artificial Sequence
  Description of Artificial Sequence: Synthetic oligonucleotide
gccctccaagatgctggtgatagcagc

SEQ ID NO: 187411 - DNA, 28 bp, Artificial Sequence
  Description of Artificial Sequence: Synthetic oligonucleotide
ccctccaagatgctggtgatagcagcag

SEQ ID NO: 187412 - DNA, 31 bp, Artificial Sequence
  Description of Artificial Sequence: Synthetic oligonucleotide
cctccaagatgctggtgatagcagcagaaag

SEQ ID NO: 187413 - DNA, 31 bp, Artificial Sequence
  Description of Artificial Sequence: Synthetic oligonucleotide
ctccaagatgctggtgatagcagcagaaagg

SEQ ID NO: 187414 - DNA, 32 bp, Artificial Sequence
  Description of Artificial Sequence: Synthetic oligonucleotide
tccaagatgctggtgatagcagcagaaaggag

SEQ ID NO: 187415 - DNA, 31 bp, Artificial Sequence
  Description of Artificial Sequence: Synthetic oligonucleotide
ccaagatgctggtgatagcagcagaaaggag

SEQ ID NO: 187416 - DNA, 33 bp, Artificial Sequence
  Description of Artificial Sequence: Synthetic oligonucleotide
caagatgctggtgatagcagcagaaaggagtac

SEQ ID NO: 187417 - DNA, 40 bp, Artificial Sequence
  Description of Artificial Sequence: Synthetic oligonucleotide
aagatgctggtgatagcagcagaaaggagtactttatttg

SEQ ID NO: 187418 - DNA, 39 bp, Artificial Sequence
  Description of Artificial Sequence: Synthetic oligonucleotide
agatgctggtgatagcagcagaaaggagtactttatttg

SEQ ID NO: 187419 - DNA, 38 bp, Artificial Sequence
  Description of Artificial Sequence: Synthetic oligonucleotide
gatgctggtgatagcagcagaaaggagtactttatttg

SEQ ID NO: 187420 - DNA, 25 bp, Artificial Sequence
  Description of Artificial Sequence: Synthetic oligonucleotide
agagtgcagatgcagccctgcaggg

SEQ ID NO: 187421 - DNA, 24 bp, Artificial Sequence
  Description of Artificial Sequence: Synthetic oligonucleotide
gagtgcagatgcagccctgcaggg

SEQ ID NO: 187422 - DNA, 24 bp, Artificial Sequence
  Description of Artificial Sequence: Synthetic oligonucleotide
agtgcagatgcagccctgcagggc

SEQ ID NO: 187423 - DNA, 23 bp, Artificial Sequence
  Description of Artificial Sequence: Synthetic oligonucleotide
gtgcagatgcagccctgcagggc

SEQ ID NO: 187424 - DNA, 24 bp, Artificial Sequence
  Description of Artificial Sequence: Synthetic oligonucleotide
tgcagatgcagccctgcagggcga

SEQ ID NO: 187425 - DNA, 23 bp, Artificial Sequence
  Description of Artificial Sequence: Synthetic oligonucleotide
gcagatgcagccctgcagggcga

SEQ ID NO: 187426 - DNA, 23 bp, Artificial Sequence
  Description of Artificial Sequence: Synthetic oligonucleotide
cagatgcagccctgcagggcgac

SEQ ID NO: 187427 - DNA, 23 bp, Artificial Sequence
  Description of Artificial Sequence: Synthetic oligonucleotide
agatgcagccctgcagggcgacc

SEQ ID NO: 187428 - DNA, 22 bp, Artificial Sequence
  Description of Artificial Sequence: Synthetic oligonucleotide
gatgcagccctgcagggcgacc

SEQ ID NO: 187429 - DNA, 23 bp, Artificial Sequence
  Description of Artificial Sequence: Synthetic oligonucleotide
atgcagccctgcagggcgaccct

SEQ ID NO: 187430 - DNA, 22 bp, Artificial Sequence
  Description of Artificial Sequence: Synthetic oligonucleotide
tgcagccctgcagggcgaccct

SEQ ID NO: 187431 - DNA, 21 bp, Artificial Sequence
  Description of Artificial Sequence: Synthetic oligonucleotide
gcagccctgcagggcgaccct

SEQ ID NO: 187432 - DNA, 21 bp, Artificial Sequence
  Description of Artificial Sequence: Synthetic oligonucleotide
cagccctgcagggcgaccctg

SEQ ID NO: 187433 - DNA, 21 bp, Artificial Sequence
  Description of Artificial Sequence: Synthetic oligonucleotide
agccctgcagggcgaccctgc

SEQ ID NO: 187434 - DNA, 20 bp, Artificial Sequence
  Description of Artificial Sequence: Synthetic oligonucleotide
gccctgcagggcgaccctgc

SEQ ID NO: 187435 - DNA, 20 bp, Artificial Sequence
  Description of Artificial Sequence: Synthetic oligonucleotide
ccctgcagggcgaccctgcc

SEQ ID NO: 187436 - DNA, 21 bp, Artificial Sequence
  Description of Artificial Sequence: Synthetic oligonucleotide
cctgcagggcgaccctgccct

SEQ ID NO: 187437 - DNA, 21 bp, Artificial Sequence
  Description of Artificial Sequence: Synthetic oligonucleotide
ctgcagggcgaccctgccctc

SEQ ID NO: 187438 - DNA, 23 bp, Artificial Sequence
  Description of Artificial Sequence: Synthetic oligonucleotide
tgcagggcgaccctgccctccaa

SEQ ID NO: 187439 - DNA, 22 bp, Artificial Sequence
  Description of Artificial Sequence: Synthetic oligonucleotide
gcagggcgaccctgccctccaa

SEQ ID NO: 187440 - DNA, 24 bp, Artificial Sequence
  Description of Artificial Sequence: Synthetic oligonucleotide
cagggcgaccctgccctccaagat

SEQ ID NO: 187441 - DNA, 24 bp, Artificial Sequence
  Description of Artificial Sequence: Synthetic oligonucleotide
agggcgaccctgccctccaagatg

SEQ ID NO: 187442 - DNA, 23 bp, Artificial Sequence
  Description of Artificial Sequence: Synthetic oligonucleotide
gggcgaccctgccctccaagatg

SEQ ID NO: 187443 - DNA, 24 bp, Artificial Sequence
  Description of Artificial Sequence: Synthetic oligonucleotide
ggcgaccctgccctccaagatgct

SEQ ID NO: 187444 - DNA, 24 bp, Artificial Sequence
  Description of Artificial Sequence: Synthetic oligonucleotide
gcgaccctgccctccaagatgctg

SEQ ID NO: 187445 - DNA, 25 bp, Artificial Sequence
  Description of Artificial Sequence: Synthetic oligonucleotide
cgaccctgccctccaagatgctggt

SEQ ID NO: 187446 - DNA, 25 bp, Artificial Sequence
  Description of Artificial Sequence: Synthetic oligonucleotide
gcctctcagcctcgagcctgatcca

SEQ ID NO: 187447 - DNA, 25 bp, Artificial Sequence
  Description of Artificial Sequence: Synthetic oligonucleotide
cctctcagcctcgagcctgatccag

SEQ ID NO: 187448 - DNA, 25 bp, Artificial Sequence
  Description of Artificial Sequence: Synthetic oligonucleotide
ctctcagcctcgagcctgatccagg

SEQ ID NO: 187449 - DNA, 27 bp, Artificial Sequence
  Description of Artificial Sequence: Synthetic oligonucleotide
tctcagcctcgagcctgatccagggat

SEQ ID NO: 187450 - DNA, 26 bp, Artificial Sequence
  Description of Artificial Sequence: Synthetic oligonucleotide
ctcagcctcgagcctgatccagggat

SEQ ID NO: 187451 - DNA, 26 bp, Artificial Sequence
  Description of Artificial Sequence: Synthetic oligonucleotide
tcagcctcgagcctgatccagggatg

SEQ ID NO: 187452 - DNA, 25 bp, Artificial Sequence
  Description of Artificial Sequence: Synthetic oligonucleotide
cagcctcgagcctgatccagggatg

SEQ ID NO: 187453 - DNA, 25 bp, Artificial Sequence
  Description of Artificial Sequence: Synthetic oligonucleotide
agcctcgagcctgatccagggatgg

SEQ ID NO: 187454 - DNA, 24 bp, Artificial Sequence
  Description of Artificial Sequence: Synthetic oligonucleotide
gcctcgagcctgatccagggatgg

SEQ ID NO: 187455 - DNA, 24 bp, Artificial Sequence
  Description of Artificial Sequence: Synthetic oligonucleotide
cctcgagcctgatccagggatggc

SEQ ID NO: 187456 - DNA, 25 bp, Artificial Sequence
  Description of Artificial Sequence: Synthetic oligonucleotide
ctcgagcctgatccagggatggcct

SEQ ID NO: 187457 - DNA, 26 bp, Artificial Sequence
  Description of Artificial Sequence: Synthetic oligonucleotide
tcgagcctgatccagggatggcctct

SEQ ID NO: 187458 - DNA, 25 bp, Artificial Sequence
  Description of Artificial Sequence: Synthetic oligonucleotide
cgagcctgatccagggatggcctct

SEQ ID NO: 187459 - DNA, 25 bp, Artificial Sequence
  Description of Artificial Sequence: Synthetic oligonucleotide
gagcctgatccagggatggcctctg

SEQ ID NO: 187460 - DNA, 25 bp, Artificial Sequence
  Description of Artificial Sequence: Synthetic oligonucleotide
agcctgatccagggatggcctctgc

SEQ ID NO: 187461 - DNA, 24 bp, Artificial Sequence
  Description of Artificial Sequence: Synthetic oligonucleotide
gcctgatccagggatggcctctgc

SEQ ID NO: 187462 - DNA, 25 bp, Artificial Sequence
  Description of Artificial Sequence: Synthetic oligonucleotide
cctgatccagggatggcctctgcct

SEQ ID NO: 187463 - DNA, 25 bp, Artificial Sequence
  Description of Artificial Sequence: Synthetic oligonucleotide
ctgatccagggatggcctctgcctc

SEQ ID NO: 187464 - DNA, 26 bp, Artificial Sequence
  Description of Artificial Sequence: Synthetic oligonucleotide
tgatccagggatggcctctgcctcca

SEQ ID NO: 187465 - DNA, 25 bp, Artificial Sequence
  Description of Artificial Sequence: Synthetic oligonucleotide
gatccagggatggcctctgcctcca

SEQ ID NO: 187466 - DNA, 25 bp, Artificial Sequence
  Description of Artificial Sequence: Synthetic oligonucleotide
atccagggatggcctctgcctccac

SEQ ID NO: 187467 - DNA, 24 bp, Artificial Sequence
  Description of Artificial Sequence: Synthetic oligonucleotide
tccagggatggcctctgcctccac

SEQ ID NO: 187468 - DNA, 23 bp, Artificial Sequence
  Description of Artificial Sequence: Synthetic oligonucleotide
ccagggatggcctctgcctccac

SEQ ID NO: 187469 - DNA, 24 bp, Artificial Sequence
  Description of Artificial Sequence: Synthetic oligonucleotide
cagggatggcctctgcctccacca

SEQ ID NO: 187470 - DNA, 27 bp, Artificial Sequence
  Description of Artificial Sequence: Synthetic oligonucleotide
agggatggcctctgcctccaccacaat

SEQ ID NO: 187471 - DNA, 27 bp, Artificial Sequence
  Description of Artificial Sequence: Synthetic oligonucleotide
tcagcctcgagcctgatccagggatgt

SEQ ID NO: 187472 - DNA, 26 bp, Artificial Sequence
  Description of Artificial Sequence: Synthetic oligonucleotide
cagcctcgagcctgatccagggatgt

SEQ ID NO: 187473 - DNA, 27 bp, Artificial Sequence
  Description of Artificial Sequence: Synthetic oligonucleotide
agcctcgagcctgatccagggatgtct

SEQ ID NO: 187474 - DNA, 26 bp, Artificial Sequence
  Description of Artificial Sequence: Synthetic oligonucleotide
gcctcgagcctgatccagggatgtct

SEQ ID NO: 187475 - DNA, 26 bp, Artificial Sequence
  Description of Artificial Sequence: Synthetic oligonucleotide
cctcgagcctgatccagggatgtctg

SEQ ID NO: 187476 - DNA, 27 bp, Artificial Sequence
  Description of Artificial Sequence: Synthetic oligonucleotide
ctcgagcctgatccagggatgtctgga

SEQ ID NO: 187477 - DNA, 28 bp, Artificial Sequence
  Description of Artificial Sequence: Synthetic oligonucleotide
tcgagcctgatccagggatgtctggatg

SEQ ID NO: 187478 - DNA, 27 bp, Artificial Sequence
  Description of Artificial Sequence: Synthetic oligonucleotide
cgagcctgatccagggatgtctggatg

SEQ ID NO: 187479 - DNA, 22 bp, Artificial Sequence
  Description of Artificial Sequence: Synthetic oligonucleotide
acggcgtggcctctcagcctcg

SEQ ID NO: 187480 - DNA, 27 bp, Artificial Sequence
  Description of Artificial Sequence: Synthetic oligonucleotide
atgggtcgacagaaggagctggtgtcc

SEQ ID NO: 187481 - DNA, 26 bp, Artificial Sequence
  Description of Artificial Sequence: Synthetic oligonucleotide
tgggtcgacagaaggagctggtgtcc

SEQ ID NO: 187482 - DNA, 25 bp, Artificial Sequence
  Description of Artificial Sequence: Synthetic oligonucleotide
gggtcgacagaaggagctggtgtcc

SEQ ID NO: 187483 - DNA, 25 bp, Artificial Sequence
  Description of Artificial Sequence: Synthetic oligonucleotide
ggtcgacagaaggagctggtgtccc

SEQ ID NO: 187484 - DNA, 25 bp, Artificial Sequence
  Description of Artificial Sequence: Synthetic oligonucleotide
gtcgacagaaggagctggtgtcccg

SEQ ID NO: 187485 - DNA, 26 bp, Artificial Sequence
  Description of Artificial Sequence: Synthetic oligonucleotide
tcgacagaaggagctggtgtcccgct

SEQ ID NO: 187486 - DNA, 25 bp, Artificial Sequence
  Description of Artificial Sequence: Synthetic oligonucleotide
cgacagaaggagctggtgtcccgct

SEQ ID NO: 187487 - DNA, 25 bp, Artificial Sequence
  Description of Artificial Sequence: Synthetic oligonucleotide
gacagaaggagctggtgtcccgctg

SEQ ID NO: 187488 - DNA, 25 bp, Artificial Sequence
  Description of Artificial Sequence: Synthetic oligonucleotide
acagaaggagctggtgtcccgctgc

SEQ ID NO: 187489 - DNA, 24 bp, Artificial Sequence
  Description of Artificial Sequence: Synthetic oligonucleotide
cagaaggagctggtgtcccgctgc

SEQ ID NO: 187490 - DNA, 24 bp, Artificial Sequence
  Description of Artificial Sequence: Synthetic oligonucleotide
agaaggagctggtgtcccgctgcg

SEQ ID NO: 187491 - DNA, 23 bp, Artificial Sequence
  Description of Artificial Sequence: Synthetic oligonucleotide
gaaggagctggtgtcccgctgcg

SEQ ID NO: 187492 - DNA, 23 bp, Artificial Sequence
  Description of Artificial Sequence: Synthetic oligonucleotide
aaggagctggtgtcccgctgcgg

SEQ ID NO: 187493 - DNA, 22 bp, Artificial Sequence
  Description of Artificial Sequence: Synthetic oligonucleotide
aggagctggtgtcccgctgcgg

SEQ ID NO: 187494 - DNA, 21 bp, Artificial Sequence
  Description of Artificial Sequence: Synthetic oligonucleotide
ggagctggtgtcccgctgcgg

SEQ ID NO: 187495 - DNA, 21 bp, Artificial Sequence
  Description of Artificial Sequence: Synthetic oligonucleotide
gagctggtgtcccgctgcggg

SEQ ID NO: 187496 - DNA, 22 bp, Artificial Sequence
  Description of Artificial Sequence: Synthetic oligonucleotide
agctggtgtcccgctgcgggga

SEQ ID NO: 187497 - DNA, 21 bp, Artificial Sequence
  Description of Artificial Sequence: Synthetic oligonucleotide
gctggtgtcccgctgcgggga

SEQ ID NO: 187498 - DNA, 23 bp, Artificial Sequence
  Description of Artificial Sequence: Synthetic oligonucleotide
ctggtgtcccgctgcggggagat

SEQ ID NO: 187499 - DNA, 23 bp, Artificial Sequence
  Description of Artificial Sequence: Synthetic oligonucleotide
tggtgtcccgctgcggggagatg

SEQ ID NO: 187500 - DNA, 22 bp, Artificial Sequence
  Description of Artificial Sequence: Synthetic oligonucleotide
ggtgtcccgctgcggggagatg

SEQ ID NO: 187501 - DNA, 23 bp, Artificial Sequence
  Description of Artificial Sequence: Synthetic oligonucleotide
gtgtcccgctgcggggagatgct

SEQ ID NO: 187502 - DNA, 23 bp, Artificial Sequence
  Description of Artificial Sequence: Synthetic oligonucleotide
tgtcccgctgcggggagatgctc

SEQ ID NO: 187503 - DNA, 22 bp, Artificial Sequence
  Description of Artificial Sequence: Synthetic oligonucleotide
gtcccgctgcggggagatgctc

SEQ ID NO: 187504 - DNA, 23 bp, Artificial Sequence
  Description of Artificial Sequence: Synthetic oligonucleotide
tcccgctgcggggagatgctcca

SEQ ID NO: 187505 - DNA, 22 bp, Artificial Sequence
  Description of Artificial Sequence: Synthetic oligonucleotide
cccgctgcggggagatgctcca

SEQ ID NO: 187506 - DNA, 24 bp, Artificial Sequence
  Description of Artificial Sequence: Synthetic oligonucleotide
ccgctgcggggagatgctccacat

SEQ ID NO: 187507 - DNA, 24 bp, Artificial Sequence
  Description of Artificial Sequence: Synthetic oligonucleotide
cgctgcggggagatgctccacatc

SEQ ID NO: 187508 - DNA, 24 bp, Artificial Sequence
  Description of Artificial Sequence: Synthetic oligonucleotide
gctgcggggagatgctccacatcc

SEQ ID NO: 187509 - DNA, 24 bp, Artificial Sequence
  Description of Artificial Sequence: Synthetic oligonucleotide
ctgcggggagatgctccacatccg

SEQ ID NO: 187510 - DNA, 26 bp, Artificial Sequence
  Description of Artificial Sequence: Synthetic oligonucleotide
tgcggggagatgctccacatccgcta

SEQ ID NO: 187511 - DNA, 25 bp, Artificial Sequence
  Description of Artificial Sequence: Synthetic oligonucleotide
gcggggagatgctccacatccgcta

SEQ ID NO: 187512 - DNA, 25 bp, Artificial Sequence
  Description of Artificial Sequence: Synthetic oligonucleotide
cggggagatgctccacatccgctac

SEQ ID NO: 187513 - DNA, 25 bp, Artificial Sequence
  Description of Artificial Sequence: Synthetic oligonucleotide
ggggagatgctccacatccgctacc

SEQ ID NO: 187514 - DNA, 25 bp, Artificial Sequence
  Description of Artificial Sequence: Synthetic oligonucleotide
gggagatgctccacatccgctaccg

SEQ ID NO: 187515 - DNA, 25 bp, Artificial Sequence
  Description of Artificial Sequence: Synthetic oligonucleotide
ggagatgctccacatccgctaccgg

SEQ ID NO: 187516 - DNA, 26 bp, Artificial Sequence
  Description of Artificial Sequence: Synthetic oligonucleotide
gagatgctccacatccgctaccggct

SEQ ID NO: 187517 - DNA, 26 bp, Artificial Sequence
  Description of Artificial Sequence: Synthetic oligonucleotide
agatgctccacatccgctaccggctg

SEQ ID NO: 187518 - DNA, 25 bp, Artificial Sequence
  Description of Artificial Sequence: Synthetic oligonucleotide
gatgctccacatccgctaccggctg

SEQ ID NO: 187519 - DNA, 26 bp, Artificial Sequence
  Description of Artificial Sequence: Synthetic oligonucleotide
atgctccacatccgctaccggctgct

SEQ ID NO: 187520 - DNA, 25 bp, Artificial Sequence
  Description of Artificial Sequence: Synthetic oligonucleotide
tgctccacatccgctaccggctgct

SEQ ID NO: 187521 - DNA, 24 bp, Artificial Sequence
  Description of Artificial Sequence: Synthetic oligonucleotide
gctccacatccgctaccggctgct

SEQ ID NO: 187522 - DNA, 24 bp, Artificial Sequence
  Description of Artificial Sequence: Synthetic oligonucleotide
ctccacatccgctaccggctgctc

SEQ ID NO: 187523 - DNA, 24 bp, Artificial Sequence
  Description of Artificial Sequence: Synthetic oligonucleotide
tccacatccgctaccggctgctcc

SEQ ID NO: 187524 - DNA, 23 bp, Artificial Sequence
  Description of Artificial Sequence: Synthetic oligonucleotide
ccacatccgctaccggctgctcc

SEQ ID NO: 187525 - DNA, 24 bp, Artificial Sequence
  Description of Artificial Sequence: Synthetic oligonucleotide
cacatccgctaccggctgctccga

SEQ ID NO: 187526 - DNA, 25 bp, Artificial Sequence
  Description of Artificial Sequence: Synthetic oligonucleotide
acatccgctaccggctgctccgaca

SEQ ID NO: 187527 - DNA, 24 bp, Artificial Sequence
  Description of Artificial Sequence: Synthetic oligonucleotide
catccgctaccggctgctccgaca

SEQ ID NO: 187528 - DNA, 24 bp, Artificial Sequence
  Description of Artificial Sequence: Synthetic oligonucleotide
atccgctaccggctgctccgacag

SEQ ID NO: 187529 - DNA, 23 bp, Artificial Sequence
  Description of Artificial Sequence: Synthetic oligonucleotide
tccgctaccggctgctccgacag

SEQ ID NO: 187530 - DNA, 22 bp, Artificial Sequence
  Description of Artificial Sequence: Synthetic oligonucleotide
ccgctaccggctgctccgacag

SEQ ID NO: 187531 - DNA, 22 bp, Artificial Sequence
  Description of Artificial Sequence: Synthetic oligonucleotide
cgctaccggctgctccgacagg

SEQ ID NO: 187532 - DNA, 22 bp, Artificial Sequence
  Description of Artificial Sequence: Synthetic oligonucleotide
gctaccggctgctccgacaggc

SEQ ID NO: 187533 - DNA, 22 bp, Artificial Sequence
  Description of Artificial Sequence: Synthetic oligonucleotide
ctaccggctgctccgacaggcg

SEQ ID NO: 187534 - DNA, 23 bp, Artificial Sequence
  Description of Artificial Sequence: Synthetic oligonucleotide
taccggctgctccgacaggcgct

SEQ ID NO: 187535 - DNA, 22 bp, Artificial Sequence
  Description of Artificial Sequence: Synthetic oligonucleotide
accggctgctccgacaggcgct

SEQ ID NO: 187536 - DNA, 21 bp, Artificial Sequence
  Description of Artificial Sequence: Synthetic oligonucleotide
ccggctgctccgacaggcgct

SEQ ID NO: 187537 - DNA, 21 bp, Artificial Sequence
  Description of Artificial Sequence: Synthetic oligonucleotide
cggctgctccgacaggcgctg

SEQ ID NO: 187538 - DNA, 21 bp, Artificial Sequence
  Description of Artificial Sequence: Synthetic oligonucleotide
ggctgctccgacaggcgctgg

SEQ ID NO: 187539 - DNA, 21 bp, Artificial Sequence
  Description of Artificial Sequence: Synthetic oligonucleotide
gctgctccgacaggcgctggc

SEQ ID NO: 187540 - DNA, 21 bp, Artificial Sequence
  Description of Artificial Sequence: Synthetic oligonucleotide
ctgctccgacaggcgctggcc

SEQ ID NO: 187541 - DNA, 22 bp, Artificial Sequence
  Description of Artificial Sequence: Synthetic oligonucleotide
tgctccgacaggcgctggccga

SEQ ID NO: 187542 - DNA, 21 bp, Artificial Sequence
  Description of Artificial Sequence: Synthetic oligonucleotide
gctccgacaggcgctggccga

SEQ ID NO: 187543 - DNA, 22 bp, Artificial Sequence
  Description of Artificial Sequence: Synthetic oligonucleotide
ctccgacaggcgctggccgagt

SEQ ID NO: 187544 - DNA, 22 bp, Artificial Sequence
  Description of Artificial Sequence: Synthetic oligonucleotide
tccgacaggcgctggccgagtg

SEQ ID NO: 187545 - DNA, 21 bp, Artificial Sequence
  Description of Artificial Sequence: Synthetic oligonucleotide
ccgacaggcgctggccgagtg

SEQ ID NO: 187546 - DNA, 21 bp, Artificial Sequence
  Description of Artificial Sequence: Synthetic oligonucleotide
cgacaggcgctggccgagtgc

SEQ ID NO: 187547 - DNA, 22 bp, Artificial Sequence
  Description of Artificial Sequence: Synthetic oligonucleotide
gacaggcgctggccgagtgcct

SEQ ID NO: 187548 - DNA, 22 bp, Artificial Sequence
  Description of Artificial Sequence: Synthetic oligonucleotide
acaggcgctggccgagtgcctg

SEQ ID NO: 187549 - DNA, 21 bp, Artificial Sequence
  Description of Artificial Sequence: Synthetic oligonucleotide
caggcgctggccgagtgcctg

SEQ ID NO: 187550 - DNA, 21 bp, Artificial Sequence
  Description of Artificial Sequence: Synthetic oligonucleotide
aggcgctggccgagtgcctgg

SEQ ID NO: 187551 - DNA, 20 bp, Artificial Sequence
  Description of Artificial Sequence: Synthetic oligonucleotide
ggcgctggccgagtgcctgg

SEQ ID NO: 187552 - DNA, 20 bp, Artificial Sequence
  Description of Artificial Sequence: Synthetic oligonucleotide
gcgctggccgagtgcctggg

SEQ ID NO: 187553 - DNA, 21 bp, Artificial Sequence
  Description of Artificial Sequence: Synthetic oligonucleotide
cgctggccgagtgcctgggga

SEQ ID NO: 187554 - DNA, 21 bp, Artificial Sequence
  Description of Artificial Sequence: Synthetic oligonucleotide
gctggccgagtgcctggggac

SEQ ID NO: 187555 - DNA, 21 bp, Artificial Sequence
  Description of Artificial Sequence: Synthetic oligonucleotide
ctggccgagtgcctggggacc

SEQ ID NO: 187556 - DNA, 22 bp, Artificial Sequence
  Description of Artificial Sequence: Synthetic oligonucleotide
tggccgagtgcctggggaccct

SEQ ID NO: 187557 - DNA, 21 bp, Artificial Sequence
  Description of Artificial Sequence: Synthetic oligonucleotide
ggccgagtgcctggggaccct

SEQ ID NO: 187558 - DNA, 23 bp, Artificial Sequence
  Description of Artificial Sequence: Synthetic oligonucleotide
gccgagtgcctggggaccctcat

SEQ ID NO: 187559 - DNA, 23 bp, Artificial Sequence
  Description of Artificial Sequence: Synthetic oligonucleotide
ccgagtgcctggggaccctcatc

SEQ ID NO: 187560 - DNA, 24 bp, Artificial Sequence
  Description of Artificial Sequence: Synthetic oligonucleotide
cgagtgcctggggaccctcatcct

SEQ ID NO: 187561 - DNA, 24 bp, Artificial Sequence
  Description of Artificial Sequence: Synthetic oligonucleotide
gagtgcctggggaccctcatcctg

SEQ ID NO: 187562 - DNA, 25 bp, Artificial Sequence
  Description of Artificial Sequence: Synthetic oligonucleotide
agtgcctggggaccctcatcctggt

SEQ ID NO: 187563 - DNA, 24 bp, Artificial Sequence
  Description of Artificial Sequence: Synthetic oligonucleotide
gtgcctggggaccctcatcctggt

SEQ ID NO: 187564 - DNA, 26 bp, Artificial Sequence
  Description of Artificial Sequence: Synthetic oligonucleotide
tgcctggggaccctcatcctggtgat

SEQ ID NO: 187565 - DNA, 25 bp, Artificial Sequence
  Description of Artificial Sequence: Synthetic oligonucleotide
gcctggggaccctcatcctggtgat

SEQ ID NO: 187566 - DNA, 27 bp, Artificial Sequence
  Description of Artificial Sequence: Synthetic oligonucleotide
cctggggaccctcatcctggtgatgtt

SEQ ID NO: 187567 - DNA, 28 bp, Artificial Sequence
  Description of Artificial Sequence: Synthetic oligonucleotide
ctggggaccctcatcctggtgatgtttg

SEQ ID NO: 187568 - DNA, 28 bp, Artificial Sequence
  Description of Artificial Sequence: Synthetic oligonucleotide
tggggaccctcatcctggtgatgtttgg

SEQ ID NO: 187569 - DNA, 27 bp, Artificial Sequence
  Description of Artificial Sequence: Synthetic oligonucleotide
ggggaccctcatcctggtgatgtttgg

SEQ ID NO: 187570 - DNA, 27 bp, Artificial Sequence
  Description of Artificial Sequence: Synthetic oligonucleotide
gggaccctcatcctggtgatgtttggc

SEQ ID NO: 187571 - DNA, 28 bp, Artificial Sequence
  Description of Artificial Sequence: Synthetic oligonucleotide
ggaccctcatcctggtgatgtttggctg

SEQ ID NO: 187572 - DNA, 29 bp, Artificial Sequence
  Description of Artificial Sequence: Synthetic oligonucleotide
gaccctcatcctggtgatgtttggctgtg

SEQ ID NO: 187573 - DNA, 29 bp, Artificial Sequence
  Description of Artificial Sequence: Synthetic oligonucleotide
accctcatcctggtgatgtttggctgtgg

SEQ ID NO: 187574 - DNA, 28 bp, Artificial Sequence
  Description of Artificial Sequence: Synthetic oligonucleotide
ccctcatcctggtgatgtttggctgtgg

SEQ ID NO: 187575 - DNA, 28 bp, Artificial Sequence
  Description of Artificial Sequence: Synthetic oligonucleotide
cctcatcctggtgatgtttggctgtggc

SEQ ID NO: 187576 - DNA, 29 bp, Artificial Sequence
  Description of Artificial Sequence: Synthetic oligonucleotide
ctcatcctggtgatgtttggctgtggctc

SEQ ID NO: 187577 - DNA, 29 bp, Artificial Sequence
  Description of Artificial Sequence: Synthetic oligonucleotide
tcatcctggtgatgtttggctgtggctcc

SEQ ID NO: 187578 - DNA, 28 bp, Artificial Sequence
  Description of Artificial Sequence: Synthetic oligonucleotide
catcctggtgatgtttggctgtggctcc

SEQ ID NO: 187579 - DNA, 28 bp, Artificial Sequence
  Description of Artificial Sequence: Synthetic oligonucleotide
atcctggtgatgtttggctgtggctccg

SEQ ID NO: 187580 - DNA, 27 bp, Artificial Sequence
  Description of Artificial Sequence: Synthetic oligonucleotide
tcctggtgatgtttggctgtggctccg

SEQ ID NO: 187581 - DNA, 27 bp, Artificial Sequence
  Description of Artificial Sequence: Synthetic oligonucleotide
cctggtgatgtttggctgtggctccgt

SEQ ID NO: 187582 - DNA, 27 bp, Artificial Sequence
  Description of Artificial Sequence: Synthetic oligonucleotide
ctggtgatgtttggctgtggctccgtg

SEQ ID NO: 187583 - DNA, 27 bp, Artificial Sequence
  Description of Artificial Sequence: Synthetic oligonucleotide
tggtgatgtttggctgtggctccgtgg

SEQ ID NO: 187584 - DNA, 26 bp, Artificial Sequence
  Description of Artificial Sequence: Synthetic oligonucleotide
ggtgatgtttggctgtggctccgtgg

SEQ ID NO: 187585 - DNA, 26 bp, Artificial Sequence
  Description of Artificial Sequence: Synthetic oligonucleotide
gtgatgtttggctgtggctccgtggc

SEQ ID NO: 187586 - DNA, 26 bp, Artificial Sequence
  Description of Artificial Sequence: Synthetic oligonucleotide
tgatgtttggctgtggctccgtggcc

SEQ ID NO: 187587 - DNA, 25 bp, Artificial Sequence
  Description of Artificial Sequence: Synthetic oligonucleotide
gatgtttggctgtggctccgtggcc

SEQ ID NO: 187588 - DNA, 26 bp, Artificial Sequence
  Description of Artificial Sequence: Synthetic oligonucleotide
atgtttggctgtggctccgtggccca

SEQ ID NO: 187589 - DNA, 25 bp, Artificial Sequence
  Description of Artificial Sequence: Synthetic oligonucleotide
tgtttggctgtggctccgtggccca

SEQ ID NO: 187590 - DNA, 24 bp, Artificial Sequence
  Description of Artificial Sequence: Synthetic oligonucleotide
gtttggctgtggctccgtggccca

SEQ ID NO: 187591 - DNA, 24 bp, Artificial Sequence
  Description of Artificial Sequence: Synthetic oligonucleotide
tttggctgtggctccgtggcccag

SEQ ID NO: 187592 - DNA, 23 bp, Artificial Sequence
  Description of Artificial Sequence: Synthetic oligonucleotide
ttggctgtggctccgtggcccag

SEQ ID NO: 187593 - DNA, 22 bp, Artificial Sequence
  Description of Artificial Sequence: Synthetic oligonucleotide
tggctgtggctccgtggcccag

SEQ ID NO: 187594 - DNA, 21 bp, Artificial Sequence
  Description of Artificial Sequence: Synthetic oligonucleotide
ggctgtggctccgtggcccag

SEQ ID NO: 187595 - DNA, 23 bp, Artificial Sequence
  Description of Artificial Sequence: Synthetic oligonucleotide
gctgtggctccgtggcccaggtt

SEQ ID NO: 187596 - DNA, 24 bp, Artificial Sequence
  Description of Artificial Sequence: Synthetic oligonucleotide
ctgtggctccgtggcccaggttgt

SEQ ID NO: 187597 - DNA, 24 bp, Artificial Sequence
  Description of Artificial Sequence: Synthetic oligonucleotide
tgtggctccgtggcccaggttgtg

SEQ ID NO: 187598 - DNA, 23 bp, Artificial Sequence
  Description of Artificial Sequence: Synthetic oligonucleotide
gtggctccgtggcccaggttgtg

SEQ ID NO: 187599 - DNA, 24 bp, Artificial Sequence
  Description of Artificial Sequence: Synthetic oligonucleotide
tggctccgtggcccaggttgtgct

SEQ ID NO: 187600 - DNA, 23 bp, Artificial Sequence
  Description of Artificial Sequence: Synthetic oligonucleotide
ggctccgtggcccaggttgtgct

SEQ ID NO: 187601 - DNA, 24 bp, Artificial Sequence
  Description of Artificial Sequence: Synthetic oligonucleotide
gctccgtggcccaggttgtgctca

SEQ ID NO: 187602 - DNA, 24 bp, Artificial Sequence
  Description of Artificial Sequence: Synthetic oligonucleotide
ctccgtggcccaggttgtgctcag

SEQ ID NO: 187603 - DNA, 24 bp, Artificial Sequence
  Description of Artificial Sequence: Synthetic oligonucleotide
tccgtggcccaggttgtgctcagc

SEQ ID NO: 187604 - DNA, 23 bp, Artificial Sequence
  Description of Artificial Sequence: Synthetic oligonucleotide
ccgtggcccaggttgtgctcagc

SEQ ID NO: 187605 - DNA, 23 bp, Artificial Sequence
  Description of Artificial Sequence: Synthetic oligonucleotide
cgtggcccaggttgtgctcagcc

SEQ ID NO: 187606 - DNA, 23 bp, Artificial Sequence
  Description of Artificial Sequence: Synthetic oligonucleotide
gtggcccaggttgtgctcagccg

SEQ ID NO: 187607 - DNA, 23 bp, Artificial Sequence
  Description of Artificial Sequence: Synthetic oligonucleotide
tggcccaggttgtgctcagccgg

SEQ ID NO: 187608 - DNA, 22 bp, Artificial Sequence
  Description of Artificial Sequence: Synthetic oligonucleotide
ggcccaggttgtgctcagccgg

SEQ ID NO: 187609 - DNA, 22 bp, Artificial Sequence
  Description of Artificial Sequence: Synthetic oligonucleotide
gcccaggttgtgctcagccggg

SEQ ID NO: 187610 - DNA, 22 bp, Artificial Sequence
  Description of Artificial Sequence: Synthetic oligonucleotide
cccaggttgtgctcagccgggg

SEQ ID NO: 187611 - DNA, 23 bp, Artificial Sequence
  Description of Artificial Sequence: Synthetic oligonucleotide
ccaggttgtgctcagccggggca

SEQ ID NO: 187612 - DNA, 23 bp, Artificial Sequence
  Description of Artificial Sequence: Synthetic oligonucleotide
caggttgtgctcagccggggcac

SEQ ID NO: 187613 - DNA, 23 bp, Artificial Sequence
  Description of Artificial Sequence: Synthetic oligonucleotide
aggttgtgctcagccggggcacc

SEQ ID NO: 187614 - DNA, 22 bp, Artificial Sequence
  Description of Artificial Sequence: Synthetic oligonucleotide
ggttgtgctcagccggggcacc

SEQ ID NO: 187615 - DNA, 23 bp, Artificial Sequence
  Description of Artificial Sequence: Synthetic oligonucleotide
gttgtgctcagccggggcaccca

SEQ ID NO: 187616 - DNA, 23 bp, Artificial Sequence
  Description of Artificial Sequence: Synthetic oligonucleotide
ttgtgctcagccggggcacccac

SEQ ID NO: 187617 - DNA, 22 bp, Artificial Sequence
  Description of Artificial Sequence: Synthetic oligonucleotide
tgtgctcagccggggcacccac

SEQ ID NO: 187618 - DNA, 21 bp, Artificial Sequence
  Description of Artificial Sequence: Synthetic oligonucleotide
gtgctcagccggggcacccac

SEQ ID NO: 187619 - DNA, 21 bp, Artificial Sequence
  Description of Artificial Sequence: Synthetic oligonucleotide
tgctcagccggggcacccacg

SEQ ID NO: 187620 - DNA, 20 bp, Artificial Sequence
  Description of Artificial Sequence: Synthetic oligonucleotide
gctcagccggggcacccacg

SEQ ID NO: 187621 - DNA, 21 bp, Artificial Sequence
  Description of Artificial Sequence: Synthetic oligonucleotide
ctcagccggggcacccacggt

SEQ ID NO: 187622 - DNA, 21 bp, Artificial Sequence
  Description of Artificial Sequence: Synthetic oligonucleotide
tcagccggggcacccacggtg

SEQ ID NO: 187623 - DNA, 20 bp, Artificial Sequence
  Description of Artificial Sequence: Synthetic oligonucleotide
cagccggggcacccacggtg

SEQ ID NO: 187624 - DNA, 23 bp, Artificial Sequence
  Description of Artificial Sequence: Synthetic oligonucleotide
agccggggcacccacggtggttt

SEQ ID NO: 187625 - DNA, 22 bp, Artificial Sequence
  Description of Artificial Sequence: Synthetic oligonucleotide
gccggggcacccacggtggttt

SEQ ID NO: 187626 - DNA, 22 bp, Artificial Sequence
  Description of Artificial Sequence: Synthetic oligonucleotide
ccggggcacccacggtggtttc

SEQ ID NO: 187627 - DNA, 23 bp, Artificial Sequence
  Description of Artificial Sequence: Synthetic oligonucleotide
cggggcacccacggtggtttcct

SEQ ID NO: 187628 - DNA, 24 bp, Artificial Sequence
  Description of Artificial Sequence: Synthetic oligonucleotide
ggggcacccacggtggtttcctca

SEQ ID NO: 187629 - DNA, 24 bp, Artificial Sequence
  Description of Artificial Sequence: Synthetic oligonucleotide
gggcacccacggtggtttcctcac

SEQ ID NO: 187630 - DNA, 26 bp, Artificial Sequence
  Description of Artificial Sequence: Synthetic oligonucleotide
ggcacccacggtggtttcctcaccat

SEQ ID NO: 187631 - DNA, 27 bp, Artificial Sequence
  Description of Artificial Sequence: Synthetic oligonucleotide
gcacccacggtggtttcctcaccatca

SEQ ID NO: 187632 - DNA, 28 bp, Artificial Sequence
  Description of Artificial Sequence: Synthetic oligonucleotide
cacccacggtggtttcctcaccatcaac

SEQ ID NO: 187633 - DNA, 28 bp, Artificial Sequence
  Description of Artificial Sequence: Synthetic oligonucleotide
acccacggtggtttcctcaccatcaacc

SEQ ID NO: 187634 - DNA, 27 bp, Artificial Sequence
  Description of Artificial Sequence: Synthetic oligonucleotide
cccacggtggtttcctcaccatcaacc

SEQ ID NO: 187635 - DNA, 28 bp, Artificial Sequence
  Description of Artificial Sequence: Synthetic oligonucleotide
ccacggtggtttcctcaccatcaacctg

SEQ ID NO: 187636 - DNA, 28 bp, Artificial Sequence
  Description of Artificial Sequence: Synthetic oligonucleotide
cacggtggtttcctcaccatcaacctgg

SEQ ID NO: 187637 - DNA, 28 bp, Artificial Sequence
  Description of Artificial Sequence: Synthetic oligonucleotide
acggtggtttcctcaccatcaacctggc

SEQ ID NO: 187638 - DNA, 27 bp, Artificial Sequence
  Description of Artificial Sequence: Synthetic oligonucleotide
cggtggtttcctcaccatcaacctggc

SEQ ID NO: 187639 - DNA, 27 bp, Artificial Sequence
  Description of Artificial Sequence: Synthetic oligonucleotide
ggtggtttcctcaccatcaacctggcc

SEQ ID NO: 187640 - DNA, 30 bp, Artificial Sequence
  Description of Artificial Sequence: Synthetic oligonucleotide
gtggtttcctcaccatcaacctggcctttg

SEQ ID NO: 187641 - DNA, 30 bp, Artificial Sequence
  Description of Artificial Sequence: Synthetic oligonucleotide
tggtttcctcaccatcaacctggcctttgg

SEQ ID NO: 187642 - DNA, 29 bp, Artificial Sequence
  Description of Artificial Sequence: Synthetic oligonucleotide
ggtttcctcaccatcaacctggcctttgg

SEQ ID NO: 187643 - DNA, 29 bp, Artificial Sequence
  Description of Artificial Sequence: Synthetic oligonucleotide
gtttcctcaccatcaacctggcctttggc

SEQ ID NO: 187644 - DNA, 32 bp, Artificial Sequence
  Description of Artificial Sequence: Synthetic oligonucleotide
tttcctcaccatcaacctggcctttggctttg

SEQ ID NO: 187645 - DNA, 31 bp, Artificial Sequence
  Description of Artificial Sequence: Synthetic oligonucleotide
ttcctcaccatcaacctggcctttggctttg

SEQ ID NO: 187646 - DNA, 30 bp, Artificial Sequence
  Description of Artificial Sequence: Synthetic oligonucleotide
tcctcaccatcaacctggcctttggctttg

SEQ ID NO: 187647 - DNA, 29 bp, Artificial Sequence
  Description of Artificial Sequence: Synthetic oligonucleotide
cctcaccatcaacctggcctttggctttg

SEQ ID NO: 187648 - DNA, 29 bp, Artificial Sequence
  Description of Artificial Sequence: Synthetic oligonucleotide
ctcaccatcaacctggcctttggctttgc

SEQ ID NO: 187649 - DNA, 30 bp, Artificial Sequence
  Description of Artificial Sequence: Synthetic oligonucleotide
tcaccatcaacctggcctttggctttgctg

SEQ ID NO: 187650 - DNA, 29 bp, Artificial Sequence
  Description of Artificial Sequence: Synthetic oligonucleotide
caccatcaacctggcctttggctttgctg

SEQ ID NO: 187651 - DNA, 30 bp, Artificial Sequence
  Description of Artificial Sequence: Synthetic oligonucleotide
accatcaacctggcctttggctttgctgtc

SEQ ID NO: 187652 - DNA, 29 bp, Artificial Sequence
  Description of Artificial Sequence: Synthetic oligonucleotide
ccatcaacctggcctttggctttgctgtc

SEQ ID NO: 187653 - DNA, 30 bp, Artificial Sequence
  Description of Artificial Sequence: Synthetic oligonucleotide
catcaacctggcctttggctttgctgtcac

SEQ ID NO: 187654 - DNA, 31 bp, Artificial Sequence
  Description of Artificial Sequence: Synthetic oligonucleotide
atcaacctggcctttggctttgctgtcactc

SEQ ID NO: 187655 - DNA, 30 bp, Artificial Sequence
  Description of Artificial Sequence: Synthetic oligonucleotide
tcaacctggcctttggctttgctgtcactc

SEQ ID NO: 187656 - DNA, 29 bp, Artificial Sequence
  Description of Artificial Sequence: Synthetic oligonucleotide
caacctggcctttggctttgctgtcactc

SEQ ID NO: 187657 - DNA, 30 bp, Artificial Sequence
  Description of Artificial Sequence: Synthetic oligonucleotide
aacctggcctttggctttgctgtcactctg

SEQ ID NO: 187658 - DNA, 29 bp, Artificial Sequence
  Description of Artificial Sequence: Synthetic oligonucleotide
acctggcctttggctttgctgtcactctg

SEQ ID NO: 187659 - DNA, 28 bp, Artificial Sequence
  Description of Artificial Sequence: Synthetic oligonucleotide
cctggcctttggctttgctgtcactctg

SEQ ID NO: 187660 - DNA, 28 bp, Artificial Sequence
  Description of Artificial Sequence: Synthetic oligonucleotide
ctggcctttggctttgctgtcactctgg

SEQ ID NO: 187661 - DNA, 28 bp, Artificial Sequence
  Description of Artificial Sequence: Synthetic oligonucleotide
tggcctttggctttgctgtcactctggg

SEQ ID NO: 187662 - DNA, 27 bp, Artificial Sequence
  Description of Artificial Sequence: Synthetic oligonucleotide
ggcctttggctttgctgtcactctggg

SEQ ID NO: 187663 - DNA, 27 bp, Artificial Sequence
  Description of Artificial Sequence: Synthetic oligonucleotide
gcctttggctttgctgtcactctgggc

SEQ ID NO: 187664 - DNA, 29 bp, Artificial Sequence
  Description of Artificial Sequence: Synthetic oligonucleotide
cctttggctttgctgtcactctgggcatc

SEQ ID NO: 187665 - DNA, 29 bp, Artificial Sequence
  Description of Artificial Sequence: Synthetic oligonucleotide
ctttggctttgctgtcactctgggcatcc

SEQ ID NO: 187666 - DNA, 30 bp, Artificial Sequence
  Description of Artificial Sequence: Synthetic oligonucleotide
tttggctttgctgtcactctgggcatcctc

SEQ ID NO: 187667 - DNA, 29 bp, Artificial Sequence
  Description of Artificial Sequence: Synthetic oligonucleotide
ttggctttgctgtcactctgggcatcctc

SEQ ID NO: 187668 - DNA, 28 bp, Artificial Sequence
  Description of Artificial Sequence: Synthetic oligonucleotide
tggctttgctgtcactctgggcatcctc

SEQ ID NO: 187669 - DNA, 27 bp, Artificial Sequence
  Description of Artificial Sequence: Synthetic oligonucleotide
ggctttgctgtcactctgggcatcctc

SEQ ID NO: 187670 - DNA, 29 bp, Artificial Sequence
  Description of Artificial Sequence: Synthetic oligonucleotide
gctttgctgtcactctgggcatcctcatc

SEQ ID NO: 187671 - DNA, 29 bp, Artificial Sequence
  Description of Artificial Sequence: Synthetic oligonucleotide
ctttgctgtcactctgggcatcctcatcg

SEQ ID NO: 187672 - DNA, 29 bp, Artificial Sequence
  Description of Artificial Sequence: Synthetic oligonucleotide
tttgctgtcactctgggcatcctcatcgc

SEQ ID NO: 187673 - DNA, 28 bp, Artificial Sequence
  Description of Artificial Sequence: Synthetic oligonucleotide
ttgctgtcactctgggcatcctcatcgc

SEQ ID NO: 187674 - DNA, 27 bp, Artificial Sequence
  Description of Artificial Sequence: Synthetic oligonucleotide
tgctgtcactctgggcatcctcatcgc

SEQ ID NO: 187675 - DNA, 27 bp, Artificial Sequence
  Description of Artificial Sequence: Synthetic oligonucleotide
gctgtcactctgggcatcctcatcgct

SEQ ID NO: 187676 - DNA, 27 bp, Artificial Sequence
  Description of Artificial Sequence: Synthetic oligonucleotide
ctgtcactctgggcatcctcatcgctg

SEQ ID NO: 187677 - DNA, 27 bp, Artificial Sequence
  Description of Artificial Sequence: Synthetic oligonucleotide
tgtcactctgggcatcctcatcgctgg

SEQ ID NO: 187678 - DNA, 26 bp, Artificial Sequence
  Description of Artificial Sequence: Synthetic oligonucleotide
gtcactctgggcatcctcatcgctgg

SEQ ID NO: 187679 - DNA, 26 bp, Artificial Sequence
  Description of Artificial Sequence: Synthetic oligonucleotide
tcactctgggcatcctcatcgctggc

SEQ ID NO: 187680 - DNA, 25 bp, Artificial Sequence
  Description of Artificial Sequence: Synthetic oligonucleotide
cactctgggcatcctcatcgctggc

SEQ ID NO: 187681 - DNA, 26 bp, Artificial Sequence
  Description of Artificial Sequence: Synthetic oligonucleotide
actctgggcatcctcatcgctggcca

SEQ ID NO: 187682 - DNA, 25 bp, Artificial Sequence
  Description of Artificial Sequence: Synthetic oligonucleotide
ctctgggcatcctcatcgctggcca

SEQ ID NO: 187683 - DNA, 25 bp, Artificial Sequence
  Description of Artificial Sequence: Synthetic oligonucleotide
tctgggcatcctcatcgctggccag

SEQ ID NO: 187684 - DNA, 24 bp, Artificial Sequence
  Description of Artificial Sequence: Synthetic oligonucleotide
ctgggcatcctcatcgctggccag

SEQ ID NO: 187685 - DNA, 25 bp, Artificial Sequence
  Description of Artificial Sequence: Synthetic oligonucleotide
tgggcatcctcatcgctggccaggt

SEQ ID NO: 187686 - DNA, 24 bp, Artificial Sequence
  Description of Artificial Sequence: Synthetic oligonucleotide
gggcatcctcatcgctggccaggt

SEQ ID NO: 187687 - DNA, 25 bp, Artificial Sequence
  Description of Artificial Sequence: Synthetic oligonucleotide
ggcatcctcatcgctggccaggtct

SEQ ID NO: 187688 - DNA, 26 bp, Artificial Sequence
  Description of Artificial Sequence: Synthetic oligonucleotide
gcatcctcatcgctggccaggtctct

SEQ ID NO: 187689 - DNA, 26 bp, Artificial Sequence
  Description of Artificial Sequence: Synthetic oligonucleotide
catcctcatcgctggccaggtctctg

SEQ ID NO: 187690 - DNA, 26 bp, Artificial Sequence
  Description of Artificial Sequence: Synthetic oligonucleotide
atcctcatcgctggccaggtctctgg

SEQ ID NO: 187691 - DNA, 25 bp, Artificial Sequence
  Description of Artificial Sequence: Synthetic oligonucleotide
tcctcatcgctggccaggtctctgg

SEQ ID NO: 187692 - DNA, 24 bp, Artificial Sequence
  Description of Artificial Sequence: Synthetic oligonucleotide
cctcatcgctggccaggtctctgg

SEQ ID NO: 187693 - DNA, 24 bp, Artificial Sequence
  Description of Artificial Sequence: Synthetic oligonucleotide
ctcatcgctggccaggtctctggg

SEQ ID NO: 187694 - DNA, 24 bp, Artificial Sequence
  Description of Artificial Sequence: Synthetic oligonucleotide
tcatcgctggccaggtctctgggg

SEQ ID NO: 187695 - DNA, 23 bp, Artificial Sequence
  Description of Artificial Sequence: Synthetic oligonucleotide
catcgctggccaggtctctgggg

SEQ ID NO: 187696 - DNA, 23 bp, Artificial Sequence
  Description of Artificial Sequence: Synthetic oligonucleotide
atcgctggccaggtctctggggc

SEQ ID NO: 187697 - DNA, 22 bp, Artificial Sequence
  Description of Artificial Sequence: Synthetic oligonucleotide
tcgctggccaggtctctggggc

SEQ ID NO: 187698 - DNA, 21 bp, Artificial Sequence
  Description of Artificial Sequence: Synthetic oligonucleotide
cgctggccaggtctctggggc

SEQ ID NO: 187699 - DNA, 21 bp, Artificial Sequence
  Description of Artificial Sequence: Synthetic oligonucleotide
gctggccaggtctctggggcc

SEQ ID NO: 187700 - DNA, 22 bp, Artificial Sequence
  Description of Artificial Sequence: Synthetic oligonucleotide
ctggccaggtctctggggccca

SEQ ID NO: 187701 - DNA, 22 bp, Artificial Sequence
  Description of Artificial Sequence: Synthetic oligonucleotide
tggccaggtctctggggcccac

SEQ ID NO: 187702 - DNA, 21 bp, Artificial Sequence
  Description of Artificial Sequence: Synthetic oligonucleotide
ggccaggtctctggggcccac

SEQ ID NO: 187703 - DNA, 22 bp, Artificial Sequence
  Description of Artificial Sequence: Synthetic oligonucleotide
gccaggtctctggggcccacct

SEQ ID NO: 187704 - DNA, 24 bp, Artificial Sequence
  Description of Artificial Sequence: Synthetic oligonucleotide
ccaggtctctggggcccacctgaa

SEQ ID NO: 187705 - DNA, 24 bp, Artificial Sequence
  Description of Artificial Sequence: Synthetic oligonucleotide
caggtctctggggcccacctgaac

SEQ ID NO: 187706 - DNA, 24 bp, Artificial Sequence
  Description of Artificial Sequence: Synthetic oligonucleotide
aggtctctggggcccacctgaacc

SEQ ID NO: 187707 - DNA, 23 bp, Artificial Sequence
  Description of Artificial Sequence: Synthetic oligonucleotide
ggtctctggggcccacctgaacc

SEQ ID NO: 187708 - DNA, 24 bp, Artificial Sequence
  Description of Artificial Sequence: Synthetic oligonucleotide
gtctctggggcccacctgaaccct

SEQ ID NO: 187709 - DNA, 24 bp, Artificial Sequence
  Description of Artificial Sequence: Synthetic oligonucleotide
tctctggggcccacctgaaccctg

SEQ ID NO: 187710 - DNA, 23 bp, Artificial Sequence
  Description of Artificial Sequence: Synthetic oligonucleotide
ctctggggcccacctgaaccctg

SEQ ID NO: 187711 - DNA, 23 bp, Artificial Sequence
  Description of Artificial Sequence: Synthetic oligonucleotide
tctggggcccacctgaaccctgc

SEQ ID NO: 187712 - DNA, 22 bp, Artificial Sequence
  Description of Artificial Sequence: Synthetic oligonucleotide
ctggggcccacctgaaccctgc

SEQ ID NO: 187713 - DNA, 22 bp, Artificial Sequence
  Description of Artificial Sequence: Synthetic oligonucleotide
tggggcccacctgaaccctgcc

SEQ ID NO: 187714 - DNA, 21 bp, Artificial Sequence
  Description of Artificial Sequence: Synthetic oligonucleotide
ggggcccacctgaaccctgcc

SEQ ID NO: 187715 - DNA, 22 bp, Artificial Sequence
  Description of Artificial Sequence: Synthetic oligonucleotide
gggcccacctgaaccctgccgt

SEQ ID NO: 187716 - DNA, 23 bp, Artificial Sequence
  Description of Artificial Sequence: Synthetic oligonucleotide
ggcccacctgaaccctgccgtga

SEQ ID NO: 187717 - DNA, 23 bp, Artificial Sequence
  Description of Artificial Sequence: Synthetic oligonucleotide
gcccacctgaaccctgccgtgac

SEQ ID NO: 187718 - DNA, 26 bp, Artificial Sequence
  Description of Artificial Sequence: Synthetic oligonucleotide
cccacctgaaccctgccgtgaccttt

SEQ ID NO: 187719 - DNA, 26 bp, Artificial Sequence
  Description of Artificial Sequence: Synthetic oligonucleotide
ccacctgaaccctgccgtgacctttg

SEQ ID NO: 187720 - DNA, 26 bp, Artificial Sequence
  Description of Artificial Sequence: Synthetic oligonucleotide
cacctgaaccctgccgtgacctttgc

SEQ ID NO: 187721 - DNA, 27 bp, Artificial Sequence
  Description of Artificial Sequence: Synthetic oligonucleotide
acctgaaccctgccgtgacctttgcca

SEQ ID NO: 187722 - DNA, 27 bp, Artificial Sequence
  Description of Artificial Sequence: Synthetic oligonucleotide
cctgaaccctgccgtgacctttgccat

SEQ ID NO: 187723 - DNA, 27 bp, Artificial Sequence
  Description of Artificial Sequence: Synthetic oligonucleotide
ctgaaccctgccgtgacctttgccatg

SEQ ID NO: 187724 - DNA, 28 bp, Artificial Sequence
  Description of Artificial Sequence: Synthetic oligonucleotide
tgaaccctgccgtgacctttgccatgtg

SEQ ID NO: 187725 - DNA, 27 bp, Artificial Sequence
  Description of Artificial Sequence: Synthetic oligonucleotide
gaaccctgccgtgacctttgccatgtg

SEQ ID NO: 187726 - DNA, 27 bp, Artificial Sequence
  Description of Artificial Sequence: Synthetic oligonucleotide
aaccctgccgtgacctttgccatgtgc

SEQ ID NO: 187727 - DNA, 27 bp, Artificial Sequence
  Description of Artificial Sequence: Synthetic oligonucleotide
accctgccgtgacctttgccatgtgct

SEQ ID NO: 187728 - DNA, 27 bp, Artificial Sequence
  Description of Artificial Sequence: Synthetic oligonucleotide
ccctgccgtgacctttgccatgtgctt

SEQ ID NO: 187729 - DNA, 27 bp, Artificial Sequence
  Description of Artificial Sequence: Synthetic oligonucleotide
cctgccgtgacctttgccatgtgcttc

SEQ ID NO: 187730 - DNA, 27 bp, Artificial Sequence
  Description of Artificial Sequence: Synthetic oligonucleotide
ctgccgtgacctttgccatgtgcttcc

SEQ ID NO: 187731 - DNA, 28 bp, Artificial Sequence
  Description of Artificial Sequence: Synthetic oligonucleotide
tgccgtgacctttgccatgtgcttcctg

SEQ ID NO: 187732 - DNA, 27 bp, Artificial Sequence
  Description of Artificial Sequence: Synthetic oligonucleotide
gccgtgacctttgccatgtgcttcctg

SEQ ID NO: 187733 - DNA, 27 bp, Artificial Sequence
  Description of Artificial Sequence: Synthetic oligonucleotide
ccgtgacctttgccatgtgcttcctgg

SEQ ID NO: 187734 - DNA, 27 bp, Artificial Sequence
  Description of Artificial Sequence: Synthetic oligonucleotide
cgtgacctttgccatgtgcttcctggc

SEQ ID NO: 187735 - DNA, 28 bp, Artificial Sequence
  Description of Artificial Sequence: Synthetic oligonucleotide
gtgacctttgccatgtgcttcctggctc

SEQ ID NO: 187736 - DNA, 28 bp, Artificial Sequence
  Description of Artificial Sequence: Synthetic oligonucleotide
tgacctttgccatgtgcttcctggctcg

SEQ ID NO: 187737 - DNA, 27 bp, Artificial Sequence
  Description of Artificial Sequence: Synthetic oligonucleotide
gacctttgccatgtgcttcctggctcg

SEQ ID NO: 187738 - DNA, 28 bp, Artificial Sequence
  Description of Artificial Sequence: Synthetic oligonucleotide
acctttgccatgtgcttcctggctcgtg

SEQ ID NO: 187739 - DNA, 27 bp, Artificial Sequence
  Description of Artificial Sequence: Synthetic oligonucleotide
cctttgccatgtgcttcctggctcgtg

SEQ ID NO: 187740 - DNA, 28 bp, Artificial Sequence
  Description of Artificial Sequence: Synthetic oligonucleotide
ctttgccatgtgcttcctggctcgtgag

SEQ ID NO: 187741 - DNA, 28 bp, Artificial Sequence
  Description of Artificial Sequence: Synthetic oligonucleotide
tttgccatgtgcttcctggctcgtgagc

SEQ ID NO: 187742 - DNA, 27 bp, Artificial Sequence
  Description of Artificial Sequence: Synthetic oligonucleotide
ttgccatgtgcttcctggctcgtgagc

SEQ ID NO: 187743 - DNA, 26 bp, Artificial Sequence
  Description of Artificial Sequence: Synthetic oligonucleotide
tgccatgtgcttcctggctcgtgagc

SEQ ID NO: 187744 - DNA, 25 bp, Artificial Sequence
  Description of Artificial Sequence: Synthetic oligonucleotide
gccatgtgcttcctggctcgtgagc

SEQ ID NO: 187745 - DNA, 25 bp, Artificial Sequence
  Description of Artificial Sequence: Synthetic oligonucleotide
ccatgtgcttcctggctcgtgagcc

SEQ ID NO: 187746 - DNA, 26 bp, Artificial Sequence
  Description of Artificial Sequence: Synthetic oligonucleotide
catgtgcttcctggctcgtgagccct

SEQ ID NO: 187747 - DNA, 26 bp, Artificial Sequence
  Description of Artificial Sequence: Synthetic oligonucleotide
atgtgcttcctggctcgtgagccctg

SEQ ID NO: 187748 - DNA, 25 bp, Artificial Sequence
  Description of Artificial Sequence: Synthetic oligonucleotide
tgtgcttcctggctcgtgagccctg

SEQ ID NO: 187749 - DNA, 24 bp, Artificial Sequence
  Description of Artificial Sequence: Synthetic oligonucleotide
gtgcttcctggctcgtgagccctg

SEQ ID NO: 187750 - DNA, 26 bp, Artificial Sequence
  Description of Artificial Sequence: Synthetic oligonucleotide
tgcttcctggctcgtgagccctggat

SEQ ID NO: 187751 - DNA, 25 bp, Artificial Sequence
  Description of Artificial Sequence: Synthetic oligonucleotide
gcttcctggctcgtgagccctggat

SEQ ID NO: 187752 - DNA, 27 bp, Artificial Sequence
  Description of Artificial Sequence: Synthetic oligonucleotide
cttcctggctcgtgagccctggatcaa

SEQ ID NO: 187753 - DNA, 27 bp, Artificial Sequence
  Description of Artificial Sequence: Synthetic oligonucleotide
ttcctggctcgtgagccctggatcaag

SEQ ID NO: 187754 - DNA, 26 bp, Artificial Sequence
  Description of Artificial Sequence: Synthetic oligonucleotide
tcctggctcgtgagccctggatcaag

SEQ ID NO: 187755 - DNA, 25 bp, Artificial Sequence
  Description of Artificial Sequence: Synthetic oligonucleotide
cctggctcgtgagccctggatcaag

SEQ ID NO: 187756 - DNA, 26 bp, Artificial Sequence
  Description of Artificial Sequence: Synthetic oligonucleotide
ctggctcgtgagccctggatcaagct

SEQ ID NO: 187757 - DNA, 26 bp, Artificial Sequence
  Description of Artificial Sequence: Synthetic oligonucleotide
tggctcgtgagccctggatcaagctg

SEQ ID NO: 187758 - DNA, 25 bp, Artificial Sequence
  Description of Artificial Sequence: Synthetic oligonucleotide
ggctcgtgagccctggatcaagctg

SEQ ID NO: 187759 - DNA, 25 bp, Artificial Sequence
  Description of Artificial Sequence: Synthetic oligonucleotide
gctcgtgagccctggatcaagctgc

SEQ ID NO: 187760 - DNA, 25 bp, Artificial Sequence
  Description of Artificial Sequence: Synthetic oligonucleotide
ctcgtgagccctggatcaagctgcc

SEQ ID NO: 187761 - DNA, 27 bp, Artificial Sequence
  Description of Artificial Sequence: Synthetic oligonucleotide
tcgtgagccctggatcaagctgcccat

SEQ ID NO: 187762 - DNA, 26 bp, Artificial Sequence
  Description of Artificial Sequence: Synthetic oligonucleotide
cgtgagccctggatcaagctgcccat

SEQ ID NO: 187763 - DNA, 27 bp, Artificial Sequence
  Description of Artificial Sequence: Synthetic oligonucleotide
gtgagccctggatcaagctgcccatct

SEQ ID NO: 187764 - DNA, 28 bp, Artificial Sequence
  Description of Artificial Sequence: Synthetic oligonucleotide
tgagccctggatcaagctgcccatctac

SEQ ID NO: 187765 - DNA, 27 bp, Artificial Sequence
  Description of Artificial Sequence: Synthetic oligonucleotide
gagccctggatcaagctgcccatctac

SEQ ID NO: 187766 - DNA, 28 bp, Artificial Sequence
  Description of Artificial Sequence: Synthetic oligonucleotide
agccctggatcaagctgcccatctacac

SEQ ID NO: 187767 - DNA, 27 bp, Artificial Sequence
  Description of Artificial Sequence: Synthetic oligonucleotide
gccctggatcaagctgcccatctacac

SEQ ID NO: 187768 - DNA, 27 bp, Artificial Sequence
  Description of Artificial Sequence: Synthetic oligonucleotide
ccctggatcaagctgcccatctacacc

SEQ ID NO: 187769 - DNA, 27 bp, Artificial Sequence
  Description of Artificial Sequence: Synthetic oligonucleotide
cctggatcaagctgcccatctacaccc

SEQ ID NO: 187770 - DNA, 28 bp, Artificial Sequence
  Description of Artificial Sequence: Synthetic oligonucleotide
ctggatcaagctgcccatctacaccctg

SEQ ID NO: 187771 - DNA, 28 bp, Artificial Sequence
  Description of Artificial Sequence: Synthetic oligonucleotide
tggatcaagctgcccatctacaccctgg

SEQ ID NO: 187772 - DNA, 27 bp, Artificial Sequence
  Description of Artificial Sequence: Synthetic oligonucleotide
ggatcaagctgcccatctacaccctgg

SEQ ID NO: 187773 - DNA, 27 bp, Artificial Sequence
  Description of Artificial Sequence: Synthetic oligonucleotide
gatcaagctgcccatctacaccctggc

SEQ ID NO: 187774 - DNA, 28 bp, Artificial Sequence
  Description of Artificial Sequence: Synthetic oligonucleotide
atcaagctgcccatctacaccctggcac

SEQ ID NO: 187775 - DNA, 27 bp, Artificial Sequence
  Description of Artificial Sequence: Synthetic oligonucleotide
tcaagctgcccatctacaccctggcac

SEQ ID NO: 187776 - DNA, 27 bp, Artificial Sequence
  Description of Artificial Sequence: Synthetic oligonucleotide
caagctgcccatctacaccctggcaca

SEQ ID NO: 187777 - DNA, 27 bp, Artificial Sequence
  Description of Artificial Sequence: Synthetic oligonucleotide
aagctgcccatctacaccctggcacag

SEQ ID NO: 187778 - DNA, 27 bp, Artificial Sequence
  Description of Artificial Sequence: Synthetic oligonucleotide
agctgcccatctacaccctggcacaga

SEQ ID NO: 187779 - DNA, 26 bp, Artificial Sequence
  Description of Artificial Sequence: Synthetic oligonucleotide
gctgcccatctacaccctggcacaga

SEQ ID NO: 187780 - DNA, 26 bp, Artificial Sequence
  Description of Artificial Sequence: Synthetic oligonucleotide
ctgcccatctacaccctggcacagac

SEQ ID NO: 187781 - DNA, 26 bp, Artificial Sequence
  Description of Artificial Sequence: Synthetic oligonucleotide
tgcccatctacaccctggcacagacg

SEQ ID NO: 187782 - DNA, 25 bp, Artificial Sequence
  Description of Artificial Sequence: Synthetic oligonucleotide
gcccatctacaccctggcacagacg

SEQ ID NO: 187783 - DNA, 26 bp, Artificial Sequence
  Description of Artificial Sequence: Synthetic oligonucleotide
cccatctacaccctggcacagacgct

SEQ ID NO: 187784 - DNA, 26 bp, Artificial Sequence
  Description of Artificial Sequence: Synthetic oligonucleotide
ccatctacaccctggcacagacgctg

SEQ ID NO: 187785 - DNA, 26 bp, Artificial Sequence
  Description of Artificial Sequence: Synthetic oligonucleotide
catctacaccctggcacagacgctgg

SEQ ID NO: 187786 - DNA, 27 bp, Artificial Sequence
  Description of Artificial Sequence: Synthetic oligonucleotide
atctacaccctggcacagacgctggga

SEQ ID NO: 187787 - DNA, 26 bp, Artificial Sequence
  Description of Artificial Sequence: Synthetic oligonucleotide
tctacaccctggcacagacgctggga

SEQ ID NO: 187788 - DNA, 25 bp, Artificial Sequence
  Description of Artificial Sequence: Synthetic oligonucleotide
ctacaccctggcacagacgctggga

SEQ ID NO: 187789 - DNA, 25 bp, Artificial Sequence
  Description of Artificial Sequence: Synthetic oligonucleotide
tacaccctggcacagacgctgggag

SEQ ID NO: 187790 - DNA, 24 bp, Artificial Sequence
  Description of Artificial Sequence: Synthetic oligonucleotide
acaccctggcacagacgctgggag

SEQ ID NO: 187791 - DNA, 23 bp, Artificial Sequence
  Description of Artificial Sequence: Synthetic oligonucleotide
caccctggcacagacgctgggag

SEQ ID NO: 187792 - DNA, 23 bp, Artificial Sequence
  Description of Artificial Sequence: Synthetic oligonucleotide
accctggcacagacgctgggagc

SEQ ID NO: 187793 - DNA, 22 bp, Artificial Sequence
  Description of Artificial Sequence: Synthetic oligonucleotide
ccctggcacagacgctgggagc

SEQ ID NO: 187794 - DNA, 24 bp, Artificial Sequence
  Description of Artificial Sequence: Synthetic oligonucleotide
cctggcacagacgctgggagcctt

SEQ ID NO: 187795 - DNA, 26 bp, Artificial Sequence
  Description of Artificial Sequence: Synthetic oligonucleotide
ctggcacagacgctgggagccttctt

SEQ ID NO: 187796 - DNA, 26 bp, Artificial Sequence
  Description of Artificial Sequence: Synthetic oligonucleotide
tggcacagacgctgggagccttcttg

SEQ ID NO: 187797 - DNA, 25 bp, Artificial Sequence
  Description of Artificial Sequence: Synthetic oligonucleotide
ggcacagacgctgggagccttcttg

SEQ ID NO: 187798 - DNA, 25 bp, Artificial Sequence
  Description of Artificial Sequence: Synthetic oligonucleotide
gcacagacgctgggagccttcttgg

SEQ ID NO: 187799 - DNA, 26 bp, Artificial Sequence
  Description of Artificial Sequence: Synthetic oligonucleotide
cacagacgctgggagccttcttgggt

SEQ ID NO: 187800 - DNA, 26 bp, Artificial Sequence
  Description of Artificial Sequence: Synthetic oligonucleotide
acagacgctgggagccttcttgggtg

SEQ ID NO: 187801 - DNA, 25 bp, Artificial Sequence
  Description of Artificial Sequence: Synthetic oligonucleotide
cagacgctgggagccttcttgggtg

SEQ ID NO: 187802 - DNA, 26 bp, Artificial Sequence
  Description of Artificial Sequence: Synthetic oligonucleotide
agacgctgggagccttcttgggtgct

SEQ ID NO: 187803 - DNA, 25 bp, Artificial Sequence
  Description of Artificial Sequence: Synthetic oligonucleotide
gacgctgggagccttcttgggtgct

SEQ ID NO: 187804 - DNA, 25 bp, Artificial Sequence
  Description of Artificial Sequence: Synthetic oligonucleotide
acgctgggagccttcttgggtgctg

SEQ ID NO: 187805 - DNA, 24 bp, Artificial Sequence
  Description of Artificial Sequence: Synthetic oligonucleotide
cgctgggagccttcttgggtgctg

SEQ ID NO: 187806 - DNA, 27 bp, Artificial Sequence
  Description of Artificial Sequence: Synthetic oligonucleotide
gctgggagccttcttgggtgctggaat

SEQ ID NO: 187807 - DNA, 28 bp, Artificial Sequence
  Description of Artificial Sequence: Synthetic oligonucleotide
ctgggagccttcttgggtgctggaatag

SEQ ID NO: 187808 - DNA, 33 bp, Artificial Sequence
  Description of Artificial Sequence: Synthetic oligonucleotide
tgggagccttcttgggtgctggaatagtttttg

SEQ ID NO: 187809 - DNA, 32 bp, Artificial Sequence
  Description of Artificial Sequence: Synthetic oligonucleotide
gggagccttcttgggtgctggaatagtttttg

SEQ ID NO: 187810 - DNA, 32 bp, Artificial Sequence
  Description of Artificial Sequence: Synthetic oligonucleotide
ggagccttcttgggtgctggaatagtttttgg

SEQ ID NO: 187811 - DNA, 32 bp, Artificial Sequence
  Description of Artificial Sequence: Synthetic oligonucleotide
gagccttcttgggtgctggaatagtttttggg

SEQ ID NO: 187812 - DNA, 32 bp, Artificial Sequence
  Description of Artificial Sequence: Synthetic oligonucleotide
agccttcttgggtgctggaatagtttttgggc

SEQ ID NO: 187813 - DNA, 31 bp, Artificial Sequence
  Description of Artificial Sequence: Synthetic oligonucleotide
gccttcttgggtgctggaatagtttttgggc

SEQ ID NO: 187814 - DNA, 32 bp, Artificial Sequence
  Description of Artificial Sequence: Synthetic oligonucleotide
ccttcttgggtgctggaatagtttttgggctg

SEQ ID NO: 187815 - DNA, 38 bp, Artificial Sequence
  Description of Artificial Sequence: Synthetic oligonucleotide
cttcttgggtgctggaatagtttttgggctgtattatg

SEQ ID NO: 187816 - DNA, 40 bp, Artificial Sequence
  Description of Artificial Sequence: Synthetic oligonucleotide
ttcttgggtgctggaatagtttttgggctgtattatgatg

SEQ ID NO: 187817 - DNA, 39 bp, Artificial Sequence
  Description of Artificial Sequence: Synthetic oligonucleotide
tcttgggtgctggaatagtttttgggctgtattatgatg

SEQ ID NO: 187818 - DNA, 38 bp, Artificial Sequence
  Description of Artificial Sequence: Synthetic oligonucleotide
cttgggtgctggaatagtttttgggctgtattatgatg

SEQ ID NO: 187819 - DNA, 38 bp, Artificial Sequence
  Description of Artificial Sequence: Synthetic oligonucleotide
ttgggtgctggaatagtttttgggctgtattatgatgc

SEQ ID NO: 187820 - DNA, 37 bp, Artificial Sequence
  Description of Artificial Sequence: Synthetic oligonucleotide
tgggtgctggaatagtttttgggctgtattatgatgc

SEQ ID NO: 187821 - DNA, 36 bp, Artificial Sequence
  Description of Artificial Sequence: Synthetic oligonucleotide
gggtgctggaatagtttttgggctgtattatgatgc

SEQ ID NO: 187822 - DNA, 39 bp, Artificial Sequence
  Description of Artificial Sequence: Synthetic oligonucleotide
ggtgctggaatagtttttgggctgtattatgatgcaatc

SEQ ID NO: 187823 - DNA, 40 bp, Artificial Sequence
  Description of Artificial Sequence: Synthetic oligonucleotide
gtgctggaatagtttttgggctgtattatgatgcaatctg

SEQ ID NO: 187824 - DNA, 40 bp, Artificial Sequence
  Description of Artificial Sequence: Synthetic oligonucleotide
tgctggaatagtttttgggctgtattatgatgcaatctgg

SEQ ID NO: 187825 - DNA, 39 bp, Artificial Sequence
  Description of Artificial Sequence: Synthetic oligonucleotide
gctggaatagtttttgggctgtattatgatgcaatctgg

SEQ ID NO: 187826 - DNA, 39 bp, Artificial Sequence
  Description of Artificial Sequence: Synthetic oligonucleotide
ctggaatagtttttgggctgtattatgatgcaatctggc

SEQ ID NO: 187827 - DNA, 40 bp, Artificial Sequence
  Description of Artificial Sequence: Synthetic oligonucleotide
tggaatagtttttgggctgtattatgatgcaatctggcac

SEQ ID NO: 187828 - DNA, 39 bp, Artificial Sequence
  Description of Artificial Sequence: Synthetic oligonucleotide
ggaatagtttttgggctgtattatgatgcaatctggcac

SEQ ID NO: 187829 - DNA, 41 bp, Artificial Sequence
  Description of Artificial Sequence: Synthetic oligonucleotide
gaatagtttttgggctgtattatgatgcaatctggcacttc

SEQ ID NO: 187830 - DNA, 41 bp, Artificial Sequence
  Description of Artificial Sequence: Synthetic oligonucleotide
aatagtttttgggctgtattatgatgcaatctggcacttcg

SEQ ID NO: 187831 - DNA, 40 bp, Artificial Sequence
  Description of Artificial Sequence: Synthetic oligonucleotide
atagtttttgggctgtattatgatgcaatctggcacttcg

SEQ ID NO: 187832 - DNA, 39 bp, Artificial Sequence
  Description of Artificial Sequence: Synthetic oligonucleotide
tagtttttgggctgtattatgatgcaatctggcacttcg

SEQ ID NO: 187833 - DNA, 38 bp, Artificial Sequence
  Description of Artificial Sequence: Synthetic oligonucleotide
agtttttgggctgtattatgatgcaatctggcacttcg

SEQ ID NO: 187834 - DNA, 37 bp, Artificial Sequence
  Description of Artificial Sequence: Synthetic oligonucleotide
gtttttgggctgtattatgatgcaatctggcacttcg

SEQ ID NO: 187835 - DNA, 37 bp, Artificial Sequence
  Description of Artificial Sequence: Synthetic oligonucleotide
tttttgggctgtattatgatgcaatctggcacttcgc

SEQ ID NO: 187836 - DNA, 36 bp, Artificial Sequence
  Description of Artificial Sequence: Synthetic oligonucleotide
ttttgggctgtattatgatgcaatctggcacttcgc

SEQ ID NO: 187837 - DNA, 35 bp, Artificial Sequence
  Description of Artificial Sequence: Synthetic oligonucleotide
tttgggctgtattatgatgcaatctggcacttcgc

SEQ ID NO: 187838 - DNA, 34 bp, Artificial Sequence
  Description of Artificial Sequence: Synthetic oligonucleotide
ttgggctgtattatgatgcaatctggcacttcgc

SEQ ID NO: 187839 - DNA, 33 bp, Artificial Sequence
  Description of Artificial Sequence: Synthetic oligonucleotide
tgggctgtattatgatgcaatctggcacttcgc

SEQ ID NO: 187840 - DNA, 32 bp, Artificial Sequence
  Description of Artificial Sequence: Synthetic oligonucleotide
gggctgtattatgatgcaatctggcacttcgc

SEQ ID NO: 187841 - DNA, 32 bp, Artificial Sequence
  Description of Artificial Sequence: Synthetic oligonucleotide
ggctgtattatgatgcaatctggcacttcgcc

SEQ ID NO: 187842 - DNA, 32 bp, Artificial Sequence
  Description of Artificial Sequence: Synthetic oligonucleotide
gctgtattatgatgcaatctggcacttcgccg

SEQ ID NO: 187843 - DNA, 33 bp, Artificial Sequence
  Description of Artificial Sequence: Synthetic oligonucleotide
ctgtattatgatgcaatctggcacttcgccgac

SEQ ID NO: 187844 - DNA, 35 bp, Artificial Sequence
  Description of Artificial Sequence: Synthetic oligonucleotide
tgtattatgatgcaatctggcacttcgccgacaac

SEQ ID NO: 187845 - DNA, 34 bp, Artificial Sequence
  Description of Artificial Sequence: Synthetic oligonucleotide
gtattatgatgcaatctggcacttcgccgacaac

SEQ ID NO: 187846 - DNA, 34 bp, Artificial Sequence
  Description of Artificial Sequence: Synthetic oligonucleotide
tattatgatgcaatctggcacttcgccgacaacc

SEQ ID NO: 187847 - DNA, 33 bp, Artificial Sequence
  Description of Artificial Sequence: Synthetic oligonucleotide
attatgatgcaatctggcacttcgccgacaacc

SEQ ID NO: 187848 - DNA, 32 bp, Artificial Sequence
  Description of Artificial Sequence: Synthetic oligonucleotide
ttatgatgcaatctggcacttcgccgacaacc

SEQ ID NO: 187849 - DNA, 31 bp, Artificial Sequence
  Description of Artificial Sequence: Synthetic oligonucleotide
tatgatgcaatctggcacttcgccgacaacc

SEQ ID NO: 187850 - DNA, 30 bp, Artificial Sequence
  Description of Artificial Sequence: Synthetic oligonucleotide
atgatgcaatctggcacttcgccgacaacc

SEQ ID NO: 187851 - DNA, 29 bp, Artificial Sequence
  Description of Artificial Sequence: Synthetic oligonucleotide
tgatgcaatctggcacttcgccgacaacc

SEQ ID NO: 187852 - DNA, 28 bp, Artificial Sequence
  Description of Artificial Sequence: Synthetic oligonucleotide
gatgcaatctggcacttcgccgacaacc

SEQ ID NO: 187853 - DNA, 29 bp, Artificial Sequence
  Description of Artificial Sequence: Synthetic oligonucleotide
atgcaatctggcacttcgccgacaaccag

SEQ ID NO: 187854 - DNA, 28 bp, Artificial Sequence
  Description of Artificial Sequence: Synthetic oligonucleotide
tgcaatctggcacttcgccgacaaccag

SEQ ID NO: 187855 - DNA, 27 bp, Artificial Sequence
  Description of Artificial Sequence: Synthetic oligonucleotide
gcaatctggcacttcgccgacaaccag

SEQ ID NO: 187856 - DNA, 27 bp, Artificial Sequence
  Description of Artificial Sequence: Synthetic oligonucleotide
caatctggcacttcgccgacaaccagc

SEQ ID NO: 187857 - DNA, 32 bp, Artificial Sequence
  Description of Artificial Sequence: Synthetic oligonucleotide
aatctggcacttcgccgacaaccagctttttg

SEQ ID NO: 187858 - DNA, 31 bp, Artificial Sequence
  Description of Artificial Sequence: Synthetic oligonucleotide
atctggcacttcgccgacaaccagctttttg

SEQ ID NO: 187859 - DNA, 30 bp, Artificial Sequence
  Description of Artificial Sequence: Synthetic oligonucleotide
tctggcacttcgccgacaaccagctttttg

SEQ ID NO: 187860 - DNA, 29 bp, Artificial Sequence
  Description of Artificial Sequence: Synthetic oligonucleotide
ctggcacttcgccgacaaccagctttttg

SEQ ID NO: 187861 - DNA, 32 bp, Artificial Sequence
  Description of Artificial Sequence: Synthetic oligonucleotide
tggcacttcgccgacaaccagctttttgtttc

SEQ ID NO: 187862 - DNA, 31 bp, Artificial Sequence
  Description of Artificial Sequence: Synthetic oligonucleotide
ggcacttcgccgacaaccagctttttgtttc

SEQ ID NO: 187863 - DNA, 31 bp, Artificial Sequence
  Description of Artificial Sequence: Synthetic oligonucleotide
gcacttcgccgacaaccagctttttgtttcg

SEQ ID NO: 187864 - DNA, 31 bp, Artificial Sequence
  Description of Artificial Sequence: Synthetic oligonucleotide
cacttcgccgacaaccagctttttgtttcgg

SEQ ID NO: 187865 - DNA, 31 bp, Artificial Sequence
  Description of Artificial Sequence: Synthetic oligonucleotide
acttcgccgacaaccagctttttgtttcggg

SEQ ID NO: 187866 - DNA, 30 bp, Artificial Sequence
  Description of Artificial Sequence: Synthetic oligonucleotide
cttcgccgacaaccagctttttgtttcggg

SEQ ID NO: 187867 - DNA, 30 bp, Artificial Sequence
  Description of Artificial Sequence: Synthetic oligonucleotide
ttcgccgacaaccagctttttgtttcgggc

SEQ ID NO: 187868 - DNA, 29 bp, Artificial Sequence
  Description of Artificial Sequence: Synthetic oligonucleotide
tcgccgacaaccagctttttgtttcgggc

SEQ ID NO: 187869 - DNA, 28 bp, Artificial Sequence
  Description of Artificial Sequence: Synthetic oligonucleotide
cgccgacaaccagctttttgtttcgggc

SEQ ID NO: 187870 - DNA, 28 bp, Artificial Sequence
  Description of Artificial Sequence: Synthetic oligonucleotide
gccgacaaccagctttttgtttcgggcc

SEQ ID NO: 187871 - DNA, 28 bp, Artificial Sequence
  Description of Artificial Sequence: Synthetic oligonucleotide
ccgacaaccagctttttgtttcgggccc

SEQ ID NO: 187872 - DNA, 28 bp, Artificial Sequence
  Description of Artificial Sequence: Synthetic oligonucleotide
cgacaaccagctttttgtttcgggcccc

SEQ ID NO: 187873 - DNA, 31 bp, Artificial Sequence
  Description of Artificial Sequence: Synthetic oligonucleotide
gacaaccagctttttgtttcgggccccaatg

SEQ ID NO: 187874 - DNA, 31 bp, Artificial Sequence
  Description of Artificial Sequence: Synthetic oligonucleotide
acaaccagctttttgtttcgggccccaatgg

SEQ ID NO: 187875 - DNA, 30 bp, Artificial Sequence
  Description of Artificial Sequence: Synthetic oligonucleotide
caaccagctttttgtttcgggccccaatgg

SEQ ID NO: 187876 - DNA, 30 bp, Artificial Sequence
  Description of Artificial Sequence: Synthetic oligonucleotide
aaccagctttttgtttcgggccccaatggc

SEQ ID NO: 187877 - DNA, 29 bp, Artificial Sequence
  Description of Artificial Sequence: Synthetic oligonucleotide
accagctttttgtttcgggccccaatggc

SEQ ID NO: 187878 - DNA, 28 bp, Artificial Sequence
  Description of Artificial Sequence: Synthetic oligonucleotide
ccagctttttgtttcgggccccaatggc

SEQ ID NO: 187879 - DNA, 29 bp, Artificial Sequence
  Description of Artificial Sequence: Synthetic oligonucleotide
cagctttttgtttcgggccccaatggcac

SEQ ID NO: 187880 - DNA, 30 bp, Artificial Sequence
  Description of Artificial Sequence: Synthetic oligonucleotide
agctttttgtttcgggccccaatggcacag

SEQ ID NO: 187881 - DNA, 29 bp, Artificial Sequence
  Description of Artificial Sequence: Synthetic oligonucleotide
gctttttgtttcgggccccaatggcacag

SEQ ID NO: 187882 - DNA, 29 bp, Artificial Sequence
  Description of Artificial Sequence: Synthetic oligonucleotide
ctttttgtttcgggccccaatggcacagc

SEQ ID NO: 187883 - DNA, 29 bp, Artificial Sequence
  Description of Artificial Sequence: Synthetic oligonucleotide
tttttgtttcgggccccaatggcacagcc

SEQ ID NO: 187884 - DNA, 28 bp, Artificial Sequence
  Description of Artificial Sequence: Synthetic oligonucleotide
ttttgtttcgggccccaatggcacagcc

SEQ ID NO: 187885 - DNA, 27 bp, Artificial Sequence
  Description of Artificial Sequence: Synthetic oligonucleotide
tttgtttcgggccccaatggcacagcc

SEQ ID NO: 187886 - DNA, 26 bp, Artificial Sequence
  Description of Artificial Sequence: Synthetic oligonucleotide
ttgtttcgggccccaatggcacagcc

SEQ ID NO: 187887 - DNA, 25 bp, Artificial Sequence
  Description of Artificial Sequence: Synthetic oligonucleotide
tgtttcgggccccaatggcacagcc

SEQ ID NO: 187888 - DNA, 24 bp, Artificial Sequence
  Description of Artificial Sequence: Synthetic oligonucleotide
gtttcgggccccaatggcacagcc

SEQ ID NO: 187889 - DNA, 24 bp, Artificial Sequence
  Description of Artificial Sequence: Synthetic oligonucleotide
tttcgggccccaatggcacagccg

SEQ ID NO: 187890 - DNA, 23 bp, Artificial Sequence
  Description of Artificial Sequence: Synthetic oligonucleotide
ttcgggccccaatggcacagccg

SEQ ID NO: 187891 - DNA, 22 bp, Artificial Sequence
  Description of Artificial Sequence: Synthetic oligonucleotide
tcgggccccaatggcacagccg

SEQ ID NO: 187892 - DNA, 21 bp, Artificial Sequence
  Description of Artificial Sequence: Synthetic oligonucleotide
cgggccccaatggcacagccg

SEQ ID NO: 187893 - DNA, 21 bp, Artificial Sequence
  Description of Artificial Sequence: Synthetic oligonucleotide
gggccccaatggcacagccgg

SEQ ID NO: 187894 - DNA, 23 bp, Artificial Sequence
  Description of Artificial Sequence: Synthetic oligonucleotide
ggccccaatggcacagccggcat

SEQ ID NO: 187895 - DNA, 26 bp, Artificial Sequence
  Description of Artificial Sequence: Synthetic oligonucleotide
gccccaatggcacagccggcatcttt

SEQ ID NO: 187896 - DNA, 26 bp, Artificial Sequence
  Description of Artificial Sequence: Synthetic oligonucleotide
ccccaatggcacagccggcatctttg

SEQ ID NO: 187897 - DNA, 27 bp, Artificial Sequence
  Description of Artificial Sequence: Synthetic oligonucleotide
cccaatggcacagccggcatctttgct

SEQ ID NO: 187898 - DNA, 28 bp, Artificial Sequence
  Description of Artificial Sequence: Synthetic oligonucleotide
ccaatggcacagccggcatctttgctac

SEQ ID NO: 187899 - DNA, 28 bp, Artificial Sequence
  Description of Artificial Sequence: Synthetic oligonucleotide
caatggcacagccggcatctttgctacc

SEQ ID NO: 187900 - DNA, 30 bp, Artificial Sequence
  Description of Artificial Sequence: Synthetic oligonucleotide
aatggcacagccggcatctttgctacctac

SEQ ID NO: 187901 - DNA, 29 bp, Artificial Sequence
  Description of Artificial Sequence: Synthetic oligonucleotide
atggcacagccggcatctttgctacctac

SEQ ID NO: 187902 - DNA, 28 bp, Artificial Sequence
  Description of Artificial Sequence: Synthetic oligonucleotide
tggcacagccggcatctttgctacctac

SEQ ID NO: 187903 - DNA, 27 bp, Artificial Sequence
  Description of Artificial Sequence: Synthetic oligonucleotide
ggcacagccggcatctttgctacctac

SEQ ID NO: 187904 - DNA, 27 bp, Artificial Sequence
  Description of Artificial Sequence: Synthetic oligonucleotide
gcacagccggcatctttgctacctacc

SEQ ID NO: 187905 - DNA, 27 bp, Artificial Sequence
  Description of Artificial Sequence: Synthetic oligonucleotide
cacagccggcatctttgctacctaccc

SEQ ID NO: 187906 - DNA, 27 bp, Artificial Sequence
  Description of Artificial Sequence: Synthetic oligonucleotide
acagccggcatctttgctacctacccc

SEQ ID NO: 187907 - DNA, 27 bp, Artificial Sequence
  Description of Artificial Sequence: Synthetic oligonucleotide
cagccggcatctttgctacctacccct

SEQ ID NO: 187908 - DNA, 27 bp, Artificial Sequence
  Description of Artificial Sequence: Synthetic oligonucleotide
agccggcatctttgctacctacccctc

SEQ ID NO: 187909 - DNA, 27 bp, Artificial Sequence
  Description of Artificial Sequence: Synthetic oligonucleotide
gccggcatctttgctacctacccctct

SEQ ID NO: 187910 - DNA, 27 bp, Artificial Sequence
  Description of Artificial Sequence: Synthetic oligonucleotide
ccggcatctttgctacctacccctctg

SEQ ID NO: 187911 - DNA, 27 bp, Artificial Sequence
  Description of Artificial Sequence: Synthetic oligonucleotide
cggcatctttgctacctacccctctgg

SEQ ID NO: 187912 - DNA, 28 bp, Artificial Sequence
  Description of Artificial Sequence: Synthetic oligonucleotide
ggcatctttgctacctacccctctggac

SEQ ID NO: 187913 - DNA, 29 bp, Artificial Sequence
  Description of Artificial Sequence: Synthetic oligonucleotide
gcatctttgctacctacccctctggacac

SEQ ID NO: 187914 - DNA, 31 bp, Artificial Sequence
  Description of Artificial Sequence: Synthetic oligonucleotide
catctttgctacctacccctctggacacttg

SEQ ID NO: 187915 - DNA, 31 bp, Artificial Sequence
  Description of Artificial Sequence: Synthetic oligonucleotide
atctttgctacctacccctctggacacttgg

SEQ ID NO: 187916 - DNA, 30 bp, Artificial Sequence
  Description of Artificial Sequence: Synthetic oligonucleotide
tctttgctacctacccctctggacacttgg

SEQ ID NO: 187917 - DNA, 29 bp, Artificial Sequence
  Description of Artificial Sequence: Synthetic oligonucleotide
ctttgctacctacccctctggacacttgg

SEQ ID NO: 187918 - DNA, 33 bp, Artificial Sequence
  Description of Artificial Sequence: Synthetic oligonucleotide
tttgctacctacccctctggacacttggatatg

SEQ ID NO: 187919 - DNA, 32 bp, Artificial Sequence
  Description of Artificial Sequence: Synthetic oligonucleotide
ttgctacctacccctctggacacttggatatg

SEQ ID NO: 187920 - DNA, 31 bp, Artificial Sequence
  Description of Artificial Sequence: Synthetic oligonucleotide
tgctacctacccctctggacacttggatatg

SEQ ID NO: 187921 - DNA, 30 bp, Artificial Sequence
  Description of Artificial Sequence: Synthetic oligonucleotide
gctacctacccctctggacacttggatatg

SEQ ID NO: 187922 - DNA, 32 bp, Artificial Sequence
  Description of Artificial Sequence: Synthetic oligonucleotide
ctacctacccctctggacacttggatatgatc

SEQ ID NO: 187923 - DNA, 35 bp, Artificial Sequence
  Description of Artificial Sequence: Synthetic oligonucleotide
tacctacccctctggacacttggatatgatcaatg

SEQ ID NO: 187924 - DNA, 34 bp, Artificial Sequence
  Description of Artificial Sequence: Synthetic oligonucleotide
acctacccctctggacacttggatatgatcaatg

SEQ ID NO: 187925 - DNA, 33 bp, Artificial Sequence
  Description of Artificial Sequence: Synthetic oligonucleotide
cctacccctctggacacttggatatgatcaatg

SEQ ID NO: 187926 - DNA, 33 bp, Artificial Sequence
  Description of Artificial Sequence: Synthetic oligonucleotide
ctacccctctggacacttggatatgatcaatgg

SEQ ID NO: 187927 - DNA, 33 bp, Artificial Sequence
  Description of Artificial Sequence: Synthetic oligonucleotide
tacccctctggacacttggatatgatcaatggc

SEQ ID NO: 187928 - DNA, 32 bp, Artificial Sequence
  Description of Artificial Sequence: Synthetic oligonucleotide
acccctctggacacttggatatgatcaatggc

SEQ ID NO: 187929 - DNA, 31 bp, Artificial Sequence
  Description of Artificial Sequence: Synthetic oligonucleotide
cccctctggacacttggatatgatcaatggc

SEQ ID NO: 187930 - DNA, 33 bp, Artificial Sequence
  Description of Artificial Sequence: Synthetic oligonucleotide
ccctctggacacttggatatgatcaatggcttc

SEQ ID NO: 187931 - DNA, 36 bp, Artificial Sequence
  Description of Artificial Sequence: Synthetic oligonucleotide
cctctggacacttggatatgatcaatggcttctttg

SEQ ID NO: 187932 - DNA, 37 bp, Artificial Sequence
  Description of Artificial Sequence: Synthetic oligonucleotide
ctctggacacttggatatgatcaatggcttctttgac

SEQ ID NO: 187933 - DNA, 37 bp, Artificial Sequence
  Description of Artificial Sequence: Synthetic oligonucleotide
tctggacacttggatatgatcaatggcttctttgacc

SEQ ID NO: 187934 - DNA, 36 bp, Artificial Sequence
  Description of Artificial Sequence: Synthetic oligonucleotide
ctggacacttggatatgatcaatggcttctttgacc

SEQ ID NO: 187935 - DNA, 37 bp, Artificial Sequence
  Description of Artificial Sequence: Synthetic oligonucleotide
tggacacttggatatgatcaatggcttctttgaccag

SEQ ID NO: 187936 - DNA, 36 bp, Artificial Sequence
  Description of Artificial Sequence: Synthetic oligonucleotide
ggacacttggatatgatcaatggcttctttgaccag

SEQ ID NO: 187937 - DNA, 38 bp, Artificial Sequence
  Description of Artificial Sequence: Synthetic oligonucleotide
gacacttggatatgatcaatggcttctttgaccagttc

SEQ ID NO: 187938 - DNA, 41 bp, Artificial Sequence
  Description of Artificial Sequence: Synthetic oligonucleotide
acacttggatatgatcaatggcttctttgaccagttcatag

SEQ ID NO: 187939 - DNA, 40 bp, Artificial Sequence
  Description of Artificial Sequence: Synthetic oligonucleotide
cacttggatatgatcaatggcttctttgaccagttcatag

SEQ ID NO: 187940 - DNA, 40 bp, Artificial Sequence
  Description of Artificial Sequence: Synthetic oligonucleotide
acttggatatgatcaatggcttctttgaccagttcatagg

SEQ ID NO: 187941 - DNA, 39 bp, Artificial Sequence
  Description of Artificial Sequence: Synthetic oligonucleotide
cttggatatgatcaatggcttctttgaccagttcatagg

SEQ ID NO: 187942 - DNA, 39 bp, Artificial Sequence
  Description of Artificial Sequence: Synthetic oligonucleotide
ttggatatgatcaatggcttctttgaccagttcataggc

SEQ ID NO: 187943 - DNA, 38 bp, Artificial Sequence
  Description of Artificial Sequence: Synthetic oligonucleotide
tggatatgatcaatggcttctttgaccagttcataggc

SEQ ID NO: 187944 - DNA, 37 bp, Artificial Sequence
  Description of Artificial Sequence: Synthetic oligonucleotide
ggatatgatcaatggcttctttgaccagttcataggc

SEQ ID NO: 187945 - DNA, 38 bp, Artificial Sequence
  Description of Artificial Sequence: Synthetic oligonucleotide
gatatgatcaatggcttctttgaccagttcataggcac

SEQ ID NO: 187946 - DNA, 39 bp, Artificial Sequence
  Description of Artificial Sequence: Synthetic oligonucleotide
atatgatcaatggcttctttgaccagttcataggcacag

SEQ ID NO: 187947 - DNA, 38 bp, Artificial Sequence
  Description of Artificial Sequence: Synthetic oligonucleotide
tatgatcaatggcttctttgaccagttcataggcacag

SEQ ID NO: 187948 - DNA, 37 bp, Artificial Sequence
  Description of Artificial Sequence: Synthetic oligonucleotide
atgatcaatggcttctttgaccagttcataggcacag

SEQ ID NO: 187949 - DNA, 36 bp, Artificial Sequence
  Description of Artificial Sequence: Synthetic oligonucleotide
tgatcaatggcttctttgaccagttcataggcacag

SEQ ID NO: 187950 - DNA, 35 bp, Artificial Sequence
  Description of Artificial Sequence: Synthetic oligonucleotide
gatcaatggcttctttgaccagttcataggcacag

SEQ ID NO: 187951 - DNA, 35 bp, Artificial Sequence
  Description of Artificial Sequence: Synthetic oligonucleotide
atcaatggcttctttgaccagttcataggcacagc

SEQ ID NO: 187952 - DNA, 34 bp, Artificial Sequence
  Description of Artificial Sequence: Synthetic oligonucleotide
tcaatggcttctttgaccagttcataggcacagc

SEQ ID NO: 187953 - DNA, 33 bp, Artificial Sequence
  Description of Artificial Sequence: Synthetic oligonucleotide
caatggcttctttgaccagttcataggcacagc

SEQ ID NO: 187954 - DNA, 33 bp, Artificial Sequence
  Description of Artificial Sequence: Synthetic oligonucleotide
aatggcttctttgaccagttcataggcacagcc

SEQ ID NO: 187955 - DNA, 32 bp, Artificial Sequence
  Description of Artificial Sequence: Synthetic oligonucleotide
atggcttctttgaccagttcataggcacagcc

SEQ ID NO: 187956 - DNA, 31 bp, Artificial Sequence
  Description of Artificial Sequence: Synthetic oligonucleotide
tggcttctttgaccagttcataggcacagcc

SEQ ID NO: 187957 - DNA, 30 bp, Artificial Sequence
  Description of Artificial Sequence: Synthetic oligonucleotide
ggcttctttgaccagttcataggcacagcc

SEQ ID NO: 187958 - DNA, 31 bp, Artificial Sequence
  Description of Artificial Sequence: Synthetic oligonucleotide
gcttctttgaccagttcataggcacagcctc

SEQ ID NO: 187959 - DNA, 31 bp, Artificial Sequence
  Description of Artificial Sequence: Synthetic oligonucleotide
cttctttgaccagttcataggcacagcctcc

SEQ ID NO: 187960 - DNA, 31 bp, Artificial Sequence
  Description of Artificial Sequence: Synthetic oligonucleotide
ttctttgaccagttcataggcacagcctccc

SEQ ID NO: 187961 - DNA, 30 bp, Artificial Sequence
  Description of Artificial Sequence: Synthetic oligonucleotide
tctttgaccagttcataggcacagcctccc

SEQ ID NO: 187962 - DNA, 29 bp, Artificial Sequence
  Description of Artificial Sequence: Synthetic oligonucleotide
ctttgaccagttcataggcacagcctccc

SEQ ID NO: 187963 - DNA, 33 bp, Artificial Sequence
  Description of Artificial Sequence: Synthetic oligonucleotide
tttgaccagttcataggcacagcctcccttatc

SEQ ID NO: 187964 - DNA, 32 bp, Artificial Sequence
  Description of Artificial Sequence: Synthetic oligonucleotide
ttgaccagttcataggcacagcctcccttatc

SEQ ID NO: 187965 - DNA, 31 bp, Artificial Sequence
  Description of Artificial Sequence: Synthetic oligonucleotide
tgaccagttcataggcacagcctcccttatc

SEQ ID NO: 187966 - DNA, 30 bp, Artificial Sequence
  Description of Artificial Sequence: Synthetic oligonucleotide
gaccagttcataggcacagcctcccttatc

SEQ ID NO: 187967 - DNA, 30 bp, Artificial Sequence
  Description of Artificial Sequence: Synthetic oligonucleotide
accagttcataggcacagcctcccttatcg

SEQ ID NO: 187968 - DNA, 29 bp, Artificial Sequence
  Description of Artificial Sequence: Synthetic oligonucleotide
ccagttcataggcacagcctcccttatcg

SEQ ID NO: 187969 - DNA, 30 bp, Artificial Sequence
  Description of Artificial Sequence: Synthetic oligonucleotide
cagttcataggcacagcctcccttatcgtg

SEQ ID NO: 187970 - DNA, 31 bp, Artificial Sequence
  Description of Artificial Sequence: Synthetic oligonucleotide
agttcataggcacagcctcccttatcgtgtg

SEQ ID NO: 187971 - DNA, 30 bp, Artificial Sequence
  Description of Artificial Sequence: Synthetic oligonucleotide
gttcataggcacagcctcccttatcgtgtg

SEQ ID NO: 187972 - DNA, 31 bp, Artificial Sequence
  Description of Artificial Sequence: Synthetic oligonucleotide
ttcataggcacagcctcccttatcgtgtgtg

SEQ ID NO: 187973 - DNA, 30 bp, Artificial Sequence
  Description of Artificial Sequence: Synthetic oligonucleotide
tcataggcacagcctcccttatcgtgtgtg

SEQ ID NO: 187974 - DNA, 29 bp, Artificial Sequence
  Description of Artificial Sequence: Synthetic oligonucleotide
cataggcacagcctcccttatcgtgtgtg

SEQ ID NO: 187975 - DNA, 30 bp, Artificial Sequence
  Description of Artificial Sequence: Synthetic oligonucleotide
ataggcacagcctcccttatcgtgtgtgtg

SEQ ID NO: 187976 - DNA, 29 bp, Artificial Sequence
  Description of Artificial Sequence: Synthetic oligonucleotide
taggcacagcctcccttatcgtgtgtgtg

SEQ ID NO: 187977 - DNA, 28 bp, Artificial Sequence
  Description of Artificial Sequence: Synthetic oligonucleotide
aggcacagcctcccttatcgtgtgtgtg

SEQ ID NO: 187978 - DNA, 27 bp, Artificial Sequence
  Description of Artificial Sequence: Synthetic oligonucleotide
ggcacagcctcccttatcgtgtgtgtg

SEQ ID NO: 187979 - DNA, 27 bp, Artificial Sequence
  Description of Artificial Sequence: Synthetic oligonucleotide
gcacagcctcccttatcgtgtgtgtgc

SEQ ID NO: 187980 - DNA, 28 bp, Artificial Sequence
  Description of Artificial Sequence: Synthetic oligonucleotide
cacagcctcccttatcgtgtgtgtgctg

SEQ ID NO: 187981 - DNA, 28 bp, Artificial Sequence
  Description of Artificial Sequence: Synthetic oligonucleotide
acagcctcccttatcgtgtgtgtgctgg

SEQ ID NO: 187982 - DNA, 27 bp, Artificial Sequence
  Description of Artificial Sequence: Synthetic oligonucleotide
cagcctcccttatcgtgtgtgtgctgg

SEQ ID NO: 187983 - DNA, 27 bp, Artificial Sequence
  Description of Artificial Sequence: Synthetic oligonucleotide
agcctcccttatcgtgtgtgtgctggc

SEQ ID NO: 187984 - DNA, 26 bp, Artificial Sequence
  Description of Artificial Sequence: Synthetic oligonucleotide
gcctcccttatcgtgtgtgtgctggc

SEQ ID NO: 187985 - DNA, 27 bp, Artificial Sequence
  Description of Artificial Sequence: Synthetic oligonucleotide
cctcccttatcgtgtgtgtgctggcca

SEQ ID NO: 187986 - DNA, 29 bp, Artificial Sequence
  Description of Artificial Sequence: Synthetic oligonucleotide
ctcccttatcgtgtgtgtgctggccattg

SEQ ID NO: 187987 - DNA, 31 bp, Artificial Sequence
  Description of Artificial Sequence: Synthetic oligonucleotide
tcccttatcgtgtgtgtgctggccattgttg

SEQ ID NO: 187988 - DNA, 30 bp, Artificial Sequence
  Description of Artificial Sequence: Synthetic oligonucleotide
cccttatcgtgtgtgtgctggccattgttg

SEQ ID NO: 187989 - DNA, 31 bp, Artificial Sequence
  Description of Artificial Sequence: Synthetic oligonucleotide
ccttatcgtgtgtgtgctggccattgttgac

SEQ ID NO: 187990 - DNA, 31 bp, Artificial Sequence
  Description of Artificial Sequence: Synthetic oligonucleotide
cttatcgtgtgtgtgctggccattgttgacc

SEQ ID NO: 187991 - DNA, 31 bp, Artificial Sequence
  Description of Artificial Sequence: Synthetic oligonucleotide
ttatcgtgtgtgtgctggccattgttgaccc

SEQ ID NO: 187992 - DNA, 30 bp, Artificial Sequence
  Description of Artificial Sequence: Synthetic oligonucleotide
tatcgtgtgtgtgctggccattgttgaccc

SEQ ID NO: 187993 - DNA, 29 bp, Artificial Sequence
  Description of Artificial Sequence: Synthetic oligonucleotide
atcgtgtgtgtgctggccattgttgaccc

SEQ ID NO: 187994 - DNA, 28 bp, Artificial Sequence
  Description of Artificial Sequence: Synthetic oligonucleotide
tcgtgtgtgtgctggccattgttgaccc

SEQ ID NO: 187995 - DNA, 27 bp, Artificial Sequence
  Description of Artificial Sequence: Synthetic oligonucleotide
cgtgtgtgtgctggccattgttgaccc

SEQ ID NO: 187996 - DNA, 27 bp, Artificial Sequence
  Description of Artificial Sequence: Synthetic oligonucleotide
gtgtgtgtgctggccattgttgacccc

SEQ ID NO: 187997 - DNA, 29 bp, Artificial Sequence
  Description of Artificial Sequence: Synthetic oligonucleotide
tgtgtgtgctggccattgttgacccctac

SEQ ID NO: 187998 - DNA, 28 bp, Artificial Sequence
  Description of Artificial Sequence: Synthetic oligonucleotide
gtgtgtgctggccattgttgacccctac

SEQ ID NO: 187999 - DNA, 30 bp, Artificial Sequence
  Description of Artificial Sequence: Synthetic oligonucleotide
tgtgtgctggccattgttgacccctacaac

SEQ ID NO: 188000 - DNA, 29 bp, Artificial Sequence
  Description of Artificial Sequence: Synthetic oligonucleotide
gtgtgctggccattgttgacccctacaac

SEQ ID NO: 188001 - DNA, 31 bp, Artificial Sequence
  Description of Artificial Sequence: Synthetic oligonucleotide
tgtgctggccattgttgacccctacaacaac

SEQ ID NO: 188002 - DNA, 30 bp, Artificial Sequence
  Description of Artificial Sequence: Synthetic oligonucleotide
gtgctggccattgttgacccctacaacaac

SEQ ID NO: 188003 - DNA, 30 bp, Artificial Sequence
  Description of Artificial Sequence: Synthetic oligonucleotide
tgctggccattgttgacccctacaacaacc

SEQ ID NO: 188004 - DNA, 29 bp, Artificial Sequence
  Description of Artificial Sequence: Synthetic oligonucleotide
gctggccattgttgacccctacaacaacc

SEQ ID NO: 188005 - DNA, 29 bp, Artificial Sequence
  Description of Artificial Sequence: Synthetic oligonucleotide
ctggccattgttgacccctacaacaaccc

SEQ ID NO: 188006 - DNA, 29 bp, Artificial Sequence
  Description of Artificial Sequence: Synthetic oligonucleotide
tggccattgttgacccctacaacaacccc

SEQ ID NO: 188007 - DNA, 28 bp, Artificial Sequence
  Description of Artificial Sequence: Synthetic oligonucleotide
ggccattgttgacccctacaacaacccc

SEQ ID NO: 188008 - DNA, 28 bp, Artificial Sequence
  Description of Artificial Sequence: Synthetic oligonucleotide
gccattgttgacccctacaacaaccccg

SEQ ID NO: 188009 - DNA, 29 bp, Artificial Sequence
  Description of Artificial Sequence: Synthetic oligonucleotide
ccattgttgacccctacaacaaccccgtc

SEQ ID NO: 188010 - DNA, 29 bp, Artificial Sequence
  Description of Artificial Sequence: Synthetic oligonucleotide
cattgttgacccctacaacaaccccgtcc

SEQ ID NO: 188011 - DNA, 29 bp, Artificial Sequence
  Description of Artificial Sequence: Synthetic oligonucleotide
attgttgacccctacaacaaccccgtccc

SEQ ID NO: 188012 - DNA, 28 bp, Artificial Sequence
  Description of Artificial Sequence: Synthetic oligonucleotide
ttgttgacccctacaacaaccccgtccc

SEQ ID NO: 188013 - DNA, 27 bp, Artificial Sequence
  Description of Artificial Sequence: Synthetic oligonucleotide
tgttgacccctacaacaaccccgtccc

SEQ ID NO: 188014 - DNA, 26 bp, Artificial Sequence
  Description of Artificial Sequence: Synthetic oligonucleotide
gttgacccctacaacaaccccgtccc

SEQ ID NO: 188015 - DNA, 26 bp, Artificial Sequence
  Description of Artificial Sequence: Synthetic oligonucleotide
ttgacccctacaacaaccccgtcccc

SEQ ID NO: 188016 - DNA, 25 bp, Artificial Sequence
  Description of Artificial Sequence: Synthetic oligonucleotide
tgacccctacaacaaccccgtcccc

SEQ ID NO: 188017 - DNA, 24 bp, Artificial Sequence
  Description of Artificial Sequence: Synthetic oligonucleotide
gacccctacaacaaccccgtcccc

SEQ ID NO: 188018 - DNA, 24 bp, Artificial Sequence
  Description of Artificial Sequence: Synthetic oligonucleotide
acccctacaacaaccccgtccccc

SEQ ID NO: 188019 - DNA, 23 bp, Artificial Sequence
  Description of Artificial Sequence: Synthetic oligonucleotide
cccctacaacaaccccgtccccc

SEQ ID NO: 188020 - DNA, 24 bp, Artificial Sequence
  Description of Artificial Sequence: Synthetic oligonucleotide
ccctacaacaaccccgtcccccga

SEQ ID NO: 188021 - DNA, 24 bp, Artificial Sequence
  Description of Artificial Sequence: Synthetic oligonucleotide
cctacaacaaccccgtcccccgag

SEQ ID NO: 188022 - DNA, 24 bp, Artificial Sequence
  Description of Artificial Sequence: Synthetic oligonucleotide
ctacaacaaccccgtcccccgagg

SEQ ID NO: 188023 - DNA, 24 bp, Artificial Sequence
  Description of Artificial Sequence: Synthetic oligonucleotide
tacaacaaccccgtcccccgaggc

SEQ ID NO: 188024 - DNA, 23 bp, Artificial Sequence
  Description of Artificial Sequence: Synthetic oligonucleotide
acaacaaccccgtcccccgaggc

SEQ ID NO: 188025 - DNA, 22 bp, Artificial Sequence
  Description of Artificial Sequence: Synthetic oligonucleotide
caacaaccccgtcccccgaggc

SEQ ID NO: 188026 - DNA, 23 bp, Artificial Sequence
  Description of Artificial Sequence: Synthetic oligonucleotide
aacaaccccgtcccccgaggcct

SEQ ID NO: 188027 - DNA, 22 bp, Artificial Sequence
  Description of Artificial Sequence: Synthetic oligonucleotide
acaaccccgtcccccgaggcct

SEQ ID NO: 188028 - DNA, 21 bp, Artificial Sequence
  Description of Artificial Sequence: Synthetic oligonucleotide
caaccccgtcccccgaggcct

SEQ ID NO: 188029 - DNA, 21 bp, Artificial Sequence
  Description of Artificial Sequence: Synthetic oligonucleotide
aaccccgtcccccgaggcctg

SEQ ID NO: 188030 - DNA, 20 bp, Artificial Sequence
  Description of Artificial Sequence: Synthetic oligonucleotide
accccgtcccccgaggcctg

SEQ ID NO: 188031 - DNA, 20 bp, Artificial Sequence
  Description of Artificial Sequence: Synthetic oligonucleotide
ccccgtcccccgaggcctgt

SEQ ID NO: 188032 - DNA, 20 bp, Artificial Sequence
  Description of Artificial Sequence: Synthetic oligonucleotide
cccgtcccccgaggcctgga

SEQ ID NO: 188033 - DNA, 20 bp, Artificial Sequence
  Description of Artificial Sequence: Synthetic oligonucleotide
ccgtcccccgaggcctggag

SEQ ID NO: 188034 - DNA, 20 bp, Artificial Sequence
  Description of Artificial Sequence: Synthetic oligonucleotide
cgtcccccgaggcctggagg

SEQ ID NO: 188035 - DNA, 20 bp, Artificial Sequence
  Description of Artificial Sequence: Synthetic oligonucleotide
gtcccccgaggcctggaggc

SEQ ID NO: 188036 - DNA, 22 bp, Artificial Sequence
  Description of Artificial Sequence: Synthetic oligonucleotide
tcccccgaggcctggaggcctt

SEQ ID NO: 188037 - DNA, 21 bp, Artificial Sequence
  Description of Artificial Sequence: Synthetic oligonucleotide
cccccgaggcctggaggcctt

SEQ ID NO: 188038 - DNA, 22 bp, Artificial Sequence
  Description of Artificial Sequence: Synthetic oligonucleotide
ccccgaggcctggaggccttca

SEQ ID NO: 188039 - DNA, 22 bp, Artificial Sequence
  Description of Artificial Sequence: Synthetic oligonucleotide
cccgaggcctggaggccttcac

SEQ ID NO: 188040 - DNA, 22 bp, Artificial Sequence
  Description of Artificial Sequence: Synthetic oligonucleotide
ccgaggcctggaggccttcacc

SEQ ID NO: 188041 - DNA, 23 bp, Artificial Sequence
  Description of Artificial Sequence: Synthetic oligonucleotide
cgaggcctggaggccttcaccgt

SEQ ID NO: 188042 - DNA, 23 bp, Artificial Sequence
  Description of Artificial Sequence: Synthetic oligonucleotide
gaggcctggaggccttcaccgtg

SEQ ID NO: 188043 - DNA, 23 bp, Artificial Sequence
  Description of Artificial Sequence: Synthetic oligonucleotide
aggcctggaggccttcaccgtgg

SEQ ID NO: 188044 - DNA, 22 bp, Artificial Sequence
  Description of Artificial Sequence: Synthetic oligonucleotide
ggcctggaggccttcaccgtgg

SEQ ID NO: 188045 - DNA, 22 bp, Artificial Sequence
  Description of Artificial Sequence: Synthetic oligonucleotide
gcctggaggccttcaccgtggg

SEQ ID NO: 188046 - DNA, 22 bp, Artificial Sequence
  Description of Artificial Sequence: Synthetic oligonucleotide
cctggaggccttcaccgtgggc

SEQ ID NO: 188047 - DNA, 23 bp, Artificial Sequence
  Description of Artificial Sequence: Synthetic oligonucleotide
ctggaggccttcaccgtgggcct

SEQ ID NO: 188048 - DNA, 23 bp, Artificial Sequence
  Description of Artificial Sequence: Synthetic oligonucleotide
tggaggccttcaccgtgggcctg

SEQ ID NO: 188049 - DNA, 22 bp, Artificial Sequence
  Description of Artificial Sequence: Synthetic oligonucleotide
ggaggccttcaccgtgggcctg

SEQ ID NO: 188050 - DNA, 23 bp, Artificial Sequence
  Description of Artificial Sequence: Synthetic oligonucleotide
gaggccttcaccgtgggcctggt

SEQ ID NO: 188051 - DNA, 23 bp, Artificial Sequence
  Description of Artificial Sequence: Synthetic oligonucleotide
aggccttcaccgtgggcctggtg

SEQ ID NO: 188052 - DNA, 22 bp, Artificial Sequence
  Description of Artificial Sequence: Synthetic oligonucleotide
ggccttcaccgtgggcctggtg

SEQ ID NO: 188053 - DNA, 23 bp, Artificial Sequence
  Description of Artificial Sequence: Synthetic oligonucleotide
gccttcaccgtgggcctggtggt

SEQ ID NO: 188054 - DNA, 23 bp, Artificial Sequence
  Description of Artificial Sequence: Synthetic oligonucleotide
ccttcaccgtgggcctggtggtc

SEQ ID NO: 188055 - DNA, 24 bp, Artificial Sequence
  Description of Artificial Sequence: Synthetic oligonucleotide
cttcaccgtgggcctggtggtcct

SEQ ID NO: 188056 - DNA, 24 bp, Artificial Sequence
  Description of Artificial Sequence: Synthetic oligonucleotide
ttcaccgtgggcctggtggtcctg

SEQ ID NO: 188057 - DNA, 23 bp, Artificial Sequence
  Description of Artificial Sequence: Synthetic oligonucleotide
tcaccgtgggcctggtggtcctg

SEQ ID NO: 188058 - DNA, 22 bp, Artificial Sequence
  Description of Artificial Sequence: Synthetic oligonucleotide
caccgtgggcctggtggtcctg

SEQ ID NO: 188059 - DNA, 23 bp, Artificial Sequence
  Description of Artificial Sequence: Synthetic oligonucleotide
accgtgggcctggtggtcctggt

SEQ ID NO: 188060 - DNA, 22 bp, Artificial Sequence
  Description of Artificial Sequence: Synthetic oligonucleotide
ccgtgggcctggtggtcctggt

SEQ ID NO: 188061 - DNA, 25 bp, Artificial Sequence
  Description of Artificial Sequence: Synthetic oligonucleotide
cgtgggcctggtggtcctggtcatt

SEQ ID NO: 188062 - DNA, 25 bp, Artificial Sequence
  Description of Artificial Sequence: Synthetic oligonucleotide
gtgggcctggtggtcctggtcattg

SEQ ID NO: 188063 - DNA, 25 bp, Artificial Sequence
  Description of Artificial Sequence: Synthetic oligonucleotide
tgggcctggtggtcctggtcattgg

SEQ ID NO: 188064 - DNA, 24 bp, Artificial Sequence
  Description of Artificial Sequence: Synthetic oligonucleotide
gggcctggtggtcctggtcattgg

SEQ ID NO: 188065 - DNA, 25 bp, Artificial Sequence
  Description of Artificial Sequence: Synthetic oligonucleotide
ggcctggtggtcctggtcattggca

SEQ ID NO: 188066 - DNA, 25 bp, Artificial Sequence
  Description of Artificial Sequence: Synthetic oligonucleotide
gcctggtggtcctggtcattggcac

SEQ ID NO: 188067 - DNA, 26 bp, Artificial Sequence
  Description of Artificial Sequence: Synthetic oligonucleotide
cctggtggtcctggtcattggcacct

SEQ ID NO: 188068 - DNA, 26 bp, Artificial Sequence
  Description of Artificial Sequence: Synthetic oligonucleotide
ctggtggtcctggtcattggcacctc

SEQ ID NO: 188069 - DNA, 27 bp, Artificial Sequence
  Description of Artificial Sequence: Synthetic oligonucleotide
tggtggtcctggtcattggcacctcca

SEQ ID NO: 188070 - DNA, 27 bp, Artificial Sequence
  Description of Artificial Sequence: Synthetic oligonucleotide
ggtggtcctggtcattggcacctccat

SEQ ID NO: 188071 - DNA, 27 bp, Artificial Sequence
  Description of Artificial Sequence: Synthetic oligonucleotide
gtggtcctggtcattggcacctccatg

SEQ ID NO: 188072 - DNA, 27 bp, Artificial Sequence
  Description of Artificial Sequence: Synthetic oligonucleotide
tggtcctggtcattggcacctccatgg

SEQ ID NO: 188073 - DNA, 26 bp, Artificial Sequence
  Description of Artificial Sequence: Synthetic oligonucleotide
ggtcctggtcattggcacctccatgg

SEQ ID NO: 188074 - DNA, 26 bp, Artificial Sequence
  Description of Artificial Sequence: Synthetic oligonucleotide
gtcctggtcattggcacctccatggg

SEQ ID NO: 188075 - DNA, 27 bp, Artificial Sequence
  Description of Artificial Sequence: Synthetic oligonucleotide
tcctggtcattggcacctccatgggct

SEQ ID NO: 188076 - DNA, 27 bp, Artificial Sequence
  Description of Artificial Sequence: Synthetic oligonucleotide
cctggtcattggcacctccatgggctt

SEQ ID NO: 188077 - DNA, 27 bp, Artificial Sequence
  Description of Artificial Sequence: Synthetic oligonucleotide
ctggtcattggcacctccatgggcttc

SEQ ID NO: 188078 - DNA, 29 bp, Artificial Sequence
  Description of Artificial Sequence: Synthetic oligonucleotide
tggtcattggcacctccatgggcttcaac

SEQ ID NO: 188079 - DNA, 28 bp, Artificial Sequence
  Description of Artificial Sequence: Synthetic oligonucleotide
ggtcattggcacctccatgggcttcaac

SEQ ID NO: 188080 - DNA, 29 bp, Artificial Sequence
  Description of Artificial Sequence: Synthetic oligonucleotide
gtcattggcacctccatgggcttcaactc

SEQ ID NO: 188081 - DNA, 29 bp, Artificial Sequence
  Description of Artificial Sequence: Synthetic oligonucleotide
tcattggcacctccatgggcttcaactcc

SEQ ID NO: 188082 - DNA, 28 bp, Artificial Sequence
  Description of Artificial Sequence: Synthetic oligonucleotide
cattggcacctccatgggcttcaactcc

SEQ ID NO: 188083 - DNA, 28 bp, Artificial Sequence
  Description of Artificial Sequence: Synthetic oligonucleotide
attggcacctccatgggcttcaactccg

SEQ ID NO: 188084 - DNA, 27 bp, Artificial Sequence
  Description of Artificial Sequence: Synthetic oligonucleotide
ttggcacctccatgggcttcaactccg

SEQ ID NO: 188085 - DNA, 26 bp, Artificial Sequence
  Description of Artificial Sequence: Synthetic oligonucleotide
tggcacctccatgggcttcaactccg

SEQ ID NO: 188086 - DNA, 25 bp, Artificial Sequence
  Description of Artificial Sequence: Synthetic oligonucleotide
ggcacctccatgggcttcaactccg

SEQ ID NO: 188087 - DNA, 25 bp, Artificial Sequence
  Description of Artificial Sequence: Synthetic oligonucleotide
gcacctccatgggcttcaactccgg

SEQ ID NO: 188088 - DNA, 27 bp, Artificial Sequence
  Description of Artificial Sequence: Synthetic oligonucleotide
cacctccatgggcttcaactccggcta

SEQ ID NO: 188089 - DNA, 28 bp, Artificial Sequence
  Description of Artificial Sequence: Synthetic oligonucleotide
acctccatgggcttcaactccggctatg

SEQ ID NO: 188090 - DNA, 27 bp, Artificial Sequence
  Description of Artificial Sequence: Synthetic oligonucleotide
cctccatgggcttcaactccggctatg

SEQ ID NO: 188091 - DNA, 27 bp, Artificial Sequence
  Description of Artificial Sequence: Synthetic oligonucleotide
ctccatgggcttcaactccggctatgc

SEQ ID NO: 188092 - DNA, 27 bp, Artificial Sequence
  Description of Artificial Sequence: Synthetic oligonucleotide
tccatgggcttcaactccggctatgcc

SEQ ID NO: 188093 - DNA, 26 bp, Artificial Sequence
  Description of Artificial Sequence: Synthetic oligonucleotide
ccatgggcttcaactccggctatgcc

SEQ ID NO: 188094 - DNA, 27 bp, Artificial Sequence
  Description of Artificial Sequence: Synthetic oligonucleotide
catgggcttcaactccggctatgccgt

SEQ ID NO: 188095 - DNA, 27 bp, Artificial Sequence
  Description of Artificial Sequence: Synthetic oligonucleotide
atgggcttcaactccggctatgccgtc

SEQ ID NO: 188096 - DNA, 27 bp, Artificial Sequence
  Description of Artificial Sequence: Synthetic oligonucleotide
tgggcttcaactccggctatgccgtca

SEQ ID NO: 188097 - DNA, 27 bp, Artificial Sequence
  Description of Artificial Sequence: Synthetic oligonucleotide
gggcttcaactccggctatgccgtcaa

SEQ ID NO: 188098 - DNA, 27 bp, Artificial Sequence
  Description of Artificial Sequence: Synthetic oligonucleotide
ggcttcaactccggctatgccgtcaac

SEQ ID NO: 188099 - DNA, 27 bp, Artificial Sequence
  Description of Artificial Sequence: Synthetic oligonucleotide
gcttcaactccggctatgccgtcaacc

SEQ ID NO: 188100 - DNA, 27 bp, Artificial Sequence
  Description of Artificial Sequence: Synthetic oligonucleotide
cttcaactccggctatgccgtcaaccc

SEQ ID NO: 188101 - DNA, 28 bp, Artificial Sequence
  Description of Artificial Sequence: Synthetic oligonucleotide
ttcaactccggctatgccgtcaaccctg

SEQ ID NO: 188102 - DNA, 27 bp, Artificial Sequence
  Description of Artificial Sequence: Synthetic oligonucleotide
tcaactccggctatgccgtcaaccctg

SEQ ID NO: 188103 - DNA, 26 bp, Artificial Sequence
  Description of Artificial Sequence: Synthetic oligonucleotide
caactccggctatgccgtcaaccctg

SEQ ID NO: 188104 - DNA, 26 bp, Artificial Sequence
  Description of Artificial Sequence: Synthetic oligonucleotide
aactccggctatgccgtcaaccctgc

SEQ ID NO: 188105 - DNA, 25 bp, Artificial Sequence
  Description of Artificial Sequence: Synthetic oligonucleotide
actccggctatgccgtcaaccctgc

SEQ ID NO: 188106 - DNA, 24 bp, Artificial Sequence
  Description of Artificial Sequence: Synthetic oligonucleotide
ctccggctatgccgtcaaccctgc

SEQ ID NO: 188107 - DNA, 24 bp, Artificial Sequence
  Description of Artificial Sequence: Synthetic oligonucleotide
tccggctatgccgtcaaccctgcc

SEQ ID NO: 188108 - DNA, 23 bp, Artificial Sequence
  Description of Artificial Sequence: Synthetic oligonucleotide
ccggctatgccgtcaaccctgcc

SEQ ID NO: 188109 - DNA, 23 bp, Artificial Sequence
  Description of Artificial Sequence: Synthetic oligonucleotide
cggctatgccgtcaaccctgccc

SEQ ID NO: 188110 - DNA, 23 bp, Artificial Sequence
  Description of Artificial Sequence: Synthetic oligonucleotide
ggctatgccgtcaaccctgcccg

SEQ ID NO: 188111 - DNA, 23 bp, Artificial Sequence
  Description of Artificial Sequence: Synthetic oligonucleotide
gctatgccgtcaaccctgcccgg

SEQ ID NO: 188112 - DNA, 24 bp, Artificial Sequence
  Description of Artificial Sequence: Synthetic oligonucleotide
ctatgccgtcaaccctgcccggga

SEQ ID NO: 188113 - DNA, 27 bp, Artificial Sequence
  Description of Artificial Sequence: Synthetic oligonucleotide
tatgccgtcaaccctgcccgggacttt

SEQ ID NO: 188114 - DNA, 26 bp, Artificial Sequence
  Description of Artificial Sequence: Synthetic oligonucleotide
atgccgtcaaccctgcccgggacttt

SEQ ID NO: 188115 - DNA, 25 bp, Artificial Sequence
  Description of Artificial Sequence: Synthetic oligonucleotide
tgccgtcaaccctgcccgggacttt

SEQ ID NO: 188116 - DNA, 24 bp, Artificial Sequence
  Description of Artificial Sequence: Synthetic oligonucleotide
gccgtcaaccctgcccgggacttt

SEQ ID NO: 188117 - DNA, 24 bp, Artificial Sequence
  Description of Artificial Sequence: Synthetic oligonucleotide
ccgtcaaccctgcccgggactttg

SEQ ID NO: 188118 - DNA, 24 bp, Artificial Sequence
  Description of Artificial Sequence: Synthetic oligonucleotide
cgtcaaccctgcccgggactttgg

SEQ ID NO: 188119 - DNA, 24 bp, Artificial Sequence
  Description of Artificial Sequence: Synthetic oligonucleotide
gtcaaccctgcccgggactttggc

SEQ ID NO: 188120 - DNA, 24 bp, Artificial Sequence
  Description of Artificial Sequence: Synthetic oligonucleotide
tcaaccctgcccgggactttggcc

SEQ ID NO: 188121 - DNA, 23 bp, Artificial Sequence
  Description of Artificial Sequence: Synthetic oligonucleotide
caaccctgcccgggactttggcc

SEQ ID NO: 188122 - DNA, 23 bp, Artificial Sequence
  Description of Artificial Sequence: Synthetic oligonucleotide
aaccctgcccgggactttggccc

SEQ ID NO: 188123 - DNA, 22 bp, Artificial Sequence
  Description of Artificial Sequence: Synthetic oligonucleotide
accctgcccgggactttggccc

SEQ ID NO: 188124 - DNA, 21 bp, Artificial Sequence
  Description of Artificial Sequence: Synthetic oligonucleotide
ccctgcccgggactttggccc

SEQ ID NO: 188125 - DNA, 21 bp, Artificial Sequence
  Description of Artificial Sequence: Synthetic oligonucleotide
cctgcccgggactttggcccc

SEQ ID NO: 188126 - DNA, 21 bp, Artificial Sequence
  Description of Artificial Sequence: Synthetic oligonucleotide
ctgcccgggactttggccccc

SEQ ID NO: 188127 - DNA, 21 bp, Artificial Sequence
  Description of Artificial Sequence: Synthetic oligonucleotide
tgcccgggactttggcccccg

SEQ ID NO: 188128 - DNA, 20 bp, Artificial Sequence
  Description of Artificial Sequence: Synthetic oligonucleotide
gcccgggactttggcccccg

SEQ ID NO: 188129 - DNA, 20 bp, Artificial Sequence
  Description of Artificial Sequence: Synthetic oligonucleotide
cccgggactttggcccccgc

SEQ ID NO: 188130 - DNA, 26 bp, Artificial Sequence
  Description of Artificial Sequence: Synthetic oligonucleotide
ccgggactttggcccccgccttttta

SEQ ID NO: 188131 - DNA, 27 bp, Artificial Sequence
  Description of Artificial Sequence: Synthetic oligonucleotide
cgggactttggcccccgcctttttaca

SEQ ID NO: 188132 - DNA, 27 bp, Artificial Sequence
  Description of Artificial Sequence: Synthetic oligonucleotide
gggactttggcccccgcctttttacag

SEQ ID NO: 188133 - DNA, 27 bp, Artificial Sequence
  Description of Artificial Sequence: Synthetic oligonucleotide
ggactttggcccccgcctttttacagc

SEQ ID NO: 188134 - DNA, 27 bp, Artificial Sequence
  Description of Artificial Sequence: Synthetic oligonucleotide
gactttggcccccgcctttttacagcc

SEQ ID NO: 188135 - DNA, 27 bp, Artificial Sequence
  Description of Artificial Sequence: Synthetic oligonucleotide
actttggcccccgcctttttacagccc

SEQ ID NO: 188136 - DNA, 27 bp, Artificial Sequence
  Description of Artificial Sequence: Synthetic oligonucleotide
ctttggcccccgcctttttacagccct

SEQ ID NO: 188137 - DNA, 28 bp, Artificial Sequence
  Description of Artificial Sequence: Synthetic oligonucleotide
tttggcccccgcctttttacagcccttg

SEQ ID NO: 188138 - DNA, 27 bp, Artificial Sequence
  Description of Artificial Sequence: Synthetic oligonucleotide
ttggcccccgcctttttacagcccttg

SEQ ID NO: 188139 - DNA, 26 bp, Artificial Sequence
  Description of Artificial Sequence: Synthetic oligonucleotide
tggcccccgcctttttacagcccttg

SEQ ID NO: 188140 - DNA, 25 bp, Artificial Sequence
  Description of Artificial Sequence: Synthetic oligonucleotide
ggcccccgcctttttacagcccttg

SEQ ID NO: 188141 - DNA, 25 bp, Artificial Sequence
  Description of Artificial Sequence: Synthetic oligonucleotide
gcccccgcctttttacagcccttgc

SEQ ID NO: 188142 - DNA, 25 bp, Artificial Sequence
  Description of Artificial Sequence: Synthetic oligonucleotide
cccccgcctttttacagcccttgcg

SEQ ID NO: 188143 - DNA, 25 bp, Artificial Sequence
  Description of Artificial Sequence: Synthetic oligonucleotide
ccccgcctttttacagcccttgcgg

SEQ ID NO: 188144 - DNA, 25 bp, Artificial Sequence
  Description of Artificial Sequence: Synthetic oligonucleotide
cccgcctttttacagcccttgcggg

SEQ ID NO: 188145 - DNA, 26 bp, Artificial Sequence
  Description of Artificial Sequence: Synthetic oligonucleotide
ccgcctttttacagcccttgcgggct

SEQ ID NO: 188146 - DNA, 26 bp, Artificial Sequence
  Description of Artificial Sequence: Synthetic oligonucleotide
cgcctttttacagcccttgcgggctg

SEQ ID NO: 188147 - DNA, 26 bp, Artificial Sequence
  Description of Artificial Sequence: Synthetic oligonucleotide
gcctttttacagcccttgcgggctgg

SEQ ID NO: 188148 - DNA, 26 bp, Artificial Sequence
  Description of Artificial Sequence: Synthetic oligonucleotide
cctttttacagcccttgcgggctggg

SEQ ID NO: 188149 - DNA, 26 bp, Artificial Sequence
  Description of Artificial Sequence: Synthetic oligonucleotide
ctttttacagcccttgcgggctgggg

SEQ ID NO: 188150 - DNA, 27 bp, Artificial Sequence
  Description of Artificial Sequence: Synthetic oligonucleotide
tttttacagcccttgcgggctggggct

SEQ ID NO: 188151 - DNA, 26 bp, Artificial Sequence
  Description of Artificial Sequence: Synthetic oligonucleotide
ttttacagcccttgcgggctggggct

SEQ ID NO: 188152 - DNA, 25 bp, Artificial Sequence
  Description of Artificial Sequence: Synthetic oligonucleotide
tttacagcccttgcgggctggggct

SEQ ID NO: 188153 - DNA, 24 bp, Artificial Sequence
  Description of Artificial Sequence: Synthetic oligonucleotide
ttacagcccttgcgggctggggct

SEQ ID NO: 188154 - DNA, 23 bp, Artificial Sequence
  Description of Artificial Sequence: Synthetic oligonucleotide
tacagcccttgcgggctggggct

SEQ ID NO: 188155 - DNA, 22 bp, Artificial Sequence
  Description of Artificial Sequence: Synthetic oligonucleotide
acagcccttgcgggctggggct

SEQ ID NO: 188156 - DNA, 21 bp, Artificial Sequence
  Description of Artificial Sequence: Synthetic oligonucleotide
cagcccttgcgggctggggct

SEQ ID NO: 188157 - DNA, 22 bp, Artificial Sequence
  Description of Artificial Sequence: Synthetic oligonucleotide
agcccttgcgggctggggctct

SEQ ID NO: 188158 - DNA, 21 bp, Artificial Sequence
  Description of Artificial Sequence: Synthetic oligonucleotide
gcccttgcgggctggggctct

SEQ ID NO: 188159 - DNA, 21 bp, Artificial Sequence
  Description of Artificial Sequence: Synthetic oligonucleotide
cccttgcgggctggggctctg

SEQ ID NO: 188160 - DNA, 22 bp, Artificial Sequence
  Description of Artificial Sequence: Synthetic oligonucleotide
ccttgcgggctggggctctgca

SEQ ID NO: 188161 - DNA, 23 bp, Artificial Sequence
  Description of Artificial Sequence: Synthetic oligonucleotide
cttgcgggctggggctctgcagt

SEQ ID NO: 188162 - DNA, 25 bp, Artificial Sequence
  Description of Artificial Sequence: Synthetic oligonucleotide
ttgcgggctggggctctgcagtctt

SEQ ID NO: 188163 - DNA, 24 bp, Artificial Sequence
  Description of Artificial Sequence: Synthetic oligonucleotide
tgcgggctggggctctgcagtctt

SEQ ID NO: 188164 - DNA, 23 bp, Artificial Sequence
  Description of Artificial Sequence: Synthetic oligonucleotide
gcgggctggggctctgcagtctt

SEQ ID NO: 188165 - DNA, 24 bp, Artificial Sequence
  Description of Artificial Sequence: Synthetic oligonucleotide
cgggctggggctctgcagtcttca

SEQ ID NO: 188166 - DNA, 24 bp, Artificial Sequence
  Description of Artificial Sequence: Synthetic oligonucleotide
gggctggggctctgcagtcttcac

SEQ ID NO: 188167 - DNA, 25 bp, Artificial Sequence
  Description of Artificial Sequence: Synthetic oligonucleotide
ggctggggctctgcagtcttcacga

SEQ ID NO: 188168 - DNA, 25 bp, Artificial Sequence
  Description of Artificial Sequence: Synthetic oligonucleotide
gctggggctctgcagtcttcacgac

SEQ ID NO: 188169 - DNA, 25 bp, Artificial Sequence
  Description of Artificial Sequence: Synthetic oligonucleotide
ctggggctctgcagtcttcacgacc

SEQ ID NO: 188170 - DNA, 25 bp, Artificial Sequence
  Description of Artificial Sequence: Synthetic oligonucleotide
tggggctctgcagtcttcacgaccg

SEQ ID NO: 188171 - DNA, 24 bp, Artificial Sequence
  Description of Artificial Sequence: Synthetic oligonucleotide
ggggctctgcagtcttcacgaccg

SEQ ID NO: 188172 - DNA, 24 bp, Artificial Sequence
  Description of Artificial Sequence: Synthetic oligonucleotide
gggctctgcagtcttcacgaccgg

SEQ ID NO: 188173 - DNA, 24 bp, Artificial Sequence
  Description of Artificial Sequence: Synthetic oligonucleotide
ggctctgcagtcttcacgaccggc

SEQ ID NO: 188174 - DNA, 25 bp, Artificial Sequence
  Description of Artificial Sequence: Synthetic oligonucleotide
gctctgcagtcttcacgaccggcca

SEQ ID NO: 188175 - DNA, 25 bp, Artificial Sequence
  Description of Artificial Sequence: Synthetic oligonucleotide
ctctgcagtcttcacgaccggccag

SEQ ID NO: 188176 - DNA, 27 bp, Artificial Sequence
  Description of Artificial Sequence: Synthetic oligonucleotide
tctgcagtcttcacgaccggccagcat

SEQ ID NO: 188177 - DNA, 27 bp, Artificial Sequence
  Description of Artificial Sequence: Synthetic oligonucleotide
ctgcagtcttcacgaccggccagcatt

SEQ ID NO: 188178 - DNA, 27 bp, Artificial Sequence
  Description of Artificial Sequence: Synthetic oligonucleotide
tgcagtcttcacgaccggccagcattg

SEQ ID NO: 188179 - DNA, 26 bp, Artificial Sequence
  Description of Artificial Sequence: Synthetic oligonucleotide
gcagtcttcacgaccggccagcattg

SEQ ID NO: 188180 - DNA, 27 bp, Artificial Sequence
  Description of Artificial Sequence: Synthetic oligonucleotide
cagtcttcacgaccggccagcattggt

SEQ ID NO: 188181 - DNA, 27 bp, Artificial Sequence
  Description of Artificial Sequence: Synthetic oligonucleotide
agtcttcacgaccggccagcattggtg

SEQ ID NO: 188182 - DNA, 26 bp, Artificial Sequence
  Description of Artificial Sequence: Synthetic oligonucleotide
gtcttcacgaccggccagcattggtg

SEQ ID NO: 188183 - DNA, 27 bp, Artificial Sequence
  Description of Artificial Sequence: Synthetic oligonucleotide
tcttcacgaccggccagcattggtggt

SEQ ID NO: 188184 - DNA, 26 bp, Artificial Sequence
  Description of Artificial Sequence: Synthetic oligonucleotide
cttcacgaccggccagcattggtggt

SEQ ID NO: 188185 - DNA, 26 bp, Artificial Sequence
  Description of Artificial Sequence: Synthetic oligonucleotide
ttcacgaccggccagcattggtggtg

SEQ ID NO: 188186 - DNA, 25 bp, Artificial Sequence
  Description of Artificial Sequence: Synthetic oligonucleotide
tcacgaccggccagcattggtggtg

SEQ ID NO: 188187 - DNA, 24 bp, Artificial Sequence
  Description of Artificial Sequence: Synthetic oligonucleotide
cacgaccggccagcattggtggtg

SEQ ID NO: 188188 - DNA, 24 bp, Artificial Sequence
  Description of Artificial Sequence: Synthetic oligonucleotide
acgaccggccagcattggtggtgg

SEQ ID NO: 188189 - DNA, 23 bp, Artificial Sequence
  Description of Artificial Sequence: Synthetic oligonucleotide
cgaccggccagcattggtggtgg

SEQ ID NO: 188190 - DNA, 24 bp, Artificial Sequence
  Description of Artificial Sequence: Synthetic oligonucleotide
gaccggccagcattggtggtgggt

SEQ ID NO: 188191 - DNA, 24 bp, Artificial Sequence
  Description of Artificial Sequence: Synthetic oligonucleotide
accggccagcattggtggtgggtg

SEQ ID NO: 188192 - DNA, 23 bp, Artificial Sequence
  Description of Artificial Sequence: Synthetic oligonucleotide
ccggccagcattggtggtgggtg

SEQ ID NO: 188193 - DNA, 23 bp, Artificial Sequence
  Description of Artificial Sequence: Synthetic oligonucleotide
cggccagcattggtggtgggtgc

SEQ ID NO: 188194 - DNA, 23 bp, Artificial Sequence
  Description of Artificial Sequence: Synthetic oligonucleotide
ggccagcattggtggtgggtgcc

SEQ ID NO: 188195 - DNA, 25 bp, Artificial Sequence
  Description of Artificial Sequence: Synthetic oligonucleotide
gccagcattggtggtgggtgcccat

SEQ ID NO: 188196 - DNA, 25 bp, Artificial Sequence
  Description of Artificial Sequence: Synthetic oligonucleotide
ccagcattggtggtgggtgcccatc

SEQ ID NO: 188197 - DNA, 26 bp, Artificial Sequence
  Description of Artificial Sequence: Synthetic oligonucleotide
cagcattggtggtgggtgcccatcgt

SEQ ID NO: 188198 - DNA, 27 bp, Artificial Sequence
  Description of Artificial Sequence: Synthetic oligonucleotide
agcattggtggtgggtgcccatcgtgt

SEQ ID NO: 188199 - DNA, 26 bp, Artificial Sequence
  Description of Artificial Sequence: Synthetic oligonucleotide
gcattggtggtgggtgcccatcgtgt

SEQ ID NO: 188200 - DNA, 26 bp, Artificial Sequence
  Description of Artificial Sequence: Synthetic oligonucleotide
cattggtggtgggtgcccatcgtgtc

SEQ ID NO: 188201 - DNA, 26 bp, Artificial Sequence
  Description of Artificial Sequence: Synthetic oligonucleotide
attggtggtgggtgcccatcgtgtcc

SEQ ID NO: 188202 - DNA, 25 bp, Artificial Sequence
  Description of Artificial Sequence: Synthetic oligonucleotide
ttggtggtgggtgcccatcgtgtcc

SEQ ID NO: 188203 - DNA, 24 bp, Artificial Sequence
  Description of Artificial Sequence: Synthetic oligonucleotide
tggtggtgggtgcccatcgtgtcc

SEQ ID NO: 188204 - DNA, 23 bp, Artificial Sequence
  Description of Artificial Sequence: Synthetic oligonucleotide
ggtggtgggtgcccatcgtgtcc

SEQ ID NO: 188205 - DNA, 23 bp, Artificial Sequence
  Description of Artificial Sequence: Synthetic oligonucleotide
gtggtgggtgcccatcgtgtccc

SEQ ID NO: 188206 - DNA, 24 bp, Artificial Sequence
  Description of Artificial Sequence: Synthetic oligonucleotide
tggtgggtgcccatcgtgtcccca

SEQ ID NO: 188207 - DNA, 23 bp, Artificial Sequence
  Description of Artificial Sequence: Synthetic oligonucleotide
ggtgggtgcccatcgtgtcccca

SEQ ID NO: 188208 - DNA, 24 bp, Artificial Sequence
  Description of Artificial Sequence: Synthetic oligonucleotide
gtgggtgcccatcgtgtccccact

SEQ ID NO: 188209 - DNA, 24 bp, Artificial Sequence
  Description of Artificial Sequence: Synthetic oligonucleotide
tgggtgcccatcgtgtccccactc

SEQ ID NO: 188210 - DNA, 23 bp, Artificial Sequence
  Description of Artificial Sequence: Synthetic oligonucleotide
gggtgcccatcgtgtccccactc

SEQ ID NO: 188211 - DNA, 24 bp, Artificial Sequence
  Description of Artificial Sequence: Synthetic oligonucleotide
ggtgcccatcgtgtccccactcct

SEQ ID NO: 188212 - DNA, 24 bp, Artificial Sequence
  Description of Artificial Sequence: Synthetic oligonucleotide
gtgcccatcgtgtccccactcctg

SEQ ID NO: 188213 - DNA, 24 bp, Artificial Sequence
  Description of Artificial Sequence: Synthetic oligonucleotide
tgcccatcgtgtccccactcctgg

SEQ ID NO: 188214 - DNA, 23 bp, Artificial Sequence
  Description of Artificial Sequence: Synthetic oligonucleotide
gcccatcgtgtccccactcctgg

SEQ ID NO: 188215 - DNA, 23 bp, Artificial Sequence
  Description of Artificial Sequence: Synthetic oligonucleotide
cccatcgtgtccccactcctggg

SEQ ID NO: 188216 - DNA, 24 bp, Artificial Sequence
  Description of Artificial Sequence: Synthetic oligonucleotide
ccatcgtgtccccactcctgggct

SEQ ID NO: 188217 - DNA, 24 bp, Artificial Sequence
  Description of Artificial Sequence: Synthetic oligonucleotide
catcgtgtccccactcctgggctc

SEQ ID NO: 188218 - DNA, 27 bp, Artificial Sequence
  Description of Artificial Sequence: Synthetic oligonucleotide
atcgtgtccccactcctgggctccatt

SEQ ID NO: 188219 - DNA, 26 bp, Artificial Sequence
  Description of Artificial Sequence: Synthetic oligonucleotide
tcgtgtccccactcctgggctccatt

SEQ ID NO: 188220 - DNA, 25 bp, Artificial Sequence
  Description of Artificial Sequence: Synthetic oligonucleotide
cgtgtccccactcctgggctccatt

SEQ ID NO: 188221 - DNA, 25 bp, Artificial Sequence
  Description of Artificial Sequence: Synthetic oligonucleotide
gtgtccccactcctgggctccattg

SEQ ID NO: 188222 - DNA, 25 bp, Artificial Sequence
  Description of Artificial Sequence: Synthetic oligonucleotide
tgtccccactcctgggctccattgc

SEQ ID NO: 188223 - DNA, 24 bp, Artificial Sequence
  Description of Artificial Sequence: Synthetic oligonucleotide
gtccccactcctgggctccattgc

SEQ ID NO: 188224 - DNA, 24 bp, Artificial Sequence
  Description of Artificial Sequence: Synthetic oligonucleotide
tccccactcctgggctccattgcg

SEQ ID NO: 188225 - DNA, 23 bp, Artificial Sequence
  Description of Artificial Sequence: Synthetic oligonucleotide
ccccactcctgggctccattgcg

SEQ ID NO: 188226 - DNA, 23 bp, Artificial Sequence
  Description of Artificial Sequence: Synthetic oligonucleotide
cccactcctgggctccattgcgg

SEQ ID NO: 188227 - DNA, 24 bp, Artificial Sequence
  Description of Artificial Sequence: Synthetic oligonucleotide
ccactcctgggctccattgcgggt

SEQ ID NO: 188228 - DNA, 25 bp, Artificial Sequence
  Description of Artificial Sequence: Synthetic oligonucleotide
cactcctgggctccattgcgggtgt

SEQ ID NO: 188229 - DNA, 27 bp, Artificial Sequence
  Description of Artificial Sequence: Synthetic oligonucleotide
actcctgggctccattgcgggtgtctt

SEQ ID NO: 188230 - DNA, 26 bp, Artificial Sequence
  Description of Artificial Sequence: Synthetic oligonucleotide
ctcctgggctccattgcgggtgtctt

SEQ ID NO: 188231 - DNA, 26 bp, Artificial Sequence
  Description of Artificial Sequence: Synthetic oligonucleotide
tcctgggctccattgcgggtgtcttc

SEQ ID NO: 188232 - DNA, 25 bp, Artificial Sequence
  Description of Artificial Sequence: Synthetic oligonucleotide
cctgggctccattgcgggtgtcttc

SEQ ID NO: 188233 - DNA, 26 bp, Artificial Sequence
  Description of Artificial Sequence: Synthetic oligonucleotide
ctgggctccattgcgggtgtcttcgt

SEQ ID NO: 188234 - DNA, 27 bp, Artificial Sequence
  Description of Artificial Sequence: Synthetic oligonucleotide
tgggctccattgcgggtgtcttcgtgt

SEQ ID NO: 188235 - DNA, 27 bp, Artificial Sequence
  Description of Artificial Sequence: Synthetic oligonucleotide
gggctccattgcgggtgtcttcgtgta

SEQ ID NO: 188236 - DNA, 27 bp, Artificial Sequence
  Description of Artificial Sequence: Synthetic oligonucleotide
ggctccattgcgggtgtcttcgtgtac

SEQ ID NO: 188237 - DNA, 27 bp, Artificial Sequence
  Description of Artificial Sequence: Synthetic oligonucleotide
gctccattgcgggtgtcttcgtgtacc

SEQ ID NO: 188238 - DNA, 28 bp, Artificial Sequence
  Description of Artificial Sequence: Synthetic oligonucleotide
ctccattgcgggtgtcttcgtgtaccag

SEQ ID NO: 188239 - DNA, 28 bp, Artificial Sequence
  Description of Artificial Sequence: Synthetic oligonucleotide
tccattgcgggtgtcttcgtgtaccagc

SEQ ID NO: 188240 - DNA, 27 bp, Artificial Sequence
  Description of Artificial Sequence: Synthetic oligonucleotide
ccattgcgggtgtcttcgtgtaccagc

SEQ ID NO: 188241 - DNA, 28 bp, Artificial Sequence
  Description of Artificial Sequence: Synthetic oligonucleotide
cattgcgggtgtcttcgtgtaccagctg

SEQ ID NO: 188242 - DNA, 30 bp, Artificial Sequence
  Description of Artificial Sequence: Synthetic oligonucleotide
attgcgggtgtcttcgtgtaccagctgatg

SEQ ID NO: 188243 - DNA, 29 bp, Artificial Sequence
  Description of Artificial Sequence: Synthetic oligonucleotide
ttgcgggtgtcttcgtgtaccagctgatg

SEQ ID NO: 188244 - DNA, 28 bp, Artificial Sequence
  Description of Artificial Sequence: Synthetic oligonucleotide
tgcgggtgtcttcgtgtaccagctgatg

SEQ ID NO: 188245 - DNA, 27 bp, Artificial Sequence
  Description of Artificial Sequence: Synthetic oligonucleotide
gcgggtgtcttcgtgtaccagctgatg

SEQ ID NO: 188246 - DNA, 29 bp, Artificial Sequence
  Description of Artificial Sequence: Synthetic oligonucleotide
cgggtgtcttcgtgtaccagctgatgatc

SEQ ID NO: 188247 - DNA, 29 bp, Artificial Sequence
  Description of Artificial Sequence: Synthetic oligonucleotide
gggtgtcttcgtgtaccagctgatgatcg

SEQ ID NO: 188248 - DNA, 29 bp, Artificial Sequence
  Description of Artificial Sequence: Synthetic oligonucleotide
ggtgtcttcgtgtaccagctgatgatcgg

SEQ ID NO: 188249 - DNA, 29 bp, Artificial Sequence
  Description of Artificial Sequence: Synthetic oligonucleotide
gtgtcttcgtgtaccagctgatgatcggc

SEQ ID NO: 188250 - DNA, 30 bp, Artificial Sequence
  Description of Artificial Sequence: Synthetic oligonucleotide
tgtcttcgtgtaccagctgatgatcggctg

SEQ ID NO: 188251 - DNA, 29 bp, Artificial Sequence
  Description of Artificial Sequence: Synthetic oligonucleotide
gtcttcgtgtaccagctgatgatcggctg

SEQ ID NO: 188252 - DNA, 29 bp, Artificial Sequence
  Description of Artificial Sequence: Synthetic oligonucleotide
tcttcgtgtaccagctgatgatcggctgc

SEQ ID NO: 188253 - DNA, 28 bp, Artificial Sequence
  Description of Artificial Sequence: Synthetic oligonucleotide
cttcgtgtaccagctgatgatcggctgc

SEQ ID NO: 188254 - DNA, 28 bp, Artificial Sequence
  Description of Artificial Sequence: Synthetic oligonucleotide
ttcgtgtaccagctgatgatcggctgcc

SEQ ID NO: 188255 - DNA, 27 bp, Artificial Sequence
  Description of Artificial Sequence: Synthetic oligonucleotide
tcgtgtaccagctgatgatcggctgcc

SEQ ID NO: 188256 - DNA, 27 bp, Artificial Sequence
  Description of Artificial Sequence: Synthetic oligonucleotide
cgtgtaccagctgatgatcggctgcca

SEQ ID NO: 188257 - DNA, 27 bp, Artificial Sequence
  Description of Artificial Sequence: Synthetic oligonucleotide
gtgtaccagctgatgatcggctgccac

SEQ ID NO: 188258 - DNA, 27 bp, Artificial Sequence
  Description of Artificial Sequence: Synthetic oligonucleotide
tgtaccagctgatgatcggctgccacc

SEQ ID NO: 188259 - DNA, 27 bp, Artificial Sequence
  Description of Artificial Sequence: Synthetic oligonucleotide
gtaccagctgatgatcggctgccacct

SEQ ID NO: 188260 - DNA, 27 bp, Artificial Sequence
  Description of Artificial Sequence: Synthetic oligonucleotide
taccagctgatgatcggctgccacctg

SEQ ID NO: 188261 - DNA, 26 bp, Artificial Sequence
  Description of Artificial Sequence: Synthetic oligonucleotide
accagctgatgatcggctgccacctg

SEQ ID NO: 188262 - DNA, 25 bp, Artificial Sequence
  Description of Artificial Sequence: Synthetic oligonucleotide
ccagctgatgatcggctgccacctg

SEQ ID NO: 188263 - DNA, 26 bp, Artificial Sequence
  Description of Artificial Sequence: Synthetic oligonucleotide
cagctgatgatcggctgccacctgga

SEQ ID NO: 188264 - DNA, 26 bp, Artificial Sequence
  Description of Artificial Sequence: Synthetic oligonucleotide
agctgatgatcggctgccacctggag

SEQ ID NO: 188265 - DNA, 25 bp, Artificial Sequence
  Description of Artificial Sequence: Synthetic oligonucleotide
gctgatgatcggctgccacctggag

SEQ ID NO: 188266 - DNA, 26 bp, Artificial Sequence
  Description of Artificial Sequence: Synthetic oligonucleotide
ctgatgatcggctgccacctggagca

SEQ ID NO: 188267 - DNA, 26 bp, Artificial Sequence
  Description of Artificial Sequence: Synthetic oligonucleotide
tgatgatcggctgccacctggagcag

SEQ ID NO: 188268 - DNA, 25 bp, Artificial Sequence
  Description of Artificial Sequence: Synthetic oligonucleotide
gatgatcggctgccacctggagcag

SEQ ID NO: 188269 - DNA, 25 bp, Artificial Sequence
  Description of Artificial Sequence: Synthetic oligonucleotide
atgatcggctgccacctggagcagc

SEQ ID NO: 188270 - DNA, 24 bp, Artificial Sequence
  Description of Artificial Sequence: Synthetic oligonucleotide
tgatcggctgccacctggagcagc

SEQ ID NO: 188271 - DNA, 23 bp, Artificial Sequence
  Description of Artificial Sequence: Synthetic oligonucleotide
gatcggctgccacctggagcagc

SEQ ID NO: 188272 - DNA, 23 bp, Artificial Sequence
  Description of Artificial Sequence: Synthetic oligonucleotide
atcggctgccacctggagcagcc

SEQ ID NO: 188273 - DNA, 22 bp, Artificial Sequence
  Description of Artificial Sequence: Synthetic oligonucleotide
tcggctgccacctggagcagcc

SEQ ID NO: 188274 - DNA, 21 bp, Artificial Sequence
  Description of Artificial Sequence: Synthetic oligonucleotide
cggctgccacctggagcagcc

SEQ ID NO: 188275 - DNA, 21 bp, Artificial Sequence
  Description of Artificial Sequence: Synthetic oligonucleotide
ggctgccacctggagcagccc

SEQ ID NO: 188276 - DNA, 21 bp, Artificial Sequence
  Description of Artificial Sequence: Synthetic oligonucleotide
gctgccacctggagcagcccc

SEQ ID NO: 188277 - DNA, 22 bp, Artificial Sequence
  Description of Artificial Sequence: Synthetic oligonucleotide
ctgccacctggagcagccccca

SEQ ID NO: 188278 - DNA, 22 bp, Artificial Sequence
  Description of Artificial Sequence: Synthetic oligonucleotide
tgccacctggagcagcccccac

SEQ ID NO: 188279 - DNA, 21 bp, Artificial Sequence
  Description of Artificial Sequence: Synthetic oligonucleotide
gccacctggagcagcccccac

SEQ ID NO: 188280 - DNA, 21 bp, Artificial Sequence
  Description of Artificial Sequence: Synthetic oligonucleotide
ccacctggagcagcccccacc

SEQ ID NO: 188281 - DNA, 22 bp, Artificial Sequence
  Description of Artificial Sequence: Synthetic oligonucleotide
cacctggagcagcccccaccct

SEQ ID NO: 188282 - DNA, 22 bp, Artificial Sequence
  Description of Artificial Sequence: Synthetic oligonucleotide
acctggagcagcccccaccctc

SEQ ID NO: 188283 - DNA, 21 bp, Artificial Sequence
  Description of Artificial Sequence: Synthetic oligonucleotide
cctggagcagcccccaccctc

SEQ ID NO: 188284 - DNA, 23 bp, Artificial Sequence
  Description of Artificial Sequence: Synthetic oligonucleotide
ctggagcagcccccaccctccaa

SEQ ID NO: 188285 - DNA, 23 bp, Artificial Sequence
  Description of Artificial Sequence: Synthetic oligonucleotide
tggagcagcccccaccctccaac

SEQ ID NO: 188286 - DNA, 22 bp, Artificial Sequence
  Description of Artificial Sequence: Synthetic oligonucleotide
ggagcagcccccaccctccaac

SEQ ID NO: 188287 - DNA, 23 bp, Artificial Sequence
  Description of Artificial Sequence: Synthetic oligonucleotide
gagcagcccccaccctccaacga

SEQ ID NO: 188288 - DNA, 23 bp, Artificial Sequence
  Description of Artificial Sequence: Synthetic oligonucleotide
agcagcccccaccctccaacgag

SEQ ID NO: 188289 - DNA, 22 bp, Artificial Sequence
  Description of Artificial Sequence: Synthetic oligonucleotide
gcagcccccaccctccaacgag

SEQ ID NO: 188290 - DNA, 24 bp, Artificial Sequence
  Description of Artificial Sequence: Synthetic oligonucleotide
cagcccccaccctccaacgaggaa

SEQ ID NO: 188291 - DNA, 25 bp, Artificial Sequence
  Description of Artificial Sequence: Synthetic oligonucleotide
agcccccaccctccaacgaggaaga

SEQ ID NO: 188292 - DNA, 24 bp, Artificial Sequence
  Description of Artificial Sequence: Synthetic oligonucleotide
gcccccaccctccaacgaggaaga

SEQ ID NO: 188293 - DNA, 27 bp, Artificial Sequence
  Description of Artificial Sequence: Synthetic oligonucleotide
cccccaccctccaacgaggaagagaat

SEQ ID NO: 188294 - DNA, 27 bp, Artificial Sequence
  Description of Artificial Sequence: Synthetic oligonucleotide
ccccaccctccaacgaggaagagaatg

SEQ ID NO: 188295 - DNA, 28 bp, Artificial Sequence
  Description of Artificial Sequence: Synthetic oligonucleotide
cccaccctccaacgaggaagagaatgtg

SEQ ID NO: 188296 - DNA, 30 bp, Artificial Sequence
  Description of Artificial Sequence: Synthetic oligonucleotide
ccaccctccaacgaggaagagaatgtgaag

SEQ ID NO: 188297 - DNA, 30 bp, Artificial Sequence
  Description of Artificial Sequence: Synthetic oligonucleotide
caccctccaacgaggaagagaatgtgaagc

SEQ ID NO: 188298 - DNA, 31 bp, Artificial Sequence
  Description of Artificial Sequence: Synthetic oligonucleotide
accctccaacgaggaagagaatgtgaagctg

SEQ ID NO: 188299 - DNA, 30 bp, Artificial Sequence
  Description of Artificial Sequence: Synthetic oligonucleotide
ccctccaacgaggaagagaatgtgaagctg

SEQ ID NO: 188300 - DNA, 30 bp, Artificial Sequence
  Description of Artificial Sequence: Synthetic oligonucleotide
cctccaacgaggaagagaatgtgaagctgg

SEQ ID NO: 188301 - DNA, 30 bp, Artificial Sequence
  Description of Artificial Sequence: Synthetic oligonucleotide
ctccaacgaggaagagaatgtgaagctggc

SEQ ID NO: 188302 - DNA, 30 bp, Artificial Sequence
  Description of Artificial Sequence: Synthetic oligonucleotide
tccaacgaggaagagaatgtgaagctggcc

SEQ ID NO: 188303 - DNA, 29 bp, Artificial Sequence
  Description of Artificial Sequence: Synthetic oligonucleotide
ccaacgaggaagagaatgtgaagctggcc

SEQ ID NO: 188304 - DNA, 29 bp, Artificial Sequence
  Description of Artificial Sequence: Synthetic oligonucleotide
caacgaggaagagaatgtgaagctggccc

SEQ ID NO: 188305 - DNA, 31 bp, Artificial Sequence
  Description of Artificial Sequence: Synthetic oligonucleotide
aacgaggaagagaatgtgaagctggcccatg

SEQ ID NO: 188306 - DNA, 30 bp, Artificial Sequence
  Description of Artificial Sequence: Synthetic oligonucleotide
acgaggaagagaatgtgaagctggcccatg

SEQ ID NO: 188307 - DNA, 29 bp, Artificial Sequence
  Description of Artificial Sequence: Synthetic oligonucleotide
cgaggaagagaatgtgaagctggcccatg

SEQ ID NO: 188308 - DNA, 30 bp, Artificial Sequence
  Description of Artificial Sequence: Synthetic oligonucleotide
gaggaagagaatgtgaagctggcccatgtg

SEQ ID NO: 188309 - DNA, 32 bp, Artificial Sequence
  Description of Artificial Sequence: Synthetic oligonucleotide
aggaagagaatgtgaagctggcccatgtgaag

SEQ ID NO: 188310 - DNA, 31 bp, Artificial Sequence
  Description of Artificial Sequence: Synthetic oligonucleotide
ggaagagaatgtgaagctggcccatgtgaag

SEQ ID NO: 188311 - DNA, 31 bp, Artificial Sequence
  Description of Artificial Sequence: Synthetic oligonucleotide
gaagagaatgtgaagctggcccatgtgaagc

SEQ ID NO: 188312 - DNA, 32 bp, Artificial Sequence
  Description of Artificial Sequence: Synthetic oligonucleotide
aagagaatgtgaagctggcccatgtgaagcac

SEQ ID NO: 188313 - DNA, 31 bp, Artificial Sequence
  Description of Artificial Sequence: Synthetic oligonucleotide
agagaatgtgaagctggcccatgtgaagcac

SEQ ID NO: 188314 - DNA, 30 bp, Artificial Sequence
  Description of Artificial Sequence: Synthetic oligonucleotide
gagaatgtgaagctggcccatgtgaagcac

SEQ ID NO: 188315 - DNA, 32 bp, Artificial Sequence
  Description of Artificial Sequence: Synthetic oligonucleotide
agaatgtgaagctggcccatgtgaagcacaag

SEQ ID NO: 188316 - DNA, 31 bp, Artificial Sequence
  Description of Artificial Sequence: Synthetic oligonucleotide
gaatgtgaagctggcccatgtgaagcacaag

SEQ ID NO: 188317 - DNA, 31 bp, Artificial Sequence
  Description of Artificial Sequence: Synthetic oligonucleotide
aatgtgaagctggcccatgtgaagcacaagg

SEQ ID NO: 188318 - DNA, 30 bp, Artificial Sequence
  Description of Artificial Sequence: Synthetic oligonucleotide
atgtgaagctggcccatgtgaagcacaagg

SEQ ID NO: 188319 - DNA, 29 bp, Artificial Sequence
  Description of Artificial Sequence: Synthetic oligonucleotide
tgtgaagctggcccatgtgaagcacaagg

SEQ ID NO: 188320 - DNA, 28 bp, Artificial Sequence
  Description of Artificial Sequence: Synthetic oligonucleotide
gtgaagctggcccatgtgaagcacaagg

SEQ ID NO: 188321 - DNA, 29 bp, Artificial Sequence
  Description of Artificial Sequence: Synthetic oligonucleotide
tgaagctggcccatgtgaagcacaaggag

SEQ ID NO: 188322 - DNA, 28 bp, Artificial Sequence
  Description of Artificial Sequence: Synthetic oligonucleotide
gaagctggcccatgtgaagcacaaggag

SEQ ID NO: 188323 - DNA, 28 bp, Artificial Sequence
  Description of Artificial Sequence: Synthetic oligonucleotide
aagctggcccatgtgaagcacaaggagc

SEQ ID NO: 188324 - DNA, 27 bp, Artificial Sequence
  Description of Artificial Sequence: Synthetic oligonucleotide
agctggcccatgtgaagcacaaggagc

SEQ ID NO: 188325 - DNA, 27 bp, Artificial Sequence
  Description of Artificial Sequence: Synthetic oligonucleotide
gctggcccatgtgaagcacaaggagca

SEQ ID NO: 188326 - DNA, 27 bp, Artificial Sequence
  Description of Artificial Sequence: Synthetic oligonucleotide
ctggcccatgtgaagcacaaggagcag

SEQ ID NO: 188327 - DNA, 29 bp, Artificial Sequence
  Description of Artificial Sequence: Synthetic oligonucleotide
tggcccatgtgaagcacaaggagcagatc

SEQ ID NO: 188328 - DNA, 28 bp, Artificial Sequence
  Description of Artificial Sequence: Synthetic oligonucleotide
ggcccatgtgaagcacaaggagcagatc

SEQ ID NO: 188329 - DNA, 29 bp, Artificial Sequence
  Description of Artificial Sequence: Synthetic oligonucleotide
gcccatgtgaagcacaaggagcagatctg

SEQ ID NO: 188330 - DNA, 27 bp, Artificial Sequence
  Description of Artificial Sequence: Synthetic oligonucleotide
ggagatgctccacatccgctaccggtt

SEQ ID NO: 188331 - DNA, 27 bp, Artificial Sequence
  Description of Artificial Sequence: Synthetic oligonucleotide
gagatgctccacatccgctaccggttg

SEQ ID NO: 188332 - DNA, 27 bp, Artificial Sequence
  Description of Artificial Sequence: Synthetic oligonucleotide
agatgctccacatccgctaccggttgc

SEQ ID NO: 188333 - DNA, 27 bp, Artificial Sequence
  Description of Artificial Sequence: Synthetic oligonucleotide
gatgctccacatccgctaccggttgct

SEQ ID NO: 188334 - DNA, 27 bp, Artificial Sequence
  Description of Artificial Sequence: Synthetic oligonucleotide
atgctccacatccgctaccggttgctc

SEQ ID NO: 188335 - DNA, 26 bp, Artificial Sequence
  Description of Artificial Sequence: Synthetic oligonucleotide
tgctccacatccgctaccggttgctc

SEQ ID NO: 188336 - DNA, 25 bp, Artificial Sequence
  Description of Artificial Sequence: Synthetic oligonucleotide
gctccacatccgctaccggttgctc

SEQ ID NO: 188337 - DNA, 25 bp, Artificial Sequence
  Description of Artificial Sequence: Synthetic oligonucleotide
ctccacatccgctaccggttgctcc

SEQ ID NO: 188338 - DNA, 26 bp, Artificial Sequence
  Description of Artificial Sequence: Synthetic oligonucleotide
tccacatccgctaccggttgctccga

SEQ ID NO: 188339 - DNA, 25 bp, Artificial Sequence
  Description of Artificial Sequence: Synthetic oligonucleotide
ccacatccgctaccggttgctccga

SEQ ID NO: 188340 - DNA, 26 bp, Artificial Sequence
  Description of Artificial Sequence: Synthetic oligonucleotide
cacatccgctaccggttgctccgaca

SEQ ID NO: 188341 - DNA, 26 bp, Artificial Sequence
  Description of Artificial Sequence: Synthetic oligonucleotide
acatccgctaccggttgctccgacag

SEQ ID NO: 188342 - DNA, 25 bp, Artificial Sequence
  Description of Artificial Sequence: Synthetic oligonucleotide
catccgctaccggttgctccgacag

SEQ ID NO: 188343 - DNA, 25 bp, Artificial Sequence
  Description of Artificial Sequence: Synthetic oligonucleotide
atccgctaccggttgctccgacagg

SEQ ID NO: 188344 - DNA, 24 bp, Artificial Sequence
  Description of Artificial Sequence: Synthetic oligonucleotide
tccgctaccggttgctccgacagg

SEQ ID NO: 188345 - DNA, 23 bp, Artificial Sequence
  Description of Artificial Sequence: Synthetic oligonucleotide
ccgctaccggttgctccgacagg

SEQ ID NO: 188346 - DNA, 23 bp, Artificial Sequence
  Description of Artificial Sequence: Synthetic oligonucleotide
cgctaccggttgctccgacaggc

SEQ ID NO: 188347 - DNA, 23 bp, Artificial Sequence
  Description of Artificial Sequence: Synthetic oligonucleotide
gctaccggttgctccgacaggcg

SEQ ID NO: 188348 - DNA, 24 bp, Artificial Sequence
  Description of Artificial Sequence: Synthetic oligonucleotide
ctaccggttgctccgacaggcgct

SEQ ID NO: 188349 - DNA, 24 bp, Artificial Sequence
  Description of Artificial Sequence: Synthetic oligonucleotide
taccggttgctccgacaggcgctg

SEQ ID NO: 188350 - DNA, 23 bp, Artificial Sequence
  Description of Artificial Sequence: Synthetic oligonucleotide
accggttgctccgacaggcgctg

SEQ ID NO: 188351 - DNA, 22 bp, Artificial Sequence
  Description of Artificial Sequence: Synthetic oligonucleotide
ccggttgctccgacaggcgctg

SEQ ID NO: 188352 - DNA, 22 bp, Artificial Sequence
  Description of Artificial Sequence: Synthetic oligonucleotide
cggttgctccgacaggcgctgg

SEQ ID NO: 188353 - DNA, 22 bp, Artificial Sequence
  Description of Artificial Sequence: Synthetic oligonucleotide
ggttgctccgacaggcgctggc

SEQ ID NO: 188354 - DNA, 22 bp, Artificial Sequence
  Description of Artificial Sequence: Synthetic oligonucleotide
gttgctccgacaggcgctggcc

SEQ ID NO: 188355 - DNA, 23 bp, Artificial Sequence
  Description of Artificial Sequence: Synthetic oligonucleotide
ttgctccgacaggcgctggccga

SEQ ID NO: 188356 - DNA, 24 bp, Artificial Sequence
  Description of Artificial Sequence: Synthetic oligonucleotide
gagtgcctggggaccctcatcctc

SEQ ID NO: 188357 - DNA, 25 bp, Artificial Sequence
  Description of Artificial Sequence: Synthetic oligonucleotide
agtgcctggggaccctcatcctcgt

SEQ ID NO: 188358 - DNA, 24 bp, Artificial Sequence
  Description of Artificial Sequence: Synthetic oligonucleotide
gtgcctggggaccctcatcctcgt

SEQ ID NO: 188359 - DNA, 26 bp, Artificial Sequence
  Description of Artificial Sequence: Synthetic oligonucleotide
tgcctggggaccctcatcctcgtgat

SEQ ID NO: 188360 - DNA, 25 bp, Artificial Sequence
  Description of Artificial Sequence: Synthetic oligonucleotide
gcctggggaccctcatcctcgtgat

SEQ ID NO: 188361 - DNA, 27 bp, Artificial Sequence
  Description of Artificial Sequence: Synthetic oligonucleotide
cctggggaccctcatcctcgtgatgtt

SEQ ID NO: 188362 - DNA, 28 bp, Artificial Sequence
  Description of Artificial Sequence: Synthetic oligonucleotide
ctggggaccctcatcctcgtgatgtttg

SEQ ID NO: 188363 - DNA, 28 bp, Artificial Sequence
  Description of Artificial Sequence: Synthetic oligonucleotide
tggggaccctcatcctcgtgatgtttgg

SEQ ID NO: 188364 - DNA, 27 bp, Artificial Sequence
  Description of Artificial Sequence: Synthetic oligonucleotide
ggggaccctcatcctcgtgatgtttgg

SEQ ID NO: 188365 - DNA, 27 bp, Artificial Sequence
  Description of Artificial Sequence: Synthetic oligonucleotide
gggaccctcatcctcgtgatgtttggc

SEQ ID NO: 188366 - DNA, 28 bp, Artificial Sequence
  Description of Artificial Sequence: Synthetic oligonucleotide
ggaccctcatcctcgtgatgtttggctg

SEQ ID NO: 188367 - DNA, 29 bp, Artificial Sequence
  Description of Artificial Sequence: Synthetic oligonucleotide
gaccctcatcctcgtgatgtttggctgtg

SEQ ID NO: 188368 - DNA, 29 bp, Artificial Sequence
  Description of Artificial Sequence: Synthetic oligonucleotide
accctcatcctcgtgatgtttggctgtgg

SEQ ID NO: 188369 - DNA, 28 bp, Artificial Sequence
  Description of Artificial Sequence: Synthetic oligonucleotide
ccctcatcctcgtgatgtttggctgtgg

SEQ ID NO: 188370 - DNA, 28 bp, Artificial Sequence
  Description of Artificial Sequence: Synthetic oligonucleotide
cctcatcctcgtgatgtttggctgtggc

SEQ ID NO: 188371 - DNA, 29 bp, Artificial Sequence
  Description of Artificial Sequence: Synthetic oligonucleotide
ctcatcctcgtgatgtttggctgtggctc

SEQ ID NO: 188372 - DNA, 29 bp, Artificial Sequence
  Description of Artificial Sequence: Synthetic oligonucleotide
tcatcctcgtgatgtttggctgtggctcc

SEQ ID NO: 188373 - DNA, 28 bp, Artificial Sequence
  Description of Artificial Sequence: Synthetic oligonucleotide
catcctcgtgatgtttggctgtggctcc

SEQ ID NO: 188374 - DNA, 28 bp, Artificial Sequence
  Description of Artificial Sequence: Synthetic oligonucleotide
atcctcgtgatgtttggctgtggctccg

SEQ ID NO: 188375 - DNA, 27 bp, Artificial Sequence
  Description of Artificial Sequence: Synthetic oligonucleotide
tcctcgtgatgtttggctgtggctccg

SEQ ID NO: 188376 - DNA, 27 bp, Artificial Sequence
  Description of Artificial Sequence: Synthetic oligonucleotide
cctcgtgatgtttggctgtggctccgt

SEQ ID NO: 188377 - DNA, 27 bp, Artificial Sequence
  Description of Artificial Sequence: Synthetic oligonucleotide
ctcgtgatgtttggctgtggctccgtg

SEQ ID NO: 188378 - DNA, 27 bp, Artificial Sequence
  Description of Artificial Sequence: Synthetic oligonucleotide
tcgtgatgtttggctgtggctccgtgg

SEQ ID NO: 188379 - DNA, 26 bp, Artificial Sequence
  Description of Artificial Sequence: Synthetic oligonucleotide
cgtgatgtttggctgtggctccgtgg

SEQ ID NO: 188380 - DNA, 42 bp, Artificial Sequence
  Description of Artificial Sequence: Synthetic oligonucleotide
gaatagtttttgggctgtattatgatgcaatctggcactttg

SEQ ID NO: 188381 - DNA, 42 bp, Artificial Sequence
  Description of Artificial Sequence: Synthetic oligonucleotide
aatagtttttgggctgtattatgatgcaatctggcactttgc

SEQ ID NO: 188382 - DNA, 41 bp, Artificial Sequence
  Description of Artificial Sequence: Synthetic oligonucleotide
atagtttttgggctgtattatgatgcaatctggcactttgc

SEQ ID NO: 188383 - DNA, 40 bp, Artificial Sequence
  Description of Artificial Sequence: Synthetic oligonucleotide
tagtttttgggctgtattatgatgcaatctggcactttgc

SEQ ID NO: 188384 - DNA, 39 bp, Artificial Sequence
  Description of Artificial Sequence: Synthetic oligonucleotide
agtttttgggctgtattatgatgcaatctggcactttgc

SEQ ID NO: 188385 - DNA, 38 bp, Artificial Sequence
  Description of Artificial Sequence: Synthetic oligonucleotide
gtttttgggctgtattatgatgcaatctggcactttgc

SEQ ID NO: 188386 - DNA, 38 bp, Artificial Sequence
  Description of Artificial Sequence: Synthetic oligonucleotide
tttttgggctgtattatgatgcaatctggcactttgcc

SEQ ID NO: 188387 - DNA, 37 bp, Artificial Sequence
  Description of Artificial Sequence: Synthetic oligonucleotide
ttttgggctgtattatgatgcaatctggcactttgcc

SEQ ID NO: 188388 - DNA, 36 bp, Artificial Sequence
  Description of Artificial Sequence: Synthetic oligonucleotide
tttgggctgtattatgatgcaatctggcactttgcc

SEQ ID NO: 188389 - DNA, 35 bp, Artificial Sequence
  Description of Artificial Sequence: Synthetic oligonucleotide
ttgggctgtattatgatgcaatctggcactttgcc

SEQ ID NO: 188390 - DNA, 34 bp, Artificial Sequence
  Description of Artificial Sequence: Synthetic oligonucleotide
tgggctgtattatgatgcaatctggcactttgcc

SEQ ID NO: 188391 - DNA, 33 bp, Artificial Sequence
  Description of Artificial Sequence: Synthetic oligonucleotide
gggctgtattatgatgcaatctggcactttgcc

SEQ ID NO: 188392 - DNA, 33 bp, Artificial Sequence
  Description of Artificial Sequence: Synthetic oligonucleotide
ggctgtattatgatgcaatctggcactttgccg

SEQ ID NO: 188393 - DNA, 34 bp, Artificial Sequence
  Description of Artificial Sequence: Synthetic oligonucleotide
gctgtattatgatgcaatctggcactttgccgac

SEQ ID NO: 188394 - DNA, 36 bp, Artificial Sequence
  Description of Artificial Sequence: Synthetic oligonucleotide
ctgtattatgatgcaatctggcactttgccgacaac

SEQ ID NO: 188395 - DNA, 36 bp, Artificial Sequence
  Description of Artificial Sequence: Synthetic oligonucleotide
tgtattatgatgcaatctggcactttgccgacaacc

SEQ ID NO: 188396 - DNA, 35 bp, Artificial Sequence
  Description of Artificial Sequence: Synthetic oligonucleotide
gtattatgatgcaatctggcactttgccgacaacc

SEQ ID NO: 188397 - DNA, 36 bp, Artificial Sequence
  Description of Artificial Sequence: Synthetic oligonucleotide
tattatgatgcaatctggcactttgccgacaaccag

SEQ ID NO: 188398 - DNA, 35 bp, Artificial Sequence
  Description of Artificial Sequence: Synthetic oligonucleotide
attatgatgcaatctggcactttgccgacaaccag

SEQ ID NO: 188399 - DNA, 34 bp, Artificial Sequence
  Description of Artificial Sequence: Synthetic oligonucleotide
ttatgatgcaatctggcactttgccgacaaccag

SEQ ID NO: 188400 - DNA, 33 bp, Artificial Sequence
  Description of Artificial Sequence: Synthetic oligonucleotide
tatgatgcaatctggcactttgccgacaaccag

SEQ ID NO: 188401 - DNA, 32 bp, Artificial Sequence
  Description of Artificial Sequence: Synthetic oligonucleotide
atgatgcaatctggcactttgccgacaaccag

SEQ ID NO: 188402 - DNA, 31 bp, Artificial Sequence
  Description of Artificial Sequence: Synthetic oligonucleotide
tgatgcaatctggcactttgccgacaaccag

SEQ ID NO: 188403 - DNA, 30 bp, Artificial Sequence
  Description of Artificial Sequence: Synthetic oligonucleotide
gatgcaatctggcactttgccgacaaccag

SEQ ID NO: 188404 - DNA, 30 bp, Artificial Sequence
  Description of Artificial Sequence: Synthetic oligonucleotide
atgcaatctggcactttgccgacaaccagc

SEQ ID NO: 188405 - DNA, 29 bp, Artificial Sequence
  Description of Artificial Sequence: Synthetic oligonucleotide
tgcaatctggcactttgccgacaaccagc

SEQ ID NO: 188406 - DNA, 28 bp, Artificial Sequence
  Description of Artificial Sequence: Synthetic oligonucleotide
gcaatctggcactttgccgacaaccagc

SEQ ID NO: 188407 - DNA, 33 bp, Artificial Sequence
  Description of Artificial Sequence: Synthetic oligonucleotide
caatctggcactttgccgacaaccagctttttg

SEQ ID NO: 188408 - DNA, 36 bp, Artificial Sequence
  Description of Artificial Sequence: Synthetic oligonucleotide
aatctggcactttgccgacaaccagctttttgtttc

SEQ ID NO: 188409 - DNA, 35 bp, Artificial Sequence
  Description of Artificial Sequence: Synthetic oligonucleotide
atctggcactttgccgacaaccagctttttgtttc

SEQ ID NO: 188410 - DNA, 34 bp, Artificial Sequence
  Description of Artificial Sequence: Synthetic oligonucleotide
tctggcactttgccgacaaccagctttttgtttc

SEQ ID NO: 188411 - DNA, 33 bp, Artificial Sequence
  Description of Artificial Sequence: Synthetic oligonucleotide
ctggcactttgccgacaaccagctttttgtttc

SEQ ID NO: 188412 - DNA, 33 bp, Artificial Sequence
  Description of Artificial Sequence: Synthetic oligonucleotide
tggcactttgccgacaaccagctttttgtttcg

SEQ ID NO: 188413 - DNA, 32 bp, Artificial Sequence
  Description of Artificial Sequence: Synthetic oligonucleotide
ggcactttgccgacaaccagctttttgtttcg

SEQ ID NO: 188414 - DNA, 32 bp, Artificial Sequence
  Description of Artificial Sequence: Synthetic oligonucleotide
gcactttgccgacaaccagctttttgtttcgg

SEQ ID NO: 188415 - DNA, 32 bp, Artificial Sequence
  Description of Artificial Sequence: Synthetic oligonucleotide
cactttgccgacaaccagctttttgtttcggg

SEQ ID NO: 188416 - DNA, 32 bp, Artificial Sequence
  Description of Artificial Sequence: Synthetic oligonucleotide
actttgccgacaaccagctttttgtttcgggc

SEQ ID NO: 188417 - DNA, 31 bp, Artificial Sequence
  Description of Artificial Sequence: Synthetic oligonucleotide
ctttgccgacaaccagctttttgtttcgggc

SEQ ID NO: 188418 - DNA, 31 bp, Artificial Sequence
  Description of Artificial Sequence: Synthetic oligonucleotide
tttgccgacaaccagctttttgtttcgggcc

SEQ ID NO: 188419 - DNA, 30 bp, Artificial Sequence
  Description of Artificial Sequence: Synthetic oligonucleotide
ttgccgacaaccagctttttgtttcgggcc

SEQ ID NO: 188420 - DNA, 29 bp, Artificial Sequence
  Description of Artificial Sequence: Synthetic oligonucleotide
tgccgacaaccagctttttgtttcgggcc

SEQ ID NO: 188421 - DNA, 30 bp, Artificial Sequence
  Description of Artificial Sequence: Synthetic oligonucleotide
gtgtgtgtgctggccattgttgacccttac

SEQ ID NO: 188422 - DNA, 32 bp, Artificial Sequence
  Description of Artificial Sequence: Synthetic oligonucleotide
tgtgtgtgctggccattgttgacccttacaac

SEQ ID NO: 188423 - DNA, 31 bp, Artificial Sequence
  Description of Artificial Sequence: Synthetic oligonucleotide
gtgtgtgctggccattgttgacccttacaac

SEQ ID NO: 188424 - DNA, 33 bp, Artificial Sequence
  Description of Artificial Sequence: Synthetic oligonucleotide
tgtgtgctggccattgttgacccttacaacaac

SEQ ID NO: 188425 - DNA, 32 bp, Artificial Sequence
  Description of Artificial Sequence: Synthetic oligonucleotide
gtgtgctggccattgttgacccttacaacaac

SEQ ID NO: 188426 - DNA, 32 bp, Artificial Sequence
  Description of Artificial Sequence: Synthetic oligonucleotide
tgtgctggccattgttgacccttacaacaacc

SEQ ID NO: 188427 - DNA, 31 bp, Artificial Sequence
  Description of Artificial Sequence: Synthetic oligonucleotide
gtgctggccattgttgacccttacaacaacc

SEQ ID NO: 188428 - DNA, 31 bp, Artificial Sequence
  Description of Artificial Sequence: Synthetic oligonucleotide
tgctggccattgttgacccttacaacaaccc

SEQ ID NO: 188429 - DNA, 30 bp, Artificial Sequence
  Description of Artificial Sequence: Synthetic oligonucleotide
gctggccattgttgacccttacaacaaccc

SEQ ID NO: 188430 - DNA, 30 bp, Artificial Sequence
  Description of Artificial Sequence: Synthetic oligonucleotide
ctggccattgttgacccttacaacaacccc

SEQ ID NO: 188431 - DNA, 30 bp, Artificial Sequence
  Description of Artificial Sequence: Synthetic oligonucleotide
tggccattgttgacccttacaacaaccccg

SEQ ID NO: 188432 - DNA, 29 bp, Artificial Sequence
  Description of Artificial Sequence: Synthetic oligonucleotide
ggccattgttgacccttacaacaaccccg

SEQ ID NO: 188433 - DNA, 30 bp, Artificial Sequence
  Description of Artificial Sequence: Synthetic oligonucleotide
gccattgttgacccttacaacaaccccgtc

SEQ ID NO: 188434 - DNA, 30 bp, Artificial Sequence
  Description of Artificial Sequence: Synthetic oligonucleotide
ccattgttgacccttacaacaaccccgtcc

SEQ ID NO: 188435 - DNA, 30 bp, Artificial Sequence
  Description of Artificial Sequence: Synthetic oligonucleotide
cattgttgacccttacaacaaccccgtccc

SEQ ID NO: 188436 - DNA, 30 bp, Artificial Sequence
  Description of Artificial Sequence: Synthetic oligonucleotide
attgttgacccttacaacaaccccgtcccc

SEQ ID NO: 188437 - DNA, 29 bp, Artificial Sequence
  Description of Artificial Sequence: Synthetic oligonucleotide
ttgttgacccttacaacaaccccgtcccc

SEQ ID NO: 188438 - DNA, 28 bp, Artificial Sequence
  Description of Artificial Sequence: Synthetic oligonucleotide
tgttgacccttacaacaaccccgtcccc

SEQ ID NO: 188439 - DNA, 27 bp, Artificial Sequence
  Description of Artificial Sequence: Synthetic oligonucleotide
gttgacccttacaacaaccccgtcccc

SEQ ID NO: 188440 - DNA, 27 bp, Artificial Sequence
  Description of Artificial Sequence: Synthetic oligonucleotide
ttgacccttacaacaaccccgtccccc

SEQ ID NO: 188441 - DNA, 26 bp, Artificial Sequence
  Description of Artificial Sequence: Synthetic oligonucleotide
tgacccttacaacaaccccgtccccc

SEQ ID NO: 188442 - DNA, 25 bp, Artificial Sequence
  Description of Artificial Sequence: Synthetic oligonucleotide
gacccttacaacaaccccgtccccc

SEQ ID NO: 188443 - DNA, 26 bp, Artificial Sequence
  Description of Artificial Sequence: Synthetic oligonucleotide
acccttacaacaaccccgtcccccga

SEQ ID NO: 188444 - DNA, 25 bp, Artificial Sequence
  Description of Artificial Sequence: Synthetic oligonucleotide
cccttacaacaaccccgtcccccga

SEQ ID NO: 188445 - DNA, 25 bp, Artificial Sequence
  Description of Artificial Sequence: Synthetic oligonucleotide
ccttacaacaaccccgtcccccgag

SEQ ID NO: 188446 - DNA, 25 bp, Artificial Sequence
  Description of Artificial Sequence: Synthetic oligonucleotide
cttacaacaaccccgtcccccgagg

SEQ ID NO: 188447 - DNA, 25 bp, Artificial Sequence
  Description of Artificial Sequence: Synthetic oligonucleotide
ttacaacaaccccgtcccccgaggc

SEQ ID NO: 188448 - DNA, 30 bp, Artificial Sequence
  Description of Artificial Sequence: Synthetic oligonucleotide
gcccatgtgaagcacaaggagcagatctag

SEQ ID NO: 188449 - DNA, 29 bp, Artificial Sequence
  Description of Artificial Sequence: Synthetic oligonucleotide
tggcacttcgccgacaaccagctttttgc

SEQ ID NO: 188450 - DNA, 28 bp, Artificial Sequence
  Description of Artificial Sequence: Synthetic oligonucleotide
ggcacttcgccgacaaccagctttttgc

SEQ ID NO: 188451 - DNA, 30 bp, Artificial Sequence
  Description of Artificial Sequence: Synthetic oligonucleotide
gcacttcgccgacaaccagctttttgcttc

SEQ ID NO: 188452 - DNA, 30 bp, Artificial Sequence
  Description of Artificial Sequence: Synthetic oligonucleotide
cacttcgccgacaaccagctttttgcttcg

SEQ ID NO: 188453 - DNA, 30 bp, Artificial Sequence
  Description of Artificial Sequence: Synthetic oligonucleotide
acttcgccgacaaccagctttttgcttcgg

SEQ ID NO: 188454 - DNA, 29 bp, Artificial Sequence
  Description of Artificial Sequence: Synthetic oligonucleotide
cttcgccgacaaccagctttttgcttcgg

SEQ ID NO: 188455 - DNA, 29 bp, Artificial Sequence
  Description of Artificial Sequence: Synthetic oligonucleotide
ttcgccgacaaccagctttttgcttcggg

SEQ ID NO: 188456 - DNA, 28 bp, Artificial Sequence
  Description of Artificial Sequence: Synthetic oligonucleotide
tcgccgacaaccagctttttgcttcggg

SEQ ID NO: 188457 - DNA, 27 bp, Artificial Sequence
  Description of Artificial Sequence: Synthetic oligonucleotide
cgccgacaaccagctttttgcttcggg

SEQ ID NO: 188458 - DNA, 27 bp, Artificial Sequence
  Description of Artificial Sequence: Synthetic oligonucleotide
gccgacaaccagctttttgcttcgggc

SEQ ID NO: 188459 - DNA, 27 bp, Artificial Sequence
  Description of Artificial Sequence: Synthetic oligonucleotide
ccgacaaccagctttttgcttcgggcc

SEQ ID NO: 188460 - DNA, 27 bp, Artificial Sequence
  Description of Artificial Sequence: Synthetic oligonucleotide
cgacaaccagctttttgcttcgggccc

SEQ ID NO: 188461 - DNA, 27 bp, Artificial Sequence
  Description of Artificial Sequence: Synthetic oligonucleotide
gacaaccagctttttgcttcgggcccc

SEQ ID NO: 188462 - DNA, 30 bp, Artificial Sequence
  Description of Artificial Sequence: Synthetic oligonucleotide
acaaccagctttttgcttcgggccccaatg

SEQ ID NO: 188463 - DNA, 29 bp, Artificial Sequence
  Description of Artificial Sequence: Synthetic oligonucleotide
caaccagctttttgcttcgggccccaatg

SEQ ID NO: 188464 - DNA, 29 bp, Artificial Sequence
  Description of Artificial Sequence: Synthetic oligonucleotide
aaccagctttttgcttcgggccccaatgg

SEQ ID NO: 188465 - DNA, 28 bp, Artificial Sequence
  Description of Artificial Sequence: Synthetic oligonucleotide
accagctttttgcttcgggccccaatgg

SEQ ID NO: 188466 - DNA, 27 bp, Artificial Sequence
  Description of Artificial Sequence: Synthetic oligonucleotide
ccagctttttgcttcgggccccaatgg

SEQ ID NO: 188467 - DNA, 27 bp, Artificial Sequence
  Description of Artificial Sequence: Synthetic oligonucleotide
cagctttttgcttcgggccccaatggc

SEQ ID NO: 188468 - DNA, 28 bp, Artificial Sequence
  Description of Artificial Sequence: Synthetic oligonucleotide
agctttttgcttcgggccccaatggcac

SEQ ID NO: 188469 - DNA, 27 bp, Artificial Sequence
  Description of Artificial Sequence: Synthetic oligonucleotide
gctttttgcttcgggccccaatggcac

SEQ ID NO: 188470 - DNA, 28 bp, Artificial Sequence
  Description of Artificial Sequence: Synthetic oligonucleotide
ctttttgcttcgggccccaatggcacag

SEQ ID NO: 188471 - DNA, 28 bp, Artificial Sequence
  Description of Artificial Sequence: Synthetic oligonucleotide
tttttgcttcgggccccaatggcacagc

SEQ ID NO: 188472 - DNA, 27 bp, Artificial Sequence
  Description of Artificial Sequence: Synthetic oligonucleotide
ttttgcttcgggccccaatggcacagc

SEQ ID NO: 188473 - DNA, 26 bp, Artificial Sequence
  Description of Artificial Sequence: Synthetic oligonucleotide
tttgcttcgggccccaatggcacagc

SEQ ID NO: 188474 - DNA, 25 bp, Artificial Sequence
  Description of Artificial Sequence: Synthetic oligonucleotide
ttgcttcgggccccaatggcacagc

SEQ ID NO: 188475 - DNA, 24 bp, Artificial Sequence
  Description of Artificial Sequence: Synthetic oligonucleotide
tgcttcgggccccaatggcacagc

SEQ ID NO: 188476 - DNA, 23 bp, Artificial Sequence
  Description of Artificial Sequence: Synthetic oligonucleotide
gcttcgggccccaatggcacagc

SEQ ID NO: 188477 - DNA, 23 bp, Artificial Sequence
  Description of Artificial Sequence: Synthetic oligonucleotide
cttcgggccccaatggcacagcc

SEQ ID NO: 188478 - DNA, 56 bp, Artificial Sequence
  Description of Artificial Sequence: Synthetic oligonucleotide
atgtatggaaaaataatctttgtattactattgtcagaaattgtgagcatatcagc

SEQ ID NO: 188479 - DNA, 55 bp, Artificial Sequence
  Description of Artificial Sequence: Synthetic oligonucleotide
tgtatggaaaaataatctttgtattactattgtcagaaattgtgagcatatcagc

SEQ ID NO: 188480 - DNA, 54 bp, Artificial Sequence
  Description of Artificial Sequence: Synthetic oligonucleotide
gtatggaaaaataatctttgtattactattgtcagaaattgtgagcatatcagc

SEQ ID NO: 188481 - DNA, 59 bp, Artificial Sequence
  Description of Artificial Sequence: Synthetic oligonucleotide
tatggaaaaataatctttgtattactattgtcagaaattgtgagcatatcagcattaag

SEQ ID NO: 188482 - DNA, 58 bp, Artificial Sequence
  Description of Artificial Sequence: Synthetic oligonucleotide
atggaaaaataatctttgtattactattgtcagaaattgtgagcatatcagcattaag

SEQ ID NO: 188483 - DNA, 57 bp, Artificial Sequence
  Description of Artificial Sequence: Synthetic oligonucleotide
tggaaaaataatctttgtattactattgtcagaaattgtgagcatatcagcattaag

SEQ ID NO: 188484 - DNA, 56 bp, Artificial Sequence
  Description of Artificial Sequence: Synthetic oligonucleotide
ggaaaaataatctttgtattactattgtcagaaattgtgagcatatcagcattaag

SEQ ID NO: 188485 - DNA, 58 bp, Artificial Sequence
  Description of Artificial Sequence: Synthetic oligonucleotide
gaaaaataatctttgtattactattgtcagaaattgtgagcatatcagcattaagtac

SEQ ID NO: 188486 - DNA, 58 bp, Artificial Sequence
  Description of Artificial Sequence: Synthetic oligonucleotide
aaaaataatctttgtattactattgtcagaaattgtgagcatatcagcattaagtacc

SEQ ID NO: 188487 - DNA, 57 bp, Artificial Sequence
  Description of Artificial Sequence: Synthetic oligonucleotide
aaaataatctttgtattactattgtcagaaattgtgagcatatcagcattaagtacc

SEQ ID NO: 188488 - DNA, 56 bp, Artificial Sequence
  Description of Artificial Sequence: Synthetic oligonucleotide
aaataatctttgtattactattgtcagaaattgtgagcatatcagcattaagtacc

SEQ ID NO: 188489 - DNA, 55 bp, Artificial Sequence
  Description of Artificial Sequence: Synthetic oligonucleotide
aataatctttgtattactattgtcagaaattgtgagcatatcagcattaagtacc

SEQ ID NO: 188490 - DNA, 54 bp, Artificial Sequence
  Description of Artificial Sequence: Synthetic oligonucleotide
ataatctttgtattactattgtcagaaattgtgagcatatcagcattaagtacc

SEQ ID NO: 188491 - DNA, 53 bp, Artificial Sequence
  Description of Artificial Sequence: Synthetic oligonucleotide
taatctttgtattactattgtcagaaattgtgagcatatcagcattaagtacc

SEQ ID NO: 188492 - DNA, 52 bp, Artificial Sequence
  Description of Artificial Sequence: Synthetic oligonucleotide
aatctttgtattactattgtcagaaattgtgagcatatcagcattaagtacc

SEQ ID NO: 188493 - DNA, 51 bp, Artificial Sequence
  Description of Artificial Sequence: Synthetic oligonucleotide
atctttgtattactattgtcagaaattgtgagcatatcagcattaagtacc

SEQ ID NO: 188494 - DNA, 50 bp, Artificial Sequence
  Description of Artificial Sequence: Synthetic oligonucleotide
tctttgtattactattgtcagaaattgtgagcatatcagcattaagtacc

SEQ ID NO: 188495 - DNA, 49 bp, Artificial Sequence
  Description of Artificial Sequence: Synthetic oligonucleotide
ctttgtattactattgtcagaaattgtgagcatatcagcattaagtacc

SEQ ID NO: 188496 - DNA, 50 bp, Artificial Sequence
  Description of Artificial Sequence: Synthetic oligonucleotide
tttgtattactattgtcagaaattgtgagcatatcagcattaagtaccac

SEQ ID NO: 188497 - DNA, 49 bp, Artificial Sequence
  Description of Artificial Sequence: Synthetic oligonucleotide
ttgtattactattgtcagaaattgtgagcatatcagcattaagtaccac

SEQ ID NO: 188498 - DNA, 48 bp, Artificial Sequence
  Description of Artificial Sequence: Synthetic oligonucleotide
tgtattactattgtcagaaattgtgagcatatcagcattaagtaccac

SEQ ID NO: 188499 - DNA, 47 bp, Artificial Sequence
  Description of Artificial Sequence: Synthetic oligonucleotide
gtattactattgtcagaaattgtgagcatatcagcattaagtaccac

SEQ ID NO: 188500 - DNA, 48 bp, Artificial Sequence
  Description of Artificial Sequence: Synthetic oligonucleotide
tattactattgtcagaaattgtgagcatatcagcattaagtaccactg

SEQ ID NO: 188501 - DNA, 47 bp, Artificial Sequence
  Description of Artificial Sequence: Synthetic oligonucleotide
attactattgtcagaaattgtgagcatatcagcattaagtaccactg

SEQ ID NO: 188502 - DNA, 46 bp, Artificial Sequence
  Description of Artificial Sequence: Synthetic oligonucleotide
ttactattgtcagaaattgtgagcatatcagcattaagtaccactg

SEQ ID NO: 188503 - DNA, 45 bp, Artificial Sequence
  Description of Artificial Sequence: Synthetic oligonucleotide
tactattgtcagaaattgtgagcatatcagcattaagtaccactg

SEQ ID NO: 188504 - DNA, 44 bp, Artificial Sequence
  Description of Artificial Sequence: Synthetic oligonucleotide
actattgtcagaaattgtgagcatatcagcattaagtaccactg

SEQ ID NO: 188505 - DNA, 43 bp, Artificial Sequence
  Description of Artificial Sequence: Synthetic oligonucleotide
ctattgtcagaaattgtgagcatatcagcattaagtaccactg

SEQ ID NO: 188506 - DNA, 44 bp, Artificial Sequence
  Description of Artificial Sequence: Synthetic oligonucleotide
tattgtcagaaattgtgagcatatcagcattaagtaccactgag

SEQ ID NO: 188507 - DNA, 43 bp, Artificial Sequence
  Description of Artificial Sequence: Synthetic oligonucleotide
attgtcagaaattgtgagcatatcagcattaagtaccactgag

SEQ ID NO: 188508 - DNA, 42 bp, Artificial Sequence
  Description of Artificial Sequence: Synthetic oligonucleotide
ttgtcagaaattgtgagcatatcagcattaagtaccactgag

SEQ ID NO: 188509 - DNA, 41 bp, Artificial Sequence
  Description of Artificial Sequence: Synthetic oligonucleotide
tgtcagaaattgtgagcatatcagcattaagtaccactgag

SEQ ID NO: 188510 - DNA, 40 bp, Artificial Sequence
  Description of Artificial Sequence: Synthetic oligonucleotide
gtcagaaattgtgagcatatcagcattaagtaccactgag

SEQ ID NO: 188511 - DNA, 40 bp, Artificial Sequence
  Description of Artificial Sequence: Synthetic oligonucleotide
tcagaaattgtgagcatatcagcattaagtaccactgagg

SEQ ID NO: 188512 - DNA, 39 bp, Artificial Sequence
  Description of Artificial Sequence: Synthetic oligonucleotide
cagaaattgtgagcatatcagcattaagtaccactgagg

SEQ ID NO: 188513 - DNA, 40 bp, Artificial Sequence
  Description of Artificial Sequence: Synthetic oligonucleotide
agaaattgtgagcatatcagcattaagtaccactgaggtg

SEQ ID NO: 188514 - DNA, 39 bp, Artificial Sequence
  Description of Artificial Sequence: Synthetic oligonucleotide
gaaattgtgagcatatcagcattaagtaccactgaggtg

SEQ ID NO: 188515 - DNA, 39 bp, Artificial Sequence
  Description of Artificial Sequence: Synthetic oligonucleotide
aaattgtgagcatatcagcattaagtaccactgaggtgg

SEQ ID NO: 188516 - DNA, 38 bp, Artificial Sequence
  Description of Artificial Sequence: Synthetic oligonucleotide
aattgtgagcatatcagcattaagtaccactgaggtgg

SEQ ID NO: 188517 - DNA, 37 bp, Artificial Sequence
  Description of Artificial Sequence: Synthetic oligonucleotide
attgtgagcatatcagcattaagtaccactgaggtgg

SEQ ID NO: 188518 - DNA, 36 bp, Artificial Sequence
  Description of Artificial Sequence: Synthetic oligonucleotide
ttgtgagcatatcagcattaagtaccactgaggtgg

SEQ ID NO: 188519 - DNA, 35 bp, Artificial Sequence
  Description of Artificial Sequence: Synthetic oligonucleotide
tgtgagcatatcagcattaagtaccactgaggtgg

SEQ ID NO: 188520 - DNA, 34 bp, Artificial Sequence
  Description of Artificial Sequence: Synthetic oligonucleotide
gtgagcatatcagcattaagtaccactgaggtgg

SEQ ID NO: 188521 - DNA, 34 bp, Artificial Sequence
  Description of Artificial Sequence: Synthetic oligonucleotide
tgagcatatcagcattaagtaccactgaggtggc

SEQ ID NO: 188522 - DNA, 33 bp, Artificial Sequence
  Description of Artificial Sequence: Synthetic oligonucleotide
gagcatatcagcattaagtaccactgaggtggc

SEQ ID NO: 188523 - DNA, 36 bp, Artificial Sequence
  Description of Artificial Sequence: Synthetic oligonucleotide
agcatatcagcattaagtaccactgaggtggcaatg

SEQ ID NO: 188524 - DNA, 35 bp, Artificial Sequence
  Description of Artificial Sequence: Synthetic oligonucleotide
gcatatcagcattaagtaccactgaggtggcaatg

SEQ ID NO: 188525 - DNA, 35 bp, Artificial Sequence
  Description of Artificial Sequence: Synthetic oligonucleotide
catatcagcattaagtaccactgaggtggcaatgc

SEQ ID NO: 188526 - DNA, 36 bp, Artificial Sequence
  Description of Artificial Sequence: Synthetic oligonucleotide
atatcagcattaagtaccactgaggtggcaatgcac

SEQ ID NO: 188527 - DNA, 35 bp, Artificial Sequence
  Description of Artificial Sequence: Synthetic oligonucleotide
tatcagcattaagtaccactgaggtggcaatgcac

SEQ ID NO: 188528 - DNA, 34 bp, Artificial Sequence
  Description of Artificial Sequence: Synthetic oligonucleotide
atcagcattaagtaccactgaggtggcaatgcac

SEQ ID NO: 188529 - DNA, 33 bp, Artificial Sequence
  Description of Artificial Sequence: Synthetic oligonucleotide
tcagcattaagtaccactgaggtggcaatgcac

SEQ ID NO: 188530 - DNA, 32 bp, Artificial Sequence
  Description of Artificial Sequence: Synthetic oligonucleotide
cagcattaagtaccactgaggtggcaatgcac

SEQ ID NO: 188531 - DNA, 33 bp, Artificial Sequence
  Description of Artificial Sequence: Synthetic oligonucleotide
agcattaagtaccactgaggtggcaatgcacac

SEQ ID NO: 188532 - DNA, 32 bp, Artificial Sequence
  Description of Artificial Sequence: Synthetic oligonucleotide
gcattaagtaccactgaggtggcaatgcacac

SEQ ID NO: 188533 - DNA, 34 bp, Artificial Sequence
  Description of Artificial Sequence: Synthetic oligonucleotide
cattaagtaccactgaggtggcaatgcacacttc

SEQ ID NO: 188534 - DNA, 36 bp, Artificial Sequence
  Description of Artificial Sequence: Synthetic oligonucleotide
attaagtaccactgaggtggcaatgcacacttcaac

SEQ ID NO: 188535 - DNA, 35 bp, Artificial Sequence
  Description of Artificial Sequence: Synthetic oligonucleotide
ttaagtaccactgaggtggcaatgcacacttcaac

SEQ ID NO: 188536 - DNA, 34 bp, Artificial Sequence
  Description of Artificial Sequence: Synthetic oligonucleotide
taagtaccactgaggtggcaatgcacacttcaac

SEQ ID NO: 188537 - DNA, 33 bp, Artificial Sequence
  Description of Artificial Sequence: Synthetic oligonucleotide
aagtaccactgaggtggcaatgcacacttcaac

SEQ ID NO: 188538 - DNA, 32 bp, Artificial Sequence
  Description of Artificial Sequence: Synthetic oligonucleotide
agtaccactgaggtggcaatgcacacttcaac

SEQ ID NO: 188539 - DNA, 31 bp, Artificial Sequence
  Description of Artificial Sequence: Synthetic oligonucleotide
gtaccactgaggtggcaatgcacacttcaac

SEQ ID NO: 188540 - DNA, 33 bp, Artificial Sequence
  Description of Artificial Sequence: Synthetic oligonucleotide
taccactgaggtggcaatgcacacttcaacttc

SEQ ID NO: 188541 - DNA, 32 bp, Artificial Sequence
  Description of Artificial Sequence: Synthetic oligonucleotide
accactgaggtggcaatgcacacttcaacttc

SEQ ID NO: 188542 - DNA, 31 bp, Artificial Sequence
  Description of Artificial Sequence: Synthetic oligonucleotide
ccactgaggtggcaatgcacacttcaacttc

SEQ ID NO: 188543 - DNA, 33 bp, Artificial Sequence
  Description of Artificial Sequence: Synthetic oligonucleotide
cactgaggtggcaatgcacacttcaacttcttc

SEQ ID NO: 188544 - DNA, 35 bp, Artificial Sequence
  Description of Artificial Sequence: Synthetic oligonucleotide
actgaggtggcaatgcacacttcaacttcttcttc

SEQ ID NO: 188545 - DNA, 34 bp, Artificial Sequence
  Description of Artificial Sequence: Synthetic oligonucleotide
ctgaggtggcaatgcacacttcaacttcttcttc

SEQ ID NO: 188546 - DNA, 35 bp, Artificial Sequence
  Description of Artificial Sequence: Synthetic oligonucleotide
tgaggtggcaatgcacacttcaacttcttcttcag

SEQ ID NO: 188547 - DNA, 34 bp, Artificial Sequence
  Description of Artificial Sequence: Synthetic oligonucleotide
gaggtggcaatgcacacttcaacttcttcttcag

SEQ ID NO: 188548 - DNA, 35 bp, Artificial Sequence
  Description of Artificial Sequence: Synthetic oligonucleotide
aggtggcaatgcacacttcaacttcttcttcagtc

SEQ ID NO: 188549 - DNA, 34 bp, Artificial Sequence
  Description of Artificial Sequence: Synthetic oligonucleotide
ggtggcaatgcacacttcaacttcttcttcagtc

SEQ ID NO: 188550 - DNA, 35 bp, Artificial Sequence
  Description of Artificial Sequence: Synthetic oligonucleotide
gtggcaatgcacacttcaacttcttcttcagtcac

SEQ ID NO: 188551 - DNA, 38 bp, Artificial Sequence
  Description of Artificial Sequence: Synthetic oligonucleotide
tggcaatgcacacttcaacttcttcttcagtcacaaag

SEQ ID NO: 188552 - DNA, 37 bp, Artificial Sequence
  Description of Artificial Sequence: Synthetic oligonucleotide
ggcaatgcacacttcaacttcttcttcagtcacaaag

SEQ ID NO: 188553 - DNA, 38 bp, Artificial Sequence
  Description of Artificial Sequence: Synthetic oligonucleotide
gcaatgcacacttcaacttcttcttcagtcacaaagag

SEQ ID NO: 188554 - DNA, 41 bp, Artificial Sequence
  Description of Artificial Sequence: Synthetic oligonucleotide
caatgcacacttcaacttcttcttcagtcacaaagagttac

SEQ ID NO: 188555 - DNA, 43 bp, Artificial Sequence
  Description of Artificial Sequence: Synthetic oligonucleotide
aatgcacacttcaacttcttcttcagtcacaaagagttacatc

SEQ ID NO: 188556 - DNA, 42 bp, Artificial Sequence
  Description of Artificial Sequence: Synthetic oligonucleotide
atgcacacttcaacttcttcttcagtcacaaagagttacatc

SEQ ID NO: 188557 - DNA, 41 bp, Artificial Sequence
  Description of Artificial Sequence: Synthetic oligonucleotide
tgcacacttcaacttcttcttcagtcacaaagagttacatc

SEQ ID NO: 188558 - DNA, 40 bp, Artificial Sequence
  Description of Artificial Sequence: Synthetic oligonucleotide
gcacacttcaacttcttcttcagtcacaaagagttacatc

SEQ ID NO: 188559 - DNA, 41 bp, Artificial Sequence
  Description of Artificial Sequence: Synthetic oligonucleotide
cacacttcaacttcttcttcagtcacaaagagttacatctc

SEQ ID NO: 188560 - DNA, 43 bp, Artificial Sequence
  Description of Artificial Sequence: Synthetic oligonucleotide
acacttcaacttcttcttcagtcacaaagagttacatctcatc

SEQ ID NO: 188561 - DNA, 42 bp, Artificial Sequence
  Description of Artificial Sequence: Synthetic oligonucleotide
cacttcaacttcttcttcagtcacaaagagttacatctcatc

SEQ ID NO: 188562 - DNA, 43 bp, Artificial Sequence
  Description of Artificial Sequence: Synthetic oligonucleotide
acttcaacttcttcttcagtcacaaagagttacatctcatcac

SEQ ID NO: 188563 - DNA, 42 bp, Artificial Sequence
  Description of Artificial Sequence: Synthetic oligonucleotide
cttcaacttcttcttcagtcacaaagagttacatctcatcac

SEQ ID NO: 188564 - DNA, 43 bp, Artificial Sequence
  Description of Artificial Sequence: Synthetic oligonucleotide
ttcaacttcttcttcagtcacaaagagttacatctcatcacag

SEQ ID NO: 188565 - DNA, 42 bp, Artificial Sequence
  Description of Artificial Sequence: Synthetic oligonucleotide
tcaacttcttcttcagtcacaaagagttacatctcatcacag

SEQ ID NO: 188566 - DNA, 41 bp, Artificial Sequence
  Description of Artificial Sequence: Synthetic oligonucleotide
caacttcttcttcagtcacaaagagttacatctcatcacag

SEQ ID NO: 188567 - DNA, 42 bp, Artificial Sequence
  Description of Artificial Sequence: Synthetic oligonucleotide
aacttcttcttcagtcacaaagagttacatctcatcacagac

SEQ ID NO: 188568 - DNA, 41 bp, Artificial Sequence
  Description of Artificial Sequence: Synthetic oligonucleotide
acttcttcttcagtcacaaagagttacatctcatcacagac

SEQ ID NO: 188569 - DNA, 40 bp, Artificial Sequence
  Description of Artificial Sequence: Synthetic oligonucleotide
cttcttcttcagtcacaaagagttacatctcatcacagac

SEQ ID NO: 188570 - DNA, 44 bp, Artificial Sequence
  Description of Artificial Sequence: Synthetic oligonucleotide
ttcttcttcagtcacaaagagttacatctcatcacagacaaatg

SEQ ID NO: 188571 - DNA, 43 bp, Artificial Sequence
  Description of Artificial Sequence: Synthetic oligonucleotide
tcttcttcagtcacaaagagttacatctcatcacagacaaatg

SEQ ID NO: 188572 - DNA, 42 bp, Artificial Sequence
  Description of Artificial Sequence: Synthetic oligonucleotide
cttcttcagtcacaaagagttacatctcatcacagacaaatg

SEQ ID NO: 188573 - DNA, 45 bp, Artificial Sequence
  Description of Artificial Sequence: Synthetic oligonucleotide
ttcttcagtcacaaagagttacatctcatcacagacaaatgatac

SEQ ID NO: 188574 - DNA, 44 bp, Artificial Sequence
  Description of Artificial Sequence: Synthetic oligonucleotide
tcttcagtcacaaagagttacatctcatcacagacaaatgatac

SEQ ID NO: 188575 - DNA, 43 bp, Artificial Sequence
  Description of Artificial Sequence: Synthetic oligonucleotide
cttcagtcacaaagagttacatctcatcacagacaaatgatac

SEQ ID NO: 188576 - DNA, 43 bp, Artificial Sequence
  Description of Artificial Sequence: Synthetic oligonucleotide
ttcagtcacaaagagttacatctcatcacagacaaatgatacg

SEQ ID NO: 188577 - DNA, 42 bp, Artificial Sequence
  Description of Artificial Sequence: Synthetic oligonucleotide
tcagtcacaaagagttacatctcatcacagacaaatgatacg

SEQ ID NO: 188578 - DNA, 41 bp, Artificial Sequence
  Description of Artificial Sequence: Synthetic oligonucleotide
cagtcacaaagagttacatctcatcacagacaaatgatacg

SEQ ID NO: 188579 - DNA, 41 bp, Artificial Sequence
  Description of Artificial Sequence: Synthetic oligonucleotide
agtcacaaagagttacatctcatcacagacaaatgatacgc

SEQ ID NO: 188580 - DNA, 40 bp, Artificial Sequence
  Description of Artificial Sequence: Synthetic oligonucleotide
gtcacaaagagttacatctcatcacagacaaatgatacgc

SEQ ID NO: 188581 - DNA, 41 bp, Artificial Sequence
  Description of Artificial Sequence: Synthetic oligonucleotide
tcacaaagagttacatctcatcacagacaaatgatacgcac

SEQ ID NO: 188582 - DNA, 40 bp, Artificial Sequence
  Description of Artificial Sequence: Synthetic oligonucleotide
cacaaagagttacatctcatcacagacaaatgatacgcac

SEQ ID NO: 188583 - DNA, 43 bp, Artificial Sequence
  Description of Artificial Sequence: Synthetic oligonucleotide
acaaagagttacatctcatcacagacaaatgatacgcacaaac

SEQ ID NO: 188584 - DNA, 42 bp, Artificial Sequence
  Description of Artificial Sequence: Synthetic oligonucleotide
caaagagttacatctcatcacagacaaatgatacgcacaaac

SEQ ID NO: 188585 - DNA, 42 bp, Artificial Sequence
  Description of Artificial Sequence: Synthetic oligonucleotide
aaagagttacatctcatcacagacaaatgatacgcacaaacg

SEQ ID NO: 188586 - DNA, 41 bp, Artificial Sequence
  Description of Artificial Sequence: Synthetic oligonucleotide
aagagttacatctcatcacagacaaatgatacgcacaaacg

SEQ ID NO: 188587 - DNA, 40 bp, Artificial Sequence
  Description of Artificial Sequence: Synthetic oligonucleotide
agagttacatctcatcacagacaaatgatacgcacaaacg

SEQ ID NO: 188588 - DNA, 39 bp, Artificial Sequence
  Description of Artificial Sequence: Synthetic oligonucleotide
gagttacatctcatcacagacaaatgatacgcacaaacg

SEQ ID NO: 188589 - DNA, 39 bp, Artificial Sequence
  Description of Artificial Sequence: Synthetic oligonucleotide
agttacatctcatcacagacaaatgatacgcacaaacgg

SEQ ID NO: 188590 - DNA, 38 bp, Artificial Sequence
  Description of Artificial Sequence: Synthetic oligonucleotide
gttacatctcatcacagacaaatgatacgcacaaacgg

SEQ ID NO: 188591 - DNA, 38 bp, Artificial Sequence
  Description of Artificial Sequence: Synthetic oligonucleotide
ttacatctcatcacagacaaatgatacgcacaaacggg

SEQ ID NO: 188592 - DNA, 37 bp, Artificial Sequence
  Description of Artificial Sequence: Synthetic oligonucleotide
tacatctcatcacagacaaatgatacgcacaaacggg

SEQ ID NO: 188593 - DNA, 36 bp, Artificial Sequence
  Description of Artificial Sequence: Synthetic oligonucleotide
acatctcatcacagacaaatgatacgcacaaacggg

SEQ ID NO: 188594 - DNA, 35 bp, Artificial Sequence
  Description of Artificial Sequence: Synthetic oligonucleotide
catctcatcacagacaaatgatacgcacaaacggg

SEQ ID NO: 188595 - DNA, 36 bp, Artificial Sequence
  Description of Artificial Sequence: Synthetic oligonucleotide
atctcatcacagacaaatgatacgcacaaacgggac

SEQ ID NO: 188596 - DNA, 35 bp, Artificial Sequence
  Description of Artificial Sequence: Synthetic oligonucleotide
tctcatcacagacaaatgatacgcacaaacgggac

SEQ ID NO: 188597 - DNA, 34 bp, Artificial Sequence
  Description of Artificial Sequence: Synthetic oligonucleotide
ctcatcacagacaaatgatacgcacaaacgggac

SEQ ID NO: 188598 - DNA, 35 bp, Artificial Sequence
  Description of Artificial Sequence: Synthetic oligonucleotide
tcatcacagacaaatgatacgcacaaacgggacac

SEQ ID NO: 188599 - DNA, 34 bp, Artificial Sequence
  Description of Artificial Sequence: Synthetic oligonucleotide
catcacagacaaatgatacgcacaaacgggacac

SEQ ID NO: 188600 - DNA, 38 bp, Artificial Sequence
  Description of Artificial Sequence: Synthetic oligonucleotide
atcacagacaaatgatacgcacaaacgggacacatatg

SEQ ID NO: 188601 - DNA, 37 bp, Artificial Sequence
  Description of Artificial Sequence: Synthetic oligonucleotide
tcacagacaaatgatacgcacaaacgggacacatatg

SEQ ID NO: 188602 - DNA, 36 bp, Artificial Sequence
  Description of Artificial Sequence: Synthetic oligonucleotide
cacagacaaatgatacgcacaaacgggacacatatg

SEQ ID NO: 188603 - DNA, 36 bp, Artificial Sequence
  Description of Artificial Sequence: Synthetic oligonucleotide
acagacaaatgatacgcacaaacgggacacatatgc

SEQ ID NO: 188604 - DNA, 35 bp, Artificial Sequence
  Description of Artificial Sequence: Synthetic oligonucleotide
cagacaaatgatacgcacaaacgggacacatatgc

SEQ ID NO: 188605 - DNA, 36 bp, Artificial Sequence
  Description of Artificial Sequence: Synthetic oligonucleotide
agacaaatgatacgcacaaacgggacacatatgcag

SEQ ID NO: 188606 - DNA, 35 bp, Artificial Sequence
  Description of Artificial Sequence: Synthetic oligonucleotide
gacaaatgatacgcacaaacgggacacatatgcag

SEQ ID NO: 188607 - DNA, 35 bp, Artificial Sequence
  Description of Artificial Sequence: Synthetic oligonucleotide
acaaatgatacgcacaaacgggacacatatgcagc

SEQ ID NO: 188608 - DNA, 34 bp, Artificial Sequence
  Description of Artificial Sequence: Synthetic oligonucleotide
caaatgatacgcacaaacgggacacatatgcagc

SEQ ID NO: 188609 - DNA, 34 bp, Artificial Sequence
  Description of Artificial Sequence: Synthetic oligonucleotide
aaatgatacgcacaaacgggacacatatgcagcc

SEQ ID NO: 188610 - DNA, 33 bp, Artificial Sequence
  Description of Artificial Sequence: Synthetic oligonucleotide
aatgatacgcacaaacgggacacatatgcagcc

SEQ ID NO: 188611 - DNA, 32 bp, Artificial Sequence
  Description of Artificial Sequence: Synthetic oligonucleotide
atgatacgcacaaacgggacacatatgcagcc

SEQ ID NO: 188612 - DNA, 31 bp, Artificial Sequence
  Description of Artificial Sequence: Synthetic oligonucleotide
tgatacgcacaaacgggacacatatgcagcc

SEQ ID NO: 188613 - DNA, 30 bp, Artificial Sequence
  Description of Artificial Sequence: Synthetic oligonucleotide
gatacgcacaaacgggacacatatgcagcc

SEQ ID NO: 188614 - DNA, 31 bp, Artificial Sequence
  Description of Artificial Sequence: Synthetic oligonucleotide
atacgcacaaacgggacacatatgcagccac

SEQ ID NO: 188615 - DNA, 30 bp, Artificial Sequence
  Description of Artificial Sequence: Synthetic oligonucleotide
tacgcacaaacgggacacatatgcagccac

SEQ ID NO: 188616 - DNA, 29 bp, Artificial Sequence
  Description of Artificial Sequence: Synthetic oligonucleotide
acgcacaaacgggacacatatgcagccac

SEQ ID NO: 188617 - DNA, 28 bp, Artificial Sequence
  Description of Artificial Sequence: Synthetic oligonucleotide
cgcacaaacgggacacatatgcagccac

SEQ ID NO: 188618 - DNA, 29 bp, Artificial Sequence
  Description of Artificial Sequence: Synthetic oligonucleotide
gcacaaacgggacacatatgcagccactc

SEQ ID NO: 188619 - DNA, 29 bp, Artificial Sequence
  Description of Artificial Sequence: Synthetic oligonucleotide
cacaaacgggacacatatgcagccactcc

SEQ ID NO: 188620 - DNA, 31 bp, Artificial Sequence
  Description of Artificial Sequence: Synthetic oligonucleotide
acaaacgggacacatatgcagccactcctag

SEQ ID NO: 188621 - DNA, 30 bp, Artificial Sequence
  Description of Artificial Sequence: Synthetic oligonucleotide
caaacgggacacatatgcagccactcctag

SEQ ID NO: 188622 - DNA, 31 bp, Artificial Sequence
  Description of Artificial Sequence: Synthetic oligonucleotide
aaacgggacacatatgcagccactcctagag

SEQ ID NO: 188623 - DNA, 30 bp, Artificial Sequence
  Description of Artificial Sequence: Synthetic oligonucleotide
aacgggacacatatgcagccactcctagag

SEQ ID NO: 188624 - DNA, 29 bp, Artificial Sequence
  Description of Artificial Sequence: Synthetic oligonucleotide
acgggacacatatgcagccactcctagag

SEQ ID NO: 188625 - DNA, 28 bp, Artificial Sequence
  Description of Artificial Sequence: Synthetic oligonucleotide
cgggacacatatgcagccactcctagag

SEQ ID NO: 188626 - DNA, 28 bp, Artificial Sequence
  Description of Artificial Sequence: Synthetic oligonucleotide
gggacacatatgcagccactcctagagc

SEQ ID NO: 188627 - DNA, 29 bp, Artificial Sequence
  Description of Artificial Sequence: Synthetic oligonucleotide
ggacacatatgcagccactcctagagctc

SEQ ID NO: 188628 - DNA, 31 bp, Artificial Sequence
  Description of Artificial Sequence: Synthetic oligonucleotide
gacacatatgcagccactcctagagctcatg

SEQ ID NO: 188629 - DNA, 33 bp, Artificial Sequence
  Description of Artificial Sequence: Synthetic oligonucleotide
acacatatgcagccactcctagagctcatgaag

SEQ ID NO: 188630 - DNA, 32 bp, Artificial Sequence
  Description of Artificial Sequence: Synthetic oligonucleotide
cacatatgcagccactcctagagctcatgaag

SEQ ID NO: 188631 - DNA, 35 bp, Artificial Sequence
  Description of Artificial Sequence: Synthetic oligonucleotide
acatatgcagccactcctagagctcatgaagtttc

SEQ ID NO: 188632 - DNA, 34 bp, Artificial Sequence
  Description of Artificial Sequence: Synthetic oligonucleotide
catatgcagccactcctagagctcatgaagtttc

SEQ ID NO: 188633 - DNA, 35 bp, Artificial Sequence
  Description of Artificial Sequence: Synthetic oligonucleotide
atatgcagccactcctagagctcatgaagtttcag

SEQ ID NO: 188634 - DNA, 34 bp, Artificial Sequence
  Description of Artificial Sequence: Synthetic oligonucleotide
tatgcagccactcctagagctcatgaagtttcag

SEQ ID NO: 188635 - DNA, 33 bp, Artificial Sequence
  Description of Artificial Sequence: Synthetic oligonucleotide
atgcagccactcctagagctcatgaagtttcag

SEQ ID NO: 188636 - DNA, 32 bp, Artificial Sequence
  Description of Artificial Sequence: Synthetic oligonucleotide
tgcagccactcctagagctcatgaagtttcag

SEQ ID NO: 188637 - DNA, 31 bp, Artificial Sequence
  Description of Artificial Sequence: Synthetic oligonucleotide
gcagccactcctagagctcatgaagtttcag

SEQ ID NO: 188638 - DNA, 37 bp, Artificial Sequence
  Description of Artificial Sequence: Synthetic oligonucleotide
cagccactcctagagctcatgaagtttcagaaatttc

SEQ ID NO: 188639 - DNA, 38 bp, Artificial Sequence
  Description of Artificial Sequence: Synthetic oligonucleotide
agccactcctagagctcatgaagtttcagaaatttctg

SEQ ID NO: 188640 - DNA, 37 bp, Artificial Sequence
  Description of Artificial Sequence: Synthetic oligonucleotide
gccactcctagagctcatgaagtttcagaaatttctg

SEQ ID NO: 188641 - DNA, 40 bp, Artificial Sequence
  Description of Artificial Sequence: Synthetic oligonucleotide
ccactcctagagctcatgaagtttcagaaatttctgttag

SEQ ID NO: 188642 - DNA, 42 bp, Artificial Sequence
  Description of Artificial Sequence: Synthetic oligonucleotide
cactcctagagctcatgaagtttcagaaatttctgttagaac

SEQ ID NO: 188643 - DNA, 43 bp, Artificial Sequence
  Description of Artificial Sequence: Synthetic oligonucleotide
actcctagagctcatgaagtttcagaaatttctgttagaactg

SEQ ID NO: 188644 - DNA, 42 bp, Artificial Sequence
  Description of Artificial Sequence: Synthetic oligonucleotide
ctcctagagctcatgaagtttcagaaatttctgttagaactg

SEQ ID NO: 188645 - DNA, 46 bp, Artificial Sequence
  Description of Artificial Sequence: Synthetic oligonucleotide
tcctagagctcatgaagtttcagaaatttctgttagaactgtttac

SEQ ID NO: 188646 - DNA, 45 bp, Artificial Sequence
  Description of Artificial Sequence: Synthetic oligonucleotide
cctagagctcatgaagtttcagaaatttctgttagaactgtttac

SEQ ID NO: 188647 - DNA, 45 bp, Artificial Sequence
  Description of Artificial Sequence: Synthetic oligonucleotide
ctagagctcatgaagtttcagaaatttctgttagaactgtttacc

SEQ ID NO: 188648 - DNA, 45 bp, Artificial Sequence
  Description of Artificial Sequence: Synthetic oligonucleotide
tagagctcatgaagtttcagaaatttctgttagaactgtttaccc

SEQ ID NO: 188649 - DNA, 44 bp, Artificial Sequence
  Description of Artificial Sequence: Synthetic oligonucleotide
agagctcatgaagtttcagaaatttctgttagaactgtttaccc

SEQ ID NO: 188650 - DNA, 43 bp, Artificial Sequence
  Description of Artificial Sequence: Synthetic oligonucleotide
gagctcatgaagtttcagaaatttctgttagaactgtttaccc

SEQ ID NO: 188651 - DNA, 44 bp, Artificial Sequence
  Description of Artificial Sequence: Synthetic oligonucleotide
agctcatgaagtttcagaaatttctgttagaactgtttaccctc

SEQ ID NO: 188652 - DNA, 43 bp, Artificial Sequence
  Description of Artificial Sequence: Synthetic oligonucleotide
gctcatgaagtttcagaaatttctgttagaactgtttaccctc

SEQ ID NO: 188653 - DNA, 43 bp, Artificial Sequence
  Description of Artificial Sequence: Synthetic oligonucleotide
ctcatgaagtttcagaaatttctgttagaactgtttaccctcc

SEQ ID NO: 188654 - DNA, 44 bp, Artificial Sequence
  Description of Artificial Sequence: Synthetic oligonucleotide
tcatgaagtttcagaaatttctgttagaactgtttaccctccag

SEQ ID NO: 188655 - DNA, 43 bp, Artificial Sequence
  Description of Artificial Sequence: Synthetic oligonucleotide
catgaagtttcagaaatttctgttagaactgtttaccctccag

SEQ ID NO: 188656 - DNA, 45 bp, Artificial Sequence
  Description of Artificial Sequence: Synthetic oligonucleotide
atgaagtttcagaaatttctgttagaactgtttaccctccagaag

SEQ ID NO: 188657 - DNA, 44 bp, Artificial Sequence
  Description of Artificial Sequence: Synthetic oligonucleotide
tgaagtttcagaaatttctgttagaactgtttaccctccagaag

SEQ ID NO: 188658 - DNA, 43 bp, Artificial Sequence
  Description of Artificial Sequence: Synthetic oligonucleotide
gaagtttcagaaatttctgttagaactgtttaccctccagaag

SEQ ID NO: 188659 - DNA, 44 bp, Artificial Sequence
  Description of Artificial Sequence: Synthetic oligonucleotide
aagtttcagaaatttctgttagaactgtttaccctccagaagag

SEQ ID NO: 188660 - DNA, 43 bp, Artificial Sequence
  Description of Artificial Sequence: Synthetic oligonucleotide
agtttcagaaatttctgttagaactgtttaccctccagaagag

SEQ ID NO: 188661 - DNA, 42 bp, Artificial Sequence
  Description of Artificial Sequence: Synthetic oligonucleotide
gtttcagaaatttctgttagaactgtttaccctccagaagag

SEQ ID NO: 188662 - DNA, 42 bp, Artificial Sequence
  Description of Artificial Sequence: Synthetic oligonucleotide
tttcagaaatttctgttagaactgtttaccctccagaagagg

SEQ ID NO: 188663 - DNA, 41 bp, Artificial Sequence
  Description of Artificial Sequence: Synthetic oligonucleotide
ttcagaaatttctgttagaactgtttaccctccagaagagg

SEQ ID NO: 188664 - DNA, 40 bp, Artificial Sequence
  Description of Artificial Sequence: Synthetic oligonucleotide
tcagaaatttctgttagaactgtttaccctccagaagagg

SEQ ID NO: 188665 - DNA, 39 bp, Artificial Sequence
  Description of Artificial Sequence: Synthetic oligonucleotide
cagaaatttctgttagaactgtttaccctccagaagagg

SEQ ID NO: 188666 - DNA, 42 bp, Artificial Sequence
  Description of Artificial Sequence: Synthetic oligonucleotide
agaaatttctgttagaactgtttaccctccagaagaggaaac

SEQ ID NO: 188667 - DNA, 41 bp, Artificial Sequence
  Description of Artificial Sequence: Synthetic oligonucleotide
gaaatttctgttagaactgtttaccctccagaagaggaaac

SEQ ID NO: 188668 - DNA, 41 bp, Artificial Sequence
  Description of Artificial Sequence: Synthetic oligonucleotide
aaatttctgttagaactgtttaccctccagaagaggaaacc

SEQ ID NO: 188669 - DNA, 40 bp, Artificial Sequence
  Description of Artificial Sequence: Synthetic oligonucleotide
aatttctgttagaactgtttaccctccagaagaggaaacc

SEQ ID NO: 188670 - DNA, 39 bp, Artificial Sequence
  Description of Artificial Sequence: Synthetic oligonucleotide
atttctgttagaactgtttaccctccagaagaggaaacc

SEQ ID NO: 188671 - DNA, 38 bp, Artificial Sequence
  Description of Artificial Sequence: Synthetic oligonucleotide
tttctgttagaactgtttaccctccagaagaggaaacc

SEQ ID NO: 188672 - DNA, 37 bp, Artificial Sequence
  Description of Artificial Sequence: Synthetic oligonucleotide
ttctgttagaactgtttaccctccagaagaggaaacc

SEQ ID NO: 188673 - DNA, 36 bp, Artificial Sequence
  Description of Artificial Sequence: Synthetic oligonucleotide
tctgttagaactgtttaccctccagaagaggaaacc

SEQ ID NO: 188674 - DNA, 35 bp, Artificial Sequence
  Description of Artificial Sequence: Synthetic oligonucleotide
ctgttagaactgtttaccctccagaagaggaaacc

SEQ ID NO: 188675 - DNA, 35 bp, Artificial Sequence
  Description of Artificial Sequence: Synthetic oligonucleotide
tgttagaactgtttaccctccagaagaggaaaccg

SEQ ID NO: 188676 - DNA, 34 bp, Artificial Sequence
  Description of Artificial Sequence: Synthetic oligonucleotide
gttagaactgtttaccctccagaagaggaaaccg

SEQ ID NO: 188677 - DNA, 34 bp, Artificial Sequence
  Description of Artificial Sequence: Synthetic oligonucleotide
ttagaactgtttaccctccagaagaggaaaccgg

SEQ ID NO: 188678 - DNA, 33 bp, Artificial Sequence
  Description of Artificial Sequence: Synthetic oligonucleotide
tagaactgtttaccctccagaagaggaaaccgg

SEQ ID NO: 188679 - DNA, 32 bp, Artificial Sequence
  Description of Artificial Sequence: Synthetic oligonucleotide
agaactgtttaccctccagaagaggaaaccgg

SEQ ID NO: 188680 - DNA, 31 bp, Artificial Sequence
  Description of Artificial Sequence: Synthetic oligonucleotide
gaactgtttaccctccagaagaggaaaccgg

SEQ ID NO: 188681 - DNA, 32 bp, Artificial Sequence
  Description of Artificial Sequence: Synthetic oligonucleotide
aactgtttaccctccagaagaggaaaccggag

SEQ ID NO: 188682 - DNA, 31 bp, Artificial Sequence
  Description of Artificial Sequence: Synthetic oligonucleotide
actgtttaccctccagaagaggaaaccggag

SEQ ID NO: 188683 - DNA, 30 bp, Artificial Sequence
  Description of Artificial Sequence: Synthetic oligonucleotide
ctgtttaccctccagaagaggaaaccggag

SEQ ID NO: 188684 - DNA, 33 bp, Artificial Sequence
  Description of Artificial Sequence: Synthetic oligonucleotide
tgtttaccctccagaagaggaaaccggagaaag

SEQ ID NO: 188685 - DNA, 32 bp, Artificial Sequence
  Description of Artificial Sequence: Synthetic oligonucleotide
gtttaccctccagaagaggaaaccggagaaag

SEQ ID NO: 188686 - DNA, 32 bp, Artificial Sequence
  Description of Artificial Sequence: Synthetic oligonucleotide
tttaccctccagaagaggaaaccggagaaagg

SEQ ID NO: 188687 - DNA, 31 bp, Artificial Sequence
  Description of Artificial Sequence: Synthetic oligonucleotide
ttaccctccagaagaggaaaccggagaaagg

SEQ ID NO: 188688 - DNA, 30 bp, Artificial Sequence
  Description of Artificial Sequence: Synthetic oligonucleotide
taccctccagaagaggaaaccggagaaagg

SEQ ID NO: 188689 - DNA, 29 bp, Artificial Sequence
  Description of Artificial Sequence: Synthetic oligonucleotide
accctccagaagaggaaaccggagaaagg

SEQ ID NO: 188690 - DNA, 28 bp, Artificial Sequence
  Description of Artificial Sequence: Synthetic oligonucleotide
ccctccagaagaggaaaccggagaaagg

SEQ ID NO: 188691 - DNA, 28 bp, Artificial Sequence
  Description of Artificial Sequence: Synthetic oligonucleotide
cctccagaagaggaaaccggagaaaggg

SEQ ID NO: 188692 - DNA, 30 bp, Artificial Sequence
  Description of Artificial Sequence: Synthetic oligonucleotide
ctccagaagaggaaaccggagaaagggtac

SEQ ID NO: 188693 - DNA, 32 bp, Artificial Sequence
  Description of Artificial Sequence: Synthetic oligonucleotide
tccagaagaggaaaccggagaaagggtacaac

SEQ ID NO: 188694 - DNA, 31 bp, Artificial Sequence
  Description of Artificial Sequence: Synthetic oligonucleotide
ccagaagaggaaaccggagaaagggtacaac

SEQ ID NO: 188695 - DNA, 33 bp, Artificial Sequence
  Description of Artificial Sequence: Synthetic oligonucleotide
cagaagaggaaaccggagaaagggtacaacttg

SEQ ID NO: 188696 - DNA, 33 bp, Artificial Sequence
  Description of Artificial Sequence: Synthetic oligonucleotide
agaagaggaaaccggagaaagggtacaacttgc

SEQ ID NO: 188697 - DNA, 32 bp, Artificial Sequence
  Description of Artificial Sequence: Synthetic oligonucleotide
gaagaggaaaccggagaaagggtacaacttgc

SEQ ID NO: 188698 - DNA, 32 bp, Artificial Sequence
  Description of Artificial Sequence: Synthetic oligonucleotide
aagaggaaaccggagaaagggtacaacttgcc

SEQ ID NO: 188699 - DNA, 31 bp, Artificial Sequence
  Description of Artificial Sequence: Synthetic oligonucleotide
agaggaaaccggagaaagggtacaacttgcc

SEQ ID NO: 188700 - DNA, 30 bp, Artificial Sequence
  Description of Artificial Sequence: Synthetic oligonucleotide
gaggaaaccggagaaagggtacaacttgcc

SEQ ID NO: 188701 - DNA, 30 bp, Artificial Sequence
  Description of Artificial Sequence: Synthetic oligonucleotide
aggaaaccggagaaagggtacaacttgccc

SEQ ID NO: 188702 - DNA, 29 bp, Artificial Sequence
  Description of Artificial Sequence: Synthetic oligonucleotide
ggaaaccggagaaagggtacaacttgccc

SEQ ID NO: 188703 - DNA, 31 bp, Artificial Sequence
  Description of Artificial Sequence: Synthetic oligonucleotide
gaaaccggagaaagggtacaacttgcccatc

SEQ ID NO: 188704 - DNA, 35 bp, Artificial Sequence
  Description of Artificial Sequence: Synthetic oligonucleotide
aaaccggagaaagggtacaacttgcccatcatttc

SEQ ID NO: 188705 - DNA, 34 bp, Artificial Sequence
  Description of Artificial Sequence: Synthetic oligonucleotide
aaccggagaaagggtacaacttgcccatcatttc

SEQ ID NO: 188706 - DNA, 33 bp, Artificial Sequence
  Description of Artificial Sequence: Synthetic oligonucleotide
accggagaaagggtacaacttgcccatcatttc

SEQ ID NO: 188707 - DNA, 32 bp, Artificial Sequence
  Description of Artificial Sequence: Synthetic oligonucleotide
ccggagaaagggtacaacttgcccatcatttc

SEQ ID NO: 188708 - DNA, 33 bp, Artificial Sequence
  Description of Artificial Sequence: Synthetic oligonucleotide
cggagaaagggtacaacttgcccatcatttctc

SEQ ID NO: 188709 - DNA, 34 bp, Artificial Sequence
  Description of Artificial Sequence: Synthetic oligonucleotide
ggagaaagggtacaacttgcccatcatttctctg

SEQ ID NO: 188710 - DNA, 36 bp, Artificial Sequence
  Description of Artificial Sequence: Synthetic oligonucleotide
gagaaagggtacaacttgcccatcatttctctgaac

SEQ ID NO: 188711 - DNA, 36 bp, Artificial Sequence
  Description of Artificial Sequence: Synthetic oligonucleotide
agaaagggtacaacttgcccatcatttctctgaacc

SEQ ID NO: 188712 - DNA, 35 bp, Artificial Sequence
  Description of Artificial Sequence: Synthetic oligonucleotide
gaaagggtacaacttgcccatcatttctctgaacc

SEQ ID NO: 188713 - DNA, 36 bp, Artificial Sequence
  Description of Artificial Sequence: Synthetic oligonucleotide
aaagggtacaacttgcccatcatttctctgaaccag

SEQ ID NO: 188714 - DNA, 35 bp, Artificial Sequence
  Description of Artificial Sequence: Synthetic oligonucleotide
aagggtacaacttgcccatcatttctctgaaccag

SEQ ID NO: 188715 - DNA, 34 bp, Artificial Sequence
  Description of Artificial Sequence: Synthetic oligonucleotide
agggtacaacttgcccatcatttctctgaaccag

SEQ ID NO: 188716 - DNA, 33 bp, Artificial Sequence
  Description of Artificial Sequence: Synthetic oligonucleotide
gggtacaacttgcccatcatttctctgaaccag

SEQ ID NO: 188717 - DNA, 34 bp, Artificial Sequence
  Description of Artificial Sequence: Synthetic oligonucleotide
ggtacaacttgcccatcatttctctgaaccagag

SEQ ID NO: 188718 - DNA, 38 bp, Artificial Sequence
  Description of Artificial Sequence: Synthetic oligonucleotide
gtacaacttgcccatcatttctctgaaccagagataac

SEQ ID NO: 188719 - DNA, 39 bp, Artificial Sequence
  Description of Artificial Sequence: Synthetic oligonucleotide
tacaacttgcccatcatttctctgaaccagagataacac

SEQ ID NO: 188720 - DNA, 38 bp, Artificial Sequence
  Description of Artificial Sequence: Synthetic oligonucleotide
acaacttgcccatcatttctctgaaccagagataacac

SEQ ID NO: 188721 - DNA, 37 bp, Artificial Sequence
  Description of Artificial Sequence: Synthetic oligonucleotide
caacttgcccatcatttctctgaaccagagataacac

SEQ ID NO: 188722 - DNA, 38 bp, Artificial Sequence
  Description of Artificial Sequence: Synthetic oligonucleotide
aacttgcccatcatttctctgaaccagagataacactc

SEQ ID NO: 188723 - DNA, 37 bp, Artificial Sequence
  Description of Artificial Sequence: Synthetic oligonucleotide
acttgcccatcatttctctgaaccagagataacactc

SEQ ID NO: 188724 - DNA, 36 bp, Artificial Sequence
  Description of Artificial Sequence: Synthetic oligonucleotide
cttgcccatcatttctctgaaccagagataacactc

SEQ ID NO: 188725 - DNA, 45 bp, Artificial Sequence
  Description of Artificial Sequence: Synthetic oligonucleotide
ttgcccatcatttctctgaaccagagataacactcattatttttg

SEQ ID NO: 188726 - DNA, 44 bp, Artificial Sequence
  Description of Artificial Sequence: Synthetic oligonucleotide
tgcccatcatttctctgaaccagagataacactcattatttttg

SEQ ID NO: 188727 - DNA, 43 bp, Artificial Sequence
  Description of Artificial Sequence: Synthetic oligonucleotide
gcccatcatttctctgaaccagagataacactcattatttttg

SEQ ID NO: 188728 - DNA, 43 bp, Artificial Sequence
  Description of Artificial Sequence: Synthetic oligonucleotide
cccatcatttctctgaaccagagataacactcattatttttgg

SEQ ID NO: 188729 - DNA, 43 bp, Artificial Sequence
  Description of Artificial Sequence: Synthetic oligonucleotide
ccatcatttctctgaaccagagataacactcattatttttggg

SEQ ID NO: 188730 - DNA, 43 bp, Artificial Sequence
  Description of Artificial Sequence: Synthetic oligonucleotide
catcatttctctgaaccagagataacactcattatttttgggg

SEQ ID NO: 188731 - DNA, 44 bp, Artificial Sequence
  Description of Artificial Sequence: Synthetic oligonucleotide
atcatttctctgaaccagagataacactcattatttttggggtg

SEQ ID NO: 188732 - DNA, 43 bp, Artificial Sequence
  Description of Artificial Sequence: Synthetic oligonucleotide
tcatttctctgaaccagagataacactcattatttttggggtg

SEQ ID NO: 188733 - DNA, 42 bp, Artificial Sequence
  Description of Artificial Sequence: Synthetic oligonucleotide
catttctctgaaccagagataacactcattatttttggggtg

SEQ ID NO: 188734 - DNA, 44 bp, Artificial Sequence
  Description of Artificial Sequence: Synthetic oligonucleotide
atttctctgaaccagagataacactcattatttttggggtgatg

SEQ ID NO: 188735 - DNA, 43 bp, Artificial Sequence
  Description of Artificial Sequence: Synthetic oligonucleotide
tttctctgaaccagagataacactcattatttttggggtgatg

SEQ ID NO: 188736 - DNA, 42 bp, Artificial Sequence
  Description of Artificial Sequence: Synthetic oligonucleotide
ttctctgaaccagagataacactcattatttttggggtgatg

SEQ ID NO: 188737 - DNA, 41 bp, Artificial Sequence
  Description of Artificial Sequence: Synthetic oligonucleotide
tctctgaaccagagataacactcattatttttggggtgatg

SEQ ID NO: 188738 - DNA, 40 bp, Artificial Sequence
  Description of Artificial Sequence: Synthetic oligonucleotide
ctctgaaccagagataacactcattatttttggggtgatg

SEQ ID NO: 188739 - DNA, 40 bp, Artificial Sequence
  Description of Artificial Sequence: Synthetic oligonucleotide
tctgaaccagagataacactcattatttttggggtgatgg

SEQ ID NO: 188740 - DNA, 39 bp, Artificial Sequence
  Description of Artificial Sequence: Synthetic oligonucleotide
ctgaaccagagataacactcattatttttggggtgatgg

SEQ ID NO: 188741 - DNA, 39 bp, Artificial Sequence
  Description of Artificial Sequence: Synthetic oligonucleotide
tgaaccagagataacactcattatttttggggtgatggc

SEQ ID NO: 188742 - DNA, 38 bp, Artificial Sequence
  Description of Artificial Sequence: Synthetic oligonucleotide
gaaccagagataacactcattatttttggggtgatggc

SEQ ID NO: 188743 - DNA, 39 bp, Artificial Sequence
  Description of Artificial Sequence: Synthetic oligonucleotide
aaccagagataacactcattatttttggggtgatggctg

SEQ ID NO: 188744 - DNA, 38 bp, Artificial Sequence
  Description of Artificial Sequence: Synthetic oligonucleotide
accagagataacactcattatttttggggtgatggctg

SEQ ID NO: 188745 - DNA, 37 bp, Artificial Sequence
  Description of Artificial Sequence: Synthetic oligonucleotide
ccagagataacactcattatttttggggtgatggctg

SEQ ID NO: 188746 - DNA, 37 bp, Artificial Sequence
  Description of Artificial Sequence: Synthetic oligonucleotide
cagagataacactcattatttttggggtgatggctgg

SEQ ID NO: 188747 - DNA, 38 bp, Artificial Sequence
  Description of Artificial Sequence: Synthetic oligonucleotide
agagataacactcattatttttggggtgatggctggtg

SEQ ID NO: 188748 - DNA, 37 bp, Artificial Sequence
  Description of Artificial Sequence: Synthetic oligonucleotide
gagataacactcattatttttggggtgatggctggtg

SEQ ID NO: 188749 - DNA, 42 bp, Artificial Sequence
  Description of Artificial Sequence: Synthetic oligonucleotide
agataacactcattatttttggggtgatggctggtgttattg

SEQ ID NO: 188750 - DNA, 41 bp, Artificial Sequence
  Description of Artificial Sequence: Synthetic oligonucleotide
gataacactcattatttttggggtgatggctggtgttattg

SEQ ID NO: 188751 - DNA, 41 bp, Artificial Sequence
  Description of Artificial Sequence: Synthetic oligonucleotide
ataacactcattatttttggggtgatggctggtgttattgg

SEQ ID NO: 188752 - DNA, 40 bp, Artificial Sequence
  Description of Artificial Sequence: Synthetic oligonucleotide
taacactcattatttttggggtgatggctggtgttattgg

SEQ ID NO: 188753 - DNA, 39 bp, Artificial Sequence
  Description of Artificial Sequence: Synthetic oligonucleotide
aacactcattatttttggggtgatggctggtgttattgg

SEQ ID NO: 188754 - DNA, 38 bp, Artificial Sequence
  Description of Artificial Sequence: Synthetic oligonucleotide
acactcattatttttggggtgatggctggtgttattgg

SEQ ID NO: 188755 - DNA, 37 bp, Artificial Sequence
  Description of Artificial Sequence: Synthetic oligonucleotide
cactcattatttttggggtgatggctggtgttattgg

SEQ ID NO: 188756 - DNA, 39 bp, Artificial Sequence
  Description of Artificial Sequence: Synthetic oligonucleotide
actcattatttttggggtgatggctggtgttattggaac

SEQ ID NO: 188757 - DNA, 38 bp, Artificial Sequence
  Description of Artificial Sequence: Synthetic oligonucleotide
ctcattatttttggggtgatggctggtgttattggaac

SEQ ID NO: 188758 - DNA, 38 bp, Artificial Sequence
  Description of Artificial Sequence: Synthetic oligonucleotide
tcattatttttggggtgatggctggtgttattggaacg

SEQ ID NO: 188759 - DNA, 37 bp, Artificial Sequence
  Description of Artificial Sequence: Synthetic oligonucleotide
cattatttttggggtgatggctggtgttattggaacg

SEQ ID NO: 188760 - DNA, 39 bp, Artificial Sequence
  Description of Artificial Sequence: Synthetic oligonucleotide
attatttttggggtgatggctggtgttattggaacgatc

SEQ ID NO: 188761 - DNA, 38 bp, Artificial Sequence
  Description of Artificial Sequence: Synthetic oligonucleotide
ttatttttggggtgatggctggtgttattggaacgatc

SEQ ID NO: 188762 - DNA, 37 bp, Artificial Sequence
  Description of Artificial Sequence: Synthetic oligonucleotide
tatttttggggtgatggctggtgttattggaacgatc

SEQ ID NO: 188763 - DNA, 36 bp, Artificial Sequence
  Description of Artificial Sequence: Synthetic oligonucleotide
atttttggggtgatggctggtgttattggaacgatc

SEQ ID NO: 188764 - DNA, 35 bp, Artificial Sequence
  Description of Artificial Sequence: Synthetic oligonucleotide
tttttggggtgatggctggtgttattggaacgatc

SEQ ID NO: 188765 - DNA, 34 bp, Artificial Sequence
  Description of Artificial Sequence: Synthetic oligonucleotide
ttttggggtgatggctggtgttattggaacgatc

SEQ ID NO: 188766 - DNA, 33 bp, Artificial Sequence
  Description of Artificial Sequence: Synthetic oligonucleotide
tttggggtgatggctggtgttattggaacgatc

SEQ ID NO: 188767 - DNA, 32 bp, Artificial Sequence
  Description of Artificial Sequence: Synthetic oligonucleotide
ttggggtgatggctggtgttattggaacgatc

SEQ ID NO: 188768 - DNA, 31 bp, Artificial Sequence
  Description of Artificial Sequence: Synthetic oligonucleotide
tggggtgatggctggtgttattggaacgatc

SEQ ID NO: 188769 - DNA, 30 bp, Artificial Sequence
  Description of Artificial Sequence: Synthetic oligonucleotide
ggggtgatggctggtgttattggaacgatc

SEQ ID NO: 188770 - DNA, 30 bp, Artificial Sequence
  Description of Artificial Sequence: Synthetic oligonucleotide
gggtgatggctggtgttattggaacgatcc

SEQ ID NO: 188771 - DNA, 31 bp, Artificial Sequence
  Description of Artificial Sequence: Synthetic oligonucleotide
ggtgatggctggtgttattggaacgatcctc

SEQ ID NO: 188772 - DNA, 38 bp, Artificial Sequence
  Description of Artificial Sequence: Synthetic oligonucleotide
gtgatggctggtgttattggaacgatcctcttaatttc

SEQ ID NO: 188773 - DNA, 41 bp, Artificial Sequence
  Description of Artificial Sequence: Synthetic oligonucleotide
tgatggctggtgttattggaacgatcctcttaatttcttac

SEQ ID NO: 188774 - DNA, 40 bp, Artificial Sequence
  Description of Artificial Sequence: Synthetic oligonucleotide
gatggctggtgttattggaacgatcctcttaatttcttac

SEQ ID NO: 188775 - DNA, 40 bp, Artificial Sequence
  Description of Artificial Sequence: Synthetic oligonucleotide
atggctggtgttattggaacgatcctcttaatttcttacg

SEQ ID NO: 188776 - DNA, 39 bp, Artificial Sequence
  Description of Artificial Sequence: Synthetic oligonucleotide
tggctggtgttattggaacgatcctcttaatttcttacg

SEQ ID NO: 188777 - DNA, 38 bp, Artificial Sequence
  Description of Artificial Sequence: Synthetic oligonucleotide
ggctggtgttattggaacgatcctcttaatttcttacg

SEQ ID NO: 188778 - DNA, 38 bp, Artificial Sequence
  Description of Artificial Sequence: Synthetic oligonucleotide
gctggtgttattggaacgatcctcttaatttcttacgg

SEQ ID NO: 188779 - DNA, 42 bp, Artificial Sequence
  Description of Artificial Sequence: Synthetic oligonucleotide
ctggtgttattggaacgatcctcttaatttcttacggtattc

SEQ ID NO: 188780 - DNA, 42 bp, Artificial Sequence
  Description of Artificial Sequence: Synthetic oligonucleotide
tggtgttattggaacgatcctcttaatttcttacggtattcg

SEQ ID NO: 188781 - DNA, 41 bp, Artificial Sequence
  Description of Artificial Sequence: Synthetic oligonucleotide
ggtgttattggaacgatcctcttaatttcttacggtattcg

SEQ ID NO: 188782 - DNA, 41 bp, Artificial Sequence
  Description of Artificial Sequence: Synthetic oligonucleotide
gtgttattggaacgatcctcttaatttcttacggtattcgc

SEQ ID NO: 188783 - DNA, 41 bp, Artificial Sequence
  Description of Artificial Sequence: Synthetic oligonucleotide
tgttattggaacgatcctcttaatttcttacggtattcgcc

SEQ ID NO: 188784 - DNA, 40 bp, Artificial Sequence
  Description of Artificial Sequence: Synthetic oligonucleotide
gttattggaacgatcctcttaatttcttacggtattcgcc

SEQ ID NO: 188785 - DNA, 40 bp, Artificial Sequence
  Description of Artificial Sequence: Synthetic oligonucleotide
ttattggaacgatcctcttaatttcttacggtattcgccg

SEQ ID NO: 188786 - DNA, 39 bp, Artificial Sequence
  Description of Artificial Sequence: Synthetic oligonucleotide
tattggaacgatcctcttaatttcttacggtattcgccg

SEQ ID NO: 188787 - DNA, 38 bp, Artificial Sequence
  Description of Artificial Sequence: Synthetic oligonucleotide
attggaacgatcctcttaatttcttacggtattcgccg

SEQ ID NO: 188788 - DNA, 37 bp, Artificial Sequence
  Description of Artificial Sequence: Synthetic oligonucleotide
ttggaacgatcctcttaatttcttacggtattcgccg

SEQ ID NO: 188789 - DNA, 36 bp, Artificial Sequence
  Description of Artificial Sequence: Synthetic oligonucleotide
tggaacgatcctcttaatttcttacggtattcgccg

SEQ ID NO: 188790 - DNA, 35 bp, Artificial Sequence
  Description of Artificial Sequence: Synthetic oligonucleotide
ggaacgatcctcttaatttcttacggtattcgccg

SEQ ID NO: 188791 - DNA, 36 bp, Artificial Sequence
  Description of Artificial Sequence: Synthetic oligonucleotide
gaacgatcctcttaatttcttacggtattcgccgac

SEQ ID NO: 188792 - DNA, 37 bp, Artificial Sequence
  Description of Artificial Sequence: Synthetic oligonucleotide
aacgatcctcttaatttcttacggtattcgccgactg

SEQ ID NO: 188793 - DNA, 36 bp, Artificial Sequence
  Description of Artificial Sequence: Synthetic oligonucleotide
acgatcctcttaatttcttacggtattcgccgactg

SEQ ID NO: 188794 - DNA, 35 bp, Artificial Sequence
  Description of Artificial Sequence: Synthetic oligonucleotide
cgatcctcttaatttcttacggtattcgccgactg

SEQ ID NO: 188795 - DNA, 40 bp, Artificial Sequence
  Description of Artificial Sequence: Synthetic oligonucleotide
gatcctcttaatttcttacggtattcgccgactgataaag

SEQ ID NO: 188796 - DNA, 44 bp, Artificial Sequence
  Description of Artificial Sequence: Synthetic oligonucleotide
atcctcttaatttcttacggtattcgccgactgataaagaaaag

SEQ ID NO: 188797 - DNA, 43 bp, Artificial Sequence
  Description of Artificial Sequence: Synthetic oligonucleotide
tcctcttaatttcttacggtattcgccgactgataaagaaaag

SEQ ID NO: 188798 - DNA, 42 bp, Artificial Sequence
  Description of Artificial Sequence: Synthetic oligonucleotide
cctcttaatttcttacggtattcgccgactgataaagaaaag

SEQ ID NO: 188799 - DNA, 42 bp, Artificial Sequence
  Description of Artificial Sequence: Synthetic oligonucleotide
ctcttaatttcttacggtattcgccgactgataaagaaaagc

SEQ ID NO: 188800 - DNA, 42 bp, Artificial Sequence
  Description of Artificial Sequence: Synthetic oligonucleotide
tcttaatttcttacggtattcgccgactgataaagaaaagcc

SEQ ID NO: 188801 - DNA, 41 bp, Artificial Sequence
  Description of Artificial Sequence: Synthetic oligonucleotide
cttaatttcttacggtattcgccgactgataaagaaaagcc

SEQ ID NO: 188802 - DNA, 41 bp, Artificial Sequence
  Description of Artificial Sequence: Synthetic oligonucleotide
ttaatttcttacggtattcgccgactgataaagaaaagccc

SEQ ID NO: 188803 - DNA, 40 bp, Artificial Sequence
  Description of Artificial Sequence: Synthetic oligonucleotide
taatttcttacggtattcgccgactgataaagaaaagccc

SEQ ID NO: 188804 - DNA, 39 bp, Artificial Sequence
  Description of Artificial Sequence: Synthetic oligonucleotide
aatttcttacggtattcgccgactgataaagaaaagccc

SEQ ID NO: 188805 - DNA, 38 bp, Artificial Sequence
  Description of Artificial Sequence: Synthetic oligonucleotide
atttcttacggtattcgccgactgataaagaaaagccc

SEQ ID NO: 188806 - DNA, 37 bp, Artificial Sequence
  Description of Artificial Sequence: Synthetic oligonucleotide
tttcttacggtattcgccgactgataaagaaaagccc

SEQ ID NO: 188807 - DNA, 36 bp, Artificial Sequence
  Description of Artificial Sequence: Synthetic oligonucleotide
ttcttacggtattcgccgactgataaagaaaagccc

SEQ ID NO: 188808 - DNA, 35 bp, Artificial Sequence
  Description of Artificial Sequence: Synthetic oligonucleotide
tcttacggtattcgccgactgataaagaaaagccc

SEQ ID NO: 188809 - DNA, 34 bp, Artificial Sequence
  Description of Artificial Sequence: Synthetic oligonucleotide
cttacggtattcgccgactgataaagaaaagccc

SEQ ID NO: 188810 - DNA, 36 bp, Artificial Sequence
  Description of Artificial Sequence: Synthetic oligonucleotide
ttacggtattcgccgactgataaagaaaagcccatc

SEQ ID NO: 188811 - DNA, 35 bp, Artificial Sequence
  Description of Artificial Sequence: Synthetic oligonucleotide
tacggtattcgccgactgataaagaaaagcccatc

SEQ ID NO: 188812 - DNA, 34 bp, Artificial Sequence
  Description of Artificial Sequence: Synthetic oligonucleotide
acggtattcgccgactgataaagaaaagcccatc

SEQ ID NO: 188813 - DNA, 33 bp, Artificial Sequence
  Description of Artificial Sequence: Synthetic oligonucleotide
cggtattcgccgactgataaagaaaagcccatc

SEQ ID NO: 188814 - DNA, 34 bp, Artificial Sequence
  Description of Artificial Sequence: Synthetic oligonucleotide
ggtattcgccgactgataaagaaaagcccatctg

SEQ ID NO: 188815 - DNA, 36 bp, Artificial Sequence
  Description of Artificial Sequence: Synthetic oligonucleotide
gtattcgccgactgataaagaaaagcccatctgatg

SEQ ID NO: 188816 - DNA, 41 bp, Artificial Sequence
  Description of Artificial Sequence: Synthetic oligonucleotide
tattcgccgactgataaagaaaagcccatctgatgtaaaac

SEQ ID NO: 188817 - DNA, 40 bp, Artificial Sequence
  Description of Artificial Sequence: Synthetic oligonucleotide
attcgccgactgataaagaaaagcccatctgatgtaaaac

SEQ ID NO: 188818 - DNA, 39 bp, Artificial Sequence
  Description of Artificial Sequence: Synthetic oligonucleotide
ttcgccgactgataaagaaaagcccatctgatgtaaaac

SEQ ID NO: 188819 - DNA, 38 bp, Artificial Sequence
  Description of Artificial Sequence: Synthetic oligonucleotide
tcgccgactgataaagaaaagcccatctgatgtaaaac

SEQ ID NO: 188820 - DNA, 37 bp, Artificial Sequence
  Description of Artificial Sequence: Synthetic oligonucleotide
cgccgactgataaagaaaagcccatctgatgtaaaac

SEQ ID NO: 188821 - DNA, 37 bp, Artificial Sequence
  Description of Artificial Sequence: Synthetic oligonucleotide
gccgactgataaagaaaagcccatctgatgtaaaacc

SEQ ID NO: 188822 - DNA, 38 bp, Artificial Sequence
  Description of Artificial Sequence: Synthetic oligonucleotide
ccgactgataaagaaaagcccatctgatgtaaaacctc

SEQ ID NO: 188823 - DNA, 39 bp, Artificial Sequence
  Description of Artificial Sequence: Synthetic oligonucleotide
cgactgataaagaaaagcccatctgatgtaaaacctctc

SEQ ID NO: 188824 - DNA, 39 bp, Artificial Sequence
  Description of Artificial Sequence: Synthetic oligonucleotide
gactgataaagaaaagcccatctgatgtaaaacctctcc

SEQ ID NO: 188825 - DNA, 39 bp, Artificial Sequence
  Description of Artificial Sequence: Synthetic oligonucleotide
actgataaagaaaagcccatctgatgtaaaacctctccc

SEQ ID NO: 188826 - DNA, 38 bp, Artificial Sequence
  Description of Artificial Sequence: Synthetic oligonucleotide
ctgataaagaaaagcccatctgatgtaaaacctctccc

SEQ ID NO: 188827 - DNA, 38 bp, Artificial Sequence
  Description of Artificial Sequence: Synthetic oligonucleotide
tgataaagaaaagcccatctgatgtaaaacctctcccc

SEQ ID NO: 188828 - DNA, 37 bp, Artificial Sequence
  Description of Artificial Sequence: Synthetic oligonucleotide
gataaagaaaagcccatctgatgtaaaacctctcccc

SEQ ID NO: 188829 - DNA, 38 bp, Artificial Sequence
  Description of Artificial Sequence: Synthetic oligonucleotide
ataaagaaaagcccatctgatgtaaaacctctcccctc

SEQ ID NO: 188830 - DNA, 37 bp, Artificial Sequence
  Description of Artificial Sequence: Synthetic oligonucleotide
taaagaaaagcccatctgatgtaaaacctctcccctc

SEQ ID NO: 188831 - DNA, 36 bp, Artificial Sequence
  Description of Artificial Sequence: Synthetic oligonucleotide
aaagaaaagcccatctgatgtaaaacctctcccctc

SEQ ID NO: 188832 - DNA, 35 bp, Artificial Sequence
  Description of Artificial Sequence: Synthetic oligonucleotide
aagaaaagcccatctgatgtaaaacctctcccctc

SEQ ID NO: 188833 - DNA, 34 bp, Artificial Sequence
  Description of Artificial Sequence: Synthetic oligonucleotide
agaaaagcccatctgatgtaaaacctctcccctc

SEQ ID NO: 188834 - DNA, 33 bp, Artificial Sequence
  Description of Artificial Sequence: Synthetic oligonucleotide
gaaaagcccatctgatgtaaaacctctcccctc

SEQ ID NO: 188835 - DNA, 34 bp, Artificial Sequence
  Description of Artificial Sequence: Synthetic oligonucleotide
aaaagcccatctgatgtaaaacctctcccctcac

SEQ ID NO: 188836 - DNA, 33 bp, Artificial Sequence
  Description of Artificial Sequence: Synthetic oligonucleotide
aaagcccatctgatgtaaaacctctcccctcac

SEQ ID NO: 188837 - DNA, 32 bp, Artificial Sequence
  Description of Artificial Sequence: Synthetic oligonucleotide
aagcccatctgatgtaaaacctctcccctcac

SEQ ID NO: 188838 - DNA, 31 bp, Artificial Sequence
  Description of Artificial Sequence: Synthetic oligonucleotide
agcccatctgatgtaaaacctctcccctcac

SEQ ID NO: 188839 - DNA, 30 bp, Artificial Sequence
  Description of Artificial Sequence: Synthetic oligonucleotide
gcccatctgatgtaaaacctctcccctcac

SEQ ID NO: 188840 - DNA, 30 bp, Artificial Sequence
  Description of Artificial Sequence: Synthetic oligonucleotide
cccatctgatgtaaaacctctcccctcacc

SEQ ID NO: 188841 - DNA, 31 bp, Artificial Sequence
  Description of Artificial Sequence: Synthetic oligonucleotide
ccatctgatgtaaaacctctcccctcacctg

SEQ ID NO: 188842 - DNA, 32 bp, Artificial Sequence
  Description of Artificial Sequence: Synthetic oligonucleotide
catctgatgtaaaacctctcccctcacctgac

SEQ ID NO: 188843 - DNA, 33 bp, Artificial Sequence
  Description of Artificial Sequence: Synthetic oligonucleotide
atctgatgtaaaacctctcccctcacctgacac

SEQ ID NO: 188844 - DNA, 32 bp, Artificial Sequence
  Description of Artificial Sequence: Synthetic oligonucleotide
tctgatgtaaaacctctcccctcacctgacac

SEQ ID NO: 188845 - DNA, 31 bp, Artificial Sequence
  Description of Artificial Sequence: Synthetic oligonucleotide
ctgatgtaaaacctctcccctcacctgacac

SEQ ID NO: 188846 - DNA, 32 bp, Artificial Sequence
  Description of Artificial Sequence: Synthetic oligonucleotide
tgatgtaaaacctctcccctcacctgacacag

SEQ ID NO: 188847 - DNA, 31 bp, Artificial Sequence
  Description of Artificial Sequence: Synthetic oligonucleotide
gatgtaaaacctctcccctcacctgacacag

SEQ ID NO: 188848 - DNA, 32 bp, Artificial Sequence
  Description of Artificial Sequence: Synthetic oligonucleotide
atgtaaaacctctcccctcacctgacacagac

SEQ ID NO: 188849 - DNA, 31 bp, Artificial Sequence
  Description of Artificial Sequence: Synthetic oligonucleotide
tgtaaaacctctcccctcacctgacacagac

SEQ ID NO: 188850 - DNA, 30 bp, Artificial Sequence
  Description of Artificial Sequence: Synthetic oligonucleotide
gtaaaacctctcccctcacctgacacagac

SEQ ID NO: 188851 - DNA, 30 bp, Artificial Sequence
  Description of Artificial Sequence: Synthetic oligonucleotide
taaaacctctcccctcacctgacacagacg

SEQ ID NO: 188852 - DNA, 29 bp, Artificial Sequence
  Description of Artificial Sequence: Synthetic oligonucleotide
aaaacctctcccctcacctgacacagacg

SEQ ID NO: 188853 - DNA, 28 bp, Artificial Sequence
  Description of Artificial Sequence: Synthetic oligonucleotide
aaacctctcccctcacctgacacagacg

SEQ ID NO: 188854 - DNA, 27 bp, Artificial Sequence
  Description of Artificial Sequence: Synthetic oligonucleotide
aacctctcccctcacctgacacagacg

SEQ ID NO: 188855 - DNA, 27 bp, Artificial Sequence
  Description of Artificial Sequence: Synthetic oligonucleotide
acctctcccctcacctgacacagacgt

SEQ ID NO: 188856 - DNA, 26 bp, Artificial Sequence
  Description of Artificial Sequence: Synthetic oligonucleotide
cctctcccctcacctgacacagacgt

SEQ ID NO: 188857 - DNA, 26 bp, Artificial Sequence
  Description of Artificial Sequence: Synthetic oligonucleotide
ctctcccctcacctgacacagacgtg

SEQ ID NO: 188858 - DNA, 26 bp, Artificial Sequence
  Description of Artificial Sequence: Synthetic oligonucleotide
tctcccctcacctgacacagacgtgc

SEQ ID NO: 188859 - DNA, 25 bp, Artificial Sequence
  Description of Artificial Sequence: Synthetic oligonucleotide
ctcccctcacctgacacagacgtgc

SEQ ID NO: 188860 - DNA, 27 bp, Artificial Sequence
  Description of Artificial Sequence: Synthetic oligonucleotide
tcccctcacctgacacagacgtgcctt

SEQ ID NO: 188861 - DNA, 27 bp, Artificial Sequence
  Description of Artificial Sequence: Synthetic oligonucleotide
cccctcacctgacacagacgtgccttt

SEQ ID NO: 188862 - DNA, 29 bp, Artificial Sequence
  Description of Artificial Sequence: Synthetic oligonucleotide
ccctcacctgacacagacgtgcctttaag

SEQ ID NO: 188863 - DNA, 31 bp, Artificial Sequence
  Description of Artificial Sequence: Synthetic oligonucleotide
cctcacctgacacagacgtgcctttaagttc

SEQ ID NO: 188864 - DNA, 32 bp, Artificial Sequence
  Description of Artificial Sequence: Synthetic oligonucleotide
ctcacctgacacagacgtgcctttaagttctg

SEQ ID NO: 188865 - DNA, 34 bp, Artificial Sequence
  Description of Artificial Sequence: Synthetic oligonucleotide
tcacctgacacagacgtgcctttaagttctgttg

SEQ ID NO: 188866 - DNA, 33 bp, Artificial Sequence
  Description of Artificial Sequence: Synthetic oligonucleotide
cacctgacacagacgtgcctttaagttctgttg

SEQ ID NO: 188867 - DNA, 38 bp, Artificial Sequence
  Description of Artificial Sequence: Synthetic oligonucleotide
acctgacacagacgtgcctttaagttctgttgaaatag

SEQ ID NO: 188868 - DNA, 37 bp, Artificial Sequence
  Description of Artificial Sequence: Synthetic oligonucleotide
cctgacacagacgtgcctttaagttctgttgaaatag

SEQ ID NO: 188869 - DNA, 42 bp, Artificial Sequence
  Description of Artificial Sequence: Synthetic oligonucleotide
ctgacacagacgtgcctttaagttctgttgaaatagaaaatc

SEQ ID NO: 188870 - DNA, 42 bp, Artificial Sequence
  Description of Artificial Sequence: Synthetic oligonucleotide
tgacacagacgtgcctttaagttctgttgaaatagaaaatcc

SEQ ID NO: 188871 - DNA, 41 bp, Artificial Sequence
  Description of Artificial Sequence: Synthetic oligonucleotide
gacacagacgtgcctttaagttctgttgaaatagaaaatcc

SEQ ID NO: 188872 - DNA, 42 bp, Artificial Sequence
  Description of Artificial Sequence: Synthetic oligonucleotide
acacagacgtgcctttaagttctgttgaaatagaaaatccag

SEQ ID NO: 188873 - DNA, 41 bp, Artificial Sequence
  Description of Artificial Sequence: Synthetic oligonucleotide
cacagacgtgcctttaagttctgttgaaatagaaaatccag

SEQ ID NO: 188874 - DNA, 42 bp, Artificial Sequence
  Description of Artificial Sequence: Synthetic oligonucleotide
acagacgtgcctttaagttctgttgaaatagaaaatccagag

SEQ ID NO: 188875 - DNA, 41 bp, Artificial Sequence
  Description of Artificial Sequence: Synthetic oligonucleotide
cagacgtgcctttaagttctgttgaaatagaaaatccagag

SEQ ID NO: 188876 - DNA, 42 bp, Artificial Sequence
  Description of Artificial Sequence: Synthetic oligonucleotide
agacgtgcctttaagttctgttgaaatagaaaatccagagac

SEQ ID NO: 188877 - DNA, 41 bp, Artificial Sequence
  Description of Artificial Sequence: Synthetic oligonucleotide
gacgtgcctttaagttctgttgaaatagaaaatccagagac

SEQ ID NO: 188878 - DNA, 43 bp, Artificial Sequence
  Description of Artificial Sequence: Synthetic oligonucleotide
acgtgcctttaagttctgttgaaatagaaaatccagagacaag

SEQ ID NO: 188879 - DNA, 42 bp, Artificial Sequence
  Description of Artificial Sequence: Synthetic oligonucleotide
cgtgcctttaagttctgttgaaatagaaaatccagagacaag

SEQ ID NO: 188880 - DNA, 43 bp, Artificial Sequence
  Description of Artificial Sequence: Synthetic oligonucleotide
gtgcctttaagttctgttgaaatagaaaatccagagacaagtg

SEQ ID NO: 188881 - DNA, 45 bp, Artificial Sequence
  Description of Artificial Sequence: Synthetic oligonucleotide
tgcctttaagttctgttgaaatagaaaatccagagacaagtgatc

SEQ ID NO: 188882 - DNA, 44 bp, Artificial Sequence
  Description of Artificial Sequence: Synthetic oligonucleotide
gcctttaagttctgttgaaatagaaaatccagagacaagtgatc

SEQ ID NO: 188883 - DNA, 47 bp, Artificial Sequence
  Description of Artificial Sequence: Synthetic oligonucleotide
cctttaagttctgttgaaatagaaaatccagagacaagtgatcaatg

SEQ ID NO: 188884 - DNA, 55 bp, Artificial Sequence
  Description of Artificial Sequence: Synthetic oligonucleotide
atgtatggaaaaataatctttgtattactattgtcagcaattgtgagcatatcag

SEQ ID NO: 188885 - DNA, 54 bp, Artificial Sequence
  Description of Artificial Sequence: Synthetic oligonucleotide
tgtatggaaaaataatctttgtattactattgtcagcaattgtgagcatatcag

SEQ ID NO: 188886 - DNA, 53 bp, Artificial Sequence
  Description of Artificial Sequence: Synthetic oligonucleotide
gtatggaaaaataatctttgtattactattgtcagcaattgtgagcatatcag

SEQ ID NO: 188887 - DNA, 53 bp, Artificial Sequence
  Description of Artificial Sequence: Synthetic oligonucleotide
tatggaaaaataatctttgtattactattgtcagcaattgtgagcatatcagc

SEQ ID NO: 188888 - DNA, 52 bp, Artificial Sequence
  Description of Artificial Sequence: Synthetic oligonucleotide
atggaaaaataatctttgtattactattgtcagcaattgtgagcatatcagc

SEQ ID NO: 188889 - DNA, 51 bp, Artificial Sequence
  Description of Artificial Sequence: Synthetic oligonucleotide
tggaaaaataatctttgtattactattgtcagcaattgtgagcatatcagc

SEQ ID NO: 188890 - DNA, 50 bp, Artificial Sequence
  Description of Artificial Sequence: Synthetic oligonucleotide
ggaaaaataatctttgtattactattgtcagcaattgtgagcatatcagc

SEQ ID NO: 188891 - DNA, 52 bp, Artificial Sequence
  Description of Artificial Sequence: Synthetic oligonucleotide
gaaaaataatctttgtattactattgtcagcaattgtgagcatatcagcatc

SEQ ID NO: 188892 - DNA, 54 bp, Artificial Sequence
  Description of Artificial Sequence: Synthetic oligonucleotide
aaaaataatctttgtattactattgtcagcaattgtgagcatatcagcatcaag

SEQ ID NO: 188893 - DNA, 53 bp, Artificial Sequence
  Description of Artificial Sequence: Synthetic oligonucleotide
aaaataatctttgtattactattgtcagcaattgtgagcatatcagcatcaag

SEQ ID NO: 188894 - DNA, 52 bp, Artificial Sequence
  Description of Artificial Sequence: Synthetic oligonucleotide
aaataatctttgtattactattgtcagcaattgtgagcatatcagcatcaag

SEQ ID NO: 188895 - DNA, 51 bp, Artificial Sequence
  Description of Artificial Sequence: Synthetic oligonucleotide
aataatctttgtattactattgtcagcaattgtgagcatatcagcatcaag

SEQ ID NO: 188896 - DNA, 50 bp, Artificial Sequence
  Description of Artificial Sequence: Synthetic oligonucleotide
ataatctttgtattactattgtcagcaattgtgagcatatcagcatcaag

SEQ ID NO: 188897 - DNA, 49 bp, Artificial Sequence
  Description of Artificial Sequence: Synthetic oligonucleotide
taatctttgtattactattgtcagcaattgtgagcatatcagcatcaag

SEQ ID NO: 188898 - DNA, 48 bp, Artificial Sequence
  Description of Artificial Sequence: Synthetic oligonucleotide
aatctttgtattactattgtcagcaattgtgagcatatcagcatcaag

SEQ ID NO: 188899 - DNA, 47 bp, Artificial Sequence
  Description of Artificial Sequence: Synthetic oligonucleotide
atctttgtattactattgtcagcaattgtgagcatatcagcatcaag

SEQ ID NO: 188900 - DNA, 46 bp, Artificial Sequence
  Description of Artificial Sequence: Synthetic oligonucleotide
tctttgtattactattgtcagcaattgtgagcatatcagcatcaag

SEQ ID NO: 188901 - DNA, 45 bp, Artificial Sequence
  Description of Artificial Sequence: Synthetic oligonucleotide
ctttgtattactattgtcagcaattgtgagcatatcagcatcaag

SEQ ID NO: 188902 - DNA, 47 bp, Artificial Sequence
  Description of Artificial Sequence: Synthetic oligonucleotide
tttgtattactattgtcagcaattgtgagcatatcagcatcaagtac

SEQ ID NO: 188903 - DNA, 46 bp, Artificial Sequence
  Description of Artificial Sequence: Synthetic oligonucleotide
ttgtattactattgtcagcaattgtgagcatatcagcatcaagtac

SEQ ID NO: 188904 - DNA, 45 bp, Artificial Sequence
  Description of Artificial Sequence: Synthetic oligonucleotide
tgtattactattgtcagcaattgtgagcatatcagcatcaagtac

SEQ ID NO: 188905 - DNA, 44 bp, Artificial Sequence
  Description of Artificial Sequence: Synthetic oligonucleotide
gtattactattgtcagcaattgtgagcatatcagcatcaagtac

SEQ ID NO: 188906 - DNA, 44 bp, Artificial Sequence
  Description of Artificial Sequence: Synthetic oligonucleotide
tattactattgtcagcaattgtgagcatatcagcatcaagtacc

SEQ ID NO: 188907 - DNA, 43 bp, Artificial Sequence
  Description of Artificial Sequence: Synthetic oligonucleotide
attactattgtcagcaattgtgagcatatcagcatcaagtacc

SEQ ID NO: 188908 - DNA, 42 bp, Artificial Sequence
  Description of Artificial Sequence: Synthetic oligonucleotide
ttactattgtcagcaattgtgagcatatcagcatcaagtacc

SEQ ID NO: 188909 - DNA, 41 bp, Artificial Sequence
  Description of Artificial Sequence: Synthetic oligonucleotide
tactattgtcagcaattgtgagcatatcagcatcaagtacc

SEQ ID NO: 188910 - DNA, 40 bp, Artificial Sequence
  Description of Artificial Sequence: Synthetic oligonucleotide
actattgtcagcaattgtgagcatatcagcatcaagtacc

SEQ ID NO: 188911 - DNA, 39 bp, Artificial Sequence
  Description of Artificial Sequence: Synthetic oligonucleotide
ctattgtcagcaattgtgagcatatcagcatcaagtacc

SEQ ID NO: 188912 - DNA, 40 bp, Artificial Sequence
  Description of Artificial Sequence: Synthetic oligonucleotide
tattgtcagcaattgtgagcatatcagcatcaagtaccac

SEQ ID NO: 188913 - DNA, 39 bp, Artificial Sequence
  Description of Artificial Sequence: Synthetic oligonucleotide
attgtcagcaattgtgagcatatcagcatcaagtaccac

SEQ ID NO: 188914 - DNA, 38 bp, Artificial Sequence
  Description of Artificial Sequence: Synthetic oligonucleotide
ttgtcagcaattgtgagcatatcagcatcaagtaccac

SEQ ID NO: 188915 - DNA, 37 bp, Artificial Sequence
  Description of Artificial Sequence: Synthetic oligonucleotide
tgtcagcaattgtgagcatatcagcatcaagtaccac

SEQ ID NO: 188916 - DNA, 36 bp, Artificial Sequence
  Description of Artificial Sequence: Synthetic oligonucleotide
gtcagcaattgtgagcatatcagcatcaagtaccac

SEQ ID NO: 188917 - DNA, 37 bp, Artificial Sequence
  Description of Artificial Sequence: Synthetic oligonucleotide
tcagcaattgtgagcatatcagcatcaagtaccactg

SEQ ID NO: 188918 - DNA, 36 bp, Artificial Sequence
  Description of Artificial Sequence: Synthetic oligonucleotide
cagcaattgtgagcatatcagcatcaagtaccactg

SEQ ID NO: 188919 - DNA, 36 bp, Artificial Sequence
  Description of Artificial Sequence: Synthetic oligonucleotide
agcaattgtgagcatatcagcatcaagtaccactgg

SEQ ID NO: 188920 - DNA, 35 bp, Artificial Sequence
  Description of Artificial Sequence: Synthetic oligonucleotide
gcaattgtgagcatatcagcatcaagtaccactgg

SEQ ID NO: 188921 - DNA, 36 bp, Artificial Sequence
  Description of Artificial Sequence: Synthetic oligonucleotide
caattgtgagcatatcagcatcaagtaccactggtg

SEQ ID NO: 188922 - DNA, 37 bp, Artificial Sequence
  Description of Artificial Sequence: Synthetic oligonucleotide
aattgtgagcatatcagcatcaagtaccactggtgtg

SEQ ID NO: 188923 - DNA, 36 bp, Artificial Sequence
  Description of Artificial Sequence: Synthetic oligonucleotide
attgtgagcatatcagcatcaagtaccactggtgtg

SEQ ID NO: 188924 - DNA, 35 bp, Artificial Sequence
  Description of Artificial Sequence: Synthetic oligonucleotide
ttgtgagcatatcagcatcaagtaccactggtgtg

SEQ ID NO: 188925 - DNA, 34 bp, Artificial Sequence
  Description of Artificial Sequence: Synthetic oligonucleotide
tgtgagcatatcagcatcaagtaccactggtgtg

SEQ ID NO: 188926 - DNA, 33 bp, Artificial Sequence
  Description of Artificial Sequence: Synthetic oligonucleotide
gtgagcatatcagcatcaagtaccactggtgtg

SEQ ID NO: 188927 - DNA, 33 bp, Artificial Sequence
  Description of Artificial Sequence: Synthetic oligonucleotide
tgagcatatcagcatcaagtaccactggtgtgg

SEQ ID NO: 188928 - DNA, 32 bp, Artificial Sequence
  Description of Artificial Sequence: Synthetic oligonucleotide
gagcatatcagcatcaagtaccactggtgtgg

SEQ ID NO: 188929 - DNA, 32 bp, Artificial Sequence
  Description of Artificial Sequence: Synthetic oligonucleotide
agcatatcagcatcaagtaccactggtgtggc

SEQ ID NO: 188930 - DNA, 31 bp, Artificial Sequence
  Description of Artificial Sequence: Synthetic oligonucleotide
gcatatcagcatcaagtaccactggtgtggc

SEQ ID NO: 188931 - DNA, 34 bp, Artificial Sequence
  Description of Artificial Sequence: Synthetic oligonucleotide
catatcagcatcaagtaccactggtgtggcaatg

SEQ ID NO: 188932 - DNA, 34 bp, Artificial Sequence
  Description of Artificial Sequence: Synthetic oligonucleotide
atatcagcatcaagtaccactggtgtggcaatgc

SEQ ID NO: 188933 - DNA, 33 bp, Artificial Sequence
  Description of Artificial Sequence: Synthetic oligonucleotide
tatcagcatcaagtaccactggtgtggcaatgc

SEQ ID NO: 188934 - DNA, 32 bp, Artificial Sequence
  Description of Artificial Sequence: Synthetic oligonucleotide
atcagcatcaagtaccactggtgtggcaatgc

SEQ ID NO: 188935 - DNA, 31 bp, Artificial Sequence
  Description of Artificial Sequence: Synthetic oligonucleotide
tcagcatcaagtaccactggtgtggcaatgc

SEQ ID NO: 188936 - DNA, 30 bp, Artificial Sequence
  Description of Artificial Sequence: Synthetic oligonucleotide
cagcatcaagtaccactggtgtggcaatgc

SEQ ID NO: 188937 - DNA, 31 bp, Artificial Sequence
  Description of Artificial Sequence: Synthetic oligonucleotide
agcatcaagtaccactggtgtggcaatgcac

SEQ ID NO: 188938 - DNA, 30 bp, Artificial Sequence
  Description of Artificial Sequence: Synthetic oligonucleotide
gcatcaagtaccactggtgtggcaatgcac

SEQ ID NO: 188939 - DNA, 31 bp, Artificial Sequence
  Description of Artificial Sequence: Synthetic oligonucleotide
catcaagtaccactggtgtggcaatgcacac

SEQ ID NO: 188940 - DNA, 33 bp, Artificial Sequence
  Description of Artificial Sequence: Synthetic oligonucleotide
atcaagtaccactggtgtggcaatgcacacttc

SEQ ID NO: 188941 - DNA, 32 bp, Artificial Sequence
  Description of Artificial Sequence: Synthetic oligonucleotide
tcaagtaccactggtgtggcaatgcacacttc

SEQ ID NO: 188942 - DNA, 31 bp, Artificial Sequence
  Description of Artificial Sequence: Synthetic oligonucleotide
caagtaccactggtgtggcaatgcacacttc

SEQ ID NO: 188943 - DNA, 33 bp, Artificial Sequence
  Description of Artificial Sequence: Synthetic oligonucleotide
aagtaccactggtgtggcaatgcacacttcaac

SEQ ID NO: 188944 - DNA, 32 bp, Artificial Sequence
  Description of Artificial Sequence: Synthetic oligonucleotide
agtaccactggtgtggcaatgcacacttcaac

SEQ ID NO: 188945 - DNA, 31 bp, Artificial Sequence
  Description of Artificial Sequence: Synthetic oligonucleotide
gtaccactggtgtggcaatgcacacttcaac

SEQ ID NO: 188946 - DNA, 31 bp, Artificial Sequence
  Description of Artificial Sequence: Synthetic oligonucleotide
taccactggtgtggcaatgcacacttcaacc

SEQ ID NO: 188947 - DNA, 30 bp, Artificial Sequence
  Description of Artificial Sequence: Synthetic oligonucleotide
accactggtgtggcaatgcacacttcaacc

SEQ ID NO: 188948 - DNA, 29 bp, Artificial Sequence
  Description of Artificial Sequence: Synthetic oligonucleotide
ccactggtgtggcaatgcacacttcaacc

SEQ ID NO: 188949 - DNA, 30 bp, Artificial Sequence
  Description of Artificial Sequence: Synthetic oligonucleotide
cactggtgtggcaatgcacacttcaacctc

SEQ ID NO: 188950 - DNA, 32 bp, Artificial Sequence
  Description of Artificial Sequence: Synthetic oligonucleotide
actggtgtggcaatgcacacttcaacctcttc

SEQ ID NO: 188951 - DNA, 31 bp, Artificial Sequence
  Description of Artificial Sequence: Synthetic oligonucleotide
ctggtgtggcaatgcacacttcaacctcttc

SEQ ID NO: 188952 - DNA, 33 bp, Artificial Sequence
  Description of Artificial Sequence: Synthetic oligonucleotide
tggtgtggcaatgcacacttcaacctcttcttc

SEQ ID NO: 188953 - DNA, 32 bp, Artificial Sequence
  Description of Artificial Sequence: Synthetic oligonucleotide
ggtgtggcaatgcacacttcaacctcttcttc

SEQ ID NO: 188954 - DNA, 33 bp, Artificial Sequence
  Description of Artificial Sequence: Synthetic oligonucleotide
gtgtggcaatgcacacttcaacctcttcttcag

SEQ ID NO: 188955 - DNA, 34 bp, Artificial Sequence
  Description of Artificial Sequence: Synthetic oligonucleotide
tgtggcaatgcacacttcaacctcttcttcagtc

SEQ ID NO: 188956 - DNA, 33 bp, Artificial Sequence
  Description of Artificial Sequence: Synthetic oligonucleotide
gtggcaatgcacacttcaacctcttcttcagtc

SEQ ID NO: 188957 - DNA, 34 bp, Artificial Sequence
  Description of Artificial Sequence: Synthetic oligonucleotide
tggcaatgcacacttcaacctcttcttcagtcac

SEQ ID NO: 188958 - DNA, 33 bp, Artificial Sequence
  Description of Artificial Sequence: Synthetic oligonucleotide
ggcaatgcacacttcaacctcttcttcagtcac

SEQ ID NO: 188959 - DNA, 36 bp, Artificial Sequence
  Description of Artificial Sequence: Synthetic oligonucleotide
gcaatgcacacttcaacctcttcttcagtcacaaag

SEQ ID NO: 188960 - DNA, 37 bp, Artificial Sequence
  Description of Artificial Sequence: Synthetic oligonucleotide
caatgcacacttcaacctcttcttcagtcacaaagag

SEQ ID NO: 188961 - DNA, 40 bp, Artificial Sequence
  Description of Artificial Sequence: Synthetic oligonucleotide
aatgcacacttcaacctcttcttcagtcacaaagagttac

SEQ ID NO: 188962 - DNA, 39 bp, Artificial Sequence
  Description of Artificial Sequence: Synthetic oligonucleotide
atgcacacttcaacctcttcttcagtcacaaagagttac

SEQ ID NO: 188963 - DNA, 38 bp, Artificial Sequence
  Description of Artificial Sequence: Synthetic oligonucleotide
tgcacacttcaacctcttcttcagtcacaaagagttac

SEQ ID NO: 188964 - DNA, 37 bp, Artificial Sequence
  Description of Artificial Sequence: Synthetic oligonucleotide
gcacacttcaacctcttcttcagtcacaaagagttac

SEQ ID NO: 188965 - DNA, 39 bp, Artificial Sequence
  Description of Artificial Sequence: Synthetic oligonucleotide
cacacttcaacctcttcttcagtcacaaagagttacatc

SEQ ID NO: 188966 - DNA, 40 bp, Artificial Sequence
  Description of Artificial Sequence: Synthetic oligonucleotide
acacttcaacctcttcttcagtcacaaagagttacatctc

SEQ ID NO: 188967 - DNA, 39 bp, Artificial Sequence
  Description of Artificial Sequence: Synthetic oligonucleotide
cacttcaacctcttcttcagtcacaaagagttacatctc

SEQ ID NO: 188968 - DNA, 41 bp, Artificial Sequence
  Description of Artificial Sequence: Synthetic oligonucleotide
acttcaacctcttcttcagtcacaaagagttacatctcatc

SEQ ID NO: 188969 - DNA, 40 bp, Artificial Sequence
  Description of Artificial Sequence: Synthetic oligonucleotide
cttcaacctcttcttcagtcacaaagagttacatctcatc

SEQ ID NO: 188970 - DNA, 41 bp, Artificial Sequence
  Description of Artificial Sequence: Synthetic oligonucleotide
ttcaacctcttcttcagtcacaaagagttacatctcatcac

SEQ ID NO: 188971 - DNA, 40 bp, Artificial Sequence
  Description of Artificial Sequence: Synthetic oligonucleotide
tcaacctcttcttcagtcacaaagagttacatctcatcac

SEQ ID NO: 188972 - DNA, 39 bp, Artificial Sequence
  Description of Artificial Sequence: Synthetic oligonucleotide
caacctcttcttcagtcacaaagagttacatctcatcac

SEQ ID NO: 188973 - DNA, 40 bp, Artificial Sequence
  Description of Artificial Sequence: Synthetic oligonucleotide
aacctcttcttcagtcacaaagagttacatctcatcacag

SEQ ID NO: 188974 - DNA, 39 bp, Artificial Sequence
  Description of Artificial Sequence: Synthetic oligonucleotide
acctcttcttcagtcacaaagagttacatctcatcacag

SEQ ID NO: 188975 - DNA, 38 bp, Artificial Sequence
  Description of Artificial Sequence: Synthetic oligonucleotide
cctcttcttcagtcacaaagagttacatctcatcacag

SEQ ID NO: 188976 - DNA, 39 bp, Artificial Sequence
  Description of Artificial Sequence: Synthetic oligonucleotide
ctcttcttcagtcacaaagagttacatctcatcacagac

SEQ ID NO: 188977 - DNA, 39 bp, Artificial Sequence
  Description of Artificial Sequence: Synthetic oligonucleotide
cagccactcctagagctcatgaagtttcagaaatttatg

SEQ ID NO: 188978 - DNA, 42 bp, Artificial Sequence
  Description of Artificial Sequence: Synthetic oligonucleotide
agccactcctagagctcatgaagtttcagaaatttatgttag

SEQ ID NO: 188979 - DNA, 41 bp, Artificial Sequence
  Description of Artificial Sequence: Synthetic oligonucleotide
gccactcctagagctcatgaagtttcagaaatttatgttag

SEQ ID NO: 188980 - DNA, 43 bp, Artificial Sequence
  Description of Artificial Sequence: Synthetic oligonucleotide
ccactcctagagctcatgaagtttcagaaatttatgttagaac

SEQ ID NO: 188981 - DNA, 44 bp, Artificial Sequence
  Description of Artificial Sequence: Synthetic oligonucleotide
cactcctagagctcatgaagtttcagaaatttatgttagaactg

SEQ ID NO: 188982 - DNA, 48 bp, Artificial Sequence
  Description of Artificial Sequence: Synthetic oligonucleotide
actcctagagctcatgaagtttcagaaatttatgttagaactgtttac

SEQ ID NO: 188983 - DNA, 47 bp, Artificial Sequence
  Description of Artificial Sequence: Synthetic oligonucleotide
ctcctagagctcatgaagtttcagaaatttatgttagaactgtttac

SEQ ID NO: 188984 - DNA, 47 bp, Artificial Sequence
  Description of Artificial Sequence: Synthetic oligonucleotide
tcctagagctcatgaagtttcagaaatttatgttagaactgtttacc

SEQ ID NO: 188985 - DNA, 46 bp, Artificial Sequence
  Description of Artificial Sequence: Synthetic oligonucleotide
cctagagctcatgaagtttcagaaatttatgttagaactgtttacc

SEQ ID NO: 188986 - DNA, 46 bp, Artificial Sequence
  Description of Artificial Sequence: Synthetic oligonucleotide
ctagagctcatgaagtttcagaaatttatgttagaactgtttaccc

SEQ ID NO: 188987 - DNA, 47 bp, Artificial Sequence
  Description of Artificial Sequence: Synthetic oligonucleotide
tagagctcatgaagtttcagaaatttatgttagaactgtttaccctc

SEQ ID NO: 188988 - DNA, 46 bp, Artificial Sequence
  Description of Artificial Sequence: Synthetic oligonucleotide
agagctcatgaagtttcagaaatttatgttagaactgtttaccctc

SEQ ID NO: 188989 - DNA, 45 bp, Artificial Sequence
  Description of Artificial Sequence: Synthetic oligonucleotide
gagctcatgaagtttcagaaatttatgttagaactgtttaccctc

SEQ ID NO: 188990 - DNA, 45 bp, Artificial Sequence
  Description of Artificial Sequence: Synthetic oligonucleotide
agctcatgaagtttcagaaatttatgttagaactgtttaccctcc

SEQ ID NO: 188991 - DNA, 44 bp, Artificial Sequence
  Description of Artificial Sequence: Synthetic oligonucleotide
gctcatgaagtttcagaaatttatgttagaactgtttaccctcc

SEQ ID NO: 188992 - DNA, 45 bp, Artificial Sequence
  Description of Artificial Sequence: Synthetic oligonucleotide
ctcatgaagtttcagaaatttatgttagaactgtttaccctccag

SEQ ID NO: 188993 - DNA, 47 bp, Artificial Sequence
  Description of Artificial Sequence: Synthetic oligonucleotide
tcatgaagtttcagaaatttatgttagaactgtttaccctccagaag

SEQ ID NO: 188994 - DNA, 46 bp, Artificial Sequence
  Description of Artificial Sequence: Synthetic oligonucleotide
catgaagtttcagaaatttatgttagaactgtttaccctccagaag

SEQ ID NO: 188995 - DNA, 47 bp, Artificial Sequence
  Description of Artificial Sequence: Synthetic oligonucleotide
atgaagtttcagaaatttatgttagaactgtttaccctccagaagag

SEQ ID NO: 188996 - DNA, 46 bp, Artificial Sequence
  Description of Artificial Sequence: Synthetic oligonucleotide
tgaagtttcagaaatttatgttagaactgtttaccctccagaagag

SEQ ID NO: 188997 - DNA, 45 bp, Artificial Sequence
  Description of Artificial Sequence: Synthetic oligonucleotide
gaagtttcagaaatttatgttagaactgtttaccctccagaagag

SEQ ID NO: 188998 - DNA, 45 bp, Artificial Sequence
  Description of Artificial Sequence: Synthetic oligonucleotide
aagtttcagaaatttatgttagaactgtttaccctccagaagagg

SEQ ID NO: 188999 - DNA, 44 bp, Artificial Sequence
  Description of Artificial Sequence: Synthetic oligonucleotide
agtttcagaaatttatgttagaactgtttaccctccagaagagg

SEQ ID NO: 189000 - DNA, 43 bp, Artificial Sequence
  Description of Artificial Sequence: Synthetic oligonucleotide
gtttcagaaatttatgttagaactgtttaccctccagaagagg

SEQ ID NO: 189001 - DNA, 46 bp, Artificial Sequence
  Description of Artificial Sequence: Synthetic oligonucleotide
tttcagaaatttatgttagaactgtttaccctccagaagaggaaac

SEQ ID NO: 189002 - DNA, 45 bp, Artificial Sequence
  Description of Artificial Sequence: Synthetic oligonucleotide
ttcagaaatttatgttagaactgtttaccctccagaagaggaaac

SEQ ID NO: 189003 - DNA, 44 bp, Artificial Sequence
  Description of Artificial Sequence: Synthetic oligonucleotide
tcagaaatttatgttagaactgtttaccctccagaagaggaaac

SEQ ID NO: 189004 - DNA, 43 bp, Artificial Sequence
  Description of Artificial Sequence: Synthetic oligonucleotide
cagaaatttatgttagaactgtttaccctccagaagaggaaac

SEQ ID NO: 189005 - DNA, 43 bp, Artificial Sequence
  Description of Artificial Sequence: Synthetic oligonucleotide
agaaatttatgttagaactgtttaccctccagaagaggaaacc

SEQ ID NO: 189006 - DNA, 42 bp, Artificial Sequence
  Description of Artificial Sequence: Synthetic oligonucleotide
gaaatttatgttagaactgtttaccctccagaagaggaaacc

SEQ ID NO: 189007 - DNA, 42 bp, Artificial Sequence
  Description of Artificial Sequence: Synthetic oligonucleotide
aaatttatgttagaactgtttaccctccagaagaggaaaccg

SEQ ID NO: 189008 - DNA, 41 bp, Artificial Sequence
  Description of Artificial Sequence: Synthetic oligonucleotide
aatttatgttagaactgtttaccctccagaagaggaaaccg

SEQ ID NO: 189009 - DNA, 40 bp, Artificial Sequence
  Description of Artificial Sequence: Synthetic oligonucleotide
atttatgttagaactgtttaccctccagaagaggaaaccg

SEQ ID NO: 189010 - DNA, 39 bp, Artificial Sequence
  Description of Artificial Sequence: Synthetic oligonucleotide
tttatgttagaactgtttaccctccagaagaggaaaccg

SEQ ID NO: 189011 - DNA, 38 bp, Artificial Sequence
  Description of Artificial Sequence: Synthetic oligonucleotide
ttatgttagaactgtttaccctccagaagaggaaaccg

SEQ ID NO: 189012 - DNA, 37 bp, Artificial Sequence
  Description of Artificial Sequence: Synthetic oligonucleotide
tatgttagaactgtttaccctccagaagaggaaaccg

SEQ ID NO: 189013 - DNA, 36 bp, Artificial Sequence
  Description of Artificial Sequence: Synthetic oligonucleotide
atgttagaactgtttaccctccagaagaggaaaccg

SEQ ID NO: 189014 - DNA, 43 bp, Artificial Sequence
  Description of Artificial Sequence: Synthetic oligonucleotide
agaaatttctgttagaactgtttaccctccagaagaggaaatc

SEQ ID NO: 189015 - DNA, 42 bp, Artificial Sequence
  Description of Artificial Sequence: Synthetic oligonucleotide
gaaatttctgttagaactgtttaccctccagaagaggaaatc

SEQ ID NO: 189016 - DNA, 42 bp, Artificial Sequence
  Description of Artificial Sequence: Synthetic oligonucleotide
aaatttctgttagaactgtttaccctccagaagaggaaatcg

SEQ ID NO: 189017 - DNA, 41 bp, Artificial Sequence
  Description of Artificial Sequence: Synthetic oligonucleotide
aatttctgttagaactgtttaccctccagaagaggaaatcg

SEQ ID NO: 189018 - DNA, 40 bp, Artificial Sequence
  Description of Artificial Sequence: Synthetic oligonucleotide
atttctgttagaactgtttaccctccagaagaggaaatcg

SEQ ID NO: 189019 - DNA, 39 bp, Artificial Sequence
  Description of Artificial Sequence: Synthetic oligonucleotide
tttctgttagaactgtttaccctccagaagaggaaatcg

SEQ ID NO: 189020 - DNA, 38 bp, Artificial Sequence
  Description of Artificial Sequence: Synthetic oligonucleotide
ttctgttagaactgtttaccctccagaagaggaaatcg

SEQ ID NO: 189021 - DNA, 37 bp, Artificial Sequence
  Description of Artificial Sequence: Synthetic oligonucleotide
tctgttagaactgtttaccctccagaagaggaaatcg

SEQ ID NO: 189022 - DNA, 36 bp, Artificial Sequence
  Description of Artificial Sequence: Synthetic oligonucleotide
ctgttagaactgtttaccctccagaagaggaaatcg

SEQ ID NO: 189023 - DNA, 36 bp, Artificial Sequence
  Description of Artificial Sequence: Synthetic oligonucleotide
tgttagaactgtttaccctccagaagaggaaatcgg

SEQ ID NO: 189024 - DNA, 35 bp, Artificial Sequence
  Description of Artificial Sequence: Synthetic oligonucleotide
gttagaactgtttaccctccagaagaggaaatcgg

SEQ ID NO: 189025 - DNA, 36 bp, Artificial Sequence
  Description of Artificial Sequence: Synthetic oligonucleotide
ttagaactgtttaccctccagaagaggaaatcggag

SEQ ID NO: 189026 - DNA, 35 bp, Artificial Sequence
  Description of Artificial Sequence: Synthetic oligonucleotide
tagaactgtttaccctccagaagaggaaatcggag

SEQ ID NO: 189027 - DNA, 34 bp, Artificial Sequence
  Description of Artificial Sequence: Synthetic oligonucleotide
agaactgtttaccctccagaagaggaaatcggag

SEQ ID NO: 189028 - DNA, 33 bp, Artificial Sequence
  Description of Artificial Sequence: Synthetic oligonucleotide
gaactgtttaccctccagaagaggaaatcggag

SEQ ID NO: 189029 - DNA, 36 bp, Artificial Sequence
  Description of Artificial Sequence: Synthetic oligonucleotide
aactgtttaccctccagaagaggaaatcggagaaag

SEQ ID NO: 189030 - DNA, 35 bp, Artificial Sequence
  Description of Artificial Sequence: Synthetic oligonucleotide
actgtttaccctccagaagaggaaatcggagaaag

SEQ ID NO: 189031 - DNA, 34 bp, Artificial Sequence
  Description of Artificial Sequence: Synthetic oligonucleotide
ctgtttaccctccagaagaggaaatcggagaaag

SEQ ID NO: 189032 - DNA, 34 bp, Artificial Sequence
  Description of Artificial Sequence: Synthetic oligonucleotide
tgtttaccctccagaagaggaaatcggagaaagg

SEQ ID NO: 189033 - DNA, 33 bp, Artificial Sequence
  Description of Artificial Sequence: Synthetic oligonucleotide
gtttaccctccagaagaggaaatcggagaaagg

SEQ ID NO: 189034 - DNA, 33 bp, Artificial Sequence
  Description of Artificial Sequence: Synthetic oligonucleotide
tttaccctccagaagaggaaatcggagaaaggg

SEQ ID NO: 189035 - DNA, 32 bp, Artificial Sequence
  Description of Artificial Sequence: Synthetic oligonucleotide
ttaccctccagaagaggaaatcggagaaaggg

SEQ ID NO: 189036 - DNA, 31 bp, Artificial Sequence
  Description of Artificial Sequence: Synthetic oligonucleotide
taccctccagaagaggaaatcggagaaaggg

SEQ ID NO: 189037 - DNA, 30 bp, Artificial Sequence
  Description of Artificial Sequence: Synthetic oligonucleotide
accctccagaagaggaaatcggagaaaggg

SEQ ID NO: 189038 - DNA, 29 bp, Artificial Sequence
  Description of Artificial Sequence: Synthetic oligonucleotide
ccctccagaagaggaaatcggagaaaggg

SEQ ID NO: 189039 - DNA, 31 bp, Artificial Sequence
  Description of Artificial Sequence: Synthetic oligonucleotide
cctccagaagaggaaatcggagaaagggtac

SEQ ID NO: 189040 - DNA, 33 bp, Artificial Sequence
  Description of Artificial Sequence: Synthetic oligonucleotide
ctccagaagaggaaatcggagaaagggtacaac

SEQ ID NO: 189041 - DNA, 35 bp, Artificial Sequence
  Description of Artificial Sequence: Synthetic oligonucleotide
tccagaagaggaaatcggagaaagggtacaacttg

SEQ ID NO: 189042 - DNA, 34 bp, Artificial Sequence
  Description of Artificial Sequence: Synthetic oligonucleotide
ccagaagaggaaatcggagaaagggtacaacttg

SEQ ID NO: 189043 - DNA, 34 bp, Artificial Sequence
  Description of Artificial Sequence: Synthetic oligonucleotide
cagaagaggaaatcggagaaagggtacaacttgc

SEQ ID NO: 189044 - DNA, 34 bp, Artificial Sequence
  Description of Artificial Sequence: Synthetic oligonucleotide
agaagaggaaatcggagaaagggtacaacttgcc

SEQ ID NO: 189045 - DNA, 33 bp, Artificial Sequence
  Description of Artificial Sequence: Synthetic oligonucleotide
gaagaggaaatcggagaaagggtacaacttgcc

SEQ ID NO: 189046 - DNA, 33 bp, Artificial Sequence
  Description of Artificial Sequence: Synthetic oligonucleotide
aagaggaaatcggagaaagggtacaacttgccc

SEQ ID NO: 189047 - DNA, 32 bp, Artificial Sequence
  Description of Artificial Sequence: Synthetic oligonucleotide
agaggaaatcggagaaagggtacaacttgccc

SEQ ID NO: 189048 - DNA, 31 bp, Artificial Sequence
  Description of Artificial Sequence: Synthetic oligonucleotide
gaggaaatcggagaaagggtacaacttgccc

SEQ ID NO: 189049 - DNA, 33 bp, Artificial Sequence
  Description of Artificial Sequence: Synthetic oligonucleotide
aggaaatcggagaaagggtacaacttgcccatc

SEQ ID NO: 189050 - DNA, 32 bp, Artificial Sequence
  Description of Artificial Sequence: Synthetic oligonucleotide
ggaaatcggagaaagggtacaacttgcccatc

SEQ ID NO: 189051 - DNA, 36 bp, Artificial Sequence
  Description of Artificial Sequence: Synthetic oligonucleotide
gaaatcggagaaagggtacaacttgcccatcatttc

SEQ ID NO: 189052 - DNA, 37 bp, Artificial Sequence
  Description of Artificial Sequence: Synthetic oligonucleotide
aaatcggagaaagggtacaacttgcccatcatttctc

SEQ ID NO: 189053 - DNA, 36 bp, Artificial Sequence
  Description of Artificial Sequence: Synthetic oligonucleotide
aatcggagaaagggtacaacttgcccatcatttctc

SEQ ID NO: 189054 - DNA, 35 bp, Artificial Sequence
  Description of Artificial Sequence: Synthetic oligonucleotide
atcggagaaagggtacaacttgcccatcatttctc

SEQ ID NO: 189055 - DNA, 34 bp, Artificial Sequence
  Description of Artificial Sequence: Synthetic oligonucleotide
tcggagaaagggtacaacttgcccatcatttctc

SEQ ID NO: 189056 - DNA, 55 bp, Artificial Sequence
  Description of Artificial Sequence: Synthetic oligonucleotide
gaaaaataatctttgtattactattgtcagcaattgtgagcatatcagcattaag

SEQ ID NO: 189057 - DNA, 57 bp, Artificial Sequence
  Description of Artificial Sequence: Synthetic oligonucleotide
aaaaataatctttgtattactattgtcagcaattgtgagcatatcagcattaagtac

SEQ ID NO: 189058 - DNA, 56 bp, Artificial Sequence
  Description of Artificial Sequence: Synthetic oligonucleotide
aaaataatctttgtattactattgtcagcaattgtgagcatatcagcattaagtac

SEQ ID NO: 189059 - DNA, 55 bp, Artificial Sequence
  Description of Artificial Sequence: Synthetic oligonucleotide
aaataatctttgtattactattgtcagcaattgtgagcatatcagcattaagtac

SEQ ID NO: 189060 - DNA, 54 bp, Artificial Sequence
  Description of Artificial Sequence: Synthetic oligonucleotide
aataatctttgtattactattgtcagcaattgtgagcatatcagcattaagtac

SEQ ID NO: 189061 - DNA, 53 bp, Artificial Sequence
  Description of Artificial Sequence: Synthetic oligonucleotide
ataatctttgtattactattgtcagcaattgtgagcatatcagcattaagtac

SEQ ID NO: 189062 - DNA, 52 bp, Artificial Sequence
  Description of Artificial Sequence: Synthetic oligonucleotide
taatctttgtattactattgtcagcaattgtgagcatatcagcattaagtac

SEQ ID NO: 189063 - DNA, 51 bp, Artificial Sequence
  Description of Artificial Sequence: Synthetic oligonucleotide
aatctttgtattactattgtcagcaattgtgagcatatcagcattaagtac

SEQ ID NO: 189064 - DNA, 50 bp, Artificial Sequence
  Description of Artificial Sequence: Synthetic oligonucleotide
atctttgtattactattgtcagcaattgtgagcatatcagcattaagtac

SEQ ID NO: 189065 - DNA, 49 bp, Artificial Sequence
  Description of Artificial Sequence: Synthetic oligonucleotide
tctttgtattactattgtcagcaattgtgagcatatcagcattaagtac

SEQ ID NO: 189066 - DNA, 48 bp, Artificial Sequence
  Description of Artificial Sequence: Synthetic oligonucleotide
ctttgtattactattgtcagcaattgtgagcatatcagcattaagtac

SEQ ID NO: 189067 - DNA, 48 bp, Artificial Sequence
  Description of Artificial Sequence: Synthetic oligonucleotide
tttgtattactattgtcagcaattgtgagcatatcagcattaagtacc

SEQ ID NO: 189068 - DNA, 47 bp, Artificial Sequence
  Description of Artificial Sequence: Synthetic oligonucleotide
ttgtattactattgtcagcaattgtgagcatatcagcattaagtacc

SEQ ID NO: 189069 - DNA, 46 bp, Artificial Sequence
  Description of Artificial Sequence: Synthetic oligonucleotide
tgtattactattgtcagcaattgtgagcatatcagcattaagtacc

SEQ ID NO: 189070 - DNA, 45 bp, Artificial Sequence
  Description of Artificial Sequence: Synthetic oligonucleotide
gtattactattgtcagcaattgtgagcatatcagcattaagtacc

SEQ ID NO: 189071 - DNA, 46 bp, Artificial Sequence
  Description of Artificial Sequence: Synthetic oligonucleotide
tattactattgtcagcaattgtgagcatatcagcattaagtaccac

SEQ ID NO: 189072 - DNA, 45 bp, Artificial Sequence
  Description of Artificial Sequence: Synthetic oligonucleotide
attactattgtcagcaattgtgagcatatcagcattaagtaccac

SEQ ID NO: 189073 - DNA, 44 bp, Artificial Sequence
  Description of Artificial Sequence: Synthetic oligonucleotide
ttactattgtcagcaattgtgagcatatcagcattaagtaccac

SEQ ID NO: 189074 - DNA, 43 bp, Artificial Sequence
  Description of Artificial Sequence: Synthetic oligonucleotide
tactattgtcagcaattgtgagcatatcagcattaagtaccac

SEQ ID NO: 189075 - DNA, 42 bp, Artificial Sequence
  Description of Artificial Sequence: Synthetic oligonucleotide
actattgtcagcaattgtgagcatatcagcattaagtaccac

SEQ ID NO: 189076 - DNA, 41 bp, Artificial Sequence
  Description of Artificial Sequence: Synthetic oligonucleotide
ctattgtcagcaattgtgagcatatcagcattaagtaccac

SEQ ID NO: 189077 - DNA, 42 bp, Artificial Sequence
  Description of Artificial Sequence: Synthetic oligonucleotide
tattgtcagcaattgtgagcatatcagcattaagtaccactg

SEQ ID NO: 189078 - DNA, 41 bp, Artificial Sequence
  Description of Artificial Sequence: Synthetic oligonucleotide
attgtcagcaattgtgagcatatcagcattaagtaccactg

SEQ ID NO: 189079 - DNA, 40 bp, Artificial Sequence
  Description of Artificial Sequence: Synthetic oligonucleotide
ttgtcagcaattgtgagcatatcagcattaagtaccactg

SEQ ID NO: 189080 - DNA, 39 bp, Artificial Sequence
  Description of Artificial Sequence: Synthetic oligonucleotide
tgtcagcaattgtgagcatatcagcattaagtaccactg

SEQ ID NO: 189081 - DNA, 38 bp, Artificial Sequence
  Description of Artificial Sequence: Synthetic oligonucleotide
gtcagcaattgtgagcatatcagcattaagtaccactg

SEQ ID NO: 189082 - DNA, 39 bp, Artificial Sequence
  Description of Artificial Sequence: Synthetic oligonucleotide
tcagcaattgtgagcatatcagcattaagtaccactgag

SEQ ID NO: 189083 - DNA, 38 bp, Artificial Sequence
  Description of Artificial Sequence: Synthetic oligonucleotide
cagcaattgtgagcatatcagcattaagtaccactgag

SEQ ID NO: 189084 - DNA, 38 bp, Artificial Sequence
  Description of Artificial Sequence: Synthetic oligonucleotide
agcaattgtgagcatatcagcattaagtaccactgagg

SEQ ID NO: 189085 - DNA, 37 bp, Artificial Sequence
  Description of Artificial Sequence: Synthetic oligonucleotide
gcaattgtgagcatatcagcattaagtaccactgagg

SEQ ID NO: 189086 - DNA, 38 bp, Artificial Sequence
  Description of Artificial Sequence: Synthetic oligonucleotide
caattgtgagcatatcagcattaagtaccactgaggtg

SEQ ID NO: 189087 - DNA, 31 bp, Artificial Sequence
  Description of Artificial Sequence: Synthetic oligonucleotide
taccactgaggtggcaatgcacacttcaacc

SEQ ID NO: 189088 - DNA, 30 bp, Artificial Sequence
  Description of Artificial Sequence: Synthetic oligonucleotide
accactgaggtggcaatgcacacttcaacc

SEQ ID NO: 189089 - DNA, 29 bp, Artificial Sequence
  Description of Artificial Sequence: Synthetic oligonucleotide
ccactgaggtggcaatgcacacttcaacc

SEQ ID NO: 189090 - DNA, 30 bp, Artificial Sequence
  Description of Artificial Sequence: Synthetic oligonucleotide
cactgaggtggcaatgcacacttcaacctc

SEQ ID NO: 189091 - DNA, 32 bp, Artificial Sequence
  Description of Artificial Sequence: Synthetic oligonucleotide
actgaggtggcaatgcacacttcaacctcttc

SEQ ID NO: 189092 - DNA, 31 bp, Artificial Sequence
  Description of Artificial Sequence: Synthetic oligonucleotide
ctgaggtggcaatgcacacttcaacctcttc

SEQ ID NO: 189093 - DNA, 33 bp, Artificial Sequence
  Description of Artificial Sequence: Synthetic oligonucleotide
tgaggtggcaatgcacacttcaacctcttcttc

SEQ ID NO: 189094 - DNA, 32 bp, Artificial Sequence
  Description of Artificial Sequence: Synthetic oligonucleotide
gaggtggcaatgcacacttcaacctcttcttc

SEQ ID NO: 189095 - DNA, 33 bp, Artificial Sequence
  Description of Artificial Sequence: Synthetic oligonucleotide
aggtggcaatgcacacttcaacctcttcttcag

SEQ ID NO: 189096 - DNA, 32 bp, Artificial Sequence
  Description of Artificial Sequence: Synthetic oligonucleotide
ggtggcaatgcacacttcaacctcttcttcag

SEQ ID NO: 189097 - DNA, 42 bp, Artificial Sequence
  Description of Artificial Sequence: Synthetic oligonucleotide
ttcttcagtcacaaagagttacatctcatcacagacaaatgg

SEQ ID NO: 189098 - DNA, 41 bp, Artificial Sequence
  Description of Artificial Sequence: Synthetic oligonucleotide
tcttcagtcacaaagagttacatctcatcacagacaaatgg

SEQ ID NO: 189099 - DNA, 40 bp, Artificial Sequence
  Description of Artificial Sequence: Synthetic oligonucleotide
cttcagtcacaaagagttacatctcatcacagacaaatgg

SEQ ID NO: 189100 - DNA, 41 bp, Artificial Sequence
  Description of Artificial Sequence: Synthetic oligonucleotide
ttcagtcacaaagagttacatctcatcacagacaaatggag

SEQ ID NO: 189101 - DNA, 40 bp, Artificial Sequence
  Description of Artificial Sequence: Synthetic oligonucleotide
tcagtcacaaagagttacatctcatcacagacaaatggag

SEQ ID NO: 189102 - DNA, 39 bp, Artificial Sequence
  Description of Artificial Sequence: Synthetic oligonucleotide
cagtcacaaagagttacatctcatcacagacaaatggag

SEQ ID NO: 189103 - DNA, 42 bp, Artificial Sequence
  Description of Artificial Sequence: Synthetic oligonucleotide
agtcacaaagagttacatctcatcacagacaaatggagaaac

SEQ ID NO: 189104 - DNA, 41 bp, Artificial Sequence
  Description of Artificial Sequence: Synthetic oligonucleotide
gtcacaaagagttacatctcatcacagacaaatggagaaac

SEQ ID NO: 189105 - DNA, 41 bp, Artificial Sequence
  Description of Artificial Sequence: Synthetic oligonucleotide
tcacaaagagttacatctcatcacagacaaatggagaaacg

SEQ ID NO: 189106 - DNA, 40 bp, Artificial Sequence
  Description of Artificial Sequence: Synthetic oligonucleotide
cacaaagagttacatctcatcacagacaaatggagaaacg

SEQ ID NO: 189107 - DNA, 40 bp, Artificial Sequence
  Description of Artificial Sequence: Synthetic oligonucleotide
acaaagagttacatctcatcacagacaaatggagaaacgg

SEQ ID NO: 189108 - DNA, 39 bp, Artificial Sequence
  Description of Artificial Sequence: Synthetic oligonucleotide
caaagagttacatctcatcacagacaaatggagaaacgg

SEQ ID NO: 189109 - DNA, 39 bp, Artificial Sequence
  Description of Artificial Sequence: Synthetic oligonucleotide
aaagagttacatctcatcacagacaaatggagaaacggg

SEQ ID NO: 189110 - DNA, 38 bp, Artificial Sequence
  Description of Artificial Sequence: Synthetic oligonucleotide
aagagttacatctcatcacagacaaatggagaaacggg

SEQ ID NO: 189111 - DNA, 37 bp, Artificial Sequence
  Description of Artificial Sequence: Synthetic oligonucleotide
agagttacatctcatcacagacaaatggagaaacggg

SEQ ID NO: 189112 - DNA, 36 bp, Artificial Sequence
  Description of Artificial Sequence: Synthetic oligonucleotide
gagttacatctcatcacagacaaatggagaaacggg

SEQ ID NO: 189113 - DNA, 37 bp, Artificial Sequence
  Description of Artificial Sequence: Synthetic oligonucleotide
agttacatctcatcacagacaaatggagaaacgggac

SEQ ID NO: 189114 - DNA, 36 bp, Artificial Sequence
  Description of Artificial Sequence: Synthetic oligonucleotide
gttacatctcatcacagacaaatggagaaacgggac

SEQ ID NO: 189115 - DNA, 38 bp, Artificial Sequence
  Description of Artificial Sequence: Synthetic oligonucleotide
ttacatctcatcacagacaaatggagaaacgggacaac

SEQ ID NO: 189116 - DNA, 37 bp, Artificial Sequence
  Description of Artificial Sequence: Synthetic oligonucleotide
tacatctcatcacagacaaatggagaaacgggacaac

SEQ ID NO: 189117 - DNA, 36 bp, Artificial Sequence
  Description of Artificial Sequence: Synthetic oligonucleotide
acatctcatcacagacaaatggagaaacgggacaac

SEQ ID NO: 189118 - DNA, 35 bp, Artificial Sequence
  Description of Artificial Sequence: Synthetic oligonucleotide
catctcatcacagacaaatggagaaacgggacaac

SEQ ID NO: 189119 - DNA, 37 bp, Artificial Sequence
  Description of Artificial Sequence: Synthetic oligonucleotide
atctcatcacagacaaatggagaaacgggacaacttg

SEQ ID NO: 189120 - DNA, 36 bp, Artificial Sequence
  Description of Artificial Sequence: Synthetic oligonucleotide
tctcatcacagacaaatggagaaacgggacaacttg

SEQ ID NO: 189121 - DNA, 35 bp, Artificial Sequence
  Description of Artificial Sequence: Synthetic oligonucleotide
ctcatcacagacaaatggagaaacgggacaacttg

SEQ ID NO: 189122 - DNA, 36 bp, Artificial Sequence
  Description of Artificial Sequence: Synthetic oligonucleotide
tcatcacagacaaatggagaaacgggacaacttgtc

SEQ ID NO: 189123 - DNA, 35 bp, Artificial Sequence
  Description of Artificial Sequence: Synthetic oligonucleotide
catcacagacaaatggagaaacgggacaacttgtc

SEQ ID NO: 189124 - DNA, 35 bp, Artificial Sequence
  Description of Artificial Sequence: Synthetic oligonucleotide
atcacagacaaatggagaaacgggacaacttgtcc

SEQ ID NO: 189125 - DNA, 34 bp, Artificial Sequence
  Description of Artificial Sequence: Synthetic oligonucleotide
tcacagacaaatggagaaacgggacaacttgtcc

SEQ ID NO: 189126 - DNA, 33 bp, Artificial Sequence
  Description of Artificial Sequence: Synthetic oligonucleotide
cacagacaaatggagaaacgggacaacttgtcc

SEQ ID NO: 189127 - DNA, 35 bp, Artificial Sequence
  Description of Artificial Sequence: Synthetic oligonucleotide
acagacaaatggagaaacgggacaacttgtccatc

SEQ ID NO: 189128 - DNA, 34 bp, Artificial Sequence
  Description of Artificial Sequence: Synthetic oligonucleotide
cagacaaatggagaaacgggacaacttgtccatc

SEQ ID NO: 189129 - DNA, 34 bp, Artificial Sequence
  Description of Artificial Sequence: Synthetic oligonucleotide
agacaaatggagaaacgggacaacttgtccatcg

SEQ ID NO: 189130 - DNA, 33 bp, Artificial Sequence
  Description of Artificial Sequence: Synthetic oligonucleotide
gacaaatggagaaacgggacaacttgtccatcg

SEQ ID NO: 189131 - DNA, 36 bp, Artificial Sequence
  Description of Artificial Sequence: Synthetic oligonucleotide
acaaatggagaaacgggacaacttgtccatcgtttc

SEQ ID NO: 189132 - DNA, 35 bp, Artificial Sequence
  Description of Artificial Sequence: Synthetic oligonucleotide
caaatggagaaacgggacaacttgtccatcgtttc

SEQ ID NO: 189133 - DNA, 36 bp, Artificial Sequence
  Description of Artificial Sequence: Synthetic oligonucleotide
aaatggagaaacgggacaacttgtccatcgtttcac

SEQ ID NO: 189134 - DNA, 35 bp, Artificial Sequence
  Description of Artificial Sequence: Synthetic oligonucleotide
aatggagaaacgggacaacttgtccatcgtttcac

SEQ ID NO: 189135 - DNA, 34 bp, Artificial Sequence
  Description of Artificial Sequence: Synthetic oligonucleotide
atggagaaacgggacaacttgtccatcgtttcac

SEQ ID NO: 189136 - DNA, 33 bp, Artificial Sequence
  Description of Artificial Sequence: Synthetic oligonucleotide
tggagaaacgggacaacttgtccatcgtttcac

SEQ ID NO: 189137 - DNA, 32 bp, Artificial Sequence
  Description of Artificial Sequence: Synthetic oligonucleotide
ggagaaacgggacaacttgtccatcgtttcac

SEQ ID NO: 189138 - DNA, 33 bp, Artificial Sequence
  Description of Artificial Sequence: Synthetic oligonucleotide
gagaaacgggacaacttgtccatcgtttcactg

SEQ ID NO: 189139 - DNA, 35 bp, Artificial Sequence
  Description of Artificial Sequence: Synthetic oligonucleotide
agaaacgggacaacttgtccatcgtttcactgtac

SEQ ID NO: 189140 - DNA, 34 bp, Artificial Sequence
  Description of Artificial Sequence: Synthetic oligonucleotide
gaaacgggacaacttgtccatcgtttcactgtac

SEQ ID NO: 189141 - DNA, 34 bp, Artificial Sequence
  Description of Artificial Sequence: Synthetic oligonucleotide
aaacgggacaacttgtccatcgtttcactgtacc

SEQ ID NO: 189142 - DNA, 33 bp, Artificial Sequence
  Description of Artificial Sequence: Synthetic oligonucleotide
aacgggacaacttgtccatcgtttcactgtacc

SEQ ID NO: 189143 - DNA, 32 bp, Artificial Sequence
  Description of Artificial Sequence: Synthetic oligonucleotide
acgggacaacttgtccatcgtttcactgtacc

SEQ ID NO: 189144 - DNA, 31 bp, Artificial Sequence
  Description of Artificial Sequence: Synthetic oligonucleotide
cgggacaacttgtccatcgtttcactgtacc

SEQ ID NO: 189145 - DNA, 32 bp, Artificial Sequence
  Description of Artificial Sequence: Synthetic oligonucleotide
gggacaacttgtccatcgtttcactgtaccag

SEQ ID NO: 189146 - DNA, 32 bp, Artificial Sequence
  Description of Artificial Sequence: Synthetic oligonucleotide
ggacaacttgtccatcgtttcactgtaccagc

SEQ ID NO: 189147 - DNA, 33 bp, Artificial Sequence
  Description of Artificial Sequence: Synthetic oligonucleotide
gacaacttgtccatcgtttcactgtaccagctc

SEQ ID NO: 189148 - DNA, 33 bp, Artificial Sequence
  Description of Artificial Sequence: Synthetic oligonucleotide
acaacttgtccatcgtttcactgtaccagctcc

SEQ ID NO: 189149 - DNA, 32 bp, Artificial Sequence
  Description of Artificial Sequence: Synthetic oligonucleotide
caacttgtccatcgtttcactgtaccagctcc

SEQ ID NO: 189150 - DNA, 33 bp, Artificial Sequence
  Description of Artificial Sequence: Synthetic oligonucleotide
aacttgtccatcgtttcactgtaccagctcctg

SEQ ID NO: 189151 - DNA, 32 bp, Artificial Sequence
  Description of Artificial Sequence: Synthetic oligonucleotide
acttgtccatcgtttcactgtaccagctcctg

SEQ ID NO: 189152 - DNA, 31 bp, Artificial Sequence
  Description of Artificial Sequence: Synthetic oligonucleotide
cttgtccatcgtttcactgtaccagctcctg

SEQ ID NO: 189153 - DNA, 33 bp, Artificial Sequence
  Description of Artificial Sequence: Synthetic oligonucleotide
ttgtccatcgtttcactgtaccagctcctgtag

SEQ ID NO: 189154 - DNA, 32 bp, Artificial Sequence
  Description of Artificial Sequence: Synthetic oligonucleotide
tgtccatcgtttcactgtaccagctcctgtag

SEQ ID NO: 189155 - DNA, 31 bp, Artificial Sequence
  Description of Artificial Sequence: Synthetic oligonucleotide
gtccatcgtttcactgtaccagctcctgtag

SEQ ID NO: 189156 - DNA, 32 bp, Artificial Sequence
  Description of Artificial Sequence: Synthetic oligonucleotide
tccatcgtttcactgtaccagctcctgtagtg

SEQ ID NO: 189157 - DNA, 31 bp, Artificial Sequence
  Description of Artificial Sequence: Synthetic oligonucleotide
ccatcgtttcactgtaccagctcctgtagtg

SEQ ID NO: 189158 - DNA, 37 bp, Artificial Sequence
  Description of Artificial Sequence: Synthetic oligonucleotide
catcgtttcactgtaccagctcctgtagtgataatac

SEQ ID NO: 189159 - DNA, 38 bp, Artificial Sequence
  Description of Artificial Sequence: Synthetic oligonucleotide
atcgtttcactgtaccagctcctgtagtgataatactc

SEQ ID NO: 189160 - DNA, 37 bp, Artificial Sequence
  Description of Artificial Sequence: Synthetic oligonucleotide
tcgtttcactgtaccagctcctgtagtgataatactc

SEQ ID NO: 189161 - DNA, 36 bp, Artificial Sequence
  Description of Artificial Sequence: Synthetic oligonucleotide
cgtttcactgtaccagctcctgtagtgataatactc

SEQ ID NO: 189162 - DNA, 44 bp, Artificial Sequence
  Description of Artificial Sequence: Synthetic oligonucleotide
gtttcactgtaccagctcctgtagtgataatactcattattttg

SEQ ID NO: 189163 - DNA, 45 bp, Artificial Sequence
  Description of Artificial Sequence: Synthetic oligonucleotide
tttcactgtaccagctcctgtagtgataatactcattattttgtg

SEQ ID NO: 189164 - DNA, 44 bp, Artificial Sequence
  Description of Artificial Sequence: Synthetic oligonucleotide
ttcactgtaccagctcctgtagtgataatactcattattttgtg

SEQ ID NO: 189165 - DNA, 43 bp, Artificial Sequence
  Description of Artificial Sequence: Synthetic oligonucleotide
tcactgtaccagctcctgtagtgataatactcattattttgtg

SEQ ID NO: 189166 - DNA, 42 bp, Artificial Sequence
  Description of Artificial Sequence: Synthetic oligonucleotide
cactgtaccagctcctgtagtgataatactcattattttgtg

SEQ ID NO: 189167 - DNA, 43 bp, Artificial Sequence
  Description of Artificial Sequence: Synthetic oligonucleotide
actgtaccagctcctgtagtgataatactcattattttgtgtg

SEQ ID NO: 189168 - DNA, 42 bp, Artificial Sequence
  Description of Artificial Sequence: Synthetic oligonucleotide
ctgtaccagctcctgtagtgataatactcattattttgtgtg

SEQ ID NO: 189169 - DNA, 43 bp, Artificial Sequence
  Description of Artificial Sequence: Synthetic oligonucleotide
tgtaccagctcctgtagtgataatactcattattttgtgtgtg

SEQ ID NO: 189170 - DNA, 42 bp, Artificial Sequence
  Description of Artificial Sequence: Synthetic oligonucleotide
gtaccagctcctgtagtgataatactcattattttgtgtgtg

SEQ ID NO: 189171 - DNA, 44 bp, Artificial Sequence
  Description of Artificial Sequence: Synthetic oligonucleotide
taccagctcctgtagtgataatactcattattttgtgtgtgatg

SEQ ID NO: 189172 - DNA, 43 bp, Artificial Sequence
  Description of Artificial Sequence: Synthetic oligonucleotide
accagctcctgtagtgataatactcattattttgtgtgtgatg

SEQ ID NO: 189173 - DNA, 42 bp, Artificial Sequence
  Description of Artificial Sequence: Synthetic oligonucleotide
ccagctcctgtagtgataatactcattattttgtgtgtgatg

SEQ ID NO: 189174 - DNA, 42 bp, Artificial Sequence
  Description of Artificial Sequence: Synthetic oligonucleotide
cagctcctgtagtgataatactcattattttgtgtgtgatgg

SEQ ID NO: 189175 - DNA, 42 bp, Artificial Sequence
  Description of Artificial Sequence: Synthetic oligonucleotide
agctcctgtagtgataatactcattattttgtgtgtgatggc

SEQ ID NO: 189176 - DNA, 41 bp, Artificial Sequence
  Description of Artificial Sequence: Synthetic oligonucleotide
gctcctgtagtgataatactcattattttgtgtgtgatggc

SEQ ID NO: 189177 - DNA, 42 bp, Artificial Sequence
  Description of Artificial Sequence: Synthetic oligonucleotide
ctcctgtagtgataatactcattattttgtgtgtgatggctg

SEQ ID NO: 189178 - DNA, 42 bp, Artificial Sequence
  Description of Artificial Sequence: Synthetic oligonucleotide
tcctgtagtgataatactcattattttgtgtgtgatggctgg

SEQ ID NO: 189179 - DNA, 41 bp, Artificial Sequence
  Description of Artificial Sequence: Synthetic oligonucleotide
cctgtagtgataatactcattattttgtgtgtgatggctgg

SEQ ID NO: 189180 - DNA, 48 bp, Artificial Sequence
  Description of Artificial Sequence: Synthetic oligonucleotide
ctgtagtgataatactcattattttgtgtgtgatggctggtattattg

SEQ ID NO: 189181 - DNA, 48 bp, Artificial Sequence
  Description of Artificial Sequence: Synthetic oligonucleotide
tgtagtgataatactcattattttgtgtgtgatggctggtattattgg

SEQ ID NO: 189182 - DNA, 47 bp, Artificial Sequence
  Description of Artificial Sequence: Synthetic oligonucleotide
gtagtgataatactcattattttgtgtgtgatggctggtattattgg

SEQ ID NO: 189183 - DNA, 49 bp, Artificial Sequence
  Description of Artificial Sequence: Synthetic oligonucleotide
tagtgataatactcattattttgtgtgtgatggctggtattattggaac

SEQ ID NO: 189184 - DNA, 48 bp, Artificial Sequence
  Description of Artificial Sequence: Synthetic oligonucleotide
agtgataatactcattattttgtgtgtgatggctggtattattggaac

SEQ ID NO: 189185 - DNA, 47 bp, Artificial Sequence
  Description of Artificial Sequence: Synthetic oligonucleotide
gtgataatactcattattttgtgtgtgatggctggtattattggaac

SEQ ID NO: 189186 - DNA, 47 bp, Artificial Sequence
  Description of Artificial Sequence: Synthetic oligonucleotide
tgataatactcattattttgtgtgtgatggctggtattattggaacg

SEQ ID NO: 189187 - DNA, 46 bp, Artificial Sequence
  Description of Artificial Sequence: Synthetic oligonucleotide
gataatactcattattttgtgtgtgatggctggtattattggaacg

SEQ ID NO: 189188 - DNA, 48 bp, Artificial Sequence
  Description of Artificial Sequence: Synthetic oligonucleotide
ataatactcattattttgtgtgtgatggctggtattattggaacgatc

SEQ ID NO: 189189 - DNA, 47 bp, Artificial Sequence
  Description of Artificial Sequence: Synthetic oligonucleotide
taatactcattattttgtgtgtgatggctggtattattggaacgatc

SEQ ID NO: 189190 - DNA, 46 bp, Artificial Sequence
  Description of Artificial Sequence: Synthetic oligonucleotide
aatactcattattttgtgtgtgatggctggtattattggaacgatc

SEQ ID NO: 189191 - DNA, 45 bp, Artificial Sequence
  Description of Artificial Sequence: Synthetic oligonucleotide
atactcattattttgtgtgtgatggctggtattattggaacgatc

SEQ ID NO: 189192 - DNA, 44 bp, Artificial Sequence
  Description of Artificial Sequence: Synthetic oligonucleotide
tactcattattttgtgtgtgatggctggtattattggaacgatc

SEQ ID NO: 189193 - DNA, 43 bp, Artificial Sequence
  Description of Artificial Sequence: Synthetic oligonucleotide
actcattattttgtgtgtgatggctggtattattggaacgatc

SEQ ID NO: 189194 - DNA, 42 bp, Artificial Sequence
  Description of Artificial Sequence: Synthetic oligonucleotide
ctcattattttgtgtgtgatggctggtattattggaacgatc

SEQ ID NO: 189195 - DNA, 42 bp, Artificial Sequence
  Description of Artificial Sequence: Synthetic oligonucleotide
tcattattttgtgtgtgatggctggtattattggaacgatcc

SEQ ID NO: 189196 - DNA, 41 bp, Artificial Sequence
  Description of Artificial Sequence: Synthetic oligonucleotide
cattattttgtgtgtgatggctggtattattggaacgatcc

SEQ ID NO: 189197 - DNA, 42 bp, Artificial Sequence
  Description of Artificial Sequence: Synthetic oligonucleotide
attattttgtgtgtgatggctggtattattggaacgatcctc

SEQ ID NO: 189198 - DNA, 41 bp, Artificial Sequence
  Description of Artificial Sequence: Synthetic oligonucleotide
ttattttgtgtgtgatggctggtattattggaacgatcctc

SEQ ID NO: 189199 - DNA, 40 bp, Artificial Sequence
  Description of Artificial Sequence: Synthetic oligonucleotide
tattttgtgtgtgatggctggtattattggaacgatcctc

SEQ ID NO: 189200 - DNA, 39 bp, Artificial Sequence
  Description of Artificial Sequence: Synthetic oligonucleotide
attttgtgtgtgatggctggtattattggaacgatcctc

SEQ ID NO: 189201 - DNA, 38 bp, Artificial Sequence
  Description of Artificial Sequence: Synthetic oligonucleotide
ttttgtgtgtgatggctggtattattggaacgatcctc

SEQ ID NO: 189202 - DNA, 37 bp, Artificial Sequence
  Description of Artificial Sequence: Synthetic oligonucleotide
tttgtgtgtgatggctggtattattggaacgatcctc

SEQ ID NO: 189203 - DNA, 36 bp, Artificial Sequence
  Description of Artificial Sequence: Synthetic oligonucleotide
ttgtgtgtgatggctggtattattggaacgatcctc

SEQ ID NO: 189204 - DNA, 35 bp, Artificial Sequence
  Description of Artificial Sequence: Synthetic oligonucleotide
tgtgtgtgatggctggtattattggaacgatcctc

SEQ ID NO: 189205 - DNA, 34 bp, Artificial Sequence
  Description of Artificial Sequence: Synthetic oligonucleotide
gtgtgtgatggctggtattattggaacgatcctc

SEQ ID NO: 189206 - DNA, 41 bp, Artificial Sequence
  Description of Artificial Sequence: Synthetic oligonucleotide
tgtgtgatggctggtattattggaacgatcctcttaatttc

SEQ ID NO: 189207 - DNA, 40 bp, Artificial Sequence
  Description of Artificial Sequence: Synthetic oligonucleotide
gtgtgatggctggtattattggaacgatcctcttaatttc

SEQ ID NO: 189208 - DNA, 43 bp, Artificial Sequence
  Description of Artificial Sequence: Synthetic oligonucleotide
tgtgatggctggtattattggaacgatcctcttaatttcttac

SEQ ID NO: 189209 - DNA, 42 bp, Artificial Sequence
  Description of Artificial Sequence: Synthetic oligonucleotide
gtgatggctggtattattggaacgatcctcttaatttcttac

SEQ ID NO: 189210 - DNA, 43 bp, Artificial Sequence
  Description of Artificial Sequence: Synthetic oligonucleotide
tgatggctggtattattggaacgatcctcttaatttcttacag

SEQ ID NO: 189211 - DNA, 42 bp, Artificial Sequence
  Description of Artificial Sequence: Synthetic oligonucleotide
gatggctggtattattggaacgatcctcttaatttcttacag

SEQ ID NO: 189212 - DNA, 46 bp, Artificial Sequence
  Description of Artificial Sequence: Synthetic oligonucleotide
atggctggtattattggaacgatcctcttaatttcttacagtattc

SEQ ID NO: 189213 - DNA, 45 bp, Artificial Sequence
  Description of Artificial Sequence: Synthetic oligonucleotide
tggctggtattattggaacgatcctcttaatttcttacagtattc

SEQ ID NO: 189214 - DNA, 44 bp, Artificial Sequence
  Description of Artificial Sequence: Synthetic oligonucleotide
ggctggtattattggaacgatcctcttaatttcttacagtattc

SEQ ID NO: 189215 - DNA, 44 bp, Artificial Sequence
  Description of Artificial Sequence: Synthetic oligonucleotide
gctggtattattggaacgatcctcttaatttcttacagtattcg

SEQ ID NO: 189216 - DNA, 44 bp, Artificial Sequence
  Description of Artificial Sequence: Synthetic oligonucleotide
ctggtattattggaacgatcctcttaatttcttacagtattcgc

SEQ ID NO: 189217 - DNA, 44 bp, Artificial Sequence
  Description of Artificial Sequence: Synthetic oligonucleotide
tggtattattggaacgatcctcttaatttcttacagtattcgcc

SEQ ID NO: 189218 - DNA, 43 bp, Artificial Sequence
  Description of Artificial Sequence: Synthetic oligonucleotide
ggtattattggaacgatcctcttaatttcttacagtattcgcc

SEQ ID NO: 189219 - DNA, 43 bp, Artificial Sequence
  Description of Artificial Sequence: Synthetic oligonucleotide
gtattattggaacgatcctcttaatttcttacagtattcgccg

SEQ ID NO: 189220 - DNA, 44 bp, Artificial Sequence
  Description of Artificial Sequence: Synthetic oligonucleotide
tattattggaacgatcctcttaatttcttacagtattcgccgac

SEQ ID NO: 189221 - DNA, 43 bp, Artificial Sequence
  Description of Artificial Sequence: Synthetic oligonucleotide
attattggaacgatcctcttaatttcttacagtattcgccgac

SEQ ID NO: 189222 - DNA, 42 bp, Artificial Sequence
  Description of Artificial Sequence: Synthetic oligonucleotide
ttattggaacgatcctcttaatttcttacagtattcgccgac

SEQ ID NO: 189223 - DNA, 41 bp, Artificial Sequence
  Description of Artificial Sequence: Synthetic oligonucleotide
tattggaacgatcctcttaatttcttacagtattcgccgac

SEQ ID NO: 189224 - DNA, 40 bp, Artificial Sequence
  Description of Artificial Sequence: Synthetic oligonucleotide
attggaacgatcctcttaatttcttacagtattcgccgac

SEQ ID NO: 189225 - DNA, 39 bp, Artificial Sequence
  Description of Artificial Sequence: Synthetic oligonucleotide
ttggaacgatcctcttaatttcttacagtattcgccgac

SEQ ID NO: 189226 - DNA, 38 bp, Artificial Sequence
  Description of Artificial Sequence: Synthetic oligonucleotide
tggaacgatcctcttaatttcttacagtattcgccgac

SEQ ID NO: 189227 - DNA, 37 bp, Artificial Sequence
  Description of Artificial Sequence: Synthetic oligonucleotide
ggaacgatcctcttaatttcttacagtattcgccgac

SEQ ID NO: 189228 - DNA, 38 bp, Artificial Sequence
  Description of Artificial Sequence: Synthetic oligonucleotide
gaacgatcctcttaatttcttacagtattcgccgactg

SEQ ID NO: 189229 - DNA, 43 bp, Artificial Sequence
  Description of Artificial Sequence: Synthetic oligonucleotide
aacgatcctcttaatttcttacagtattcgccgactgataaag

SEQ ID NO: 189230 - DNA, 43 bp, Artificial Sequence
  Description of Artificial Sequence: Synthetic oligonucleotide
ttcttcagtcacaaagagttacatctcatcacagacaaatgag

SEQ ID NO: 189231 - DNA, 42 bp, Artificial Sequence
  Description of Artificial Sequence: Synthetic oligonucleotide
tcttcagtcacaaagagttacatctcatcacagacaaatgag

SEQ ID NO: 189232 - DNA, 41 bp, Artificial Sequence
  Description of Artificial Sequence: Synthetic oligonucleotide
cttcagtcacaaagagttacatctcatcacagacaaatgag

SEQ ID NO: 189233 - DNA, 45 bp, Artificial Sequence
  Description of Artificial Sequence: Synthetic oligonucleotide
ttcagtcacaaagagttacatctcatcacagacaaatgagataac

SEQ ID NO: 189234 - DNA, 44 bp, Artificial Sequence
  Description of Artificial Sequence: Synthetic oligonucleotide
tcagtcacaaagagttacatctcatcacagacaaatgagataac

SEQ ID NO: 189235 - DNA, 43 bp, Artificial Sequence
  Description of Artificial Sequence: Synthetic oligonucleotide
cagtcacaaagagttacatctcatcacagacaaatgagataac

SEQ ID NO: 189236 - DNA, 44 bp, Artificial Sequence
  Description of Artificial Sequence: Synthetic oligonucleotide
agtcacaaagagttacatctcatcacagacaaatgagataacac

SEQ ID NO: 189237 - DNA, 43 bp, Artificial Sequence
  Description of Artificial Sequence: Synthetic oligonucleotide
gtcacaaagagttacatctcatcacagacaaatgagataacac

SEQ ID NO: 189238 - DNA, 44 bp, Artificial Sequence
  Description of Artificial Sequence: Synthetic oligonucleotide
tcacaaagagttacatctcatcacagacaaatgagataacactc

SEQ ID NO: 189239 - DNA, 43 bp, Artificial Sequence
  Description of Artificial Sequence: Synthetic oligonucleotide
cacaaagagttacatctcatcacagacaaatgagataacactc

SEQ ID NO: 189240 - DNA, 52 bp, Artificial Sequence
  Description of Artificial Sequence: Synthetic oligonucleotide
acaaagagttacatctcatcacagacaaatgagataacactcattatttttg

SEQ ID NO: 189241 - DNA, 51 bp, Artificial Sequence
  Description of Artificial Sequence: Synthetic oligonucleotide
caaagagttacatctcatcacagacaaatgagataacactcattatttttg

SEQ ID NO: 189242 - DNA, 51 bp, Artificial Sequence
  Description of Artificial Sequence: Synthetic oligonucleotide
aaagagttacatctcatcacagacaaatgagataacactcattatttttgg

SEQ ID NO: 189243 - DNA, 50 bp, Artificial Sequence
  Description of Artificial Sequence: Synthetic oligonucleotide
aagagttacatctcatcacagacaaatgagataacactcattatttttgg

SEQ ID NO: 189244 - DNA, 49 bp, Artificial Sequence
  Description of Artificial Sequence: Synthetic oligonucleotide
agagttacatctcatcacagacaaatgagataacactcattatttttgg

SEQ ID NO: 189245 - DNA, 48 bp, Artificial Sequence
  Description of Artificial Sequence: Synthetic oligonucleotide
gagttacatctcatcacagacaaatgagataacactcattatttttgg

SEQ ID NO: 189246 - DNA, 48 bp, Artificial Sequence
  Description of Artificial Sequence: Synthetic oligonucleotide
agttacatctcatcacagacaaatgagataacactcattatttttggg

SEQ ID NO: 189247 - DNA, 47 bp, Artificial Sequence
  Description of Artificial Sequence: Synthetic oligonucleotide
gttacatctcatcacagacaaatgagataacactcattatttttggg

SEQ ID NO: 189248 - DNA, 47 bp, Artificial Sequence
  Description of Artificial Sequence: Synthetic oligonucleotide
ttacatctcatcacagacaaatgagataacactcattatttttgggg

SEQ ID NO: 189249 - DNA, 46 bp, Artificial Sequence
  Description of Artificial Sequence: Synthetic oligonucleotide
tacatctcatcacagacaaatgagataacactcattatttttgggg

SEQ ID NO: 189250 - DNA, 45 bp, Artificial Sequence
  Description of Artificial Sequence: Synthetic oligonucleotide
acatctcatcacagacaaatgagataacactcattatttttgggg

SEQ ID NO: 189251 - DNA, 44 bp, Artificial Sequence
  Description of Artificial Sequence: Synthetic oligonucleotide
catctcatcacagacaaatgagataacactcattatttttgggg

SEQ ID NO: 189252 - DNA, 45 bp, Artificial Sequence
  Description of Artificial Sequence: Synthetic oligonucleotide
atctcatcacagacaaatgagataacactcattatttttggggtg

SEQ ID NO: 189253 - DNA, 44 bp, Artificial Sequence
  Description of Artificial Sequence: Synthetic oligonucleotide
tctcatcacagacaaatgagataacactcattatttttggggtg

SEQ ID NO: 189254 - DNA, 43 bp, Artificial Sequence
  Description of Artificial Sequence: Synthetic oligonucleotide
ctcatcacagacaaatgagataacactcattatttttggggtg

SEQ ID NO: 189255 - DNA, 45 bp, Artificial Sequence
  Description of Artificial Sequence: Synthetic oligonucleotide
tcatcacagacaaatgagataacactcattatttttggggtgatg

SEQ ID NO: 189256 - DNA, 44 bp, Artificial Sequence
  Description of Artificial Sequence: Synthetic oligonucleotide
catcacagacaaatgagataacactcattatttttggggtgatg

SEQ ID NO: 189257 - DNA, 44 bp, Artificial Sequence
  Description of Artificial Sequence: Synthetic oligonucleotide
atcacagacaaatgagataacactcattatttttggggtgatgg

SEQ ID NO: 189258 - DNA, 43 bp, Artificial Sequence
  Description of Artificial Sequence: Synthetic oligonucleotide
tcacagacaaatgagataacactcattatttttggggtgatgg

SEQ ID NO: 189259 - DNA, 42 bp, Artificial Sequence
  Description of Artificial Sequence: Synthetic oligonucleotide
cacagacaaatgagataacactcattatttttggggtgatgg

SEQ ID NO: 189260 - DNA, 42 bp, Artificial Sequence
  Description of Artificial Sequence: Synthetic oligonucleotide
acagacaaatgagataacactcattatttttggggtgatggc

SEQ ID NO: 189261 - DNA, 41 bp, Artificial Sequence
  Description of Artificial Sequence: Synthetic oligonucleotide
cagacaaatgagataacactcattatttttggggtgatggc

SEQ ID NO: 189262 - DNA, 42 bp, Artificial Sequence
  Description of Artificial Sequence: Synthetic oligonucleotide
agacaaatgagataacactcattatttttggggtgatggctg

SEQ ID NO: 189263 - DNA, 41 bp, Artificial Sequence
  Description of Artificial Sequence: Synthetic oligonucleotide
gacaaatgagataacactcattatttttggggtgatggctg

SEQ ID NO: 189264 - DNA, 41 bp, Artificial Sequence
  Description of Artificial Sequence: Synthetic oligonucleotide
acaaatgagataacactcattatttttggggtgatggctgg

SEQ ID NO: 189265 - DNA, 40 bp, Artificial Sequence
  Description of Artificial Sequence: Synthetic oligonucleotide
caaatgagataacactcattatttttggggtgatggctgg

SEQ ID NO: 189266 - DNA, 41 bp, Artificial Sequence
  Description of Artificial Sequence: Synthetic oligonucleotide
aaatgagataacactcattatttttggggtgatggctggtg

SEQ ID NO: 189267 - DNA, 40 bp, Artificial Sequence
  Description of Artificial Sequence: Synthetic oligonucleotide
aatgagataacactcattatttttggggtgatggctggtg

SEQ ID NO: 189268 - DNA, 39 bp, Artificial Sequence
  Description of Artificial Sequence: Synthetic oligonucleotide
atgagataacactcattatttttggggtgatggctggtg

SEQ ID NO: 189269 - DNA, 38 bp, Artificial Sequence
  Description of Artificial Sequence: Synthetic oligonucleotide
tgagataacactcattatttttggggtgatggctggtg

SEQ ID NO: 189270 - DNA, 44 bp, Artificial Sequence
  Description of Artificial Sequence: Synthetic oligonucleotide
cctttaagttctgttgaaatagaaaatccagagacaagtgatcc

SEQ ID NO: 189271 - DNA, 34 bp, Artificial Sequence
  Description of Artificial Sequence: Synthetic oligonucleotide
ggagaaagggtacaacttgcccatcatttctcag

SEQ ID NO: 189272 - DNA, 36 bp, Artificial Sequence
  Description of Artificial Sequence: Synthetic oligonucleotide
gagaaagggtacaacttgcccatcatttctcagaac

SEQ ID NO: 189273 - DNA, 36 bp, Artificial Sequence
  Description of Artificial Sequence: Synthetic oligonucleotide
agaaagggtacaacttgcccatcatttctcagaacc

SEQ ID NO: 189274 - DNA, 35 bp, Artificial Sequence
  Description of Artificial Sequence: Synthetic oligonucleotide
gaaagggtacaacttgcccatcatttctcagaacc

SEQ ID NO: 189275 - DNA, 36 bp, Artificial Sequence
  Description of Artificial Sequence: Synthetic oligonucleotide
aaagggtacaacttgcccatcatttctcagaaccag

SEQ ID NO: 189276 - DNA, 35 bp, Artificial Sequence
  Description of Artificial Sequence: Synthetic oligonucleotide
aagggtacaacttgcccatcatttctcagaaccag

SEQ ID NO: 189277 - DNA, 34 bp, Artificial Sequence
  Description of Artificial Sequence: Synthetic oligonucleotide
agggtacaacttgcccatcatttctcagaaccag

SEQ ID NO: 189278 - DNA, 33 bp, Artificial Sequence
  Description of Artificial Sequence: Synthetic oligonucleotide
gggtacaacttgcccatcatttctcagaaccag

SEQ ID NO: 189279 - DNA, 34 bp, Artificial Sequence
  Description of Artificial Sequence: Synthetic oligonucleotide
ggtacaacttgcccatcatttctcagaaccagag

SEQ ID NO: 189280 - DNA, 38 bp, Artificial Sequence
  Description of Artificial Sequence: Synthetic oligonucleotide
gtacaacttgcccatcatttctcagaaccagagataac

SEQ ID NO: 189281 - DNA, 39 bp, Artificial Sequence
  Description of Artificial Sequence: Synthetic oligonucleotide
tacaacttgcccatcatttctcagaaccagagataacac

SEQ ID NO: 189282 - DNA, 38 bp, Artificial Sequence
  Description of Artificial Sequence: Synthetic oligonucleotide
acaacttgcccatcatttctcagaaccagagataacac

SEQ ID NO: 189283 - DNA, 37 bp, Artificial Sequence
  Description of Artificial Sequence: Synthetic oligonucleotide
caacttgcccatcatttctcagaaccagagataacac

SEQ ID NO: 189284 - DNA, 38 bp, Artificial Sequence
  Description of Artificial Sequence: Synthetic oligonucleotide
aacttgcccatcatttctcagaaccagagataacactc

SEQ ID NO: 189285 - DNA, 37 bp, Artificial Sequence
  Description of Artificial Sequence: Synthetic oligonucleotide
acttgcccatcatttctcagaaccagagataacactc

SEQ ID NO: 189286 - DNA, 36 bp, Artificial Sequence
  Description of Artificial Sequence: Synthetic oligonucleotide
cttgcccatcatttctcagaaccagagataacactc

SEQ ID NO: 189287 - DNA, 45 bp, Artificial Sequence
  Description of Artificial Sequence: Synthetic oligonucleotide
ttgcccatcatttctcagaaccagagataacactcattatttttg

SEQ ID NO: 189288 - DNA, 44 bp, Artificial Sequence
  Description of Artificial Sequence: Synthetic oligonucleotide
tgcccatcatttctcagaaccagagataacactcattatttttg

SEQ ID NO: 189289 - DNA, 43 bp, Artificial Sequence
  Description of Artificial Sequence: Synthetic oligonucleotide
gcccatcatttctcagaaccagagataacactcattatttttg

SEQ ID NO: 189290 - DNA, 43 bp, Artificial Sequence
  Description of Artificial Sequence: Synthetic oligonucleotide
cccatcatttctcagaaccagagataacactcattatttttgg

SEQ ID NO: 189291 - DNA, 43 bp, Artificial Sequence
  Description of Artificial Sequence: Synthetic oligonucleotide
ccatcatttctcagaaccagagataacactcattatttttggg

SEQ ID NO: 189292 - DNA, 43 bp, Artificial Sequence
  Description of Artificial Sequence: Synthetic oligonucleotide
catcatttctcagaaccagagataacactcattatttttgggg

SEQ ID NO: 189293 - DNA, 44 bp, Artificial Sequence
  Description of Artificial Sequence: Synthetic oligonucleotide
atcatttctcagaaccagagataacactcattatttttggggtg

SEQ ID NO: 189294 - DNA, 43 bp, Artificial Sequence
  Description of Artificial Sequence: Synthetic oligonucleotide
tcatttctcagaaccagagataacactcattatttttggggtg

SEQ ID NO: 189295 - DNA, 42 bp, Artificial Sequence
  Description of Artificial Sequence: Synthetic oligonucleotide
catttctcagaaccagagataacactcattatttttggggtg

SEQ ID NO: 189296 - DNA, 44 bp, Artificial Sequence
  Description of Artificial Sequence: Synthetic oligonucleotide
atttctcagaaccagagataacactcattatttttggggtgatg

SEQ ID NO: 189297 - DNA, 43 bp, Artificial Sequence
  Description of Artificial Sequence: Synthetic oligonucleotide
tttctcagaaccagagataacactcattatttttggggtgatg

SEQ ID NO: 189298 - DNA, 42 bp, Artificial Sequence
  Description of Artificial Sequence: Synthetic oligonucleotide
ttctcagaaccagagataacactcattatttttggggtgatg

SEQ ID NO: 189299 - DNA, 41 bp, Artificial Sequence
  Description of Artificial Sequence: Synthetic oligonucleotide
tctcagaaccagagataacactcattatttttggggtgatg

SEQ ID NO: 189300 - DNA, 40 bp, Artificial Sequence
  Description of Artificial Sequence: Synthetic oligonucleotide
ctcagaaccagagataacactcattatttttggggtgatg

SEQ ID NO: 189301 - DNA, 40 bp, Artificial Sequence
  Description of Artificial Sequence: Synthetic oligonucleotide
tcagaaccagagataacactcattatttttggggtgatgg

SEQ ID NO: 189302 - DNA, 39 bp, Artificial Sequence
  Description of Artificial Sequence: Synthetic oligonucleotide
cagaaccagagataacactcattatttttggggtgatgg

SEQ ID NO: 189303 - DNA, 39 bp, Artificial Sequence
  Description of Artificial Sequence: Synthetic oligonucleotide
agaaccagagataacactcattatttttggggtgatggc

SEQ ID NO: 189304 - DNA, 33 bp, Artificial Sequence
  Description of Artificial Sequence: Synthetic oligonucleotide
atctgatgtaaaacctctcccctcacctgacag

SEQ ID NO: 189305 - DNA, 32 bp, Artificial Sequence
  Description of Artificial Sequence: Synthetic oligonucleotide
tctgatgtaaaacctctcccctcacctgacag

SEQ ID NO: 189306 - DNA, 31 bp, Artificial Sequence
  Description of Artificial Sequence: Synthetic oligonucleotide
ctgatgtaaaacctctcccctcacctgacag

SEQ ID NO: 189307 - DNA, 32 bp, Artificial Sequence
  Description of Artificial Sequence: Synthetic oligonucleotide
tgatgtaaaacctctcccctcacctgacagag

SEQ ID NO: 189308 - DNA, 31 bp, Artificial Sequence
  Description of Artificial Sequence: Synthetic oligonucleotide
gatgtaaaacctctcccctcacctgacagag

SEQ ID NO: 189309 - DNA, 32 bp, Artificial Sequence
  Description of Artificial Sequence: Synthetic oligonucleotide
atgtaaaacctctcccctcacctgacagagac

SEQ ID NO: 189310 - DNA, 31 bp, Artificial Sequence
  Description of Artificial Sequence: Synthetic oligonucleotide
tgtaaaacctctcccctcacctgacagagac

SEQ ID NO: 189311 - DNA, 30 bp, Artificial Sequence
  Description of Artificial Sequence: Synthetic oligonucleotide
gtaaaacctctcccctcacctgacagagac

SEQ ID NO: 189312 - DNA, 30 bp, Artificial Sequence
  Description of Artificial Sequence: Synthetic oligonucleotide
taaaacctctcccctcacctgacagagacg

SEQ ID NO: 189313 - DNA, 29 bp, Artificial Sequence
  Description of Artificial Sequence: Synthetic oligonucleotide
aaaacctctcccctcacctgacagagacg

SEQ ID NO: 189314 - DNA, 28 bp, Artificial Sequence
  Description of Artificial Sequence: Synthetic oligonucleotide
aaacctctcccctcacctgacagagacg

SEQ ID NO: 189315 - DNA, 27 bp, Artificial Sequence
  Description of Artificial Sequence: Synthetic oligonucleotide
aacctctcccctcacctgacagagacg

SEQ ID NO: 189316 - DNA, 27 bp, Artificial Sequence
  Description of Artificial Sequence: Synthetic oligonucleotide
acctctcccctcacctgacagagacgt

SEQ ID NO: 189317 - DNA, 26 bp, Artificial Sequence
  Description of Artificial Sequence: Synthetic oligonucleotide
cctctcccctcacctgacagagacgt

SEQ ID NO: 189318 - DNA, 26 bp, Artificial Sequence
  Description of Artificial Sequence: Synthetic oligonucleotide
ctctcccctcacctgacagagacgtg

SEQ ID NO: 189319 - DNA, 26 bp, Artificial Sequence
  Description of Artificial Sequence: Synthetic oligonucleotide
tctcccctcacctgacagagacgtgc

SEQ ID NO: 189320 - DNA, 25 bp, Artificial Sequence
  Description of Artificial Sequence: Synthetic oligonucleotide
ctcccctcacctgacagagacgtgc

SEQ ID NO: 189321 - DNA, 27 bp, Artificial Sequence
  Description of Artificial Sequence: Synthetic oligonucleotide
tcccctcacctgacagagacgtgcctt

SEQ ID NO: 189322 - DNA, 27 bp, Artificial Sequence
  Description of Artificial Sequence: Synthetic oligonucleotide
cccctcacctgacagagacgtgccttt

SEQ ID NO: 189323 - DNA, 29 bp, Artificial Sequence
  Description of Artificial Sequence: Synthetic oligonucleotide
ccctcacctgacagagacgtgcctttaag

SEQ ID NO: 189324 - DNA, 31 bp, Artificial Sequence
  Description of Artificial Sequence: Synthetic oligonucleotide
cctcacctgacagagacgtgcctttaagttc

SEQ ID NO: 189325 - DNA, 32 bp, Artificial Sequence
  Description of Artificial Sequence: Synthetic oligonucleotide
ctcacctgacagagacgtgcctttaagttctg

SEQ ID NO: 189326 - DNA, 34 bp, Artificial Sequence
  Description of Artificial Sequence: Synthetic oligonucleotide
tcacctgacagagacgtgcctttaagttctgttg

SEQ ID NO: 189327 - DNA, 33 bp, Artificial Sequence
  Description of Artificial Sequence: Synthetic oligonucleotide
cacctgacagagacgtgcctttaagttctgttg

SEQ ID NO: 189328 - DNA, 38 bp, Artificial Sequence
  Description of Artificial Sequence: Synthetic oligonucleotide
acctgacagagacgtgcctttaagttctgttgaaatag

SEQ ID NO: 189329 - DNA, 37 bp, Artificial Sequence
  Description of Artificial Sequence: Synthetic oligonucleotide
cctgacagagacgtgcctttaagttctgttgaaatag

SEQ ID NO: 189330 - DNA, 42 bp, Artificial Sequence
  Description of Artificial Sequence: Synthetic oligonucleotide
ctgacagagacgtgcctttaagttctgttgaaatagaaaatc

SEQ ID NO: 189331 - DNA, 42 bp, Artificial Sequence
  Description of Artificial Sequence: Synthetic oligonucleotide
tgacagagacgtgcctttaagttctgttgaaatagaaaatcc

SEQ ID NO: 189332 - DNA, 41 bp, Artificial Sequence
  Description of Artificial Sequence: Synthetic oligonucleotide
gacagagacgtgcctttaagttctgttgaaatagaaaatcc

SEQ ID NO: 189333 - DNA, 42 bp, Artificial Sequence
  Description of Artificial Sequence: Synthetic oligonucleotide
acagagacgtgcctttaagttctgttgaaatagaaaatccag

SEQ ID NO: 189334 - DNA, 41 bp, Artificial Sequence
  Description of Artificial Sequence: Synthetic oligonucleotide
cagagacgtgcctttaagttctgttgaaatagaaaatccag

SEQ ID NO: 189335 - DNA, 42 bp, Artificial Sequence
  Description of Artificial Sequence: Synthetic oligonucleotide
agagacgtgcctttaagttctgttgaaatagaaaatccagag

SEQ ID NO: 189336 - DNA, 41 bp, Artificial Sequence
  Description of Artificial Sequence: Synthetic oligonucleotide
gagacgtgcctttaagttctgttgaaatagaaaatccagag

SEQ ID NO: 189337 - DNA, 38 bp, Artificial Sequence
  Description of Artificial Sequence: Synthetic oligonucleotide
acctgacacagacgtgcctttaagttctgttgaaattg

SEQ ID NO: 189338 - DNA, 37 bp, Artificial Sequence
  Description of Artificial Sequence: Synthetic oligonucleotide
cctgacacagacgtgcctttaagttctgttgaaattg

SEQ ID NO: 189339 - DNA, 38 bp, Artificial Sequence
  Description of Artificial Sequence: Synthetic oligonucleotide
ctgacacagacgtgcctttaagttctgttgaaattgag

SEQ ID NO: 189340 - DNA, 40 bp, Artificial Sequence
  Description of Artificial Sequence: Synthetic oligonucleotide
tgacacagacgtgcctttaagttctgttgaaattgagaac

SEQ ID NO: 189341 - DNA, 39 bp, Artificial Sequence
  Description of Artificial Sequence: Synthetic oligonucleotide
gacacagacgtgcctttaagttctgttgaaattgagaac

SEQ ID NO: 189342 - DNA, 39 bp, Artificial Sequence
  Description of Artificial Sequence: Synthetic oligonucleotide
acacagacgtgcctttaagttctgttgaaattgagaacc

SEQ ID NO: 189343 - DNA, 38 bp, Artificial Sequence
  Description of Artificial Sequence: Synthetic oligonucleotide
cacagacgtgcctttaagttctgttgaaattgagaacc

SEQ ID NO: 189344 - DNA, 38 bp, Artificial Sequence
  Description of Artificial Sequence: Synthetic oligonucleotide
acagacgtgcctttaagttctgttgaaattgagaaccc

SEQ ID NO: 189345 - DNA, 37 bp, Artificial Sequence
  Description of Artificial Sequence: Synthetic oligonucleotide
cagacgtgcctttaagttctgttgaaattgagaaccc

SEQ ID NO: 189346 - DNA, 37 bp, Artificial Sequence
  Description of Artificial Sequence: Synthetic oligonucleotide
agacgtgcctttaagttctgttgaaattgagaacccc

SEQ ID NO: 189347 - DNA, 36 bp, Artificial Sequence
  Description of Artificial Sequence: Synthetic oligonucleotide
tgttagaactgtttaccctccagaagaggaaaccag

SEQ ID NO: 189348 - DNA, 35 bp, Artificial Sequence
  Description of Artificial Sequence: Synthetic oligonucleotide
gttagaactgtttaccctccagaagaggaaaccag

SEQ ID NO: 189349 - DNA, 36 bp, Artificial Sequence
  Description of Artificial Sequence: Synthetic oligonucleotide
ttagaactgtttaccctccagaagaggaaaccagag

SEQ ID NO: 189350 - DNA, 35 bp, Artificial Sequence
  Description of Artificial Sequence: Synthetic oligonucleotide
tagaactgtttaccctccagaagaggaaaccagag

SEQ ID NO: 189351 - DNA, 34 bp, Artificial Sequence
  Description of Artificial Sequence: Synthetic oligonucleotide
agaactgtttaccctccagaagaggaaaccagag

SEQ ID NO: 189352 - DNA, 33 bp, Artificial Sequence
  Description of Artificial Sequence: Synthetic oligonucleotide
gaactgtttaccctccagaagaggaaaccagag

SEQ ID NO: 189353 - DNA, 36 bp, Artificial Sequence
  Description of Artificial Sequence: Synthetic oligonucleotide
aactgtttaccctccagaagaggaaaccagagaaag

SEQ ID NO: 189354 - DNA, 35 bp, Artificial Sequence
  Description of Artificial Sequence: Synthetic oligonucleotide
actgtttaccctccagaagaggaaaccagagaaag

SEQ ID NO: 189355 - DNA, 34 bp, Artificial Sequence
  Description of Artificial Sequence: Synthetic oligonucleotide
ctgtttaccctccagaagaggaaaccagagaaag

SEQ ID NO: 189356 - DNA, 34 bp, Artificial Sequence
  Description of Artificial Sequence: Synthetic oligonucleotide
tgtttaccctccagaagaggaaaccagagaaagg

SEQ ID NO: 189357 - DNA, 33 bp, Artificial Sequence
  Description of Artificial Sequence: Synthetic oligonucleotide
gtttaccctccagaagaggaaaccagagaaagg

SEQ ID NO: 189358 - DNA, 33 bp, Artificial Sequence
  Description of Artificial Sequence: Synthetic oligonucleotide
tttaccctccagaagaggaaaccagagaaaggg

SEQ ID NO: 189359 - DNA, 32 bp, Artificial Sequence
  Description of Artificial Sequence: Synthetic oligonucleotide
ttaccctccagaagaggaaaccagagaaaggg

SEQ ID NO: 189360 - DNA, 31 bp, Artificial Sequence
  Description of Artificial Sequence: Synthetic oligonucleotide
taccctccagaagaggaaaccagagaaaggg

SEQ ID NO: 189361 - DNA, 30 bp, Artificial Sequence
  Description of Artificial Sequence: Synthetic oligonucleotide
accctccagaagaggaaaccagagaaaggg

SEQ ID NO: 189362 - DNA, 29 bp, Artificial Sequence
  Description of Artificial Sequence: Synthetic oligonucleotide
ccctccagaagaggaaaccagagaaaggg

SEQ ID NO: 189363 - DNA, 31 bp, Artificial Sequence
  Description of Artificial Sequence: Synthetic oligonucleotide
cctccagaagaggaaaccagagaaagggtac

SEQ ID NO: 189364 - DNA, 33 bp, Artificial Sequence
  Description of Artificial Sequence: Synthetic oligonucleotide
ctccagaagaggaaaccagagaaagggtacaac

SEQ ID NO: 189365 - DNA, 35 bp, Artificial Sequence
  Description of Artificial Sequence: Synthetic oligonucleotide
tccagaagaggaaaccagagaaagggtacaacttg

SEQ ID NO: 189366 - DNA, 34 bp, Artificial Sequence
  Description of Artificial Sequence: Synthetic oligonucleotide
ccagaagaggaaaccagagaaagggtacaacttg

SEQ ID NO: 189367 - DNA, 34 bp, Artificial Sequence
  Description of Artificial Sequence: Synthetic oligonucleotide
cagaagaggaaaccagagaaagggtacaacttgc

SEQ ID NO: 189368 - DNA, 34 bp, Artificial Sequence
  Description of Artificial Sequence: Synthetic oligonucleotide
agaagaggaaaccagagaaagggtacaacttgcc

SEQ ID NO: 189369 - DNA, 33 bp, Artificial Sequence
  Description of Artificial Sequence: Synthetic oligonucleotide
gaagaggaaaccagagaaagggtacaacttgcc

SEQ ID NO: 189370 - DNA, 33 bp, Artificial Sequence
  Description of Artificial Sequence: Synthetic oligonucleotide
aagaggaaaccagagaaagggtacaacttgccc

SEQ ID NO: 189371 - DNA, 32 bp, Artificial Sequence
  Description of Artificial Sequence: Synthetic oligonucleotide
agaggaaaccagagaaagggtacaacttgccc

SEQ ID NO: 189372 - DNA, 31 bp, Artificial Sequence
  Description of Artificial Sequence: Synthetic oligonucleotide
gaggaaaccagagaaagggtacaacttgccc

SEQ ID NO: 189373 - DNA, 33 bp, Artificial Sequence
  Description of Artificial Sequence: Synthetic oligonucleotide
aggaaaccagagaaagggtacaacttgcccatc

SEQ ID NO: 189374 - DNA, 32 bp, Artificial Sequence
  Description of Artificial Sequence: Synthetic oligonucleotide
ggaaaccagagaaagggtacaacttgcccatc

SEQ ID NO: 189375 - DNA, 36 bp, Artificial Sequence
  Description of Artificial Sequence: Synthetic oligonucleotide
gaaaccagagaaagggtacaacttgcccatcatttc

SEQ ID NO: 189376 - DNA, 37 bp, Artificial Sequence
  Description of Artificial Sequence: Synthetic oligonucleotide
aaaccagagaaagggtacaacttgcccatcatttctc

SEQ ID NO: 189377 - DNA, 36 bp, Artificial Sequence
  Description of Artificial Sequence: Synthetic oligonucleotide
aaccagagaaagggtacaacttgcccatcatttctc

SEQ ID NO: 189378 - DNA, 35 bp, Artificial Sequence
  Description of Artificial Sequence: Synthetic oligonucleotide
accagagaaagggtacaacttgcccatcatttctc

SEQ ID NO: 189379 - DNA, 34 bp, Artificial Sequence
  Description of Artificial Sequence: Synthetic oligonucleotide
ccagagaaagggtacaacttgcccatcatttctc

SEQ ID NO: 189380 - DNA, 35 bp, Artificial Sequence
  Description of Artificial Sequence: Synthetic oligonucleotide
cagagaaagggtacaacttgcccatcatttctctg

SEQ ID NO: 189381 - DNA, 37 bp, Artificial Sequence
  Description of Artificial Sequence: Synthetic oligonucleotide
agagaaagggtacaacttgcccatcatttctctgaac

SEQ ID NO: 189382 - DNA, 46 bp, Artificial Sequence
  Description of Artificial Sequence: Synthetic oligonucleotide
ttcttcagtcacaaagagttacatctcatcacagacaaatgataag

SEQ ID NO: 189383 - DNA, 45 bp, Artificial Sequence
  Description of Artificial Sequence: Synthetic oligonucleotide
tcttcagtcacaaagagttacatctcatcacagacaaatgataag

SEQ ID NO: 189384 - DNA, 44 bp, Artificial Sequence
  Description of Artificial Sequence: Synthetic oligonucleotide
cttcagtcacaaagagttacatctcatcacagacaaatgataag

SEQ ID NO: 189385 - DNA, 44 bp, Artificial Sequence
  Description of Artificial Sequence: Synthetic oligonucleotide
ttcagtcacaaagagttacatctcatcacagacaaatgataagc

SEQ ID NO: 189386 - DNA, 43 bp, Artificial Sequence
  Description of Artificial Sequence: Synthetic oligonucleotide
tcagtcacaaagagttacatctcatcacagacaaatgataagc

SEQ ID NO: 189387 - DNA, 42 bp, Artificial Sequence
  Description of Artificial Sequence: Synthetic oligonucleotide
cagtcacaaagagttacatctcatcacagacaaatgataagc

SEQ ID NO: 189388 - DNA, 43 bp, Artificial Sequence
  Description of Artificial Sequence: Synthetic oligonucleotide
agtcacaaagagttacatctcatcacagacaaatgataagcac

SEQ ID NO: 189389 - DNA, 42 bp, Artificial Sequence
  Description of Artificial Sequence: Synthetic oligonucleotide
gtcacaaagagttacatctcatcacagacaaatgataagcac

SEQ ID NO: 189390 - DNA, 45 bp, Artificial Sequence
  Description of Artificial Sequence: Synthetic oligonucleotide
tcacaaagagttacatctcatcacagacaaatgataagcacaaac

SEQ ID NO: 189391 - DNA, 44 bp, Artificial Sequence
  Description of Artificial Sequence: Synthetic oligonucleotide
cacaaagagttacatctcatcacagacaaatgataagcacaaac

SEQ ID NO: 189392 - DNA, 44 bp, Artificial Sequence
  Description of Artificial Sequence: Synthetic oligonucleotide
acaaagagttacatctcatcacagacaaatgataagcacaaacg

SEQ ID NO: 189393 - DNA, 43 bp, Artificial Sequence
  Description of Artificial Sequence: Synthetic oligonucleotide
caaagagttacatctcatcacagacaaatgataagcacaaacg

SEQ ID NO: 189394 - DNA, 43 bp, Artificial Sequence
  Description of Artificial Sequence: Synthetic oligonucleotide
aaagagttacatctcatcacagacaaatgataagcacaaacgg

SEQ ID NO: 189395 - DNA, 42 bp, Artificial Sequence
  Description of Artificial Sequence: Synthetic oligonucleotide
aagagttacatctcatcacagacaaatgataagcacaaacgg

SEQ ID NO: 189396 - DNA, 41 bp, Artificial Sequence
  Description of Artificial Sequence: Synthetic oligonucleotide
agagttacatctcatcacagacaaatgataagcacaaacgg

SEQ ID NO: 189397 - DNA, 40 bp, Artificial Sequence
  Description of Artificial Sequence: Synthetic oligonucleotide
gagttacatctcatcacagacaaatgataagcacaaacgg

SEQ ID NO: 189398 - DNA, 40 bp, Artificial Sequence
  Description of Artificial Sequence: Synthetic oligonucleotide
agttacatctcatcacagacaaatgataagcacaaacggg

SEQ ID NO: 189399 - DNA, 39 bp, Artificial Sequence
  Description of Artificial Sequence: Synthetic oligonucleotide
gttacatctcatcacagacaaatgataagcacaaacggg

SEQ ID NO: 189400 - DNA, 40 bp, Artificial Sequence
  Description of Artificial Sequence: Synthetic oligonucleotide
ttacatctcatcacagacaaatgataagcacaaacgggac

SEQ ID NO: 189401 - DNA, 39 bp, Artificial Sequence
  Description of Artificial Sequence: Synthetic oligonucleotide
tacatctcatcacagacaaatgataagcacaaacgggac

SEQ ID NO: 189402 - DNA, 38 bp, Artificial Sequence
  Description of Artificial Sequence: Synthetic oligonucleotide
acatctcatcacagacaaatgataagcacaaacgggac

SEQ ID NO: 189403 - DNA, 37 bp, Artificial Sequence
  Description of Artificial Sequence: Synthetic oligonucleotide
catctcatcacagacaaatgataagcacaaacgggac

SEQ ID NO: 189404 - DNA, 38 bp, Artificial Sequence
  Description of Artificial Sequence: Synthetic oligonucleotide
atctcatcacagacaaatgataagcacaaacgggacac

SEQ ID NO: 189405 - DNA, 37 bp, Artificial Sequence
  Description of Artificial Sequence: Synthetic oligonucleotide
tctcatcacagacaaatgataagcacaaacgggacac

SEQ ID NO: 189406 - DNA, 36 bp, Artificial Sequence
  Description of Artificial Sequence: Synthetic oligonucleotide
ctcatcacagacaaatgataagcacaaacgggacac

SEQ ID NO: 189407 - DNA, 38 bp, Artificial Sequence
  Description of Artificial Sequence: Synthetic oligonucleotide
tcatcacagacaaatgataagcacaaacgggacacatg

SEQ ID NO: 189408 - DNA, 37 bp, Artificial Sequence
  Description of Artificial Sequence: Synthetic oligonucleotide
catcacagacaaatgataagcacaaacgggacacatg

SEQ ID NO: 189409 - DNA, 38 bp, Artificial Sequence
  Description of Artificial Sequence: Synthetic oligonucleotide
atcacagacaaatgataagcacaaacgggacacatgtc

SEQ ID NO: 189410 - DNA, 37 bp, Artificial Sequence
  Description of Artificial Sequence: Synthetic oligonucleotide
tcacagacaaatgataagcacaaacgggacacatgtc

SEQ ID NO: 189411 - DNA, 36 bp, Artificial Sequence
  Description of Artificial Sequence: Synthetic oligonucleotide
cacagacaaatgataagcacaaacgggacacatgtc

SEQ ID NO: 189412 - DNA, 36 bp, Artificial Sequence
  Description of Artificial Sequence: Synthetic oligonucleotide
acagacaaatgataagcacaaacgggacacatgtcc

SEQ ID NO: 189413 - DNA, 35 bp, Artificial Sequence
  Description of Artificial Sequence: Synthetic oligonucleotide
cagacaaatgataagcacaaacgggacacatgtcc

SEQ ID NO: 189414 - DNA, 36 bp, Artificial Sequence
  Description of Artificial Sequence: Synthetic oligonucleotide
agacaaatgataagcacaaacgggacacatgtccag

SEQ ID NO: 189415 - DNA, 35 bp, Artificial Sequence
  Description of Artificial Sequence: Synthetic oligonucleotide
gacaaatgataagcacaaacgggacacatgtccag

SEQ ID NO: 189416 - DNA, 35 bp, Artificial Sequence
  Description of Artificial Sequence: Synthetic oligonucleotide
acaaatgataagcacaaacgggacacatgtccagc

SEQ ID NO: 189417 - DNA, 34 bp, Artificial Sequence
  Description of Artificial Sequence: Synthetic oligonucleotide
caaatgataagcacaaacgggacacatgtccagc

SEQ ID NO: 189418 - DNA, 35 bp, Artificial Sequence
  Description of Artificial Sequence: Synthetic oligonucleotide
aaatgataagcacaaacgggacacatgtccagctc

SEQ ID NO: 189419 - DNA, 34 bp, Artificial Sequence
  Description of Artificial Sequence: Synthetic oligonucleotide
aatgataagcacaaacgggacacatgtccagctc

SEQ ID NO: 189420 - DNA, 33 bp, Artificial Sequence
  Description of Artificial Sequence: Synthetic oligonucleotide
atgataagcacaaacgggacacatgtccagctc

SEQ ID NO: 189421 - DNA, 32 bp, Artificial Sequence
  Description of Artificial Sequence: Synthetic oligonucleotide
tgataagcacaaacgggacacatgtccagctc

SEQ ID NO: 189422 - DNA, 31 bp, Artificial Sequence
  Description of Artificial Sequence: Synthetic oligonucleotide
gataagcacaaacgggacacatgtccagctc

SEQ ID NO: 189423 - DNA, 34 bp, Artificial Sequence
  Description of Artificial Sequence: Synthetic oligonucleotide
ataagcacaaacgggacacatgtccagctcatac

SEQ ID NO: 189424 - DNA, 33 bp, Artificial Sequence
  Description of Artificial Sequence: Synthetic oligonucleotide
taagcacaaacgggacacatgtccagctcatac

SEQ ID NO: 189425 - DNA, 32 bp, Artificial Sequence
  Description of Artificial Sequence: Synthetic oligonucleotide
aagcacaaacgggacacatgtccagctcatac

SEQ ID NO: 189426 - DNA, 31 bp, Artificial Sequence
  Description of Artificial Sequence: Synthetic oligonucleotide
agcacaaacgggacacatgtccagctcatac

SEQ ID NO: 189427 - DNA, 30 bp, Artificial Sequence
  Description of Artificial Sequence: Synthetic oligonucleotide
gcacaaacgggacacatgtccagctcatac

SEQ ID NO: 189428 - DNA, 31 bp, Artificial Sequence
  Description of Artificial Sequence: Synthetic oligonucleotide
cacaaacgggacacatgtccagctcatactg

SEQ ID NO: 189429 - DNA, 31 bp, Artificial Sequence
  Description of Artificial Sequence: Synthetic oligonucleotide
acaaacgggacacatgtccagctcatactgc

SEQ ID NO: 189430 - DNA, 30 bp, Artificial Sequence
  Description of Artificial Sequence: Synthetic oligonucleotide
caaacgggacacatgtccagctcatactgc

SEQ ID NO: 189431 - DNA, 34 bp, Artificial Sequence
  Description of Artificial Sequence: Synthetic oligonucleotide
aaacgggacacatgtccagctcatactgctaatg

SEQ ID NO: 189432 - DNA, 33 bp, Artificial Sequence
  Description of Artificial Sequence: Synthetic oligonucleotide
aacgggacacatgtccagctcatactgctaatg

SEQ ID NO: 189433 - DNA, 32 bp, Artificial Sequence
  Description of Artificial Sequence: Synthetic oligonucleotide
acgggacacatgtccagctcatactgctaatg

SEQ ID NO: 189434 - DNA, 31 bp, Artificial Sequence
  Description of Artificial Sequence: Synthetic oligonucleotide
cgggacacatgtccagctcatactgctaatg

SEQ ID NO: 189435 - DNA, 33 bp, Artificial Sequence
  Description of Artificial Sequence: Synthetic oligonucleotide
gggacacatgtccagctcatactgctaatgaag

SEQ ID NO: 189436 - DNA, 36 bp, Artificial Sequence
  Description of Artificial Sequence: Synthetic oligonucleotide
ggacacatgtccagctcatactgctaatgaagtttc

SEQ ID NO: 189437 - DNA, 37 bp, Artificial Sequence
  Description of Artificial Sequence: Synthetic oligonucleotide
gacacatgtccagctcatactgctaatgaagtttcag

SEQ ID NO: 189438 - DNA, 43 bp, Artificial Sequence
  Description of Artificial Sequence: Synthetic oligonucleotide
acacatgtccagctcatactgctaatgaagtttcagaaatttc

SEQ ID NO: 189439 - DNA, 42 bp, Artificial Sequence
  Description of Artificial Sequence: Synthetic oligonucleotide
cacatgtccagctcatactgctaatgaagtttcagaaatttc

SEQ ID NO: 189440 - DNA, 43 bp, Artificial Sequence
  Description of Artificial Sequence: Synthetic oligonucleotide
acatgtccagctcatactgctaatgaagtttcagaaatttctg

SEQ ID NO: 189441 - DNA, 42 bp, Artificial Sequence
  Description of Artificial Sequence: Synthetic oligonucleotide
catgtccagctcatactgctaatgaagtttcagaaatttctg

SEQ ID NO: 189442 - DNA, 45 bp, Artificial Sequence
  Description of Artificial Sequence: Synthetic oligonucleotide
atgtccagctcatactgctaatgaagtttcagaaatttctgttac

SEQ ID NO: 189443 - DNA, 44 bp, Artificial Sequence
  Description of Artificial Sequence: Synthetic oligonucleotide
tgtccagctcatactgctaatgaagtttcagaaatttctgttac

SEQ ID NO: 189444 - DNA, 43 bp, Artificial Sequence
  Description of Artificial Sequence: Synthetic oligonucleotide
gtccagctcatactgctaatgaagtttcagaaatttctgttac

SEQ ID NO: 189445 - DNA, 45 bp, Artificial Sequence
  Description of Artificial Sequence: Synthetic oligonucleotide
tccagctcatactgctaatgaagtttcagaaatttctgttacaac

SEQ ID NO: 189446 - DNA, 44 bp, Artificial Sequence
  Description of Artificial Sequence: Synthetic oligonucleotide
ccagctcatactgctaatgaagtttcagaaatttctgttacaac

SEQ ID NO: 189447 - DNA, 45 bp, Artificial Sequence
  Description of Artificial Sequence: Synthetic oligonucleotide
cagctcatactgctaatgaagtttcagaaatttctgttacaactg

SEQ ID NO: 189448 - DNA, 48 bp, Artificial Sequence
  Description of Artificial Sequence: Synthetic oligonucleotide
agctcatactgctaatgaagtttcagaaatttctgttacaactgtttc

SEQ ID NO: 189449 - DNA, 47 bp, Artificial Sequence
  Description of Artificial Sequence: Synthetic oligonucleotide
gctcatactgctaatgaagtttcagaaatttctgttacaactgtttc

SEQ ID NO: 189450 - DNA, 47 bp, Artificial Sequence
  Description of Artificial Sequence: Synthetic oligonucleotide
ctcatactgctaatgaagtttcagaaatttctgttacaactgtttcc

SEQ ID NO: 189451 - DNA, 47 bp, Artificial Sequence
  Description of Artificial Sequence: Synthetic oligonucleotide
tcatactgctaatgaagtttcagaaatttctgttacaactgtttccc

SEQ ID NO: 189452 - DNA, 46 bp, Artificial Sequence
  Description of Artificial Sequence: Synthetic oligonucleotide
catactgctaatgaagtttcagaaatttctgttacaactgtttccc

SEQ ID NO: 189453 - DNA, 46 bp, Artificial Sequence
  Description of Artificial Sequence: Synthetic oligonucleotide
atactgctaatgaagtttcagaaatttctgttacaactgtttcccc

SEQ ID NO: 189454 - DNA, 45 bp, Artificial Sequence
  Description of Artificial Sequence: Synthetic oligonucleotide
tactgctaatgaagtttcagaaatttctgttacaactgtttcccc

SEQ ID NO: 189455 - DNA, 44 bp, Artificial Sequence
  Description of Artificial Sequence: Synthetic oligonucleotide
actgctaatgaagtttcagaaatttctgttacaactgtttcccc

SEQ ID NO: 189456 - DNA, 43 bp, Artificial Sequence
  Description of Artificial Sequence: Synthetic oligonucleotide
ctgctaatgaagtttcagaaatttctgttacaactgtttcccc

SEQ ID NO: 189457 - DNA, 44 bp, Artificial Sequence
  Description of Artificial Sequence: Synthetic oligonucleotide
tgctaatgaagtttcagaaatttctgttacaactgtttcccctc

SEQ ID NO: 189458 - DNA, 43 bp, Artificial Sequence
  Description of Artificial Sequence: Synthetic oligonucleotide
gctaatgaagtttcagaaatttctgttacaactgtttcccctc

SEQ ID NO: 189459 - DNA, 43 bp, Artificial Sequence
  Description of Artificial Sequence: Synthetic oligonucleotide
ctaatgaagtttcagaaatttctgttacaactgtttcccctcc

SEQ ID NO: 189460 - DNA, 44 bp, Artificial Sequence
  Description of Artificial Sequence: Synthetic oligonucleotide
taatgaagtttcagaaatttctgttacaactgtttcccctccag

SEQ ID NO: 189461 - DNA, 43 bp, Artificial Sequence
  Description of Artificial Sequence: Synthetic oligonucleotide
aatgaagtttcagaaatttctgttacaactgtttcccctccag

SEQ ID NO: 189462 - DNA, 42 bp, Artificial Sequence
  Description of Artificial Sequence: Synthetic oligonucleotide
atgaagtttcagaaatttctgttacaactgtttcccctccag

SEQ ID NO: 189463 - DNA, 41 bp, Artificial Sequence
  Description of Artificial Sequence: Synthetic oligonucleotide
tgaagtttcagaaatttctgttacaactgtttcccctccag

SEQ ID NO: 189464 - DNA, 40 bp, Artificial Sequence
  Description of Artificial Sequence: Synthetic oligonucleotide
gaagtttcagaaatttctgttacaactgtttcccctccag

SEQ ID NO: 189465 - DNA, 44 bp, Artificial Sequence
  Description of Artificial Sequence: Synthetic oligonucleotide
aagtttcagaaatttctgttacaactgtttcccctccagaaaag

SEQ ID NO: 189466 - DNA, 43 bp, Artificial Sequence
  Description of Artificial Sequence: Synthetic oligonucleotide
agtttcagaaatttctgttacaactgtttcccctccagaaaag

SEQ ID NO: 189467 - DNA, 42 bp, Artificial Sequence
  Description of Artificial Sequence: Synthetic oligonucleotide
gtttcagaaatttctgttacaactgtttcccctccagaaaag

SEQ ID NO: 189468 - DNA, 47 bp, Artificial Sequence
  Description of Artificial Sequence: Synthetic oligonucleotide
tttcagaaatttctgttacaactgtttcccctccagaaaagaaaaac

SEQ ID NO: 189469 - DNA, 46 bp, Artificial Sequence
  Description of Artificial Sequence: Synthetic oligonucleotide
ttcagaaatttctgttacaactgtttcccctccagaaaagaaaaac

SEQ ID NO: 189470 - DNA, 45 bp, Artificial Sequence
  Description of Artificial Sequence: Synthetic oligonucleotide
tcagaaatttctgttacaactgtttcccctccagaaaagaaaaac

SEQ ID NO: 189471 - DNA, 44 bp, Artificial Sequence
  Description of Artificial Sequence: Synthetic oligonucleotide
cagaaatttctgttacaactgtttcccctccagaaaagaaaaac

SEQ ID NO: 189472 - DNA, 44 bp, Artificial Sequence
  Description of Artificial Sequence: Synthetic oligonucleotide
agaaatttctgttacaactgtttcccctccagaaaagaaaaacg

SEQ ID NO: 189473 - DNA, 43 bp, Artificial Sequence
  Description of Artificial Sequence: Synthetic oligonucleotide
gaaatttctgttacaactgtttcccctccagaaaagaaaaacg

SEQ ID NO: 189474 - DNA, 43 bp, Artificial Sequence
  Description of Artificial Sequence: Synthetic oligonucleotide
aaatttctgttacaactgtttcccctccagaaaagaaaaacgg

SEQ ID NO: 189475 - DNA, 42 bp, Artificial Sequence
  Description of Artificial Sequence: Synthetic oligonucleotide
aatttctgttacaactgtttcccctccagaaaagaaaaacgg

SEQ ID NO: 189476 - DNA, 41 bp, Artificial Sequence
  Description of Artificial Sequence: Synthetic oligonucleotide
atttctgttacaactgtttcccctccagaaaagaaaaacgg

SEQ ID NO: 189477 - DNA, 40 bp, Artificial Sequence
  Description of Artificial Sequence: Synthetic oligonucleotide
tttctgttacaactgtttcccctccagaaaagaaaaacgg

SEQ ID NO: 189478 - DNA, 39 bp, Artificial Sequence
  Description of Artificial Sequence: Synthetic oligonucleotide
ttctgttacaactgtttcccctccagaaaagaaaaacgg

SEQ ID NO: 189479 - DNA, 38 bp, Artificial Sequence
  Description of Artificial Sequence: Synthetic oligonucleotide
tctgttacaactgtttcccctccagaaaagaaaaacgg

SEQ ID NO: 189480 - DNA, 37 bp, Artificial Sequence
  Description of Artificial Sequence: Synthetic oligonucleotide
ctgttacaactgtttcccctccagaaaagaaaaacgg

SEQ ID NO: 189481 - DNA, 38 bp, Artificial Sequence
  Description of Artificial Sequence: Synthetic oligonucleotide
tgttacaactgtttcccctccagaaaagaaaaacggag

SEQ ID NO: 189482 - DNA, 37 bp, Artificial Sequence
  Description of Artificial Sequence: Synthetic oligonucleotide
gttacaactgtttcccctccagaaaagaaaaacggag

SEQ ID NO: 189483 - DNA, 40 bp, Artificial Sequence
  Description of Artificial Sequence: Synthetic oligonucleotide
ttacaactgtttcccctccagaaaagaaaaacggagaaac

SEQ ID NO: 189484 - DNA, 39 bp, Artificial Sequence
  Description of Artificial Sequence: Synthetic oligonucleotide
tacaactgtttcccctccagaaaagaaaaacggagaaac

SEQ ID NO: 189485 - DNA, 38 bp, Artificial Sequence
  Description of Artificial Sequence: Synthetic oligonucleotide
acaactgtttcccctccagaaaagaaaaacggagaaac

SEQ ID NO: 189486 - DNA, 37 bp, Artificial Sequence
  Description of Artificial Sequence: Synthetic oligonucleotide
caactgtttcccctccagaaaagaaaaacggagaaac

SEQ ID NO: 189487 - DNA, 37 bp, Artificial Sequence
  Description of Artificial Sequence: Synthetic oligonucleotide
aactgtttcccctccagaaaagaaaaacggagaaacg

SEQ ID NO: 189488 - DNA, 36 bp, Artificial Sequence
  Description of Artificial Sequence: Synthetic oligonucleotide
actgtttcccctccagaaaagaaaaacggagaaacg

SEQ ID NO: 189489 - DNA, 35 bp, Artificial Sequence
  Description of Artificial Sequence: Synthetic oligonucleotide
ctgtttcccctccagaaaagaaaaacggagaaacg

SEQ ID NO: 189490 - DNA, 35 bp, Artificial Sequence
  Description of Artificial Sequence: Synthetic oligonucleotide
tgtttcccctccagaaaagaaaaacggagaaacgg

SEQ ID NO: 189491 - DNA, 34 bp, Artificial Sequence
  Description of Artificial Sequence: Synthetic oligonucleotide
gtttcccctccagaaaagaaaaacggagaaacgg

SEQ ID NO: 189492 - DNA, 34 bp, Artificial Sequence
  Description of Artificial Sequence: Synthetic oligonucleotide
tttcccctccagaaaagaaaaacggagaaacggg

SEQ ID NO: 189493 - DNA, 33 bp, Artificial Sequence
  Description of Artificial Sequence: Synthetic oligonucleotide
ttcccctccagaaaagaaaaacggagaaacggg

SEQ ID NO: 189494 - DNA, 32 bp, Artificial Sequence
  Description of Artificial Sequence: Synthetic oligonucleotide
tcccctccagaaaagaaaaacggagaaacggg

SEQ ID NO: 189495 - DNA, 31 bp, Artificial Sequence
  Description of Artificial Sequence: Synthetic oligonucleotide
cccctccagaaaagaaaaacggagaaacggg

SEQ ID NO: 189496 - DNA, 32 bp, Artificial Sequence
  Description of Artificial Sequence: Synthetic oligonucleotide
ccctccagaaaagaaaaacggagaaacgggac

SEQ ID NO: 189497 - DNA, 34 bp, Artificial Sequence
  Description of Artificial Sequence: Synthetic oligonucleotide
cctccagaaaagaaaaacggagaaacgggacaac

SEQ ID NO: 189498 - DNA, 36 bp, Artificial Sequence
  Description of Artificial Sequence: Synthetic oligonucleotide
ctccagaaaagaaaaacggagaaacgggacaacttg

SEQ ID NO: 189499 - DNA, 37 bp, Artificial Sequence
  Description of Artificial Sequence: Synthetic oligonucleotide
tccagaaaagaaaaacggagaaacgggacaacttgtc

SEQ ID NO: 189500 - DNA, 36 bp, Artificial Sequence
  Description of Artificial Sequence: Synthetic oligonucleotide
ccagaaaagaaaaacggagaaacgggacaacttgtc

SEQ ID NO: 189501 - DNA, 36 bp, Artificial Sequence
  Description of Artificial Sequence: Synthetic oligonucleotide
cagaaaagaaaaacggagaaacgggacaacttgtcc

SEQ ID NO: 189502 - DNA, 38 bp, Artificial Sequence
  Description of Artificial Sequence: Synthetic oligonucleotide
agaaaagaaaaacggagaaacgggacaacttgtccatc

SEQ ID NO: 189503 - DNA, 37 bp, Artificial Sequence
  Description of Artificial Sequence: Synthetic oligonucleotide
gaaaagaaaaacggagaaacgggacaacttgtccatc

SEQ ID NO: 189504 - DNA, 37 bp, Artificial Sequence
  Description of Artificial Sequence: Synthetic oligonucleotide
aaaagaaaaacggagaaacgggacaacttgtccatcg

SEQ ID NO: 189505 - DNA, 36 bp, Artificial Sequence
  Description of Artificial Sequence: Synthetic oligonucleotide
aaagaaaaacggagaaacgggacaacttgtccatcg

SEQ ID NO: 189506 - DNA, 35 bp, Artificial Sequence
  Description of Artificial Sequence: Synthetic oligonucleotide
aagaaaaacggagaaacgggacaacttgtccatcg

SEQ ID NO: 189507 - DNA, 34 bp, Artificial Sequence
  Description of Artificial Sequence: Synthetic oligonucleotide
agaaaaacggagaaacgggacaacttgtccatcg

SEQ ID NO: 189508 - DNA, 33 bp, Artificial Sequence
  Description of Artificial Sequence: Synthetic oligonucleotide
gaaaaacggagaaacgggacaacttgtccatcg

SEQ ID NO: 189509 - DNA, 36 bp, Artificial Sequence
  Description of Artificial Sequence: Synthetic oligonucleotide
aaaaacggagaaacgggacaacttgtccatcgtttc

SEQ ID NO: 189510 - DNA, 35 bp, Artificial Sequence
  Description of Artificial Sequence: Synthetic oligonucleotide
aaaacggagaaacgggacaacttgtccatcgtttc

SEQ ID NO: 189511 - DNA, 34 bp, Artificial Sequence
  Description of Artificial Sequence: Synthetic oligonucleotide
aaacggagaaacgggacaacttgtccatcgtttc

SEQ ID NO: 189512 - DNA, 33 bp, Artificial Sequence
  Description of Artificial Sequence: Synthetic oligonucleotide
aacggagaaacgggacaacttgtccatcgtttc

SEQ ID NO: 189513 - DNA, 32 bp, Artificial Sequence
  Description of Artificial Sequence: Synthetic oligonucleotide
acggagaaacgggacaacttgtccatcgtttc

SEQ ID NO: 189514 - DNA, 31 bp, Artificial Sequence
  Description of Artificial Sequence: Synthetic oligonucleotide
cggagaaacgggacaacttgtccatcgtttc

SEQ ID NO: 189515 - DNA, 42 bp, Artificial Sequence
  Description of Artificial Sequence: Synthetic oligonucleotide
acgatcctcttaatttcttacagtattcgccgactgataaag

SEQ ID NO: 189516 - DNA, 41 bp, Artificial Sequence
  Description of Artificial Sequence: Synthetic oligonucleotide
cgatcctcttaatttcttacagtattcgccgactgataaag

SEQ ID NO: 189517 - DNA, 41 bp, Artificial Sequence
  Description of Artificial Sequence: Synthetic oligonucleotide
gatcctcttaatttcttacagtattcgccgactgataaagg

SEQ ID NO: 189518 - DNA, 41 bp, Artificial Sequence
  Description of Artificial Sequence: Synthetic oligonucleotide
atcctcttaatttcttacagtattcgccgactgataaaggc

SEQ ID NO: 189519 - DNA, 40 bp, Artificial Sequence
  Description of Artificial Sequence: Synthetic oligonucleotide
tcctcttaatttcttacagtattcgccgactgataaaggc

SEQ ID NO: 189520 - DNA, 39 bp, Artificial Sequence
  Description of Artificial Sequence: Synthetic oligonucleotide
cctcttaatttcttacagtattcgccgactgataaaggc

SEQ ID NO: 189521 - DNA, 41 bp, Artificial Sequence
  Description of Artificial Sequence: Synthetic oligonucleotide
ctcttaatttcttacagtattcgccgactgataaaggcatg

SEQ ID NO: 189522 - DNA, 45 bp, Artificial Sequence
  Description of Artificial Sequence: Synthetic oligonucleotide
acaaagagttacatctcatcacagacaaatgataagcacaaacag

SEQ ID NO: 189523 - DNA, 44 bp, Artificial Sequence
  Description of Artificial Sequence: Synthetic oligonucleotide
caaagagttacatctcatcacagacaaatgataagcacaaacag

SEQ ID NO: 189524 - DNA, 44 bp, Artificial Sequence
  Description of Artificial Sequence: Synthetic oligonucleotide
aaagagttacatctcatcacagacaaatgataagcacaaacagg

SEQ ID NO: 189525 - DNA, 43 bp, Artificial Sequence
  Description of Artificial Sequence: Synthetic oligonucleotide
aagagttacatctcatcacagacaaatgataagcacaaacagg

SEQ ID NO: 189526 - DNA, 42 bp, Artificial Sequence
  Description of Artificial Sequence: Synthetic oligonucleotide
agagttacatctcatcacagacaaatgataagcacaaacagg

SEQ ID NO: 189527 - DNA, 41 bp, Artificial Sequence
  Description of Artificial Sequence: Synthetic oligonucleotide
gagttacatctcatcacagacaaatgataagcacaaacagg

SEQ ID NO: 189528 - DNA, 42 bp, Artificial Sequence
  Description of Artificial Sequence: Synthetic oligonucleotide
agttacatctcatcacagacaaatgataagcacaaacaggac

SEQ ID NO: 189529 - DNA, 41 bp, Artificial Sequence
  Description of Artificial Sequence: Synthetic oligonucleotide
gttacatctcatcacagacaaatgataagcacaaacaggac

SEQ ID NO: 189530 - DNA, 42 bp, Artificial Sequence
  Description of Artificial Sequence: Synthetic oligonucleotide
ttacatctcatcacagacaaatgataagcacaaacaggacac

SEQ ID NO: 189531 - DNA, 41 bp, Artificial Sequence
  Description of Artificial Sequence: Synthetic oligonucleotide
tacatctcatcacagacaaatgataagcacaaacaggacac

SEQ ID NO: 189532 - DNA, 40 bp, Artificial Sequence
  Description of Artificial Sequence: Synthetic oligonucleotide
acatctcatcacagacaaatgataagcacaaacaggacac

SEQ ID NO: 189533 - DNA, 39 bp, Artificial Sequence
  Description of Artificial Sequence: Synthetic oligonucleotide
catctcatcacagacaaatgataagcacaaacaggacac

SEQ ID NO: 189534 - DNA, 43 bp, Artificial Sequence
  Description of Artificial Sequence: Synthetic oligonucleotide
atctcatcacagacaaatgataagcacaaacaggacacatatc

SEQ ID NO: 189535 - DNA, 42 bp, Artificial Sequence
  Description of Artificial Sequence: Synthetic oligonucleotide
tctcatcacagacaaatgataagcacaaacaggacacatatc

SEQ ID NO: 189536 - DNA, 41 bp, Artificial Sequence
  Description of Artificial Sequence: Synthetic oligonucleotide
ctcatcacagacaaatgataagcacaaacaggacacatatc

SEQ ID NO: 189537 - DNA, 41 bp, Artificial Sequence
  Description of Artificial Sequence: Synthetic oligonucleotide
tcatcacagacaaatgataagcacaaacaggacacatatcc

SEQ ID NO: 189538 - DNA, 40 bp, Artificial Sequence
  Description of Artificial Sequence: Synthetic oligonucleotide
catcacagacaaatgataagcacaaacaggacacatatcc

SEQ ID NO: 189539 - DNA, 41 bp, Artificial Sequence
  Description of Artificial Sequence: Synthetic oligonucleotide
atcacagacaaatgataagcacaaacaggacacatatccag

SEQ ID NO: 189540 - DNA, 40 bp, Artificial Sequence
  Description of Artificial Sequence: Synthetic oligonucleotide
tcacagacaaatgataagcacaaacaggacacatatccag

SEQ ID NO: 189541 - DNA, 39 bp, Artificial Sequence
  Description of Artificial Sequence: Synthetic oligonucleotide
cacagacaaatgataagcacaaacaggacacatatccag

SEQ ID NO: 189542 - DNA, 39 bp, Artificial Sequence
  Description of Artificial Sequence: Synthetic oligonucleotide
acagacaaatgataagcacaaacaggacacatatccagc

SEQ ID NO: 189543 - DNA, 38 bp, Artificial Sequence
  Description of Artificial Sequence: Synthetic oligonucleotide
cagacaaatgataagcacaaacaggacacatatccagc

SEQ ID NO: 189544 - DNA, 39 bp, Artificial Sequence
  Description of Artificial Sequence: Synthetic oligonucleotide
agacaaatgataagcacaaacaggacacatatccagctc

SEQ ID NO: 189545 - DNA, 38 bp, Artificial Sequence
  Description of Artificial Sequence: Synthetic oligonucleotide
gacaaatgataagcacaaacaggacacatatccagctc

SEQ ID NO: 189546 - DNA, 41 bp, Artificial Sequence
  Description of Artificial Sequence: Synthetic oligonucleotide
acaaatgataagcacaaacaggacacatatccagctcatac

SEQ ID NO: 189547 - DNA, 40 bp, Artificial Sequence
  Description of Artificial Sequence: Synthetic oligonucleotide
caaatgataagcacaaacaggacacatatccagctcatac

SEQ ID NO: 189548 - DNA, 41 bp, Artificial Sequence
  Description of Artificial Sequence: Synthetic oligonucleotide
aaatgataagcacaaacaggacacatatccagctcatactg

SEQ ID NO: 189549 - DNA, 40 bp, Artificial Sequence
  Description of Artificial Sequence: Synthetic oligonucleotide
aatgataagcacaaacaggacacatatccagctcatactg

SEQ ID NO: 189550 - DNA, 39 bp, Artificial Sequence
  Description of Artificial Sequence: Synthetic oligonucleotide
atgataagcacaaacaggacacatatccagctcatactg

SEQ ID NO: 189551 - DNA, 38 bp, Artificial Sequence
  Description of Artificial Sequence: Synthetic oligonucleotide
tgataagcacaaacaggacacatatccagctcatactg

SEQ ID NO: 189552 - DNA, 37 bp, Artificial Sequence
  Description of Artificial Sequence: Synthetic oligonucleotide
gataagcacaaacaggacacatatccagctcatactg

SEQ ID NO: 189553 - DNA, 37 bp, Artificial Sequence
  Description of Artificial Sequence: Synthetic oligonucleotide
ataagcacaaacaggacacatatccagctcatactgc

SEQ ID NO: 189554 - DNA, 36 bp, Artificial Sequence
  Description of Artificial Sequence: Synthetic oligonucleotide
taagcacaaacaggacacatatccagctcatactgc

SEQ ID NO: 189555 - DNA, 35 bp, Artificial Sequence
  Description of Artificial Sequence: Synthetic oligonucleotide
aagcacaaacaggacacatatccagctcatactgc

SEQ ID NO: 189556 - DNA, 34 bp, Artificial Sequence
  Description of Artificial Sequence: Synthetic oligonucleotide
agcacaaacaggacacatatccagctcatactgc

SEQ ID NO: 189557 - DNA, 33 bp, Artificial Sequence
  Description of Artificial Sequence: Synthetic oligonucleotide
gcacaaacaggacacatatccagctcatactgc

SEQ ID NO: 189558 - DNA, 37 bp, Artificial Sequence
  Description of Artificial Sequence: Synthetic oligonucleotide
cacaaacaggacacatatccagctcatactgctaatg

SEQ ID NO: 189559 - DNA, 39 bp, Artificial Sequence
  Description of Artificial Sequence: Synthetic oligonucleotide
acaaacaggacacatatccagctcatactgctaatgaag

SEQ ID NO: 189560 - DNA, 38 bp, Artificial Sequence
  Description of Artificial Sequence: Synthetic oligonucleotide
caaacaggacacatatccagctcatactgctaatgaag

SEQ ID NO: 189561 - DNA, 41 bp, Artificial Sequence
  Description of Artificial Sequence: Synthetic oligonucleotide
aaacaggacacatatccagctcatactgctaatgaagtttc

SEQ ID NO: 189562 - DNA, 40 bp, Artificial Sequence
  Description of Artificial Sequence: Synthetic oligonucleotide
aacaggacacatatccagctcatactgctaatgaagtttc

SEQ ID NO: 189563 - DNA, 39 bp, Artificial Sequence
  Description of Artificial Sequence: Synthetic oligonucleotide
acaggacacatatccagctcatactgctaatgaagtttc

SEQ ID NO: 189564 - DNA, 38 bp, Artificial Sequence
  Description of Artificial Sequence: Synthetic oligonucleotide
caggacacatatccagctcatactgctaatgaagtttc

SEQ ID NO: 189565 - DNA, 39 bp, Artificial Sequence
  Description of Artificial Sequence: Synthetic oligonucleotide
aggacacatatccagctcatactgctaatgaagtttcag

SEQ ID NO: 189566 - DNA, 38 bp, Artificial Sequence
  Description of Artificial Sequence: Synthetic oligonucleotide
ggacacatatccagctcatactgctaatgaagtttcag

SEQ ID NO: 189567 - DNA, 44 bp, Artificial Sequence
  Description of Artificial Sequence: Synthetic oligonucleotide
gacacatatccagctcatactgctaatgaagtttcagaaatttc

SEQ ID NO: 189568 - DNA, 45 bp, Artificial Sequence
  Description of Artificial Sequence: Synthetic oligonucleotide
acacatatccagctcatactgctaatgaagtttcagaaatttctg

SEQ ID NO: 189569 - DNA, 44 bp, Artificial Sequence
  Description of Artificial Sequence: Synthetic oligonucleotide
cacatatccagctcatactgctaatgaagtttcagaaatttctg

SEQ ID NO: 189570 - DNA, 47 bp, Artificial Sequence
  Description of Artificial Sequence: Synthetic oligonucleotide
acatatccagctcatactgctaatgaagtttcagaaatttctgttac

SEQ ID NO: 189571 - DNA, 46 bp, Artificial Sequence
  Description of Artificial Sequence: Synthetic oligonucleotide
catatccagctcatactgctaatgaagtttcagaaatttctgttac

SEQ ID NO: 189572 - DNA, 48 bp, Artificial Sequence
  Description of Artificial Sequence: Synthetic oligonucleotide
atatccagctcatactgctaatgaagtttcagaaatttctgttacaac

SEQ ID NO: 189573 - DNA, 47 bp, Artificial Sequence
  Description of Artificial Sequence: Synthetic oligonucleotide
tatccagctcatactgctaatgaagtttcagaaatttctgttacaac

SEQ ID NO: 189574 - DNA, 46 bp, Artificial Sequence
  Description of Artificial Sequence: Synthetic oligonucleotide
atccagctcatactgctaatgaagtttcagaaatttctgttacaac

SEQ ID NO: 189575 - DNA, 43 bp, Artificial Sequence
  Description of Artificial Sequence: Synthetic oligonucleotide
tgatggctggtattattggaacgatcctcttaatttcttacac

SEQ ID NO: 189576 - DNA, 42 bp, Artificial Sequence
  Description of Artificial Sequence: Synthetic oligonucleotide
gatggctggtattattggaacgatcctcttaatttcttacac

SEQ ID NO: 189577 - DNA, 46 bp, Artificial Sequence
  Description of Artificial Sequence: Synthetic oligonucleotide
atggctggtattattggaacgatcctcttaatttcttacactattc

SEQ ID NO: 189578 - DNA, 45 bp, Artificial Sequence
  Description of Artificial Sequence: Synthetic oligonucleotide
tggctggtattattggaacgatcctcttaatttcttacactattc

SEQ ID NO: 189579 - DNA, 44 bp, Artificial Sequence
  Description of Artificial Sequence: Synthetic oligonucleotide
ggctggtattattggaacgatcctcttaatttcttacactattc

SEQ ID NO: 189580 - DNA, 44 bp, Artificial Sequence
  Description of Artificial Sequence: Synthetic oligonucleotide
gctggtattattggaacgatcctcttaatttcttacactattcg

SEQ ID NO: 189581 - DNA, 44 bp, Artificial Sequence
  Description of Artificial Sequence: Synthetic oligonucleotide
ctggtattattggaacgatcctcttaatttcttacactattcgc

SEQ ID NO: 189582 - DNA, 44 bp, Artificial Sequence
  Description of Artificial Sequence: Synthetic oligonucleotide
tggtattattggaacgatcctcttaatttcttacactattcgcc

SEQ ID NO: 189583 - DNA, 43 bp, Artificial Sequence
  Description of Artificial Sequence: Synthetic oligonucleotide
ggtattattggaacgatcctcttaatttcttacactattcgcc

SEQ ID NO: 189584 - DNA, 43 bp, Artificial Sequence
  Description of Artificial Sequence: Synthetic oligonucleotide
gtattattggaacgatcctcttaatttcttacactattcgccg

SEQ ID NO: 189585 - DNA, 44 bp, Artificial Sequence
  Description of Artificial Sequence: Synthetic oligonucleotide
tattattggaacgatcctcttaatttcttacactattcgccgac

SEQ ID NO: 189586 - DNA, 43 bp, Artificial Sequence
  Description of Artificial Sequence: Synthetic oligonucleotide
attattggaacgatcctcttaatttcttacactattcgccgac

SEQ ID NO: 189587 - DNA, 42 bp, Artificial Sequence
  Description of Artificial Sequence: Synthetic oligonucleotide
ttattggaacgatcctcttaatttcttacactattcgccgac

SEQ ID NO: 189588 - DNA, 41 bp, Artificial Sequence
  Description of Artificial Sequence: Synthetic oligonucleotide
tattggaacgatcctcttaatttcttacactattcgccgac

SEQ ID NO: 189589 - DNA, 40 bp, Artificial Sequence
  Description of Artificial Sequence: Synthetic oligonucleotide
attggaacgatcctcttaatttcttacactattcgccgac

SEQ ID NO: 189590 - DNA, 39 bp, Artificial Sequence
  Description of Artificial Sequence: Synthetic oligonucleotide
ttggaacgatcctcttaatttcttacactattcgccgac

SEQ ID NO: 189591 - DNA, 38 bp, Artificial Sequence
  Description of Artificial Sequence: Synthetic oligonucleotide
tggaacgatcctcttaatttcttacactattcgccgac

SEQ ID NO: 189592 - DNA, 37 bp, Artificial Sequence
  Description of Artificial Sequence: Synthetic oligonucleotide
ggaacgatcctcttaatttcttacactattcgccgac

SEQ ID NO: 189593 - DNA, 38 bp, Artificial Sequence
  Description of Artificial Sequence: Synthetic oligonucleotide
gaacgatcctcttaatttcttacactattcgccgactg

SEQ ID NO: 189594 - DNA, 43 bp, Artificial Sequence
  Description of Artificial Sequence: Synthetic oligonucleotide
aacgatcctcttaatttcttacactattcgccgactgataaag

SEQ ID NO: 189595 - DNA, 56 bp, Artificial Sequence
  Description of Artificial Sequence: Synthetic oligonucleotide
tatggaaaaataatctttgtattactattgtcagaaattgtgagcatatcagcatg

SEQ ID NO: 189596 - DNA, 55 bp, Artificial Sequence
  Description of Artificial Sequence: Synthetic oligonucleotide
atggaaaaataatctttgtattactattgtcagaaattgtgagcatatcagcatg

SEQ ID NO: 189597 - DNA, 54 bp, Artificial Sequence
  Description of Artificial Sequence: Synthetic oligonucleotide
tggaaaaataatctttgtattactattgtcagaaattgtgagcatatcagcatg

SEQ ID NO: 189598 - DNA, 53 bp, Artificial Sequence
  Description of Artificial Sequence: Synthetic oligonucleotide
ggaaaaataatctttgtattactattgtcagaaattgtgagcatatcagcatg

SEQ ID NO: 189599 - DNA, 53 bp, Artificial Sequence
  Description of Artificial Sequence: Synthetic oligonucleotide
gaaaaataatctttgtattactattgtcagaaattgtgagcatatcagcatgg

SEQ ID NO: 189600 - DNA, 54 bp, Artificial Sequence
  Description of Artificial Sequence: Synthetic oligonucleotide
aaaaataatctttgtattactattgtcagaaattgtgagcatatcagcatggag

SEQ ID NO: 189601 - DNA, 53 bp, Artificial Sequence
  Description of Artificial Sequence: Synthetic oligonucleotide
aaaataatctttgtattactattgtcagaaattgtgagcatatcagcatggag

SEQ ID NO: 189602 - DNA, 52 bp, Artificial Sequence
  Description of Artificial Sequence: Synthetic oligonucleotide
aaataatctttgtattactattgtcagaaattgtgagcatatcagcatggag

SEQ ID NO: 189603 - DNA, 51 bp, Artificial Sequence
  Description of Artificial Sequence: Synthetic oligonucleotide
aataatctttgtattactattgtcagaaattgtgagcatatcagcatggag

SEQ ID NO: 189604 - DNA, 50 bp, Artificial Sequence
  Description of Artificial Sequence: Synthetic oligonucleotide
ataatctttgtattactattgtcagaaattgtgagcatatcagcatggag

SEQ ID NO: 189605 - DNA, 49 bp, Artificial Sequence
  Description of Artificial Sequence: Synthetic oligonucleotide
taatctttgtattactattgtcagaaattgtgagcatatcagcatggag

SEQ ID NO: 189606 - DNA, 48 bp, Artificial Sequence
  Description of Artificial Sequence: Synthetic oligonucleotide
aatctttgtattactattgtcagaaattgtgagcatatcagcatggag

SEQ ID NO: 189607 - DNA, 47 bp, Artificial Sequence
  Description of Artificial Sequence: Synthetic oligonucleotide
atctttgtattactattgtcagaaattgtgagcatatcagcatggag

SEQ ID NO: 189608 - DNA, 46 bp, Artificial Sequence
  Description of Artificial Sequence: Synthetic oligonucleotide
tctttgtattactattgtcagaaattgtgagcatatcagcatggag

SEQ ID NO: 189609 - DNA, 45 bp, Artificial Sequence
  Description of Artificial Sequence: Synthetic oligonucleotide
ctttgtattactattgtcagaaattgtgagcatatcagcatggag

SEQ ID NO: 189610 - DNA, 47 bp, Artificial Sequence
  Description of Artificial Sequence: Synthetic oligonucleotide
tttgtattactattgtcagaaattgtgagcatatcagcatggagtac

SEQ ID NO: 189611 - DNA, 46 bp, Artificial Sequence
  Description of Artificial Sequence: Synthetic oligonucleotide
ttgtattactattgtcagaaattgtgagcatatcagcatggagtac

SEQ ID NO: 189612 - DNA, 45 bp, Artificial Sequence
  Description of Artificial Sequence: Synthetic oligonucleotide
tgtattactattgtcagaaattgtgagcatatcagcatggagtac

SEQ ID NO: 189613 - DNA, 44 bp, Artificial Sequence
  Description of Artificial Sequence: Synthetic oligonucleotide
gtattactattgtcagaaattgtgagcatatcagcatggagtac

SEQ ID NO: 189614 - DNA, 44 bp, Artificial Sequence
  Description of Artificial Sequence: Synthetic oligonucleotide
tattactattgtcagaaattgtgagcatatcagcatggagtacc

SEQ ID NO: 189615 - DNA, 43 bp, Artificial Sequence
  Description of Artificial Sequence: Synthetic oligonucleotide
attactattgtcagaaattgtgagcatatcagcatggagtacc

SEQ ID NO: 189616 - DNA, 42 bp, Artificial Sequence
  Description of Artificial Sequence: Synthetic oligonucleotide
ttactattgtcagaaattgtgagcatatcagcatggagtacc

SEQ ID NO: 189617 - DNA, 41 bp, Artificial Sequence
  Description of Artificial Sequence: Synthetic oligonucleotide
tactattgtcagaaattgtgagcatatcagcatggagtacc

SEQ ID NO: 189618 - DNA, 40 bp, Artificial Sequence
  Description of Artificial Sequence: Synthetic oligonucleotide
actattgtcagaaattgtgagcatatcagcatggagtacc

SEQ ID NO: 189619 - DNA, 39 bp, Artificial Sequence
  Description of Artificial Sequence: Synthetic oligonucleotide
ctattgtcagaaattgtgagcatatcagcatggagtacc

SEQ ID NO: 189620 - DNA, 40 bp, Artificial Sequence
  Description of Artificial Sequence: Synthetic oligonucleotide
tattgtcagaaattgtgagcatatcagcatggagtacctc

SEQ ID NO: 189621 - DNA, 39 bp, Artificial Sequence
  Description of Artificial Sequence: Synthetic oligonucleotide
attgtcagaaattgtgagcatatcagcatggagtacctc

SEQ ID NO: 189622 - DNA, 38 bp, Artificial Sequence
  Description of Artificial Sequence: Synthetic oligonucleotide
ttgtcagaaattgtgagcatatcagcatggagtacctc

SEQ ID NO: 189623 - DNA, 37 bp, Artificial Sequence
  Description of Artificial Sequence: Synthetic oligonucleotide
tgtcagaaattgtgagcatatcagcatggagtacctc

SEQ ID NO: 189624 - DNA, 36 bp, Artificial Sequence
  Description of Artificial Sequence: Synthetic oligonucleotide
gtcagaaattgtgagcatatcagcatggagtacctc

SEQ ID NO: 189625 - DNA, 37 bp, Artificial Sequence
  Description of Artificial Sequence: Synthetic oligonucleotide
tcagaaattgtgagcatatcagcatggagtacctctg

SEQ ID NO: 189626 - DNA, 36 bp, Artificial Sequence
  Description of Artificial Sequence: Synthetic oligonucleotide
cagaaattgtgagcatatcagcatggagtacctctg

SEQ ID NO: 189627 - DNA, 36 bp, Artificial Sequence
  Description of Artificial Sequence: Synthetic oligonucleotide
agaaattgtgagcatatcagcatggagtacctctgg

SEQ ID NO: 189628 - DNA, 35 bp, Artificial Sequence
  Description of Artificial Sequence: Synthetic oligonucleotide
gaaattgtgagcatatcagcatggagtacctctgg

SEQ ID NO: 189629 - DNA, 36 bp, Artificial Sequence
  Description of Artificial Sequence: Synthetic oligonucleotide
aaattgtgagcatatcagcatggagtacctctggtg

SEQ ID NO: 189630 - DNA, 35 bp, Artificial Sequence
  Description of Artificial Sequence: Synthetic oligonucleotide
aattgtgagcatatcagcatggagtacctctggtg

SEQ ID NO: 189631 - DNA, 34 bp, Artificial Sequence
  Description of Artificial Sequence: Synthetic oligonucleotide
attgtgagcatatcagcatggagtacctctggtg

SEQ ID NO: 189632 - DNA, 33 bp, Artificial Sequence
  Description of Artificial Sequence: Synthetic oligonucleotide
ttgtgagcatatcagcatggagtacctctggtg

SEQ ID NO: 189633 - DNA, 32 bp, Artificial Sequence
  Description of Artificial Sequence: Synthetic oligonucleotide
tgtgagcatatcagcatggagtacctctggtg

SEQ ID NO: 189634 - DNA, 31 bp, Artificial Sequence
  Description of Artificial Sequence: Synthetic oligonucleotide
gtgagcatatcagcatggagtacctctggtg

SEQ ID NO: 189635 - DNA, 32 bp, Artificial Sequence
  Description of Artificial Sequence: Synthetic oligonucleotide
tgagcatatcagcatggagtacctctggtgtg

SEQ ID NO: 189636 - DNA, 31 bp, Artificial Sequence
  Description of Artificial Sequence: Synthetic oligonucleotide
gagcatatcagcatggagtacctctggtgtg

SEQ ID NO: 189637 - DNA, 31 bp, Artificial Sequence
  Description of Artificial Sequence: Synthetic oligonucleotide
agcatatcagcatggagtacctctggtgtgg

SEQ ID NO: 189638 - DNA, 30 bp, Artificial Sequence
  Description of Artificial Sequence: Synthetic oligonucleotide
gcatatcagcatggagtacctctggtgtgg

SEQ ID NO: 189639 - DNA, 30 bp, Artificial Sequence
  Description of Artificial Sequence: Synthetic oligonucleotide
catatcagcatggagtacctctggtgtggc

SEQ ID NO: 189640 - DNA, 33 bp, Artificial Sequence
  Description of Artificial Sequence: Synthetic oligonucleotide
atatcagcatggagtacctctggtgtggcaatg

SEQ ID NO: 189641 - DNA, 32 bp, Artificial Sequence
  Description of Artificial Sequence: Synthetic oligonucleotide
tatcagcatggagtacctctggtgtggcaatg

SEQ ID NO: 189642 - DNA, 31 bp, Artificial Sequence
  Description of Artificial Sequence: Synthetic oligonucleotide
atcagcatggagtacctctggtgtggcaatg

SEQ ID NO: 189643 - DNA, 30 bp, Artificial Sequence
  Description of Artificial Sequence: Synthetic oligonucleotide
tcagcatggagtacctctggtgtggcaatg

SEQ ID NO: 189644 - DNA, 29 bp, Artificial Sequence
  Description of Artificial Sequence: Synthetic oligonucleotide
cagcatggagtacctctggtgtggcaatg

SEQ ID NO: 189645 - DNA, 29 bp, Artificial Sequence
  Description of Artificial Sequence: Synthetic oligonucleotide
agcatggagtacctctggtgtggcaatgc

SEQ ID NO: 189646 - DNA, 28 bp, Artificial Sequence
  Description of Artificial Sequence: Synthetic oligonucleotide
gcatggagtacctctggtgtggcaatgc

SEQ ID NO: 189647 - DNA, 29 bp, Artificial Sequence
  Description of Artificial Sequence: Synthetic oligonucleotide
catggagtacctctggtgtggcaatgcac

SEQ ID NO: 189648 - DNA, 30 bp, Artificial Sequence
  Description of Artificial Sequence: Synthetic oligonucleotide
atggagtacctctggtgtggcaatgcacac

SEQ ID NO: 189649 - DNA, 29 bp, Artificial Sequence
  Description of Artificial Sequence: Synthetic oligonucleotide
tggagtacctctggtgtggcaatgcacac

SEQ ID NO: 189650 - DNA, 28 bp, Artificial Sequence
  Description of Artificial Sequence: Synthetic oligonucleotide
ggagtacctctggtgtggcaatgcacac

SEQ ID NO: 189651 - DNA, 28 bp, Artificial Sequence
  Description of Artificial Sequence: Synthetic oligonucleotide
gagtacctctggtgtggcaatgcacacc

SEQ ID NO: 189652 - DNA, 29 bp, Artificial Sequence
  Description of Artificial Sequence: Synthetic oligonucleotide
agtacctctggtgtggcaatgcacacctc

SEQ ID NO: 189653 - DNA, 28 bp, Artificial Sequence
  Description of Artificial Sequence: Synthetic oligonucleotide
gtacctctggtgtggcaatgcacacctc

SEQ ID NO: 189654 - DNA, 30 bp, Artificial Sequence
  Description of Artificial Sequence: Synthetic oligonucleotide
tacctctggtgtggcaatgcacacctcaac

SEQ ID NO: 189655 - DNA, 29 bp, Artificial Sequence
  Description of Artificial Sequence: Synthetic oligonucleotide
acctctggtgtggcaatgcacacctcaac

SEQ ID NO: 189656 - DNA, 28 bp, Artificial Sequence
  Description of Artificial Sequence: Synthetic oligonucleotide
cctctggtgtggcaatgcacacctcaac

SEQ ID NO: 189657 - DNA, 28 bp, Artificial Sequence
  Description of Artificial Sequence: Synthetic oligonucleotide
ctctggtgtggcaatgcacacctcaacc

SEQ ID NO: 189658 - DNA, 29 bp, Artificial Sequence
  Description of Artificial Sequence: Synthetic oligonucleotide
tctggtgtggcaatgcacacctcaacctc

SEQ ID NO: 189659 - DNA, 28 bp, Artificial Sequence
  Description of Artificial Sequence: Synthetic oligonucleotide
ctggtgtggcaatgcacacctcaacctc

SEQ ID NO: 189660 - DNA, 28 bp, Artificial Sequence
  Description of Artificial Sequence: Synthetic oligonucleotide
tggtgtggcaatgcacacctcaacctcc

SEQ ID NO: 189661 - DNA, 27 bp, Artificial Sequence
  Description of Artificial Sequence: Synthetic oligonucleotide
ggtgtggcaatgcacacctcaacctcc

SEQ ID NO: 189662 - DNA, 28 bp, Artificial Sequence
  Description of Artificial Sequence: Synthetic oligonucleotide
gtgtggcaatgcacacctcaacctcctc

SEQ ID NO: 189663 - DNA, 30 bp, Artificial Sequence
  Description of Artificial Sequence: Synthetic oligonucleotide
tgtggcaatgcacacctcaacctcctcttc

SEQ ID NO: 189664 - DNA, 29 bp, Artificial Sequence
  Description of Artificial Sequence: Synthetic oligonucleotide
gtggcaatgcacacctcaacctcctcttc

SEQ ID NO: 189665 - DNA, 29 bp, Artificial Sequence
  Description of Artificial Sequence: Synthetic oligonucleotide
tggcaatgcacacctcaacctcctcttcg

SEQ ID NO: 189666 - DNA, 28 bp, Artificial Sequence
  Description of Artificial Sequence: Synthetic oligonucleotide
ggcaatgcacacctcaacctcctcttcg

SEQ ID NO: 189667 - DNA, 28 bp, Artificial Sequence
  Description of Artificial Sequence: Synthetic oligonucleotide
gcaatgcacacctcaacctcctcttcgg

SEQ ID NO: 189668 - DNA, 29 bp, Artificial Sequence
  Description of Artificial Sequence: Synthetic oligonucleotide
caatgcacacctcaacctcctcttcggtc

SEQ ID NO: 189669 - DNA, 30 bp, Artificial Sequence
  Description of Artificial Sequence: Synthetic oligonucleotide
aatgcacacctcaacctcctcttcggtcac

SEQ ID NO: 189670 - DNA, 29 bp, Artificial Sequence
  Description of Artificial Sequence: Synthetic oligonucleotide
atgcacacctcaacctcctcttcggtcac

SEQ ID NO: 189671 - DNA, 28 bp, Artificial Sequence
  Description of Artificial Sequence: Synthetic oligonucleotide
tgcacacctcaacctcctcttcggtcac

SEQ ID NO: 189672 - DNA, 27 bp, Artificial Sequence
  Description of Artificial Sequence: Synthetic oligonucleotide
gcacacctcaacctcctcttcggtcac

SEQ ID NO: 189673 - DNA, 30 bp, Artificial Sequence
  Description of Artificial Sequence: Synthetic oligonucleotide
cacacctcaacctcctcttcggtcacaaag

SEQ ID NO: 189674 - DNA, 31 bp, Artificial Sequence
  Description of Artificial Sequence: Synthetic oligonucleotide
acacctcaacctcctcttcggtcacaaagag

SEQ ID NO: 189675 - DNA, 30 bp, Artificial Sequence
  Description of Artificial Sequence: Synthetic oligonucleotide
cacctcaacctcctcttcggtcacaaagag

SEQ ID NO: 189676 - DNA, 33 bp, Artificial Sequence
  Description of Artificial Sequence: Synthetic oligonucleotide
acctcaacctcctcttcggtcacaaagagttac

SEQ ID NO: 189677 - DNA, 32 bp, Artificial Sequence
  Description of Artificial Sequence: Synthetic oligonucleotide
cctcaacctcctcttcggtcacaaagagttac

SEQ ID NO: 189678 - DNA, 34 bp, Artificial Sequence
  Description of Artificial Sequence: Synthetic oligonucleotide
ctcaacctcctcttcggtcacaaagagttacatc

SEQ ID NO: 189679 - DNA, 35 bp, Artificial Sequence
  Description of Artificial Sequence: Synthetic oligonucleotide
tcaacctcctcttcggtcacaaagagttacatctc

SEQ ID NO: 189680 - DNA, 34 bp, Artificial Sequence
  Description of Artificial Sequence: Synthetic oligonucleotide
caacctcctcttcggtcacaaagagttacatctc

SEQ ID NO: 189681 - DNA, 36 bp, Artificial Sequence
  Description of Artificial Sequence: Synthetic oligonucleotide
aacctcctcttcggtcacaaagagttacatctcatc

SEQ ID NO: 189682 - DNA, 35 bp, Artificial Sequence
  Description of Artificial Sequence: Synthetic oligonucleotide
acctcctcttcggtcacaaagagttacatctcatc

SEQ ID NO: 189683 - DNA, 34 bp, Artificial Sequence
  Description of Artificial Sequence: Synthetic oligonucleotide
cctcctcttcggtcacaaagagttacatctcatc

SEQ ID NO: 189684 - DNA, 35 bp, Artificial Sequence
  Description of Artificial Sequence: Synthetic oligonucleotide
ctcctcttcggtcacaaagagttacatctcatcac

SEQ ID NO: 189685 - DNA, 36 bp, Artificial Sequence
  Description of Artificial Sequence: Synthetic oligonucleotide
tcctcttcggtcacaaagagttacatctcatcacag

SEQ ID NO: 189686 - DNA, 35 bp, Artificial Sequence
  Description of Artificial Sequence: Synthetic oligonucleotide
cctcttcggtcacaaagagttacatctcatcacag

SEQ ID NO: 189687 - DNA, 36 bp, Artificial Sequence
  Description of Artificial Sequence: Synthetic oligonucleotide
ctcttcggtcacaaagagttacatctcatcacagac

SEQ ID NO: 189688 - DNA, 40 bp, Artificial Sequence
  Description of Artificial Sequence: Synthetic oligonucleotide
tcttcggtcacaaagagttacatctcatcacagacaaatg

SEQ ID NO: 189689 - DNA, 39 bp, Artificial Sequence
  Description of Artificial Sequence: Synthetic oligonucleotide
cttcggtcacaaagagttacatctcatcacagacaaatg

SEQ ID NO: 189690 - DNA, 39 bp, Artificial Sequence
  Description of Artificial Sequence: Synthetic oligonucleotide
ttcggtcacaaagagttacatctcatcacagacaaatgg

SEQ ID NO: 189691 - DNA, 38 bp, Artificial Sequence
  Description of Artificial Sequence: Synthetic oligonucleotide
tcggtcacaaagagttacatctcatcacagacaaatgg

SEQ ID NO: 189692 - DNA, 37 bp, Artificial Sequence
  Description of Artificial Sequence: Synthetic oligonucleotide
cggtcacaaagagttacatctcatcacagacaaatgg

SEQ ID NO: 189693 - DNA, 38 bp, Artificial Sequence
  Description of Artificial Sequence: Synthetic oligonucleotide
ggtcacaaagagttacatctcatcacagacaaatggag

SEQ ID NO: 189694 - DNA, 42 bp, Artificial Sequence
  Description of Artificial Sequence: Synthetic oligonucleotide
gtcacaaagagttacatctcatcacagacaaatggagaaatg

SEQ ID NO: 189695 - DNA, 42 bp, Artificial Sequence
  Description of Artificial Sequence: Synthetic oligonucleotide
tcacaaagagttacatctcatcacagacaaatggagaaatgg

SEQ ID NO: 189696 - DNA, 41 bp, Artificial Sequence
  Description of Artificial Sequence: Synthetic oligonucleotide
cacaaagagttacatctcatcacagacaaatggagaaatgg

SEQ ID NO: 189697 - DNA, 41 bp, Artificial Sequence
  Description of Artificial Sequence: Synthetic oligonucleotide
acaaagagttacatctcatcacagacaaatggagaaatggg

SEQ ID NO: 189698 - DNA, 40 bp, Artificial Sequence
  Description of Artificial Sequence: Synthetic oligonucleotide
caaagagttacatctcatcacagacaaatggagaaatggg

SEQ ID NO: 189699 - DNA, 41 bp, Artificial Sequence
  Description of Artificial Sequence: Synthetic oligonucleotide
aaagagttacatctcatcacagacaaatggagaaatgggac

SEQ ID NO: 189700 - DNA, 40 bp, Artificial Sequence
  Description of Artificial Sequence: Synthetic oligonucleotide
aagagttacatctcatcacagacaaatggagaaatgggac

SEQ ID NO: 189701 - DNA, 39 bp, Artificial Sequence
  Description of Artificial Sequence: Synthetic oligonucleotide
agagttacatctcatcacagacaaatggagaaatgggac

SEQ ID NO: 189702 - DNA, 38 bp, Artificial Sequence
  Description of Artificial Sequence: Synthetic oligonucleotide
gagttacatctcatcacagacaaatggagaaatgggac

SEQ ID NO: 189703 - DNA, 40 bp, Artificial Sequence
  Description of Artificial Sequence: Synthetic oligonucleotide
agttacatctcatcacagacaaatggagaaatgggacaac

SEQ ID NO: 189704 - DNA, 39 bp, Artificial Sequence
  Description of Artificial Sequence: Synthetic oligonucleotide
gttacatctcatcacagacaaatggagaaatgggacaac

SEQ ID NO: 189705 - DNA, 41 bp, Artificial Sequence
  Description of Artificial Sequence: Synthetic oligonucleotide
ttacatctcatcacagacaaatggagaaatgggacaacttg

SEQ ID NO: 189706 - DNA, 40 bp, Artificial Sequence
  Description of Artificial Sequence: Synthetic oligonucleotide
tacatctcatcacagacaaatggagaaatgggacaacttg

SEQ ID NO: 189707 - DNA, 39 bp, Artificial Sequence
  Description of Artificial Sequence: Synthetic oligonucleotide
acatctcatcacagacaaatggagaaatgggacaacttg

SEQ ID NO: 189708 - DNA, 38 bp, Artificial Sequence
  Description of Artificial Sequence: Synthetic oligonucleotide
catctcatcacagacaaatggagaaatgggacaacttg

SEQ ID NO: 189709 - DNA, 39 bp, Artificial Sequence
  Description of Artificial Sequence: Synthetic oligonucleotide
atctcatcacagacaaatggagaaatgggacaacttgtc

SEQ ID NO: 189710 - DNA, 38 bp, Artificial Sequence
  Description of Artificial Sequence: Synthetic oligonucleotide
tctcatcacagacaaatggagaaatgggacaacttgtc

SEQ ID NO: 189711 - DNA, 37 bp, Artificial Sequence
  Description of Artificial Sequence: Synthetic oligonucleotide
ctcatcacagacaaatggagaaatgggacaacttgtc

SEQ ID NO: 189712 - DNA, 37 bp, Artificial Sequence
  Description of Artificial Sequence: Synthetic oligonucleotide
tcatcacagacaaatggagaaatgggacaacttgtcc

SEQ ID NO: 189713 - DNA, 36 bp, Artificial Sequence
  Description of Artificial Sequence: Synthetic oligonucleotide
catcacagacaaatggagaaatgggacaacttgtcc

SEQ ID NO: 189714 - DNA, 38 bp, Artificial Sequence
  Description of Artificial Sequence: Synthetic oligonucleotide
atcacagacaaatggagaaatgggacaacttgtccatc

SEQ ID NO: 189715 - DNA, 37 bp, Artificial Sequence
  Description of Artificial Sequence: Synthetic oligonucleotide
tcacagacaaatggagaaatgggacaacttgtccatc

SEQ ID NO: 189716 - DNA, 36 bp, Artificial Sequence
  Description of Artificial Sequence: Synthetic oligonucleotide
cacagacaaatggagaaatgggacaacttgtccatc

SEQ ID NO: 189717 - DNA, 36 bp, Artificial Sequence
  Description of Artificial Sequence: Synthetic oligonucleotide
acagacaaatggagaaatgggacaacttgtccatcg

SEQ ID NO: 189718 - DNA, 35 bp, Artificial Sequence
  Description of Artificial Sequence: Synthetic oligonucleotide
cagacaaatggagaaatgggacaacttgtccatcg

SEQ ID NO: 189719 - DNA, 38 bp, Artificial Sequence
  Description of Artificial Sequence: Synthetic oligonucleotide
agacaaatggagaaatgggacaacttgtccatcgtttc

SEQ ID NO: 189720 - DNA, 37 bp, Artificial Sequence
  Description of Artificial Sequence: Synthetic oligonucleotide
gacaaatggagaaatgggacaacttgtccatcgtttc

SEQ ID NO: 189721 - DNA, 38 bp, Artificial Sequence
  Description of Artificial Sequence: Synthetic oligonucleotide
acaaatggagaaatgggacaacttgtccatcgtttcac

SEQ ID NO: 189722 - DNA, 37 bp, Artificial Sequence
  Description of Artificial Sequence: Synthetic oligonucleotide
caaatggagaaatgggacaacttgtccatcgtttcac

SEQ ID NO: 189723 - DNA, 38 bp, Artificial Sequence
  Description of Artificial Sequence: Synthetic oligonucleotide
aaatggagaaatgggacaacttgtccatcgtttcactg

SEQ ID NO: 189724 - DNA, 37 bp, Artificial Sequence
  Description of Artificial Sequence: Synthetic oligonucleotide
aatggagaaatgggacaacttgtccatcgtttcactg

SEQ ID NO: 189725 - DNA, 36 bp, Artificial Sequence
  Description of Artificial Sequence: Synthetic oligonucleotide
atggagaaatgggacaacttgtccatcgtttcactg

SEQ ID NO: 189726 - DNA, 35 bp, Artificial Sequence
  Description of Artificial Sequence: Synthetic oligonucleotide
tggagaaatgggacaacttgtccatcgtttcactg

SEQ ID NO: 189727 - DNA, 34 bp, Artificial Sequence
  Description of Artificial Sequence: Synthetic oligonucleotide
ggagaaatgggacaacttgtccatcgtttcactg

SEQ ID NO: 189728 - DNA, 36 bp, Artificial Sequence
  Description of Artificial Sequence: Synthetic oligonucleotide
gagaaatgggacaacttgtccatcgtttcactgtac

SEQ ID NO: 189729 - DNA, 36 bp, Artificial Sequence
  Description of Artificial Sequence: Synthetic oligonucleotide
agaaatgggacaacttgtccatcgtttcactgtacc

SEQ ID NO: 189730 - DNA, 35 bp, Artificial Sequence
  Description of Artificial Sequence: Synthetic oligonucleotide
gaaatgggacaacttgtccatcgtttcactgtacc

SEQ ID NO: 189731 - DNA, 36 bp, Artificial Sequence
  Description of Artificial Sequence: Synthetic oligonucleotide
aaatgggacaacttgtccatcgtttcactgtaccag

SEQ ID NO: 189732 - DNA, 35 bp, Artificial Sequence
  Description of Artificial Sequence: Synthetic oligonucleotide
aatgggacaacttgtccatcgtttcactgtaccag

SEQ ID NO: 189733 - DNA, 34 bp, Artificial Sequence
  Description of Artificial Sequence: Synthetic oligonucleotide
atgggacaacttgtccatcgtttcactgtaccag

SEQ ID NO: 189734 - DNA, 33 bp, Artificial Sequence
  Description of Artificial Sequence: Synthetic oligonucleotide
tgggacaacttgtccatcgtttcactgtaccag

SEQ ID NO: 189735 - DNA, 36 bp, Artificial Sequence
  Description of Artificial Sequence: Synthetic oligonucleotide
ggacaacttgtccatcgtttcactgtaccagtattc

SEQ ID NO: 189736 - DNA, 36 bp, Artificial Sequence
  Description of Artificial Sequence: Synthetic oligonucleotide
gacaacttgtccatcgtttcactgtaccagtattcg

SEQ ID NO: 189737 - DNA, 36 bp, Artificial Sequence
  Description of Artificial Sequence: Synthetic oligonucleotide
acaacttgtccatcgtttcactgtaccagtattcgc

SEQ ID NO: 189738 - DNA, 35 bp, Artificial Sequence
  Description of Artificial Sequence: Synthetic oligonucleotide
caacttgtccatcgtttcactgtaccagtattcgc

SEQ ID NO: 189739 - DNA, 35 bp, Artificial Sequence
  Description of Artificial Sequence: Synthetic oligonucleotide
aacttgtccatcgtttcactgtaccagtattcgcc

SEQ ID NO: 189740 - DNA, 34 bp, Artificial Sequence
  Description of Artificial Sequence: Synthetic oligonucleotide
acttgtccatcgtttcactgtaccagtattcgcc

SEQ ID NO: 189741 - DNA, 33 bp, Artificial Sequence
  Description of Artificial Sequence: Synthetic oligonucleotide
cttgtccatcgtttcactgtaccagtattcgcc

SEQ ID NO: 189742 - DNA, 33 bp, Artificial Sequence
  Description of Artificial Sequence: Synthetic oligonucleotide
ttgtccatcgtttcactgtaccagtattcgccg

SEQ ID NO: 189743 - DNA, 32 bp, Artificial Sequence
  Description of Artificial Sequence: Synthetic oligonucleotide
tgtccatcgtttcactgtaccagtattcgccg

SEQ ID NO: 189744 - DNA, 31 bp, Artificial Sequence
  Description of Artificial Sequence: Synthetic oligonucleotide
gtccatcgtttcactgtaccagtattcgccg

SEQ ID NO: 189745 - DNA, 32 bp, Artificial Sequence
  Description of Artificial Sequence: Synthetic oligonucleotide
tccatcgtttcactgtaccagtattcgccgac

SEQ ID NO: 189746 - DNA, 31 bp, Artificial Sequence
  Description of Artificial Sequence: Synthetic oligonucleotide
ccatcgtttcactgtaccagtattcgccgac

SEQ ID NO: 189747 - DNA, 32 bp, Artificial Sequence
  Description of Artificial Sequence: Synthetic oligonucleotide
catcgtttcactgtaccagtattcgccgactg

SEQ ID NO: 189748 - DNA, 58 bp, Artificial Sequence
  Description of Artificial Sequence: Synthetic oligonucleotide
gaaaaataatctttgtattactattgtcagaaattgtgagcatatcagcattaagtag

SEQ ID NO: 189749 - DNA, 58 bp, Artificial Sequence
  Description of Artificial Sequence: Synthetic oligonucleotide
aaaaataatctttgtattactattgtcagaaattgtgagcatatcagcattaagtagc

SEQ ID NO: 189750 - DNA, 57 bp, Artificial Sequence
  Description of Artificial Sequence: Synthetic oligonucleotide
aaaataatctttgtattactattgtcagaaattgtgagcatatcagcattaagtagc

SEQ ID NO: 189751 - DNA, 56 bp, Artificial Sequence
  Description of Artificial Sequence: Synthetic oligonucleotide
aaataatctttgtattactattgtcagaaattgtgagcatatcagcattaagtagc

SEQ ID NO: 189752 - DNA, 55 bp, Artificial Sequence
  Description of Artificial Sequence: Synthetic oligonucleotide
aataatctttgtattactattgtcagaaattgtgagcatatcagcattaagtagc

SEQ ID NO: 189753 - DNA, 54 bp, Artificial Sequence
  Description of Artificial Sequence: Synthetic oligonucleotide
ataatctttgtattactattgtcagaaattgtgagcatatcagcattaagtagc

SEQ ID NO: 189754 - DNA, 53 bp, Artificial Sequence
  Description of Artificial Sequence: Synthetic oligonucleotide
taatctttgtattactattgtcagaaattgtgagcatatcagcattaagtagc

SEQ ID NO: 189755 - DNA, 52 bp, Artificial Sequence
  Description of Artificial Sequence: Synthetic oligonucleotide
aatctttgtattactattgtcagaaattgtgagcatatcagcattaagtagc

SEQ ID NO: 189756 - DNA, 51 bp, Artificial Sequence
  Description of Artificial Sequence: Synthetic oligonucleotide
atctttgtattactattgtcagaaattgtgagcatatcagcattaagtagc

SEQ ID NO: 189757 - DNA, 50 bp, Artificial Sequence
  Description of Artificial Sequence: Synthetic oligonucleotide
tctttgtattactattgtcagaaattgtgagcatatcagcattaagtagc

SEQ ID NO: 189758 - DNA, 49 bp, Artificial Sequence
  Description of Artificial Sequence: Synthetic oligonucleotide
ctttgtattactattgtcagaaattgtgagcatatcagcattaagtagc

SEQ ID NO: 189759 - DNA, 50 bp, Artificial Sequence
  Description of Artificial Sequence: Synthetic oligonucleotide
tttgtattactattgtcagaaattgtgagcatatcagcattaagtagcac

SEQ ID NO: 189760 - DNA, 49 bp, Artificial Sequence
  Description of Artificial Sequence: Synthetic oligonucleotide
ttgtattactattgtcagaaattgtgagcatatcagcattaagtagcac

SEQ ID NO: 189761 - DNA, 48 bp, Artificial Sequence
  Description of Artificial Sequence: Synthetic oligonucleotide
tgtattactattgtcagaaattgtgagcatatcagcattaagtagcac

SEQ ID NO: 189762 - DNA, 47 bp, Artificial Sequence
  Description of Artificial Sequence: Synthetic oligonucleotide
gtattactattgtcagaaattgtgagcatatcagcattaagtagcac

SEQ ID NO: 189763 - DNA, 48 bp, Artificial Sequence
  Description of Artificial Sequence: Synthetic oligonucleotide
tattactattgtcagaaattgtgagcatatcagcattaagtagcactg

SEQ ID NO: 189764 - DNA, 47 bp, Artificial Sequence
  Description of Artificial Sequence: Synthetic oligonucleotide
attactattgtcagaaattgtgagcatatcagcattaagtagcactg

SEQ ID NO: 189765 - DNA, 46 bp, Artificial Sequence
  Description of Artificial Sequence: Synthetic oligonucleotide
ttactattgtcagaaattgtgagcatatcagcattaagtagcactg

SEQ ID NO: 189766 - DNA, 45 bp, Artificial Sequence
  Description of Artificial Sequence: Synthetic oligonucleotide
tactattgtcagaaattgtgagcatatcagcattaagtagcactg

SEQ ID NO: 189767 - DNA, 44 bp, Artificial Sequence
  Description of Artificial Sequence: Synthetic oligonucleotide
actattgtcagaaattgtgagcatatcagcattaagtagcactg

SEQ ID NO: 189768 - DNA, 43 bp, Artificial Sequence
  Description of Artificial Sequence: Synthetic oligonucleotide
ctattgtcagaaattgtgagcatatcagcattaagtagcactg

SEQ ID NO: 189769 - DNA, 44 bp, Artificial Sequence
  Description of Artificial Sequence: Synthetic oligonucleotide
tattgtcagaaattgtgagcatatcagcattaagtagcactgag

SEQ ID NO: 189770 - DNA, 43 bp, Artificial Sequence
  Description of Artificial Sequence: Synthetic oligonucleotide
attgtcagaaattgtgagcatatcagcattaagtagcactgag

SEQ ID NO: 189771 - DNA, 42 bp, Artificial Sequence
  Description of Artificial Sequence: Synthetic oligonucleotide
ttgtcagaaattgtgagcatatcagcattaagtagcactgag

SEQ ID NO: 189772 - DNA, 41 bp, Artificial Sequence
  Description of Artificial Sequence: Synthetic oligonucleotide
tgtcagaaattgtgagcatatcagcattaagtagcactgag

SEQ ID NO: 189773 - DNA, 40 bp, Artificial Sequence
  Description of Artificial Sequence: Synthetic oligonucleotide
gtcagaaattgtgagcatatcagcattaagtagcactgag

SEQ ID NO: 189774 - DNA, 40 bp, Artificial Sequence
  Description of Artificial Sequence: Synthetic oligonucleotide
tcagaaattgtgagcatatcagcattaagtagcactgagg

SEQ ID NO: 189775 - DNA, 39 bp, Artificial Sequence
  Description of Artificial Sequence: Synthetic oligonucleotide
cagaaattgtgagcatatcagcattaagtagcactgagg

SEQ ID NO: 189776 - DNA, 40 bp, Artificial Sequence
  Description of Artificial Sequence: Synthetic oligonucleotide
agaaattgtgagcatatcagcattaagtagcactgaggtg

SEQ ID NO: 189777 - DNA, 39 bp, Artificial Sequence
  Description of Artificial Sequence: Synthetic oligonucleotide
gaaattgtgagcatatcagcattaagtagcactgaggtg

SEQ ID NO: 189778 - DNA, 39 bp, Artificial Sequence
  Description of Artificial Sequence: Synthetic oligonucleotide
aaattgtgagcatatcagcattaagtagcactgaggtgg

SEQ ID NO: 189779 - DNA, 38 bp, Artificial Sequence
  Description of Artificial Sequence: Synthetic oligonucleotide
aattgtgagcatatcagcattaagtagcactgaggtgg

SEQ ID NO: 189780 - DNA, 37 bp, Artificial Sequence
  Description of Artificial Sequence: Synthetic oligonucleotide
attgtgagcatatcagcattaagtagcactgaggtgg

SEQ ID NO: 189781 - DNA, 36 bp, Artificial Sequence
  Description of Artificial Sequence: Synthetic oligonucleotide
ttgtgagcatatcagcattaagtagcactgaggtgg

SEQ ID NO: 189782 - DNA, 35 bp, Artificial Sequence
  Description of Artificial Sequence: Synthetic oligonucleotide
tgtgagcatatcagcattaagtagcactgaggtgg

SEQ ID NO: 189783 - DNA, 34 bp, Artificial Sequence
  Description of Artificial Sequence: Synthetic oligonucleotide
gtgagcatatcagcattaagtagcactgaggtgg

SEQ ID NO: 189784 - DNA, 34 bp, Artificial Sequence
  Description of Artificial Sequence: Synthetic oligonucleotide
tgagcatatcagcattaagtagcactgaggtggc

SEQ ID NO: 189785 - DNA, 33 bp, Artificial Sequence
  Description of Artificial Sequence: Synthetic oligonucleotide
gagcatatcagcattaagtagcactgaggtggc

SEQ ID NO: 189786 - DNA, 36 bp, Artificial Sequence
  Description of Artificial Sequence: Synthetic oligonucleotide
agcatatcagcattaagtagcactgaggtggcaatg

SEQ ID NO: 189787 - DNA, 35 bp, Artificial Sequence
  Description of Artificial Sequence: Synthetic oligonucleotide
gcatatcagcattaagtagcactgaggtggcaatg

SEQ ID NO: 189788 - DNA, 35 bp, Artificial Sequence
  Description of Artificial Sequence: Synthetic oligonucleotide
catatcagcattaagtagcactgaggtggcaatgc

SEQ ID NO: 189789 - DNA, 36 bp, Artificial Sequence
  Description of Artificial Sequence: Synthetic oligonucleotide
atatcagcattaagtagcactgaggtggcaatgcac

SEQ ID NO: 189790 - DNA, 35 bp, Artificial Sequence
  Description of Artificial Sequence: Synthetic oligonucleotide
tatcagcattaagtagcactgaggtggcaatgcac

SEQ ID NO: 189791 - DNA, 34 bp, Artificial Sequence
  Description of Artificial Sequence: Synthetic oligonucleotide
atcagcattaagtagcactgaggtggcaatgcac

SEQ ID NO: 189792 - DNA, 33 bp, Artificial Sequence
  Description of Artificial Sequence: Synthetic oligonucleotide
tcagcattaagtagcactgaggtggcaatgcac

SEQ ID NO: 189793 - DNA, 32 bp, Artificial Sequence
  Description of Artificial Sequence: Synthetic oligonucleotide
cagcattaagtagcactgaggtggcaatgcac

SEQ ID NO: 189794 - DNA, 33 bp, Artificial Sequence
  Description of Artificial Sequence: Synthetic oligonucleotide
agcattaagtagcactgaggtggcaatgcacac

SEQ ID NO: 189795 - DNA, 32 bp, Artificial Sequence
  Description of Artificial Sequence: Synthetic oligonucleotide
gcattaagtagcactgaggtggcaatgcacac

SEQ ID NO: 189796 - DNA, 34 bp, Artificial Sequence
  Description of Artificial Sequence: Synthetic oligonucleotide
cattaagtagcactgaggtggcaatgcacacttc

SEQ ID NO: 189797 - DNA, 36 bp, Artificial Sequence
  Description of Artificial Sequence: Synthetic oligonucleotide
attaagtagcactgaggtggcaatgcacacttcaac

SEQ ID NO: 189798 - DNA, 35 bp, Artificial Sequence
  Description of Artificial Sequence: Synthetic oligonucleotide
ttaagtagcactgaggtggcaatgcacacttcaac

SEQ ID NO: 189799 - DNA, 34 bp, Artificial Sequence
  Description of Artificial Sequence: Synthetic oligonucleotide
taagtagcactgaggtggcaatgcacacttcaac

SEQ ID NO: 189800 - DNA, 33 bp, Artificial Sequence
  Description of Artificial Sequence: Synthetic oligonucleotide
aagtagcactgaggtggcaatgcacacttcaac

SEQ ID NO: 189801 - DNA, 32 bp, Artificial Sequence
  Description of Artificial Sequence: Synthetic oligonucleotide
agtagcactgaggtggcaatgcacacttcaac

SEQ ID NO: 189802 - DNA, 31 bp, Artificial Sequence
  Description of Artificial Sequence: Synthetic oligonucleotide
gtagcactgaggtggcaatgcacacttcaac

SEQ ID NO: 189803 - DNA, 31 bp, Artificial Sequence
  Description of Artificial Sequence: Synthetic oligonucleotide
tagcactgaggtggcaatgcacacttcaacc

SEQ ID NO: 189804 - DNA, 30 bp, Artificial Sequence
  Description of Artificial Sequence: Synthetic oligonucleotide
agcactgaggtggcaatgcacacttcaacc

SEQ ID NO: 189805 - DNA, 29 bp, Artificial Sequence
  Description of Artificial Sequence: Synthetic oligonucleotide
gcactgaggtggcaatgcacacttcaacc

SEQ ID NO: 189806 - DNA, 42 bp, Artificial Sequence
  Description of Artificial Sequence: Synthetic oligonucleotide
acgatcctcttaatttcttacactattcgccgactgataaag

SEQ ID NO: 189807 - DNA, 41 bp, Artificial Sequence
  Description of Artificial Sequence: Synthetic oligonucleotide
cgatcctcttaatttcttacactattcgccgactgataaag

SEQ ID NO: 189808 - DNA, 41 bp, Artificial Sequence
  Description of Artificial Sequence: Synthetic oligonucleotide
gatcctcttaatttcttacactattcgccgactgataaagg

SEQ ID NO: 189809 - DNA, 41 bp, Artificial Sequence
  Description of Artificial Sequence: Synthetic oligonucleotide
atcctcttaatttcttacactattcgccgactgataaaggc

SEQ ID NO: 189810 - DNA, 40 bp, Artificial Sequence
  Description of Artificial Sequence: Synthetic oligonucleotide
tcctcttaatttcttacactattcgccgactgataaaggc

SEQ ID NO: 189811 - DNA, 39 bp, Artificial Sequence
  Description of Artificial Sequence: Synthetic oligonucleotide
cctcttaatttcttacactattcgccgactgataaaggc

SEQ ID NO: 189812 - DNA, 41 bp, Artificial Sequence
  Description of Artificial Sequence: Synthetic oligonucleotide
ctcttaatttcttacactattcgccgactgataaaggcatg

SEQ ID NO: 189813 - DNA, 43 bp, Artificial Sequence
  Description of Artificial Sequence: Synthetic oligonucleotide
agtcacaaagagttacatctcatcacagacaaatggagaaatg

SEQ ID NO: 189814 - DNA, 40 bp, Artificial Sequence
  Description of Artificial Sequence: Synthetic oligonucleotide
acagacaaatggagaaatgggacaacttgtccatcatttc

SEQ ID NO: 189815 - DNA, 39 bp, Artificial Sequence
  Description of Artificial Sequence: Synthetic oligonucleotide
cagacaaatggagaaatgggacaacttgtccatcatttc

SEQ ID NO: 189816 - DNA, 40 bp, Artificial Sequence
  Description of Artificial Sequence: Synthetic oligonucleotide
agacaaatggagaaatgggacaacttgtccatcatttcac

SEQ ID NO: 189817 - DNA, 39 bp, Artificial Sequence
  Description of Artificial Sequence: Synthetic oligonucleotide
gacaaatggagaaatgggacaacttgtccatcatttcac

SEQ ID NO: 189818 - DNA, 40 bp, Artificial Sequence
  Description of Artificial Sequence: Synthetic oligonucleotide
acaaatggagaaatgggacaacttgtccatcatttcactg

SEQ ID NO: 189819 - DNA, 39 bp, Artificial Sequence
  Description of Artificial Sequence: Synthetic oligonucleotide
caaatggagaaatgggacaacttgtccatcatttcactg

SEQ ID NO: 189820 - DNA, 41 bp, Artificial Sequence
  Description of Artificial Sequence: Synthetic oligonucleotide
aaatggagaaatgggacaacttgtccatcatttcactgtac

SEQ ID NO: 189821 - DNA, 40 bp, Artificial Sequence
  Description of Artificial Sequence: Synthetic oligonucleotide
aatggagaaatgggacaacttgtccatcatttcactgtac

SEQ ID NO: 189822 - DNA, 39 bp, Artificial Sequence
  Description of Artificial Sequence: Synthetic oligonucleotide
atggagaaatgggacaacttgtccatcatttcactgtac

SEQ ID NO: 189823 - DNA, 38 bp, Artificial Sequence
  Description of Artificial Sequence: Synthetic oligonucleotide
tggagaaatgggacaacttgtccatcatttcactgtac

SEQ ID NO: 189824 - DNA, 37 bp, Artificial Sequence
  Description of Artificial Sequence: Synthetic oligonucleotide
ggagaaatgggacaacttgtccatcatttcactgtac

SEQ ID NO: 189825 - DNA, 37 bp, Artificial Sequence
  Description of Artificial Sequence: Synthetic oligonucleotide
gagaaatgggacaacttgtccatcatttcactgtacc

SEQ ID NO: 189826 - DNA, 38 bp, Artificial Sequence
  Description of Artificial Sequence: Synthetic oligonucleotide
agaaatgggacaacttgtccatcatttcactgtaccag

SEQ ID NO: 189827 - DNA, 37 bp, Artificial Sequence
  Description of Artificial Sequence: Synthetic oligonucleotide
gaaatgggacaacttgtccatcatttcactgtaccag

SEQ ID NO: 189828 - DNA, 37 bp, Artificial Sequence
  Description of Artificial Sequence: Synthetic oligonucleotide
aaatgggacaacttgtccatcatttcactgtaccagc

SEQ ID NO: 189829 - DNA, 36 bp, Artificial Sequence
  Description of Artificial Sequence: Synthetic oligonucleotide
aatgggacaacttgtccatcatttcactgtaccagc

SEQ ID NO: 189830 - DNA, 35 bp, Artificial Sequence
  Description of Artificial Sequence: Synthetic oligonucleotide
atgggacaacttgtccatcatttcactgtaccagc

SEQ ID NO: 189831 - DNA, 34 bp, Artificial Sequence
  Description of Artificial Sequence: Synthetic oligonucleotide
tgggacaacttgtccatcatttcactgtaccagc

SEQ ID NO: 189832 - DNA, 33 bp, Artificial Sequence
  Description of Artificial Sequence: Synthetic oligonucleotide
gggacaacttgtccatcatttcactgtaccagc

SEQ ID NO: 189833 - DNA, 34 bp, Artificial Sequence
  Description of Artificial Sequence: Synthetic oligonucleotide
ggacaacttgtccatcatttcactgtaccagctc

SEQ ID NO: 189834 - DNA, 34 bp, Artificial Sequence
  Description of Artificial Sequence: Synthetic oligonucleotide
gacaacttgtccatcatttcactgtaccagctcc

SEQ ID NO: 189835 - DNA, 35 bp, Artificial Sequence
  Description of Artificial Sequence: Synthetic oligonucleotide
acaacttgtccatcatttcactgtaccagctcctg

SEQ ID NO: 189836 - DNA, 34 bp, Artificial Sequence
  Description of Artificial Sequence: Synthetic oligonucleotide
caacttgtccatcatttcactgtaccagctcctg

SEQ ID NO: 189837 - DNA, 36 bp, Artificial Sequence
  Description of Artificial Sequence: Synthetic oligonucleotide
aacttgtccatcatttcactgtaccagctcctgtag

SEQ ID NO: 189838 - DNA, 35 bp, Artificial Sequence
  Description of Artificial Sequence: Synthetic oligonucleotide
acttgtccatcatttcactgtaccagctcctgtag

SEQ ID NO: 189839 - DNA, 34 bp, Artificial Sequence
  Description of Artificial Sequence: Synthetic oligonucleotide
cttgtccatcatttcactgtaccagctcctgtag

SEQ ID NO: 189840 - DNA, 35 bp, Artificial Sequence
  Description of Artificial Sequence: Synthetic oligonucleotide
ttgtccatcatttcactgtaccagctcctgtagtg

SEQ ID NO: 189841 - DNA, 34 bp, Artificial Sequence
  Description of Artificial Sequence: Synthetic oligonucleotide
tgtccatcatttcactgtaccagctcctgtagtg

SEQ ID NO: 189842 - DNA, 33 bp, Artificial Sequence
  Description of Artificial Sequence: Synthetic oligonucleotide
gtccatcatttcactgtaccagctcctgtagtg

SEQ ID NO: 189843 - DNA, 39 bp, Artificial Sequence
  Description of Artificial Sequence: Synthetic oligonucleotide
tccatcatttcactgtaccagctcctgtagtgataatac

SEQ ID NO: 189844 - DNA, 38 bp, Artificial Sequence
  Description of Artificial Sequence: Synthetic oligonucleotide
ccatcatttcactgtaccagctcctgtagtgataatac

SEQ ID NO: 189845 - DNA, 39 bp, Artificial Sequence
  Description of Artificial Sequence: Synthetic oligonucleotide
catcatttcactgtaccagctcctgtagtgataatactc

SEQ ID NO: 189846 - DNA, 47 bp, Artificial Sequence
  Description of Artificial Sequence: Synthetic oligonucleotide
atcatttcactgtaccagctcctgtagtgataatactcattattttg

SEQ ID NO: 189847 - DNA, 46 bp, Artificial Sequence
  Description of Artificial Sequence: Synthetic oligonucleotide
tcatttcactgtaccagctcctgtagtgataatactcattattttg

SEQ ID NO: 189848 - DNA, 45 bp, Artificial Sequence
  Description of Artificial Sequence: Synthetic oligonucleotide
catttcactgtaccagctcctgtagtgataatactcattattttg

SEQ ID NO: 189849 - DNA, 46 bp, Artificial Sequence
  Description of Artificial Sequence: Synthetic oligonucleotide
atttcactgtaccagctcctgtagtgataatactcattattttgtg

SEQ ID NO: 189850 - DNA, 34 bp, Artificial Sequence
  Description of Artificial Sequence: Synthetic oligonucleotide
aaacgggacaacttgtccatcgtttcactgtacg

SEQ ID NO: 189851 - DNA, 33 bp, Artificial Sequence
  Description of Artificial Sequence: Synthetic oligonucleotide
aacgggacaacttgtccatcgtttcactgtacg

SEQ ID NO: 189852 - DNA, 32 bp, Artificial Sequence
  Description of Artificial Sequence: Synthetic oligonucleotide
acgggacaacttgtccatcgtttcactgtacg

SEQ ID NO: 189853 - DNA, 31 bp, Artificial Sequence
  Description of Artificial Sequence: Synthetic oligonucleotide
cgggacaacttgtccatcgtttcactgtacg

SEQ ID NO: 189854 - DNA, 32 bp, Artificial Sequence
  Description of Artificial Sequence: Synthetic oligonucleotide
gggacaacttgtccatcgtttcactgtacgag

SEQ ID NO: 189855 - DNA, 32 bp, Artificial Sequence
  Description of Artificial Sequence: Synthetic oligonucleotide
ggacaacttgtccatcgtttcactgtacgagc

SEQ ID NO: 189856 - DNA, 33 bp, Artificial Sequence
  Description of Artificial Sequence: Synthetic oligonucleotide
gacaacttgtccatcgtttcactgtacgagctc

SEQ ID NO: 189857 - DNA, 33 bp, Artificial Sequence
  Description of Artificial Sequence: Synthetic oligonucleotide
acaacttgtccatcgtttcactgtacgagctcc

SEQ ID NO: 189858 - DNA, 32 bp, Artificial Sequence
  Description of Artificial Sequence: Synthetic oligonucleotide
caacttgtccatcgtttcactgtacgagctcc

SEQ ID NO: 189859 - DNA, 33 bp, Artificial Sequence
  Description of Artificial Sequence: Synthetic oligonucleotide
aacttgtccatcgtttcactgtacgagctcctg

SEQ ID NO: 189860 - DNA, 32 bp, Artificial Sequence
  Description of Artificial Sequence: Synthetic oligonucleotide
acttgtccatcgtttcactgtacgagctcctg

SEQ ID NO: 189861 - DNA, 31 bp, Artificial Sequence
  Description of Artificial Sequence: Synthetic oligonucleotide
cttgtccatcgtttcactgtacgagctcctg

SEQ ID NO: 189862 - DNA, 33 bp, Artificial Sequence
  Description of Artificial Sequence: Synthetic oligonucleotide
ttgtccatcgtttcactgtacgagctcctgtag

SEQ ID NO: 189863 - DNA, 32 bp, Artificial Sequence
  Description of Artificial Sequence: Synthetic oligonucleotide
tgtccatcgtttcactgtacgagctcctgtag

SEQ ID NO: 189864 - DNA, 31 bp, Artificial Sequence
  Description of Artificial Sequence: Synthetic oligonucleotide
gtccatcgtttcactgtacgagctcctgtag

SEQ ID NO: 189865 - DNA, 32 bp, Artificial Sequence
  Description of Artificial Sequence: Synthetic oligonucleotide
tccatcgtttcactgtacgagctcctgtagtg

SEQ ID NO: 189866 - DNA, 31 bp, Artificial Sequence
  Description of Artificial Sequence: Synthetic oligonucleotide
ccatcgtttcactgtacgagctcctgtagtg

SEQ ID NO: 189867 - DNA, 37 bp, Artificial Sequence
  Description of Artificial Sequence: Synthetic oligonucleotide
catcgtttcactgtacgagctcctgtagtgataatac

SEQ ID NO: 189868 - DNA, 38 bp, Artificial Sequence
  Description of Artificial Sequence: Synthetic oligonucleotide
atcgtttcactgtacgagctcctgtagtgataatactc

SEQ ID NO: 189869 - DNA, 37 bp, Artificial Sequence
  Description of Artificial Sequence: Synthetic oligonucleotide
tcgtttcactgtacgagctcctgtagtgataatactc

SEQ ID NO: 189870 - DNA, 36 bp, Artificial Sequence
  Description of Artificial Sequence: Synthetic oligonucleotide
cgtttcactgtacgagctcctgtagtgataatactc

SEQ ID NO: 189871 - DNA, 44 bp, Artificial Sequence
  Description of Artificial Sequence: Synthetic oligonucleotide
gtttcactgtacgagctcctgtagtgataatactcattattttg

SEQ ID NO: 189872 - DNA, 45 bp, Artificial Sequence
  Description of Artificial Sequence: Synthetic oligonucleotide
tttcactgtacgagctcctgtagtgataatactcattattttgtg

SEQ ID NO: 189873 - DNA, 44 bp, Artificial Sequence
  Description of Artificial Sequence: Synthetic oligonucleotide
ttcactgtacgagctcctgtagtgataatactcattattttgtg

SEQ ID NO: 189874 - DNA, 43 bp, Artificial Sequence
  Description of Artificial Sequence: Synthetic oligonucleotide
tcactgtacgagctcctgtagtgataatactcattattttgtg

SEQ ID NO: 189875 - DNA, 42 bp, Artificial Sequence
  Description of Artificial Sequence: Synthetic oligonucleotide
cactgtacgagctcctgtagtgataatactcattattttgtg

SEQ ID NO: 189876 - DNA, 43 bp, Artificial Sequence
  Description of Artificial Sequence: Synthetic oligonucleotide
actgtacgagctcctgtagtgataatactcattattttgtgtg

SEQ ID NO: 189877 - DNA, 42 bp, Artificial Sequence
  Description of Artificial Sequence: Synthetic oligonucleotide
ctgtacgagctcctgtagtgataatactcattattttgtgtg

SEQ ID NO: 189878 - DNA, 43 bp, Artificial Sequence
  Description of Artificial Sequence: Synthetic oligonucleotide
tgtacgagctcctgtagtgataatactcattattttgtgtgtg

SEQ ID NO: 189879 - DNA, 42 bp, Artificial Sequence
  Description of Artificial Sequence: Synthetic oligonucleotide
gtacgagctcctgtagtgataatactcattattttgtgtgtg

SEQ ID NO: 189880 - DNA, 44 bp, Artificial Sequence
  Description of Artificial Sequence: Synthetic oligonucleotide
tacgagctcctgtagtgataatactcattattttgtgtgtgatg

SEQ ID NO: 189881 - DNA, 43 bp, Artificial Sequence
  Description of Artificial Sequence: Synthetic oligonucleotide
acgagctcctgtagtgataatactcattattttgtgtgtgatg

SEQ ID NO: 189882 - DNA, 42 bp, Artificial Sequence
  Description of Artificial Sequence: Synthetic oligonucleotide
cgagctcctgtagtgataatactcattattttgtgtgtgatg

SEQ ID NO: 189883 - DNA, 42 bp, Artificial Sequence
  Description of Artificial Sequence: Synthetic oligonucleotide
gagctcctgtagtgataatactcattattttgtgtgtgatgg

SEQ ID NO: 189884 - DNA, 40 bp, Artificial Sequence
  Description of Artificial Sequence: Synthetic oligonucleotide
tcatcacagacaaatgataagcacaaacgggacacatatc

SEQ ID NO: 189885 - DNA, 39 bp, Artificial Sequence
  Description of Artificial Sequence: Synthetic oligonucleotide
catcacagacaaatgataagcacaaacgggacacatatc

SEQ ID NO: 189886 - DNA, 39 bp, Artificial Sequence
  Description of Artificial Sequence: Synthetic oligonucleotide
atcacagacaaatgataagcacaaacgggacacatatcc

SEQ ID NO: 189887 - DNA, 38 bp, Artificial Sequence
  Description of Artificial Sequence: Synthetic oligonucleotide
tcacagacaaatgataagcacaaacgggacacatatcc

SEQ ID NO: 189888 - DNA, 37 bp, Artificial Sequence
  Description of Artificial Sequence: Synthetic oligonucleotide
cacagacaaatgataagcacaaacgggacacatatcc

SEQ ID NO: 189889 - DNA, 38 bp, Artificial Sequence
  Description of Artificial Sequence: Synthetic oligonucleotide
acagacaaatgataagcacaaacgggacacatatccag

SEQ ID NO: 189890 - DNA, 37 bp, Artificial Sequence
  Description of Artificial Sequence: Synthetic oligonucleotide
cagacaaatgataagcacaaacgggacacatatccag

SEQ ID NO: 189891 - DNA, 37 bp, Artificial Sequence
  Description of Artificial Sequence: Synthetic oligonucleotide
agacaaatgataagcacaaacgggacacatatccagc

SEQ ID NO: 189892 - DNA, 36 bp, Artificial Sequence
  Description of Artificial Sequence: Synthetic oligonucleotide
gacaaatgataagcacaaacgggacacatatccagc

SEQ ID NO: 189893 - DNA, 37 bp, Artificial Sequence
  Description of Artificial Sequence: Synthetic oligonucleotide
acaaatgataagcacaaacgggacacatatccagctc

SEQ ID NO: 189894 - DNA, 36 bp, Artificial Sequence
  Description of Artificial Sequence: Synthetic oligonucleotide
caaatgataagcacaaacgggacacatatccagctc

SEQ ID NO: 189895 - DNA, 39 bp, Artificial Sequence
  Description of Artificial Sequence: Synthetic oligonucleotide
aaatgataagcacaaacgggacacatatccagctcatac

SEQ ID NO: 189896 - DNA, 38 bp, Artificial Sequence
  Description of Artificial Sequence: Synthetic oligonucleotide
aatgataagcacaaacgggacacatatccagctcatac

SEQ ID NO: 189897 - DNA, 37 bp, Artificial Sequence
  Description of Artificial Sequence: Synthetic oligonucleotide
atgataagcacaaacgggacacatatccagctcatac

SEQ ID NO: 189898 - DNA, 36 bp, Artificial Sequence
  Description of Artificial Sequence: Synthetic oligonucleotide
tgataagcacaaacgggacacatatccagctcatac

SEQ ID NO: 189899 - DNA, 35 bp, Artificial Sequence
  Description of Artificial Sequence: Synthetic oligonucleotide
gataagcacaaacgggacacatatccagctcatac

SEQ ID NO: 189900 - DNA, 36 bp, Artificial Sequence
  Description of Artificial Sequence: Synthetic oligonucleotide
ataagcacaaacgggacacatatccagctcatactg

SEQ ID NO: 189901 - DNA, 35 bp, Artificial Sequence
  Description of Artificial Sequence: Synthetic oligonucleotide
taagcacaaacgggacacatatccagctcatactg

SEQ ID NO: 189902 - DNA, 34 bp, Artificial Sequence
  Description of Artificial Sequence: Synthetic oligonucleotide
aagcacaaacgggacacatatccagctcatactg

SEQ ID NO: 189903 - DNA, 33 bp, Artificial Sequence
  Description of Artificial Sequence: Synthetic oligonucleotide
agcacaaacgggacacatatccagctcatactg

SEQ ID NO: 189904 - DNA, 32 bp, Artificial Sequence
  Description of Artificial Sequence: Synthetic oligonucleotide
gcacaaacgggacacatatccagctcatactg

SEQ ID NO: 189905 - DNA, 32 bp, Artificial Sequence
  Description of Artificial Sequence: Synthetic oligonucleotide
cacaaacgggacacatatccagctcatactgc

SEQ ID NO: 189906 - DNA, 36 bp, Artificial Sequence
  Description of Artificial Sequence: Synthetic oligonucleotide
acaaacgggacacatatccagctcatactgctaatg

SEQ ID NO: 189907 - DNA, 35 bp, Artificial Sequence
  Description of Artificial Sequence: Synthetic oligonucleotide
caaacgggacacatatccagctcatactgctaatg

SEQ ID NO: 189908 - DNA, 37 bp, Artificial Sequence
  Description of Artificial Sequence: Synthetic oligonucleotide
aaacgggacacatatccagctcatactgctaatgaag

SEQ ID NO: 189909 - DNA, 36 bp, Artificial Sequence
  Description of Artificial Sequence: Synthetic oligonucleotide
aacgggacacatatccagctcatactgctaatgaag

SEQ ID NO: 189910 - DNA, 35 bp, Artificial Sequence
  Description of Artificial Sequence: Synthetic oligonucleotide
acgggacacatatccagctcatactgctaatgaag

SEQ ID NO: 189911 - DNA, 34 bp, Artificial Sequence
  Description of Artificial Sequence: Synthetic oligonucleotide
cgggacacatatccagctcatactgctaatgaag

SEQ ID NO: 189912 - DNA, 37 bp, Artificial Sequence
  Description of Artificial Sequence: Synthetic oligonucleotide
gggacacatatccagctcatactgctaatgaagtttc

SEQ ID NO: 189913 - DNA, 49 bp, Artificial Sequence
  Description of Artificial Sequence: Synthetic oligonucleotide
agctcatactgctaatgaagtttcagaaatttctgttacaactgtttac

SEQ ID NO: 189914 - DNA, 48 bp, Artificial Sequence
  Description of Artificial Sequence: Synthetic oligonucleotide
gctcatactgctaatgaagtttcagaaatttctgttacaactgtttac

SEQ ID NO: 189915 - DNA, 48 bp, Artificial Sequence
  Description of Artificial Sequence: Synthetic oligonucleotide
ctcatactgctaatgaagtttcagaaatttctgttacaactgtttacc

SEQ ID NO: 189916 - DNA, 48 bp, Artificial Sequence
  Description of Artificial Sequence: Synthetic oligonucleotide
tcatactgctaatgaagtttcagaaatttctgttacaactgtttaccc

SEQ ID NO: 189917 - DNA, 47 bp, Artificial Sequence
  Description of Artificial Sequence: Synthetic oligonucleotide
catactgctaatgaagtttcagaaatttctgttacaactgtttaccc

SEQ ID NO: 189918 - DNA, 48 bp, Artificial Sequence
  Description of Artificial Sequence: Synthetic oligonucleotide
atactgctaatgaagtttcagaaatttctgttacaactgtttaccctc

SEQ ID NO: 189919 - DNA, 47 bp, Artificial Sequence
  Description of Artificial Sequence: Synthetic oligonucleotide
tactgctaatgaagtttcagaaatttctgttacaactgtttaccctc

SEQ ID NO: 189920 - DNA, 46 bp, Artificial Sequence
  Description of Artificial Sequence: Synthetic oligonucleotide
actgctaatgaagtttcagaaatttctgttacaactgtttaccctc

SEQ ID NO: 189921 - DNA, 45 bp, Artificial Sequence
  Description of Artificial Sequence: Synthetic oligonucleotide
ctgctaatgaagtttcagaaatttctgttacaactgtttaccctc

SEQ ID NO: 189922 - DNA, 45 bp, Artificial Sequence
  Description of Artificial Sequence: Synthetic oligonucleotide
tgctaatgaagtttcagaaatttctgttacaactgtttaccctcc

SEQ ID NO: 189923 - DNA, 44 bp, Artificial Sequence
  Description of Artificial Sequence: Synthetic oligonucleotide
gctaatgaagtttcagaaatttctgttacaactgtttaccctcc

SEQ ID NO: 189924 - DNA, 45 bp, Artificial Sequence
  Description of Artificial Sequence: Synthetic oligonucleotide
ctaatgaagtttcagaaatttctgttacaactgtttaccctccag

SEQ ID NO: 189925 - DNA, 47 bp, Artificial Sequence
  Description of Artificial Sequence: Synthetic oligonucleotide
taatgaagtttcagaaatttctgttacaactgtttaccctccagaag

SEQ ID NO: 189926 - DNA, 46 bp, Artificial Sequence
  Description of Artificial Sequence: Synthetic oligonucleotide
aatgaagtttcagaaatttctgttacaactgtttaccctccagaag

SEQ ID NO: 189927 - DNA, 45 bp, Artificial Sequence
  Description of Artificial Sequence: Synthetic oligonucleotide
atgaagtttcagaaatttctgttacaactgtttaccctccagaag

SEQ ID NO: 189928 - DNA, 44 bp, Artificial Sequence
  Description of Artificial Sequence: Synthetic oligonucleotide
tgaagtttcagaaatttctgttacaactgtttaccctccagaag

SEQ ID NO: 189929 - DNA, 43 bp, Artificial Sequence
  Description of Artificial Sequence: Synthetic oligonucleotide
gaagtttcagaaatttctgttacaactgtttaccctccagaag

SEQ ID NO: 189930 - DNA, 44 bp, Artificial Sequence
  Description of Artificial Sequence: Synthetic oligonucleotide
aagtttcagaaatttctgttacaactgtttaccctccagaagag

SEQ ID NO: 189931 - DNA, 43 bp, Artificial Sequence
  Description of Artificial Sequence: Synthetic oligonucleotide
agtttcagaaatttctgttacaactgtttaccctccagaagag

SEQ ID NO: 189932 - DNA, 42 bp, Artificial Sequence
  Description of Artificial Sequence: Synthetic oligonucleotide
gtttcagaaatttctgttacaactgtttaccctccagaagag

SEQ ID NO: 189933 - DNA, 42 bp, Artificial Sequence
  Description of Artificial Sequence: Synthetic oligonucleotide
tttcagaaatttctgttacaactgtttaccctccagaagagg

SEQ ID NO: 189934 - DNA, 41 bp, Artificial Sequence
  Description of Artificial Sequence: Synthetic oligonucleotide
ttcagaaatttctgttacaactgtttaccctccagaagagg

SEQ ID NO: 189935 - DNA, 40 bp, Artificial Sequence
  Description of Artificial Sequence: Synthetic oligonucleotide
tcagaaatttctgttacaactgtttaccctccagaagagg

SEQ ID NO: 189936 - DNA, 39 bp, Artificial Sequence
  Description of Artificial Sequence: Synthetic oligonucleotide
cagaaatttctgttacaactgtttaccctccagaagagg

SEQ ID NO: 189937 - DNA, 42 bp, Artificial Sequence
  Description of Artificial Sequence: Synthetic oligonucleotide
agaaatttctgttacaactgtttaccctccagaagaggaaac

SEQ ID NO: 189938 - DNA, 41 bp, Artificial Sequence
  Description of Artificial Sequence: Synthetic oligonucleotide
gaaatttctgttacaactgtttaccctccagaagaggaaac

SEQ ID NO: 189939 - DNA, 41 bp, Artificial Sequence
  Description of Artificial Sequence: Synthetic oligonucleotide
aaatttctgttacaactgtttaccctccagaagaggaaacc

SEQ ID NO: 189940 - DNA, 40 bp, Artificial Sequence
  Description of Artificial Sequence: Synthetic oligonucleotide
aatttctgttacaactgtttaccctccagaagaggaaacc

SEQ ID NO: 189941 - DNA, 39 bp, Artificial Sequence
  Description of Artificial Sequence: Synthetic oligonucleotide
atttctgttacaactgtttaccctccagaagaggaaacc

SEQ ID NO: 189942 - DNA, 38 bp, Artificial Sequence
  Description of Artificial Sequence: Synthetic oligonucleotide
tttctgttacaactgtttaccctccagaagaggaaacc

SEQ ID NO: 189943 - DNA, 37 bp, Artificial Sequence
  Description of Artificial Sequence: Synthetic oligonucleotide
ttctgttacaactgtttaccctccagaagaggaaacc

SEQ ID NO: 189944 - DNA, 36 bp, Artificial Sequence
  Description of Artificial Sequence: Synthetic oligonucleotide
tctgttacaactgtttaccctccagaagaggaaacc

SEQ ID NO: 189945 - DNA, 35 bp, Artificial Sequence
  Description of Artificial Sequence: Synthetic oligonucleotide
ctgttacaactgtttaccctccagaagaggaaacc

SEQ ID NO: 189946 - DNA, 35 bp, Artificial Sequence
  Description of Artificial Sequence: Synthetic oligonucleotide
tgttacaactgtttaccctccagaagaggaaaccg

SEQ ID NO: 189947 - DNA, 34 bp, Artificial Sequence
  Description of Artificial Sequence: Synthetic oligonucleotide
gttacaactgtttaccctccagaagaggaaaccg

SEQ ID NO: 189948 - DNA, 34 bp, Artificial Sequence
  Description of Artificial Sequence: Synthetic oligonucleotide
ttacaactgtttaccctccagaagaggaaaccgg

SEQ ID NO: 189949 - DNA, 33 bp, Artificial Sequence
  Description of Artificial Sequence: Synthetic oligonucleotide
tacaactgtttaccctccagaagaggaaaccgg

SEQ ID NO: 189950 - DNA, 32 bp, Artificial Sequence
  Description of Artificial Sequence: Synthetic oligonucleotide
acaactgtttaccctccagaagaggaaaccgg

SEQ ID NO: 189951 - DNA, 31 bp, Artificial Sequence
  Description of Artificial Sequence: Synthetic oligonucleotide
caactgtttaccctccagaagaggaaaccgg

SEQ ID NO: 189952 - DNA, 34 bp, Artificial Sequence
  Description of Artificial Sequence: Synthetic oligonucleotide
tgtttaccctccagaagaggaaaccggagaaatg

SEQ ID NO: 189953 - DNA, 33 bp, Artificial Sequence
  Description of Artificial Sequence: Synthetic oligonucleotide
gtttaccctccagaagaggaaaccggagaaatg

SEQ ID NO: 189954 - DNA, 33 bp, Artificial Sequence
  Description of Artificial Sequence: Synthetic oligonucleotide
tttaccctccagaagaggaaaccggagaaatgg

SEQ ID NO: 189955 - DNA, 32 bp, Artificial Sequence
  Description of Artificial Sequence: Synthetic oligonucleotide
ttaccctccagaagaggaaaccggagaaatgg

SEQ ID NO: 189956 - DNA, 31 bp, Artificial Sequence
  Description of Artificial Sequence: Synthetic oligonucleotide
taccctccagaagaggaaaccggagaaatgg

SEQ ID NO: 189957 - DNA, 30 bp, Artificial Sequence
  Description of Artificial Sequence: Synthetic oligonucleotide
accctccagaagaggaaaccggagaaatgg

SEQ ID NO: 189958 - DNA, 29 bp, Artificial Sequence
  Description of Artificial Sequence: Synthetic oligonucleotide
ccctccagaagaggaaaccggagaaatgg

SEQ ID NO: 189959 - DNA, 29 bp, Artificial Sequence
  Description of Artificial Sequence: Synthetic oligonucleotide
cctccagaagaggaaaccggagaaatggg

SEQ ID NO: 189960 - DNA, 30 bp, Artificial Sequence
  Description of Artificial Sequence: Synthetic oligonucleotide
ctccagaagaggaaaccggagaaatgggac

SEQ ID NO: 189961 - DNA, 32 bp, Artificial Sequence
  Description of Artificial Sequence: Synthetic oligonucleotide
tccagaagaggaaaccggagaaatgggacaac

SEQ ID NO: 189962 - DNA, 31 bp, Artificial Sequence
  Description of Artificial Sequence: Synthetic oligonucleotide
ccagaagaggaaaccggagaaatgggacaac

SEQ ID NO: 189963 - DNA, 33 bp, Artificial Sequence
  Description of Artificial Sequence: Synthetic oligonucleotide
cagaagaggaaaccggagaaatgggacaacttg

SEQ ID NO: 189964 - DNA, 34 bp, Artificial Sequence
  Description of Artificial Sequence: Synthetic oligonucleotide
agaagaggaaaccggagaaatgggacaacttgtc

SEQ ID NO: 189965 - DNA, 33 bp, Artificial Sequence
  Description of Artificial Sequence: Synthetic oligonucleotide
gaagaggaaaccggagaaatgggacaacttgtc

SEQ ID NO: 189966 - DNA, 33 bp, Artificial Sequence
  Description of Artificial Sequence: Synthetic oligonucleotide
aagaggaaaccggagaaatgggacaacttgtcc

SEQ ID NO: 189967 - DNA, 32 bp, Artificial Sequence
  Description of Artificial Sequence: Synthetic oligonucleotide
agaggaaaccggagaaatgggacaacttgtcc

SEQ ID NO: 189968 - DNA, 31 bp, Artificial Sequence
  Description of Artificial Sequence: Synthetic oligonucleotide
gaggaaaccggagaaatgggacaacttgtcc

SEQ ID NO: 189969 - DNA, 33 bp, Artificial Sequence
  Description of Artificial Sequence: Synthetic oligonucleotide
aggaaaccggagaaatgggacaacttgtccatc

SEQ ID NO: 189970 - DNA, 32 bp, Artificial Sequence
  Description of Artificial Sequence: Synthetic oligonucleotide
ggaaaccggagaaatgggacaacttgtccatc

SEQ ID NO: 189971 - DNA, 32 bp, Artificial Sequence
  Description of Artificial Sequence: Synthetic oligonucleotide
gaaaccggagaaatgggacaacttgtccatcg

SEQ ID NO: 189972 - DNA, 35 bp, Artificial Sequence
  Description of Artificial Sequence: Synthetic oligonucleotide
aaaccggagaaatgggacaacttgtccatcgtttc

SEQ ID NO: 189973 - DNA, 34 bp, Artificial Sequence
  Description of Artificial Sequence: Synthetic oligonucleotide
aaccggagaaatgggacaacttgtccatcgtttc

SEQ ID NO: 189974 - DNA, 33 bp, Artificial Sequence
  Description of Artificial Sequence: Synthetic oligonucleotide
accggagaaatgggacaacttgtccatcgtttc

SEQ ID NO: 189975 - DNA, 32 bp, Artificial Sequence
  Description of Artificial Sequence: Synthetic oligonucleotide
ccggagaaatgggacaacttgtccatcgtttc

SEQ ID NO: 189976 - DNA, 33 bp, Artificial Sequence
  Description of Artificial Sequence: Synthetic oligonucleotide
cggagaaatgggacaacttgtccatcgtttcac

SEQ ID NO: 189977 - DNA, 30 bp, Artificial Sequence
  Description of Artificial Sequence: Synthetic oligonucleotide
gagtacctctggtgtggcaatgcacacttc

SEQ ID NO: 189978 - DNA, 32 bp, Artificial Sequence
  Description of Artificial Sequence: Synthetic oligonucleotide
agtacctctggtgtggcaatgcacacttcaac

SEQ ID NO: 189979 - DNA, 31 bp, Artificial Sequence
  Description of Artificial Sequence: Synthetic oligonucleotide
gtacctctggtgtggcaatgcacacttcaac

SEQ ID NO: 189980 - DNA, 31 bp, Artificial Sequence
  Description of Artificial Sequence: Synthetic oligonucleotide
tacctctggtgtggcaatgcacacttcaacc

SEQ ID NO: 189981 - DNA, 30 bp, Artificial Sequence
  Description of Artificial Sequence: Synthetic oligonucleotide
acctctggtgtggcaatgcacacttcaacc

SEQ ID NO: 189982 - DNA, 29 bp, Artificial Sequence
  Description of Artificial Sequence: Synthetic oligonucleotide
cctctggtgtggcaatgcacacttcaacc

SEQ ID NO: 189983 - DNA, 30 bp, Artificial Sequence
  Description of Artificial Sequence: Synthetic oligonucleotide
ctctggtgtggcaatgcacacttcaacctc

SEQ ID NO: 189984 - DNA, 30 bp, Artificial Sequence
  Description of Artificial Sequence: Synthetic oligonucleotide
tctggtgtggcaatgcacacttcaacctcc

SEQ ID NO: 189985 - DNA, 29 bp, Artificial Sequence
  Description of Artificial Sequence: Synthetic oligonucleotide
ctggtgtggcaatgcacacttcaacctcc

SEQ ID NO: 189986 - DNA, 30 bp, Artificial Sequence
  Description of Artificial Sequence: Synthetic oligonucleotide
tggtgtggcaatgcacacttcaacctcctc

SEQ ID NO: 189987 - DNA, 29 bp, Artificial Sequence
  Description of Artificial Sequence: Synthetic oligonucleotide
ggtgtggcaatgcacacttcaacctcctc

SEQ ID NO: 189988 - DNA, 31 bp, Artificial Sequence
  Description of Artificial Sequence: Synthetic oligonucleotide
gtgtggcaatgcacacttcaacctcctcttc

SEQ ID NO: 189989 - DNA, 31 bp, Artificial Sequence
  Description of Artificial Sequence: Synthetic oligonucleotide
tgtggcaatgcacacttcaacctcctcttcg

SEQ ID NO: 189990 - DNA, 30 bp, Artificial Sequence
  Description of Artificial Sequence: Synthetic oligonucleotide
gtggcaatgcacacttcaacctcctcttcg

SEQ ID NO: 189991 - DNA, 30 bp, Artificial Sequence
  Description of Artificial Sequence: Synthetic oligonucleotide
tggcaatgcacacttcaacctcctcttcgg

SEQ ID NO: 189992 - DNA, 29 bp, Artificial Sequence
  Description of Artificial Sequence: Synthetic oligonucleotide
ggcaatgcacacttcaacctcctcttcgg

SEQ ID NO: 189993 - DNA, 30 bp, Artificial Sequence
  Description of Artificial Sequence: Synthetic oligonucleotide
gcaatgcacacttcaacctcctcttcggtc

SEQ ID NO: 189994 - DNA, 31 bp, Artificial Sequence
  Description of Artificial Sequence: Synthetic oligonucleotide
caatgcacacttcaacctcctcttcggtcac

SEQ ID NO: 189995 - DNA, 34 bp, Artificial Sequence
  Description of Artificial Sequence: Synthetic oligonucleotide
aatgcacacttcaacctcctcttcggtcacaaag

SEQ ID NO: 189996 - DNA, 33 bp, Artificial Sequence
  Description of Artificial Sequence: Synthetic oligonucleotide
atgcacacttcaacctcctcttcggtcacaaag

SEQ ID NO: 189997 - DNA, 32 bp, Artificial Sequence
  Description of Artificial Sequence: Synthetic oligonucleotide
tgcacacttcaacctcctcttcggtcacaaag

SEQ ID NO: 189998 - DNA, 31 bp, Artificial Sequence
  Description of Artificial Sequence: Synthetic oligonucleotide
gcacacttcaacctcctcttcggtcacaaag

SEQ ID NO: 189999 - DNA, 32 bp, Artificial Sequence
  Description of Artificial Sequence: Synthetic oligonucleotide
cacacttcaacctcctcttcggtcacaaagag

SEQ ID NO: 190000 - DNA, 35 bp, Artificial Sequence
  Description of Artificial Sequence: Synthetic oligonucleotide
acacttcaacctcctcttcggtcacaaagagttac

SEQ ID NO: 190001 - DNA, 34 bp, Artificial Sequence
  Description of Artificial Sequence: Synthetic oligonucleotide
cacttcaacctcctcttcggtcacaaagagttac

SEQ ID NO: 190002 - DNA, 36 bp, Artificial Sequence
  Description of Artificial Sequence: Synthetic oligonucleotide
acttcaacctcctcttcggtcacaaagagttacatc

SEQ ID NO: 190003 - DNA, 35 bp, Artificial Sequence
  Description of Artificial Sequence: Synthetic oligonucleotide
cttcaacctcctcttcggtcacaaagagttacatc

SEQ ID NO: 190004 - DNA, 36 bp, Artificial Sequence
  Description of Artificial Sequence: Synthetic oligonucleotide
ttcaacctcctcttcggtcacaaagagttacatctc

SEQ ID NO: 190005 - DNA, 32 bp, Artificial Sequence
  Description of Artificial Sequence: Synthetic oligonucleotide
ggacaacttgtccatcgtttcactgtaccagg

SEQ ID NO: 190006 - DNA, 32 bp, Artificial Sequence
  Description of Artificial Sequence: Synthetic oligonucleotide
gacaacttgtccatcgtttcactgtaccaggc

SEQ ID NO: 190007 - DNA, 34 bp, Artificial Sequence
  Description of Artificial Sequence: Synthetic oligonucleotide
acaacttgtccatcgtttcactgtaccaggcatg

SEQ ID NO: 190008 - DNA, 33 bp, Artificial Sequence
  Description of Artificial Sequence: Synthetic oligonucleotide
caacttgtccatcgtttcactgtaccaggcatg

SEQ ID NO: 190009 - DNA, 55 bp, Artificial Sequence
  Description of Artificial Sequence: Synthetic oligonucleotide
atgtatggaaaaataatctttgtattactattgtcaggaattgtgagcatatcag

SEQ ID NO: 190010 - DNA, 54 bp, Artificial Sequence
  Description of Artificial Sequence: Synthetic oligonucleotide
tgtatggaaaaataatctttgtattactattgtcaggaattgtgagcatatcag

SEQ ID NO: 190011 - DNA, 53 bp, Artificial Sequence
  Description of Artificial Sequence: Synthetic oligonucleotide
gtatggaaaaataatctttgtattactattgtcaggaattgtgagcatatcag

SEQ ID NO: 190012 - DNA, 53 bp, Artificial Sequence
  Description of Artificial Sequence: Synthetic oligonucleotide
tatggaaaaataatctttgtattactattgtcaggaattgtgagcatatcagc

SEQ ID NO: 190013 - DNA, 52 bp, Artificial Sequence
  Description of Artificial Sequence: Synthetic oligonucleotide
atggaaaaataatctttgtattactattgtcaggaattgtgagcatatcagc

SEQ ID NO: 190014 - DNA, 51 bp, Artificial Sequence
  Description of Artificial Sequence: Synthetic oligonucleotide
tggaaaaataatctttgtattactattgtcaggaattgtgagcatatcagc

SEQ ID NO: 190015 - DNA, 50 bp, Artificial Sequence
  Description of Artificial Sequence: Synthetic oligonucleotide
ggaaaaataatctttgtattactattgtcaggaattgtgagcatatcagc

SEQ ID NO: 190016 - DNA, 52 bp, Artificial Sequence
  Description of Artificial Sequence: Synthetic oligonucleotide
gaaaaataatctttgtattactattgtcaggaattgtgagcatatcagcatc

SEQ ID NO: 190017 - DNA, 54 bp, Artificial Sequence
  Description of Artificial Sequence: Synthetic oligonucleotide
aaaaataatctttgtattactattgtcaggaattgtgagcatatcagcatcaag

SEQ ID NO: 190018 - DNA, 53 bp, Artificial Sequence
  Description of Artificial Sequence: Synthetic oligonucleotide
aaaataatctttgtattactattgtcaggaattgtgagcatatcagcatcaag

SEQ ID NO: 190019 - DNA, 52 bp, Artificial Sequence
  Description of Artificial Sequence: Synthetic oligonucleotide
aaataatctttgtattactattgtcaggaattgtgagcatatcagcatcaag

SEQ ID NO: 190020 - DNA, 51 bp, Artificial Sequence
  Description of Artificial Sequence: Synthetic oligonucleotide
aataatctttgtattactattgtcaggaattgtgagcatatcagcatcaag

SEQ ID NO: 190021 - DNA, 50 bp, Artificial Sequence
  Description of Artificial Sequence: Synthetic oligonucleotide
ataatctttgtattactattgtcaggaattgtgagcatatcagcatcaag

SEQ ID NO: 190022 - DNA, 49 bp, Artificial Sequence
  Description of Artificial Sequence: Synthetic oligonucleotide
taatctttgtattactattgtcaggaattgtgagcatatcagcatcaag

SEQ ID NO: 190023 - DNA, 48 bp, Artificial Sequence
  Description of Artificial Sequence: Synthetic oligonucleotide
aatctttgtattactattgtcaggaattgtgagcatatcagcatcaag

SEQ ID NO: 190024 - DNA, 47 bp, Artificial Sequence
  Description of Artificial Sequence: Synthetic oligonucleotide
atctttgtattactattgtcaggaattgtgagcatatcagcatcaag

SEQ ID NO: 190025 - DNA, 46 bp, Artificial Sequence
  Description of Artificial Sequence: Synthetic oligonucleotide
tctttgtattactattgtcaggaattgtgagcatatcagcatcaag

SEQ ID NO: 190026 - DNA, 45 bp, Artificial Sequence
  Description of Artificial Sequence: Synthetic oligonucleotide
ctttgtattactattgtcaggaattgtgagcatatcagcatcaag

SEQ ID NO: 190027 - DNA, 47 bp, Artificial Sequence
  Description of Artificial Sequence: Synthetic oligonucleotide
tttgtattactattgtcaggaattgtgagcatatcagcatcaagtac

SEQ ID NO: 190028 - DNA, 46 bp, Artificial Sequence
  Description of Artificial Sequence: Synthetic oligonucleotide
ttgtattactattgtcaggaattgtgagcatatcagcatcaagtac

SEQ ID NO: 190029 - DNA, 45 bp, Artificial Sequence
  Description of Artificial Sequence: Synthetic oligonucleotide
tgtattactattgtcaggaattgtgagcatatcagcatcaagtac

SEQ ID NO: 190030 - DNA, 44 bp, Artificial Sequence
  Description of Artificial Sequence: Synthetic oligonucleotide
gtattactattgtcaggaattgtgagcatatcagcatcaagtac

SEQ ID NO: 190031 - DNA, 44 bp, Artificial Sequence
  Description of Artificial Sequence: Synthetic oligonucleotide
tattactattgtcaggaattgtgagcatatcagcatcaagtacc

SEQ ID NO: 190032 - DNA, 43 bp, Artificial Sequence
  Description of Artificial Sequence: Synthetic oligonucleotide
attactattgtcaggaattgtgagcatatcagcatcaagtacc

SEQ ID NO: 190033 - DNA, 42 bp, Artificial Sequence
  Description of Artificial Sequence: Synthetic oligonucleotide
ttactattgtcaggaattgtgagcatatcagcatcaagtacc

SEQ ID NO: 190034 - DNA, 41 bp, Artificial Sequence
  Description of Artificial Sequence: Synthetic oligonucleotide
tactattgtcaggaattgtgagcatatcagcatcaagtacc

SEQ ID NO: 190035 - DNA, 40 bp, Artificial Sequence
  Description of Artificial Sequence: Synthetic oligonucleotide
actattgtcaggaattgtgagcatatcagcatcaagtacc

SEQ ID NO: 190036 - DNA, 39 bp, Artificial Sequence
  Description of Artificial Sequence: Synthetic oligonucleotide
ctattgtcaggaattgtgagcatatcagcatcaagtacc

SEQ ID NO: 190037 - DNA, 40 bp, Artificial Sequence
  Description of Artificial Sequence: Synthetic oligonucleotide
tattgtcaggaattgtgagcatatcagcatcaagtaccac

SEQ ID NO: 190038 - DNA, 39 bp, Artificial Sequence
  Description of Artificial Sequence: Synthetic oligonucleotide
attgtcaggaattgtgagcatatcagcatcaagtaccac

SEQ ID NO: 190039 - DNA, 38 bp, Artificial Sequence
  Description of Artificial Sequence: Synthetic oligonucleotide
ttgtcaggaattgtgagcatatcagcatcaagtaccac

SEQ ID NO: 190040 - DNA, 37 bp, Artificial Sequence
  Description of Artificial Sequence: Synthetic oligonucleotide
tgtcaggaattgtgagcatatcagcatcaagtaccac

SEQ ID NO: 190041 - DNA, 36 bp, Artificial Sequence
  Description of Artificial Sequence: Synthetic oligonucleotide
gtcaggaattgtgagcatatcagcatcaagtaccac

SEQ ID NO: 190042 - DNA, 37 bp, Artificial Sequence
  Description of Artificial Sequence: Synthetic oligonucleotide
tcaggaattgtgagcatatcagcatcaagtaccactg

SEQ ID NO: 190043 - DNA, 36 bp, Artificial Sequence
  Description of Artificial Sequence: Synthetic oligonucleotide
caggaattgtgagcatatcagcatcaagtaccactg

SEQ ID NO: 190044 - DNA, 36 bp, Artificial Sequence
  Description of Artificial Sequence: Synthetic oligonucleotide
aggaattgtgagcatatcagcatcaagtaccactgg

SEQ ID NO: 190045 - DNA, 35 bp, Artificial Sequence
  Description of Artificial Sequence: Synthetic oligonucleotide
ggaattgtgagcatatcagcatcaagtaccactgg

SEQ ID NO: 190046 - DNA, 36 bp, Artificial Sequence
  Description of Artificial Sequence: Synthetic oligonucleotide
gaattgtgagcatatcagcatcaagtaccactggtg

SEQ ID NO: 190047 - DNA, 45 bp, Artificial Sequence
  Description of Artificial Sequence: Synthetic oligonucleotide
tcttcttcagtcacaaagagttacatctcatcacagacaaataag

SEQ ID NO: 190048 - DNA, 44 bp, Artificial Sequence
  Description of Artificial Sequence: Synthetic oligonucleotide
cttcttcagtcacaaagagttacatctcatcacagacaaataag

SEQ ID NO: 190049 - DNA, 44 bp, Artificial Sequence
  Description of Artificial Sequence: Synthetic oligonucleotide
ttcttcagtcacaaagagttacatctcatcacagacaaataagc

SEQ ID NO: 190050 - DNA, 43 bp, Artificial Sequence
  Description of Artificial Sequence: Synthetic oligonucleotide
tcttcagtcacaaagagttacatctcatcacagacaaataagc

SEQ ID NO: 190051 - DNA, 42 bp, Artificial Sequence
  Description of Artificial Sequence: Synthetic oligonucleotide
cttcagtcacaaagagttacatctcatcacagacaaataagc

SEQ ID NO: 190052 - DNA, 43 bp, Artificial Sequence
  Description of Artificial Sequence: Synthetic oligonucleotide
ttcagtcacaaagagttacatctcatcacagacaaataagcac

SEQ ID NO: 190053 - DNA, 42 bp, Artificial Sequence
  Description of Artificial Sequence: Synthetic oligonucleotide
tcagtcacaaagagttacatctcatcacagacaaataagcac

SEQ ID NO: 190054 - DNA, 41 bp, Artificial Sequence
  Description of Artificial Sequence: Synthetic oligonucleotide
cagtcacaaagagttacatctcatcacagacaaataagcac

SEQ ID NO: 190055 - DNA, 44 bp, Artificial Sequence
  Description of Artificial Sequence: Synthetic oligonucleotide
agtcacaaagagttacatctcatcacagacaaataagcacaaac

SEQ ID NO: 190056 - DNA, 43 bp, Artificial Sequence
  Description of Artificial Sequence: Synthetic oligonucleotide
gtcacaaagagttacatctcatcacagacaaataagcacaaac

SEQ ID NO: 190057 - DNA, 43 bp, Artificial Sequence
  Description of Artificial Sequence: Synthetic oligonucleotide
tcacaaagagttacatctcatcacagacaaataagcacaaacg

SEQ ID NO: 190058 - DNA, 42 bp, Artificial Sequence
  Description of Artificial Sequence: Synthetic oligonucleotide
cacaaagagttacatctcatcacagacaaataagcacaaacg

SEQ ID NO: 190059 - DNA, 42 bp, Artificial Sequence
  Description of Artificial Sequence: Synthetic oligonucleotide
acaaagagttacatctcatcacagacaaataagcacaaacgg

SEQ ID NO: 190060 - DNA, 41 bp, Artificial Sequence
  Description of Artificial Sequence: Synthetic oligonucleotide
caaagagttacatctcatcacagacaaataagcacaaacgg

SEQ ID NO: 190061 - DNA, 41 bp, Artificial Sequence
  Description of Artificial Sequence: Synthetic oligonucleotide
aaagagttacatctcatcacagacaaataagcacaaacggg

SEQ ID NO: 190062 - DNA, 40 bp, Artificial Sequence
  Description of Artificial Sequence: Synthetic oligonucleotide
aagagttacatctcatcacagacaaataagcacaaacggg

SEQ ID NO: 190063 - DNA, 39 bp, Artificial Sequence
  Description of Artificial Sequence: Synthetic oligonucleotide
agagttacatctcatcacagacaaataagcacaaacggg

SEQ ID NO: 190064 - DNA, 38 bp, Artificial Sequence
  Description of Artificial Sequence: Synthetic oligonucleotide
gagttacatctcatcacagacaaataagcacaaacggg

SEQ ID NO: 190065 - DNA, 39 bp, Artificial Sequence
  Description of Artificial Sequence: Synthetic oligonucleotide
agttacatctcatcacagacaaataagcacaaacgggac

SEQ ID NO: 190066 - DNA, 38 bp, Artificial Sequence
  Description of Artificial Sequence: Synthetic oligonucleotide
gttacatctcatcacagacaaataagcacaaacgggac

SEQ ID NO: 190067 - DNA, 39 bp, Artificial Sequence
  Description of Artificial Sequence: Synthetic oligonucleotide
ttacatctcatcacagacaaataagcacaaacgggacac

SEQ ID NO: 190068 - DNA, 38 bp, Artificial Sequence
  Description of Artificial Sequence: Synthetic oligonucleotide
tacatctcatcacagacaaataagcacaaacgggacac

SEQ ID NO: 190069 - DNA, 37 bp, Artificial Sequence
  Description of Artificial Sequence: Synthetic oligonucleotide
acatctcatcacagacaaataagcacaaacgggacac

SEQ ID NO: 190070 - DNA, 36 bp, Artificial Sequence
  Description of Artificial Sequence: Synthetic oligonucleotide
catctcatcacagacaaataagcacaaacgggacac

SEQ ID NO: 190071 - DNA, 40 bp, Artificial Sequence
  Description of Artificial Sequence: Synthetic oligonucleotide
atctcatcacagacaaataagcacaaacgggacacatatc

SEQ ID NO: 190072 - DNA, 39 bp, Artificial Sequence
  Description of Artificial Sequence: Synthetic oligonucleotide
tctcatcacagacaaataagcacaaacgggacacatatc

SEQ ID NO: 190073 - DNA, 38 bp, Artificial Sequence
  Description of Artificial Sequence: Synthetic oligonucleotide
ctcatcacagacaaataagcacaaacgggacacatatc

SEQ ID NO: 190074 - DNA, 38 bp, Artificial Sequence
  Description of Artificial Sequence: Synthetic oligonucleotide
tcatcacagacaaataagcacaaacgggacacatatcc

SEQ ID NO: 190075 - DNA, 37 bp, Artificial Sequence
  Description of Artificial Sequence: Synthetic oligonucleotide
catcacagacaaataagcacaaacgggacacatatcc

SEQ ID NO: 190076 - DNA, 38 bp, Artificial Sequence
  Description of Artificial Sequence: Synthetic oligonucleotide
atcacagacaaataagcacaaacgggacacatatccag

SEQ ID NO: 190077 - DNA, 37 bp, Artificial Sequence
  Description of Artificial Sequence: Synthetic oligonucleotide
tcacagacaaataagcacaaacgggacacatatccag

SEQ ID NO: 190078 - DNA, 36 bp, Artificial Sequence
  Description of Artificial Sequence: Synthetic oligonucleotide
cacagacaaataagcacaaacgggacacatatccag

SEQ ID NO: 190079 - DNA, 36 bp, Artificial Sequence
  Description of Artificial Sequence: Synthetic oligonucleotide
acagacaaataagcacaaacgggacacatatccagc

SEQ ID NO: 190080 - DNA, 35 bp, Artificial Sequence
  Description of Artificial Sequence: Synthetic oligonucleotide
cagacaaataagcacaaacgggacacatatccagc

SEQ ID NO: 190081 - DNA, 36 bp, Artificial Sequence
  Description of Artificial Sequence: Synthetic oligonucleotide
agacaaataagcacaaacgggacacatatccagctc

SEQ ID NO: 190082 - DNA, 35 bp, Artificial Sequence
  Description of Artificial Sequence: Synthetic oligonucleotide
gacaaataagcacaaacgggacacatatccagctc

SEQ ID NO: 190083 - DNA, 38 bp, Artificial Sequence
  Description of Artificial Sequence: Synthetic oligonucleotide
acaaataagcacaaacgggacacatatccagctcatag

SEQ ID NO: 190084 - DNA, 37 bp, Artificial Sequence
  Description of Artificial Sequence: Synthetic oligonucleotide
caaataagcacaaacgggacacatatccagctcatag

SEQ ID NO: 190085 - DNA, 38 bp, Artificial Sequence
  Description of Artificial Sequence: Synthetic oligonucleotide
aaataagcacaaacgggacacatatccagctcatagtg

SEQ ID NO: 190086 - DNA, 37 bp, Artificial Sequence
  Description of Artificial Sequence: Synthetic oligonucleotide
aataagcacaaacgggacacatatccagctcatagtg

SEQ ID NO: 190087 - DNA, 36 bp, Artificial Sequence
  Description of Artificial Sequence: Synthetic oligonucleotide
ataagcacaaacgggacacatatccagctcatagtg

SEQ ID NO: 190088 - DNA, 35 bp, Artificial Sequence
  Description of Artificial Sequence: Synthetic oligonucleotide
taagcacaaacgggacacatatccagctcatagtg

SEQ ID NO: 190089 - DNA, 34 bp, Artificial Sequence
  Description of Artificial Sequence: Synthetic oligonucleotide
aagcacaaacgggacacatatccagctcatagtg

SEQ ID NO: 190090 - DNA, 33 bp, Artificial Sequence
  Description of Artificial Sequence: Synthetic oligonucleotide
agcacaaacgggacacatatccagctcatagtg

SEQ ID NO: 190091 - DNA, 32 bp, Artificial Sequence
  Description of Artificial Sequence: Synthetic oligonucleotide
gcacaaacgggacacatatccagctcatagtg

SEQ ID NO: 190092 - DNA, 37 bp, Artificial Sequence
  Description of Artificial Sequence: Synthetic oligonucleotide
cacaaacgggacacatatccagctcatagtgttaatg

SEQ ID NO: 190093 - DNA, 39 bp, Artificial Sequence
  Description of Artificial Sequence: Synthetic oligonucleotide
acaaacgggacacatatccagctcatagtgttaatgaag

SEQ ID NO: 190094 - DNA, 38 bp, Artificial Sequence
  Description of Artificial Sequence: Synthetic oligonucleotide
caaacgggacacatatccagctcatagtgttaatgaag

SEQ ID NO: 190095 - DNA, 41 bp, Artificial Sequence
  Description of Artificial Sequence: Synthetic oligonucleotide
aaacgggacacatatccagctcatagtgttaatgaagtttc

SEQ ID NO: 190096 - DNA, 40 bp, Artificial Sequence
  Description of Artificial Sequence: Synthetic oligonucleotide
aacgggacacatatccagctcatagtgttaatgaagtttc

SEQ ID NO: 190097 - DNA, 39 bp, Artificial Sequence
  Description of Artificial Sequence: Synthetic oligonucleotide
acgggacacatatccagctcatagtgttaatgaagtttc

SEQ ID NO: 190098 - DNA, 38 bp, Artificial Sequence
  Description of Artificial Sequence: Synthetic oligonucleotide
cgggacacatatccagctcatagtgttaatgaagtttc

SEQ ID NO: 190099 - DNA, 39 bp, Artificial Sequence
  Description of Artificial Sequence: Synthetic oligonucleotide
gggacacatatccagctcatagtgttaatgaagtttcag

SEQ ID NO: 190100 - DNA, 45 bp, Artificial Sequence
  Description of Artificial Sequence: Synthetic oligonucleotide
ggacacatatccagctcatagtgttaatgaagtttcagaaaattc

SEQ ID NO: 190101 - DNA, 46 bp, Artificial Sequence
  Description of Artificial Sequence: Synthetic oligonucleotide
gacacatatccagctcatagtgttaatgaagtttcagaaaattctg

SEQ ID NO: 190102 - DNA, 49 bp, Artificial Sequence
  Description of Artificial Sequence: Synthetic oligonucleotide
acacatatccagctcatagtgttaatgaagtttcagaaaattctgttac

SEQ ID NO: 190103 - DNA, 48 bp, Artificial Sequence
  Description of Artificial Sequence: Synthetic oligonucleotide
cacatatccagctcatagtgttaatgaagtttcagaaaattctgttac

SEQ ID NO: 190104 - DNA, 50 bp, Artificial Sequence
  Description of Artificial Sequence: Synthetic oligonucleotide
acatatccagctcatagtgttaatgaagtttcagaaaattctgttacaac

SEQ ID NO: 190105 - DNA, 49 bp, Artificial Sequence
  Description of Artificial Sequence: Synthetic oligonucleotide
catatccagctcatagtgttaatgaagtttcagaaaattctgttacaac

SEQ ID NO: 190106 - DNA, 50 bp, Artificial Sequence
  Description of Artificial Sequence: Synthetic oligonucleotide
atatccagctcatagtgttaatgaagtttcagaaaattctgttacaactg

SEQ ID NO: 190107 - DNA, 49 bp, Artificial Sequence
  Description of Artificial Sequence: Synthetic oligonucleotide
tatccagctcatagtgttaatgaagtttcagaaaattctgttacaactg

SEQ ID NO: 190108 - DNA, 48 bp, Artificial Sequence
  Description of Artificial Sequence: Synthetic oligonucleotide
atccagctcatagtgttaatgaagtttcagaaaattctgttacaactg

SEQ ID NO: 190109 - DNA, 47 bp, Artificial Sequence
  Description of Artificial Sequence: Synthetic oligonucleotide
tccagctcatagtgttaatgaagtttcagaaaattctgttacaactg

SEQ ID NO: 190110 - DNA, 46 bp, Artificial Sequence
  Description of Artificial Sequence: Synthetic oligonucleotide
ccagctcatagtgttaatgaagtttcagaaaattctgttacaactg

SEQ ID NO: 190111 - DNA, 50 bp, Artificial Sequence
  Description of Artificial Sequence: Synthetic oligonucleotide
cagctcatagtgttaatgaagtttcagaaaattctgttacaactgtttac

SEQ ID NO: 190112 - DNA, 50 bp, Artificial Sequence
  Description of Artificial Sequence: Synthetic oligonucleotide
agctcatagtgttaatgaagtttcagaaaattctgttacaactgtttacc

SEQ ID NO: 190113 - DNA, 49 bp, Artificial Sequence
  Description of Artificial Sequence: Synthetic oligonucleotide
gctcatagtgttaatgaagtttcagaaaattctgttacaactgtttacc

SEQ ID NO: 190114 - DNA, 49 bp, Artificial Sequence
  Description of Artificial Sequence: Synthetic oligonucleotide
ctcatagtgttaatgaagtttcagaaaattctgttacaactgtttaccc

SEQ ID NO: 190115 - DNA, 50 bp, Artificial Sequence
  Description of Artificial Sequence: Synthetic oligonucleotide
tcatagtgttaatgaagtttcagaaaattctgttacaactgtttaccctc

SEQ ID NO: 190116 - DNA, 49 bp, Artificial Sequence
  Description of Artificial Sequence: Synthetic oligonucleotide
catagtgttaatgaagtttcagaaaattctgttacaactgtttaccctc

SEQ ID NO: 190117 - DNA, 49 bp, Artificial Sequence
  Description of Artificial Sequence: Synthetic oligonucleotide
atagtgttaatgaagtttcagaaaattctgttacaactgtttaccctcc

SEQ ID NO: 190118 - DNA, 48 bp, Artificial Sequence
  Description of Artificial Sequence: Synthetic oligonucleotide
tagtgttaatgaagtttcagaaaattctgttacaactgtttaccctcc

SEQ ID NO: 190119 - DNA, 47 bp, Artificial Sequence
  Description of Artificial Sequence: Synthetic oligonucleotide
agtgttaatgaagtttcagaaaattctgttacaactgtttaccctcc

SEQ ID NO: 190120 - DNA, 46 bp, Artificial Sequence
  Description of Artificial Sequence: Synthetic oligonucleotide
gtgttaatgaagtttcagaaaattctgttacaactgtttaccctcc

SEQ ID NO: 190121 - DNA, 47 bp, Artificial Sequence
  Description of Artificial Sequence: Synthetic oligonucleotide
tgttaatgaagtttcagaaaattctgttacaactgtttaccctccag

SEQ ID NO: 190122 - DNA, 46 bp, Artificial Sequence
  Description of Artificial Sequence: Synthetic oligonucleotide
gttaatgaagtttcagaaaattctgttacaactgtttaccctccag

SEQ ID NO: 190123 - DNA, 48 bp, Artificial Sequence
  Description of Artificial Sequence: Synthetic oligonucleotide
ttaatgaagtttcagaaaattctgttacaactgtttaccctccagaag

SEQ ID NO: 190124 - DNA, 47 bp, Artificial Sequence
  Description of Artificial Sequence: Synthetic oligonucleotide
taatgaagtttcagaaaattctgttacaactgtttaccctccagaag

SEQ ID NO: 190125 - DNA, 46 bp, Artificial Sequence
  Description of Artificial Sequence: Synthetic oligonucleotide
aatgaagtttcagaaaattctgttacaactgtttaccctccagaag

SEQ ID NO: 190126 - DNA, 45 bp, Artificial Sequence
  Description of Artificial Sequence: Synthetic oligonucleotide
atgaagtttcagaaaattctgttacaactgtttaccctccagaag

SEQ ID NO: 190127 - DNA, 44 bp, Artificial Sequence
  Description of Artificial Sequence: Synthetic oligonucleotide
tgaagtttcagaaaattctgttacaactgtttaccctccagaag

SEQ ID NO: 190128 - DNA, 43 bp, Artificial Sequence
  Description of Artificial Sequence: Synthetic oligonucleotide
gaagtttcagaaaattctgttacaactgtttaccctccagaag

SEQ ID NO: 190129 - DNA, 44 bp, Artificial Sequence
  Description of Artificial Sequence: Synthetic oligonucleotide
aagtttcagaaaattctgttacaactgtttaccctccagaagag

SEQ ID NO: 190130 - DNA, 43 bp, Artificial Sequence
  Description of Artificial Sequence: Synthetic oligonucleotide
agtttcagaaaattctgttacaactgtttaccctccagaagag

SEQ ID NO: 190131 - DNA, 42 bp, Artificial Sequence
  Description of Artificial Sequence: Synthetic oligonucleotide
gtttcagaaaattctgttacaactgtttaccctccagaagag

SEQ ID NO: 190132 - DNA, 42 bp, Artificial Sequence
  Description of Artificial Sequence: Synthetic oligonucleotide
tttcagaaaattctgttacaactgtttaccctccagaagagg

SEQ ID NO: 190133 - DNA, 41 bp, Artificial Sequence
  Description of Artificial Sequence: Synthetic oligonucleotide
ttcagaaaattctgttacaactgtttaccctccagaagagg

SEQ ID NO: 190134 - DNA, 40 bp, Artificial Sequence
  Description of Artificial Sequence: Synthetic oligonucleotide
tcagaaaattctgttacaactgtttaccctccagaagagg

SEQ ID NO: 190135 - DNA, 39 bp, Artificial Sequence
  Description of Artificial Sequence: Synthetic oligonucleotide
cagaaaattctgttacaactgtttaccctccagaagagg

SEQ ID NO: 190136 - DNA, 44 bp, Artificial Sequence
  Description of Artificial Sequence: Synthetic oligonucleotide
agaaaattctgttacaactgtttaccctccagaagaggaaaatg

SEQ ID NO: 190137 - DNA, 43 bp, Artificial Sequence
  Description of Artificial Sequence: Synthetic oligonucleotide
gaaaattctgttacaactgtttaccctccagaagaggaaaatg

SEQ ID NO: 190138 - DNA, 43 bp, Artificial Sequence
  Description of Artificial Sequence: Synthetic oligonucleotide
aaaattctgttacaactgtttaccctccagaagaggaaaatgg

SEQ ID NO: 190139 - DNA, 42 bp, Artificial Sequence
  Description of Artificial Sequence: Synthetic oligonucleotide
aaattctgttacaactgtttaccctccagaagaggaaaatgg

SEQ ID NO: 190140 - DNA, 41 bp, Artificial Sequence
  Description of Artificial Sequence: Synthetic oligonucleotide
aattctgttacaactgtttaccctccagaagaggaaaatgg

SEQ ID NO: 190141 - DNA, 40 bp, Artificial Sequence
  Description of Artificial Sequence: Synthetic oligonucleotide
attctgttacaactgtttaccctccagaagaggaaaatgg

SEQ ID NO: 190142 - DNA, 39 bp, Artificial Sequence
  Description of Artificial Sequence: Synthetic oligonucleotide
ttctgttacaactgtttaccctccagaagaggaaaatgg

SEQ ID NO: 190143 - DNA, 38 bp, Artificial Sequence
  Description of Artificial Sequence: Synthetic oligonucleotide
tctgttacaactgtttaccctccagaagaggaaaatgg

SEQ ID NO: 190144 - DNA, 37 bp, Artificial Sequence
  Description of Artificial Sequence: Synthetic oligonucleotide
ctgttacaactgtttaccctccagaagaggaaaatgg

SEQ ID NO: 190145 - DNA, 38 bp, Artificial Sequence
  Description of Artificial Sequence: Synthetic oligonucleotide
tgttacaactgtttaccctccagaagaggaaaatggag

SEQ ID NO: 190146 - DNA, 37 bp, Artificial Sequence
  Description of Artificial Sequence: Synthetic oligonucleotide
gttacaactgtttaccctccagaagaggaaaatggag

SEQ ID NO: 190147 - DNA, 40 bp, Artificial Sequence
  Description of Artificial Sequence: Synthetic oligonucleotide
ttacaactgtttaccctccagaagaggaaaatggagaaag

SEQ ID NO: 190148 - DNA, 39 bp, Artificial Sequence
  Description of Artificial Sequence: Synthetic oligonucleotide
tacaactgtttaccctccagaagaggaaaatggagaaag

SEQ ID NO: 190149 - DNA, 38 bp, Artificial Sequence
  Description of Artificial Sequence: Synthetic oligonucleotide
acaactgtttaccctccagaagaggaaaatggagaaag

SEQ ID NO: 190150 - DNA, 37 bp, Artificial Sequence
  Description of Artificial Sequence: Synthetic oligonucleotide
caactgtttaccctccagaagaggaaaatggagaaag

SEQ ID NO: 190151 - DNA, 37 bp, Artificial Sequence
  Description of Artificial Sequence: Synthetic oligonucleotide
aactgtttaccctccagaagaggaaaatggagaaagg

SEQ ID NO: 190152 - DNA, 36 bp, Artificial Sequence
  Description of Artificial Sequence: Synthetic oligonucleotide
actgtttaccctccagaagaggaaaatggagaaagg

SEQ ID NO: 190153 - DNA, 35 bp, Artificial Sequence
  Description of Artificial Sequence: Synthetic oligonucleotide
ctgtttaccctccagaagaggaaaatggagaaagg

SEQ ID NO: 190154 - DNA, 35 bp, Artificial Sequence
  Description of Artificial Sequence: Synthetic oligonucleotide
tgtttaccctccagaagaggaaaatggagaaaggg

SEQ ID NO: 190155 - DNA, 34 bp, Artificial Sequence
  Description of Artificial Sequence: Synthetic oligonucleotide
gtttaccctccagaagaggaaaatggagaaaggg

SEQ ID NO: 190156 - DNA, 34 bp, Artificial Sequence
  Description of Artificial Sequence: Synthetic oligonucleotide
tttaccctccagaagaggaaaatggagaaagggg

SEQ ID NO: 190157 - DNA, 33 bp, Artificial Sequence
  Description of Artificial Sequence: Synthetic oligonucleotide
ttaccctccagaagaggaaaatggagaaagggg

SEQ ID NO: 190158 - DNA, 32 bp, Artificial Sequence
  Description of Artificial Sequence: Synthetic oligonucleotide
taccctccagaagaggaaaatggagaaagggg

SEQ ID NO: 190159 - DNA, 31 bp, Artificial Sequence
  Description of Artificial Sequence: Synthetic oligonucleotide
accctccagaagaggaaaatggagaaagggg

SEQ ID NO: 190160 - DNA, 30 bp, Artificial Sequence
  Description of Artificial Sequence: Synthetic oligonucleotide
ccctccagaagaggaaaatggagaaagggg

SEQ ID NO: 190161 - DNA, 31 bp, Artificial Sequence
  Description of Artificial Sequence: Synthetic oligonucleotide
cctccagaagaggaaaatggagaaaggggac

SEQ ID NO: 190162 - DNA, 33 bp, Artificial Sequence
  Description of Artificial Sequence: Synthetic oligonucleotide
ctccagaagaggaaaatggagaaaggggacaac

SEQ ID NO: 190163 - DNA, 35 bp, Artificial Sequence
  Description of Artificial Sequence: Synthetic oligonucleotide
tccagaagaggaaaatggagaaaggggacaacttg

SEQ ID NO: 190164 - DNA, 34 bp, Artificial Sequence
  Description of Artificial Sequence: Synthetic oligonucleotide
ccagaagaggaaaatggagaaaggggacaacttg

SEQ ID NO: 190165 - DNA, 35 bp, Artificial Sequence
  Description of Artificial Sequence: Synthetic oligonucleotide
cagaagaggaaaatggagaaaggggacaacttgtc

SEQ ID NO: 190166 - DNA, 35 bp, Artificial Sequence
  Description of Artificial Sequence: Synthetic oligonucleotide
agaagaggaaaatggagaaaggggacaacttgtcc

SEQ ID NO: 190167 - DNA, 34 bp, Artificial Sequence
  Description of Artificial Sequence: Synthetic oligonucleotide
gaagaggaaaatggagaaaggggacaacttgtcc

SEQ ID NO: 190168 - DNA, 36 bp, Artificial Sequence
  Description of Artificial Sequence: Synthetic oligonucleotide
aagaggaaaatggagaaaggggacaacttgtccatc

SEQ ID NO: 190169 - DNA, 35 bp, Artificial Sequence
  Description of Artificial Sequence: Synthetic oligonucleotide
agaggaaaatggagaaaggggacaacttgtccatc

SEQ ID NO: 190170 - DNA, 34 bp, Artificial Sequence
  Description of Artificial Sequence: Synthetic oligonucleotide
gaggaaaatggagaaaggggacaacttgtccatc

SEQ ID NO: 190171 - DNA, 34 bp, Artificial Sequence
  Description of Artificial Sequence: Synthetic oligonucleotide
aggaaaatggagaaaggggacaacttgtccatcg

SEQ ID NO: 190172 - DNA, 33 bp, Artificial Sequence
  Description of Artificial Sequence: Synthetic oligonucleotide
ggaaaatggagaaaggggacaacttgtccatcg

SEQ ID NO: 190173 - DNA, 36 bp, Artificial Sequence
  Description of Artificial Sequence: Synthetic oligonucleotide
gaaaatggagaaaggggacaacttgtccatcgtttc

SEQ ID NO: 190174 - DNA, 36 bp, Artificial Sequence
  Description of Artificial Sequence: Synthetic oligonucleotide
aaaatggagaaaggggacaacttgtccatcgtttcc

SEQ ID NO: 190175 - DNA, 35 bp, Artificial Sequence
  Description of Artificial Sequence: Synthetic oligonucleotide
aaatggagaaaggggacaacttgtccatcgtttcc

SEQ ID NO: 190176 - DNA, 34 bp, Artificial Sequence
  Description of Artificial Sequence: Synthetic oligonucleotide
aatggagaaaggggacaacttgtccatcgtttcc

SEQ ID NO: 190177 - DNA, 33 bp, Artificial Sequence
  Description of Artificial Sequence: Synthetic oligonucleotide
atggagaaaggggacaacttgtccatcgtttcc

SEQ ID NO: 190178 - DNA, 32 bp, Artificial Sequence
  Description of Artificial Sequence: Synthetic oligonucleotide
tggagaaaggggacaacttgtccatcgtttcc

SEQ ID NO: 190179 - DNA, 31 bp, Artificial Sequence
  Description of Artificial Sequence: Synthetic oligonucleotide
ggagaaaggggacaacttgtccatcgtttcc

SEQ ID NO: 190180 - DNA, 31 bp, Artificial Sequence
  Description of Artificial Sequence: Synthetic oligonucleotide
gagaaaggggacaacttgtccatcgtttccc

SEQ ID NO: 190181 - DNA, 32 bp, Artificial Sequence
  Description of Artificial Sequence: Synthetic oligonucleotide
agaaaggggacaacttgtccatcgtttccctg

SEQ ID NO: 190182 - DNA, 31 bp, Artificial Sequence
  Description of Artificial Sequence: Synthetic oligonucleotide
gaaaggggacaacttgtccatcgtttccctg

SEQ ID NO: 190183 - DNA, 33 bp, Artificial Sequence
  Description of Artificial Sequence: Synthetic oligonucleotide
aaaggggacaacttgtccatcgtttccctgaag

SEQ ID NO: 190184 - DNA, 32 bp, Artificial Sequence
  Description of Artificial Sequence: Synthetic oligonucleotide
aaggggacaacttgtccatcgtttccctgaag

SEQ ID NO: 190185 - DNA, 31 bp, Artificial Sequence
  Description of Artificial Sequence: Synthetic oligonucleotide
aggggacaacttgtccatcgtttccctgaag

SEQ ID NO: 190186 - DNA, 30 bp, Artificial Sequence
  Description of Artificial Sequence: Synthetic oligonucleotide
ggggacaacttgtccatcgtttccctgaag

SEQ ID NO: 190187 - DNA, 30 bp, Artificial Sequence
  Description of Artificial Sequence: Synthetic oligonucleotide
gggacaacttgtccatcgtttccctgaagc

SEQ ID NO: 190188 - DNA, 31 bp, Artificial Sequence
  Description of Artificial Sequence: Synthetic oligonucleotide
ggacaacttgtccatcgtttccctgaagcag

SEQ ID NO: 190189 - DNA, 31 bp, Artificial Sequence
  Description of Artificial Sequence: Synthetic oligonucleotide
gacaacttgtccatcgtttccctgaagcagg

SEQ ID NO: 190190 - DNA, 31 bp, Artificial Sequence
  Description of Artificial Sequence: Synthetic oligonucleotide
acaacttgtccatcgtttccctgaagcaggg

SEQ ID NO: 190191 - DNA, 30 bp, Artificial Sequence
  Description of Artificial Sequence: Synthetic oligonucleotide
caacttgtccatcgtttccctgaagcaggg

SEQ ID NO: 190192 - DNA, 34 bp, Artificial Sequence
  Description of Artificial Sequence: Synthetic oligonucleotide
aacttgtccatcgtttccctgaagcagggataac

SEQ ID NO: 190193 - DNA, 33 bp, Artificial Sequence
  Description of Artificial Sequence: Synthetic oligonucleotide
acttgtccatcgtttccctgaagcagggataac

SEQ ID NO: 190194 - DNA, 32 bp, Artificial Sequence
  Description of Artificial Sequence: Synthetic oligonucleotide
cttgtccatcgtttccctgaagcagggataac

SEQ ID NO: 190195 - DNA, 33 bp, Artificial Sequence
  Description of Artificial Sequence: Synthetic oligonucleotide
ttgtccatcgtttccctgaagcagggataacac

SEQ ID NO: 190196 - DNA, 32 bp, Artificial Sequence
  Description of Artificial Sequence: Synthetic oligonucleotide
tgtccatcgtttccctgaagcagggataacac

SEQ ID NO: 190197 - DNA, 31 bp, Artificial Sequence
  Description of Artificial Sequence: Synthetic oligonucleotide
gtccatcgtttccctgaagcagggataacac

SEQ ID NO: 190198 - DNA, 32 bp, Artificial Sequence
  Description of Artificial Sequence: Synthetic oligonucleotide
tccatcgtttccctgaagcagggataacactc

SEQ ID NO: 190199 - DNA, 31 bp, Artificial Sequence
  Description of Artificial Sequence: Synthetic oligonucleotide
ccatcgtttccctgaagcagggataacactc

SEQ ID NO: 190200 - DNA, 38 bp, Artificial Sequence
  Description of Artificial Sequence: Synthetic oligonucleotide
catcgtttccctgaagcagggataacactcattaattg

SEQ ID NO: 190201 - DNA, 38 bp, Artificial Sequence
  Description of Artificial Sequence: Synthetic oligonucleotide
atcgtttccctgaagcagggataacactcattaattgg

SEQ ID NO: 190202 - DNA, 37 bp, Artificial Sequence
  Description of Artificial Sequence: Synthetic oligonucleotide
tcgtttccctgaagcagggataacactcattaattgg

SEQ ID NO: 190203 - DNA, 36 bp, Artificial Sequence
  Description of Artificial Sequence: Synthetic oligonucleotide
cgtttccctgaagcagggataacactcattaattgg

SEQ ID NO: 190204 - DNA, 37 bp, Artificial Sequence
  Description of Artificial Sequence: Synthetic oligonucleotide
gtttccctgaagcagggataacactcattaattggtg

SEQ ID NO: 190205 - DNA, 37 bp, Artificial Sequence
  Description of Artificial Sequence: Synthetic oligonucleotide
tttccctgaagcagggataacactcattaattggtgg

SEQ ID NO: 190206 - DNA, 36 bp, Artificial Sequence
  Description of Artificial Sequence: Synthetic oligonucleotide
ttccctgaagcagggataacactcattaattggtgg

SEQ ID NO: 190207 - DNA, 35 bp, Artificial Sequence
  Description of Artificial Sequence: Synthetic oligonucleotide
tccctgaagcagggataacactcattaattggtgg

SEQ ID NO: 190208 - DNA, 34 bp, Artificial Sequence
  Description of Artificial Sequence: Synthetic oligonucleotide
ccctgaagcagggataacactcattaattggtgg

SEQ ID NO: 190209 - DNA, 34 bp, Artificial Sequence
  Description of Artificial Sequence: Synthetic oligonucleotide
cctgaagcagggataacactcattaattggtggg

SEQ ID NO: 190210 - DNA, 34 bp, Artificial Sequence
  Description of Artificial Sequence: Synthetic oligonucleotide
ctgaagcagggataacactcattaattggtgggc

SEQ ID NO: 190211 - DNA, 34 bp, Artificial Sequence
  Description of Artificial Sequence: Synthetic oligonucleotide
tgaagcagggataacactcattaattggtgggcg

SEQ ID NO: 190212 - DNA, 33 bp, Artificial Sequence
  Description of Artificial Sequence: Synthetic oligonucleotide
gaagcagggataacactcattaattggtgggcg

SEQ ID NO: 190213 - DNA, 35 bp, Artificial Sequence
  Description of Artificial Sequence: Synthetic oligonucleotide
aagcagggataacactcattaattggtgggcgatg

SEQ ID NO: 190214 - DNA, 34 bp, Artificial Sequence
  Description of Artificial Sequence: Synthetic oligonucleotide
agcagggataacactcattaattggtgggcgatg

SEQ ID NO: 190215 - DNA, 33 bp, Artificial Sequence
  Description of Artificial Sequence: Synthetic oligonucleotide
gcagggataacactcattaattggtgggcgatg

SEQ ID NO: 190216 - DNA, 33 bp, Artificial Sequence
  Description of Artificial Sequence: Synthetic oligonucleotide
cagggataacactcattaattggtgggcgatgg

SEQ ID NO: 190217 - DNA, 33 bp, Artificial Sequence
  Description of Artificial Sequence: Synthetic oligonucleotide
agggataacactcattaattggtgggcgatggc

SEQ ID NO: 190218 - DNA, 32 bp, Artificial Sequence
  Description of Artificial Sequence: Synthetic oligonucleotide
gggataacactcattaattggtgggcgatggc

SEQ ID NO: 190219 - DNA, 33 bp, Artificial Sequence
  Description of Artificial Sequence: Synthetic oligonucleotide
ggataacactcattaattggtgggcgatggctc

SEQ ID NO: 190220 - DNA, 33 bp, Artificial Sequence
  Description of Artificial Sequence: Synthetic oligonucleotide
gataacactcattaattggtgggcgatggctcg

SEQ ID NO: 190221 - DNA, 34 bp, Artificial Sequence
  Description of Artificial Sequence: Synthetic oligonucleotide
ataacactcattaattggtgggcgatggctcgtg

SEQ ID NO: 190222 - DNA, 33 bp, Artificial Sequence
  Description of Artificial Sequence: Synthetic oligonucleotide
taacactcattaattggtgggcgatggctcgtg

SEQ ID NO: 190223 - DNA, 32 bp, Artificial Sequence
  Description of Artificial Sequence: Synthetic oligonucleotide
aacactcattaattggtgggcgatggctcgtg

SEQ ID NO: 190224 - DNA, 31 bp, Artificial Sequence
  Description of Artificial Sequence: Synthetic oligonucleotide
acactcattaattggtgggcgatggctcgtg

SEQ ID NO: 190225 - DNA, 30 bp, Artificial Sequence
  Description of Artificial Sequence: Synthetic oligonucleotide
cactcattaattggtgggcgatggctcgtg

SEQ ID NO: 190226 - DNA, 38 bp, Artificial Sequence
  Description of Artificial Sequence: Synthetic oligonucleotide
actcattaattggtgggcgatggctcgtgttatttttg

SEQ ID NO: 190227 - DNA, 37 bp, Artificial Sequence
  Description of Artificial Sequence: Synthetic oligonucleotide
ctcattaattggtgggcgatggctcgtgttatttttg

SEQ ID NO: 190228 - DNA, 38 bp, Artificial Sequence
  Description of Artificial Sequence: Synthetic oligonucleotide
tcattaattggtgggcgatggctcgtgttatttttgag

SEQ ID NO: 190229 - DNA, 37 bp, Artificial Sequence
  Description of Artificial Sequence: Synthetic oligonucleotide
cattaattggtgggcgatggctcgtgttatttttgag

SEQ ID NO: 190230 - DNA, 37 bp, Artificial Sequence
  Description of Artificial Sequence: Synthetic oligonucleotide
attaattggtgggcgatggctcgtgttatttttgagg

SEQ ID NO: 190231 - DNA, 36 bp, Artificial Sequence
  Description of Artificial Sequence: Synthetic oligonucleotide
ttaattggtgggcgatggctcgtgttatttttgagg

SEQ ID NO: 190232 - DNA, 35 bp, Artificial Sequence
  Description of Artificial Sequence: Synthetic oligonucleotide
taattggtgggcgatggctcgtgttatttttgagg

SEQ ID NO: 190233 - DNA, 34 bp, Artificial Sequence
  Description of Artificial Sequence: Synthetic oligonucleotide
aattggtgggcgatggctcgtgttatttttgagg

SEQ ID NO: 190234 - DNA, 33 bp, Artificial Sequence
  Description of Artificial Sequence: Synthetic oligonucleotide
attggtgggcgatggctcgtgttatttttgagg

SEQ ID NO: 190235 - DNA, 32 bp, Artificial Sequence
  Description of Artificial Sequence: Synthetic oligonucleotide
ttggtgggcgatggctcgtgttatttttgagg

SEQ ID NO: 190236 - DNA, 31 bp, Artificial Sequence
  Description of Artificial Sequence: Synthetic oligonucleotide
tggtgggcgatggctcgtgttatttttgagg

SEQ ID NO: 190237 - DNA, 30 bp, Artificial Sequence
  Description of Artificial Sequence: Synthetic oligonucleotide
ggtgggcgatggctcgtgttatttttgagg

SEQ ID NO: 190238 - DNA, 31 bp, Artificial Sequence
  Description of Artificial Sequence: Synthetic oligonucleotide
gtgggcgatggctcgtgttatttttgaggtg

SEQ ID NO: 190239 - DNA, 33 bp, Artificial Sequence
  Description of Artificial Sequence: Synthetic oligonucleotide
tgggcgatggctcgtgttatttttgaggtgatg

SEQ ID NO: 190240 - DNA, 32 bp, Artificial Sequence
  Description of Artificial Sequence: Synthetic oligonucleotide
gggcgatggctcgtgttatttttgaggtgatg

SEQ ID NO: 190241 - DNA, 32 bp, Artificial Sequence
  Description of Artificial Sequence: Synthetic oligonucleotide
ggcgatggctcgtgttatttttgaggtgatgc

SEQ ID NO: 190242 - DNA, 34 bp, Artificial Sequence
  Description of Artificial Sequence: Synthetic oligonucleotide
gcgatggctcgtgttatttttgaggtgatgcttg

SEQ ID NO: 190243 - DNA, 36 bp, Artificial Sequence
  Description of Artificial Sequence: Synthetic oligonucleotide
cgatggctcgtgttatttttgaggtgatgcttgttg

SEQ ID NO: 190244 - DNA, 38 bp, Artificial Sequence
  Description of Artificial Sequence: Synthetic oligonucleotide
gatggctcgtgttatttttgaggtgatgcttgttgttg

SEQ ID NO: 190245 - DNA, 40 bp, Artificial Sequence
  Description of Artificial Sequence: Synthetic oligonucleotide
atggctcgtgttatttttgaggtgatgcttgttgttgttg

SEQ ID NO: 190246 - DNA, 39 bp, Artificial Sequence
  Description of Artificial Sequence: Synthetic oligonucleotide
tggctcgtgttatttttgaggtgatgcttgttgttgttg

SEQ ID NO: 190247 - DNA, 38 bp, Artificial Sequence
  Description of Artificial Sequence: Synthetic oligonucleotide
ggctcgtgttatttttgaggtgatgcttgttgttgttg

SEQ ID NO: 190248 - DNA, 38 bp, Artificial Sequence
  Description of Artificial Sequence: Synthetic oligonucleotide
gctcgtgttatttttgaggtgatgcttgttgttgttgg

SEQ ID NO: 190249 - DNA, 41 bp, Artificial Sequence
  Description of Artificial Sequence: Synthetic oligonucleotide
ctcgtgttatttttgaggtgatgcttgttgttgttggaatg

SEQ ID NO: 190250 - DNA, 43 bp, Artificial Sequence
  Description of Artificial Sequence: Synthetic oligonucleotide
tcgtgttatttttgaggtgatgcttgttgttgttggaatgatc

SEQ ID NO: 190251 - DNA, 42 bp, Artificial Sequence
  Description of Artificial Sequence: Synthetic oligonucleotide
cgtgttatttttgaggtgatgcttgttgttgttggaatgatc

SEQ ID NO: 190252 - DNA, 44 bp, Artificial Sequence
  Description of Artificial Sequence: Synthetic oligonucleotide
gtgttatttttgaggtgatgcttgttgttgttggaatgatcatc

SEQ ID NO: 190253 - DNA, 51 bp, Artificial Sequence
  Description of Artificial Sequence: Synthetic oligonucleotide
tgttatttttgaggtgatgcttgttgttgttggaatgatcatcttaatttc

SEQ ID NO: 190254 - DNA, 50 bp, Artificial Sequence
  Description of Artificial Sequence: Synthetic oligonucleotide
gttatttttgaggtgatgcttgttgttgttggaatgatcatcttaatttc

SEQ ID NO: 190255 - DNA, 53 bp, Artificial Sequence
  Description of Artificial Sequence: Synthetic oligonucleotide
ttatttttgaggtgatgcttgttgttgttggaatgatcatcttaatttcttac

SEQ ID NO: 190256 - DNA, 52 bp, Artificial Sequence
  Description of Artificial Sequence: Synthetic oligonucleotide
tatttttgaggtgatgcttgttgttgttggaatgatcatcttaatttcttac

SEQ ID NO: 190257 - DNA, 51 bp, Artificial Sequence
  Description of Artificial Sequence: Synthetic oligonucleotide
atttttgaggtgatgcttgttgttgttggaatgatcatcttaatttcttac

SEQ ID NO: 190258 - DNA, 50 bp, Artificial Sequence
  Description of Artificial Sequence: Synthetic oligonucleotide
tttttgaggtgatgcttgttgttgttggaatgatcatcttaatttcttac

SEQ ID NO: 190259 - DNA, 49 bp, Artificial Sequence
  Description of Artificial Sequence: Synthetic oligonucleotide
ttttgaggtgatgcttgttgttgttggaatgatcatcttaatttcttac

SEQ ID NO: 190260 - DNA, 48 bp, Artificial Sequence
  Description of Artificial Sequence: Synthetic oligonucleotide
tttgaggtgatgcttgttgttgttggaatgatcatcttaatttcttac

SEQ ID NO: 190261 - DNA, 47 bp, Artificial Sequence
  Description of Artificial Sequence: Synthetic oligonucleotide
ttgaggtgatgcttgttgttgttggaatgatcatcttaatttcttac

SEQ ID NO: 190262 - DNA, 46 bp, Artificial Sequence
  Description of Artificial Sequence: Synthetic oligonucleotide
tgaggtgatgcttgttgttgttggaatgatcatcttaatttcttac

SEQ ID NO: 190263 - DNA, 45 bp, Artificial Sequence
  Description of Artificial Sequence: Synthetic oligonucleotide
gaggtgatgcttgttgttgttggaatgatcatcttaatttcttac

SEQ ID NO: 190264 - DNA, 46 bp, Artificial Sequence
  Description of Artificial Sequence: Synthetic oligonucleotide
aggtgatgcttgttgttgttggaatgatcatcttaatttcttactg

SEQ ID NO: 190265 - DNA, 45 bp, Artificial Sequence
  Description of Artificial Sequence: Synthetic oligonucleotide
ggtgatgcttgttgttgttggaatgatcatcttaatttcttactg

SEQ ID NO: 190266 - DNA, 49 bp, Artificial Sequence
  Description of Artificial Sequence: Synthetic oligonucleotide
gtgatgcttgttgttgttggaatgatcatcttaatttcttactgtattc

SEQ ID NO: 190267 - DNA, 49 bp, Artificial Sequence
  Description of Artificial Sequence: Synthetic oligonucleotide
tgatgcttgttgttgttggaatgatcatcttaatttcttactgtattcg

SEQ ID NO: 190268 - DNA, 48 bp, Artificial Sequence
  Description of Artificial Sequence: Synthetic oligonucleotide
gatgcttgttgttgttggaatgatcatcttaatttcttactgtattcg

SEQ ID NO: 190269 - DNA, 50 bp, Artificial Sequence
  Description of Artificial Sequence: Synthetic oligonucleotide
atgcttgttgttgttggaatgatcatcttaatttcttactgtattcgatg

SEQ ID NO: 190270 - DNA, 49 bp, Artificial Sequence
  Description of Artificial Sequence: Synthetic oligonucleotide
tgcttgttgttgttggaatgatcatcttaatttcttactgtattcgatg

SEQ ID NO: 190271 - DNA, 48 bp, Artificial Sequence
  Description of Artificial Sequence: Synthetic oligonucleotide
gcttgttgttgttggaatgatcatcttaatttcttactgtattcgatg

SEQ ID NO: 190272 - DNA, 56 bp, Artificial Sequence
  Description of Artificial Sequence: Synthetic oligonucleotide
tatggaaaaataatctttgtattactattgtcagaaattgtgagcatatcagcatc

SEQ ID NO: 190273 - DNA, 55 bp, Artificial Sequence
  Description of Artificial Sequence: Synthetic oligonucleotide
atggaaaaataatctttgtattactattgtcagaaattgtgagcatatcagcatc

SEQ ID NO: 190274 - DNA, 54 bp, Artificial Sequence
  Description of Artificial Sequence: Synthetic oligonucleotide
tggaaaaataatctttgtattactattgtcagaaattgtgagcatatcagcatc

SEQ ID NO: 190275 - DNA, 53 bp, Artificial Sequence
  Description of Artificial Sequence: Synthetic oligonucleotide
ggaaaaataatctttgtattactattgtcagaaattgtgagcatatcagcatc

SEQ ID NO: 190276 - DNA, 55 bp, Artificial Sequence
  Description of Artificial Sequence: Synthetic oligonucleotide
gaaaaataatctttgtattactattgtcagaaattgtgagcatatcagcatcaag

SEQ ID NO: 190277 - DNA, 57 bp, Artificial Sequence
  Description of Artificial Sequence: Synthetic oligonucleotide
aaaaataatctttgtattactattgtcagaaattgtgagcatatcagcatcaagtac

SEQ ID NO: 190278 - DNA, 56 bp, Artificial Sequence
  Description of Artificial Sequence: Synthetic oligonucleotide
aaaataatctttgtattactattgtcagaaattgtgagcatatcagcatcaagtac

SEQ ID NO: 190279 - DNA, 55 bp, Artificial Sequence
  Description of Artificial Sequence: Synthetic oligonucleotide
aaataatctttgtattactattgtcagaaattgtgagcatatcagcatcaagtac

SEQ ID NO: 190280 - DNA, 54 bp, Artificial Sequence
  Description of Artificial Sequence: Synthetic oligonucleotide
aataatctttgtattactattgtcagaaattgtgagcatatcagcatcaagtac

SEQ ID NO: 190281 - DNA, 53 bp, Artificial Sequence
  Description of Artificial Sequence: Synthetic oligonucleotide
ataatctttgtattactattgtcagaaattgtgagcatatcagcatcaagtac

SEQ ID NO: 190282 - DNA, 52 bp, Artificial Sequence
  Description of Artificial Sequence: Synthetic oligonucleotide
taatctttgtattactattgtcagaaattgtgagcatatcagcatcaagtac

SEQ ID NO: 190283 - DNA, 51 bp, Artificial Sequence
  Description of Artificial Sequence: Synthetic oligonucleotide
aatctttgtattactattgtcagaaattgtgagcatatcagcatcaagtac

SEQ ID NO: 190284 - DNA, 50 bp, Artificial Sequence
  Description of Artificial Sequence: Synthetic oligonucleotide
atctttgtattactattgtcagaaattgtgagcatatcagcatcaagtac

SEQ ID NO: 190285 - DNA, 49 bp, Artificial Sequence
  Description of Artificial Sequence: Synthetic oligonucleotide
tctttgtattactattgtcagaaattgtgagcatatcagcatcaagtac

SEQ ID NO: 190286 - DNA, 48 bp, Artificial Sequence
  Description of Artificial Sequence: Synthetic oligonucleotide
ctttgtattactattgtcagaaattgtgagcatatcagcatcaagtac

SEQ ID NO: 190287 - DNA, 48 bp, Artificial Sequence
  Description of Artificial Sequence: Synthetic oligonucleotide
tttgtattactattgtcagaaattgtgagcatatcagcatcaagtacc

SEQ ID NO: 190288 - DNA, 47 bp, Artificial Sequence
  Description of Artificial Sequence: Synthetic oligonucleotide
ttgtattactattgtcagaaattgtgagcatatcagcatcaagtacc

SEQ ID NO: 190289 - DNA, 46 bp, Artificial Sequence
  Description of Artificial Sequence: Synthetic oligonucleotide
tgtattactattgtcagaaattgtgagcatatcagcatcaagtacc

SEQ ID NO: 190290 - DNA, 45 bp, Artificial Sequence
  Description of Artificial Sequence: Synthetic oligonucleotide
gtattactattgtcagaaattgtgagcatatcagcatcaagtacc

SEQ ID NO: 190291 - DNA, 46 bp, Artificial Sequence
  Description of Artificial Sequence: Synthetic oligonucleotide
tattactattgtcagaaattgtgagcatatcagcatcaagtaccac

SEQ ID NO: 190292 - DNA, 45 bp, Artificial Sequence
  Description of Artificial Sequence: Synthetic oligonucleotide
attactattgtcagaaattgtgagcatatcagcatcaagtaccac

SEQ ID NO: 190293 - DNA, 44 bp, Artificial Sequence
  Description of Artificial Sequence: Synthetic oligonucleotide
ttactattgtcagaaattgtgagcatatcagcatcaagtaccac

SEQ ID NO: 190294 - DNA, 43 bp, Artificial Sequence
  Description of Artificial Sequence: Synthetic oligonucleotide
tactattgtcagaaattgtgagcatatcagcatcaagtaccac

SEQ ID NO: 190295 - DNA, 42 bp, Artificial Sequence
  Description of Artificial Sequence: Synthetic oligonucleotide
actattgtcagaaattgtgagcatatcagcatcaagtaccac

SEQ ID NO: 190296 - DNA, 41 bp, Artificial Sequence
  Description of Artificial Sequence: Synthetic oligonucleotide
ctattgtcagaaattgtgagcatatcagcatcaagtaccac

SEQ ID NO: 190297 - DNA, 42 bp, Artificial Sequence
  Description of Artificial Sequence: Synthetic oligonucleotide
tattgtcagaaattgtgagcatatcagcatcaagtaccactg

SEQ ID NO: 190298 - DNA, 41 bp, Artificial Sequence
  Description of Artificial Sequence: Synthetic oligonucleotide
attgtcagaaattgtgagcatatcagcatcaagtaccactg

SEQ ID NO: 190299 - DNA, 40 bp, Artificial Sequence
  Description of Artificial Sequence: Synthetic oligonucleotide
ttgtcagaaattgtgagcatatcagcatcaagtaccactg

SEQ ID NO: 190300 - DNA, 39 bp, Artificial Sequence
  Description of Artificial Sequence: Synthetic oligonucleotide
tgtcagaaattgtgagcatatcagcatcaagtaccactg

SEQ ID NO: 190301 - DNA, 38 bp, Artificial Sequence
  Description of Artificial Sequence: Synthetic oligonucleotide
gtcagaaattgtgagcatatcagcatcaagtaccactg

SEQ ID NO: 190302 - DNA, 38 bp, Artificial Sequence
  Description of Artificial Sequence: Synthetic oligonucleotide
tcagaaattgtgagcatatcagcatcaagtaccactgg

SEQ ID NO: 190303 - DNA, 37 bp, Artificial Sequence
  Description of Artificial Sequence: Synthetic oligonucleotide
cagaaattgtgagcatatcagcatcaagtaccactgg

SEQ ID NO: 190304 - DNA, 38 bp, Artificial Sequence
  Description of Artificial Sequence: Synthetic oligonucleotide
agaaattgtgagcatatcagcatcaagtaccactggtg

SEQ ID NO: 190305 - DNA, 37 bp, Artificial Sequence
  Description of Artificial Sequence: Synthetic oligonucleotide
gaaattgtgagcatatcagcatcaagtaccactggtg

SEQ ID NO: 190306 - DNA, 38 bp, Artificial Sequence
  Description of Artificial Sequence: Synthetic oligonucleotide
aaattgtgagcatatcagcatcaagtaccactggtgtg

SEQ ID NO: 190307 - DNA, 39 bp, Artificial Sequence
  Description of Artificial Sequence: Synthetic oligonucleotide
agacaaatgataagcacaaacgggacacatatccagttc

SEQ ID NO: 190308 - DNA, 38 bp, Artificial Sequence
  Description of Artificial Sequence: Synthetic oligonucleotide
gacaaatgataagcacaaacgggacacatatccagttc

SEQ ID NO: 190309 - DNA, 41 bp, Artificial Sequence
  Description of Artificial Sequence: Synthetic oligonucleotide
acaaatgataagcacaaacgggacacatatccagttcatag

SEQ ID NO: 190310 - DNA, 40 bp, Artificial Sequence
  Description of Artificial Sequence: Synthetic oligonucleotide
caaatgataagcacaaacgggacacatatccagttcatag

SEQ ID NO: 190311 - DNA, 41 bp, Artificial Sequence
  Description of Artificial Sequence: Synthetic oligonucleotide
aaatgataagcacaaacgggacacatatccagttcatagtg

SEQ ID NO: 190312 - DNA, 40 bp, Artificial Sequence
  Description of Artificial Sequence: Synthetic oligonucleotide
aatgataagcacaaacgggacacatatccagttcatagtg

SEQ ID NO: 190313 - DNA, 39 bp, Artificial Sequence
  Description of Artificial Sequence: Synthetic oligonucleotide
atgataagcacaaacgggacacatatccagttcatagtg

SEQ ID NO: 190314 - DNA, 38 bp, Artificial Sequence
  Description of Artificial Sequence: Synthetic oligonucleotide
tgataagcacaaacgggacacatatccagttcatagtg

SEQ ID NO: 190315 - DNA, 37 bp, Artificial Sequence
  Description of Artificial Sequence: Synthetic oligonucleotide
gataagcacaaacgggacacatatccagttcatagtg

SEQ ID NO: 190316 - DNA, 42 bp, Artificial Sequence
  Description of Artificial Sequence: Synthetic oligonucleotide
ataagcacaaacgggacacatatccagttcatagtgttaatg

SEQ ID NO: 190317 - DNA, 41 bp, Artificial Sequence
  Description of Artificial Sequence: Synthetic oligonucleotide
taagcacaaacgggacacatatccagttcatagtgttaatg

SEQ ID NO: 190318 - DNA, 40 bp, Artificial Sequence
  Description of Artificial Sequence: Synthetic oligonucleotide
aagcacaaacgggacacatatccagttcatagtgttaatg

SEQ ID NO: 190319 - DNA, 39 bp, Artificial Sequence
  Description of Artificial Sequence: Synthetic oligonucleotide
agcacaaacgggacacatatccagttcatagtgttaatg

SEQ ID NO: 190320 - DNA, 38 bp, Artificial Sequence
  Description of Artificial Sequence: Synthetic oligonucleotide
gcacaaacgggacacatatccagttcatagtgttaatg

SEQ ID NO: 190321 - DNA, 40 bp, Artificial Sequence
  Description of Artificial Sequence: Synthetic oligonucleotide
cacaaacgggacacatatccagttcatagtgttaatgaag

SEQ ID NO: 190322 - DNA, 43 bp, Artificial Sequence
  Description of Artificial Sequence: Synthetic oligonucleotide
acaaacgggacacatatccagttcatagtgttaatgaagtttc

SEQ ID NO: 190323 - DNA, 42 bp, Artificial Sequence
  Description of Artificial Sequence: Synthetic oligonucleotide
caaacgggacacatatccagttcatagtgttaatgaagtttc

SEQ ID NO: 190324 - DNA, 43 bp, Artificial Sequence
  Description of Artificial Sequence: Synthetic oligonucleotide
aaacgggacacatatccagttcatagtgttaatgaagtttcag

SEQ ID NO: 190325 - DNA, 42 bp, Artificial Sequence
  Description of Artificial Sequence: Synthetic oligonucleotide
aacgggacacatatccagttcatagtgttaatgaagtttcag

SEQ ID NO: 190326 - DNA, 41 bp, Artificial Sequence
  Description of Artificial Sequence: Synthetic oligonucleotide
acgggacacatatccagttcatagtgttaatgaagtttcag

SEQ ID NO: 190327 - DNA, 40 bp, Artificial Sequence
  Description of Artificial Sequence: Synthetic oligonucleotide
cgggacacatatccagttcatagtgttaatgaagtttcag

SEQ ID NO: 190328 - DNA, 46 bp, Artificial Sequence
  Description of Artificial Sequence: Synthetic oligonucleotide
gggacacatatccagttcatagtgttaatgaagtttcagaaaattc

SEQ ID NO: 190329 - DNA, 47 bp, Artificial Sequence
  Description of Artificial Sequence: Synthetic oligonucleotide
ggacacatatccagttcatagtgttaatgaagtttcagaaaattctg

SEQ ID NO: 190330 - DNA, 50 bp, Artificial Sequence
  Description of Artificial Sequence: Synthetic oligonucleotide
gacacatatccagttcatagtgttaatgaagtttcagaaaattctgttac

SEQ ID NO: 190331 - DNA, 52 bp, Artificial Sequence
  Description of Artificial Sequence: Synthetic oligonucleotide
acacatatccagttcatagtgttaatgaagtttcagaaaattctgttacaac

SEQ ID NO: 190332 - DNA, 51 bp, Artificial Sequence
  Description of Artificial Sequence: Synthetic oligonucleotide
cacatatccagttcatagtgttaatgaagtttcagaaaattctgttacaac

SEQ ID NO: 190333 - DNA, 52 bp, Artificial Sequence
  Description of Artificial Sequence: Synthetic oligonucleotide
acatatccagttcatagtgttaatgaagtttcagaaaattctgttacaactg

SEQ ID NO: 190334 - DNA, 51 bp, Artificial Sequence
  Description of Artificial Sequence: Synthetic oligonucleotide
catatccagttcatagtgttaatgaagtttcagaaaattctgttacaactg

SEQ ID NO: 190335 - DNA, 55 bp, Artificial Sequence
  Description of Artificial Sequence: Synthetic oligonucleotide
atatccagttcatagtgttaatgaagtttcagaaaattctgttacaactgtttac

SEQ ID NO: 190336 - DNA, 54 bp, Artificial Sequence
  Description of Artificial Sequence: Synthetic oligonucleotide
tatccagttcatagtgttaatgaagtttcagaaaattctgttacaactgtttac

SEQ ID NO: 190337 - DNA, 53 bp, Artificial Sequence
  Description of Artificial Sequence: Synthetic oligonucleotide
atccagttcatagtgttaatgaagtttcagaaaattctgttacaactgtttac

SEQ ID NO: 190338 - DNA, 52 bp, Artificial Sequence
  Description of Artificial Sequence: Synthetic oligonucleotide
tccagttcatagtgttaatgaagtttcagaaaattctgttacaactgtttac

SEQ ID NO: 190339 - DNA, 51 bp, Artificial Sequence
  Description of Artificial Sequence: Synthetic oligonucleotide
ccagttcatagtgttaatgaagtttcagaaaattctgttacaactgtttac

SEQ ID NO: 190340 - DNA, 51 bp, Artificial Sequence
  Description of Artificial Sequence: Synthetic oligonucleotide
cagttcatagtgttaatgaagtttcagaaaattctgttacaactgtttacc

SEQ ID NO: 190341 - DNA, 51 bp, Artificial Sequence
  Description of Artificial Sequence: Synthetic oligonucleotide
agttcatagtgttaatgaagtttcagaaaattctgttacaactgtttaccc

SEQ ID NO: 190342 - DNA, 50 bp, Artificial Sequence
  Description of Artificial Sequence: Synthetic oligonucleotide
gttcatagtgttaatgaagtttcagaaaattctgttacaactgtttaccc

SEQ ID NO: 190343 - DNA, 51 bp, Artificial Sequence
  Description of Artificial Sequence: Synthetic oligonucleotide
ttcatagtgttaatgaagtttcagaaaattctgttacaactgtttaccctc

SEQ ID NO: 190344 - DNA, 49 bp, Artificial Sequence
  Description of Artificial Sequence: Synthetic oligonucleotide
cttgttgttgttggaatgatcatcttaatttcttactgtattcgatgac

SEQ ID NO: 190345 - DNA, 50 bp, Artificial Sequence
  Description of Artificial Sequence: Synthetic oligonucleotide
ttgttgttgttggaatgatcatcttaatttcttactgtattcgatgactg

SEQ ID NO: 190346 - DNA, 49 bp, Artificial Sequence
  Description of Artificial Sequence: Synthetic oligonucleotide
tgttgttgttggaatgatcatcttaatttcttactgtattcgatgactg

SEQ ID NO: 190347 - DNA, 48 bp, Artificial Sequence
  Description of Artificial Sequence: Synthetic oligonucleotide
gttgttgttggaatgatcatcttaatttcttactgtattcgatgactg

SEQ ID NO: 190348 - DNA, 53 bp, Artificial Sequence
  Description of Artificial Sequence: Synthetic oligonucleotide
ttgttgttggaatgatcatcttaatttcttactgtattcgatgactgataaag

SEQ ID NO: 190349 - DNA, 40 bp, Artificial Sequence
  Description of Artificial Sequence: Synthetic oligonucleotide
ttcagtcacaaagagttacatctcatcacagacaaatggg

SEQ ID NO: 190350 - DNA, 39 bp, Artificial Sequence
  Description of Artificial Sequence: Synthetic oligonucleotide
tcagtcacaaagagttacatctcatcacagacaaatggg

SEQ ID NO: 190351 - DNA, 38 bp, Artificial Sequence
  Description of Artificial Sequence: Synthetic oligonucleotide
cagtcacaaagagttacatctcatcacagacaaatggg

SEQ ID NO: 190352 - DNA, 42 bp, Artificial Sequence
  Description of Artificial Sequence: Synthetic oligonucleotide
agtcacaaagagttacatctcatcacagacaaatgggataac

SEQ ID NO: 190353 - DNA, 41 bp, Artificial Sequence
  Description of Artificial Sequence: Synthetic oligonucleotide
gtcacaaagagttacatctcatcacagacaaatgggataac

SEQ ID NO: 190354 - DNA, 42 bp, Artificial Sequence
  Description of Artificial Sequence: Synthetic oligonucleotide
tcacaaagagttacatctcatcacagacaaatgggataacac

SEQ ID NO: 190355 - DNA, 41 bp, Artificial Sequence
  Description of Artificial Sequence: Synthetic oligonucleotide
cacaaagagttacatctcatcacagacaaatgggataacac

SEQ ID NO: 190356 - DNA, 42 bp, Artificial Sequence
  Description of Artificial Sequence: Synthetic oligonucleotide
acaaagagttacatctcatcacagacaaatgggataacactc

SEQ ID NO: 190357 - DNA, 41 bp, Artificial Sequence
  Description of Artificial Sequence: Synthetic oligonucleotide
caaagagttacatctcatcacagacaaatgggataacactc

SEQ ID NO: 190358 - DNA, 48 bp, Artificial Sequence
  Description of Artificial Sequence: Synthetic oligonucleotide
aaagagttacatctcatcacagacaaatgggataacactcattaattg

SEQ ID NO: 190359 - DNA, 47 bp, Artificial Sequence
  Description of Artificial Sequence: Synthetic oligonucleotide
aagagttacatctcatcacagacaaatgggataacactcattaattg

SEQ ID NO: 190360 - DNA, 46 bp, Artificial Sequence
  Description of Artificial Sequence: Synthetic oligonucleotide
agagttacatctcatcacagacaaatgggataacactcattaattg

SEQ ID NO: 190361 - DNA, 45 bp, Artificial Sequence
  Description of Artificial Sequence: Synthetic oligonucleotide
gagttacatctcatcacagacaaatgggataacactcattaattg

SEQ ID NO: 190362 - DNA, 45 bp, Artificial Sequence
  Description of Artificial Sequence: Synthetic oligonucleotide
agttacatctcatcacagacaaatgggataacactcattaattgg

SEQ ID NO: 190363 - DNA, 44 bp, Artificial Sequence
  Description of Artificial Sequence: Synthetic oligonucleotide
gttacatctcatcacagacaaatgggataacactcattaattgg

SEQ ID NO: 190364 - DNA, 45 bp, Artificial Sequence
  Description of Artificial Sequence: Synthetic oligonucleotide
ttacatctcatcacagacaaatgggataacactcattaattggtg

SEQ ID NO: 190365 - DNA, 44 bp, Artificial Sequence
  Description of Artificial Sequence: Synthetic oligonucleotide
tacatctcatcacagacaaatgggataacactcattaattggtg

SEQ ID NO: 190366 - DNA, 43 bp, Artificial Sequence
  Description of Artificial Sequence: Synthetic oligonucleotide
acatctcatcacagacaaatgggataacactcattaattggtg

SEQ ID NO: 190367 - DNA, 42 bp, Artificial Sequence
  Description of Artificial Sequence: Synthetic oligonucleotide
catctcatcacagacaaatgggataacactcattaattggtg

SEQ ID NO: 190368 - DNA, 42 bp, Artificial Sequence
  Description of Artificial Sequence: Synthetic oligonucleotide
atctcatcacagacaaatgggataacactcattaattggtgg

SEQ ID NO: 190369 - DNA, 41 bp, Artificial Sequence
  Description of Artificial Sequence: Synthetic oligonucleotide
tctcatcacagacaaatgggataacactcattaattggtgg

SEQ ID NO: 190370 - DNA, 40 bp, Artificial Sequence
  Description of Artificial Sequence: Synthetic oligonucleotide
ctcatcacagacaaatgggataacactcattaattggtgg

SEQ ID NO: 190371 - DNA, 40 bp, Artificial Sequence
  Description of Artificial Sequence: Synthetic oligonucleotide
tcatcacagacaaatgggataacactcattaattggtggg

SEQ ID NO: 190372 - DNA, 39 bp, Artificial Sequence
  Description of Artificial Sequence: Synthetic oligonucleotide
catcacagacaaatgggataacactcattaattggtggg

SEQ ID NO: 190373 - DNA, 39 bp, Artificial Sequence
  Description of Artificial Sequence: Synthetic oligonucleotide
atcacagacaaatgggataacactcattaattggtgggc

SEQ ID NO: 190374 - DNA, 38 bp, Artificial Sequence
  Description of Artificial Sequence: Synthetic oligonucleotide
tcacagacaaatgggataacactcattaattggtgggc

SEQ ID NO: 190375 - DNA, 37 bp, Artificial Sequence
  Description of Artificial Sequence: Synthetic oligonucleotide
cacagacaaatgggataacactcattaattggtgggc

SEQ ID NO: 190376 - DNA, 37 bp, Artificial Sequence
  Description of Artificial Sequence: Synthetic oligonucleotide
acagacaaatgggataacactcattaattggtgggcg

SEQ ID NO: 190377 - DNA, 36 bp, Artificial Sequence
  Description of Artificial Sequence: Synthetic oligonucleotide
cagacaaatgggataacactcattaattggtgggcg

SEQ ID NO: 190378 - DNA, 38 bp, Artificial Sequence
  Description of Artificial Sequence: Synthetic oligonucleotide
agacaaatgggataacactcattaattggtgggcgatg

SEQ ID NO: 190379 - DNA, 37 bp, Artificial Sequence
  Description of Artificial Sequence: Synthetic oligonucleotide
gacaaatgggataacactcattaattggtgggcgatg

SEQ ID NO: 190380 - DNA, 37 bp, Artificial Sequence
  Description of Artificial Sequence: Synthetic oligonucleotide
acaaatgggataacactcattaattggtgggcgatgg

SEQ ID NO: 190381 - DNA, 36 bp, Artificial Sequence
  Description of Artificial Sequence: Synthetic oligonucleotide
caaatgggataacactcattaattggtgggcgatgg

SEQ ID NO: 190382 - DNA, 36 bp, Artificial Sequence
  Description of Artificial Sequence: Synthetic oligonucleotide
aaatgggataacactcattaattggtgggcgatggc

SEQ ID NO: 190383 - DNA, 35 bp, Artificial Sequence
  Description of Artificial Sequence: Synthetic oligonucleotide
aatgggataacactcattaattggtgggcgatggc

SEQ ID NO: 190384 - DNA, 34 bp, Artificial Sequence
  Description of Artificial Sequence: Synthetic oligonucleotide
atgggataacactcattaattggtgggcgatggc

SEQ ID NO: 190385 - DNA, 33 bp, Artificial Sequence
  Description of Artificial Sequence: Synthetic oligonucleotide
tgggataacactcattaattggtgggcgatggc

SEQ ID NO: 190386 - DNA, 52 bp, Artificial Sequence
  Description of Artificial Sequence: Synthetic oligonucleotide
tgttgttggaatgatcatcttaatttcttactgtattcgatgactgataaag

SEQ ID NO: 190387 - DNA, 51 bp, Artificial Sequence
  Description of Artificial Sequence: Synthetic oligonucleotide
gttgttggaatgatcatcttaatttcttactgtattcgatgactgataaag

SEQ ID NO: 190388 - DNA, 51 bp, Artificial Sequence
  Description of Artificial Sequence: Synthetic oligonucleotide
ttgttggaatgatcatcttaatttcttactgtattcgatgactgataaagg

SEQ ID NO: 190389 - DNA, 50 bp, Artificial Sequence
  Description of Artificial Sequence: Synthetic oligonucleotide
tgttggaatgatcatcttaatttcttactgtattcgatgactgataaagg

SEQ ID NO: 190390 - DNA, 49 bp, Artificial Sequence
  Description of Artificial Sequence: Synthetic oligonucleotide
gttggaatgatcatcttaatttcttactgtattcgatgactgataaagg

SEQ ID NO: 190391 - DNA, 49 bp, Artificial Sequence
  Description of Artificial Sequence: Synthetic oligonucleotide
ttggaatgatcatcttaatttcttactgtattcgatgactgataaaggc

SEQ ID NO: 190392 - DNA, 48 bp, Artificial Sequence
  Description of Artificial Sequence: Synthetic oligonucleotide
tggaatgatcatcttaatttcttactgtattcgatgactgataaaggc

SEQ ID NO: 190393 - DNA, 47 bp, Artificial Sequence
  Description of Artificial Sequence: Synthetic oligonucleotide
ggaatgatcatcttaatttcttactgtattcgatgactgataaaggc

SEQ ID NO: 190394 - DNA, 49 bp, Artificial Sequence
  Description of Artificial Sequence: Synthetic oligonucleotide
gaatgatcatcttaatttcttactgtattcgatgactgataaaggcatg

SEQ ID NO: 190395 - DNA, 33 bp, Artificial Sequence
  Description of Artificial Sequence: Synthetic oligonucleotide
ggtacaacttgcccatcatttctctgaaccagc

SEQ ID NO: 190396 - DNA, 34 bp, Artificial Sequence
  Description of Artificial Sequence: Synthetic oligonucleotide
gtacaacttgcccatcatttctctgaaccagctc

SEQ ID NO: 190397 - DNA, 34 bp, Artificial Sequence
  Description of Artificial Sequence: Synthetic oligonucleotide
tacaacttgcccatcatttctctgaaccagctcc

SEQ ID NO: 190398 - DNA, 33 bp, Artificial Sequence
  Description of Artificial Sequence: Synthetic oligonucleotide
acaacttgcccatcatttctctgaaccagctcc

SEQ ID NO: 190399 - DNA, 32 bp, Artificial Sequence
  Description of Artificial Sequence: Synthetic oligonucleotide
caacttgcccatcatttctctgaaccagctcc

SEQ ID NO: 190400 - DNA, 33 bp, Artificial Sequence
  Description of Artificial Sequence: Synthetic oligonucleotide
aacttgcccatcatttctctgaaccagctcctg

SEQ ID NO: 190401 - DNA, 32 bp, Artificial Sequence
  Description of Artificial Sequence: Synthetic oligonucleotide
acttgcccatcatttctctgaaccagctcctg

SEQ ID NO: 190402 - DNA, 31 bp, Artificial Sequence
  Description of Artificial Sequence: Synthetic oligonucleotide
cttgcccatcatttctctgaaccagctcctg

SEQ ID NO: 190403 - DNA, 33 bp, Artificial Sequence
  Description of Artificial Sequence: Synthetic oligonucleotide
ttgcccatcatttctctgaaccagctcctgtag

SEQ ID NO: 190404 - DNA, 32 bp, Artificial Sequence
  Description of Artificial Sequence: Synthetic oligonucleotide
tgcccatcatttctctgaaccagctcctgtag

SEQ ID NO: 190405 - DNA, 31 bp, Artificial Sequence
  Description of Artificial Sequence: Synthetic oligonucleotide
gcccatcatttctctgaaccagctcctgtag

SEQ ID NO: 190406 - DNA, 32 bp, Artificial Sequence
  Description of Artificial Sequence: Synthetic oligonucleotide
cccatcatttctctgaaccagctcctgtagtg

SEQ ID NO: 190407 - DNA, 38 bp, Artificial Sequence
  Description of Artificial Sequence: Synthetic oligonucleotide
ccatcatttctctgaaccagctcctgtagtgataatac

SEQ ID NO: 190408 - DNA, 39 bp, Artificial Sequence
  Description of Artificial Sequence: Synthetic oligonucleotide
catcatttctctgaaccagctcctgtagtgataatactc

SEQ ID NO: 190409 - DNA, 47 bp, Artificial Sequence
  Description of Artificial Sequence: Synthetic oligonucleotide
atcatttctctgaaccagctcctgtagtgataatactcattattttg

SEQ ID NO: 190410 - DNA, 46 bp, Artificial Sequence
  Description of Artificial Sequence: Synthetic oligonucleotide
tcatttctctgaaccagctcctgtagtgataatactcattattttg

SEQ ID NO: 190411 - DNA, 45 bp, Artificial Sequence
  Description of Artificial Sequence: Synthetic oligonucleotide
catttctctgaaccagctcctgtagtgataatactcattattttg

SEQ ID NO: 190412 - DNA, 46 bp, Artificial Sequence
  Description of Artificial Sequence: Synthetic oligonucleotide
atttctctgaaccagctcctgtagtgataatactcattattttgtg

SEQ ID NO: 190413 - DNA, 45 bp, Artificial Sequence
  Description of Artificial Sequence: Synthetic oligonucleotide
tttctctgaaccagctcctgtagtgataatactcattattttgtg

SEQ ID NO: 190414 - DNA, 44 bp, Artificial Sequence
  Description of Artificial Sequence: Synthetic oligonucleotide
ttctctgaaccagctcctgtagtgataatactcattattttgtg

SEQ ID NO: 190415 - DNA, 43 bp, Artificial Sequence
  Description of Artificial Sequence: Synthetic oligonucleotide
tctctgaaccagctcctgtagtgataatactcattattttgtg

SEQ ID NO: 190416 - DNA, 42 bp, Artificial Sequence
  Description of Artificial Sequence: Synthetic oligonucleotide
ctctgaaccagctcctgtagtgataatactcattattttgtg

SEQ ID NO: 190417 - DNA, 43 bp, Artificial Sequence
  Description of Artificial Sequence: Synthetic oligonucleotide
tctgaaccagctcctgtagtgataatactcattattttgtgtg

SEQ ID NO: 190418 - DNA, 42 bp, Artificial Sequence
  Description of Artificial Sequence: Synthetic oligonucleotide
ctgaaccagctcctgtagtgataatactcattattttgtgtg

SEQ ID NO: 190419 - DNA, 43 bp, Artificial Sequence
  Description of Artificial Sequence: Synthetic oligonucleotide
tgaaccagctcctgtagtgataatactcattattttgtgtgtg

SEQ ID NO: 190420 - DNA, 42 bp, Artificial Sequence
  Description of Artificial Sequence: Synthetic oligonucleotide
gaaccagctcctgtagtgataatactcattattttgtgtgtg

SEQ ID NO: 190421 - DNA, 44 bp, Artificial Sequence
  Description of Artificial Sequence: Synthetic oligonucleotide
aaccagctcctgtagtgataatactcattattttgtgtgtgatg

SEQ ID NO: 190422 - DNA, 31 bp, Artificial Sequence
  Description of Artificial Sequence: Synthetic oligonucleotide
atggtgcatctgactcctgaggagaagtctg

SEQ ID NO: 190423 - DNA, 30 bp, Artificial Sequence
  Description of Artificial Sequence: Synthetic oligonucleotide
tggtgcatctgactcctgaggagaagtctg

SEQ ID NO: 190424 - DNA, 29 bp, Artificial Sequence
  Description of Artificial Sequence: Synthetic oligonucleotide
ggtgcatctgactcctgaggagaagtctg

SEQ ID NO: 190425 - DNA, 29 bp, Artificial Sequence
  Description of Artificial Sequence: Synthetic oligonucleotide
gtgcatctgactcctgaggagaagtctgc

SEQ ID NO: 190426 - DNA, 29 bp, Artificial Sequence
  Description of Artificial Sequence: Synthetic oligonucleotide
tgcatctgactcctgaggagaagtctgcc

SEQ ID NO: 190427 - DNA, 28 bp, Artificial Sequence
  Description of Artificial Sequence: Synthetic oligonucleotide
gcatctgactcctgaggagaagtctgcc

SEQ ID NO: 190428 - DNA, 28 bp, Artificial Sequence
  Description of Artificial Sequence: Synthetic oligonucleotide
catctgactcctgaggagaagtctgccg

SEQ ID NO: 190429 - DNA, 31 bp, Artificial Sequence
  Description of Artificial Sequence: Synthetic oligonucleotide
atctgactcctgaggagaagtctgccgttac

SEQ ID NO: 190430 - DNA, 30 bp, Artificial Sequence
  Description of Artificial Sequence: Synthetic oligonucleotide
tctgactcctgaggagaagtctgccgttac

SEQ ID NO: 190431 - DNA, 29 bp, Artificial Sequence
  Description of Artificial Sequence: Synthetic oligonucleotide
ctgactcctgaggagaagtctgccgttac

SEQ ID NO: 190432 - DNA, 30 bp, Artificial Sequence
  Description of Artificial Sequence: Synthetic oligonucleotide
tgactcctgaggagaagtctgccgttactg

SEQ ID NO: 190433 - DNA, 29 bp, Artificial Sequence
  Description of Artificial Sequence: Synthetic oligonucleotide
gactcctgaggagaagtctgccgttactg

SEQ ID NO: 190434 - DNA, 29 bp, Artificial Sequence
  Description of Artificial Sequence: Synthetic oligonucleotide
actcctgaggagaagtctgccgttactgc

SEQ ID NO: 190435 - DNA, 28 bp, Artificial Sequence
  Description of Artificial Sequence: Synthetic oligonucleotide
ctcctgaggagaagtctgccgttactgc

SEQ ID NO: 190436 - DNA, 28 bp, Artificial Sequence
  Description of Artificial Sequence: Synthetic oligonucleotide
tcctgaggagaagtctgccgttactgcc

SEQ ID NO: 190437 - DNA, 27 bp, Artificial Sequence
  Description of Artificial Sequence: Synthetic oligonucleotide
cctgaggagaagtctgccgttactgcc

SEQ ID NO: 190438 - DNA, 27 bp, Artificial Sequence
  Description of Artificial Sequence: Synthetic oligonucleotide
ctgaggagaagtctgccgttactgccc

SEQ ID NO: 190439 - DNA, 28 bp, Artificial Sequence
  Description of Artificial Sequence: Synthetic oligonucleotide
tgaggagaagtctgccgttactgccctg

SEQ ID NO: 190440 - DNA, 27 bp, Artificial Sequence
  Description of Artificial Sequence: Synthetic oligonucleotide
gaggagaagtctgccgttactgccctg

SEQ ID NO: 190441 - DNA, 28 bp, Artificial Sequence
  Description of Artificial Sequence: Synthetic oligonucleotide
aggagaagtctgccgttactgccctgtg

SEQ ID NO: 190442 - DNA, 27 bp, Artificial Sequence
  Description of Artificial Sequence: Synthetic oligonucleotide
ggagaagtctgccgttactgccctgtg

SEQ ID NO: 190443 - DNA, 27 bp, Artificial Sequence
  Description of Artificial Sequence: Synthetic oligonucleotide
gagaagtctgccgttactgccctgtgg

SEQ ID NO: 190444 - DNA, 27 bp, Artificial Sequence
  Description of Artificial Sequence: Synthetic oligonucleotide
agaagtctgccgttactgccctgtggg

SEQ ID NO: 190445 - DNA, 26 bp, Artificial Sequence
  Description of Artificial Sequence: Synthetic oligonucleotide
gaagtctgccgttactgccctgtggg

SEQ ID NO: 190446 - DNA, 26 bp, Artificial Sequence
  Description of Artificial Sequence: Synthetic oligonucleotide
aagtctgccgttactgccctgtgggg

SEQ ID NO: 190447 - DNA, 25 bp, Artificial Sequence
  Description of Artificial Sequence: Synthetic oligonucleotide
agtctgccgttactgccctgtgggg

SEQ ID NO: 190448 - DNA, 24 bp, Artificial Sequence
  Description of Artificial Sequence: Synthetic oligonucleotide
gtctgccgttactgccctgtgggg

SEQ ID NO: 190449 - DNA, 26 bp, Artificial Sequence
  Description of Artificial Sequence: Synthetic oligonucleotide
tctgccgttactgccctgtggggcaa

SEQ ID NO: 190450 - DNA, 25 bp, Artificial Sequence
  Description of Artificial Sequence: Synthetic oligonucleotide
ctgccgttactgccctgtggggcaa

SEQ ID NO: 190451 - DNA, 25 bp, Artificial Sequence
  Description of Artificial Sequence: Synthetic oligonucleotide
tgccgttactgccctgtggggcaag

SEQ ID NO: 190452 - DNA, 24 bp, Artificial Sequence
  Description of Artificial Sequence: Synthetic oligonucleotide
gccgttactgccctgtggggcaag

SEQ ID NO: 190453 - DNA, 25 bp, Artificial Sequence
  Description of Artificial Sequence: Synthetic oligonucleotide
ccgttactgccctgtggggcaaggt

SEQ ID NO: 190454 - DNA, 27 bp, Artificial Sequence
  Description of Artificial Sequence: Synthetic oligonucleotide
cgttactgccctgtggggcaaggtgaa

SEQ ID NO: 190455 - DNA, 27 bp, Artificial Sequence
  Description of Artificial Sequence: Synthetic oligonucleotide
gttactgccctgtggggcaaggtgaac

SEQ ID NO: 190456 - DNA, 27 bp, Artificial Sequence
  Description of Artificial Sequence: Synthetic oligonucleotide
ttactgccctgtggggcaaggtgaacg

SEQ ID NO: 190457 - DNA, 27 bp, Artificial Sequence
  Description of Artificial Sequence: Synthetic oligonucleotide
tactgccctgtggggcaaggtgaacgt

SEQ ID NO: 190458 - DNA, 26 bp, Artificial Sequence
  Description of Artificial Sequence: Synthetic oligonucleotide
actgccctgtggggcaaggtgaacgt

SEQ ID NO: 190459 - DNA, 25 bp, Artificial Sequence
  Description of Artificial Sequence: Synthetic oligonucleotide
ctgccctgtggggcaaggtgaacgt

SEQ ID NO: 190460 - DNA, 25 bp, Artificial Sequence
  Description of Artificial Sequence: Synthetic oligonucleotide
tgccctgtggggcaaggtgaacgtg

SEQ ID NO: 190461 - DNA, 24 bp, Artificial Sequence
  Description of Artificial Sequence: Synthetic oligonucleotide
gccctgtggggcaaggtgaacgtg

SEQ ID NO: 190462 - DNA, 26 bp, Artificial Sequence
  Description of Artificial Sequence: Synthetic oligonucleotide
ccctgtggggcaaggtgaacgtggat

SEQ ID NO: 190463 - DNA, 27 bp, Artificial Sequence
  Description of Artificial Sequence: Synthetic oligonucleotide
cctgtggggcaaggtgaacgtggatga

SEQ ID NO: 190464 - DNA, 28 bp, Artificial Sequence
  Description of Artificial Sequence: Synthetic oligonucleotide
ctgtggggcaaggtgaacgtggatgaag

SEQ ID NO: 190465 - DNA, 30 bp, Artificial Sequence
  Description of Artificial Sequence: Synthetic oligonucleotide
tgtggggcaaggtgaacgtggatgaagttg

SEQ ID NO: 190466 - DNA, 29 bp, Artificial Sequence
  Description of Artificial Sequence: Synthetic oligonucleotide
gtggggcaaggtgaacgtggatgaagttg

SEQ ID NO: 190467 - DNA, 29 bp, Artificial Sequence
  Description of Artificial Sequence: Synthetic oligonucleotide
tggggcaaggtgaacgtggatgaagttgg

SEQ ID NO: 190468 - DNA, 28 bp, Artificial Sequence
  Description of Artificial Sequence: Synthetic oligonucleotide
ggggcaaggtgaacgtggatgaagttgg

SEQ ID NO: 190469 - DNA, 29 bp, Artificial Sequence
  Description of Artificial Sequence: Synthetic oligonucleotide
gggcaaggtgaacgtggatgaagttggtg

SEQ ID NO: 190470 - DNA, 29 bp, Artificial Sequence
  Description of Artificial Sequence: Synthetic oligonucleotide
ggcaaggtgaacgtggatgaagttggtgg

SEQ ID NO: 190471 - DNA, 30 bp, Artificial Sequence
  Description of Artificial Sequence: Synthetic oligonucleotide
gcaaggtgaacgtggatgaagttggtggtg

SEQ ID NO: 190472 - DNA, 31 bp, Artificial Sequence
  Description of Artificial Sequence: Synthetic oligonucleotide
caaggtgaacgtggatgaagttggtggtgag

SEQ ID NO: 190473 - DNA, 31 bp, Artificial Sequence
  Description of Artificial Sequence: Synthetic oligonucleotide
aaggtgaacgtggatgaagttggtggtgagg

SEQ ID NO: 190474 - DNA, 30 bp, Artificial Sequence
  Description of Artificial Sequence: Synthetic oligonucleotide
aggtgaacgtggatgaagttggtggtgagg

SEQ ID NO: 190475 - DNA, 29 bp, Artificial Sequence
  Description of Artificial Sequence: Synthetic oligonucleotide
ggtgaacgtggatgaagttggtggtgagg

SEQ ID NO: 190476 - DNA, 29 bp, Artificial Sequence
  Description of Artificial Sequence: Synthetic oligonucleotide
gtgaacgtggatgaagttggtggtgaggc

SEQ ID NO: 190477 - DNA, 29 bp, Artificial Sequence
  Description of Artificial Sequence: Synthetic oligonucleotide
tgaacgtggatgaagttggtggtgaggcc

SEQ ID NO: 190478 - DNA, 28 bp, Artificial Sequence
  Description of Artificial Sequence: Synthetic oligonucleotide
gaacgtggatgaagttggtggtgaggcc

SEQ ID NO: 190479 - DNA, 28 bp, Artificial Sequence
  Description of Artificial Sequence: Synthetic oligonucleotide
aacgtggatgaagttggtggtgaggccc

SEQ ID NO: 190480 - DNA, 27 bp, Artificial Sequence
  Description of Artificial Sequence: Synthetic oligonucleotide
acgtggatgaagttggtggtgaggccc

SEQ ID NO: 190481 - DNA, 27 bp, Artificial Sequence
  Description of Artificial Sequence: Synthetic oligonucleotide
cgtggatgaagttggtggtgaggccct

SEQ ID NO: 190482 - DNA, 27 bp, Artificial Sequence
  Description of Artificial Sequence: Synthetic oligonucleotide
gtggatgaagttggtggtgaggccctg

SEQ ID NO: 190483 - DNA, 27 bp, Artificial Sequence
  Description of Artificial Sequence: Synthetic oligonucleotide
tggatgaagttggtggtgaggccctgg

SEQ ID NO: 190484 - DNA, 26 bp, Artificial Sequence
  Description of Artificial Sequence: Synthetic oligonucleotide
ggatgaagttggtggtgaggccctgg

SEQ ID NO: 190485 - DNA, 26 bp, Artificial Sequence
  Description of Artificial Sequence: Synthetic oligonucleotide
gatgaagttggtggtgaggccctggg

SEQ ID NO: 190486 - DNA, 27 bp, Artificial Sequence
  Description of Artificial Sequence: Synthetic oligonucleotide
atgaagttggtggtgaggccctgggca

SEQ ID NO: 190487 - DNA, 26 bp, Artificial Sequence
  Description of Artificial Sequence: Synthetic oligonucleotide
tgaagttggtggtgaggccctgggca

SEQ ID NO: 190488 - DNA, 25 bp, Artificial Sequence
  Description of Artificial Sequence: Synthetic oligonucleotide
gaagttggtggtgaggccctgggca

SEQ ID NO: 190489 - DNA, 25 bp, Artificial Sequence
  Description of Artificial Sequence: Synthetic oligonucleotide
aagttggtggtgaggccctgggcag

SEQ ID NO: 190490 - DNA, 24 bp, Artificial Sequence
  Description of Artificial Sequence: Synthetic oligonucleotide
agttggtggtgaggccctgggcag

SEQ ID NO: 190491 - DNA, 23 bp, Artificial Sequence
  Description of Artificial Sequence: Synthetic oligonucleotide
gttggtggtgaggccctgggcag

SEQ ID NO: 190492 - DNA, 23 bp, Artificial Sequence
  Description of Artificial Sequence: Synthetic oligonucleotide
ttggtggtgaggccctgggcagg

SEQ ID NO: 190493 - DNA, 22 bp, Artificial Sequence
  Description of Artificial Sequence: Synthetic oligonucleotide
tggtggtgaggccctgggcagg

SEQ ID NO: 190494 - DNA, 21 bp, Artificial Sequence
  Description of Artificial Sequence: Synthetic oligonucleotide
ggtggtgaggccctgggcagg

SEQ ID NO: 190495 - DNA, 22 bp, Artificial Sequence
  Description of Artificial Sequence: Synthetic oligonucleotide
gtggtgaggccctgggcaggct

SEQ ID NO: 190496 - DNA, 22 bp, Artificial Sequence
  Description of Artificial Sequence: Synthetic oligonucleotide
tggtgaggccctgggcaggctg

SEQ ID NO: 190497 - DNA, 21 bp, Artificial Sequence
  Description of Artificial Sequence: Synthetic oligonucleotide
ggtgaggccctgggcaggctg

SEQ ID NO: 190498 - DNA, 22 bp, Artificial Sequence
  Description of Artificial Sequence: Synthetic oligonucleotide
gtgaggccctgggcaggctgct

SEQ ID NO: 190499 - DNA, 22 bp, Artificial Sequence
  Description of Artificial Sequence: Synthetic oligonucleotide
tgaggccctgggcaggctgctg

SEQ ID NO: 190500 - DNA, 21 bp, Artificial Sequence
  Description of Artificial Sequence: Synthetic oligonucleotide
gaggccctgggcaggctgctg

SEQ ID NO: 190501 - DNA, 22 bp, Artificial Sequence
  Description of Artificial Sequence: Synthetic oligonucleotide
aggccctgggcaggctgctggt

SEQ ID NO: 190502 - DNA, 21 bp, Artificial Sequence
  Description of Artificial Sequence: Synthetic oligonucleotide
ggccctgggcaggctgctggt

SEQ ID NO: 190503 - DNA, 21 bp, Artificial Sequence
  Description of Artificial Sequence: Synthetic oligonucleotide
gccctgggcaggctgctggtg

SEQ ID NO: 190504 - DNA, 22 bp, Artificial Sequence
  Description of Artificial Sequence: Synthetic oligonucleotide
ccctgggcaggctgctggtggt

SEQ ID NO: 190505 - DNA, 24 bp, Artificial Sequence
  Description of Artificial Sequence: Synthetic oligonucleotide
cctgggcaggctgctggtggtcta

SEQ ID NO: 190506 - DNA, 24 bp, Artificial Sequence
  Description of Artificial Sequence: Synthetic oligonucleotide
ctgggcaggctgctggtggtctac

SEQ ID NO: 190507 - DNA, 24 bp, Artificial Sequence
  Description of Artificial Sequence: Synthetic oligonucleotide
tgggcaggctgctggtggtctacc

SEQ ID NO: 190508 - DNA, 23 bp, Artificial Sequence
  Description of Artificial Sequence: Synthetic oligonucleotide
gggcaggctgctggtggtctacc

SEQ ID NO: 190509 - DNA, 25 bp, Artificial Sequence
  Description of Artificial Sequence: Synthetic oligonucleotide
ggcaggctgctggtggtctaccctt

SEQ ID NO: 190510 - DNA, 25 bp, Artificial Sequence
  Description of Artificial Sequence: Synthetic oligonucleotide
gcaggctgctggtggtctacccttg

SEQ ID NO: 190511 - DNA, 26 bp, Artificial Sequence
  Description of Artificial Sequence: Synthetic oligonucleotide
caggctgctggtggtctacccttgga

SEQ ID NO: 190512 - DNA, 26 bp, Artificial Sequence
  Description of Artificial Sequence: Synthetic oligonucleotide
aggctgctggtggtctacccttggac

SEQ ID NO: 190513 - DNA, 25 bp, Artificial Sequence
  Description of Artificial Sequence: Synthetic oligonucleotide
ggctgctggtggtctacccttggac

SEQ ID NO: 190514 - DNA, 25 bp, Artificial Sequence
  Description of Artificial Sequence: Synthetic oligonucleotide
gctgctggtggtctacccttggacc

SEQ ID NO: 190515 - DNA, 26 bp, Artificial Sequence
  Description of Artificial Sequence: Synthetic oligonucleotide
ctgctggtggtctacccttggaccca

SEQ ID NO: 190516 - DNA, 27 bp, Artificial Sequence
  Description of Artificial Sequence: Synthetic oligonucleotide
tgctggtggtctacccttggacccaga

SEQ ID NO: 190517 - DNA, 26 bp, Artificial Sequence
  Description of Artificial Sequence: Synthetic oligonucleotide
gctggtggtctacccttggacccaga

SEQ ID NO: 190518 - DNA, 26 bp, Artificial Sequence
  Description of Artificial Sequence: Synthetic oligonucleotide
ctggtggtctacccttggacccagag

SEQ ID NO: 190519 - DNA, 27 bp, Artificial Sequence
  Description of Artificial Sequence: Synthetic oligonucleotide
tggtggtctacccttggacccagaggt

SEQ ID NO: 190520 - DNA, 27 bp, Artificial Sequence
  Description of Artificial Sequence: Synthetic oligonucleotide
ggtggtctacccttggacccagaggtt

SEQ ID NO: 190521 - DNA, 27 bp, Artificial Sequence
  Description of Artificial Sequence: Synthetic oligonucleotide
gtggtctacccttggacccagaggttc

SEQ ID NO: 190522 - DNA, 30 bp, Artificial Sequence
  Description of Artificial Sequence: Synthetic oligonucleotide
tggtctacccttggacccagaggttctttg

SEQ ID NO: 190523 - DNA, 29 bp, Artificial Sequence
  Description of Artificial Sequence: Synthetic oligonucleotide
ggtctacccttggacccagaggttctttg

SEQ ID NO: 190524 - DNA, 30 bp, Artificial Sequence
  Description of Artificial Sequence: Synthetic oligonucleotide
gtctacccttggacccagaggttctttgag

SEQ ID NO: 190525 - DNA, 31 bp, Artificial Sequence
  Description of Artificial Sequence: Synthetic oligonucleotide
tctacccttggacccagaggttctttgagtc

SEQ ID NO: 190526 - DNA, 30 bp, Artificial Sequence
  Description of Artificial Sequence: Synthetic oligonucleotide
ctacccttggacccagaggttctttgagtc

SEQ ID NO: 190527 - DNA, 30 bp, Artificial Sequence
  Description of Artificial Sequence: Synthetic oligonucleotide
tacccttggacccagaggttctttgagtcc

SEQ ID NO: 190528 - DNA, 29 bp, Artificial Sequence
  Description of Artificial Sequence: Synthetic oligonucleotide
acccttggacccagaggttctttgagtcc

SEQ ID NO: 190529 - DNA, 28 bp, Artificial Sequence
  Description of Artificial Sequence: Synthetic oligonucleotide
cccttggacccagaggttctttgagtcc

SEQ ID NO: 190530 - DNA, 31 bp, Artificial Sequence
  Description of Artificial Sequence: Synthetic oligonucleotide
ccttggacccagaggttctttgagtcctttg

SEQ ID NO: 190531 - DNA, 31 bp, Artificial Sequence
  Description of Artificial Sequence: Synthetic oligonucleotide
cttggacccagaggttctttgagtcctttgg

SEQ ID NO: 190532 - DNA, 31 bp, Artificial Sequence
  Description of Artificial Sequence: Synthetic oligonucleotide
ttggacccagaggttctttgagtcctttggg

SEQ ID NO: 190533 - DNA, 30 bp, Artificial Sequence
  Description of Artificial Sequence: Synthetic oligonucleotide
tggacccagaggttctttgagtcctttggg

SEQ ID NO: 190534 - DNA, 29 bp, Artificial Sequence
  Description of Artificial Sequence: Synthetic oligonucleotide
ggacccagaggttctttgagtcctttggg

SEQ ID NO: 190535 - DNA, 29 bp, Artificial Sequence
  Description of Artificial Sequence: Synthetic oligonucleotide
gacccagaggttctttgagtcctttgggg

SEQ ID NO: 190536 - DNA, 31 bp, Artificial Sequence
  Description of Artificial Sequence: Synthetic oligonucleotide
acccagaggttctttgagtcctttggggatc

SEQ ID NO: 190537 - DNA, 30 bp, Artificial Sequence
  Description of Artificial Sequence: Synthetic oligonucleotide
cccagaggttctttgagtcctttggggatc

SEQ ID NO: 190538 - DNA, 31 bp, Artificial Sequence
  Description of Artificial Sequence: Synthetic oligonucleotide
ccagaggttctttgagtcctttggggatctg

SEQ ID NO: 190539 - DNA, 32 bp, Artificial Sequence
  Description of Artificial Sequence: Synthetic oligonucleotide
cagaggttctttgagtcctttggggatctgtc

SEQ ID NO: 190540 - DNA, 32 bp, Artificial Sequence
  Description of Artificial Sequence: Synthetic oligonucleotide
agaggttctttgagtcctttggggatctgtcc

SEQ ID NO: 190541 - DNA, 31 bp, Artificial Sequence
  Description of Artificial Sequence: Synthetic oligonucleotide
gaggttctttgagtcctttggggatctgtcc

SEQ ID NO: 190542 - DNA, 32 bp, Artificial Sequence
  Description of Artificial Sequence: Synthetic oligonucleotide
aggttctttgagtcctttggggatctgtccac

SEQ ID NO: 190543 - DNA, 31 bp, Artificial Sequence
  Description of Artificial Sequence: Synthetic oligonucleotide
ggttctttgagtcctttggggatctgtccac

SEQ ID NO: 190544 - DNA, 32 bp, Artificial Sequence
  Description of Artificial Sequence: Synthetic oligonucleotide
gttctttgagtcctttggggatctgtccactc

SEQ ID NO: 190545 - DNA, 32 bp, Artificial Sequence
  Description of Artificial Sequence: Synthetic oligonucleotide
ttctttgagtcctttggggatctgtccactcc

SEQ ID NO: 190546 - DNA, 31 bp, Artificial Sequence
  Description of Artificial Sequence: Synthetic oligonucleotide
tctttgagtcctttggggatctgtccactcc

SEQ ID NO: 190547 - DNA, 30 bp, Artificial Sequence
  Description of Artificial Sequence: Synthetic oligonucleotide
ctttgagtcctttggggatctgtccactcc

SEQ ID NO: 190548 - DNA, 31 bp, Artificial Sequence
  Description of Artificial Sequence: Synthetic oligonucleotide
tttgagtcctttggggatctgtccactcctg

SEQ ID NO: 190549 - DNA, 30 bp, Artificial Sequence
  Description of Artificial Sequence: Synthetic oligonucleotide
ttgagtcctttggggatctgtccactcctg

SEQ ID NO: 190550 - DNA, 29 bp, Artificial Sequence
  Description of Artificial Sequence: Synthetic oligonucleotide
tgagtcctttggggatctgtccactcctg

SEQ ID NO: 190551 - DNA, 28 bp, Artificial Sequence
  Description of Artificial Sequence: Synthetic oligonucleotide
gagtcctttggggatctgtccactcctg

SEQ ID NO: 190552 - DNA, 30 bp, Artificial Sequence
  Description of Artificial Sequence: Synthetic oligonucleotide
agtcctttggggatctgtccactcctgatg

SEQ ID NO: 190553 - DNA, 29 bp, Artificial Sequence
  Description of Artificial Sequence: Synthetic oligonucleotide
gtcctttggggatctgtccactcctgatg

SEQ ID NO: 190554 - DNA, 29 bp, Artificial Sequence
  Description of Artificial Sequence: Synthetic oligonucleotide
tcctttggggatctgtccactcctgatgc

SEQ ID NO: 190555 - DNA, 28 bp, Artificial Sequence
  Description of Artificial Sequence: Synthetic oligonucleotide
cctttggggatctgtccactcctgatgc

SEQ ID NO: 190556 - DNA, 29 bp, Artificial Sequence
  Description of Artificial Sequence: Synthetic oligonucleotide
ctttggggatctgtccactcctgatgctg

SEQ ID NO: 190557 - DNA, 33 bp, Artificial Sequence
  Description of Artificial Sequence: Synthetic oligonucleotide
tttggggatctgtccactcctgatgctgttatg

SEQ ID NO: 190558 - DNA, 32 bp, Artificial Sequence
  Description of Artificial Sequence: Synthetic oligonucleotide
ttggggatctgtccactcctgatgctgttatg

SEQ ID NO: 190559 - DNA, 31 bp, Artificial Sequence
  Description of Artificial Sequence: Synthetic oligonucleotide
tggggatctgtccactcctgatgctgttatg

SEQ ID NO: 190560 - DNA, 30 bp, Artificial Sequence
  Description of Artificial Sequence: Synthetic oligonucleotide
ggggatctgtccactcctgatgctgttatg

SEQ ID NO: 190561 - DNA, 30 bp, Artificial Sequence
  Description of Artificial Sequence: Synthetic oligonucleotide
gggatctgtccactcctgatgctgttatgg

SEQ ID NO: 190562 - DNA, 30 bp, Artificial Sequence
  Description of Artificial Sequence: Synthetic oligonucleotide
ggatctgtccactcctgatgctgttatggg

SEQ ID NO: 190563 - DNA, 30 bp, Artificial Sequence
  Description of Artificial Sequence: Synthetic oligonucleotide
gatctgtccactcctgatgctgttatgggc

SEQ ID NO: 190564 - DNA, 32 bp, Artificial Sequence
  Description of Artificial Sequence: Synthetic oligonucleotide
atctgtccactcctgatgctgttatgggcaac

SEQ ID NO: 190565 - DNA, 31 bp, Artificial Sequence
  Description of Artificial Sequence: Synthetic oligonucleotide
tctgtccactcctgatgctgttatgggcaac

SEQ ID NO: 190566 - DNA, 30 bp, Artificial Sequence
  Description of Artificial Sequence: Synthetic oligonucleotide
ctgtccactcctgatgctgttatgggcaac

SEQ ID NO: 190567 - DNA, 30 bp, Artificial Sequence
  Description of Artificial Sequence: Synthetic oligonucleotide
tgtccactcctgatgctgttatgggcaacc

SEQ ID NO: 190568 - DNA, 29 bp, Artificial Sequence
  Description of Artificial Sequence: Synthetic oligonucleotide
gtccactcctgatgctgttatgggcaacc

SEQ ID NO: 190569 - DNA, 29 bp, Artificial Sequence
  Description of Artificial Sequence: Synthetic oligonucleotide
tccactcctgatgctgttatgggcaaccc

SEQ ID NO: 190570 - DNA, 28 bp, Artificial Sequence
  Description of Artificial Sequence: Synthetic oligonucleotide
ccactcctgatgctgttatgggcaaccc

SEQ ID NO: 190571 - DNA, 31 bp, Artificial Sequence
  Description of Artificial Sequence: Synthetic oligonucleotide
cactcctgatgctgttatgggcaaccctaag

SEQ ID NO: 190572 - DNA, 31 bp, Artificial Sequence
  Description of Artificial Sequence: Synthetic oligonucleotide
actcctgatgctgttatgggcaaccctaagg

SEQ ID NO: 190573 - DNA, 30 bp, Artificial Sequence
  Description of Artificial Sequence: Synthetic oligonucleotide
ctcctgatgctgttatgggcaaccctaagg

SEQ ID NO: 190574 - DNA, 31 bp, Artificial Sequence
  Description of Artificial Sequence: Synthetic oligonucleotide
tcctgatgctgttatgggcaaccctaaggtg

SEQ ID NO: 190575 - DNA, 30 bp, Artificial Sequence
  Description of Artificial Sequence: Synthetic oligonucleotide
cctgatgctgttatgggcaaccctaaggtg

SEQ ID NO: 190576 - DNA, 32 bp, Artificial Sequence
  Description of Artificial Sequence: Synthetic oligonucleotide
ctgatgctgttatgggcaaccctaaggtgaag

SEQ ID NO: 190577 - DNA, 32 bp, Artificial Sequence
  Description of Artificial Sequence: Synthetic oligonucleotide
tgatgctgttatgggcaaccctaaggtgaagg

SEQ ID NO: 190578 - DNA, 31 bp, Artificial Sequence
  Description of Artificial Sequence: Synthetic oligonucleotide
gatgctgttatgggcaaccctaaggtgaagg

SEQ ID NO: 190579 - DNA, 31 bp, Artificial Sequence
  Description of Artificial Sequence: Synthetic oligonucleotide
atgctgttatgggcaaccctaaggtgaaggc

SEQ ID NO: 190580 - DNA, 30 bp, Artificial Sequence
  Description of Artificial Sequence: Synthetic oligonucleotide
tgctgttatgggcaaccctaaggtgaaggc

SEQ ID NO: 190581 - DNA, 29 bp, Artificial Sequence
  Description of Artificial Sequence: Synthetic oligonucleotide
gctgttatgggcaaccctaaggtgaaggc

SEQ ID NO: 190582 - DNA, 30 bp, Artificial Sequence
  Description of Artificial Sequence: Synthetic oligonucleotide
ctgttatgggcaaccctaaggtgaaggctc

SEQ ID NO: 190583 - DNA, 32 bp, Artificial Sequence
  Description of Artificial Sequence: Synthetic oligonucleotide
tgttatgggcaaccctaaggtgaaggctcatg

SEQ ID NO: 190584 - DNA, 31 bp, Artificial Sequence
  Description of Artificial Sequence: Synthetic oligonucleotide
gttatgggcaaccctaaggtgaaggctcatg

SEQ ID NO: 190585 - DNA, 31 bp, Artificial Sequence
  Description of Artificial Sequence: Synthetic oligonucleotide
ttatgggcaaccctaaggtgaaggctcatgg

SEQ ID NO: 190586 - DNA, 30 bp, Artificial Sequence
  Description of Artificial Sequence: Synthetic oligonucleotide
tatgggcaaccctaaggtgaaggctcatgg

SEQ ID NO: 190587 - DNA, 29 bp, Artificial Sequence
  Description of Artificial Sequence: Synthetic oligonucleotide
atgggcaaccctaaggtgaaggctcatgg

SEQ ID NO: 190588 - DNA, 28 bp, Artificial Sequence
  Description of Artificial Sequence: Synthetic oligonucleotide
tgggcaaccctaaggtgaaggctcatgg

SEQ ID NO: 190589 - DNA, 27 bp, Artificial Sequence
  Description of Artificial Sequence: Synthetic oligonucleotide
gggcaaccctaaggtgaaggctcatgg

SEQ ID NO: 190590 - DNA, 27 bp, Artificial Sequence
  Description of Artificial Sequence: Synthetic oligonucleotide
ggcaaccctaaggtgaaggctcatggc

SEQ ID NO: 190591 - DNA, 29 bp, Artificial Sequence
  Description of Artificial Sequence: Synthetic oligonucleotide
gcaaccctaaggtgaaggctcatggcaag

SEQ ID NO: 190592 - DNA, 32 bp, Artificial Sequence
  Description of Artificial Sequence: Synthetic oligonucleotide
caaccctaaggtgaaggctcatggcaagaaag

SEQ ID NO: 190593 - DNA, 33 bp, Artificial Sequence
  Description of Artificial Sequence: Synthetic oligonucleotide
aaccctaaggtgaaggctcatggcaagaaagtg

SEQ ID NO: 190594 - DNA, 32 bp, Artificial Sequence
  Description of Artificial Sequence: Synthetic oligonucleotide
accctaaggtgaaggctcatggcaagaaagtg

SEQ ID NO: 190595 - DNA, 31 bp, Artificial Sequence
  Description of Artificial Sequence: Synthetic oligonucleotide
ccctaaggtgaaggctcatggcaagaaagtg

SEQ ID NO: 190596 - DNA, 31 bp, Artificial Sequence
  Description of Artificial Sequence: Synthetic oligonucleotide
cctaaggtgaaggctcatggcaagaaagtgc

SEQ ID NO: 190597 - DNA, 32 bp, Artificial Sequence
  Description of Artificial Sequence: Synthetic oligonucleotide
ctaaggtgaaggctcatggcaagaaagtgctc

SEQ ID NO: 190598 - DNA, 32 bp, Artificial Sequence
  Description of Artificial Sequence: Synthetic oligonucleotide
taaggtgaaggctcatggcaagaaagtgctcg

SEQ ID NO: 190599 - DNA, 31 bp, Artificial Sequence
  Description of Artificial Sequence: Synthetic oligonucleotide
aaggtgaaggctcatggcaagaaagtgctcg

SEQ ID NO: 190600 - DNA, 30 bp, Artificial Sequence
  Description of Artificial Sequence: Synthetic oligonucleotide
aggtgaaggctcatggcaagaaagtgctcg

SEQ ID NO: 190601 - DNA, 29 bp, Artificial Sequence
  Description of Artificial Sequence: Synthetic oligonucleotide
ggtgaaggctcatggcaagaaagtgctcg

SEQ ID NO: 190602 - DNA, 29 bp, Artificial Sequence
  Description of Artificial Sequence: Synthetic oligonucleotide
gtgaaggctcatggcaagaaagtgctcgg

SEQ ID NO: 190603 - DNA, 30 bp, Artificial Sequence
  Description of Artificial Sequence: Synthetic oligonucleotide
tgaaggctcatggcaagaaagtgctcggtg

SEQ ID NO: 190604 - DNA, 29 bp, Artificial Sequence
  Description of Artificial Sequence: Synthetic oligonucleotide
gaaggctcatggcaagaaagtgctcggtg

SEQ ID NO: 190605 - DNA, 29 bp, Artificial Sequence
  Description of Artificial Sequence: Synthetic oligonucleotide
aaggctcatggcaagaaagtgctcggtgc

SEQ ID NO: 190606 - DNA, 28 bp, Artificial Sequence
  Description of Artificial Sequence: Synthetic oligonucleotide
aggctcatggcaagaaagtgctcggtgc

SEQ ID NO: 190607 - DNA, 27 bp, Artificial Sequence
  Description of Artificial Sequence: Synthetic oligonucleotide
ggctcatggcaagaaagtgctcggtgc

SEQ ID NO: 190608 - DNA, 27 bp, Artificial Sequence
  Description of Artificial Sequence: Synthetic oligonucleotide
gctcatggcaagaaagtgctcggtgcc

SEQ ID NO: 190609 - DNA, 31 bp, Artificial Sequence
  Description of Artificial Sequence: Synthetic oligonucleotide
ctcatggcaagaaagtgctcggtgcctttag

SEQ ID NO: 190610 - DNA, 32 bp, Artificial Sequence
  Description of Artificial Sequence: Synthetic oligonucleotide
tcatggcaagaaagtgctcggtgcctttagtg

SEQ ID NO: 190611 - DNA, 31 bp, Artificial Sequence
  Description of Artificial Sequence: Synthetic oligonucleotide
catggcaagaaagtgctcggtgcctttagtg

SEQ ID NO: 190612 - DNA, 33 bp, Artificial Sequence
  Description of Artificial Sequence: Synthetic oligonucleotide
atggcaagaaagtgctcggtgcctttagtgatg

SEQ ID NO: 190613 - DNA, 32 bp, Artificial Sequence
  Description of Artificial Sequence: Synthetic oligonucleotide
tggcaagaaagtgctcggtgcctttagtgatg

SEQ ID NO: 190614 - DNA, 31 bp, Artificial Sequence
  Description of Artificial Sequence: Synthetic oligonucleotide
ggcaagaaagtgctcggtgcctttagtgatg

SEQ ID NO: 190615 - DNA, 31 bp, Artificial Sequence
  Description of Artificial Sequence: Synthetic oligonucleotide
gcaagaaagtgctcggtgcctttagtgatgg

SEQ ID NO: 190616 - DNA, 31 bp, Artificial Sequence
  Description of Artificial Sequence: Synthetic oligonucleotide
caagaaagtgctcggtgcctttagtgatggc

SEQ ID NO: 190617 - DNA, 31 bp, Artificial Sequence
  Description of Artificial Sequence: Synthetic oligonucleotide
aagaaagtgctcggtgcctttagtgatggcc

SEQ ID NO: 190618 - DNA, 30 bp, Artificial Sequence
  Description of Artificial Sequence: Synthetic oligonucleotide
agaaagtgctcggtgcctttagtgatggcc

SEQ ID NO: 190619 - DNA, 29 bp, Artificial Sequence
  Description of Artificial Sequence: Synthetic oligonucleotide
gaaagtgctcggtgcctttagtgatggcc

SEQ ID NO: 190620 - DNA, 30 bp, Artificial Sequence
  Description of Artificial Sequence: Synthetic oligonucleotide
aaagtgctcggtgcctttagtgatggcctg

SEQ ID NO: 190621 - DNA, 29 bp, Artificial Sequence
  Description of Artificial Sequence: Synthetic oligonucleotide
aagtgctcggtgcctttagtgatggcctg

SEQ ID NO: 190622 - DNA, 28 bp, Artificial Sequence
  Description of Artificial Sequence: Synthetic oligonucleotide
agtgctcggtgcctttagtgatggcctg

SEQ ID NO: 190623 - DNA, 27 bp, Artificial Sequence
  Description of Artificial Sequence: Synthetic oligonucleotide
gtgctcggtgcctttagtgatggcctg

SEQ ID NO: 190624 - DNA, 27 bp, Artificial Sequence
  Description of Artificial Sequence: Synthetic oligonucleotide
tgctcggtgcctttagtgatggcctgg

SEQ ID NO: 190625 - DNA, 26 bp, Artificial Sequence
  Description of Artificial Sequence: Synthetic oligonucleotide
gctcggtgcctttagtgatggcctgg

SEQ ID NO: 190626 - DNA, 27 bp, Artificial Sequence
  Description of Artificial Sequence: Synthetic oligonucleotide
ctcggtgcctttagtgatggcctggct

SEQ ID NO: 190627 - DNA, 27 bp, Artificial Sequence
  Description of Artificial Sequence: Synthetic oligonucleotide
tcggtgcctttagtgatggcctggctc

SEQ ID NO: 190628 - DNA, 27 bp, Artificial Sequence
  Description of Artificial Sequence: Synthetic oligonucleotide
cggtgcctttagtgatggcctggctca

SEQ ID NO: 190629 - DNA, 27 bp, Artificial Sequence
  Description of Artificial Sequence: Synthetic oligonucleotide
ggtgcctttagtgatggcctggctcac

SEQ ID NO: 190630 - DNA, 27 bp, Artificial Sequence
  Description of Artificial Sequence: Synthetic oligonucleotide
gtgcctttagtgatggcctggctcacc

SEQ ID NO: 190631 - DNA, 28 bp, Artificial Sequence
  Description of Artificial Sequence: Synthetic oligonucleotide
tgcctttagtgatggcctggctcacctg

SEQ ID NO: 190632 - DNA, 27 bp, Artificial Sequence
  Description of Artificial Sequence: Synthetic oligonucleotide
gcctttagtgatggcctggctcacctg

SEQ ID NO: 190633 - DNA, 27 bp, Artificial Sequence
  Description of Artificial Sequence: Synthetic oligonucleotide
cctttagtgatggcctggctcacctgg

SEQ ID NO: 190634 - DNA, 28 bp, Artificial Sequence
  Description of Artificial Sequence: Synthetic oligonucleotide
ctttagtgatggcctggctcacctggac

SEQ ID NO: 190635 - DNA, 30 bp, Artificial Sequence
  Description of Artificial Sequence: Synthetic oligonucleotide
tttagtgatggcctggctcacctggacaac

SEQ ID NO: 190636 - DNA, 29 bp, Artificial Sequence
  Description of Artificial Sequence: Synthetic oligonucleotide
ttagtgatggcctggctcacctggacaac

SEQ ID NO: 190637 - DNA, 28 bp, Artificial Sequence
  Description of Artificial Sequence: Synthetic oligonucleotide
tagtgatggcctggctcacctggacaac

SEQ ID NO: 190638 - DNA, 27 bp, Artificial Sequence
  Description of Artificial Sequence: Synthetic oligonucleotide
agtgatggcctggctcacctggacaac

SEQ ID NO: 190639 - DNA, 26 bp, Artificial Sequence
  Description of Artificial Sequence: Synthetic oligonucleotide
gtgatggcctggctcacctggacaac

SEQ ID NO: 190640 - DNA, 27 bp, Artificial Sequence
  Description of Artificial Sequence: Synthetic oligonucleotide
tgatggcctggctcacctggacaacct

SEQ ID NO: 190641 - DNA, 26 bp, Artificial Sequence
  Description of Artificial Sequence: Synthetic oligonucleotide
gatggcctggctcacctggacaacct

SEQ ID NO: 190642 - DNA, 27 bp, Artificial Sequence
  Description of Artificial Sequence: Synthetic oligonucleotide
atggcctggctcacctggacaacctca

SEQ ID NO: 190643 - DNA, 27 bp, Artificial Sequence
  Description of Artificial Sequence: Synthetic oligonucleotide
tggcctggctcacctggacaacctcaa

SEQ ID NO: 190644 - DNA, 26 bp, Artificial Sequence
  Description of Artificial Sequence: Synthetic oligonucleotide
ggcctggctcacctggacaacctcaa

SEQ ID NO: 190645 - DNA, 26 bp, Artificial Sequence
  Description of Artificial Sequence: Synthetic oligonucleotide
gcctggctcacctggacaacctcaag

SEQ ID NO: 190646 - DNA, 26 bp, Artificial Sequence
  Description of Artificial Sequence: Synthetic oligonucleotide
cctggctcacctggacaacctcaagg

SEQ ID NO: 190647 - DNA, 26 bp, Artificial Sequence
  Description of Artificial Sequence: Synthetic oligonucleotide
ctggctcacctggacaacctcaaggg

SEQ ID NO: 190648 - DNA, 27 bp, Artificial Sequence
  Description of Artificial Sequence: Synthetic oligonucleotide
tggctcacctggacaacctcaagggca

SEQ ID NO: 190649 - DNA, 26 bp, Artificial Sequence
  Description of Artificial Sequence: Synthetic oligonucleotide
ggctcacctggacaacctcaagggca

SEQ ID NO: 190650 - DNA, 26 bp, Artificial Sequence
  Description of Artificial Sequence: Synthetic oligonucleotide
gctcacctggacaacctcaagggcac

SEQ ID NO: 190651 - DNA, 27 bp, Artificial Sequence
  Description of Artificial Sequence: Synthetic oligonucleotide
ctcacctggacaacctcaagggcacct

SEQ ID NO: 190652 - DNA, 29 bp, Artificial Sequence
  Description of Artificial Sequence: Synthetic oligonucleotide
tcacctggacaacctcaagggcacctttg

SEQ ID NO: 190653 - DNA, 28 bp, Artificial Sequence
  Description of Artificial Sequence: Synthetic oligonucleotide
cacctggacaacctcaagggcacctttg

SEQ ID NO: 190654 - DNA, 28 bp, Artificial Sequence
  Description of Artificial Sequence: Synthetic oligonucleotide
acctggacaacctcaagggcacctttgc

SEQ ID NO: 190655 - DNA, 27 bp, Artificial Sequence
  Description of Artificial Sequence: Synthetic oligonucleotide
cctggacaacctcaagggcacctttgc

SEQ ID NO: 190656 - DNA, 27 bp, Artificial Sequence
  Description of Artificial Sequence: Synthetic oligonucleotide
ctggacaacctcaagggcacctttgcc

SEQ ID NO: 190657 - DNA, 28 bp, Artificial Sequence
  Description of Artificial Sequence: Synthetic oligonucleotide
tggacaacctcaagggcacctttgccac

SEQ ID NO: 190658 - DNA, 27 bp, Artificial Sequence
  Description of Artificial Sequence: Synthetic oligonucleotide
ggacaacctcaagggcacctttgccac

SEQ ID NO: 190659 - DNA, 28 bp, Artificial Sequence
  Description of Artificial Sequence: Synthetic oligonucleotide
gacaacctcaagggcacctttgccacac

SEQ ID NO: 190660 - DNA, 29 bp, Artificial Sequence
  Description of Artificial Sequence: Synthetic oligonucleotide
acaacctcaagggcacctttgccacactg

SEQ ID NO: 190661 - DNA, 28 bp, Artificial Sequence
  Description of Artificial Sequence: Synthetic oligonucleotide
caacctcaagggcacctttgccacactg

SEQ ID NO: 190662 - DNA, 29 bp, Artificial Sequence
  Description of Artificial Sequence: Synthetic oligonucleotide
aacctcaagggcacctttgccacactgag

SEQ ID NO: 190663 - DNA, 28 bp, Artificial Sequence
  Description of Artificial Sequence: Synthetic oligonucleotide
acctcaagggcacctttgccacactgag

SEQ ID NO: 190664 - DNA, 27 bp, Artificial Sequence
  Description of Artificial Sequence: Synthetic oligonucleotide
cctcaagggcacctttgccacactgag

SEQ ID NO: 190665 - DNA, 28 bp, Artificial Sequence
  Description of Artificial Sequence: Synthetic oligonucleotide
ctcaagggcacctttgccacactgagtg

SEQ ID NO: 190666 - DNA, 29 bp, Artificial Sequence
  Description of Artificial Sequence: Synthetic oligonucleotide
tcaagggcacctttgccacactgagtgag

SEQ ID NO: 190667 - DNA, 28 bp, Artificial Sequence
  Description of Artificial Sequence: Synthetic oligonucleotide
caagggcacctttgccacactgagtgag

SEQ ID NO: 190668 - DNA, 28 bp, Artificial Sequence
  Description of Artificial Sequence: Synthetic oligonucleotide
aagggcacctttgccacactgagtgagc

SEQ ID NO: 190669 - DNA, 27 bp, Artificial Sequence
  Description of Artificial Sequence: Synthetic oligonucleotide
agggcacctttgccacactgagtgagc

SEQ ID NO: 190670 - DNA, 27 bp, Artificial Sequence
  Description of Artificial Sequence: Synthetic oligonucleotide
gggcacctttgccacactgagtgagct

SEQ ID NO: 190671 - DNA, 27 bp, Artificial Sequence
  Description of Artificial Sequence: Synthetic oligonucleotide
ggcacctttgccacactgagtgagctg

SEQ ID NO: 190672 - DNA, 27 bp, Artificial Sequence
  Description of Artificial Sequence: Synthetic oligonucleotide
gcacctttgccacactgagtgagctgc

SEQ ID NO: 190673 - DNA, 28 bp, Artificial Sequence
  Description of Artificial Sequence: Synthetic oligonucleotide
cacctttgccacactgagtgagctgcac

SEQ ID NO: 190674 - DNA, 29 bp, Artificial Sequence
  Description of Artificial Sequence: Synthetic oligonucleotide
acctttgccacactgagtgagctgcactg

SEQ ID NO: 190675 - DNA, 28 bp, Artificial Sequence
  Description of Artificial Sequence: Synthetic oligonucleotide
cctttgccacactgagtgagctgcactg

SEQ ID NO: 190676 - DNA, 29 bp, Artificial Sequence
  Description of Artificial Sequence: Synthetic oligonucleotide
ctttgccacactgagtgagctgcactgtg

SEQ ID NO: 190677 - DNA, 30 bp, Artificial Sequence
  Description of Artificial Sequence: Synthetic oligonucleotide
tttgccacactgagtgagctgcactgtgac

SEQ ID NO: 190678 - DNA, 29 bp, Artificial Sequence
  Description of Artificial Sequence: Synthetic oligonucleotide
ttgccacactgagtgagctgcactgtgac

SEQ ID NO: 190679 - DNA, 28 bp, Artificial Sequence
  Description of Artificial Sequence: Synthetic oligonucleotide
tgccacactgagtgagctgcactgtgac

SEQ ID NO: 190680 - DNA, 27 bp, Artificial Sequence
  Description of Artificial Sequence: Synthetic oligonucleotide
gccacactgagtgagctgcactgtgac

SEQ ID NO: 190681 - DNA, 29 bp, Artificial Sequence
  Description of Artificial Sequence: Synthetic oligonucleotide
ccacactgagtgagctgcactgtgacaag

SEQ ID NO: 190682 - DNA, 29 bp, Artificial Sequence
  Description of Artificial Sequence: Synthetic oligonucleotide
cacactgagtgagctgcactgtgacaagc

SEQ ID NO: 190683 - DNA, 30 bp, Artificial Sequence
  Description of Artificial Sequence: Synthetic oligonucleotide
acactgagtgagctgcactgtgacaagctg

SEQ ID NO: 190684 - DNA, 29 bp, Artificial Sequence
  Description of Artificial Sequence: Synthetic oligonucleotide
cactgagtgagctgcactgtgacaagctg

SEQ ID NO: 190685 - DNA, 29 bp, Artificial Sequence
  Description of Artificial Sequence: Synthetic oligonucleotide
actgagtgagctgcactgtgacaagctgc

SEQ ID NO: 190686 - DNA, 28 bp, Artificial Sequence
  Description of Artificial Sequence: Synthetic oligonucleotide
ctgagtgagctgcactgtgacaagctgc

SEQ ID NO: 190687 - DNA, 29 bp, Artificial Sequence
  Description of Artificial Sequence: Synthetic oligonucleotide
tgagtgagctgcactgtgacaagctgcac

SEQ ID NO: 190688 - DNA, 28 bp, Artificial Sequence
  Description of Artificial Sequence: Synthetic oligonucleotide
gagtgagctgcactgtgacaagctgcac

SEQ ID NO: 190689 - DNA, 28 bp, Artificial Sequence
  Description of Artificial Sequence: Synthetic oligonucleotide
agtgagctgcactgtgacaagctgcacg

SEQ ID NO: 190690 - DNA, 27 bp, Artificial Sequence
  Description of Artificial Sequence: Synthetic oligonucleotide
gtgagctgcactgtgacaagctgcacg

SEQ ID NO: 190691 - DNA, 28 bp, Artificial Sequence
  Description of Artificial Sequence: Synthetic oligonucleotide
tgagctgcactgtgacaagctgcacgtg

SEQ ID NO: 190692 - DNA, 27 bp, Artificial Sequence
  Description of Artificial Sequence: Synthetic oligonucleotide
gagctgcactgtgacaagctgcacgtg

SEQ ID NO: 190693 - DNA, 27 bp, Artificial Sequence
  Description of Artificial Sequence: Synthetic oligonucleotide
agctgcactgtgacaagctgcacgtgg

SEQ ID NO: 190694 - DNA, 27 bp, Artificial Sequence
  Description of Artificial Sequence: Synthetic oligonucleotide
gctgcactgtgacaagctgcacgtgga

SEQ ID NO: 190695 - DNA, 28 bp, Artificial Sequence
  Description of Artificial Sequence: Synthetic oligonucleotide
ctgcactgtgacaagctgcacgtggatc

SEQ ID NO: 190696 - DNA, 28 bp, Artificial Sequence
  Description of Artificial Sequence: Synthetic oligonucleotide
tgcactgtgacaagctgcacgtggatcc

SEQ ID NO: 190697 - DNA, 27 bp, Artificial Sequence
  Description of Artificial Sequence: Synthetic oligonucleotide
gcactgtgacaagctgcacgtggatcc

SEQ ID NO: 190698 - DNA, 28 bp, Artificial Sequence
  Description of Artificial Sequence: Synthetic oligonucleotide
cactgtgacaagctgcacgtggatcctg

SEQ ID NO: 190699 - DNA, 29 bp, Artificial Sequence
  Description of Artificial Sequence: Synthetic oligonucleotide
actgtgacaagctgcacgtggatcctgag

SEQ ID NO: 190700 - DNA, 28 bp, Artificial Sequence
  Description of Artificial Sequence: Synthetic oligonucleotide
ctgtgacaagctgcacgtggatcctgag

SEQ ID NO: 190701 - DNA, 30 bp, Artificial Sequence
  Description of Artificial Sequence: Synthetic oligonucleotide
tgtgacaagctgcacgtggatcctgagaac

SEQ ID NO: 190702 - DNA, 29 bp, Artificial Sequence
  Description of Artificial Sequence: Synthetic oligonucleotide
gtgacaagctgcacgtggatcctgagaac

SEQ ID NO: 190703 - DNA, 31 bp, Artificial Sequence
  Description of Artificial Sequence: Synthetic oligonucleotide
tgacaagctgcacgtggatcctgagaacttc

SEQ ID NO: 190704 - DNA, 30 bp, Artificial Sequence
  Description of Artificial Sequence: Synthetic oligonucleotide
gacaagctgcacgtggatcctgagaacttc

SEQ ID NO: 190705 - DNA, 31 bp, Artificial Sequence
  Description of Artificial Sequence: Synthetic oligonucleotide
acaagctgcacgtggatcctgagaacttcag

SEQ ID NO: 190706 - DNA, 30 bp, Artificial Sequence
  Description of Artificial Sequence: Synthetic oligonucleotide
caagctgcacgtggatcctgagaacttcag

SEQ ID NO: 190707 - DNA, 30 bp, Artificial Sequence
  Description of Artificial Sequence: Synthetic oligonucleotide
aagctgcacgtggatcctgagaacttcagg

SEQ ID NO: 190708 - DNA, 29 bp, Artificial Sequence
  Description of Artificial Sequence: Synthetic oligonucleotide
agctgcacgtggatcctgagaacttcagg

SEQ ID NO: 190709 - DNA, 28 bp, Artificial Sequence
  Description of Artificial Sequence: Synthetic oligonucleotide
gctgcacgtggatcctgagaacttcagg

SEQ ID NO: 190710 - DNA, 28 bp, Artificial Sequence
  Description of Artificial Sequence: Synthetic oligonucleotide
ctgcacgtggatcctgagaacttcaggc

SEQ ID NO: 190711 - DNA, 29 bp, Artificial Sequence
  Description of Artificial Sequence: Synthetic oligonucleotide
tgcacgtggatcctgagaacttcaggctc

SEQ ID NO: 190712 - DNA, 28 bp, Artificial Sequence
  Description of Artificial Sequence: Synthetic oligonucleotide
gcacgtggatcctgagaacttcaggctc

SEQ ID NO: 190713 - DNA, 28 bp, Artificial Sequence
  Description of Artificial Sequence: Synthetic oligonucleotide
cacgtggatcctgagaacttcaggctcc

SEQ ID NO: 190714 - DNA, 29 bp, Artificial Sequence
  Description of Artificial Sequence: Synthetic oligonucleotide
acgtggatcctgagaacttcaggctcctg

SEQ ID NO: 190715 - DNA, 28 bp, Artificial Sequence
  Description of Artificial Sequence: Synthetic oligonucleotide
cgtggatcctgagaacttcaggctcctg

SEQ ID NO: 190716 - DNA, 28 bp, Artificial Sequence
  Description of Artificial Sequence: Synthetic oligonucleotide
gtggatcctgagaacttcaggctcctgg

SEQ ID NO: 190717 - DNA, 28 bp, Artificial Sequence
  Description of Artificial Sequence: Synthetic oligonucleotide
tggatcctgagaacttcaggctcctggg

SEQ ID NO: 190718 - DNA, 27 bp, Artificial Sequence
  Description of Artificial Sequence: Synthetic oligonucleotide
ggatcctgagaacttcaggctcctggg

SEQ ID NO: 190719 - DNA, 27 bp, Artificial Sequence
  Description of Artificial Sequence: Synthetic oligonucleotide
gatcctgagaacttcaggctcctgggc

SEQ ID NO: 190720 - DNA, 29 bp, Artificial Sequence
  Description of Artificial Sequence: Synthetic oligonucleotide
atcctgagaacttcaggctcctgggcaac

SEQ ID NO: 190721 - DNA, 28 bp, Artificial Sequence
  Description of Artificial Sequence: Synthetic oligonucleotide
tcctgagaacttcaggctcctgggcaac

SEQ ID NO: 190722 - DNA, 27 bp, Artificial Sequence
  Description of Artificial Sequence: Synthetic oligonucleotide
cctgagaacttcaggctcctgggcaac

SEQ ID NO: 190723 - DNA, 27 bp, Artificial Sequence
  Description of Artificial Sequence: Synthetic oligonucleotide
ctgagaacttcaggctcctgggcaacg

SEQ ID NO: 190724 - DNA, 28 bp, Artificial Sequence
  Description of Artificial Sequence: Synthetic oligonucleotide
tgagaacttcaggctcctgggcaacgtg

SEQ ID NO: 190725 - DNA, 27 bp, Artificial Sequence
  Description of Artificial Sequence: Synthetic oligonucleotide
gagaacttcaggctcctgggcaacgtg

SEQ ID NO: 190726 - DNA, 27 bp, Artificial Sequence
  Description of Artificial Sequence: Synthetic oligonucleotide
agaacttcaggctcctgggcaacgtgc

SEQ ID NO: 190727 - DNA, 27 bp, Artificial Sequence
  Description of Artificial Sequence: Synthetic oligonucleotide
gaacttcaggctcctgggcaacgtgct

SEQ ID NO: 190728 - DNA, 27 bp, Artificial Sequence
  Description of Artificial Sequence: Synthetic oligonucleotide
aacttcaggctcctgggcaacgtgctg

SEQ ID NO: 190729 - DNA, 26 bp, Artificial Sequence
  Description of Artificial Sequence: Synthetic oligonucleotide
acttcaggctcctgggcaacgtgctg

SEQ ID NO: 190730 - DNA, 25 bp, Artificial Sequence
  Description of Artificial Sequence: Synthetic oligonucleotide
cttcaggctcctgggcaacgtgctg

SEQ ID NO: 190731 - DNA, 26 bp, Artificial Sequence
  Description of Artificial Sequence: Synthetic oligonucleotide
ttcaggctcctgggcaacgtgctggt

SEQ ID NO: 190732 - DNA, 25 bp, Artificial Sequence
  Description of Artificial Sequence: Synthetic oligonucleotide
tcaggctcctgggcaacgtgctggt

SEQ ID NO: 190733 - DNA, 24 bp, Artificial Sequence
  Description of Artificial Sequence: Synthetic oligonucleotide
caggctcctgggcaacgtgctggt

SEQ ID NO: 190734 - DNA, 25 bp, Artificial Sequence
  Description of Artificial Sequence: Synthetic oligonucleotide
aggctcctgggcaacgtgctggtct

SEQ ID NO: 190735 - DNA, 24 bp, Artificial Sequence
  Description of Artificial Sequence: Synthetic oligonucleotide
ggctcctgggcaacgtgctggtct

SEQ ID NO: 190736 - DNA, 25 bp, Artificial Sequence
  Description of Artificial Sequence: Synthetic oligonucleotide
gctcctgggcaacgtgctggtctgt

SEQ ID NO: 190737 - DNA, 26 bp, Artificial Sequence
  Description of Artificial Sequence: Synthetic oligonucleotide
ctcctgggcaacgtgctggtctgtgt

SEQ ID NO: 190738 - DNA, 26 bp, Artificial Sequence
  Description of Artificial Sequence: Synthetic oligonucleotide
tcctgggcaacgtgctggtctgtgtg

SEQ ID NO: 190739 - DNA, 25 bp, Artificial Sequence
  Description of Artificial Sequence: Synthetic oligonucleotide
cctgggcaacgtgctggtctgtgtg

SEQ ID NO: 190740 - DNA, 26 bp, Artificial Sequence
  Description of Artificial Sequence: Synthetic oligonucleotide
ctgggcaacgtgctggtctgtgtgct

SEQ ID NO: 190741 - DNA, 26 bp, Artificial Sequence
  Description of Artificial Sequence: Synthetic oligonucleotide
tgggcaacgtgctggtctgtgtgctg

SEQ ID NO: 190742 - DNA, 25 bp, Artificial Sequence
  Description of Artificial Sequence: Synthetic oligonucleotide
gggcaacgtgctggtctgtgtgctg

SEQ ID NO: 190743 - DNA, 25 bp, Artificial Sequence
  Description of Artificial Sequence: Synthetic oligonucleotide
ggcaacgtgctggtctgtgtgctgg

SEQ ID NO: 190744 - DNA, 25 bp, Artificial Sequence
  Description of Artificial Sequence: Synthetic oligonucleotide
gcaacgtgctggtctgtgtgctggc

SEQ ID NO: 190745 - DNA, 25 bp, Artificial Sequence
  Description of Artificial Sequence: Synthetic oligonucleotide
caacgtgctggtctgtgtgctggcc

SEQ ID NO: 190746 - DNA, 27 bp, Artificial Sequence
  Description of Artificial Sequence: Synthetic oligonucleotide
aacgtgctggtctgtgtgctggcccat

SEQ ID NO: 190747 - DNA, 26 bp, Artificial Sequence
  Description of Artificial Sequence: Synthetic oligonucleotide
acgtgctggtctgtgtgctggcccat

SEQ ID NO: 190748 - DNA, 25 bp, Artificial Sequence
  Description of Artificial Sequence: Synthetic oligonucleotide
cgtgctggtctgtgtgctggcccat

SEQ ID NO: 190749 - DNA, 26 bp, Artificial Sequence
  Description of Artificial Sequence: Synthetic oligonucleotide
gtgctggtctgtgtgctggcccatca

SEQ ID NO: 190750 - DNA, 27 bp, Artificial Sequence
  Description of Artificial Sequence: Synthetic oligonucleotide
tgctggtctgtgtgctggcccatcact

SEQ ID NO: 190751 - DNA, 27 bp, Artificial Sequence
  Description of Artificial Sequence: Synthetic oligonucleotide
gctggtctgtgtgctggcccatcactt

SEQ ID NO: 190752 - DNA, 28 bp, Artificial Sequence
  Description of Artificial Sequence: Synthetic oligonucleotide
ctggtctgtgtgctggcccatcactttg

SEQ ID NO: 190753 - DNA, 28 bp, Artificial Sequence
  Description of Artificial Sequence: Synthetic oligonucleotide
tggtctgtgtgctggcccatcactttgg

SEQ ID NO: 190754 - DNA, 27 bp, Artificial Sequence
  Description of Artificial Sequence: Synthetic oligonucleotide
ggtctgtgtgctggcccatcactttgg

SEQ ID NO: 190755 - DNA, 27 bp, Artificial Sequence
  Description of Artificial Sequence: Synthetic oligonucleotide
gtctgtgtgctggcccatcactttggc

SEQ ID NO: 190756 - DNA, 30 bp, Artificial Sequence
  Description of Artificial Sequence: Synthetic oligonucleotide
tctgtgtgctggcccatcactttggcaaag

SEQ ID NO: 190757 - DNA, 29 bp, Artificial Sequence
  Description of Artificial Sequence: Synthetic oligonucleotide
ctgtgtgctggcccatcactttggcaaag

SEQ ID NO: 190758 - DNA, 33 bp, Artificial Sequence
  Description of Artificial Sequence: Synthetic oligonucleotide
tgtgtgctggcccatcactttggcaaagaattc

SEQ ID NO: 190759 - DNA, 32 bp, Artificial Sequence
  Description of Artificial Sequence: Synthetic oligonucleotide
gtgtgctggcccatcactttggcaaagaattc

SEQ ID NO: 190760 - DNA, 33 bp, Artificial Sequence
  Description of Artificial Sequence: Synthetic oligonucleotide
tgtgctggcccatcactttggcaaagaattcac

SEQ ID NO: 190761 - DNA, 32 bp, Artificial Sequence
  Description of Artificial Sequence: Synthetic oligonucleotide
gtgctggcccatcactttggcaaagaattcac

SEQ ID NO: 190762 - DNA, 32 bp, Artificial Sequence
  Description of Artificial Sequence: Synthetic oligonucleotide
tgctggcccatcactttggcaaagaattcacc

SEQ ID NO: 190763 - DNA, 31 bp, Artificial Sequence
  Description of Artificial Sequence: Synthetic oligonucleotide
gctggcccatcactttggcaaagaattcacc

SEQ ID NO: 190764 - DNA, 31 bp, Artificial Sequence
  Description of Artificial Sequence: Synthetic oligonucleotide
ctggcccatcactttggcaaagaattcaccc

SEQ ID NO: 190765 - DNA, 31 bp, Artificial Sequence
  Description of Artificial Sequence: Synthetic oligonucleotide
tggcccatcactttggcaaagaattcacccc

SEQ ID NO: 190766 - DNA, 30 bp, Artificial Sequence
  Description of Artificial Sequence: Synthetic oligonucleotide
ggcccatcactttggcaaagaattcacccc

SEQ ID NO: 190767 - DNA, 31 bp, Artificial Sequence
  Description of Artificial Sequence: Synthetic oligonucleotide
gcccatcactttggcaaagaattcaccccac

SEQ ID NO: 190768 - DNA, 31 bp, Artificial Sequence
  Description of Artificial Sequence: Synthetic oligonucleotide
cccatcactttggcaaagaattcaccccacc

SEQ ID NO: 190769 - DNA, 32 bp, Artificial Sequence
  Description of Artificial Sequence: Synthetic oligonucleotide
ccatcactttggcaaagaattcaccccaccag

SEQ ID NO: 190770 - DNA, 33 bp, Artificial Sequence
  Description of Artificial Sequence: Synthetic oligonucleotide
catcactttggcaaagaattcaccccaccagtg

SEQ ID NO: 190771 - DNA, 33 bp, Artificial Sequence
  Description of Artificial Sequence: Synthetic oligonucleotide
atcactttggcaaagaattcaccccaccagtgc

SEQ ID NO: 190772 - DNA, 32 bp, Artificial Sequence
  Description of Artificial Sequence: Synthetic oligonucleotide
tcactttggcaaagaattcaccccaccagtgc

SEQ ID NO: 190773 - DNA, 31 bp, Artificial Sequence
  Description of Artificial Sequence: Synthetic oligonucleotide
cactttggcaaagaattcaccccaccagtgc

SEQ ID NO: 190774 - DNA, 32 bp, Artificial Sequence
  Description of Artificial Sequence: Synthetic oligonucleotide
actttggcaaagaattcaccccaccagtgcag

SEQ ID NO: 190775 - DNA, 31 bp, Artificial Sequence
  Description of Artificial Sequence: Synthetic oligonucleotide
ctttggcaaagaattcaccccaccagtgcag

SEQ ID NO: 190776 - DNA, 31 bp, Artificial Sequence
  Description of Artificial Sequence: Synthetic oligonucleotide
tttggcaaagaattcaccccaccagtgcagg

SEQ ID NO: 190777 - DNA, 30 bp, Artificial Sequence
  Description of Artificial Sequence: Synthetic oligonucleotide
ttggcaaagaattcaccccaccagtgcagg

SEQ ID NO: 190778 - DNA, 29 bp, Artificial Sequence
  Description of Artificial Sequence: Synthetic oligonucleotide
tggcaaagaattcaccccaccagtgcagg

SEQ ID NO: 190779 - DNA, 28 bp, Artificial Sequence
  Description of Artificial Sequence: Synthetic oligonucleotide
ggcaaagaattcaccccaccagtgcagg

SEQ ID NO: 190780 - DNA, 28 bp, Artificial Sequence
  Description of Artificial Sequence: Synthetic oligonucleotide
gcaaagaattcaccccaccagtgcaggc

SEQ ID NO: 190781 - DNA, 29 bp, Artificial Sequence
  Description of Artificial Sequence: Synthetic oligonucleotide
caaagaattcaccccaccagtgcaggctg

SEQ ID NO: 190782 - DNA, 29 bp, Artificial Sequence
  Description of Artificial Sequence: Synthetic oligonucleotide
aaagaattcaccccaccagtgcaggctgc

SEQ ID NO: 190783 - DNA, 28 bp, Artificial Sequence
  Description of Artificial Sequence: Synthetic oligonucleotide
aagaattcaccccaccagtgcaggctgc

SEQ ID NO: 190784 - DNA, 27 bp, Artificial Sequence
  Description of Artificial Sequence: Synthetic oligonucleotide
agaattcaccccaccagtgcaggctgc

SEQ ID NO: 190785 - DNA, 26 bp, Artificial Sequence
  Description of Artificial Sequence: Synthetic oligonucleotide
gaattcaccccaccagtgcaggctgc

SEQ ID NO: 190786 - DNA, 27 bp, Artificial Sequence
  Description of Artificial Sequence: Synthetic oligonucleotide
aattcaccccaccagtgcaggctgcct

SEQ ID NO: 190787 - DNA, 27 bp, Artificial Sequence
  Description of Artificial Sequence: Synthetic oligonucleotide
attcaccccaccagtgcaggctgccta

SEQ ID NO: 190788 - DNA, 27 bp, Artificial Sequence
  Description of Artificial Sequence: Synthetic oligonucleotide
ttcaccccaccagtgcaggctgcctat

SEQ ID NO: 190789 - DNA, 26 bp, Artificial Sequence
  Description of Artificial Sequence: Synthetic oligonucleotide
tcaccccaccagtgcaggctgcctat

SEQ ID NO: 190790 - DNA, 25 bp, Artificial Sequence
  Description of Artificial Sequence: Synthetic oligonucleotide
caccccaccagtgcaggctgcctat

SEQ ID NO: 190791 - DNA, 26 bp, Artificial Sequence
  Description of Artificial Sequence: Synthetic oligonucleotide
accccaccagtgcaggctgcctatca

SEQ ID NO: 190792 - DNA, 25 bp, Artificial Sequence
  Description of Artificial Sequence: Synthetic oligonucleotide
ccccaccagtgcaggctgcctatca

SEQ ID NO: 190793 - DNA, 27 bp, Artificial Sequence
  Description of Artificial Sequence: Synthetic oligonucleotide
cccaccagtgcaggctgcctatcagaa

SEQ ID NO: 190794 - DNA, 28 bp, Artificial Sequence
  Description of Artificial Sequence: Synthetic oligonucleotide
ccaccagtgcaggctgcctatcagaaag

SEQ ID NO: 190795 - DNA, 29 bp, Artificial Sequence
  Description of Artificial Sequence: Synthetic oligonucleotide
caccagtgcaggctgcctatcagaaagtg

SEQ ID NO: 190796 - DNA, 29 bp, Artificial Sequence
  Description of Artificial Sequence: Synthetic oligonucleotide
accagtgcaggctgcctatcagaaagtgg

SEQ ID NO: 190797 - DNA, 28 bp, Artificial Sequence
  Description of Artificial Sequence: Synthetic oligonucleotide
ccagtgcaggctgcctatcagaaagtgg

SEQ ID NO: 190798 - DNA, 29 bp, Artificial Sequence
  Description of Artificial Sequence: Synthetic oligonucleotide
cagtgcaggctgcctatcagaaagtggtg

SEQ ID NO: 190799 - DNA, 29 bp, Artificial Sequence
  Description of Artificial Sequence: Synthetic oligonucleotide
agtgcaggctgcctatcagaaagtggtgg

SEQ ID NO: 190800 - DNA, 28 bp, Artificial Sequence
  Description of Artificial Sequence: Synthetic oligonucleotide
gtgcaggctgcctatcagaaagtggtgg

SEQ ID NO: 190801 - DNA, 28 bp, Artificial Sequence
  Description of Artificial Sequence: Synthetic oligonucleotide
tgcaggctgcctatcagaaagtggtggc

SEQ ID NO: 190802 - DNA, 27 bp, Artificial Sequence
  Description of Artificial Sequence: Synthetic oligonucleotide
gcaggctgcctatcagaaagtggtggc

SEQ ID NO: 190803 - DNA, 28 bp, Artificial Sequence
  Description of Artificial Sequence: Synthetic oligonucleotide
caggctgcctatcagaaagtggtggctg

SEQ ID NO: 190804 - DNA, 28 bp, Artificial Sequence
  Description of Artificial Sequence: Synthetic oligonucleotide
aggctgcctatcagaaagtggtggctgg

SEQ ID NO: 190805 - DNA, 27 bp, Artificial Sequence
  Description of Artificial Sequence: Synthetic oligonucleotide
ggctgcctatcagaaagtggtggctgg

SEQ ID NO: 190806 - DNA, 28 bp, Artificial Sequence
  Description of Artificial Sequence: Synthetic oligonucleotide
gctgcctatcagaaagtggtggctggtg

SEQ ID NO: 190807 - DNA, 29 bp, Artificial Sequence
  Description of Artificial Sequence: Synthetic oligonucleotide
ctgcctatcagaaagtggtggctggtgtg

SEQ ID NO: 190808 - DNA, 29 bp, Artificial Sequence
  Description of Artificial Sequence: Synthetic oligonucleotide
tgcctatcagaaagtggtggctggtgtgg

SEQ ID NO: 190809 - DNA, 28 bp, Artificial Sequence
  Description of Artificial Sequence: Synthetic oligonucleotide
gcctatcagaaagtggtggctggtgtgg

SEQ ID NO: 190810 - DNA, 28 bp, Artificial Sequence
  Description of Artificial Sequence: Synthetic oligonucleotide
cctatcagaaagtggtggctggtgtggc

SEQ ID NO: 190811 - DNA, 32 bp, Artificial Sequence
  Description of Artificial Sequence: Synthetic oligonucleotide
ctatcagaaagtggtggctggtgtggctaatg

SEQ ID NO: 190812 - DNA, 32 bp, Artificial Sequence
  Description of Artificial Sequence: Synthetic oligonucleotide
tatcagaaagtggtggctggtgtggctaatgc

SEQ ID NO: 190813 - DNA, 31 bp, Artificial Sequence
  Description of Artificial Sequence: Synthetic oligonucleotide
atcagaaagtggtggctggtgtggctaatgc

SEQ ID NO: 190814 - DNA, 30 bp, Artificial Sequence
  Description of Artificial Sequence: Synthetic oligonucleotide
tcagaaagtggtggctggtgtggctaatgc

SEQ ID NO: 190815 - DNA, 29 bp, Artificial Sequence
  Description of Artificial Sequence: Synthetic oligonucleotide
cagaaagtggtggctggtgtggctaatgc

SEQ ID NO: 190816 - DNA, 29 bp, Artificial Sequence
  Description of Artificial Sequence: Synthetic oligonucleotide
agaaagtggtggctggtgtggctaatgcc

SEQ ID NO: 190817 - DNA, 28 bp, Artificial Sequence
  Description of Artificial Sequence: Synthetic oligonucleotide
gaaagtggtggctggtgtggctaatgcc

SEQ ID NO: 190818 - DNA, 28 bp, Artificial Sequence
  Description of Artificial Sequence: Synthetic oligonucleotide
aaagtggtggctggtgtggctaatgccc

SEQ ID NO: 190819 - DNA, 27 bp, Artificial Sequence
  Description of Artificial Sequence: Synthetic oligonucleotide
aagtggtggctggtgtggctaatgccc

SEQ ID NO: 190820 - DNA, 27 bp, Artificial Sequence
  Description of Artificial Sequence: Synthetic oligonucleotide
agtggtggctggtgtggctaatgccct

SEQ ID NO: 190821 - DNA, 26 bp, Artificial Sequence
  Description of Artificial Sequence: Synthetic oligonucleotide
gtggtggctggtgtggctaatgccct

SEQ ID NO: 190822 - DNA, 26 bp, Artificial Sequence
  Description of Artificial Sequence: Synthetic oligonucleotide
tggtggctggtgtggctaatgccctg

SEQ ID NO: 190823 - DNA, 25 bp, Artificial Sequence
  Description of Artificial Sequence: Synthetic oligonucleotide
ggtggctggtgtggctaatgccctg

SEQ ID NO: 190824 - DNA, 25 bp, Artificial Sequence
  Description of Artificial Sequence: Synthetic oligonucleotide
gtggctggtgtggctaatgccctgg

SEQ ID NO: 190825 - DNA, 25 bp, Artificial Sequence
  Description of Artificial Sequence: Synthetic oligonucleotide
tggctggtgtggctaatgccctggc

SEQ ID NO: 190826 - DNA, 24 bp, Artificial Sequence
  Description of Artificial Sequence: Synthetic oligonucleotide
ggctggtgtggctaatgccctggc

SEQ ID NO: 190827 - DNA, 24 bp, Artificial Sequence
  Description of Artificial Sequence: Synthetic oligonucleotide
gctggtgtggctaatgccctggcc

SEQ ID NO: 190828 - DNA, 25 bp, Artificial Sequence
  Description of Artificial Sequence: Synthetic oligonucleotide
ctggtgtggctaatgccctggccca

SEQ ID NO: 190829 - DNA, 27 bp, Artificial Sequence
  Description of Artificial Sequence: Synthetic oligonucleotide
tggtgtggctaatgccctggcccacaa

SEQ ID NO: 190830 - DNA, 26 bp, Artificial Sequence
  Description of Artificial Sequence: Synthetic oligonucleotide
ggtgtggctaatgccctggcccacaa

SEQ ID NO: 190831 - DNA, 27 bp, Artificial Sequence
  Description of Artificial Sequence: Synthetic oligonucleotide
gtgtggctaatgccctggcccacaagt

SEQ ID NO: 190832 - DNA, 29 bp, Artificial Sequence
  Description of Artificial Sequence: Synthetic oligonucleotide
tgtggctaatgccctggcccacaagtatc

SEQ ID NO: 190833 - DNA, 28 bp, Artificial Sequence
  Description of Artificial Sequence: Synthetic oligonucleotide
gtggctaatgccctggcccacaagtatc

SEQ ID NO: 190834 - DNA, 29 bp, Artificial Sequence
  Description of Artificial Sequence: Synthetic oligonucleotide
tggctaatgccctggcccacaagtatcac

SEQ ID NO: 190835 - DNA, 28 bp, Artificial Sequence
  Description of Artificial Sequence: Synthetic oligonucleotide
ggctaatgccctggcccacaagtatcac

SEQ ID NO: 190836 - DNA, 27 bp, Artificial Sequence
  Description of Artificial Sequence: Synthetic oligonucleotide
atggtgctgtctcctgccgacaagacc

SEQ ID NO: 190837 - DNA, 27 bp, Artificial Sequence
  Description of Artificial Sequence: Synthetic oligonucleotide
tggtgctgtctcctgccgacaagacca

SEQ ID NO: 190838 - DNA, 27 bp, Artificial Sequence
  Description of Artificial Sequence: Synthetic oligonucleotide
ggtgctgtctcctgccgacaagaccaa

SEQ ID NO: 190839 - DNA, 27 bp, Artificial Sequence
  Description of Artificial Sequence: Synthetic oligonucleotide
gtgctgtctcctgccgacaagaccaac

SEQ ID NO: 190840 - DNA, 27 bp, Artificial Sequence
  Description of Artificial Sequence: Synthetic oligonucleotide
tgctgtctcctgccgacaagaccaacg

SEQ ID NO: 190841 - DNA, 27 bp, Artificial Sequence
  Description of Artificial Sequence: Synthetic oligonucleotide
gctgtctcctgccgacaagaccaacgt

SEQ ID NO: 190842 - DNA, 27 bp, Artificial Sequence
  Description of Artificial Sequence: Synthetic oligonucleotide
ctgtctcctgccgacaagaccaacgtc

SEQ ID NO: 190843 - DNA, 29 bp, Artificial Sequence
  Description of Artificial Sequence: Synthetic oligonucleotide
tgtctcctgccgacaagaccaacgtcaag

SEQ ID NO: 190844 - DNA, 28 bp, Artificial Sequence
  Description of Artificial Sequence: Synthetic oligonucleotide
gtctcctgccgacaagaccaacgtcaag

SEQ ID NO: 190845 - DNA, 28 bp, Artificial Sequence
  Description of Artificial Sequence: Synthetic oligonucleotide
tctcctgccgacaagaccaacgtcaagg

SEQ ID NO: 190846 - DNA, 27 bp, Artificial Sequence
  Description of Artificial Sequence: Synthetic oligonucleotide
ctcctgccgacaagaccaacgtcaagg

SEQ ID NO: 190847 - DNA, 27 bp, Artificial Sequence
  Description of Artificial Sequence: Synthetic oligonucleotide
tcctgccgacaagaccaacgtcaaggc

SEQ ID NO: 190848 - DNA, 26 bp, Artificial Sequence
  Description of Artificial Sequence: Synthetic oligonucleotide
cctgccgacaagaccaacgtcaaggc

SEQ ID NO: 190849 - DNA, 26 bp, Artificial Sequence
  Description of Artificial Sequence: Synthetic oligonucleotide
ctgccgacaagaccaacgtcaaggcc

SEQ ID NO: 190850 - DNA, 26 bp, Artificial Sequence
  Description of Artificial Sequence: Synthetic oligonucleotide
tgccgacaagaccaacgtcaaggccg

SEQ ID NO: 190851 - DNA, 25 bp, Artificial Sequence
  Description of Artificial Sequence: Synthetic oligonucleotide
gccgacaagaccaacgtcaaggccg

SEQ ID NO: 190852 - DNA, 25 bp, Artificial Sequence
  Description of Artificial Sequence: Synthetic oligonucleotide
ccgacaagaccaacgtcaaggccgc

SEQ ID NO: 190853 - DNA, 26 bp, Artificial Sequence
  Description of Artificial Sequence: Synthetic oligonucleotide
cgacaagaccaacgtcaaggccgcct

SEQ ID NO: 190854 - DNA, 26 bp, Artificial Sequence
  Description of Artificial Sequence: Synthetic oligonucleotide
gacaagaccaacgtcaaggccgcctg

SEQ ID NO: 190855 - DNA, 26 bp, Artificial Sequence
  Description of Artificial Sequence: Synthetic oligonucleotide
acaagaccaacgtcaaggccgcctgg

SEQ ID NO: 190856 - DNA, 25 bp, Artificial Sequence
  Description of Artificial Sequence: Synthetic oligonucleotide
caagaccaacgtcaaggccgcctgg

SEQ ID NO: 190857 - DNA, 25 bp, Artificial Sequence
  Description of Artificial Sequence: Synthetic oligonucleotide
aagaccaacgtcaaggccgcctggg

SEQ ID NO: 190858 - DNA, 24 bp, Artificial Sequence
  Description of Artificial Sequence: Synthetic oligonucleotide
agaccaacgtcaaggccgcctggg

SEQ ID NO: 190859 - DNA, 23 bp, Artificial Sequence
  Description of Artificial Sequence: Synthetic oligonucleotide
gaccaacgtcaaggccgcctggg

SEQ ID NO: 190860 - DNA, 26 bp, Artificial Sequence
  Description of Artificial Sequence: Synthetic oligonucleotide
accaacgtcaaggccgcctggggtaa

SEQ ID NO: 190861 - DNA, 25 bp, Artificial Sequence
  Description of Artificial Sequence: Synthetic oligonucleotide
ccaacgtcaaggccgcctggggtaa

SEQ ID NO: 190862 - DNA, 25 bp, Artificial Sequence
  Description of Artificial Sequence: Synthetic oligonucleotide
caacgtcaaggccgcctggggtaag

SEQ ID NO: 190863 - DNA, 26 bp, Artificial Sequence
  Description of Artificial Sequence: Synthetic oligonucleotide
aacgtcaaggccgcctggggtaaggt

SEQ ID NO: 190864 - DNA, 25 bp, Artificial Sequence
  Description of Artificial Sequence: Synthetic oligonucleotide
acgtcaaggccgcctggggtaaggt

SEQ ID NO: 190865 - DNA, 24 bp, Artificial Sequence
  Description of Artificial Sequence: Synthetic oligonucleotide
cgtcaaggccgcctggggtaaggt

SEQ ID NO: 190866 - DNA, 24 bp, Artificial Sequence
  Description of Artificial Sequence: Synthetic oligonucleotide
gtcaaggccgcctggggtaaggtc

SEQ ID NO: 190867 - DNA, 24 bp, Artificial Sequence
  Description of Artificial Sequence: Synthetic oligonucleotide
tcaaggccgcctggggtaaggtcg

SEQ ID NO: 190868 - DNA, 23 bp, Artificial Sequence
  Description of Artificial Sequence: Synthetic oligonucleotide
caaggccgcctggggtaaggtcg

SEQ ID NO: 190869 - DNA, 23 bp, Artificial Sequence
  Description of Artificial Sequence: Synthetic oligonucleotide
aaggccgcctggggtaaggtcgg

SEQ ID NO: 190870 - DNA, 22 bp, Artificial Sequence
  Description of Artificial Sequence: Synthetic oligonucleotide
aggccgcctggggtaaggtcgg

SEQ ID NO: 190871 - DNA, 21 bp, Artificial Sequence
  Description of Artificial Sequence: Synthetic oligonucleotide
ggccgcctggggtaaggtcgg

SEQ ID NO: 190872 - DNA, 21 bp, Artificial Sequence
  Description of Artificial Sequence: Synthetic oligonucleotide
gccgcctggggtaaggtcggc

SEQ ID NO: 190873 - DNA, 21 bp, Artificial Sequence
  Description of Artificial Sequence: Synthetic oligonucleotide
ccgcctggggtaaggtcggcg

SEQ ID NO: 190874 - DNA, 21 bp, Artificial Sequence
  Description of Artificial Sequence: Synthetic oligonucleotide
cgcctggggtaaggtcggcgc

SEQ ID NO: 190875 - DNA, 21 bp, Artificial Sequence
  Description of Artificial Sequence: Synthetic oligonucleotide
gcctggggtaaggtcggcgcg

SEQ ID NO: 190876 - DNA, 22 bp, Artificial Sequence
  Description of Artificial Sequence: Synthetic oligonucleotide
cctggggtaaggtcggcgcgca

SEQ ID NO: 190877 - DNA, 22 bp, Artificial Sequence
  Description of Artificial Sequence: Synthetic oligonucleotide
ctggggtaaggtcggcgcgcac

SEQ ID NO: 190878 - DNA, 22 bp, Artificial Sequence
  Description of Artificial Sequence: Synthetic oligonucleotide
tggggtaaggtcggcgcgcacg

SEQ ID NO: 190879 - DNA, 21 bp, Artificial Sequence
  Description of Artificial Sequence: Synthetic oligonucleotide
ggggtaaggtcggcgcgcacg

SEQ ID NO: 190880 - DNA, 22 bp, Artificial Sequence
  Description of Artificial Sequence: Synthetic oligonucleotide
gggtaaggtcggcgcgcacgct

SEQ ID NO: 190881 - DNA, 22 bp, Artificial Sequence
  Description of Artificial Sequence: Synthetic oligonucleotide
ggtaaggtcggcgcgcacgctg

SEQ ID NO: 190882 - DNA, 22 bp, Artificial Sequence
  Description of Artificial Sequence: Synthetic oligonucleotide
gtaaggtcggcgcgcacgctgg

SEQ ID NO: 190883 - DNA, 22 bp, Artificial Sequence
  Description of Artificial Sequence: Synthetic oligonucleotide
taaggtcggcgcgcacgctggc

SEQ ID NO: 190884 - DNA, 21 bp, Artificial Sequence
  Description of Artificial Sequence: Synthetic oligonucleotide
aaggtcggcgcgcacgctggc

SEQ ID NO: 190885 - DNA, 20 bp, Artificial Sequence
  Description of Artificial Sequence: Synthetic oligonucleotide
aggtcggcgcgcacgctggc

SEQ ID NO: 190886 - DNA, 20 bp, Artificial Sequence
  Description of Artificial Sequence: Synthetic oligonucleotide
ggtcggcgcgcacgctggct

SEQ ID NO: 190887 - DNA, 20 bp, Artificial Sequence
  Description of Artificial Sequence: Synthetic oligonucleotide
gtcggcgcgcacgctggcga

SEQ ID NO: 190888 - DNA, 23 bp, Artificial Sequence
  Description of Artificial Sequence: Synthetic oligonucleotide
tcggcgcgcacgctggcgagtat

SEQ ID NO: 190889 - DNA, 22 bp, Artificial Sequence
  Description of Artificial Sequence: Synthetic oligonucleotide
cggcgcgcacgctggcgagtat

SEQ ID NO: 190890 - DNA, 22 bp, Artificial Sequence
  Description of Artificial Sequence: Synthetic oligonucleotide
ggcgcgcacgctggcgagtatg

SEQ ID NO: 190891 - DNA, 23 bp, Artificial Sequence
  Description of Artificial Sequence: Synthetic oligonucleotide
gcgcgcacgctggcgagtatggt

SEQ ID NO: 190892 - DNA, 23 bp, Artificial Sequence
  Description of Artificial Sequence: Synthetic oligonucleotide
cgcgcacgctggcgagtatggtg

SEQ ID NO: 190893 - DNA, 23 bp, Artificial Sequence
  Description of Artificial Sequence: Synthetic oligonucleotide
gcgcacgctggcgagtatggtgc

SEQ ID NO: 190894 - DNA, 23 bp, Artificial Sequence
  Description of Artificial Sequence: Synthetic oligonucleotide
cgcacgctggcgagtatggtgcg

SEQ ID NO: 190895 - DNA, 24 bp, Artificial Sequence
  Description of Artificial Sequence: Synthetic oligonucleotide
gcacgctggcgagtatggtgcgga

SEQ ID NO: 190896 - DNA, 24 bp, Artificial Sequence
  Description of Artificial Sequence: Synthetic oligonucleotide
cacgctggcgagtatggtgcggag

SEQ ID NO: 190897 - DNA, 24 bp, Artificial Sequence
  Description of Artificial Sequence: Synthetic oligonucleotide
acgctggcgagtatggtgcggagg

SEQ ID NO: 190898 - DNA, 23 bp, Artificial Sequence
  Description of Artificial Sequence: Synthetic oligonucleotide
cgctggcgagtatggtgcggagg

SEQ ID NO: 190899 - DNA, 23 bp, Artificial Sequence
  Description of Artificial Sequence: Synthetic oligonucleotide
gctggcgagtatggtgcggaggc

SEQ ID NO: 190900 - DNA, 23 bp, Artificial Sequence
  Description of Artificial Sequence: Synthetic oligonucleotide
ctggcgagtatggtgcggaggcc

SEQ ID NO: 190901 - DNA, 24 bp, Artificial Sequence
  Description of Artificial Sequence: Synthetic oligonucleotide
tggcgagtatggtgcggaggccct

SEQ ID NO: 190902 - DNA, 23 bp, Artificial Sequence
  Description of Artificial Sequence: Synthetic oligonucleotide
ggcgagtatggtgcggaggccct

SEQ ID NO: 190903 - DNA, 23 bp, Artificial Sequence
  Description of Artificial Sequence: Synthetic oligonucleotide
gcgagtatggtgcggaggccctg

SEQ ID NO: 190904 - DNA, 24 bp, Artificial Sequence
  Description of Artificial Sequence: Synthetic oligonucleotide
cgagtatggtgcggaggccctgga

SEQ ID NO: 190905 - DNA, 25 bp, Artificial Sequence
  Description of Artificial Sequence: Synthetic oligonucleotide
gagtatggtgcggaggccctggaga

SEQ ID NO: 190906 - DNA, 25 bp, Artificial Sequence
  Description of Artificial Sequence: Synthetic oligonucleotide
agtatggtgcggaggccctggagag

SEQ ID NO: 190907 - DNA, 24 bp, Artificial Sequence
  Description of Artificial Sequence: Synthetic oligonucleotide
gtatggtgcggaggccctggagag

SEQ ID NO: 190908 - DNA, 26 bp, Artificial Sequence
  Description of Artificial Sequence: Synthetic oligonucleotide
tatggtgcggaggccctggagaggat

SEQ ID NO: 190909 - DNA, 25 bp, Artificial Sequence
  Description of Artificial Sequence: Synthetic oligonucleotide
atggtgcggaggccctggagaggat

SEQ ID NO: 190910 - DNA, 24 bp, Artificial Sequence
  Description of Artificial Sequence: Synthetic oligonucleotide
tggtgcggaggccctggagaggat

SEQ ID NO: 190911 - DNA, 23 bp, Artificial Sequence
  Description of Artificial Sequence: Synthetic oligonucleotide
ggtgcggaggccctggagaggat

SEQ ID NO: 190912 - DNA, 25 bp, Artificial Sequence
  Description of Artificial Sequence: Synthetic oligonucleotide
gtgcggaggccctggagaggatgtt

SEQ ID NO: 190913 - DNA, 25 bp, Artificial Sequence
  Description of Artificial Sequence: Synthetic oligonucleotide
tgcggaggccctggagaggatgttc

SEQ ID NO: 190914 - DNA, 24 bp, Artificial Sequence
  Description of Artificial Sequence: Synthetic oligonucleotide
gcggaggccctggagaggatgttc

SEQ ID NO: 190915 - DNA, 25 bp, Artificial Sequence
  Description of Artificial Sequence: Synthetic oligonucleotide
cggaggccctggagaggatgttcct

SEQ ID NO: 190916 - DNA, 26 bp, Artificial Sequence
  Description of Artificial Sequence: Synthetic oligonucleotide
ggaggccctggagaggatgttcctgt

SEQ ID NO: 190917 - DNA, 26 bp, Artificial Sequence
  Description of Artificial Sequence: Synthetic oligonucleotide
gaggccctggagaggatgttcctgtc

SEQ ID NO: 190918 - DNA, 27 bp, Artificial Sequence
  Description of Artificial Sequence: Synthetic oligonucleotide
aggccctggagaggatgttcctgtcct

SEQ ID NO: 190919 - DNA, 27 bp, Artificial Sequence
  Description of Artificial Sequence: Synthetic oligonucleotide
ggccctggagaggatgttcctgtcctt

SEQ ID NO: 190920 - DNA, 27 bp, Artificial Sequence
  Description of Artificial Sequence: Synthetic oligonucleotide
gccctggagaggatgttcctgtccttc

SEQ ID NO: 190921 - DNA, 27 bp, Artificial Sequence
  Description of Artificial Sequence: Synthetic oligonucleotide
ccctggagaggatgttcctgtccttcc

SEQ ID NO: 190922 - DNA, 27 bp, Artificial Sequence
  Description of Artificial Sequence: Synthetic oligonucleotide
cctggagaggatgttcctgtccttccc

SEQ ID NO: 190923 - DNA, 27 bp, Artificial Sequence
  Description of Artificial Sequence: Synthetic oligonucleotide
ctggagaggatgttcctgtccttcccc

SEQ ID NO: 190924 - DNA, 28 bp, Artificial Sequence
  Description of Artificial Sequence: Synthetic oligonucleotide
tggagaggatgttcctgtccttccccac

SEQ ID NO: 190925 - DNA, 27 bp, Artificial Sequence
  Description of Artificial Sequence: Synthetic oligonucleotide
ggagaggatgttcctgtccttccccac

SEQ ID NO: 190926 - DNA, 27 bp, Artificial Sequence
  Description of Artificial Sequence: Synthetic oligonucleotide
gagaggatgttcctgtccttccccacc

SEQ ID NO: 190927 - DNA, 28 bp, Artificial Sequence
  Description of Artificial Sequence: Synthetic oligonucleotide
agaggatgttcctgtccttccccaccac

SEQ ID NO: 190928 - DNA, 27 bp, Artificial Sequence
  Description of Artificial Sequence: Synthetic oligonucleotide
gaggatgttcctgtccttccccaccac

SEQ ID NO: 190929 - DNA, 27 bp, Artificial Sequence
  Description of Artificial Sequence: Synthetic oligonucleotide
aggatgttcctgtccttccccaccacc

SEQ ID NO: 190930 - DNA, 27 bp, Artificial Sequence
  Description of Artificial Sequence: Synthetic oligonucleotide
ggatgttcctgtccttccccaccacca

SEQ ID NO: 190931 - DNA, 28 bp, Artificial Sequence
  Description of Artificial Sequence: Synthetic oligonucleotide
gatgttcctgtccttccccaccaccaag

SEQ ID NO: 190932 - DNA, 29 bp, Artificial Sequence
  Description of Artificial Sequence: Synthetic oligonucleotide
atgttcctgtccttccccaccaccaagac

SEQ ID NO: 190933 - DNA, 28 bp, Artificial Sequence
  Description of Artificial Sequence: Synthetic oligonucleotide
tgttcctgtccttccccaccaccaagac

SEQ ID NO: 190934 - DNA, 27 bp, Artificial Sequence
  Description of Artificial Sequence: Synthetic oligonucleotide
gttcctgtccttccccaccaccaagac

SEQ ID NO: 190935 - DNA, 27 bp, Artificial Sequence
  Description of Artificial Sequence: Synthetic oligonucleotide
ttcctgtccttccccaccaccaagacc

SEQ ID NO: 190936 - DNA, 27 bp, Artificial Sequence
  Description of Artificial Sequence: Synthetic oligonucleotide
tcctgtccttccccaccaccaagacct

SEQ ID NO: 190937 - DNA, 27 bp, Artificial Sequence
  Description of Artificial Sequence: Synthetic oligonucleotide
cctgtccttccccaccaccaagaccta

SEQ ID NO: 190938 - DNA, 27 bp, Artificial Sequence
  Description of Artificial Sequence: Synthetic oligonucleotide
ctgtccttccccaccaccaagacctac

SEQ ID NO: 190939 - DNA, 29 bp, Artificial Sequence
  Description of Artificial Sequence: Synthetic oligonucleotide
tgtccttccccaccaccaagacctacttc

SEQ ID NO: 190940 - DNA, 28 bp, Artificial Sequence
  Description of Artificial Sequence: Synthetic oligonucleotide
gtccttccccaccaccaagacctacttc

SEQ ID NO: 190941 - DNA, 28 bp, Artificial Sequence
  Description of Artificial Sequence: Synthetic oligonucleotide
tccttccccaccaccaagacctacttcc

SEQ ID NO: 190942 - DNA, 27 bp, Artificial Sequence
  Description of Artificial Sequence: Synthetic oligonucleotide
ccttccccaccaccaagacctacttcc

SEQ ID NO: 190943 - DNA, 27 bp, Artificial Sequence
  Description of Artificial Sequence: Synthetic oligonucleotide
cttccccaccaccaagacctacttccc

SEQ ID NO: 190944 - DNA, 27 bp, Artificial Sequence
  Description of Artificial Sequence: Synthetic oligonucleotide
ttccccaccaccaagacctacttcccg

SEQ ID NO: 190945 - DNA, 26 bp, Artificial Sequence
  Description of Artificial Sequence: Synthetic oligonucleotide
tccccaccaccaagacctacttcccg

SEQ ID NO: 190946 - DNA, 25 bp, Artificial Sequence
  Description of Artificial Sequence: Synthetic oligonucleotide
ccccaccaccaagacctacttcccg

SEQ ID NO: 190947 - DNA, 26 bp, Artificial Sequence
  Description of Artificial Sequence: Synthetic oligonucleotide
cccaccaccaagacctacttcccgca

SEQ ID NO: 190948 - DNA, 27 bp, Artificial Sequence
  Description of Artificial Sequence: Synthetic oligonucleotide
ccaccaccaagacctacttcccgcact

SEQ ID NO: 190949 - DNA, 28 bp, Artificial Sequence
  Description of Artificial Sequence: Synthetic oligonucleotide
caccaccaagacctacttcccgcacttc

SEQ ID NO: 190950 - DNA, 28 bp, Artificial Sequence
  Description of Artificial Sequence: Synthetic oligonucleotide
accaccaagacctacttcccgcacttcg

SEQ ID NO: 190951 - DNA, 27 bp, Artificial Sequence
  Description of Artificial Sequence: Synthetic oligonucleotide
ccaccaagacctacttcccgcacttcg

SEQ ID NO: 190952 - DNA, 28 bp, Artificial Sequence
  Description of Artificial Sequence: Synthetic oligonucleotide
caccaagacctacttcccgcacttcgac

SEQ ID NO: 190953 - DNA, 28 bp, Artificial Sequence
  Description of Artificial Sequence: Synthetic oligonucleotide
accaagacctacttcccgcacttcgacc

SEQ ID NO: 190954 - DNA, 27 bp, Artificial Sequence
  Description of Artificial Sequence: Synthetic oligonucleotide
ccaagacctacttcccgcacttcgacc

SEQ ID NO: 190955 - DNA, 28 bp, Artificial Sequence
  Description of Artificial Sequence: Synthetic oligonucleotide
caagacctacttcccgcacttcgacctg

SEQ ID NO: 190956 - DNA, 29 bp, Artificial Sequence
  Description of Artificial Sequence: Synthetic oligonucleotide
aagacctacttcccgcacttcgacctgag

SEQ ID NO: 190957 - DNA, 28 bp, Artificial Sequence
  Description of Artificial Sequence: Synthetic oligonucleotide
agacctacttcccgcacttcgacctgag

SEQ ID NO: 190958 - DNA, 27 bp, Artificial Sequence
  Description of Artificial Sequence: Synthetic oligonucleotide
gacctacttcccgcacttcgacctgag

SEQ ID NO: 190959 - DNA, 27 bp, Artificial Sequence
  Description of Artificial Sequence: Synthetic oligonucleotide
acctacttcccgcacttcgacctgagc

SEQ ID NO: 190960 - DNA, 26 bp, Artificial Sequence
  Description of Artificial Sequence: Synthetic oligonucleotide
cctacttcccgcacttcgacctgagc

SEQ ID NO: 190961 - DNA, 27 bp, Artificial Sequence
  Description of Artificial Sequence: Synthetic oligonucleotide
ctacttcccgcacttcgacctgagcca

SEQ ID NO: 190962 - DNA, 27 bp, Artificial Sequence
  Description of Artificial Sequence: Synthetic oligonucleotide
tacttcccgcacttcgacctgagccac

SEQ ID NO: 190963 - DNA, 26 bp, Artificial Sequence
  Description of Artificial Sequence: Synthetic oligonucleotide
acttcccgcacttcgacctgagccac

SEQ ID NO: 190964 - DNA, 25 bp, Artificial Sequence
  Description of Artificial Sequence: Synthetic oligonucleotide
cttcccgcacttcgacctgagccac

SEQ ID NO: 190965 - DNA, 25 bp, Artificial Sequence
  Description of Artificial Sequence: Synthetic oligonucleotide
ttcccgcacttcgacctgagccacg

SEQ ID NO: 190966 - DNA, 24 bp, Artificial Sequence
  Description of Artificial Sequence: Synthetic oligonucleotide
tcccgcacttcgacctgagccacg

SEQ ID NO: 190967 - DNA, 23 bp, Artificial Sequence
  Description of Artificial Sequence: Synthetic oligonucleotide
cccgcacttcgacctgagccacg

SEQ ID NO: 190968 - DNA, 23 bp, Artificial Sequence
  Description of Artificial Sequence: Synthetic oligonucleotide
ccgcacttcgacctgagccacgg

SEQ ID NO: 190969 - DNA, 24 bp, Artificial Sequence
  Description of Artificial Sequence: Synthetic oligonucleotide
cgcacttcgacctgagccacggct

SEQ ID NO: 190970 - DNA, 25 bp, Artificial Sequence
  Description of Artificial Sequence: Synthetic oligonucleotide
gcacttcgacctgagccacggctct

SEQ ID NO: 190971 - DNA, 25 bp, Artificial Sequence
  Description of Artificial Sequence: Synthetic oligonucleotide
cacttcgacctgagccacggctctg

SEQ ID NO: 190972 - DNA, 25 bp, Artificial Sequence
  Description of Artificial Sequence: Synthetic oligonucleotide
acttcgacctgagccacggctctgc

SEQ ID NO: 190973 - DNA, 24 bp, Artificial Sequence
  Description of Artificial Sequence: Synthetic oligonucleotide
cttcgacctgagccacggctctgc

SEQ ID NO: 190974 - DNA, 24 bp, Artificial Sequence
  Description of Artificial Sequence: Synthetic oligonucleotide
ttcgacctgagccacggctctgcc

SEQ ID NO: 190975 - DNA, 23 bp, Artificial Sequence
  Description of Artificial Sequence: Synthetic oligonucleotide
tcgacctgagccacggctctgcc

SEQ ID NO: 190976 - DNA, 22 bp, Artificial Sequence
  Description of Artificial Sequence: Synthetic oligonucleotide
cgacctgagccacggctctgcc

SEQ ID NO: 190977 - DNA, 23 bp, Artificial Sequence
  Description of Artificial Sequence: Synthetic oligonucleotide
gacctgagccacggctctgccca

SEQ ID NO: 190978 - DNA, 23 bp, Artificial Sequence
  Description of Artificial Sequence: Synthetic oligonucleotide
acctgagccacggctctgcccag

SEQ ID NO: 190979 - DNA, 22 bp, Artificial Sequence
  Description of Artificial Sequence: Synthetic oligonucleotide
cctgagccacggctctgcccag

SEQ ID NO: 190980 - DNA, 26 bp, Artificial Sequence
  Description of Artificial Sequence: Synthetic oligonucleotide
ctgagccacggctctgcccaggttaa

SEQ ID NO: 190981 - DNA, 26 bp, Artificial Sequence
  Description of Artificial Sequence: Synthetic oligonucleotide
tgagccacggctctgcccaggttaag

SEQ ID NO: 190982 - DNA, 25 bp, Artificial Sequence
  Description of Artificial Sequence: Synthetic oligonucleotide
gagccacggctctgcccaggttaag

SEQ ID NO: 190983 - DNA, 25 bp, Artificial Sequence
  Description of Artificial Sequence: Synthetic oligonucleotide
agccacggctctgcccaggttaagg

SEQ ID NO: 190984 - DNA, 24 bp, Artificial Sequence
  Description of Artificial Sequence: Synthetic oligonucleotide
gccacggctctgcccaggttaagg

SEQ ID NO: 190985 - DNA, 24 bp, Artificial Sequence
  Description of Artificial Sequence: Synthetic oligonucleotide
ccacggctctgcccaggttaaggg

SEQ ID NO: 190986 - DNA, 24 bp, Artificial Sequence
  Description of Artificial Sequence: Synthetic oligonucleotide
cacggctctgcccaggttaagggc

SEQ ID NO: 190987 - DNA, 25 bp, Artificial Sequence
  Description of Artificial Sequence: Synthetic oligonucleotide
acggctctgcccaggttaagggcca

SEQ ID NO: 190988 - DNA, 24 bp, Artificial Sequence
  Description of Artificial Sequence: Synthetic oligonucleotide
cggctctgcccaggttaagggcca

SEQ ID NO: 190989 - DNA, 24 bp, Artificial Sequence
  Description of Artificial Sequence: Synthetic oligonucleotide
ggctctgcccaggttaagggccac

SEQ ID NO: 190990 - DNA, 24 bp, Artificial Sequence
  Description of Artificial Sequence: Synthetic oligonucleotide
gctctgcccaggttaagggccacg

SEQ ID NO: 190991 - DNA, 24 bp, Artificial Sequence
  Description of Artificial Sequence: Synthetic oligonucleotide
ctctgcccaggttaagggccacgg

SEQ ID NO: 190992 - DNA, 26 bp, Artificial Sequence
  Description of Artificial Sequence: Synthetic oligonucleotide
tctgcccaggttaagggccacggcaa

SEQ ID NO: 190993 - DNA, 25 bp, Artificial Sequence
  Description of Artificial Sequence: Synthetic oligonucleotide
ctgcccaggttaagggccacggcaa

SEQ ID NO: 190994 - DNA, 27 bp, Artificial Sequence
  Description of Artificial Sequence: Synthetic oligonucleotide
tgcccaggttaagggccacggcaagaa

SEQ ID NO: 190995 - DNA, 26 bp, Artificial Sequence
  Description of Artificial Sequence: Synthetic oligonucleotide
gcccaggttaagggccacggcaagaa

SEQ ID NO: 190996 - DNA, 26 bp, Artificial Sequence
  Description of Artificial Sequence: Synthetic oligonucleotide
cccaggttaagggccacggcaagaag

SEQ ID NO: 190997 - DNA, 27 bp, Artificial Sequence
  Description of Artificial Sequence: Synthetic oligonucleotide
ccaggttaagggccacggcaagaaggt

SEQ ID NO: 190998 - DNA, 27 bp, Artificial Sequence
  Description of Artificial Sequence: Synthetic oligonucleotide
caggttaagggccacggcaagaaggtg

SEQ ID NO: 190999 - DNA, 27 bp, Artificial Sequence
  Description of Artificial Sequence: Synthetic oligonucleotide
aggttaagggccacggcaagaaggtgg

SEQ ID NO: 191000 - DNA, 26 bp, Artificial Sequence
  Description of Artificial Sequence: Synthetic oligonucleotide
ggttaagggccacggcaagaaggtgg

SEQ ID NO: 191001 - DNA, 26 bp, Artificial Sequence
  Description of Artificial Sequence: Synthetic oligonucleotide
gttaagggccacggcaagaaggtggc

SEQ ID NO: 191002 - DNA, 26 bp, Artificial Sequence
  Description of Artificial Sequence: Synthetic oligonucleotide
ttaagggccacggcaagaaggtggcc

SEQ ID NO: 191003 - DNA, 25 bp, Artificial Sequence
  Description of Artificial Sequence: Synthetic oligonucleotide
taagggccacggcaagaaggtggcc

SEQ ID NO: 191004 - DNA, 24 bp, Artificial Sequence
  Description of Artificial Sequence: Synthetic oligonucleotide
aagggccacggcaagaaggtggcc

SEQ ID NO: 191005 - DNA, 23 bp, Artificial Sequence
  Description of Artificial Sequence: Synthetic oligonucleotide
agggccacggcaagaaggtggcc

SEQ ID NO: 191006 - DNA, 22 bp, Artificial Sequence
  Description of Artificial Sequence: Synthetic oligonucleotide
gggccacggcaagaaggtggcc

SEQ ID NO: 191007 - DNA, 23 bp, Artificial Sequence
  Description of Artificial Sequence: Synthetic oligonucleotide
ggccacggcaagaaggtggccga

SEQ ID NO: 191008 - DNA, 23 bp, Artificial Sequence
  Description of Artificial Sequence: Synthetic oligonucleotide
gccacggcaagaaggtggccgac

SEQ ID NO: 191009 - DNA, 23 bp, Artificial Sequence
  Description of Artificial Sequence: Synthetic oligonucleotide
ccacggcaagaaggtggccgacg

SEQ ID NO: 191010 - DNA, 23 bp, Artificial Sequence
  Description of Artificial Sequence: Synthetic oligonucleotide
cacggcaagaaggtggccgacgc

SEQ ID NO: 191011 - DNA, 23 bp, Artificial Sequence
  Description of Artificial Sequence: Synthetic oligonucleotide
acggcaagaaggtggccgacgcg

SEQ ID NO: 191012 - DNA, 22 bp, Artificial Sequence
  Description of Artificial Sequence: Synthetic oligonucleotide
cggcaagaaggtggccgacgcg

SEQ ID NO: 191013 - DNA, 23 bp, Artificial Sequence
  Description of Artificial Sequence: Synthetic oligonucleotide
ggcaagaaggtggccgacgcgct

SEQ ID NO: 191014 - DNA, 24 bp, Artificial Sequence
  Description of Artificial Sequence: Synthetic oligonucleotide
gcaagaaggtggccgacgcgctga

SEQ ID NO: 191015 - DNA, 24 bp, Artificial Sequence
  Description of Artificial Sequence: Synthetic oligonucleotide
caagaaggtggccgacgcgctgac

SEQ ID NO: 191016 - DNA, 26 bp, Artificial Sequence
  Description of Artificial Sequence: Synthetic oligonucleotide
aagaaggtggccgacgcgctgaccaa

SEQ ID NO: 191017 - DNA, 25 bp, Artificial Sequence
  Description of Artificial Sequence: Synthetic oligonucleotide
agaaggtggccgacgcgctgaccaa

SEQ ID NO: 191018 - DNA, 24 bp, Artificial Sequence
  Description of Artificial Sequence: Synthetic oligonucleotide
gaaggtggccgacgcgctgaccaa

SEQ ID NO: 191019 - DNA, 24 bp, Artificial Sequence
  Description of Artificial Sequence: Synthetic oligonucleotide
aaggtggccgacgcgctgaccaac

SEQ ID NO: 191020 - DNA, 23 bp, Artificial Sequence
  Description of Artificial Sequence: Synthetic oligonucleotide
aggtggccgacgcgctgaccaac

SEQ ID NO: 191021 - DNA, 22 bp, Artificial Sequence
  Description of Artificial Sequence: Synthetic oligonucleotide
ggtggccgacgcgctgaccaac

SEQ ID NO: 191022 - DNA, 22 bp, Artificial Sequence
  Description of Artificial Sequence: Synthetic oligonucleotide
gtggccgacgcgctgaccaacg

SEQ ID NO: 191023 - DNA, 22 bp, Artificial Sequence
  Description of Artificial Sequence: Synthetic oligonucleotide
tggccgacgcgctgaccaacgc

SEQ ID NO: 191024 - DNA, 21 bp, Artificial Sequence
  Description of Artificial Sequence: Synthetic oligonucleotide
ggccgacgcgctgaccaacgc

SEQ ID NO: 191025 - DNA, 21 bp, Artificial Sequence
  Description of Artificial Sequence: Synthetic oligonucleotide
gccgacgcgctgaccaacgcc

SEQ ID NO: 191026 - DNA, 22 bp, Artificial Sequence
  Description of Artificial Sequence: Synthetic oligonucleotide
ccgacgcgctgaccaacgccgt

SEQ ID NO: 191027 - DNA, 22 bp, Artificial Sequence
  Description of Artificial Sequence: Synthetic oligonucleotide
cgacgcgctgaccaacgccgtg

SEQ ID NO: 191028 - DNA, 22 bp, Artificial Sequence
  Description of Artificial Sequence: Synthetic oligonucleotide
gacgcgctgaccaacgccgtgg

SEQ ID NO: 191029 - DNA, 22 bp, Artificial Sequence
  Description of Artificial Sequence: Synthetic oligonucleotide
acgcgctgaccaacgccgtggc

SEQ ID NO: 191030 - DNA, 21 bp, Artificial Sequence
  Description of Artificial Sequence: Synthetic oligonucleotide
cgcgctgaccaacgccgtggc

SEQ ID NO: 191031 - DNA, 21 bp, Artificial Sequence
  Description of Artificial Sequence: Synthetic oligonucleotide
gcgctgaccaacgccgtggcg

SEQ ID NO: 191032 - DNA, 22 bp, Artificial Sequence
  Description of Artificial Sequence: Synthetic oligonucleotide
cgctgaccaacgccgtggcgca

SEQ ID NO: 191033 - DNA, 22 bp, Artificial Sequence
  Description of Artificial Sequence: Synthetic oligonucleotide
gctgaccaacgccgtggcgcac

SEQ ID NO: 191034 - DNA, 23 bp, Artificial Sequence
  Description of Artificial Sequence: Synthetic oligonucleotide
ctgaccaacgccgtggcgcacgt

SEQ ID NO: 191035 - DNA, 23 bp, Artificial Sequence
  Description of Artificial Sequence: Synthetic oligonucleotide
tgaccaacgccgtggcgcacgtg

SEQ ID NO: 191036 - DNA, 22 bp, Artificial Sequence
  Description of Artificial Sequence: Synthetic oligonucleotide
gaccaacgccgtggcgcacgtg

SEQ ID NO: 191037 - DNA, 23 bp, Artificial Sequence
  Description of Artificial Sequence: Synthetic oligonucleotide
accaacgccgtggcgcacgtgga

SEQ ID NO: 191038 - DNA, 22 bp, Artificial Sequence
  Description of Artificial Sequence: Synthetic oligonucleotide
ccaacgccgtggcgcacgtgga

SEQ ID NO: 191039 - DNA, 22 bp, Artificial Sequence
  Description of Artificial Sequence: Synthetic oligonucleotide
caacgccgtggcgcacgtggac

SEQ ID NO: 191040 - DNA, 23 bp, Artificial Sequence
  Description of Artificial Sequence: Synthetic oligonucleotide
aacgccgtggcgcacgtggacga

SEQ ID NO: 191041 - DNA, 22 bp, Artificial Sequence
  Description of Artificial Sequence: Synthetic oligonucleotide
acgccgtggcgcacgtggacga

SEQ ID NO: 191042 - DNA, 21 bp, Artificial Sequence
  Description of Artificial Sequence: Synthetic oligonucleotide
cgccgtggcgcacgtggacga

SEQ ID NO: 191043 - DNA, 23 bp, Artificial Sequence
  Description of Artificial Sequence: Synthetic oligonucleotide
gccgtggcgcacgtggacgacat

SEQ ID NO: 191044 - DNA, 23 bp, Artificial Sequence
  Description of Artificial Sequence: Synthetic oligonucleotide
ccgtggcgcacgtggacgacatg

SEQ ID NO: 191045 - DNA, 23 bp, Artificial Sequence
  Description of Artificial Sequence: Synthetic oligonucleotide
cgtggcgcacgtggacgacatgc

SEQ ID NO: 191046 - DNA, 23 bp, Artificial Sequence
  Description of Artificial Sequence: Synthetic oligonucleotide
gtggcgcacgtggacgacatgcc

SEQ ID NO: 191047 - DNA, 25 bp, Artificial Sequence
  Description of Artificial Sequence: Synthetic oligonucleotide
tggcgcacgtggacgacatgcccaa

SEQ ID NO: 191048 - DNA, 24 bp, Artificial Sequence
  Description of Artificial Sequence: Synthetic oligonucleotide
ggcgcacgtggacgacatgcccaa

SEQ ID NO: 191049 - DNA, 24 bp, Artificial Sequence
  Description of Artificial Sequence: Synthetic oligonucleotide
gcgcacgtggacgacatgcccaac

SEQ ID NO: 191050 - DNA, 24 bp, Artificial Sequence
  Description of Artificial Sequence: Synthetic oligonucleotide
cgcacgtggacgacatgcccaacg

SEQ ID NO: 191051 - DNA, 24 bp, Artificial Sequence
  Description of Artificial Sequence: Synthetic oligonucleotide
gcacgtggacgacatgcccaacgc

SEQ ID NO: 191052 - DNA, 24 bp, Artificial Sequence
  Description of Artificial Sequence: Synthetic oligonucleotide
cacgtggacgacatgcccaacgcg

SEQ ID NO: 191053 - DNA, 25 bp, Artificial Sequence
  Description of Artificial Sequence: Synthetic oligonucleotide
acgtggacgacatgcccaacgcgct

SEQ ID NO: 191054 - DNA, 24 bp, Artificial Sequence
  Description of Artificial Sequence: Synthetic oligonucleotide
cgtggacgacatgcccaacgcgct

SEQ ID NO: 191055 - DNA, 25 bp, Artificial Sequence
  Description of Artificial Sequence: Synthetic oligonucleotide
gtggacgacatgcccaacgcgctgt

SEQ ID NO: 191056 - DNA, 25 bp, Artificial Sequence
  Description of Artificial Sequence: Synthetic oligonucleotide
tggacgacatgcccaacgcgctgtc

SEQ ID NO: 191057 - DNA, 24 bp, Artificial Sequence
  Description of Artificial Sequence: Synthetic oligonucleotide
ggacgacatgcccaacgcgctgtc

SEQ ID NO: 191058 - DNA, 24 bp, Artificial Sequence
  Description of Artificial Sequence: Synthetic oligonucleotide
gacgacatgcccaacgcgctgtcc

SEQ ID NO: 191059 - DNA, 24 bp, Artificial Sequence
  Description of Artificial Sequence: Synthetic oligonucleotide
acgacatgcccaacgcgctgtccg

SEQ ID NO: 191060 - DNA, 23 bp, Artificial Sequence
  Description of Artificial Sequence: Synthetic oligonucleotide
cgacatgcccaacgcgctgtccg

SEQ ID NO: 191061 - DNA, 23 bp, Artificial Sequence
  Description of Artificial Sequence: Synthetic oligonucleotide
gacatgcccaacgcgctgtccgc

SEQ ID NO: 191062 - DNA, 23 bp, Artificial Sequence
  Description of Artificial Sequence: Synthetic oligonucleotide
acatgcccaacgcgctgtccgcc

SEQ ID NO: 191063 - DNA, 22 bp, Artificial Sequence
  Description of Artificial Sequence: Synthetic oligonucleotide
catgcccaacgcgctgtccgcc

SEQ ID NO: 191064 - DNA, 23 bp, Artificial Sequence
  Description of Artificial Sequence: Synthetic oligonucleotide
atgcccaacgcgctgtccgccct

SEQ ID NO: 191065 - DNA, 22 bp, Artificial Sequence
  Description of Artificial Sequence: Synthetic oligonucleotide
tgcccaacgcgctgtccgccct

SEQ ID NO: 191066 - DNA, 21 bp, Artificial Sequence
  Description of Artificial Sequence: Synthetic oligonucleotide
gcccaacgcgctgtccgccct

SEQ ID NO: 191067 - DNA, 22 bp, Artificial Sequence
  Description of Artificial Sequence: Synthetic oligonucleotide
cccaacgcgctgtccgccctga

SEQ ID NO: 191068 - DNA, 22 bp, Artificial Sequence
  Description of Artificial Sequence: Synthetic oligonucleotide
ccaacgcgctgtccgccctgag

SEQ ID NO: 191069 - DNA, 22 bp, Artificial Sequence
  Description of Artificial Sequence: Synthetic oligonucleotide
caacgcgctgtccgccctgagc

SEQ ID NO: 191070 - DNA, 23 bp, Artificial Sequence
  Description of Artificial Sequence: Synthetic oligonucleotide
aacgcgctgtccgccctgagcga

SEQ ID NO: 191071 - DNA, 22 bp, Artificial Sequence
  Description of Artificial Sequence: Synthetic oligonucleotide
acgcgctgtccgccctgagcga

SEQ ID NO: 191072 - DNA, 21 bp, Artificial Sequence
  Description of Artificial Sequence: Synthetic oligonucleotide
cgcgctgtccgccctgagcga

SEQ ID NO: 191073 - DNA, 21 bp, Artificial Sequence
  Description of Artificial Sequence: Synthetic oligonucleotide
gcgctgtccgccctgagcgac

SEQ ID NO: 191074 - DNA, 22 bp, Artificial Sequence
  Description of Artificial Sequence: Synthetic oligonucleotide
cgctgtccgccctgagcgacct

SEQ ID NO: 191075 - DNA, 22 bp, Artificial Sequence
  Description of Artificial Sequence: Synthetic oligonucleotide
gctgtccgccctgagcgacctg

SEQ ID NO: 191076 - DNA, 23 bp, Artificial Sequence
  Description of Artificial Sequence: Synthetic oligonucleotide
ctgtccgccctgagcgacctgca

SEQ ID NO: 191077 - DNA, 23 bp, Artificial Sequence
  Description of Artificial Sequence: Synthetic oligonucleotide
tgtccgccctgagcgacctgcac

SEQ ID NO: 191078 - DNA, 22 bp, Artificial Sequence
  Description of Artificial Sequence: Synthetic oligonucleotide
gtccgccctgagcgacctgcac

SEQ ID NO: 191079 - DNA, 22 bp, Artificial Sequence
  Description of Artificial Sequence: Synthetic oligonucleotide
tccgccctgagcgacctgcacg

SEQ ID NO: 191080 - DNA, 21 bp, Artificial Sequence
  Description of Artificial Sequence: Synthetic oligonucleotide
ccgccctgagcgacctgcacg

SEQ ID NO: 191081 - DNA, 21 bp, Artificial Sequence
  Description of Artificial Sequence: Synthetic oligonucleotide
cgccctgagcgacctgcacgc

SEQ ID NO: 191082 - DNA, 21 bp, Artificial Sequence
  Description of Artificial Sequence: Synthetic oligonucleotide
gccctgagcgacctgcacgcg

SEQ ID NO: 191083 - DNA, 22 bp, Artificial Sequence
  Description of Artificial Sequence: Synthetic oligonucleotide
ccctgagcgacctgcacgcgca

SEQ ID NO: 191084 - DNA, 24 bp, Artificial Sequence
  Description of Artificial Sequence: Synthetic oligonucleotide
cctgagcgacctgcacgcgcacaa

SEQ ID NO: 191085 - DNA, 24 bp, Artificial Sequence
  Description of Artificial Sequence: Synthetic oligonucleotide
ctgagcgacctgcacgcgcacaag

SEQ ID NO: 191086 - DNA, 26 bp, Artificial Sequence
  Description of Artificial Sequence: Synthetic oligonucleotide
tgagcgacctgcacgcgcacaagctt

SEQ ID NO: 191087 - DNA, 25 bp, Artificial Sequence
  Description of Artificial Sequence: Synthetic oligonucleotide
gagcgacctgcacgcgcacaagctt

SEQ ID NO: 191088 - DNA, 25 bp, Artificial Sequence
  Description of Artificial Sequence: Synthetic oligonucleotide
agcgacctgcacgcgcacaagcttc

SEQ ID NO: 191089 - DNA, 24 bp, Artificial Sequence
  Description of Artificial Sequence: Synthetic oligonucleotide
gcgacctgcacgcgcacaagcttc

SEQ ID NO: 191090 - DNA, 24 bp, Artificial Sequence
  Description of Artificial Sequence: Synthetic oligonucleotide
cgacctgcacgcgcacaagcttcg

SEQ ID NO: 191091 - DNA, 24 bp, Artificial Sequence
  Description of Artificial Sequence: Synthetic oligonucleotide
gacctgcacgcgcacaagcttcgg

SEQ ID NO: 191092 - DNA, 25 bp, Artificial Sequence
  Description of Artificial Sequence: Synthetic oligonucleotide
acctgcacgcgcacaagcttcgggt

SEQ ID NO: 191093 - DNA, 24 bp, Artificial Sequence
  Description of Artificial Sequence: Synthetic oligonucleotide
cctgcacgcgcacaagcttcgggt

SEQ ID NO: 191094 - DNA, 24 bp, Artificial Sequence
  Description of Artificial Sequence: Synthetic oligonucleotide
ctgcacgcgcacaagcttcgggtg

SEQ ID NO: 191095 - DNA, 25 bp, Artificial Sequence
  Description of Artificial Sequence: Synthetic oligonucleotide
tgcacgcgcacaagcttcgggtgga

SEQ ID NO: 191096 - DNA, 24 bp, Artificial Sequence
  Description of Artificial Sequence: Synthetic oligonucleotide
gcacgcgcacaagcttcgggtgga

SEQ ID NO: 191097 - DNA, 24 bp, Artificial Sequence
  Description of Artificial Sequence: Synthetic oligonucleotide
cacgcgcacaagcttcgggtggac

SEQ ID NO: 191098 - DNA, 24 bp, Artificial Sequence
  Description of Artificial Sequence: Synthetic oligonucleotide
acgcgcacaagcttcgggtggacc

SEQ ID NO: 191099 - DNA, 23 bp, Artificial Sequence
  Description of Artificial Sequence: Synthetic oligonucleotide
cgcgcacaagcttcgggtggacc

SEQ ID NO: 191100 - DNA, 23 bp, Artificial Sequence
  Description of Artificial Sequence: Synthetic oligonucleotide
gcgcacaagcttcgggtggaccc

SEQ ID NO: 191101 - DNA, 23 bp, Artificial Sequence
  Description of Artificial Sequence: Synthetic oligonucleotide
cgcacaagcttcgggtggacccg

SEQ ID NO: 191102 - DNA, 24 bp, Artificial Sequence
  Description of Artificial Sequence: Synthetic oligonucleotide
gcacaagcttcgggtggacccggt

SEQ ID NO: 191103 - DNA, 26 bp, Artificial Sequence
  Description of Artificial Sequence: Synthetic oligonucleotide
cacaagcttcgggtggacccggtcaa

SEQ ID NO: 191104 - DNA, 27 bp, Artificial Sequence
  Description of Artificial Sequence: Synthetic oligonucleotide
acaagcttcgggtggacccggtcaact

SEQ ID NO: 191105 - DNA, 27 bp, Artificial Sequence
  Description of Artificial Sequence: Synthetic oligonucleotide
caagcttcgggtggacccggtcaactt

SEQ ID NO: 191106 - DNA, 27 bp, Artificial Sequence
  Description of Artificial Sequence: Synthetic oligonucleotide
aagcttcgggtggacccggtcaacttc

SEQ ID NO: 191107 - DNA, 27 bp, Artificial Sequence
  Description of Artificial Sequence: Synthetic oligonucleotide
agcttcgggtggacccggtcaacttca

SEQ ID NO: 191108 - DNA, 27 bp, Artificial Sequence
  Description of Artificial Sequence: Synthetic oligonucleotide
gcttcgggtggacccggtcaacttcaa

SEQ ID NO: 191109 - DNA, 27 bp, Artificial Sequence
  Description of Artificial Sequence: Synthetic oligonucleotide
cttcgggtggacccggtcaacttcaag

SEQ ID NO: 191110 - DNA, 27 bp, Artificial Sequence
  Description of Artificial Sequence: Synthetic oligonucleotide
ttcgggtggacccggtcaacttcaagc

SEQ ID NO: 191111 - DNA, 27 bp, Artificial Sequence
  Description of Artificial Sequence: Synthetic oligonucleotide
tcgggtggacccggtcaacttcaagct

SEQ ID NO: 191112 - DNA, 26 bp, Artificial Sequence
  Description of Artificial Sequence: Synthetic oligonucleotide
cgggtggacccggtcaacttcaagct

SEQ ID NO: 191113 - DNA, 26 bp, Artificial Sequence
  Description of Artificial Sequence: Synthetic oligonucleotide
gggtggacccggtcaacttcaagctc

SEQ ID NO: 191114 - DNA, 27 bp, Artificial Sequence
  Description of Artificial Sequence: Synthetic oligonucleotide
ggtggacccggtcaacttcaagctcct

SEQ ID NO: 191115 - DNA, 29 bp, Artificial Sequence
  Description of Artificial Sequence: Synthetic oligonucleotide
gtggacccggtcaacttcaagctcctaag

SEQ ID NO: 191116 - DNA, 29 bp, Artificial Sequence
  Description of Artificial Sequence: Synthetic oligonucleotide
tggacccggtcaacttcaagctcctaagc

SEQ ID NO: 191117 - DNA, 28 bp, Artificial Sequence
  Description of Artificial Sequence: Synthetic oligonucleotide
ggacccggtcaacttcaagctcctaagc

SEQ ID NO: 191118 - DNA, 28 bp, Artificial Sequence
  Description of Artificial Sequence: Synthetic oligonucleotide
gacccggtcaacttcaagctcctaagcc

SEQ ID NO: 191119 - DNA, 29 bp, Artificial Sequence
  Description of Artificial Sequence: Synthetic oligonucleotide
acccggtcaacttcaagctcctaagccac

SEQ ID NO: 191120 - DNA, 28 bp, Artificial Sequence
  Description of Artificial Sequence: Synthetic oligonucleotide
cccggtcaacttcaagctcctaagccac

SEQ ID NO: 191121 - DNA, 29 bp, Artificial Sequence
  Description of Artificial Sequence: Synthetic oligonucleotide
ccggtcaacttcaagctcctaagccactg

SEQ ID NO: 191122 - DNA, 29 bp, Artificial Sequence
  Description of Artificial Sequence: Synthetic oligonucleotide
cggtcaacttcaagctcctaagccactgc

SEQ ID NO: 191123 - DNA, 29 bp, Artificial Sequence
  Description of Artificial Sequence: Synthetic oligonucleotide
ggtcaacttcaagctcctaagccactgcc

SEQ ID NO: 191124 - DNA, 30 bp, Artificial Sequence
  Description of Artificial Sequence: Synthetic oligonucleotide
gtcaacttcaagctcctaagccactgcctg

SEQ ID NO: 191125 - DNA, 30 bp, Artificial Sequence
  Description of Artificial Sequence: Synthetic oligonucleotide
tcaacttcaagctcctaagccactgcctgc

SEQ ID NO: 191126 - DNA, 29 bp, Artificial Sequence
  Description of Artificial Sequence: Synthetic oligonucleotide
caacttcaagctcctaagccactgcctgc

SEQ ID NO: 191127 - DNA, 30 bp, Artificial Sequence
  Description of Artificial Sequence: Synthetic oligonucleotide
aacttcaagctcctaagccactgcctgctg

SEQ ID NO: 191128 - DNA, 29 bp, Artificial Sequence
  Description of Artificial Sequence: Synthetic oligonucleotide
acttcaagctcctaagccactgcctgctg

SEQ ID NO: 191129 - DNA, 28 bp, Artificial Sequence
  Description of Artificial Sequence: Synthetic oligonucleotide
cttcaagctcctaagccactgcctgctg

SEQ ID NO: 191130 - DNA, 28 bp, Artificial Sequence
  Description of Artificial Sequence: Synthetic oligonucleotide
ttcaagctcctaagccactgcctgctgg

SEQ ID NO: 191131 - DNA, 27 bp, Artificial Sequence
  Description of Artificial Sequence: Synthetic oligonucleotide
tcaagctcctaagccactgcctgctgg

SEQ ID NO: 191132 - DNA, 27 bp, Artificial Sequence
  Description of Artificial Sequence: Synthetic oligonucleotide
caagctcctaagccactgcctgctggt

SEQ ID NO: 191133 - DNA, 27 bp, Artificial Sequence
  Description of Artificial Sequence: Synthetic oligonucleotide
aagctcctaagccactgcctgctggtg

SEQ ID NO: 191134 - DNA, 27 bp, Artificial Sequence
  Description of Artificial Sequence: Synthetic oligonucleotide
agctcctaagccactgcctgctggtga

SEQ ID NO: 191135 - DNA, 26 bp, Artificial Sequence
  Description of Artificial Sequence: Synthetic oligonucleotide
gctcctaagccactgcctgctggtga

SEQ ID NO: 191136 - DNA, 26 bp, Artificial Sequence
  Description of Artificial Sequence: Synthetic oligonucleotide
ctcctaagccactgcctgctggtgac

SEQ ID NO: 191137 - DNA, 26 bp, Artificial Sequence
  Description of Artificial Sequence: Synthetic oligonucleotide
tcctaagccactgcctgctggtgacc

SEQ ID NO: 191138 - DNA, 25 bp, Artificial Sequence
  Description of Artificial Sequence: Synthetic oligonucleotide
cctaagccactgcctgctggtgacc

SEQ ID NO: 191139 - DNA, 26 bp, Artificial Sequence
  Description of Artificial Sequence: Synthetic oligonucleotide
ctaagccactgcctgctggtgaccct

SEQ ID NO: 191140 - DNA, 26 bp, Artificial Sequence
  Description of Artificial Sequence: Synthetic oligonucleotide
taagccactgcctgctggtgaccctg

SEQ ID NO: 191141 - DNA, 25 bp, Artificial Sequence
  Description of Artificial Sequence: Synthetic oligonucleotide
aagccactgcctgctggtgaccctg

SEQ ID NO: 191142 - DNA, 24 bp, Artificial Sequence
  Description of Artificial Sequence: Synthetic oligonucleotide
agccactgcctgctggtgaccctg

SEQ ID NO: 191143 - DNA, 23 bp, Artificial Sequence
  Description of Artificial Sequence: Synthetic oligonucleotide
gccactgcctgctggtgaccctg

SEQ ID NO: 191144 - DNA, 23 bp, Artificial Sequence
  Description of Artificial Sequence: Synthetic oligonucleotide
ccactgcctgctggtgaccctgg

SEQ ID NO: 191145 - DNA, 23 bp, Artificial Sequence
  Description of Artificial Sequence: Synthetic oligonucleotide
cactgcctgctggtgaccctggc

SEQ ID NO: 191146 - DNA, 23 bp, Artificial Sequence
  Description of Artificial Sequence: Synthetic oligonucleotide
actgcctgctggtgaccctggcc

SEQ ID NO: 191147 - DNA, 22 bp, Artificial Sequence
  Description of Artificial Sequence: Synthetic oligonucleotide
ctgcctgctggtgaccctggcc

SEQ ID NO: 191148 - DNA, 22 bp, Artificial Sequence
  Description of Artificial Sequence: Synthetic oligonucleotide
tgcctgctggtgaccctggccg

SEQ ID NO: 191149 - DNA, 21 bp, Artificial Sequence
  Description of Artificial Sequence: Synthetic oligonucleotide
gcctgctggtgaccctggccg

SEQ ID NO: 191150 - DNA, 21 bp, Artificial Sequence
  Description of Artificial Sequence: Synthetic oligonucleotide
cctgctggtgaccctggccgc

SEQ ID NO: 191151 - DNA, 21 bp, Artificial Sequence
  Description of Artificial Sequence: Synthetic oligonucleotide
ctgctggtgaccctggccgcc

SEQ ID NO: 191152 - DNA, 22 bp, Artificial Sequence
  Description of Artificial Sequence: Synthetic oligonucleotide
tgctggtgaccctggccgccca

SEQ ID NO: 191153 - DNA, 21 bp, Artificial Sequence
  Description of Artificial Sequence: Synthetic oligonucleotide
gctggtgaccctggccgccca

SEQ ID NO: 191154 - DNA, 21 bp, Artificial Sequence
  Description of Artificial Sequence: Synthetic oligonucleotide
ctggtgaccctggccgcccac

SEQ ID NO: 191155 - DNA, 22 bp, Artificial Sequence
  Description of Artificial Sequence: Synthetic oligonucleotide
tggtgaccctggccgcccacct

SEQ ID NO: 191156 - DNA, 21 bp, Artificial Sequence
  Description of Artificial Sequence: Synthetic oligonucleotide
ggtgaccctggccgcccacct

SEQ ID NO: 191157 - DNA, 21 bp, Artificial Sequence
  Description of Artificial Sequence: Synthetic oligonucleotide
gtgaccctggccgcccacctc

SEQ ID NO: 191158 - DNA, 21 bp, Artificial Sequence
  Description of Artificial Sequence: Synthetic oligonucleotide
tgaccctggccgcccacctcc

SEQ ID NO: 191159 - DNA, 20 bp, Artificial Sequence
  Description of Artificial Sequence: Synthetic oligonucleotide
gaccctggccgcccacctcc

SEQ ID NO: 191160 - DNA, 20 bp, Artificial Sequence
  Description of Artificial Sequence: Synthetic oligonucleotide
accctggccgcccacctccc

SEQ ID NO: 191161 - DNA, 20 bp, Artificial Sequence
  Description of Artificial Sequence: Synthetic oligonucleotide
ccctggccgcccacctccct

SEQ ID NO: 191162 - DNA, 20 bp, Artificial Sequence
  Description of Artificial Sequence: Synthetic oligonucleotide
cctggccgcccacctcccct

SEQ ID NO: 191163 - DNA, 20 bp, Artificial Sequence
  Description of Artificial Sequence: Synthetic oligonucleotide
ctggccgcccacctccccgt

SEQ ID NO: 191164 - DNA, 20 bp, Artificial Sequence
  Description of Artificial Sequence: Synthetic oligonucleotide
tggccgcccacctccccgct

SEQ ID NO: 191165 - DNA, 20 bp, Artificial Sequence
  Description of Artificial Sequence: Synthetic oligonucleotide
ggccgcccacctccccgctt

SEQ ID NO: 191166 - DNA, 20 bp, Artificial Sequence
  Description of Artificial Sequence: Synthetic oligonucleotide
gccgcccacctccccgcctt

SEQ ID NO: 191167 - DNA, 20 bp, Artificial Sequence
  Description of Artificial Sequence: Synthetic oligonucleotide
ccgcccacctccccgccgat

SEQ ID NO: 191168 - DNA, 21 bp, Artificial Sequence
  Description of Artificial Sequence: Synthetic oligonucleotide
cgcccacctccccgccgagtt

SEQ ID NO: 191169 - DNA, 22 bp, Artificial Sequence
  Description of Artificial Sequence: Synthetic oligonucleotide
gcccacctccccgccgagttca

SEQ ID NO: 191170 - DNA, 22 bp, Artificial Sequence
  Description of Artificial Sequence: Synthetic oligonucleotide
cccacctccccgccgagttcac

SEQ ID NO: 191171 - DNA, 22 bp, Artificial Sequence
  Description of Artificial Sequence: Synthetic oligonucleotide
ccacctccccgccgagttcacc

SEQ ID NO: 191172 - DNA, 22 bp, Artificial Sequence
  Description of Artificial Sequence: Synthetic oligonucleotide
cacctccccgccgagttcaccc

SEQ ID NO: 191173 - DNA, 23 bp, Artificial Sequence
  Description of Artificial Sequence: Synthetic oligonucleotide
acctccccgccgagttcacccct

SEQ ID NO: 191174 - DNA, 22 bp, Artificial Sequence
  Description of Artificial Sequence: Synthetic oligonucleotide
cctccccgccgagttcacccct

SEQ ID NO: 191175 - DNA, 22 bp, Artificial Sequence
  Description of Artificial Sequence: Synthetic oligonucleotide
ctccccgccgagttcacccctg

SEQ ID NO: 191176 - DNA, 22 bp, Artificial Sequence
  Description of Artificial Sequence: Synthetic oligonucleotide
tccccgccgagttcacccctgc

SEQ ID NO: 191177 - DNA, 21 bp, Artificial Sequence
  Description of Artificial Sequence: Synthetic oligonucleotide
ccccgccgagttcacccctgc

SEQ ID NO: 191178 - DNA, 21 bp, Artificial Sequence
  Description of Artificial Sequence: Synthetic oligonucleotide
cccgccgagttcacccctgcg

SEQ ID NO: 191179 - DNA, 22 bp, Artificial Sequence
  Description of Artificial Sequence: Synthetic oligonucleotide
ccgccgagttcacccctgcggt

SEQ ID NO: 191180 - DNA, 22 bp, Artificial Sequence
  Description of Artificial Sequence: Synthetic oligonucleotide
cgccgagttcacccctgcggtg

SEQ ID NO: 191181 - DNA, 23 bp, Artificial Sequence
  Description of Artificial Sequence: Synthetic oligonucleotide
gccgagttcacccctgcggtgca

SEQ ID NO: 191182 - DNA, 23 bp, Artificial Sequence
  Description of Artificial Sequence: Synthetic oligonucleotide
ccgagttcacccctgcggtgcac

SEQ ID NO: 191183 - DNA, 23 bp, Artificial Sequence
  Description of Artificial Sequence: Synthetic oligonucleotide
cgagttcacccctgcggtgcacg

SEQ ID NO: 191184 - DNA, 23 bp, Artificial Sequence
  Description of Artificial Sequence: Synthetic oligonucleotide
gagttcacccctgcggtgcacgc

SEQ ID NO: 191185 - DNA, 24 bp, Artificial Sequence
  Description of Artificial Sequence: Synthetic oligonucleotide
agttcacccctgcggtgcacgcct

SEQ ID NO: 191186 - DNA, 23 bp, Artificial Sequence
  Description of Artificial Sequence: Synthetic oligonucleotide
gttcacccctgcggtgcacgcct

SEQ ID NO: 191187 - DNA, 23 bp, Artificial Sequence
  Description of Artificial Sequence: Synthetic oligonucleotide
ttcacccctgcggtgcacgcctc

SEQ ID NO: 191188 - DNA, 22 bp, Artificial Sequence
  Description of Artificial Sequence: Synthetic oligonucleotide
tcacccctgcggtgcacgcctc

SEQ ID NO: 191189 - DNA, 21 bp, Artificial Sequence
  Description of Artificial Sequence: Synthetic oligonucleotide
cacccctgcggtgcacgcctc

SEQ ID NO: 191190 - DNA, 21 bp, Artificial Sequence
  Description of Artificial Sequence: Synthetic oligonucleotide
acccctgcggtgcacgcctcc

SEQ ID NO: 191191 - DNA, 20 bp, Artificial Sequence
  Description of Artificial Sequence: Synthetic oligonucleotide
cccctgcggtgcacgcctcc

SEQ ID NO: 191192 - DNA, 21 bp, Artificial Sequence
  Description of Artificial Sequence: Synthetic oligonucleotide
ccctgcggtgcacgcctccct

SEQ ID NO: 191193 - DNA, 21 bp, Artificial Sequence
  Description of Artificial Sequence: Synthetic oligonucleotide
cctgcggtgcacgcctccctg

SEQ ID NO: 191194 - DNA, 22 bp, Artificial Sequence
  Description of Artificial Sequence: Synthetic oligonucleotide
ctgcggtgcacgcctccctgga

SEQ ID NO: 191195 - DNA, 24 bp, Artificial Sequence
  Description of Artificial Sequence: Synthetic oligonucleotide
tgcggtgcacgcctccctggacaa

SEQ ID NO: 191196 - DNA, 23 bp, Artificial Sequence
  Description of Artificial Sequence: Synthetic oligonucleotide
gcggtgcacgcctccctggacaa

SEQ ID NO: 191197 - DNA, 25 bp, Artificial Sequence
  Description of Artificial Sequence: Synthetic oligonucleotide
cggtgcacgcctccctggacaagtt

SEQ ID NO: 191198 - DNA, 25 bp, Artificial Sequence
  Description of Artificial Sequence: Synthetic oligonucleotide
ggtgcacgcctccctggacaagttc

SEQ ID NO: 191199 - DNA, 26 bp, Artificial Sequence
  Description of Artificial Sequence: Synthetic oligonucleotide
gtgcacgcctccctggacaagttcct

SEQ ID NO: 191200 - DNA, 26 bp, Artificial Sequence
  Description of Artificial Sequence: Synthetic oligonucleotide
tgcacgcctccctggacaagttcctg

SEQ ID NO: 191201 - DNA, 25 bp, Artificial Sequence
  Description of Artificial Sequence: Synthetic oligonucleotide
gcacgcctccctggacaagttcctg

SEQ ID NO: 191202 - DNA, 25 bp, Artificial Sequence
  Description of Artificial Sequence: Synthetic oligonucleotide
cacgcctccctggacaagttcctgg

SEQ ID NO: 191203 - DNA, 27 bp, Artificial Sequence
  Description of Artificial Sequence: Synthetic oligonucleotide
acgcctccctggacaagttcctggctt

SEQ ID NO: 191204 - DNA, 26 bp, Artificial Sequence
  Description of Artificial Sequence: Synthetic oligonucleotide
cgcctccctggacaagttcctggctt

SEQ ID NO: 191205 - DNA, 27 bp, Artificial Sequence
  Description of Artificial Sequence: Synthetic oligonucleotide
gcctccctggacaagttcctggcttct

SEQ ID NO: 191206 - DNA, 27 bp, Artificial Sequence
  Description of Artificial Sequence: Synthetic oligonucleotide
cctccctggacaagttcctggcttctg

SEQ ID NO: 191207 - DNA, 28 bp, Artificial Sequence
  Description of Artificial Sequence: Synthetic oligonucleotide
ctccctggacaagttcctggcttctgtg

SEQ ID NO: 191208 - DNA, 29 bp, Artificial Sequence
  Description of Artificial Sequence: Synthetic oligonucleotide
tccctggacaagttcctggcttctgtgag

SEQ ID NO: 191209 - DNA, 28 bp, Artificial Sequence
  Description of Artificial Sequence: Synthetic oligonucleotide
ccctggacaagttcctggcttctgtgag

SEQ ID NO: 191210 - DNA, 28 bp, Artificial Sequence
  Description of Artificial Sequence: Synthetic oligonucleotide
cctggacaagttcctggcttctgtgagc

SEQ ID NO: 191211 - DNA, 29 bp, Artificial Sequence
  Description of Artificial Sequence: Synthetic oligonucleotide
ctggacaagttcctggcttctgtgagcac

SEQ ID NO: 191212 - DNA, 29 bp, Artificial Sequence
  Description of Artificial Sequence: Synthetic oligonucleotide
tggacaagttcctggcttctgtgagcacc

SEQ ID NO: 191213 - DNA, 28 bp, Artificial Sequence
  Description of Artificial Sequence: Synthetic oligonucleotide
ggacaagttcctggcttctgtgagcacc

SEQ ID NO: 191214 - DNA, 28 bp, Artificial Sequence
  Description of Artificial Sequence: Synthetic oligonucleotide
gacaagttcctggcttctgtgagcaccg

SEQ ID NO: 191215 - DNA, 29 bp, Artificial Sequence
  Description of Artificial Sequence: Synthetic oligonucleotide
acaagttcctggcttctgtgagcaccgtg

SEQ ID NO: 191216 - DNA, 28 bp, Artificial Sequence
  Description of Artificial Sequence: Synthetic oligonucleotide
caagttcctggcttctgtgagcaccgtg

SEQ ID NO: 191217 - DNA, 28 bp, Artificial Sequence
  Description of Artificial Sequence: Synthetic oligonucleotide
aagttcctggcttctgtgagcaccgtgc

SEQ ID NO: 191218 - DNA, 27 bp, Artificial Sequence
  Description of Artificial Sequence: Synthetic oligonucleotide
agttcctggcttctgtgagcaccgtgc

SEQ ID NO: 191219 - DNA, 27 bp, Artificial Sequence
  Description of Artificial Sequence: Synthetic oligonucleotide
gttcctggcttctgtgagcaccgtgct

SEQ ID NO: 191220 - DNA, 27 bp, Artificial Sequence
  Description of Artificial Sequence: Synthetic oligonucleotide
ttcctggcttctgtgagcaccgtgctg

SEQ ID NO: 191221 - DNA, 27 bp, Artificial Sequence
  Description of Artificial Sequence: Synthetic oligonucleotide
tcctggcttctgtgagcaccgtgctga

SEQ ID NO: 191222 - DNA, 26 bp, Artificial Sequence
  Description of Artificial Sequence: Synthetic oligonucleotide
cctggcttctgtgagcaccgtgctga

SEQ ID NO: 191223 - DNA, 26 bp, Artificial Sequence
  Description of Artificial Sequence: Synthetic oligonucleotide
ctggcttctgtgagcaccgtgctgac

SEQ ID NO: 191224 - DNA, 27 bp, Artificial Sequence
  Description of Artificial Sequence: Synthetic oligonucleotide
tggcttctgtgagcaccgtgctgacct

SEQ ID NO: 191225 - DNA, 26 bp, Artificial Sequence
  Description of Artificial Sequence: Synthetic oligonucleotide
ggcttctgtgagcaccgtgctgacct

SEQ ID NO: 191226 - DNA, 26 bp, Artificial Sequence
  Description of Artificial Sequence: Synthetic oligonucleotide
gcttctgtgagcaccgtgctgacctc

SEQ ID NO: 191227 - DNA, 27 bp, Artificial Sequence
  Description of Artificial Sequence: Synthetic oligonucleotide
cttctgtgagcaccgtgctgacctcca

SEQ ID NO: 191228 - DNA, 31 bp, Artificial Sequence
  Description of Artificial Sequence: Synthetic oligonucleotide
ttctgtgagcaccgtgctgacctccaaatac

SEQ ID NO: 191229 - DNA, 30 bp, Artificial Sequence
  Description of Artificial Sequence: Synthetic oligonucleotide
tctgtgagcaccgtgctgacctccaaatac

SEQ ID NO: 191230 - DNA, 29 bp, Artificial Sequence
  Description of Artificial Sequence: Synthetic oligonucleotide
ctgtgagcaccgtgctgacctccaaatac

SEQ ID NO: 191231 - DNA, 29 bp, Artificial Sequence
  Description of Artificial Sequence: Synthetic oligonucleotide
tgtgagcaccgtgctgacctccaaatacc

SEQ ID NO: 191232 - DNA, 28 bp, Artificial Sequence
  Description of Artificial Sequence: Synthetic oligonucleotide
gtgagcaccgtgctgacctccaaatacc

SEQ ID NO: 191233 - DNA, 28 bp, Artificial Sequence
  Description of Artificial Sequence: Synthetic oligonucleotide
tgagcaccgtgctgacctccaaataccg

SEQ ID NO: 191234 - DNA, 27 bp, Artificial Sequence
  Description of Artificial Sequence: Synthetic oligonucleotide
gagcaccgtgctgacctccaaataccg

SEQ ID NO: 191235 - DNA, 22 bp, Artificial Sequence
  Description of Artificial Sequence: Synthetic oligonucleotide
atggcgctgtccgcggaggacc

SEQ ID NO: 191236 - DNA, 21 bp, Artificial Sequence
  Description of Artificial Sequence: Synthetic oligonucleotide
tggcgctgtccgcggaggacc

SEQ ID NO: 191237 - DNA, 20 bp, Artificial Sequence
  Description of Artificial Sequence: Synthetic oligonucleotide
ggcgctgtccgcggaggacc

SEQ ID NO: 191238 - DNA, 20 bp, Artificial Sequence
  Description of Artificial Sequence: Synthetic oligonucleotide
gcgctgtccgcggaggaccg

SEQ ID NO: 191239 - DNA, 20 bp, Artificial Sequence
  Description of Artificial Sequence: Synthetic oligonucleotide
cgctgtccgcggaggaccgg

SEQ ID NO: 191240 - DNA, 20 bp, Artificial Sequence
  Description of Artificial Sequence: Synthetic oligonucleotide
gctgtccgcggaggaccggg

SEQ ID NO: 191241 - DNA, 20 bp, Artificial Sequence
  Description of Artificial Sequence: Synthetic oligonucleotide
ctgtccgcggaggaccgggc

SEQ ID NO: 191242 - DNA, 20 bp, Artificial Sequence
  Description of Artificial Sequence: Synthetic oligonucleotide
tgtccgcggaggaccgggcg

SEQ ID NO: 191243 - DNA, 20 bp, Artificial Sequence
  Description of Artificial Sequence: Synthetic oligonucleotide
gtccgcggaggaccgggcgt

SEQ ID NO: 191244 - DNA, 20 bp, Artificial Sequence
  Description of Artificial Sequence: Synthetic oligonucleotide
tccgcggaggaccgggcgct

SEQ ID NO: 191245 - DNA, 20 bp, Artificial Sequence
  Description of Artificial Sequence: Synthetic oligonucleotide
ccgcggaggaccgggcgctt

SEQ ID NO: 191246 - DNA, 20 bp, Artificial Sequence
  Description of Artificial Sequence: Synthetic oligonucleotide
cgcggaggaccgggcgctgt

SEQ ID NO: 191247 - DNA, 20 bp, Artificial Sequence
  Description of Artificial Sequence: Synthetic oligonucleotide
gcggaggaccgggcgctggt

SEQ ID NO: 191248 - DNA, 20 bp, Artificial Sequence
  Description of Artificial Sequence: Synthetic oligonucleotide
cggaggaccgggcgctggtg

SEQ ID NO: 191249 - DNA, 20 bp, Artificial Sequence
  Description of Artificial Sequence: Synthetic oligonucleotide
ggaggaccgggcgctggtgc

SEQ ID NO: 191250 - DNA, 20 bp, Artificial Sequence
  Description of Artificial Sequence: Synthetic oligonucleotide
gaggaccgggcgctggtgcg

SEQ ID NO: 191251 - DNA, 20 bp, Artificial Sequence
  Description of Artificial Sequence: Synthetic oligonucleotide
aggaccgggcgctggtgcgc

SEQ ID NO: 191252 - DNA, 20 bp, Artificial Sequence
  Description of Artificial Sequence: Synthetic oligonucleotide
ggaccgggcgctggtgcgct

SEQ ID NO: 191253 - DNA, 20 bp, Artificial Sequence
  Description of Artificial Sequence: Synthetic oligonucleotide
gaccgggcgctggtgcgcgt

SEQ ID NO: 191254 - DNA, 20 bp, Artificial Sequence
  Description of Artificial Sequence: Synthetic oligonucleotide
accgggcgctggtgcgcgct

SEQ ID NO: 191255 - DNA, 20 bp, Artificial Sequence
  Description of Artificial Sequence: Synthetic oligonucleotide
ccgggcgctggtgcgcgctt

SEQ ID NO: 191256 - DNA, 20 bp, Artificial Sequence
  Description of Artificial Sequence: Synthetic oligonucleotide
cgggcgctggtgcgcgcctt

SEQ ID NO: 191257 - DNA, 20 bp, Artificial Sequence
  Description of Artificial Sequence: Synthetic oligonucleotide
gggcgctggtgcgcgccctt

SEQ ID NO: 191258 - DNA, 20 bp, Artificial Sequence
  Description of Artificial Sequence: Synthetic oligonucleotide
ggcgctggtgcgcgccctgt

SEQ ID NO: 191259 - DNA, 20 bp, Artificial Sequence
  Description of Artificial Sequence: Synthetic oligonucleotide
gcgctggtgcgcgccctgtg

SEQ ID NO: 191260 - DNA, 22 bp, Artificial Sequence
  Description of Artificial Sequence: Synthetic oligonucleotide
cgctggtgcgcgccctgtggaa

SEQ ID NO: 191261 - DNA, 24 bp, Artificial Sequence
  Description of Artificial Sequence: Synthetic oligonucleotide
gctggtgcgcgccctgtggaagaa

SEQ ID NO: 191262 - DNA, 24 bp, Artificial Sequence
  Description of Artificial Sequence: Synthetic oligonucleotide
ctggtgcgcgccctgtggaagaag

SEQ ID NO: 191263 - DNA, 25 bp, Artificial Sequence
  Description of Artificial Sequence: Synthetic oligonucleotide
tggtgcgcgccctgtggaagaagct

SEQ ID NO: 191264 - DNA, 24 bp, Artificial Sequence
  Description of Artificial Sequence: Synthetic oligonucleotide
ggtgcgcgccctgtggaagaagct

SEQ ID NO: 191265 - DNA, 24 bp, Artificial Sequence
  Description of Artificial Sequence: Synthetic oligonucleotide
gtgcgcgccctgtggaagaagctg

SEQ ID NO: 191266 - DNA, 24 bp, Artificial Sequence
  Description of Artificial Sequence: Synthetic oligonucleotide
tgcgcgccctgtggaagaagctgg

SEQ ID NO: 191267 - DNA, 23 bp, Artificial Sequence
  Description of Artificial Sequence: Synthetic oligonucleotide
gcgcgccctgtggaagaagctgg

SEQ ID NO: 191268 - DNA, 23 bp, Artificial Sequence
  Description of Artificial Sequence: Synthetic oligonucleotide
cgcgccctgtggaagaagctggg

SEQ ID NO: 191269 - DNA, 24 bp, Artificial Sequence
  Description of Artificial Sequence: Synthetic oligonucleotide
gcgccctgtggaagaagctgggca

SEQ ID NO: 191270 - DNA, 24 bp, Artificial Sequence
  Description of Artificial Sequence: Synthetic oligonucleotide
cgccctgtggaagaagctgggcag

SEQ ID NO: 191271 - DNA, 26 bp, Artificial Sequence
  Description of Artificial Sequence: Synthetic oligonucleotide
gccctgtggaagaagctgggcagcaa

SEQ ID NO: 191272 - DNA, 26 bp, Artificial Sequence
  Description of Artificial Sequence: Synthetic oligonucleotide
ccctgtggaagaagctgggcagcaac

SEQ ID NO: 191273 - DNA, 27 bp, Artificial Sequence
  Description of Artificial Sequence: Synthetic oligonucleotide
cctgtggaagaagctgggcagcaacgt

SEQ ID NO: 191274 - DNA, 27 bp, Artificial Sequence
  Description of Artificial Sequence: Synthetic oligonucleotide
ctgtggaagaagctgggcagcaacgtc

SEQ ID NO: 191275 - DNA, 27 bp, Artificial Sequence
  Description of Artificial Sequence: Synthetic oligonucleotide
tgtggaagaagctgggcagcaacgtcg

SEQ ID NO: 191276 - DNA, 26 bp, Artificial Sequence
  Description of Artificial Sequence: Synthetic oligonucleotide
gtggaagaagctgggcagcaacgtcg

SEQ ID NO: 191277 - DNA, 26 bp, Artificial Sequence
  Description of Artificial Sequence: Synthetic oligonucleotide
tggaagaagctgggcagcaacgtcgg

SEQ ID NO: 191278 - DNA, 25 bp, Artificial Sequence
  Description of Artificial Sequence: Synthetic oligonucleotide
ggaagaagctgggcagcaacgtcgg

SEQ ID NO: 191279 - DNA, 25 bp, Artificial Sequence
  Description of Artificial Sequence: Synthetic oligonucleotide
gaagaagctgggcagcaacgtcggc

SEQ ID NO: 191280 - DNA, 26 bp, Artificial Sequence
  Description of Artificial Sequence: Synthetic oligonucleotide
aagaagctgggcagcaacgtcggcgt

SEQ ID NO: 191281 - DNA, 25 bp, Artificial Sequence
  Description of Artificial Sequence: Synthetic oligonucleotide
agaagctgggcagcaacgtcggcgt

SEQ ID NO: 191282 - DNA, 24 bp, Artificial Sequence
  Description of Artificial Sequence: Synthetic oligonucleotide
gaagctgggcagcaacgtcggcgt

SEQ ID NO: 191283 - DNA, 26 bp, Artificial Sequence
  Description of Artificial Sequence: Synthetic oligonucleotide
aagctgggcagcaacgtcggcgtcta

SEQ ID NO: 191284 - DNA, 25 bp, Artificial Sequence
  Description of Artificial Sequence: Synthetic oligonucleotide
agctgggcagcaacgtcggcgtcta

SEQ ID NO: 191285 - DNA, 24 bp, Artificial Sequence
  Description of Artificial Sequence: Synthetic oligonucleotide
gctgggcagcaacgtcggcgtcta

SEQ ID NO: 191286 - DNA, 25 bp, Artificial Sequence
  Description of Artificial Sequence: Synthetic oligonucleotide
ctgggcagcaacgtcggcgtctaca

SEQ ID NO: 191287 - DNA, 25 bp, Artificial Sequence
  Description of Artificial Sequence: Synthetic oligonucleotide
tgggcagcaacgtcggcgtctacac

SEQ ID NO: 191288 - DNA, 24 bp, Artificial Sequence
  Description of Artificial Sequence: Synthetic oligonucleotide
gggcagcaacgtcggcgtctacac

SEQ ID NO: 191289 - DNA, 25 bp, Artificial Sequence
  Description of Artificial Sequence: Synthetic oligonucleotide
ggcagcaacgtcggcgtctacacga

SEQ ID NO: 191290 - DNA, 26 bp, Artificial Sequence
  Description of Artificial Sequence: Synthetic oligonucleotide
gcagcaacgtcggcgtctacacgaca

SEQ ID NO: 191291 - DNA, 27 bp, Artificial Sequence
  Description of Artificial Sequence: Synthetic oligonucleotide
cagcaacgtcggcgtctacacgacaga

SEQ ID NO: 191292 - DNA, 27 bp, Artificial Sequence
  Description of Artificial Sequence: Synthetic oligonucleotide
agcaacgtcggcgtctacacgacagag

SEQ ID NO: 191293 - DNA, 26 bp, Artificial Sequence
  Description of Artificial Sequence: Synthetic oligonucleotide
gcaacgtcggcgtctacacgacagag

SEQ ID NO: 191294 - DNA, 26 bp, Artificial Sequence
  Description of Artificial Sequence: Synthetic oligonucleotide
caacgtcggcgtctacacgacagagg

SEQ ID NO: 191295 - DNA, 26 bp, Artificial Sequence
  Description of Artificial Sequence: Synthetic oligonucleotide
aacgtcggcgtctacacgacagaggc

SEQ ID NO: 191296 - DNA, 25 bp, Artificial Sequence
  Description of Artificial Sequence: Synthetic oligonucleotide
acgtcggcgtctacacgacagaggc

SEQ ID NO: 191297 - DNA, 24 bp, Artificial Sequence
  Description of Artificial Sequence: Synthetic oligonucleotide
cgtcggcgtctacacgacagaggc

SEQ ID NO: 191298 - DNA, 24 bp, Artificial Sequence
  Description of Artificial Sequence: Synthetic oligonucleotide
gtcggcgtctacacgacagaggcc

SEQ ID NO: 191299 - DNA, 25 bp, Artificial Sequence
  Description of Artificial Sequence: Synthetic oligonucleotide
tcggcgtctacacgacagaggccct

SEQ ID NO: 191300 - DNA, 24 bp, Artificial Sequence
  Description of Artificial Sequence: Synthetic oligonucleotide
cggcgtctacacgacagaggccct

SEQ ID NO: 191301 - DNA, 24 bp, Artificial Sequence
  Description of Artificial Sequence: Synthetic oligonucleotide
ggcgtctacacgacagaggccctg

SEQ ID NO: 191302 - DNA, 27 bp, Artificial Sequence
  Description of Artificial Sequence: Synthetic oligonucleotide
gcgtctacacgacagaggccctggaaa

SEQ ID NO: 191303 - DNA, 27 bp, Artificial Sequence
  Description of Artificial Sequence: Synthetic oligonucleotide
cgtctacacgacagaggccctggaaag

SEQ ID NO: 191304 - DNA, 27 bp, Artificial Sequence
  Description of Artificial Sequence: Synthetic oligonucleotide
gtctacacgacagaggccctggaaagg

SEQ ID NO: 191305 - DNA, 28 bp, Artificial Sequence
  Description of Artificial Sequence: Synthetic oligonucleotide
tctacacgacagaggccctggaaaggac

SEQ ID NO: 191306 - DNA, 27 bp, Artificial Sequence
  Description of Artificial Sequence: Synthetic oligonucleotide
ctacacgacagaggccctggaaaggac

SEQ ID NO: 191307 - DNA, 27 bp, Artificial Sequence
  Description of Artificial Sequence: Synthetic oligonucleotide
tacacgacagaggccctggaaaggacc

SEQ ID NO: 191308 - DNA, 27 bp, Artificial Sequence
  Description of Artificial Sequence: Synthetic oligonucleotide
acacgacagaggccctggaaaggacct

SEQ ID NO: 191309 - DNA, 27 bp, Artificial Sequence
  Description of Artificial Sequence: Synthetic oligonucleotide
cacgacagaggccctggaaaggacctt

SEQ ID NO: 191310 - DNA, 27 bp, Artificial Sequence
  Description of Artificial Sequence: Synthetic oligonucleotide
acgacagaggccctggaaaggaccttc

SEQ ID NO: 191311 - DNA, 26 bp, Artificial Sequence
  Description of Artificial Sequence: Synthetic oligonucleotide
cgacagaggccctggaaaggaccttc

SEQ ID NO: 191312 - DNA, 27 bp, Artificial Sequence
  Description of Artificial Sequence: Synthetic oligonucleotide
gacagaggccctggaaaggaccttcct

SEQ ID NO: 191313 - DNA, 27 bp, Artificial Sequence
  Description of Artificial Sequence: Synthetic oligonucleotide
acagaggccctggaaaggaccttcctg

SEQ ID NO: 191314 - DNA, 26 bp, Artificial Sequence
  Description of Artificial Sequence: Synthetic oligonucleotide
cagaggccctggaaaggaccttcctg

SEQ ID NO: 191315 - DNA, 26 bp, Artificial Sequence
  Description of Artificial Sequence: Synthetic oligonucleotide
agaggccctggaaaggaccttcctgg

SEQ ID NO: 191316 - DNA, 25 bp, Artificial Sequence
  Description of Artificial Sequence: Synthetic oligonucleotide
gaggccctggaaaggaccttcctgg

SEQ ID NO: 191317 - DNA, 27 bp, Artificial Sequence
  Description of Artificial Sequence: Synthetic oligonucleotide
aggccctggaaaggaccttcctggctt

SEQ ID NO: 191318 - DNA, 27 bp, Artificial Sequence
  Description of Artificial Sequence: Synthetic oligonucleotide
ggccctggaaaggaccttcctggcttt

SEQ ID NO: 191319 - DNA, 27 bp, Artificial Sequence
  Description of Artificial Sequence: Synthetic oligonucleotide
gccctggaaaggaccttcctggctttc

SEQ ID NO: 191320 - DNA, 27 bp, Artificial Sequence
  Description of Artificial Sequence: Synthetic oligonucleotide
ccctggaaaggaccttcctggctttcc

SEQ ID NO: 191321 - DNA, 27 bp, Artificial Sequence
  Description of Artificial Sequence: Synthetic oligonucleotide
cctggaaaggaccttcctggctttccc

SEQ ID NO: 191322 - DNA, 27 bp, Artificial Sequence
  Description of Artificial Sequence: Synthetic oligonucleotide
ctggaaaggaccttcctggctttcccc

SEQ ID NO: 191323 - DNA, 27 bp, Artificial Sequence
  Description of Artificial Sequence: Synthetic oligonucleotide
tggaaaggaccttcctggctttccccg

SEQ ID NO: 191324 - DNA, 26 bp, Artificial Sequence
  Description of Artificial Sequence: Synthetic oligonucleotide
ggaaaggaccttcctggctttccccg

SEQ ID NO: 191325 - DNA, 26 bp, Artificial Sequence
  Description of Artificial Sequence: Synthetic oligonucleotide
gaaaggaccttcctggctttccccgc

SEQ ID NO: 191326 - DNA, 27 bp, Artificial Sequence
  Description of Artificial Sequence: Synthetic oligonucleotide
aaaggaccttcctggctttccccgcca

SEQ ID NO: 191327 - DNA, 26 bp, Artificial Sequence
  Description of Artificial Sequence: Synthetic oligonucleotide
aaggaccttcctggctttccccgcca

SEQ ID NO: 191328 - DNA, 25 bp, Artificial Sequence
  Description of Artificial Sequence: Synthetic oligonucleotide
aggaccttcctggctttccccgcca

SEQ ID NO: 191329 - DNA, 24 bp, Artificial Sequence
  Description of Artificial Sequence: Synthetic oligonucleotide
ggaccttcctggctttccccgcca

SEQ ID NO: 191330 - DNA, 24 bp, Artificial Sequence
  Description of Artificial Sequence: Synthetic oligonucleotide
gaccttcctggctttccccgccac

SEQ ID NO: 191331 - DNA, 26 bp, Artificial Sequence
  Description of Artificial Sequence: Synthetic oligonucleotide
accttcctggctttccccgccacgaa

SEQ ID NO: 191332 - DNA, 25 bp, Artificial Sequence
  Description of Artificial Sequence: Synthetic oligonucleotide
ccttcctggctttccccgccacgaa

SEQ ID NO: 191333 - DNA, 26 bp, Artificial Sequence
  Description of Artificial Sequence: Synthetic oligonucleotide
cttcctggctttccccgccacgaaga

SEQ ID NO: 191334 - DNA, 26 bp, Artificial Sequence
  Description of Artificial Sequence: Synthetic oligonucleotide
ttcctggctttccccgccacgaagac

SEQ ID NO: 191335 - DNA, 25 bp, Artificial Sequence
  Description of Artificial Sequence: Synthetic oligonucleotide
tcctggctttccccgccacgaagac

SEQ ID NO: 191336 - DNA, 24 bp, Artificial Sequence
  Description of Artificial Sequence: Synthetic oligonucleotide
cctggctttccccgccacgaagac

SEQ ID NO: 191337 - DNA, 26 bp, Artificial Sequence
  Description of Artificial Sequence: Synthetic oligonucleotide
ctggctttccccgccacgaagaccta

SEQ ID NO: 191338 - DNA, 27 bp, Artificial Sequence
  Description of Artificial Sequence: Synthetic oligonucleotide
tggctttccccgccacgaagacctact

SEQ ID NO: 191339 - DNA, 27 bp, Artificial Sequence
  Description of Artificial Sequence: Synthetic oligonucleotide
ggctttccccgccacgaagacctactt

SEQ ID NO: 191340 - DNA, 27 bp, Artificial Sequence
  Description of Artificial Sequence: Synthetic oligonucleotide
gctttccccgccacgaagacctacttc

SEQ ID NO: 191341 - DNA, 28 bp, Artificial Sequence
  Description of Artificial Sequence: Synthetic oligonucleotide
ctttccccgccacgaagacctacttctc

SEQ ID NO: 191342 - DNA, 28 bp, Artificial Sequence
  Description of Artificial Sequence: Synthetic oligonucleotide
tttccccgccacgaagacctacttctcc

SEQ ID NO: 191343 - DNA, 27 bp, Artificial Sequence
  Description of Artificial Sequence: Synthetic oligonucleotide
ttccccgccacgaagacctacttctcc

SEQ ID NO: 191344 - DNA, 26 bp, Artificial Sequence
  Description of Artificial Sequence: Synthetic oligonucleotide
tccccgccacgaagacctacttctcc

SEQ ID NO: 191345 - DNA, 25 bp, Artificial Sequence
  Description of Artificial Sequence: Synthetic oligonucleotide
ccccgccacgaagacctacttctcc

SEQ ID NO: 191346 - DNA, 26 bp, Artificial Sequence
  Description of Artificial Sequence: Synthetic oligonucleotide
cccgccacgaagacctacttctccca

SEQ ID NO: 191347 - DNA, 26 bp, Artificial Sequence
  Description of Artificial Sequence: Synthetic oligonucleotide
ccgccacgaagacctacttctcccac

SEQ ID NO: 191348 - DNA, 27 bp, Artificial Sequence
  Description of Artificial Sequence: Synthetic oligonucleotide
cgccacgaagacctacttctcccacct

SEQ ID NO: 191349 - DNA, 27 bp, Artificial Sequence
  Description of Artificial Sequence: Synthetic oligonucleotide
gccacgaagacctacttctcccacctg

SEQ ID NO: 191350 - DNA, 27 bp, Artificial Sequence
  Description of Artificial Sequence: Synthetic oligonucleotide
ccacgaagacctacttctcccacctgg

SEQ ID NO: 191351 - DNA, 28 bp, Artificial Sequence
  Description of Artificial Sequence: Synthetic oligonucleotide
cacgaagacctacttctcccacctggac

SEQ ID NO: 191352 - DNA, 28 bp, Artificial Sequence
  Description of Artificial Sequence: Synthetic oligonucleotide
acgaagacctacttctcccacctggacc

SEQ ID NO: 191353 - DNA, 27 bp, Artificial Sequence
  Description of Artificial Sequence: Synthetic oligonucleotide
cgaagacctacttctcccacctggacc

SEQ ID NO: 191354 - DNA, 28 bp, Artificial Sequence
  Description of Artificial Sequence: Synthetic oligonucleotide
gaagacctacttctcccacctggacctg

SEQ ID NO: 191355 - DNA, 29 bp, Artificial Sequence
  Description of Artificial Sequence: Synthetic oligonucleotide
aagacctacttctcccacctggacctgag

SEQ ID NO: 191356 - DNA, 28 bp, Artificial Sequence
  Description of Artificial Sequence: Synthetic oligonucleotide
agacctacttctcccacctggacctgag

SEQ ID NO: 191357 - DNA, 27 bp, Artificial Sequence
  Description of Artificial Sequence: Synthetic oligonucleotide
gacctacttctcccacctggacctgag

SEQ ID NO: 191358 - DNA, 27 bp, Artificial Sequence
  Description of Artificial Sequence: Synthetic oligonucleotide
acctacttctcccacctggacctgagc

SEQ ID NO: 191359 - DNA, 26 bp, Artificial Sequence
  Description of Artificial Sequence: Synthetic oligonucleotide
cctacttctcccacctggacctgagc

SEQ ID NO: 191360 - DNA, 26 bp, Artificial Sequence
  Description of Artificial Sequence: Synthetic oligonucleotide
ctacttctcccacctggacctgagcc

SEQ ID NO: 191361 - DNA, 26 bp, Artificial Sequence
  Description of Artificial Sequence: Synthetic oligonucleotide
tacttctcccacctggacctgagccc

SEQ ID NO: 191362 - DNA, 25 bp, Artificial Sequence
  Description of Artificial Sequence: Synthetic oligonucleotide
acttctcccacctggacctgagccc

SEQ ID NO: 191363 - DNA, 24 bp, Artificial Sequence
  Description of Artificial Sequence: Synthetic oligonucleotide
cttctcccacctggacctgagccc

SEQ ID NO: 191364 - DNA, 24 bp, Artificial Sequence
  Description of Artificial Sequence: Synthetic oligonucleotide
ttctcccacctggacctgagcccc

SEQ ID NO: 191365 - DNA, 23 bp, Artificial Sequence
  Description of Artificial Sequence: Synthetic oligonucleotide
tctcccacctggacctgagcccc

SEQ ID NO: 191366 - DNA, 22 bp, Artificial Sequence
  Description of Artificial Sequence: Synthetic oligonucleotide
ctcccacctggacctgagcccc

SEQ ID NO: 191367 - DNA, 22 bp, Artificial Sequence
  Description of Artificial Sequence: Synthetic oligonucleotide
tcccacctggacctgagccccg

SEQ ID NO: 191368 - DNA, 21 bp, Artificial Sequence
  Description of Artificial Sequence: Synthetic oligonucleotide
cccacctggacctgagccccg

SEQ ID NO: 191369 - DNA, 21 bp, Artificial Sequence
  Description of Artificial Sequence: Synthetic oligonucleotide
ccacctggacctgagccccgg

SEQ ID NO: 191370 - DNA, 22 bp, Artificial Sequence
  Description of Artificial Sequence: Synthetic oligonucleotide
cacctggacctgagccccggct

SEQ ID NO: 191371 - DNA, 22 bp, Artificial Sequence
  Description of Artificial Sequence: Synthetic oligonucleotide
acctggacctgagccccggctc

SEQ ID NO: 191372 - DNA, 21 bp, Artificial Sequence
  Description of Artificial Sequence: Synthetic oligonucleotide
cctggacctgagccccggctc

SEQ ID NO: 191373 - DNA, 22 bp, Artificial Sequence
  Description of Artificial Sequence: Synthetic oligonucleotide
ctggacctgagccccggctcct

SEQ ID NO: 191374 - DNA, 23 bp, Artificial Sequence
  Description of Artificial Sequence: Synthetic oligonucleotide
tggacctgagccccggctcctca

SEQ ID NO: 191375 - DNA, 22 bp, Artificial Sequence
  Description of Artificial Sequence: Synthetic oligonucleotide
ggacctgagccccggctcctca

SEQ ID NO: 191376 - DNA, 24 bp, Artificial Sequence
  Description of Artificial Sequence: Synthetic oligonucleotide
gacctgagccccggctcctcacaa

SEQ ID NO: 191377 - DNA, 25 bp, Artificial Sequence
  Description of Artificial Sequence: Synthetic oligonucleotide
acctgagccccggctcctcacaagt

SEQ ID NO: 191378 - DNA, 24 bp, Artificial Sequence
  Description of Artificial Sequence: Synthetic oligonucleotide
cctgagccccggctcctcacaagt

SEQ ID NO: 191379 - DNA, 25 bp, Artificial Sequence
  Description of Artificial Sequence: Synthetic oligonucleotide
ctgagccccggctcctcacaagtca

SEQ ID NO: 191380 - DNA, 26 bp, Artificial Sequence
  Description of Artificial Sequence: Synthetic oligonucleotide
tgagccccggctcctcacaagtcaga

SEQ ID NO: 191381 - DNA, 25 bp, Artificial Sequence
  Description of Artificial Sequence: Synthetic oligonucleotide
gagccccggctcctcacaagtcaga

SEQ ID NO: 191382 - DNA, 25 bp, Artificial Sequence
  Description of Artificial Sequence: Synthetic oligonucleotide
agccccggctcctcacaagtcagag

SEQ ID NO: 191383 - DNA, 24 bp, Artificial Sequence
  Description of Artificial Sequence: Synthetic oligonucleotide
gccccggctcctcacaagtcagag

SEQ ID NO: 191384 - DNA, 24 bp, Artificial Sequence
  Description of Artificial Sequence: Synthetic oligonucleotide
ccccggctcctcacaagtcagagc

SEQ ID NO: 191385 - DNA, 24 bp, Artificial Sequence
  Description of Artificial Sequence: Synthetic oligonucleotide
cccggctcctcacaagtcagagcc

SEQ ID NO: 191386 - DNA, 25 bp, Artificial Sequence
  Description of Artificial Sequence: Synthetic oligonucleotide
ccggctcctcacaagtcagagccca

SEQ ID NO: 191387 - DNA, 25 bp, Artificial Sequence
  Description of Artificial Sequence: Synthetic oligonucleotide
cggctcctcacaagtcagagcccac

SEQ ID NO: 191388 - DNA, 25 bp, Artificial Sequence
  Description of Artificial Sequence: Synthetic oligonucleotide
ggctcctcacaagtcagagcccacg

SEQ ID NO: 191389 - DNA, 25 bp, Artificial Sequence
  Description of Artificial Sequence: Synthetic oligonucleotide
gctcctcacaagtcagagcccacgg

SEQ ID NO: 191390 - DNA, 25 bp, Artificial Sequence
  Description of Artificial Sequence: Synthetic oligonucleotide
ctcctcacaagtcagagcccacggc

SEQ ID NO: 191391 - DNA, 26 bp, Artificial Sequence
  Description of Artificial Sequence: Synthetic oligonucleotide
tcctcacaagtcagagcccacggcca

SEQ ID NO: 191392 - DNA, 25 bp, Artificial Sequence
  Description of Artificial Sequence: Synthetic oligonucleotide
cctcacaagtcagagcccacggcca

SEQ ID NO: 191393 - DNA, 27 bp, Artificial Sequence
  Description of Artificial Sequence: Synthetic oligonucleotide
ctcacaagtcagagcccacggccagaa

SEQ ID NO: 191394 - DNA, 27 bp, Artificial Sequence
  Description of Artificial Sequence: Synthetic oligonucleotide
tcacaagtcagagcccacggccagaag

SEQ ID NO: 191395 - DNA, 26 bp, Artificial Sequence
  Description of Artificial Sequence: Synthetic oligonucleotide
cacaagtcagagcccacggccagaag

SEQ ID NO: 191396 - DNA, 27 bp, Artificial Sequence
  Description of Artificial Sequence: Synthetic oligonucleotide
acaagtcagagcccacggccagaaggt

SEQ ID NO: 191397 - DNA, 26 bp, Artificial Sequence
  Description of Artificial Sequence: Synthetic oligonucleotide
caagtcagagcccacggccagaaggt

SEQ ID NO: 191398 - DNA, 26 bp, Artificial Sequence
  Description of Artificial Sequence: Synthetic oligonucleotide
aagtcagagcccacggccagaaggtg

SEQ ID NO: 191399 - DNA, 25 bp, Artificial Sequence
  Description of Artificial Sequence: Synthetic oligonucleotide
agtcagagcccacggccagaaggtg

SEQ ID NO: 191400 - DNA, 24 bp, Artificial Sequence
  Description of Artificial Sequence: Synthetic oligonucleotide
gtcagagcccacggccagaaggtg

SEQ ID NO: 191401 - DNA, 24 bp, Artificial Sequence
  Description of Artificial Sequence: Synthetic oligonucleotide
tcagagcccacggccagaaggtgg

SEQ ID NO: 191402 - DNA, 23 bp, Artificial Sequence
  Description of Artificial Sequence: Synthetic oligonucleotide
cagagcccacggccagaaggtgg

SEQ ID NO: 191403 - DNA, 23 bp, Artificial Sequence
  Description of Artificial Sequence: Synthetic oligonucleotide
agagcccacggccagaaggtggc

SEQ ID NO: 191404 - DNA, 22 bp, Artificial Sequence
  Description of Artificial Sequence: Synthetic oligonucleotide
gagcccacggccagaaggtggc

SEQ ID NO: 191405 - DNA, 22 bp, Artificial Sequence
  Description of Artificial Sequence: Synthetic oligonucleotide
agcccacggccagaaggtggcg

SEQ ID NO: 191406 - DNA, 21 bp, Artificial Sequence
  Description of Artificial Sequence: Synthetic oligonucleotide
gcccacggccagaaggtggcg

SEQ ID NO: 191407 - DNA, 22 bp, Artificial Sequence
  Description of Artificial Sequence: Synthetic oligonucleotide
cccacggccagaaggtggcgga

SEQ ID NO: 191408 - DNA, 22 bp, Artificial Sequence
  Description of Artificial Sequence: Synthetic oligonucleotide
ccacggccagaaggtggcggac

SEQ ID NO: 191409 - DNA, 22 bp, Artificial Sequence
  Description of Artificial Sequence: Synthetic oligonucleotide
cacggccagaaggtggcggacg

SEQ ID NO: 191410 - DNA, 22 bp, Artificial Sequence
  Description of Artificial Sequence: Synthetic oligonucleotide
acggccagaaggtggcggacgc

SEQ ID NO: 191411 - DNA, 21 bp, Artificial Sequence
  Description of Artificial Sequence: Synthetic oligonucleotide
cggccagaaggtggcggacgc

SEQ ID NO: 191412 - DNA, 21 bp, Artificial Sequence
  Description of Artificial Sequence: Synthetic oligonucleotide
ggccagaaggtggcggacgcg

SEQ ID NO: 191413 - DNA, 22 bp, Artificial Sequence
  Description of Artificial Sequence: Synthetic oligonucleotide
gccagaaggtggcggacgcgct

SEQ ID NO: 191414 - DNA, 23 bp, Artificial Sequence
  Description of Artificial Sequence: Synthetic oligonucleotide
ccagaaggtggcggacgcgctga

SEQ ID NO: 191415 - DNA, 23 bp, Artificial Sequence
  Description of Artificial Sequence: Synthetic oligonucleotide
cagaaggtggcggacgcgctgag

SEQ ID NO: 191416 - DNA, 23 bp, Artificial Sequence
  Description of Artificial Sequence: Synthetic oligonucleotide
agaaggtggcggacgcgctgagc

SEQ ID NO: 191417 - DNA, 22 bp, Artificial Sequence
  Description of Artificial Sequence: Synthetic oligonucleotide
gaaggtggcggacgcgctgagc

SEQ ID NO: 191418 - DNA, 23 bp, Artificial Sequence
  Description of Artificial Sequence: Synthetic oligonucleotide
aaggtggcggacgcgctgagcct

SEQ ID NO: 191419 - DNA, 22 bp, Artificial Sequence
  Description of Artificial Sequence: Synthetic oligonucleotide
aggtggcggacgcgctgagcct

SEQ ID NO: 191420 - DNA, 21 bp, Artificial Sequence
  Description of Artificial Sequence: Synthetic oligonucleotide
ggtggcggacgcgctgagcct

SEQ ID NO: 191421 - DNA, 21 bp, Artificial Sequence
  Description of Artificial Sequence: Synthetic oligonucleotide
gtggcggacgcgctgagcctc

SEQ ID NO: 191422 - DNA, 21 bp, Artificial Sequence
  Description of Artificial Sequence: Synthetic oligonucleotide
tggcggacgcgctgagcctcg

SEQ ID NO: 191423 - DNA, 20 bp, Artificial Sequence
  Description of Artificial Sequence: Synthetic oligonucleotide
ggcggacgcgctgagcctcg

SEQ ID NO: 191424 - DNA, 20 bp, Artificial Sequence
  Description of Artificial Sequence: Synthetic oligonucleotide
gcggacgcgctgagcctcgc

SEQ ID NO: 191425 - DNA, 20 bp, Artificial Sequence
  Description of Artificial Sequence: Synthetic oligonucleotide
cggacgcgctgagcctcgcc

SEQ ID NO: 191426 - DNA, 21 bp, Artificial Sequence
  Description of Artificial Sequence: Synthetic oligonucleotide
ggacgcgctgagcctcgccgt

SEQ ID NO: 191427 - DNA, 21 bp, Artificial Sequence
  Description of Artificial Sequence: Synthetic oligonucleotide
gacgcgctgagcctcgccgtg

SEQ ID NO: 191428 - DNA, 22 bp, Artificial Sequence
  Description of Artificial Sequence: Synthetic oligonucleotide
acgcgctgagcctcgccgtgga

SEQ ID NO: 191429 - DNA, 21 bp, Artificial Sequence
  Description of Artificial Sequence: Synthetic oligonucleotide
cgcgctgagcctcgccgtgga

SEQ ID NO: 191430 - DNA, 21 bp, Artificial Sequence
  Description of Artificial Sequence: Synthetic oligonucleotide
gcgctgagcctcgccgtggag

SEQ ID NO: 191431 - DNA, 21 bp, Artificial Sequence
  Description of Artificial Sequence: Synthetic oligonucleotide
cgctgagcctcgccgtggagc

SEQ ID NO: 191432 - DNA, 21 bp, Artificial Sequence
  Description of Artificial Sequence: Synthetic oligonucleotide
gctgagcctcgccgtggagcg

SEQ ID NO: 191433 - DNA, 21 bp, Artificial Sequence
  Description of Artificial Sequence: Synthetic oligonucleotide
ctgagcctcgccgtggagcgc

SEQ ID NO: 191434 - DNA, 22 bp, Artificial Sequence
  Description of Artificial Sequence: Synthetic oligonucleotide
tgagcctcgccgtggagcgcct

SEQ ID NO: 191435 - DNA, 21 bp, Artificial Sequence
  Description of Artificial Sequence: Synthetic oligonucleotide
gagcctcgccgtggagcgcct

SEQ ID NO: 191436 - DNA, 21 bp, Artificial Sequence
  Description of Artificial Sequence: Synthetic oligonucleotide
agcctcgccgtggagcgcctg

SEQ ID NO: 191437 - DNA, 20 bp, Artificial Sequence
  Description of Artificial Sequence: Synthetic oligonucleotide
gcctcgccgtggagcgcctg

SEQ ID NO: 191438 - DNA, 21 bp, Artificial Sequence
  Description of Artificial Sequence: Synthetic oligonucleotide
cctcgccgtggagcgcctgga

SEQ ID NO: 191439 - DNA, 21 bp, Artificial Sequence
  Description of Artificial Sequence: Synthetic oligonucleotide
ctcgccgtggagcgcctggac

SEQ ID NO: 191440 - DNA, 22 bp, Artificial Sequence
  Description of Artificial Sequence: Synthetic oligonucleotide
tcgccgtggagcgcctggacga

SEQ ID NO: 191441 - DNA, 21 bp, Artificial Sequence
  Description of Artificial Sequence: Synthetic oligonucleotide
cgccgtggagcgcctggacga

SEQ ID NO: 191442 - DNA, 21 bp, Artificial Sequence
  Description of Artificial Sequence: Synthetic oligonucleotide
gccgtggagcgcctggacgac

SEQ ID NO: 191443 - DNA, 23 bp, Artificial Sequence
  Description of Artificial Sequence: Synthetic oligonucleotide
ccgtggagcgcctggacgaccta

SEQ ID NO: 191444 - DNA, 23 bp, Artificial Sequence
  Description of Artificial Sequence: Synthetic oligonucleotide
cgtggagcgcctggacgacctac

SEQ ID NO: 191445 - DNA, 23 bp, Artificial Sequence
  Description of Artificial Sequence: Synthetic oligonucleotide
gtggagcgcctggacgacctacc

SEQ ID NO: 191446 - DNA, 23 bp, Artificial Sequence
  Description of Artificial Sequence: Synthetic oligonucleotide
tggagcgcctggacgacctaccc

SEQ ID NO: 191447 - DNA, 22 bp, Artificial Sequence
  Description of Artificial Sequence: Synthetic oligonucleotide
ggagcgcctggacgacctaccc

SEQ ID NO: 191448 - DNA, 23 bp, Artificial Sequence
  Description of Artificial Sequence: Synthetic oligonucleotide
gagcgcctggacgacctacccca

SEQ ID NO: 191449 - DNA, 23 bp, Artificial Sequence
  Description of Artificial Sequence: Synthetic oligonucleotide
agcgcctggacgacctaccccac

SEQ ID NO: 191450 - DNA, 22 bp, Artificial Sequence
  Description of Artificial Sequence: Synthetic oligonucleotide
gcgcctggacgacctaccccac

SEQ ID NO: 191451 - DNA, 22 bp, Artificial Sequence
  Description of Artificial Sequence: Synthetic oligonucleotide
cgcctggacgacctaccccacg

SEQ ID NO: 191452 - DNA, 22 bp, Artificial Sequence
  Description of Artificial Sequence: Synthetic oligonucleotide
gcctggacgacctaccccacgc

SEQ ID NO: 191453 - DNA, 22 bp, Artificial Sequence
  Description of Artificial Sequence: Synthetic oligonucleotide
cctggacgacctaccccacgcg

SEQ ID NO: 191454 - DNA, 23 bp, Artificial Sequence
  Description of Artificial Sequence: Synthetic oligonucleotide
ctggacgacctaccccacgcgct

SEQ ID NO: 191455 - DNA, 24 bp, Artificial Sequence
  Description of Artificial Sequence: Synthetic oligonucleotide
tggacgacctaccccacgcgctgt

SEQ ID NO: 191456 - DNA, 23 bp, Artificial Sequence
  Description of Artificial Sequence: Synthetic oligonucleotide
ggacgacctaccccacgcgctgt

SEQ ID NO: 191457 - DNA, 23 bp, Artificial Sequence
  Description of Artificial Sequence: Synthetic oligonucleotide
gacgacctaccccacgcgctgtc

SEQ ID NO: 191458 - DNA, 23 bp, Artificial Sequence
  Description of Artificial Sequence: Synthetic oligonucleotide
acgacctaccccacgcgctgtcc

SEQ ID NO: 191459 - DNA, 22 bp, Artificial Sequence
  Description of Artificial Sequence: Synthetic oligonucleotide
cgacctaccccacgcgctgtcc

SEQ ID NO: 191460 - DNA, 22 bp, Artificial Sequence
  Description of Artificial Sequence: Synthetic oligonucleotide
gacctaccccacgcgctgtccg

SEQ ID NO: 191461 - DNA, 22 bp, Artificial Sequence
  Description of Artificial Sequence: Synthetic oligonucleotide
acctaccccacgcgctgtccgc

SEQ ID NO: 191462 - DNA, 21 bp, Artificial Sequence
  Description of Artificial Sequence: Synthetic oligonucleotide
cctaccccacgcgctgtccgc

SEQ ID NO: 191463 - DNA, 21 bp, Artificial Sequence
  Description of Artificial Sequence: Synthetic oligonucleotide
ctaccccacgcgctgtccgcg

SEQ ID NO: 191464 - DNA, 22 bp, Artificial Sequence
  Description of Artificial Sequence: Synthetic oligonucleotide
taccccacgcgctgtccgcgct

SEQ ID NO: 191465 - DNA, 21 bp, Artificial Sequence
  Description of Artificial Sequence: Synthetic oligonucleotide
accccacgcgctgtccgcgct

SEQ ID NO: 191466 - DNA, 20 bp, Artificial Sequence
  Description of Artificial Sequence: Synthetic oligonucleotide
ccccacgcgctgtccgcgct

SEQ ID NO: 191467 - DNA, 21 bp, Artificial Sequence
  Description of Artificial Sequence: Synthetic oligonucleotide
cccacgcgctgtccgcgctga

SEQ ID NO: 191468 - DNA, 21 bp, Artificial Sequence
  Description of Artificial Sequence: Synthetic oligonucleotide
ccacgcgctgtccgcgctgag

SEQ ID NO: 191469 - DNA, 21 bp, Artificial Sequence
  Description of Artificial Sequence: Synthetic oligonucleotide
cacgcgctgtccgcgctgagc

SEQ ID NO: 191470 - DNA, 22 bp, Artificial Sequence
  Description of Artificial Sequence: Synthetic oligonucleotide
acgcgctgtccgcgctgagcca

SEQ ID NO: 191471 - DNA, 21 bp, Artificial Sequence
  Description of Artificial Sequence: Synthetic oligonucleotide
cgcgctgtccgcgctgagcca

SEQ ID NO: 191472 - DNA, 21 bp, Artificial Sequence
  Description of Artificial Sequence: Synthetic oligonucleotide
gcgctgtccgcgctgagccac

SEQ ID NO: 191473 - DNA, 22 bp, Artificial Sequence
  Description of Artificial Sequence: Synthetic oligonucleotide
cgctgtccgcgctgagccacct

SEQ ID NO: 191474 - DNA, 22 bp, Artificial Sequence
  Description of Artificial Sequence: Synthetic oligonucleotide
gctgtccgcgctgagccacctg

SEQ ID NO: 191475 - DNA, 23 bp, Artificial Sequence
  Description of Artificial Sequence: Synthetic oligonucleotide
ctgtccgcgctgagccacctgca

SEQ ID NO: 191476 - DNA, 23 bp, Artificial Sequence
  Description of Artificial Sequence: Synthetic oligonucleotide
tgtccgcgctgagccacctgcac

SEQ ID NO: 191477 - DNA, 22 bp, Artificial Sequence
  Description of Artificial Sequence: Synthetic oligonucleotide
gtccgcgctgagccacctgcac

SEQ ID NO: 191478 - DNA, 22 bp, Artificial Sequence
  Description of Artificial Sequence: Synthetic oligonucleotide
tccgcgctgagccacctgcacg

SEQ ID NO: 191479 - DNA, 21 bp, Artificial Sequence
  Description of Artificial Sequence: Synthetic oligonucleotide
ccgcgctgagccacctgcacg

SEQ ID NO: 191480 - DNA, 21 bp, Artificial Sequence
  Description of Artificial Sequence: Synthetic oligonucleotide
cgcgctgagccacctgcacgc

SEQ ID NO: 191481 - DNA, 22 bp, Artificial Sequence
  Description of Artificial Sequence: Synthetic oligonucleotide
gcgctgagccacctgcacgcgt

SEQ ID NO: 191482 - DNA, 22 bp, Artificial Sequence
  Description of Artificial Sequence: Synthetic oligonucleotide
cgctgagccacctgcacgcgtg

SEQ ID NO: 191483 - DNA, 22 bp, Artificial Sequence
  Description of Artificial Sequence: Synthetic oligonucleotide
gctgagccacctgcacgcgtgc

SEQ ID NO: 191484 - DNA, 23 bp, Artificial Sequence
  Description of Artificial Sequence: Synthetic oligonucleotide
ctgagccacctgcacgcgtgcca

SEQ ID NO: 191485 - DNA, 23 bp, Artificial Sequence
  Description of Artificial Sequence: Synthetic oligonucleotide
tgagccacctgcacgcgtgccag

SEQ ID NO: 191486 - DNA, 22 bp, Artificial Sequence
  Description of Artificial Sequence: Synthetic oligonucleotide
gagccacctgcacgcgtgccag

SEQ ID NO: 191487 - DNA, 23 bp, Artificial Sequence
  Description of Artificial Sequence: Synthetic oligonucleotide
agccacctgcacgcgtgccagct

SEQ ID NO: 191488 - DNA, 22 bp, Artificial Sequence
  Description of Artificial Sequence: Synthetic oligonucleotide
gccacctgcacgcgtgccagct

SEQ ID NO: 191489 - DNA, 22 bp, Artificial Sequence
  Description of Artificial Sequence: Synthetic oligonucleotide
ccacctgcacgcgtgccagctg

SEQ ID NO: 191490 - DNA, 22 bp, Artificial Sequence
  Description of Artificial Sequence: Synthetic oligonucleotide
cacctgcacgcgtgccagctgc

SEQ ID NO: 191491 - DNA, 23 bp, Artificial Sequence
  Description of Artificial Sequence: Synthetic oligonucleotide
acctgcacgcgtgccagctgcga

SEQ ID NO: 191492 - DNA, 22 bp, Artificial Sequence
  Description of Artificial Sequence: Synthetic oligonucleotide
cctgcacgcgtgccagctgcga

SEQ ID NO: 191493 - DNA, 23 bp, Artificial Sequence
  Description of Artificial Sequence: Synthetic oligonucleotide
ctgcacgcgtgccagctgcgagt

SEQ ID NO: 191494 - DNA, 23 bp, Artificial Sequence
  Description of Artificial Sequence: Synthetic oligonucleotide
tgcacgcgtgccagctgcgagtg

SEQ ID NO: 191495 - DNA, 22 bp, Artificial Sequence
  Description of Artificial Sequence: Synthetic oligonucleotide
gcacgcgtgccagctgcgagtg

SEQ ID NO: 191496 - DNA, 23 bp, Artificial Sequence
  Description of Artificial Sequence: Synthetic oligonucleotide
cacgcgtgccagctgcgagtgga

SEQ ID NO: 191497 - DNA, 23 bp, Artificial Sequence
  Description of Artificial Sequence: Synthetic oligonucleotide
acgcgtgccagctgcgagtggac

SEQ ID NO: 191498 - DNA, 22 bp, Artificial Sequence
  Description of Artificial Sequence: Synthetic oligonucleotide
cgcgtgccagctgcgagtggac

SEQ ID NO: 191499 - DNA, 22 bp, Artificial Sequence
  Description of Artificial Sequence: Synthetic oligonucleotide
gcgtgccagctgcgagtggacc

SEQ ID NO: 191500 - DNA, 22 bp, Artificial Sequence
  Description of Artificial Sequence: Synthetic oligonucleotide
cgtgccagctgcgagtggaccc

SEQ ID NO: 191501 - DNA, 22 bp, Artificial Sequence
  Description of Artificial Sequence: Synthetic oligonucleotide
gtgccagctgcgagtggacccg

SEQ ID NO: 191502 - DNA, 22 bp, Artificial Sequence
  Description of Artificial Sequence: Synthetic oligonucleotide
tgccagctgcgagtggacccgg

SEQ ID NO: 191503 - DNA, 21 bp, Artificial Sequence
  Description of Artificial Sequence: Synthetic oligonucleotide
gccagctgcgagtggacccgg

SEQ ID NO: 191504 - DNA, 21 bp, Artificial Sequence
  Description of Artificial Sequence: Synthetic oligonucleotide
ccagctgcgagtggacccggc

SEQ ID NO: 191505 - DNA, 22 bp, Artificial Sequence
  Description of Artificial Sequence: Synthetic oligonucleotide
cagctgcgagtggacccggcca

SEQ ID NO: 191506 - DNA, 22 bp, Artificial Sequence
  Description of Artificial Sequence: Synthetic oligonucleotide
agctgcgagtggacccggccag

SEQ ID NO: 191507 - DNA, 21 bp, Artificial Sequence
  Description of Artificial Sequence: Synthetic oligonucleotide
gctgcgagtggacccggccag

SEQ ID NO: 191508 - DNA, 23 bp, Artificial Sequence
  Description of Artificial Sequence: Synthetic oligonucleotide
ctgcgagtggacccggccagctt

SEQ ID NO: 191509 - DNA, 23 bp, Artificial Sequence
  Description of Artificial Sequence: Synthetic oligonucleotide
tgcgagtggacccggccagcttc

SEQ ID NO: 191510 - DNA, 22 bp, Artificial Sequence
  Description of Artificial Sequence: Synthetic oligonucleotide
gcgagtggacccggccagcttc

SEQ ID NO: 191511 - DNA, 23 bp, Artificial Sequence
  Description of Artificial Sequence: Synthetic oligonucleotide
cgagtggacccggccagcttcca

SEQ ID NO: 191512 - DNA, 23 bp, Artificial Sequence
  Description of Artificial Sequence: Synthetic oligonucleotide
gagtggacccggccagcttccag

SEQ ID NO: 191513 - DNA, 24 bp, Artificial Sequence
  Description of Artificial Sequence: Synthetic oligonucleotide
agtggacccggccagcttccagct

SEQ ID NO: 191514 - DNA, 23 bp, Artificial Sequence
  Description of Artificial Sequence: Synthetic oligonucleotide
gtggacccggccagcttccagct

SEQ ID NO: 191515 - DNA, 23 bp, Artificial Sequence
  Description of Artificial Sequence: Synthetic oligonucleotide
tggacccggccagcttccagctc

SEQ ID NO: 191516 - DNA, 22 bp, Artificial Sequence
  Description of Artificial Sequence: Synthetic oligonucleotide
ggacccggccagcttccagctc

SEQ ID NO: 191517 - DNA, 23 bp, Artificial Sequence
  Description of Artificial Sequence: Synthetic oligonucleotide
gacccggccagcttccagctcct

SEQ ID NO: 191518 - DNA, 23 bp, Artificial Sequence
  Description of Artificial Sequence: Synthetic oligonucleotide
acccggccagcttccagctcctg

SEQ ID NO: 191519 - DNA, 22 bp, Artificial Sequence
  Description of Artificial Sequence: Synthetic oligonucleotide
cccggccagcttccagctcctg

SEQ ID NO: 191520 - DNA, 22 bp, Artificial Sequence
  Description of Artificial Sequence: Synthetic oligonucleotide
ccggccagcttccagctcctgg

SEQ ID NO: 191521 - DNA, 22 bp, Artificial Sequence
  Description of Artificial Sequence: Synthetic oligonucleotide
cggccagcttccagctcctggg

SEQ ID NO: 191522 - DNA, 22 bp, Artificial Sequence
  Description of Artificial Sequence: Synthetic oligonucleotide
ggccagcttccagctcctgggc

SEQ ID NO: 191523 - DNA, 23 bp, Artificial Sequence
  Description of Artificial Sequence: Synthetic oligonucleotide
gccagcttccagctcctgggcca

SEQ ID NO: 191524 - DNA, 24 bp, Artificial Sequence
  Description of Artificial Sequence: Synthetic oligonucleotide
ccagcttccagctcctgggccact

SEQ ID NO: 191525 - DNA, 24 bp, Artificial Sequence
  Description of Artificial Sequence: Synthetic oligonucleotide
cagcttccagctcctgggccactg

SEQ ID NO: 191526 - DNA, 24 bp, Artificial Sequence
  Description of Artificial Sequence: Synthetic oligonucleotide
agcttccagctcctgggccactgc

SEQ ID NO: 191527 - DNA, 23 bp, Artificial Sequence
  Description of Artificial Sequence: Synthetic oligonucleotide
gcttccagctcctgggccactgc

SEQ ID NO: 191528 - DNA, 24 bp, Artificial Sequence
  Description of Artificial Sequence: Synthetic oligonucleotide
cttccagctcctgggccactgcct

SEQ ID NO: 191529 - DNA, 24 bp, Artificial Sequence
  Description of Artificial Sequence: Synthetic oligonucleotide
ttccagctcctgggccactgcctg

SEQ ID NO: 191530 - DNA, 23 bp, Artificial Sequence
  Description of Artificial Sequence: Synthetic oligonucleotide
tccagctcctgggccactgcctg

SEQ ID NO: 191531 - DNA, 22 bp, Artificial Sequence
  Description of Artificial Sequence: Synthetic oligonucleotide
ccagctcctgggccactgcctg

SEQ ID NO: 191532 - DNA, 23 bp, Artificial Sequence
  Description of Artificial Sequence: Synthetic oligonucleotide
cagctcctgggccactgcctgct

SEQ ID NO: 191533 - DNA, 23 bp, Artificial Sequence
  Description of Artificial Sequence: Synthetic oligonucleotide
agctcctgggccactgcctgctg

SEQ ID NO: 191534 - DNA, 22 bp, Artificial Sequence
  Description of Artificial Sequence: Synthetic oligonucleotide
gctcctgggccactgcctgctg

SEQ ID NO: 191535 - DNA, 25 bp, Artificial Sequence
  Description of Artificial Sequence: Synthetic oligonucleotide
ctcctgggccactgcctgctggtaa

SEQ ID NO: 191536 - DNA, 25 bp, Artificial Sequence
  Description of Artificial Sequence: Synthetic oligonucleotide
tcctgggccactgcctgctggtaac

SEQ ID NO: 191537 - DNA, 24 bp, Artificial Sequence
  Description of Artificial Sequence: Synthetic oligonucleotide
cctgggccactgcctgctggtaac

SEQ ID NO: 191538 - DNA, 24 bp, Artificial Sequence
  Description of Artificial Sequence: Synthetic oligonucleotide
ctgggccactgcctgctggtaacc

SEQ ID NO: 191539 - DNA, 25 bp, Artificial Sequence
  Description of Artificial Sequence: Synthetic oligonucleotide
tgggccactgcctgctggtaaccct

SEQ ID NO: 191540 - DNA, 24 bp, Artificial Sequence
  Description of Artificial Sequence: Synthetic oligonucleotide
gggccactgcctgctggtaaccct

SEQ ID NO: 191541 - DNA, 24 bp, Artificial Sequence
  Description of Artificial Sequence: Synthetic oligonucleotide
ggccactgcctgctggtaaccctc

SEQ ID NO: 191542 - DNA, 24 bp, Artificial Sequence
  Description of Artificial Sequence: Synthetic oligonucleotide
gccactgcctgctggtaaccctcg

SEQ ID NO: 191543 - DNA, 24 bp, Artificial Sequence
  Description of Artificial Sequence: Synthetic oligonucleotide
ccactgcctgctggtaaccctcgc

SEQ ID NO: 191544 - DNA, 24 bp, Artificial Sequence
  Description of Artificial Sequence: Synthetic oligonucleotide
cactgcctgctggtaaccctcgcc

SEQ ID NO: 191545 - DNA, 24 bp, Artificial Sequence
  Description of Artificial Sequence: Synthetic oligonucleotide
actgcctgctggtaaccctcgccc

SEQ ID NO: 191546 - DNA, 23 bp, Artificial Sequence
  Description of Artificial Sequence: Synthetic oligonucleotide
ctgcctgctggtaaccctcgccc

SEQ ID NO: 191547 - DNA, 23 bp, Artificial Sequence
  Description of Artificial Sequence: Synthetic oligonucleotide
tgcctgctggtaaccctcgcccg

SEQ ID NO: 191548 - DNA, 22 bp, Artificial Sequence
  Description of Artificial Sequence: Synthetic oligonucleotide
gcctgctggtaaccctcgcccg

SEQ ID NO: 191549 - DNA, 22 bp, Artificial Sequence
  Description of Artificial Sequence: Synthetic oligonucleotide
cctgctggtaaccctcgcccgg

SEQ ID NO: 191550 - DNA, 23 bp, Artificial Sequence
  Description of Artificial Sequence: Synthetic oligonucleotide
ctgctggtaaccctcgcccggca

SEQ ID NO: 191551 - DNA, 25 bp, Artificial Sequence
  Description of Artificial Sequence: Synthetic oligonucleotide
tgctggtaaccctcgcccggcacta

SEQ ID NO: 191552 - DNA, 24 bp, Artificial Sequence
  Description of Artificial Sequence: Synthetic oligonucleotide
gctggtaaccctcgcccggcacta

SEQ ID NO: 191553 - DNA, 24 bp, Artificial Sequence
  Description of Artificial Sequence: Synthetic oligonucleotide
ctggtaaccctcgcccggcactac

SEQ ID NO: 191554 - DNA, 24 bp, Artificial Sequence
  Description of Artificial Sequence: Synthetic oligonucleotide
tggtaaccctcgcccggcactacc

SEQ ID NO: 191555 - DNA, 23 bp, Artificial Sequence
  Description of Artificial Sequence: Synthetic oligonucleotide
ggtaaccctcgcccggcactacc

SEQ ID NO: 191556 - DNA, 23 bp, Artificial Sequence
  Description of Artificial Sequence: Synthetic oligonucleotide
gtaaccctcgcccggcactaccc

SEQ ID NO: 191557 - DNA, 23 bp, Artificial Sequence
  Description of Artificial Sequence: Synthetic oligonucleotide
taaccctcgcccggcactacccc

SEQ ID NO: 191558 - DNA, 22 bp, Artificial Sequence
  Description of Artificial Sequence: Synthetic oligonucleotide
aaccctcgcccggcactacccc

SEQ ID NO: 191559 - DNA, 21 bp, Artificial Sequence
  Description of Artificial Sequence: Synthetic oligonucleotide
accctcgcccggcactacccc

SEQ ID NO: 191560 - DNA, 20 bp, Artificial Sequence
  Description of Artificial Sequence: Synthetic oligonucleotide
ccctcgcccggcactacccc

SEQ ID NO: 191561 - DNA, 20 bp, Artificial Sequence
  Description of Artificial Sequence: Synthetic oligonucleotide
cctcgcccggcactaccccg

SEQ ID NO: 191562 - DNA, 21 bp, Artificial Sequence
  Description of Artificial Sequence: Synthetic oligonucleotide
ctcgcccggcactaccccgga

SEQ ID NO: 191563 - DNA, 22 bp, Artificial Sequence
  Description of Artificial Sequence: Synthetic oligonucleotide
tcgcccggcactaccccggaga

SEQ ID NO: 191564 - DNA, 21 bp, Artificial Sequence
  Description of Artificial Sequence: Synthetic oligonucleotide
cgcccggcactaccccggaga

SEQ ID NO: 191565 - DNA, 23 bp, Artificial Sequence
  Description of Artificial Sequence: Synthetic oligonucleotide
gcccggcactaccccggagactt

SEQ ID NO: 191566 - DNA, 24 bp, Artificial Sequence
  Description of Artificial Sequence: Synthetic oligonucleotide
cccggcactaccccggagacttca

SEQ ID NO: 191567 - DNA, 24 bp, Artificial Sequence
  Description of Artificial Sequence: Synthetic oligonucleotide
ccggcactaccccggagacttcag

SEQ ID NO: 191568 - DNA, 24 bp, Artificial Sequence
  Description of Artificial Sequence: Synthetic oligonucleotide
cggcactaccccggagacttcagc

SEQ ID NO: 191569 - DNA, 24 bp, Artificial Sequence
  Description of Artificial Sequence: Synthetic oligonucleotide
ggcactaccccggagacttcagcc

SEQ ID NO: 191570 - DNA, 24 bp, Artificial Sequence
  Description of Artificial Sequence: Synthetic oligonucleotide
gcactaccccggagacttcagccc

SEQ ID NO: 191571 - DNA, 24 bp, Artificial Sequence
  Description of Artificial Sequence: Synthetic oligonucleotide
cactaccccggagacttcagcccc

SEQ ID NO: 191572 - DNA, 24 bp, Artificial Sequence
  Description of Artificial Sequence: Synthetic oligonucleotide
actaccccggagacttcagccccg

SEQ ID NO: 191573 - DNA, 23 bp, Artificial Sequence
  Description of Artificial Sequence: Synthetic oligonucleotide
ctaccccggagacttcagccccg

SEQ ID NO: 191574 - DNA, 23 bp, Artificial Sequence
  Description of Artificial Sequence: Synthetic oligonucleotide
taccccggagacttcagccccgc

SEQ ID NO: 191575 - DNA, 22 bp, Artificial Sequence
  Description of Artificial Sequence: Synthetic oligonucleotide
accccggagacttcagccccgc

SEQ ID NO: 191576 - DNA, 21 bp, Artificial Sequence
  Description of Artificial Sequence: Synthetic oligonucleotide
ccccggagacttcagccccgc

SEQ ID NO: 191577 - DNA, 21 bp, Artificial Sequence
  Description of Artificial Sequence: Synthetic oligonucleotide
cccggagacttcagccccgcg

SEQ ID NO: 191578 - DNA, 22 bp, Artificial Sequence
  Description of Artificial Sequence: Synthetic oligonucleotide
ccggagacttcagccccgcgct

SEQ ID NO: 191579 - DNA, 22 bp, Artificial Sequence
  Description of Artificial Sequence: Synthetic oligonucleotide
cggagacttcagccccgcgctg

SEQ ID NO: 191580 - DNA, 23 bp, Artificial Sequence
  Description of Artificial Sequence: Synthetic oligonucleotide
ggagacttcagccccgcgctgca

SEQ ID NO: 191581 - DNA, 23 bp, Artificial Sequence
  Description of Artificial Sequence: Synthetic oligonucleotide
gagacttcagccccgcgctgcag

SEQ ID NO: 191582 - DNA, 23 bp, Artificial Sequence
  Description of Artificial Sequence: Synthetic oligonucleotide
agacttcagccccgcgctgcagg

SEQ ID NO: 191583 - DNA, 22 bp, Artificial Sequence
  Description of Artificial Sequence: Synthetic oligonucleotide
gacttcagccccgcgctgcagg

SEQ ID NO: 191584 - DNA, 22 bp, Artificial Sequence
  Description of Artificial Sequence: Synthetic oligonucleotide
acttcagccccgcgctgcaggc

SEQ ID NO: 191585 - DNA, 21 bp, Artificial Sequence
  Description of Artificial Sequence: Synthetic oligonucleotide
cttcagccccgcgctgcaggc

SEQ ID NO: 191586 - DNA, 22 bp, Artificial Sequence
  Description of Artificial Sequence: Synthetic oligonucleotide
ttcagccccgcgctgcaggcgt

SEQ ID NO: 191587 - DNA, 21 bp, Artificial Sequence
  Description of Artificial Sequence: Synthetic oligonucleotide
tcagccccgcgctgcaggcgt

SEQ ID NO: 191588 - DNA, 20 bp, Artificial Sequence
  Description of Artificial Sequence: Synthetic oligonucleotide
cagccccgcgctgcaggcgt

SEQ ID NO: 191589 - DNA, 20 bp, Artificial Sequence
  Description of Artificial Sequence: Synthetic oligonucleotide
agccccgcgctgcaggcgtc

SEQ ID NO: 191590 - DNA, 20 bp, Artificial Sequence
  Description of Artificial Sequence: Synthetic oligonucleotide
gccccgcgctgcaggcgtct

SEQ ID NO: 191591 - DNA, 20 bp, Artificial Sequence
  Description of Artificial Sequence: Synthetic oligonucleotide
ccccgcgctgcaggcgtcgt

SEQ ID NO: 191592 - DNA, 20 bp, Artificial Sequence
  Description of Artificial Sequence: Synthetic oligonucleotide
cccgcgctgcaggcgtcgct

SEQ ID NO: 191593 - DNA, 20 bp, Artificial Sequence
  Description of Artificial Sequence: Synthetic oligonucleotide
ccgcgctgcaggcgtcgctg

SEQ ID NO: 191594 - DNA, 21 bp, Artificial Sequence
  Description of Artificial Sequence: Synthetic oligonucleotide
cgcgctgcaggcgtcgctgga

SEQ ID NO: 191595 - DNA, 23 bp, Artificial Sequence
  Description of Artificial Sequence: Synthetic oligonucleotide
gcgctgcaggcgtcgctggacaa

SEQ ID NO: 191596 - DNA, 25 bp, Artificial Sequence
  Description of Artificial Sequence: Synthetic oligonucleotide
cgctgcaggcgtcgctggacaagtt

SEQ ID NO: 191597 - DNA, 25 bp, Artificial Sequence
  Description of Artificial Sequence: Synthetic oligonucleotide
gctgcaggcgtcgctggacaagttc

SEQ ID NO: 191598 - DNA, 26 bp, Artificial Sequence
  Description of Artificial Sequence: Synthetic oligonucleotide
ctgcaggcgtcgctggacaagttcct

SEQ ID NO: 191599 - DNA, 27 bp, Artificial Sequence
  Description of Artificial Sequence: Synthetic oligonucleotide
tgcaggcgtcgctggacaagttcctga

SEQ ID NO: 191600 - DNA, 26 bp, Artificial Sequence
  Description of Artificial Sequence: Synthetic oligonucleotide
gcaggcgtcgctggacaagttcctga

SEQ ID NO: 191601 - DNA, 26 bp, Artificial Sequence
  Description of Artificial Sequence: Synthetic oligonucleotide
caggcgtcgctggacaagttcctgag

SEQ ID NO: 191602 - DNA, 26 bp, Artificial Sequence
  Description of Artificial Sequence: Synthetic oligonucleotide
aggcgtcgctggacaagttcctgagc

SEQ ID NO: 191603 - DNA, 25 bp, Artificial Sequence
  Description of Artificial Sequence: Synthetic oligonucleotide
ggcgtcgctggacaagttcctgagc

SEQ ID NO: 191604 - DNA, 26 bp, Artificial Sequence
  Description of Artificial Sequence: Synthetic oligonucleotide
gcgtcgctggacaagttcctgagcca

SEQ ID NO: 191605 - DNA, 26 bp, Artificial Sequence
  Description of Artificial Sequence: Synthetic oligonucleotide
cgtcgctggacaagttcctgagccac

SEQ ID NO: 191606 - DNA, 27 bp, Artificial Sequence
  Description of Artificial Sequence: Synthetic oligonucleotide
gtcgctggacaagttcctgagccacgt

SEQ ID NO: 191607 - DNA, 30 bp, Artificial Sequence
  Description of Artificial Sequence: Synthetic oligonucleotide
tcgctggacaagttcctgagccacgttatc

SEQ ID NO: 191608 - DNA, 29 bp, Artificial Sequence
  Description of Artificial Sequence: Synthetic oligonucleotide
cgctggacaagttcctgagccacgttatc

SEQ ID NO: 191609 - DNA, 30 bp, Artificial Sequence
  Description of Artificial Sequence: Synthetic oligonucleotide
gctggacaagttcctgagccacgttatctc

SEQ ID NO: 191610 - DNA, 30 bp, Artificial Sequence
  Description of Artificial Sequence: Synthetic oligonucleotide
ctggacaagttcctgagccacgttatctcg

SEQ ID NO: 191611 - DNA, 30 bp, Artificial Sequence
  Description of Artificial Sequence: Synthetic oligonucleotide
tggacaagttcctgagccacgttatctcgg

SEQ ID NO: 191612 - DNA, 29 bp, Artificial Sequence
  Description of Artificial Sequence: Synthetic oligonucleotide
ggacaagttcctgagccacgttatctcgg

SEQ ID NO: 191613 - DNA, 29 bp, Artificial Sequence
  Description of Artificial Sequence: Synthetic oligonucleotide
gacaagttcctgagccacgttatctcggc

SEQ ID NO: 191614 - DNA, 29 bp, Artificial Sequence
  Description of Artificial Sequence: Synthetic oligonucleotide
acaagttcctgagccacgttatctcggcg

SEQ ID NO: 191615 - DNA, 28 bp, Artificial Sequence
  Description of Artificial Sequence: Synthetic oligonucleotide
caagttcctgagccacgttatctcggcg

SEQ ID NO: 191616 - DNA, 28 bp, Artificial Sequence
  Description of Artificial Sequence: Synthetic oligonucleotide
aagttcctgagccacgttatctcggcgc

SEQ ID NO: 191617 - DNA, 27 bp, Artificial Sequence
  Description of Artificial Sequence: Synthetic oligonucleotide
agttcctgagccacgttatctcggcgc

SEQ ID NO: 191618 - DNA, 27 bp, Artificial Sequence
  Description of Artificial Sequence: Synthetic oligonucleotide
gttcctgagccacgttatctcggcgct

SEQ ID NO: 191619 - DNA, 27 bp, Artificial Sequence
  Description of Artificial Sequence: Synthetic oligonucleotide
ttcctgagccacgttatctcggcgctg

SEQ ID NO: 191620 - DNA, 26 bp, Artificial Sequence
  Description of Artificial Sequence: Synthetic oligonucleotide
tcctgagccacgttatctcggcgctg

SEQ ID NO: 191621 - DNA, 25 bp, Artificial Sequence
  Description of Artificial Sequence: Synthetic oligonucleotide
cctgagccacgttatctcggcgctg

SEQ ID NO: 191622 - DNA, 27 bp, Artificial Sequence
  Description of Artificial Sequence: Synthetic oligonucleotide
ctgagccacgttatctcggcgctggtt

SEQ ID NO: 191623 - DNA, 28 bp, Artificial Sequence
  Description of Artificial Sequence: Synthetic oligonucleotide
tgagccacgttatctcggcgctggtttc

SEQ ID NO: 191624 - DNA, 27 bp, Artificial Sequence
  Description of Artificial Sequence: Synthetic oligonucleotide
gagccacgttatctcggcgctggtttc

SEQ ID NO: 191625 - DNA, 27 bp, Artificial Sequence
  Description of Artificial Sequence: Synthetic oligonucleotide
agccacgttatctcggcgctggtttcc

SEQ ID NO: 191626 - DNA, 26 bp, Artificial Sequence
  Description of Artificial Sequence: Synthetic oligonucleotide
gccacgttatctcggcgctggtttcc

SEQ ID NO: 191627 - DNA, 27 bp, Artificial Sequence
  Description of Artificial Sequence: Synthetic oligonucleotide
ccacgttatctcggcgctggtttccga

SEQ ID NO: 191628 - DNA, 27 bp, Artificial Sequence
  Description of Artificial Sequence: Synthetic oligonucleotide
cacgttatctcggcgctggtttccgag

SEQ ID NO: 191629 - DNA, 29 bp, Artificial Sequence
  Description of Artificial Sequence: Synthetic oligonucleotide
acgttatctcggcgctggtttccgagtac

SEQ ID NO: 191630 - DNA, 28 bp, Artificial Sequence
  Description of Artificial Sequence: Synthetic oligonucleotide
cgttatctcggcgctggtttccgagtac

SEQ ID NO: 191631 - DNA, 28 bp, Artificial Sequence
  Description of Artificial Sequence: Synthetic oligonucleotide
gttatctcggcgctggtttccgagtacc

SEQ ID NO: 191632 - DNA, 28 bp, Artificial Sequence
  Description of Artificial Sequence: Synthetic oligonucleotide
ttatctcggcgctggtttccgagtaccg

SEQ ID NO: 191633 - DNA, 27 bp, Artificial Sequence
  Description of Artificial Sequence: Synthetic oligonucleotide
tatctcggcgctggtttccgagtaccg

SEQ ID NO: 191634 - DNA, 26 bp, Artificial Sequence
  Description of Artificial Sequence: Synthetic oligonucleotide
atctcggcgctggtttccgagtaccg

SEQ ID NO: 191635 - DNA, 25 bp, Artificial Sequence
  Description of Artificial Sequence: Synthetic oligonucleotide
tctcggcgctggtttccgagtaccg

SEQ ID NO: 191636 - DNA, 24 bp, Artificial Sequence
  Description of Artificial Sequence: Synthetic oligonucleotide
ctcggcgctggtttccgagtaccg

SEQ ID NO: 191637 - DNA, 25 bp, Artificial Sequence
  Description of Artificial Sequence: Synthetic oligonucleotide
tcggcgctggtttccgagtaccgct

SEQ ID NO: 191638 - DNA, 24 bp, Artificial Sequence
  Description of Artificial Sequence: Synthetic oligonucleotide
cggcgctggtttccgagtaccgct

SEQ ID NO: 191639 - DNA, 25 bp, Artificial Sequence
  Description of Artificial Sequence: Synthetic oligonucleotide
ggcgctggtttccgagtaccgctga

SEQ ID NO: 191640 - DNA, 34 bp, Artificial Sequence
  Description of Artificial Sequence: Synthetic oligonucleotide
atgtctctgaccaagactgagaggaccatcattg

SEQ ID NO: 191641 - DNA, 33 bp, Artificial Sequence
  Description of Artificial Sequence: Synthetic oligonucleotide
tgtctctgaccaagactgagaggaccatcattg

SEQ ID NO: 191642 - DNA, 32 bp, Artificial Sequence
  Description of Artificial Sequence: Synthetic oligonucleotide
gtctctgaccaagactgagaggaccatcattg

SEQ ID NO: 191643 - DNA, 33 bp, Artificial Sequence
  Description of Artificial Sequence: Synthetic oligonucleotide
tctctgaccaagactgagaggaccatcattgtg

SEQ ID NO: 191644 - DNA, 32 bp, Artificial Sequence
  Description of Artificial Sequence: Synthetic oligonucleotide
ctctgaccaagactgagaggaccatcattgtg

SEQ ID NO: 191645 - DNA, 33 bp, Artificial Sequence
  Description of Artificial Sequence: Synthetic oligonucleotide
tctgaccaagactgagaggaccatcattgtgtc

SEQ ID NO: 191646 - DNA, 32 bp, Artificial Sequence
  Description of Artificial Sequence: Synthetic oligonucleotide
ctgaccaagactgagaggaccatcattgtgtc

SEQ ID NO: 191647 - DNA, 32 bp, Artificial Sequence
  Description of Artificial Sequence: Synthetic oligonucleotide
tgaccaagactgagaggaccatcattgtgtcc

SEQ ID NO: 191648 - DNA, 31 bp, Artificial Sequence
  Description of Artificial Sequence: Synthetic oligonucleotide
gaccaagactgagaggaccatcattgtgtcc

SEQ ID NO: 191649 - DNA, 33 bp, Artificial Sequence
  Description of Artificial Sequence: Synthetic oligonucleotide
accaagactgagaggaccatcattgtgtccatg

SEQ ID NO: 191650 - DNA, 32 bp, Artificial Sequence
  Description of Artificial Sequence: Synthetic oligonucleotide
ccaagactgagaggaccatcattgtgtccatg

SEQ ID NO: 191651 - DNA, 33 bp, Artificial Sequence
  Description of Artificial Sequence: Synthetic oligonucleotide
caagactgagaggaccatcattgtgtccatgtg

SEQ ID NO: 191652 - DNA, 33 bp, Artificial Sequence
  Description of Artificial Sequence: Synthetic oligonucleotide
aagactgagaggaccatcattgtgtccatgtgg

SEQ ID NO: 191653 - DNA, 32 bp, Artificial Sequence
  Description of Artificial Sequence: Synthetic oligonucleotide
agactgagaggaccatcattgtgtccatgtgg

SEQ ID NO: 191654 - DNA, 31 bp, Artificial Sequence
  Description of Artificial Sequence: Synthetic oligonucleotide
gactgagaggaccatcattgtgtccatgtgg

SEQ ID NO: 191655 - DNA, 31 bp, Artificial Sequence
  Description of Artificial Sequence: Synthetic oligonucleotide
actgagaggaccatcattgtgtccatgtggg

SEQ ID NO: 191656 - DNA, 30 bp, Artificial Sequence
  Description of Artificial Sequence: Synthetic oligonucleotide
ctgagaggaccatcattgtgtccatgtggg

SEQ ID NO: 191657 - DNA, 30 bp, Artificial Sequence
  Description of Artificial Sequence: Synthetic oligonucleotide
tgagaggaccatcattgtgtccatgtgggc

SEQ ID NO: 191658 - DNA, 29 bp, Artificial Sequence
  Description of Artificial Sequence: Synthetic oligonucleotide
gagaggaccatcattgtgtccatgtgggc

SEQ ID NO: 191659 - DNA, 29 bp, Artificial Sequence
  Description of Artificial Sequence: Synthetic oligonucleotide
agaggaccatcattgtgtccatgtgggcc

SEQ ID NO: 191660 - DNA, 28 bp, Artificial Sequence
  Description of Artificial Sequence: Synthetic oligonucleotide
gaggaccatcattgtgtccatgtgggcc

SEQ ID NO: 191661 - DNA, 30 bp, Artificial Sequence
  Description of Artificial Sequence: Synthetic oligonucleotide
aggaccatcattgtgtccatgtgggccaag

SEQ ID NO: 191662 - DNA, 29 bp, Artificial Sequence
  Description of Artificial Sequence: Synthetic oligonucleotide
ggaccatcattgtgtccatgtgggccaag

SEQ ID NO: 191663 - DNA, 31 bp, Artificial Sequence
  Description of Artificial Sequence: Synthetic oligonucleotide
gaccatcattgtgtccatgtgggccaagatc

SEQ ID NO: 191664 - DNA, 32 bp, Artificial Sequence
  Description of Artificial Sequence: Synthetic oligonucleotide
accatcattgtgtccatgtgggccaagatctc

SEQ ID NO: 191665 - DNA, 31 bp, Artificial Sequence
  Description of Artificial Sequence: Synthetic oligonucleotide
ccatcattgtgtccatgtgggccaagatctc

SEQ ID NO: 191666 - DNA, 31 bp, Artificial Sequence
  Description of Artificial Sequence: Synthetic oligonucleotide
catcattgtgtccatgtgggccaagatctcc

SEQ ID NO: 191667 - DNA, 32 bp, Artificial Sequence
  Description of Artificial Sequence: Synthetic oligonucleotide
atcattgtgtccatgtgggccaagatctccac

SEQ ID NO: 191668 - DNA, 31 bp, Artificial Sequence
  Description of Artificial Sequence: Synthetic oligonucleotide
tcattgtgtccatgtgggccaagatctccac

SEQ ID NO: 191669 - DNA, 30 bp, Artificial Sequence
  Description of Artificial Sequence: Synthetic oligonucleotide
cattgtgtccatgtgggccaagatctccac

SEQ ID NO: 191670 - DNA, 30 bp, Artificial Sequence
  Description of Artificial Sequence: Synthetic oligonucleotide
attgtgtccatgtgggccaagatctccacg

SEQ ID NO: 191671 - DNA, 29 bp, Artificial Sequence
  Description of Artificial Sequence: Synthetic oligonucleotide
ttgtgtccatgtgggccaagatctccacg

SEQ ID NO: 191672 - DNA, 28 bp, Artificial Sequence
  Description of Artificial Sequence: Synthetic oligonucleotide
tgtgtccatgtgggccaagatctccacg

SEQ ID NO: 191673 - DNA, 27 bp, Artificial Sequence
  Description of Artificial Sequence: Synthetic oligonucleotide
gtgtccatgtgggccaagatctccacg

SEQ ID NO: 191674 - DNA, 27 bp, Artificial Sequence
  Description of Artificial Sequence: Synthetic oligonucleotide
tgtccatgtgggccaagatctccacgc

SEQ ID NO: 191675 - DNA, 27 bp, Artificial Sequence
  Description of Artificial Sequence: Synthetic oligonucleotide
gtccatgtgggccaagatctccacgca

SEQ ID NO: 191676 - DNA, 27 bp, Artificial Sequence
  Description of Artificial Sequence: Synthetic oligonucleotide
tccatgtgggccaagatctccacgcag

SEQ ID NO: 191677 - DNA, 26 bp, Artificial Sequence
  Description of Artificial Sequence: Synthetic oligonucleotide
ccatgtgggccaagatctccacgcag

SEQ ID NO: 191678 - DNA, 26 bp, Artificial Sequence
  Description of Artificial Sequence: Synthetic oligonucleotide
catgtgggccaagatctccacgcagg

SEQ ID NO: 191679 - DNA, 26 bp, Artificial Sequence
  Description of Artificial Sequence: Synthetic oligonucleotide
atgtgggccaagatctccacgcaggc

SEQ ID NO: 191680 - DNA, 25 bp, Artificial Sequence
  Description of Artificial Sequence: Synthetic oligonucleotide
tgtgggccaagatctccacgcaggc

SEQ ID NO: 191681 - DNA, 24 bp, Artificial Sequence
  Description of Artificial Sequence: Synthetic oligonucleotide
gtgggccaagatctccacgcaggc

SEQ ID NO: 191682 - DNA, 24 bp, Artificial Sequence
  Description of Artificial Sequence: Synthetic oligonucleotide
tgggccaagatctccacgcaggcc

SEQ ID NO: 191683 - DNA, 23 bp, Artificial Sequence
  Description of Artificial Sequence: Synthetic oligonucleotide
gggccaagatctccacgcaggcc

SEQ ID NO: 191684 - DNA, 24 bp, Artificial Sequence
  Description of Artificial Sequence: Synthetic oligonucleotide
ggccaagatctccacgcaggccga

SEQ ID NO: 191685 - DNA, 25 bp, Artificial Sequence
  Description of Artificial Sequence: Synthetic oligonucleotide
gccaagatctccacgcaggccgaca

SEQ ID NO: 191686 - DNA, 25 bp, Artificial Sequence
  Description of Artificial Sequence: Synthetic oligonucleotide
ccaagatctccacgcaggccgacac

SEQ ID NO: 191687 - DNA, 27 bp, Artificial Sequence
  Description of Artificial Sequence: Synthetic oligonucleotide
caagatctccacgcaggccgacaccat

SEQ ID NO: 191688 - DNA, 27 bp, Artificial Sequence
  Description of Artificial Sequence: Synthetic oligonucleotide
aagatctccacgcaggccgacaccatc

SEQ ID NO: 191689 - DNA, 26 bp, Artificial Sequence
  Description of Artificial Sequence: Synthetic oligonucleotide
agatctccacgcaggccgacaccatc

SEQ ID NO: 191690 - DNA, 25 bp, Artificial Sequence
  Description of Artificial Sequence: Synthetic oligonucleotide
gatctccacgcaggccgacaccatc

SEQ ID NO: 191691 - DNA, 25 bp, Artificial Sequence
  Description of Artificial Sequence: Synthetic oligonucleotide
atctccacgcaggccgacaccatcg

SEQ ID NO: 191692 - DNA, 24 bp, Artificial Sequence
  Description of Artificial Sequence: Synthetic oligonucleotide
tctccacgcaggccgacaccatcg

SEQ ID NO: 191693 - DNA, 23 bp, Artificial Sequence
  Description of Artificial Sequence: Synthetic oligonucleotide
ctccacgcaggccgacaccatcg

SEQ ID NO: 191694 - DNA, 23 bp, Artificial Sequence
  Description of Artificial Sequence: Synthetic oligonucleotide
tccacgcaggccgacaccatcgg

SEQ ID NO: 191695 - DNA, 22 bp, Artificial Sequence
  Description of Artificial Sequence: Synthetic oligonucleotide
ccacgcaggccgacaccatcgg

SEQ ID NO: 191696 - DNA, 23 bp, Artificial Sequence
  Description of Artificial Sequence: Synthetic oligonucleotide
cacgcaggccgacaccatcggca

SEQ ID NO: 191697 - DNA, 23 bp, Artificial Sequence
  Description of Artificial Sequence: Synthetic oligonucleotide
acgcaggccgacaccatcggcac

SEQ ID NO: 191698 - DNA, 22 bp, Artificial Sequence
  Description of Artificial Sequence: Synthetic oligonucleotide
cgcaggccgacaccatcggcac

SEQ ID NO: 191699 - DNA, 22 bp, Artificial Sequence
  Description of Artificial Sequence: Synthetic oligonucleotide
gcaggccgacaccatcggcacc

SEQ ID NO: 191700 - DNA, 23 bp, Artificial Sequence
  Description of Artificial Sequence: Synthetic oligonucleotide
caggccgacaccatcggcaccga

SEQ ID NO: 191701 - DNA, 24 bp, Artificial Sequence
  Description of Artificial Sequence: Synthetic oligonucleotide
aggccgacaccatcggcaccgaga

SEQ ID NO: 191702 - DNA, 23 bp, Artificial Sequence
  Description of Artificial Sequence: Synthetic oligonucleotide
ggccgacaccatcggcaccgaga

SEQ ID NO: 191703 - DNA, 24 bp, Artificial Sequence
  Description of Artificial Sequence: Synthetic oligonucleotide
gccgacaccatcggcaccgagact

SEQ ID NO: 191704 - DNA, 25 bp, Artificial Sequence
  Description of Artificial Sequence: Synthetic oligonucleotide
ccgacaccatcggcaccgagactct

SEQ ID NO: 191705 - DNA, 25 bp, Artificial Sequence
  Description of Artificial Sequence: Synthetic oligonucleotide
cgacaccatcggcaccgagactctg

SEQ ID NO: 191706 - DNA, 26 bp, Artificial Sequence
  Description of Artificial Sequence: Synthetic oligonucleotide
gacaccatcggcaccgagactctgga

SEQ ID NO: 191707 - DNA, 27 bp, Artificial Sequence
  Description of Artificial Sequence: Synthetic oligonucleotide
acaccatcggcaccgagactctggaga

SEQ ID NO: 191708 - DNA, 26 bp, Artificial Sequence
  Description of Artificial Sequence: Synthetic oligonucleotide
caccatcggcaccgagactctggaga

SEQ ID NO: 191709 - DNA, 26 bp, Artificial Sequence
  Description of Artificial Sequence: Synthetic oligonucleotide
accatcggcaccgagactctggagag

SEQ ID NO: 191710 - DNA, 25 bp, Artificial Sequence
  Description of Artificial Sequence: Synthetic oligonucleotide
ccatcggcaccgagactctggagag

SEQ ID NO: 191711 - DNA, 25 bp, Artificial Sequence
  Description of Artificial Sequence: Synthetic oligonucleotide
catcggcaccgagactctggagagg

SEQ ID NO: 191712 - DNA, 26 bp, Artificial Sequence
  Description of Artificial Sequence: Synthetic oligonucleotide
atcggcaccgagactctggagaggct

SEQ ID NO: 191713 - DNA, 25 bp, Artificial Sequence
  Description of Artificial Sequence: Synthetic oligonucleotide
tcggcaccgagactctggagaggct

SEQ ID NO: 191714 - DNA, 24 bp, Artificial Sequence
  Description of Artificial Sequence: Synthetic oligonucleotide
cggcaccgagactctggagaggct

SEQ ID NO: 191715 - DNA, 26 bp, Artificial Sequence
  Description of Artificial Sequence: Synthetic oligonucleotide
ggcaccgagactctggagaggctctt

SEQ ID NO: 191716 - DNA, 26 bp, Artificial Sequence
  Description of Artificial Sequence: Synthetic oligonucleotide
gcaccgagactctggagaggctcttc

SEQ ID NO: 191717 - DNA, 27 bp, Artificial Sequence
  Description of Artificial Sequence: Synthetic oligonucleotide
caccgagactctggagaggctcttcct

SEQ ID NO: 191718 - DNA, 27 bp, Artificial Sequence
  Description of Artificial Sequence: Synthetic oligonucleotide
accgagactctggagaggctcttcctc

SEQ ID NO: 191719 - DNA, 27 bp, Artificial Sequence
  Description of Artificial Sequence: Synthetic oligonucleotide
ccgagactctggagaggctcttcctca

SEQ ID NO: 191720 - DNA, 27 bp, Artificial Sequence
  Description of Artificial Sequence: Synthetic oligonucleotide
cgagactctggagaggctcttcctcag

SEQ ID NO: 191721 - DNA, 27 bp, Artificial Sequence
  Description of Artificial Sequence: Synthetic oligonucleotide
gagactctggagaggctcttcctcagc

SEQ ID NO: 191722 - DNA, 27 bp, Artificial Sequence
  Description of Artificial Sequence: Synthetic oligonucleotide
agactctggagaggctcttcctcagcc

SEQ ID NO: 191723 - DNA, 27 bp, Artificial Sequence
  Description of Artificial Sequence: Synthetic oligonucleotide
gactctggagaggctcttcctcagcca

SEQ ID NO: 191724 - DNA, 27 bp, Artificial Sequence
  Description of Artificial Sequence: Synthetic oligonucleotide
actctggagaggctcttcctcagccac

SEQ ID NO: 191725 - DNA, 26 bp, Artificial Sequence
  Description of Artificial Sequence: Synthetic oligonucleotide
ctctggagaggctcttcctcagccac

SEQ ID NO: 191726 - DNA, 26 bp, Artificial Sequence
  Description of Artificial Sequence: Synthetic oligonucleotide
tctggagaggctcttcctcagccacc

SEQ ID NO: 191727 - DNA, 25 bp, Artificial Sequence
  Description of Artificial Sequence: Synthetic oligonucleotide
ctggagaggctcttcctcagccacc

SEQ ID NO: 191728 - DNA, 25 bp, Artificial Sequence
  Description of Artificial Sequence: Synthetic oligonucleotide
tggagaggctcttcctcagccaccc

SEQ ID NO: 191729 - DNA, 24 bp, Artificial Sequence
  Description of Artificial Sequence: Synthetic oligonucleotide
ggagaggctcttcctcagccaccc

SEQ ID NO: 191730 - DNA, 24 bp, Artificial Sequence
  Description of Artificial Sequence: Synthetic oligonucleotide
gagaggctcttcctcagccacccg

SEQ ID NO: 191731 - DNA, 25 bp, Artificial Sequence
  Description of Artificial Sequence: Synthetic oligonucleotide
agaggctcttcctcagccacccgca

SEQ ID NO: 191732 - DNA, 24 bp, Artificial Sequence
  Description of Artificial Sequence: Synthetic oligonucleotide
gaggctcttcctcagccacccgca

SEQ ID NO: 191733 - DNA, 25 bp, Artificial Sequence
  Description of Artificial Sequence: Synthetic oligonucleotide
aggctcttcctcagccacccgcaga

SEQ ID NO: 191734 - DNA, 24 bp, Artificial Sequence
  Description of Artificial Sequence: Synthetic oligonucleotide
ggctcttcctcagccacccgcaga

SEQ ID NO: 191735 - DNA, 24 bp, Artificial Sequence
  Description of Artificial Sequence: Synthetic oligonucleotide
gctcttcctcagccacccgcagac

SEQ ID NO: 191736 - DNA, 26 bp, Artificial Sequence
  Description of Artificial Sequence: Synthetic oligonucleotide
ctcttcctcagccacccgcagaccaa

SEQ ID NO: 191737 - DNA, 27 bp, Artificial Sequence
  Description of Artificial Sequence: Synthetic oligonucleotide
tcttcctcagccacccgcagaccaaga

SEQ ID NO: 191738 - DNA, 26 bp, Artificial Sequence
  Description of Artificial Sequence: Synthetic oligonucleotide
cttcctcagccacccgcagaccaaga

SEQ ID NO: 191739 - DNA, 26 bp, Artificial Sequence
  Description of Artificial Sequence: Synthetic oligonucleotide
ttcctcagccacccgcagaccaagac

SEQ ID NO: 191740 - DNA, 25 bp, Artificial Sequence
  Description of Artificial Sequence: Synthetic oligonucleotide
tcctcagccacccgcagaccaagac

SEQ ID NO: 191741 - DNA, 24 bp, Artificial Sequence
  Description of Artificial Sequence: Synthetic oligonucleotide
cctcagccacccgcagaccaagac

SEQ ID NO: 191742 - DNA, 26 bp, Artificial Sequence
  Description of Artificial Sequence: Synthetic oligonucleotide
ctcagccacccgcagaccaagaccta

SEQ ID NO: 191743 - DNA, 27 bp, Artificial Sequence
  Description of Artificial Sequence: Synthetic oligonucleotide
tcagccacccgcagaccaagacctact

SEQ ID NO: 191744 - DNA, 27 bp, Artificial Sequence
  Description of Artificial Sequence: Synthetic oligonucleotide
cagccacccgcagaccaagacctactt

SEQ ID NO: 191745 - DNA, 27 bp, Artificial Sequence
  Description of Artificial Sequence: Synthetic oligonucleotide
agccacccgcagaccaagacctacttc

SEQ ID NO: 191746 - DNA, 26 bp, Artificial Sequence
  Description of Artificial Sequence: Synthetic oligonucleotide
gccacccgcagaccaagacctacttc

SEQ ID NO: 191747 - DNA, 26 bp, Artificial Sequence
  Description of Artificial Sequence: Synthetic oligonucleotide
ccacccgcagaccaagacctacttcc

SEQ ID NO: 191748 - DNA, 26 bp, Artificial Sequence
  Description of Artificial Sequence: Synthetic oligonucleotide
cacccgcagaccaagacctacttccc

SEQ ID NO: 191749 - DNA, 26 bp, Artificial Sequence
  Description of Artificial Sequence: Synthetic oligonucleotide
acccgcagaccaagacctacttcccg

SEQ ID NO: 191750 - DNA, 25 bp, Artificial Sequence
  Description of Artificial Sequence: Synthetic oligonucleotide
cccgcagaccaagacctacttcccg

SEQ ID NO: 191751 - DNA, 26 bp, Artificial Sequence
  Description of Artificial Sequence: Synthetic oligonucleotide
ccgcagaccaagacctacttcccgca

SEQ ID NO: 191752 - DNA, 27 bp, Artificial Sequence
  Description of Artificial Sequence: Synthetic oligonucleotide
cgcagaccaagacctacttcccgcact

SEQ ID NO: 191753 - DNA, 28 bp, Artificial Sequence
  Description of Artificial Sequence: Synthetic oligonucleotide
gcagaccaagacctacttcccgcacttc

SEQ ID NO: 191754 - DNA, 28 bp, Artificial Sequence
  Description of Artificial Sequence: Synthetic oligonucleotide
cagaccaagacctacttcccgcacttcg

SEQ ID NO: 191755 - DNA, 29 bp, Artificial Sequence
  Description of Artificial Sequence: Synthetic oligonucleotide
agaccaagacctacttcccgcacttcgac

SEQ ID NO: 191756 - DNA, 28 bp, Artificial Sequence
  Description of Artificial Sequence: Synthetic oligonucleotide
gaccaagacctacttcccgcacttcgac

SEQ ID NO: 191757 - DNA, 28 bp, Artificial Sequence
  Description of Artificial Sequence: Synthetic oligonucleotide
aagacctacttcccgcacttcgacctgc

SEQ ID NO: 191758 - DNA, 27 bp, Artificial Sequence
  Description of Artificial Sequence: Synthetic oligonucleotide
agacctacttcccgcacttcgacctgc

SEQ ID NO: 191759 - DNA, 27 bp, Artificial Sequence
  Description of Artificial Sequence: Synthetic oligonucleotide
gacctacttcccgcacttcgacctgca

SEQ ID NO: 191760 - DNA, 27 bp, Artificial Sequence
  Description of Artificial Sequence: Synthetic oligonucleotide
acctacttcccgcacttcgacctgcac

SEQ ID NO: 191761 - DNA, 26 bp, Artificial Sequence
  Description of Artificial Sequence: Synthetic oligonucleotide
cctacttcccgcacttcgacctgcac

SEQ ID NO: 191762 - DNA, 26 bp, Artificial Sequence
  Description of Artificial Sequence: Synthetic oligonucleotide
ctacttcccgcacttcgacctgcacc

SEQ ID NO: 191763 - DNA, 26 bp, Artificial Sequence
  Description of Artificial Sequence: Synthetic oligonucleotide
tacttcccgcacttcgacctgcaccc

SEQ ID NO: 191764 - DNA, 25 bp, Artificial Sequence
  Description of Artificial Sequence: Synthetic oligonucleotide
acttcccgcacttcgacctgcaccc

SEQ ID NO: 191765 - DNA, 24 bp, Artificial Sequence
  Description of Artificial Sequence: Synthetic oligonucleotide
cttcccgcacttcgacctgcaccc

SEQ ID NO: 191766 - DNA, 24 bp, Artificial Sequence
  Description of Artificial Sequence: Synthetic oligonucleotide
ttcccgcacttcgacctgcacccg

SEQ ID NO: 191767 - DNA, 23 bp, Artificial Sequence
  Description of Artificial Sequence: Synthetic oligonucleotide
tcccgcacttcgacctgcacccg

SEQ ID NO: 191768 - DNA, 22 bp, Artificial Sequence
  Description of Artificial Sequence: Synthetic oligonucleotide
cccgcacttcgacctgcacccg

SEQ ID NO: 191769 - DNA, 22 bp, Artificial Sequence
  Description of Artificial Sequence: Synthetic oligonucleotide
ccgcacttcgacctgcacccgg

SEQ ID NO: 191770 - DNA, 22 bp, Artificial Sequence
  Description of Artificial Sequence: Synthetic oligonucleotide
cgcacttcgacctgcacccggg

SEQ ID NO: 191771 - DNA, 23 bp, Artificial Sequence
  Description of Artificial Sequence: Synthetic oligonucleotide
gcacttcgacctgcacccggggt

SEQ ID NO: 191772 - DNA, 23 bp, Artificial Sequence
  Description of Artificial Sequence: Synthetic oligonucleotide
cacttcgacctgcacccggggtc

SEQ ID NO: 191773 - DNA, 23 bp, Artificial Sequence
  Description of Artificial Sequence: Synthetic oligonucleotide
acttcgacctgcacccggggtcc

SEQ ID NO: 191774 - DNA, 22 bp, Artificial Sequence
  Description of Artificial Sequence: Synthetic oligonucleotide
cttcgacctgcacccggggtcc

SEQ ID NO: 191775 - DNA, 22 bp, Artificial Sequence
  Description of Artificial Sequence: Synthetic oligonucleotide
ttcgacctgcacccggggtccg

SEQ ID NO: 191776 - DNA, 21 bp, Artificial Sequence
  Description of Artificial Sequence: Synthetic oligonucleotide
tcgacctgcacccggggtccg

SEQ ID NO: 191777 - DNA, 20 bp, Artificial Sequence
  Description of Artificial Sequence: Synthetic oligonucleotide
cgacctgcacccggggtccg

SEQ ID NO: 191778 - DNA, 20 bp, Artificial Sequence
  Description of Artificial Sequence: Synthetic oligonucleotide
gacctgcacccggggtccgc

SEQ ID NO: 191779 - DNA, 20 bp, Artificial Sequence
  Description of Artificial Sequence: Synthetic oligonucleotide
acctgcacccggggtccgcg

SEQ ID NO: 191780 - DNA, 20 bp, Artificial Sequence
  Description of Artificial Sequence: Synthetic oligonucleotide
cctgcacccggggtccgcgt

SEQ ID NO: 191781 - DNA, 20 bp, Artificial Sequence
  Description of Artificial Sequence: Synthetic oligonucleotide
ctgcacccggggtccgcgca

SEQ ID NO: 191782 - DNA, 22 bp, Artificial Sequence
  Description of Artificial Sequence: Synthetic oligonucleotide
tgcacccggggtccgcgcagtt

SEQ ID NO: 191783 - DNA, 21 bp, Artificial Sequence
  Description of Artificial Sequence: Synthetic oligonucleotide
gcacccggggtccgcgcagtt

SEQ ID NO: 191784 - DNA, 21 bp, Artificial Sequence
  Description of Artificial Sequence: Synthetic oligonucleotide
cacccggggtccgcgcagttg

SEQ ID NO: 191785 - DNA, 21 bp, Artificial Sequence
  Description of Artificial Sequence: Synthetic oligonucleotide
acccggggtccgcgcagttgc

SEQ ID NO: 191786 - DNA, 20 bp, Artificial Sequence
  Description of Artificial Sequence: Synthetic oligonucleotide
cccggggtccgcgcagttgc

SEQ ID NO: 191787 - DNA, 20 bp, Artificial Sequence
  Description of Artificial Sequence: Synthetic oligonucleotide
ccggggtccgcgcagttgcg

SEQ ID NO: 191788 - DNA, 20 bp, Artificial Sequence
  Description of Artificial Sequence: Synthetic oligonucleotide
cggggtccgcgcagttgcgc

SEQ ID NO: 191789 - DNA, 20 bp, Artificial Sequence
  Description of Artificial Sequence: Synthetic oligonucleotide
ggggtccgcgcagttgcgcg

SEQ ID NO: 191790 - DNA, 20 bp, Artificial Sequence
  Description of Artificial Sequence: Synthetic oligonucleotide
gggtccgcgcagttgcgcgc

SEQ ID NO: 191791 - DNA, 20 bp, Artificial Sequence
  Description of Artificial Sequence: Synthetic oligonucleotide
ggtccgcgcagttgcgcgcg

SEQ ID NO: 191792 - DNA, 21 bp, Artificial Sequence
  Description of Artificial Sequence: Synthetic oligonucleotide
gtccgcgcagttgcgcgcgca

SEQ ID NO: 191793 - DNA, 21 bp, Artificial Sequence
  Description of Artificial Sequence: Synthetic oligonucleotide
tccgcgcagttgcgcgcgcac

SEQ ID NO: 191794 - DNA, 20 bp, Artificial Sequence
  Description of Artificial Sequence: Synthetic oligonucleotide
ccgcgcagttgcgcgcgcac

SEQ ID NO: 191795 - DNA, 20 bp, Artificial Sequence
  Description of Artificial Sequence: Synthetic oligonucleotide
cgcgcagttgcgcgcgcacg

SEQ ID NO: 191796 - DNA, 20 bp, Artificial Sequence
  Description of Artificial Sequence: Synthetic oligonucleotide
gcgcagttgcgcgcgcacgg

SEQ ID NO: 191797 - DNA, 21 bp, Artificial Sequence
  Description of Artificial Sequence: Synthetic oligonucleotide
cgcagttgcgcgcgcacggct

SEQ ID NO: 191798 - DNA, 21 bp, Artificial Sequence
  Description of Artificial Sequence: Synthetic oligonucleotide
gcagttgcgcgcgcacggctc

SEQ ID NO: 191799 - DNA, 23 bp, Artificial Sequence
  Description of Artificial Sequence: Synthetic oligonucleotide
cagttgcgcgcgcacggctccaa

SEQ ID NO: 191800 - DNA, 23 bp, Artificial Sequence
  Description of Artificial Sequence: Synthetic oligonucleotide
agttgcgcgcgcacggctccaag

SEQ ID NO: 191801 - DNA, 22 bp, Artificial Sequence
  Description of Artificial Sequence: Synthetic oligonucleotide
gttgcgcgcgcacggctccaag

SEQ ID NO: 191802 - DNA, 23 bp, Artificial Sequence
  Description of Artificial Sequence: Synthetic oligonucleotide
ttgcgcgcgcacggctccaaggt

SEQ ID NO: 191803 - DNA, 22 bp, Artificial Sequence
  Description of Artificial Sequence: Synthetic oligonucleotide
tgcgcgcgcacggctccaaggt

SEQ ID NO: 191804 - DNA, 21 bp, Artificial Sequence
  Description of Artificial Sequence: Synthetic oligonucleotide
gcgcgcgcacggctccaaggt

SEQ ID NO: 191805 - DNA, 21 bp, Artificial Sequence
  Description of Artificial Sequence: Synthetic oligonucleotide
cgcgcgcacggctccaaggtg

SEQ ID NO: 191806 - DNA, 22 bp, Artificial Sequence
  Description of Artificial Sequence: Synthetic oligonucleotide
gcgcgcacggctccaaggtggt

SEQ ID NO: 191807 - DNA, 22 bp, Artificial Sequence
  Description of Artificial Sequence: Synthetic oligonucleotide
cgcgcacggctccaaggtggtg

SEQ ID NO: 191808 - DNA, 22 bp, Artificial Sequence
  Description of Artificial Sequence: Synthetic oligonucleotide
gcgcacggctccaaggtggtgg

SEQ ID NO: 191809 - DNA, 22 bp, Artificial Sequence
  Description of Artificial Sequence: Synthetic oligonucleotide
cgcacggctccaaggtggtggc

SEQ ID NO: 191810 - DNA, 22 bp, Artificial Sequence
  Description of Artificial Sequence: Synthetic oligonucleotide
gcacggctccaaggtggtggcc

SEQ ID NO: 191811 - DNA, 22 bp, Artificial Sequence
  Description of Artificial Sequence: Synthetic oligonucleotide
cacggctccaaggtggtggccg

SEQ ID NO: 191812 - DNA, 22 bp, Artificial Sequence
  Description of Artificial Sequence: Synthetic oligonucleotide
acggctccaaggtggtggccgc

SEQ ID NO: 191813 - DNA, 21 bp, Artificial Sequence
  Description of Artificial Sequence: Synthetic oligonucleotide
cggctccaaggtggtggccgc

SEQ ID NO: 191814 - DNA, 21 bp, Artificial Sequence
  Description of Artificial Sequence: Synthetic oligonucleotide
ggctccaaggtggtggccgcc

SEQ ID NO: 191815 - DNA, 22 bp, Artificial Sequence
  Description of Artificial Sequence: Synthetic oligonucleotide
gctccaaggtggtggccgccgt

SEQ ID NO: 191816 - DNA, 22 bp, Artificial Sequence
  Description of Artificial Sequence: Synthetic oligonucleotide
ctccaaggtggtggccgccgtg

SEQ ID NO: 191817 - DNA, 22 bp, Artificial Sequence
  Description of Artificial Sequence: Synthetic oligonucleotide
tccaaggtggtggccgccgtgg

SEQ ID NO: 191818 - DNA, 21 bp, Artificial Sequence
  Description of Artificial Sequence: Synthetic oligonucleotide
ccaaggtggtggccgccgtgg

SEQ ID NO: 191819 - DNA, 21 bp, Artificial Sequence
  Description of Artificial Sequence: Synthetic oligonucleotide
caaggtggtggccgccgtggg

SEQ ID NO: 191820 - DNA, 21 bp, Artificial Sequence
  Description of Artificial Sequence: Synthetic oligonucleotide
aaggtggtggccgccgtgggc

SEQ ID NO: 191821 - DNA, 20 bp, Artificial Sequence
  Description of Artificial Sequence: Synthetic oligonucleotide
aggtggtggccgccgtgggc

SEQ ID NO: 191822 - DNA, 20 bp, Artificial Sequence
  Description of Artificial Sequence: Synthetic oligonucleotide
ggtggtggccgccgtgggct

SEQ ID NO: 191823 - DNA, 20 bp, Artificial Sequence
  Description of Artificial Sequence: Synthetic oligonucleotide
gtggtggccgccgtgggcga

SEQ ID NO: 191824 - DNA, 20 bp, Artificial Sequence
  Description of Artificial Sequence: Synthetic oligonucleotide
tggtggccgccgtgggcgac

SEQ ID NO: 191825 - DNA, 20 bp, Artificial Sequence
  Description of Artificial Sequence: Synthetic oligonucleotide
ggtggccgccgtgggcgact

SEQ ID NO: 191826 - DNA, 20 bp, Artificial Sequence
  Description of Artificial Sequence: Synthetic oligonucleotide
gtggccgccgtgggcgacgt

SEQ ID NO: 191827 - DNA, 20 bp, Artificial Sequence
  Description of Artificial Sequence: Synthetic oligonucleotide
tggccgccgtgggcgacgct

SEQ ID NO: 191828 - DNA, 20 bp, Artificial Sequence
  Description of Artificial Sequence: Synthetic oligonucleotide
ggccgccgtgggcgacgctt

SEQ ID NO: 191829 - DNA, 20 bp, Artificial Sequence
  Description of Artificial Sequence: Synthetic oligonucleotide
gccgccgtgggcgacgcgtt

SEQ ID NO: 191830 - DNA, 20 bp, Artificial Sequence
  Description of Artificial Sequence: Synthetic oligonucleotide
ccgccgtgggcgacgcggtt

SEQ ID NO: 191831 - DNA, 21 bp, Artificial Sequence
  Description of Artificial Sequence: Synthetic oligonucleotide
cgccgtgggcgacgcggtgaa

SEQ ID NO: 191832 - DNA, 22 bp, Artificial Sequence
  Description of Artificial Sequence: Synthetic oligonucleotide
gccgtgggcgacgcggtgaaga

SEQ ID NO: 191833 - DNA, 22 bp, Artificial Sequence
  Description of Artificial Sequence: Synthetic oligonucleotide
ccgtgggcgacgcggtgaagag

SEQ ID NO: 191834 - DNA, 24 bp, Artificial Sequence
  Description of Artificial Sequence: Synthetic oligonucleotide
cgtgggcgacgcggtgaagagcat

SEQ ID NO: 191835 - DNA, 24 bp, Artificial Sequence
  Description of Artificial Sequence: Synthetic oligonucleotide
gtgggcgacgcggtgaagagcatc

SEQ ID NO: 191836 - DNA, 25 bp, Artificial Sequence
  Description of Artificial Sequence: Synthetic oligonucleotide
tgggcgacgcggtgaagagcatcga

SEQ ID NO: 191837 - DNA, 24 bp, Artificial Sequence
  Description of Artificial Sequence: Synthetic oligonucleotide
gggcgacgcggtgaagagcatcga

SEQ ID NO: 191838 - DNA, 24 bp, Artificial Sequence
  Description of Artificial Sequence: Synthetic oligonucleotide
ggcgacgcggtgaagagcatcgac

SEQ ID NO: 191839 - DNA, 25 bp, Artificial Sequence
  Description of Artificial Sequence: Synthetic oligonucleotide
gcgacgcggtgaagagcatcgacga

SEQ ID NO: 191840 - DNA, 27 bp, Artificial Sequence
  Description of Artificial Sequence: Synthetic oligonucleotide
cgacgcggtgaagagcatcgacgacat

SEQ ID NO: 191841 - DNA, 27 bp, Artificial Sequence
  Description of Artificial Sequence: Synthetic oligonucleotide
gacgcggtgaagagcatcgacgacatc

SEQ ID NO: 191842 - DNA, 27 bp, Artificial Sequence
  Description of Artificial Sequence: Synthetic oligonucleotide
acgcggtgaagagcatcgacgacatcg

SEQ ID NO: 191843 - DNA, 26 bp, Artificial Sequence
  Description of Artificial Sequence: Synthetic oligonucleotide
cgcggtgaagagcatcgacgacatcg

SEQ ID NO: 191844 - DNA, 26 bp, Artificial Sequence
  Description of Artificial Sequence: Synthetic oligonucleotide
gcggtgaagagcatcgacgacatcgg

SEQ ID NO: 191845 - DNA, 26 bp, Artificial Sequence
  Description of Artificial Sequence: Synthetic oligonucleotide
cggtgaagagcatcgacgacatcggc

SEQ ID NO: 191846 - DNA, 26 bp, Artificial Sequence
  Description of Artificial Sequence: Synthetic oligonucleotide
ggtgaagagcatcgacgacatcggcg

SEQ ID NO: 191847 - DNA, 26 bp, Artificial Sequence
  Description of Artificial Sequence: Synthetic oligonucleotide
gtgaagagcatcgacgacatcggcgg

SEQ ID NO: 191848 - DNA, 26 bp, Artificial Sequence
  Description of Artificial Sequence: Synthetic oligonucleotide
tgaagagcatcgacgacatcggcggc

SEQ ID NO: 191849 - DNA, 25 bp, Artificial Sequence
  Description of Artificial Sequence: Synthetic oligonucleotide
gaagagcatcgacgacatcggcggc

SEQ ID NO: 191850 - DNA, 25 bp, Artificial Sequence
  Description of Artificial Sequence: Synthetic oligonucleotide
aagagcatcgacgacatcggcggcg

SEQ ID NO: 191851 - DNA, 24 bp, Artificial Sequence
  Description of Artificial Sequence: Synthetic oligonucleotide
agagcatcgacgacatcggcggcg

SEQ ID NO: 191852 - DNA, 23 bp, Artificial Sequence
  Description of Artificial Sequence: Synthetic oligonucleotide
gagcatcgacgacatcggcggcg

SEQ ID NO: 191853 - DNA, 23 bp, Artificial Sequence
  Description of Artificial Sequence: Synthetic oligonucleotide
agcatcgacgacatcggcggcgc

SEQ ID NO: 191854 - DNA, 22 bp, Artificial Sequence
  Description of Artificial Sequence: Synthetic oligonucleotide
gcatcgacgacatcggcggcgc

SEQ ID NO: 191855 - DNA, 22 bp, Artificial Sequence
  Description of Artificial Sequence: Synthetic oligonucleotide
catcgacgacatcggcggcgcc

SEQ ID NO: 191856 - DNA, 23 bp, Artificial Sequence
  Description of Artificial Sequence: Synthetic oligonucleotide
atcgacgacatcggcggcgccct

SEQ ID NO: 191857 - DNA, 22 bp, Artificial Sequence
  Description of Artificial Sequence: Synthetic oligonucleotide
tcgacgacatcggcggcgccct

SEQ ID NO: 191858 - DNA, 21 bp, Artificial Sequence
  Description of Artificial Sequence: Synthetic oligonucleotide
cgacgacatcggcggcgccct

SEQ ID NO: 191859 - DNA, 22 bp, Artificial Sequence
  Description of Artificial Sequence: Synthetic oligonucleotide
gacgacatcggcggcgccctgt

SEQ ID NO: 191860 - DNA, 22 bp, Artificial Sequence
  Description of Artificial Sequence: Synthetic oligonucleotide
acgacatcggcggcgccctgtc

SEQ ID NO: 191861 - DNA, 21 bp, Artificial Sequence
  Description of Artificial Sequence: Synthetic oligonucleotide
cgacatcggcggcgccctgtc

SEQ ID NO: 191862 - DNA, 23 bp, Artificial Sequence
  Description of Artificial Sequence: Synthetic oligonucleotide
gacatcggcggcgccctgtccaa

SEQ ID NO: 191863 - DNA, 23 bp, Artificial Sequence
  Description of Artificial Sequence: Synthetic oligonucleotide
acatcggcggcgccctgtccaag

SEQ ID NO: 191864 - DNA, 22 bp, Artificial Sequence
  Description of Artificial Sequence: Synthetic oligonucleotide
catcggcggcgccctgtccaag

SEQ ID NO: 191865 - DNA, 23 bp, Artificial Sequence
  Description of Artificial Sequence: Synthetic oligonucleotide
atcggcggcgccctgtccaagct

SEQ ID NO: 191866 - DNA, 22 bp, Artificial Sequence
  Description of Artificial Sequence: Synthetic oligonucleotide
tcggcggcgccctgtccaagct

SEQ ID NO: 191867 - DNA, 21 bp, Artificial Sequence
  Description of Artificial Sequence: Synthetic oligonucleotide
cggcggcgccctgtccaagct

SEQ ID NO: 191868 - DNA, 22 bp, Artificial Sequence
  Description of Artificial Sequence: Synthetic oligonucleotide
ggcggcgccctgtccaagctga

SEQ ID NO: 191869 - DNA, 22 bp, Artificial Sequence
  Description of Artificial Sequence: Synthetic oligonucleotide
gcggcgccctgtccaagctgag

SEQ ID NO: 191870 - DNA, 22 bp, Artificial Sequence
  Description of Artificial Sequence: Synthetic oligonucleotide
cggcgccctgtccaagctgagc

SEQ ID NO: 191871 - DNA, 23 bp, Artificial Sequence
  Description of Artificial Sequence: Synthetic oligonucleotide
ggcgccctgtccaagctgagcga

SEQ ID NO: 191872 - DNA, 23 bp, Artificial Sequence
  Description of Artificial Sequence: Synthetic oligonucleotide
gcgccctgtccaagctgagcgag

SEQ ID NO: 191873 - DNA, 24 bp, Artificial Sequence
  Description of Artificial Sequence: Synthetic oligonucleotide
cgccctgtccaagctgagcgagct

SEQ ID NO: 191874 - DNA, 24 bp, Artificial Sequence
  Description of Artificial Sequence: Synthetic oligonucleotide
gccctgtccaagctgagcgagctg

SEQ ID NO: 191875 - DNA, 25 bp, Artificial Sequence
  Description of Artificial Sequence: Synthetic oligonucleotide
ccctgtccaagctgagcgagctgca

SEQ ID NO: 191876 - DNA, 25 bp, Artificial Sequence
  Description of Artificial Sequence: Synthetic oligonucleotide
cctgtccaagctgagcgagctgcac

SEQ ID NO: 191877 - DNA, 25 bp, Artificial Sequence
  Description of Artificial Sequence: Synthetic oligonucleotide
ctgtccaagctgagcgagctgcacg

SEQ ID NO: 191878 - DNA, 25 bp, Artificial Sequence
  Description of Artificial Sequence: Synthetic oligonucleotide
tgtccaagctgagcgagctgcacgc

SEQ ID NO: 191879 - DNA, 24 bp, Artificial Sequence
  Description of Artificial Sequence: Synthetic oligonucleotide
gtccaagctgagcgagctgcacgc

SEQ ID NO: 191880 - DNA, 26 bp, Artificial Sequence
  Description of Artificial Sequence: Synthetic oligonucleotide
tccaagctgagcgagctgcacgccta

SEQ ID NO: 191881 - DNA, 25 bp, Artificial Sequence
  Description of Artificial Sequence: Synthetic oligonucleotide
ccaagctgagcgagctgcacgccta

SEQ ID NO: 191882 - DNA, 27 bp, Artificial Sequence
  Description of Artificial Sequence: Synthetic oligonucleotide
caagctgagcgagctgcacgcctacat

SEQ ID NO: 191883 - DNA, 27 bp, Artificial Sequence
  Description of Artificial Sequence: Synthetic oligonucleotide
aagctgagcgagctgcacgcctacatc

SEQ ID NO: 191884 - DNA, 26 bp, Artificial Sequence
  Description of Artificial Sequence: Synthetic oligonucleotide
agctgagcgagctgcacgcctacatc

SEQ ID NO: 191885 - DNA, 25 bp, Artificial Sequence
  Description of Artificial Sequence: Synthetic oligonucleotide
gctgagcgagctgcacgcctacatc

SEQ ID NO: 191886 - DNA, 26 bp, Artificial Sequence
  Description of Artificial Sequence: Synthetic oligonucleotide
ctgagcgagctgcacgcctacatcct

SEQ ID NO: 191887 - DNA, 26 bp, Artificial Sequence
  Description of Artificial Sequence: Synthetic oligonucleotide
tgagcgagctgcacgcctacatcctg

SEQ ID NO: 191888 - DNA, 25 bp, Artificial Sequence
  Description of Artificial Sequence: Synthetic oligonucleotide
gagcgagctgcacgcctacatcctg

SEQ ID NO: 191889 - DNA, 25 bp, Artificial Sequence
  Description of Artificial Sequence: Synthetic oligonucleotide
agcgagctgcacgcctacatcctgc

SEQ ID NO: 191890 - DNA, 24 bp, Artificial Sequence
  Description of Artificial Sequence: Synthetic oligonucleotide
gcgagctgcacgcctacatcctgc

SEQ ID NO: 191891 - DNA, 24 bp, Artificial Sequence
  Description of Artificial Sequence: Synthetic oligonucleotide
cgagctgcacgcctacatcctgcg

SEQ ID NO: 191892 - DNA, 24 bp, Artificial Sequence
  Description of Artificial Sequence: Synthetic oligonucleotide
gagctgcacgcctacatcctgcgc

SEQ ID NO: 191893 - DNA, 25 bp, Artificial Sequence
  Description of Artificial Sequence: Synthetic oligonucleotide
agctgcacgcctacatcctgcgcgt

SEQ ID NO: 191894 - DNA, 24 bp, Artificial Sequence
  Description of Artificial Sequence: Synthetic oligonucleotide
gctgcacgcctacatcctgcgcgt

SEQ ID NO: 191895 - DNA, 24 bp, Artificial Sequence
  Description of Artificial Sequence: Synthetic oligonucleotide
ctgcacgcctacatcctgcgcgtg

SEQ ID NO: 191896 - DNA, 25 bp, Artificial Sequence
  Description of Artificial Sequence: Synthetic oligonucleotide
tgcacgcctacatcctgcgcgtgga

SEQ ID NO: 191897 - DNA, 24 bp, Artificial Sequence
  Description of Artificial Sequence: Synthetic oligonucleotide
gcacgcctacatcctgcgcgtgga

SEQ ID NO: 191898 - DNA, 24 bp, Artificial Sequence
  Description of Artificial Sequence: Synthetic oligonucleotide
cacgcctacatcctgcgcgtggac

SEQ ID NO: 191899 - DNA, 24 bp, Artificial Sequence
  Description of Artificial Sequence: Synthetic oligonucleotide
acgcctacatcctgcgcgtggacc

SEQ ID NO: 191900 - DNA, 23 bp, Artificial Sequence
  Description of Artificial Sequence: Synthetic oligonucleotide
cgcctacatcctgcgcgtggacc

SEQ ID NO: 191901 - DNA, 23 bp, Artificial Sequence
  Description of Artificial Sequence: Synthetic oligonucleotide
gcctacatcctgcgcgtggaccc

SEQ ID NO: 191902 - DNA, 23 bp, Artificial Sequence
  Description of Artificial Sequence: Synthetic oligonucleotide
cctacatcctgcgcgtggacccg

SEQ ID NO: 191903 - DNA, 24 bp, Artificial Sequence
  Description of Artificial Sequence: Synthetic oligonucleotide
ctacatcctgcgcgtggacccggt

SEQ ID NO: 191904 - DNA, 26 bp, Artificial Sequence
  Description of Artificial Sequence: Synthetic oligonucleotide
tacatcctgcgcgtggacccggtcaa

SEQ ID NO: 191905 - DNA, 25 bp, Artificial Sequence
  Description of Artificial Sequence: Synthetic oligonucleotide
acatcctgcgcgtggacccggtcaa

SEQ ID NO: 191906 - DNA, 24 bp, Artificial Sequence
  Description of Artificial Sequence: Synthetic oligonucleotide
catcctgcgcgtggacccggtcaa

SEQ ID NO: 191907 - DNA, 26 bp, Artificial Sequence
  Description of Artificial Sequence: Synthetic oligonucleotide
atcctgcgcgtggacccggtcaactt

SEQ ID NO: 191908 - DNA, 25 bp, Artificial Sequence
  Description of Artificial Sequence: Synthetic oligonucleotide
tcctgcgcgtggacccggtcaactt

SEQ ID NO: 191909 - DNA, 24 bp, Artificial Sequence
  Description of Artificial Sequence: Synthetic oligonucleotide
cctgcgcgtggacccggtcaactt

SEQ ID NO: 191910 - DNA, 26 bp, Artificial Sequence
  Description of Artificial Sequence: Synthetic oligonucleotide
ctgcgcgtggacccggtcaacttcaa

SEQ ID NO: 191911 - DNA, 26 bp, Artificial Sequence
  Description of Artificial Sequence: Synthetic oligonucleotide
tgcgcgtggacccggtcaacttcaag

SEQ ID NO: 191912 - DNA, 25 bp, Artificial Sequence
  Description of Artificial Sequence: Synthetic oligonucleotide
gcgcgtggacccggtcaacttcaag

SEQ ID NO: 191913 - DNA, 26 bp, Artificial Sequence
  Description of Artificial Sequence: Synthetic oligonucleotide
cgcgtggacccggtcaacttcaagct

SEQ ID NO: 191914 - DNA, 26 bp, Artificial Sequence
  Description of Artificial Sequence: Synthetic oligonucleotide
gcgtggacccggtcaacttcaagctc

SEQ ID NO: 191915 - DNA, 27 bp, Artificial Sequence
  Description of Artificial Sequence: Synthetic oligonucleotide
cgtggacccggtcaacttcaagctcct

SEQ ID NO: 191916 - DNA, 27 bp, Artificial Sequence
  Description of Artificial Sequence: Synthetic oligonucleotide
gtggacccggtcaacttcaagctcctg

SEQ ID NO: 191917 - DNA, 28 bp, Artificial Sequence
  Description of Artificial Sequence: Synthetic oligonucleotide
tggacccggtcaacttcaagctcctgtc

SEQ ID NO: 191918 - DNA, 27 bp, Artificial Sequence
  Description of Artificial Sequence: Synthetic oligonucleotide
ggacccggtcaacttcaagctcctgtc

SEQ ID NO: 191919 - DNA, 27 bp, Artificial Sequence
  Description of Artificial Sequence: Synthetic oligonucleotide
gacccggtcaacttcaagctcctgtcc

SEQ ID NO: 191920 - DNA, 27 bp, Artificial Sequence
  Description of Artificial Sequence: Synthetic oligonucleotide
acccggtcaacttcaagctcctgtccc

SEQ ID NO: 191921 - DNA, 27 bp, Artificial Sequence
  Description of Artificial Sequence: Synthetic oligonucleotide
cccggtcaacttcaagctcctgtccca

SEQ ID NO: 191922 - DNA, 27 bp, Artificial Sequence
  Description of Artificial Sequence: Synthetic oligonucleotide
ccggtcaacttcaagctcctgtcccac

SEQ ID NO: 191923 - DNA, 28 bp, Artificial Sequence
  Description of Artificial Sequence: Synthetic oligonucleotide
cggtcaacttcaagctcctgtcccactg

SEQ ID NO: 191924 - DNA, 28 bp, Artificial Sequence
  Description of Artificial Sequence: Synthetic oligonucleotide
ggtcaacttcaagctcctgtcccactgc

SEQ ID NO: 191925 - DNA, 28 bp, Artificial Sequence
  Description of Artificial Sequence: Synthetic oligonucleotide
gtcaacttcaagctcctgtcccactgcc

SEQ ID NO: 191926 - DNA, 29 bp, Artificial Sequence
  Description of Artificial Sequence: Synthetic oligonucleotide
tcaacttcaagctcctgtcccactgcctg

SEQ ID NO: 191927 - DNA, 28 bp, Artificial Sequence
  Description of Artificial Sequence: Synthetic oligonucleotide
caacttcaagctcctgtcccactgcctg

SEQ ID NO: 191928 - DNA, 28 bp, Artificial Sequence
  Description of Artificial Sequence: Synthetic oligonucleotide
aacttcaagctcctgtcccactgcctgc

SEQ ID NO: 191929 - DNA, 27 bp, Artificial Sequence
  Description of Artificial Sequence: Synthetic oligonucleotide
acttcaagctcctgtcccactgcctgc

SEQ ID NO: 191930 - DNA, 27 bp, Artificial Sequence
  Description of Artificial Sequence: Synthetic oligonucleotide
cttcaagctcctgtcccactgcctgct

SEQ ID NO: 191931 - DNA, 27 bp, Artificial Sequence
  Description of Artificial Sequence: Synthetic oligonucleotide
ttcaagctcctgtcccactgcctgctg

SEQ ID NO: 191932 - DNA, 26 bp, Artificial Sequence
  Description of Artificial Sequence: Synthetic oligonucleotide
tcaagctcctgtcccactgcctgctg

SEQ ID NO: 191933 - DNA, 25 bp, Artificial Sequence
  Description of Artificial Sequence: Synthetic oligonucleotide
caagctcctgtcccactgcctgctg

SEQ ID NO: 191934 - DNA, 26 bp, Artificial Sequence
  Description of Artificial Sequence: Synthetic oligonucleotide
aagctcctgtcccactgcctgctggt

SEQ ID NO: 191935 - DNA, 25 bp, Artificial Sequence
  Description of Artificial Sequence: Synthetic oligonucleotide
agctcctgtcccactgcctgctggt

SEQ ID NO: 191936 - DNA, 24 bp, Artificial Sequence
  Description of Artificial Sequence: Synthetic oligonucleotide
gctcctgtcccactgcctgctggt

SEQ ID NO: 191937 - DNA, 25 bp, Artificial Sequence
  Description of Artificial Sequence: Synthetic oligonucleotide
ctcctgtcccactgcctgctggtca

SEQ ID NO: 191938 - DNA, 25 bp, Artificial Sequence
  Description of Artificial Sequence: Synthetic oligonucleotide
tcctgtcccactgcctgctggtcac

SEQ ID NO: 191939 - DNA, 24 bp, Artificial Sequence
  Description of Artificial Sequence: Synthetic oligonucleotide
cctgtcccactgcctgctggtcac

SEQ ID NO: 191940 - DNA, 24 bp, Artificial Sequence
  Description of Artificial Sequence: Synthetic oligonucleotide
ctgtcccactgcctgctggtcacc

SEQ ID NO: 191941 - DNA, 25 bp, Artificial Sequence
  Description of Artificial Sequence: Synthetic oligonucleotide
tgtcccactgcctgctggtcaccct

SEQ ID NO: 191942 - DNA, 24 bp, Artificial Sequence
  Description of Artificial Sequence: Synthetic oligonucleotide
gtcccactgcctgctggtcaccct

SEQ ID NO: 191943 - DNA, 24 bp, Artificial Sequence
  Description of Artificial Sequence: Synthetic oligonucleotide
tcccactgcctgctggtcaccctg

SEQ ID NO: 191944 - DNA, 23 bp, Artificial Sequence
  Description of Artificial Sequence: Synthetic oligonucleotide
cccactgcctgctggtcaccctg

SEQ ID NO: 191945 - DNA, 23 bp, Artificial Sequence
  Description of Artificial Sequence: Synthetic oligonucleotide
ccactgcctgctggtcaccctgg

SEQ ID NO: 191946 - DNA, 23 bp, Artificial Sequence
  Description of Artificial Sequence: Synthetic oligonucleotide
cactgcctgctggtcaccctggc

SEQ ID NO: 191947 - DNA, 23 bp, Artificial Sequence
  Description of Artificial Sequence: Synthetic oligonucleotide
actgcctgctggtcaccctggcc

SEQ ID NO: 191948 - DNA, 22 bp, Artificial Sequence
  Description of Artificial Sequence: Synthetic oligonucleotide
ctgcctgctggtcaccctggcc

SEQ ID NO: 191949 - DNA, 22 bp, Artificial Sequence
  Description of Artificial Sequence: Synthetic oligonucleotide
tgcctgctggtcaccctggccg

SEQ ID NO: 191950 - DNA, 21 bp, Artificial Sequence
  Description of Artificial Sequence: Synthetic oligonucleotide
gcctgctggtcaccctggccg

SEQ ID NO: 191951 - DNA, 21 bp, Artificial Sequence
  Description of Artificial Sequence: Synthetic oligonucleotide
cctgctggtcaccctggccgc

SEQ ID NO: 191952 - DNA, 21 bp, Artificial Sequence
  Description of Artificial Sequence: Synthetic oligonucleotide
ctgctggtcaccctggccgcg

SEQ ID NO: 191953 - DNA, 21 bp, Artificial Sequence
  Description of Artificial Sequence: Synthetic oligonucleotide
tgctggtcaccctggccgcgc

SEQ ID NO: 191954 - DNA, 20 bp, Artificial Sequence
  Description of Artificial Sequence: Synthetic oligonucleotide
gctggtcaccctggccgcgc

SEQ ID NO: 191955 - DNA, 20 bp, Artificial Sequence
  Description of Artificial Sequence: Synthetic oligonucleotide
ctggtcaccctggccgcgcg

SEQ ID NO: 191956 - DNA, 22 bp, Artificial Sequence
  Description of Artificial Sequence: Synthetic oligonucleotide
tggtcaccctggccgcgcgctt

SEQ ID NO: 191957 - DNA, 21 bp, Artificial Sequence
  Description of Artificial Sequence: Synthetic oligonucleotide
ggtcaccctggccgcgcgctt

SEQ ID NO: 191958 - DNA, 21 bp, Artificial Sequence
  Description of Artificial Sequence: Synthetic oligonucleotide
gtcaccctggccgcgcgcttc

SEQ ID NO: 191959 - DNA, 21 bp, Artificial Sequence
  Description of Artificial Sequence: Synthetic oligonucleotide
tcaccctggccgcgcgcttcc

SEQ ID NO: 191960 - DNA, 20 bp, Artificial Sequence
  Description of Artificial Sequence: Synthetic oligonucleotide
caccctggccgcgcgcttcc

SEQ ID NO: 191961 - DNA, 20 bp, Artificial Sequence
  Description of Artificial Sequence: Synthetic oligonucleotide
accctggccgcgcgcttccc

SEQ ID NO: 191962 - DNA, 20 bp, Artificial Sequence
  Description of Artificial Sequence: Synthetic oligonucleotide
ccctggccgcgcgcttccct

SEQ ID NO: 191963 - DNA, 20 bp, Artificial Sequence
  Description of Artificial Sequence: Synthetic oligonucleotide
cctggccgcgcgcttcccct

SEQ ID NO: 191964 - DNA, 20 bp, Artificial Sequence
  Description of Artificial Sequence: Synthetic oligonucleotide
ctggccgcgcgcttccccgt

SEQ ID NO: 191965 - DNA, 20 bp, Artificial Sequence
  Description of Artificial Sequence: Synthetic oligonucleotide
tggccgcgcgcttccccgct

SEQ ID NO: 191966 - DNA, 20 bp, Artificial Sequence
  Description of Artificial Sequence: Synthetic oligonucleotide
ggccgcgcgcttccccgctt

SEQ ID NO: 191967 - DNA, 20 bp, Artificial Sequence
  Description of Artificial Sequence: Synthetic oligonucleotide
gccgcgcgcttccccgcctt

SEQ ID NO: 191968 - DNA, 20 bp, Artificial Sequence
  Description of Artificial Sequence: Synthetic oligonucleotide
ccgcgcgcttccccgccgat

SEQ ID NO: 191969 - DNA, 21 bp, Artificial Sequence
  Description of Artificial Sequence: Synthetic oligonucleotide
cgcgcgcttccccgccgactt

SEQ ID NO: 191970 - DNA, 22 bp, Artificial Sequence
  Description of Artificial Sequence: Synthetic oligonucleotide
gcgcgcttccccgccgacttca

SEQ ID NO: 191971 - DNA, 22 bp, Artificial Sequence
  Description of Artificial Sequence: Synthetic oligonucleotide
cgcgcttccccgccgacttcac

SEQ ID NO: 191972 - DNA, 22 bp, Artificial Sequence
  Description of Artificial Sequence: Synthetic oligonucleotide
gcgcttccccgccgacttcacg

SEQ ID NO: 191973 - DNA, 22 bp, Artificial Sequence
  Description of Artificial Sequence: Synthetic oligonucleotide
cgcttccccgccgacttcacgg

SEQ ID NO: 191974 - DNA, 22 bp, Artificial Sequence
  Description of Artificial Sequence: Synthetic oligonucleotide
gcttccccgccgacttcacggc

SEQ ID NO: 191975 - DNA, 22 bp, Artificial Sequence
  Description of Artificial Sequence: Synthetic oligonucleotide
cttccccgccgacttcacggcc

SEQ ID NO: 191976 - DNA, 23 bp, Artificial Sequence
  Description of Artificial Sequence: Synthetic oligonucleotide
ttccccgccgacttcacggccga

SEQ ID NO: 191977 - DNA, 22 bp, Artificial Sequence
  Description of Artificial Sequence: Synthetic oligonucleotide
tccccgccgacttcacggccga

SEQ ID NO: 191978 - DNA, 21 bp, Artificial Sequence
  Description of Artificial Sequence: Synthetic oligonucleotide
ccccgccgacttcacggccga

SEQ ID NO: 191979 - DNA, 21 bp, Artificial Sequence
  Description of Artificial Sequence: Synthetic oligonucleotide
cccgccgacttcacggccgag

SEQ ID NO: 191980 - DNA, 21 bp, Artificial Sequence
  Description of Artificial Sequence: Synthetic oligonucleotide
ccgccgacttcacggccgagg

SEQ ID NO: 191981 - DNA, 21 bp, Artificial Sequence
  Description of Artificial Sequence: Synthetic oligonucleotide
cgccgacttcacggccgaggc

SEQ ID NO: 191982 - DNA, 21 bp, Artificial Sequence
  Description of Artificial Sequence: Synthetic oligonucleotide
gccgacttcacggccgaggcc

SEQ ID NO: 191983 - DNA, 22 bp, Artificial Sequence
  Description of Artificial Sequence: Synthetic oligonucleotide
ccgacttcacggccgaggccca

SEQ ID NO: 191984 - DNA, 22 bp, Artificial Sequence
  Description of Artificial Sequence: Synthetic oligonucleotide
cgacttcacggccgaggcccac

SEQ ID NO: 191985 - DNA, 22 bp, Artificial Sequence
  Description of Artificial Sequence: Synthetic oligonucleotide
gacttcacggccgaggcccacg

SEQ ID NO: 191986 - DNA, 22 bp, Artificial Sequence
  Description of Artificial Sequence: Synthetic oligonucleotide
acttcacggccgaggcccacgc

SEQ ID NO: 191987 - DNA, 21 bp, Artificial Sequence
  Description of Artificial Sequence: Synthetic oligonucleotide
cttcacggccgaggcccacgc

SEQ ID NO: 191988 - DNA, 21 bp, Artificial Sequence
  Description of Artificial Sequence: Synthetic oligonucleotide
ttcacggccgaggcccacgcc

SEQ ID NO: 191989 - DNA, 20 bp, Artificial Sequence
  Description of Artificial Sequence: Synthetic oligonucleotide
tcacggccgaggcccacgcc

SEQ ID NO: 191990 - DNA, 20 bp, Artificial Sequence
  Description of Artificial Sequence: Synthetic oligonucleotide
cacggccgaggcccacgcct

SEQ ID NO: 191991 - DNA, 20 bp, Artificial Sequence
  Description of Artificial Sequence: Synthetic oligonucleotide
acggccgaggcccacgccgt

SEQ ID NO: 191992 - DNA, 20 bp, Artificial Sequence
  Description of Artificial Sequence: Synthetic oligonucleotide
cggccgaggcccacgccgtt

SEQ ID NO: 191993 - DNA, 20 bp, Artificial Sequence
  Description of Artificial Sequence: Synthetic oligonucleotide
ggccgaggcccacgccgctt

SEQ ID NO: 191994 - DNA, 20 bp, Artificial Sequence
  Description of Artificial Sequence: Synthetic oligonucleotide
gccgaggcccacgccgcctt

SEQ ID NO: 191995 - DNA, 20 bp, Artificial Sequence
  Description of Artificial Sequence: Synthetic oligonucleotide
ccgaggcccacgccgcctgt

SEQ ID NO: 191996 - DNA, 20 bp, Artificial Sequence
  Description of Artificial Sequence: Synthetic oligonucleotide
cgaggcccacgccgcctggt

SEQ ID NO: 191997 - DNA, 20 bp, Artificial Sequence
  Description of Artificial Sequence: Synthetic oligonucleotide
gaggcccacgccgcctggga

SEQ ID NO: 191998 - DNA, 22 bp, Artificial Sequence
  Description of Artificial Sequence: Synthetic oligonucleotide
aggcccacgccgcctgggacaa

SEQ ID NO: 191999 - DNA, 21 bp, Artificial Sequence
  Description of Artificial Sequence: Synthetic oligonucleotide
ggcccacgccgcctgggacaa

SEQ ID NO: 192000 - DNA, 23 bp, Artificial Sequence
  Description of Artificial Sequence: Synthetic oligonucleotide
gcccacgccgcctgggacaagtt

SEQ ID NO: 192001 - DNA, 23 bp, Artificial Sequence
  Description of Artificial Sequence: Synthetic oligonucleotide
cccacgccgcctgggacaagttc

SEQ ID NO: 192002 - DNA, 26 bp, Artificial Sequence
  Description of Artificial Sequence: Synthetic oligonucleotide
ccacgccgcctgggacaagttcctat

SEQ ID NO: 192003 - DNA, 26 bp, Artificial Sequence
  Description of Artificial Sequence: Synthetic oligonucleotide
cacgccgcctgggacaagttcctatc

SEQ ID NO: 192004 - DNA, 26 bp, Artificial Sequence
  Description of Artificial Sequence: Synthetic oligonucleotide
acgccgcctgggacaagttcctatcg

SEQ ID NO: 192005 - DNA, 25 bp, Artificial Sequence
  Description of Artificial Sequence: Synthetic oligonucleotide
cgccgcctgggacaagttcctatcg

SEQ ID NO: 192006 - DNA, 26 bp, Artificial Sequence
  Description of Artificial Sequence: Synthetic oligonucleotide
gccgcctgggacaagttcctatcggt

SEQ ID NO: 192007 - DNA, 26 bp, Artificial Sequence
  Description of Artificial Sequence: Synthetic oligonucleotide
ccgcctgggacaagttcctatcggtc

SEQ ID NO: 192008 - DNA, 27 bp, Artificial Sequence
  Description of Artificial Sequence: Synthetic oligonucleotide
cgcctgggacaagttcctatcggtcgt

SEQ ID NO: 192009 - DNA, 29 bp, Artificial Sequence
  Description of Artificial Sequence: Synthetic oligonucleotide
gcctgggacaagttcctatcggtcgtatc

SEQ ID NO: 192010 - DNA, 29 bp, Artificial Sequence
  Description of Artificial Sequence: Synthetic oligonucleotide
cctgggacaagttcctatcggtcgtatcc

SEQ ID NO: 192011 - DNA, 30 bp, Artificial Sequence
  Description of Artificial Sequence: Synthetic oligonucleotide
ctgggacaagttcctatcggtcgtatcctc

SEQ ID NO: 192012 - DNA, 31 bp, Artificial Sequence
  Description of Artificial Sequence: Synthetic oligonucleotide
tgggacaagttcctatcggtcgtatcctctg

SEQ ID NO: 192013 - DNA, 30 bp, Artificial Sequence
  Description of Artificial Sequence: Synthetic oligonucleotide
gggacaagttcctatcggtcgtatcctctg

SEQ ID NO: 192014 - DNA, 31 bp, Artificial Sequence
  Description of Artificial Sequence: Synthetic oligonucleotide
ggacaagttcctatcggtcgtatcctctgtc

SEQ ID NO: 192015 - DNA, 31 bp, Artificial Sequence
  Description of Artificial Sequence: Synthetic oligonucleotide
gacaagttcctatcggtcgtatcctctgtcc

SEQ ID NO: 192016 - DNA, 32 bp, Artificial Sequence
  Description of Artificial Sequence: Synthetic oligonucleotide
acaagttcctatcggtcgtatcctctgtcctg

SEQ ID NO: 192017 - DNA, 31 bp, Artificial Sequence
  Description of Artificial Sequence: Synthetic oligonucleotide
caagttcctatcggtcgtatcctctgtcctg

SEQ ID NO: 192018 - DNA, 32 bp, Artificial Sequence
  Description of Artificial Sequence: Synthetic oligonucleotide
aagttcctatcggtcgtatcctctgtcctgac

SEQ ID NO: 192019 - DNA, 31 bp, Artificial Sequence
  Description of Artificial Sequence: Synthetic oligonucleotide
agttcctatcggtcgtatcctctgtcctgac

SEQ ID NO: 192020 - DNA, 30 bp, Artificial Sequence
  Description of Artificial Sequence: Synthetic oligonucleotide
gttcctatcggtcgtatcctctgtcctgac

SEQ ID NO: 192021 - DNA, 30 bp, Artificial Sequence
  Description of Artificial Sequence: Synthetic oligonucleotide
ttcctatcggtcgtatcctctgtcctgacc

SEQ ID NO: 192022 - DNA, 29 bp, Artificial Sequence
  Description of Artificial Sequence: Synthetic oligonucleotide
tcctatcggtcgtatcctctgtcctgacc

SEQ ID NO: 192023 - DNA, 28 bp, Artificial Sequence
  Description of Artificial Sequence: Synthetic oligonucleotide
cctatcggtcgtatcctctgtcctgacc

SEQ ID NO: 192024 - DNA, 28 bp, Artificial Sequence
  Description of Artificial Sequence: Synthetic oligonucleotide
ctatcggtcgtatcctctgtcctgaccg

SEQ ID NO: 192025 - DNA, 29 bp, Artificial Sequence
  Description of Artificial Sequence: Synthetic oligonucleotide
tatcggtcgtatcctctgtcctgaccgag

SEQ ID NO: 192026 - DNA, 28 bp, Artificial Sequence
  Description of Artificial Sequence: Synthetic oligonucleotide
atcggtcgtatcctctgtcctgaccgag

SEQ ID NO: 192027 - DNA, 27 bp, Artificial Sequence
  Description of Artificial Sequence: Synthetic oligonucleotide
tcggtcgtatcctctgtcctgaccgag

SEQ ID NO: 192028 - DNA, 27 bp, Artificial Sequence
  Description of Artificial Sequence: Synthetic oligonucleotide
cggtcgtatcctctgtcctgaccgaga

SEQ ID NO: 192029 - DNA, 28 bp, Artificial Sequence
  Description of Artificial Sequence: Synthetic oligonucleotide
ggtcgtatcctctgtcctgaccgagaag

SEQ ID NO: 192030 - DNA, 30 bp, Artificial Sequence
  Description of Artificial Sequence: Synthetic oligonucleotide
gtcgtatcctctgtcctgaccgagaagtac

SEQ ID NO: 192031 - DNA, 30 bp, Artificial Sequence
  Description of Artificial Sequence: Synthetic oligonucleotide
tcgtatcctctgtcctgaccgagaagtacc

SEQ ID NO: 192032 - DNA, 29 bp, Artificial Sequence
  Description of Artificial Sequence: Synthetic oligonucleotide
cgtatcctctgtcctgaccgagaagtacc

SEQ ID NO: 192033 - DNA, 29 bp, Artificial Sequence
  Description of Artificial Sequence: Synthetic oligonucleotide
gtatcctctgtcctgaccgagaagtaccg

SEQ ID NO: 192034 - DNA, 29 bp, Artificial Sequence
  Description of Artificial Sequence: Synthetic oligonucleotide
tatcctctgtcctgaccgagaagtaccgc

SEQ ID NO: 192035 - DNA, 28 bp, Artificial Sequence
  Description of Artificial Sequence: Synthetic oligonucleotide
atcctctgtcctgaccgagaagtaccgc

SEQ ID NO: 192036 - DNA, 27 bp, Artificial Sequence
  Description of Artificial Sequence: Synthetic oligonucleotide
tcctctgtcctgaccgagaagtaccgc

SEQ ID NO: 192037 - DNA, 27 bp, Artificial Sequence
  Description of Artificial Sequence: Synthetic oligonucleotide
cctctgtcctgaccgagaagtaccgct

SEQ ID NO: 192038 - DNA, 27 bp, Artificial Sequence
  Description of Artificial Sequence: Synthetic oligonucleotide
ctctgtcctgaccgagaagtaccgctg

SEQ ID NO: 192039 - DNA, 37 bp, Artificial Sequence
  Description of Artificial Sequence: Synthetic oligonucleotide
ataggcactgactctctctgcctattggtctattttc

SEQ ID NO: 192040 - DNA, 36 bp, Artificial Sequence
  Description of Artificial Sequence: Synthetic oligonucleotide
taggcactgactctctctgcctattggtctattttc

SEQ ID NO: 192041 - DNA, 35 bp, Artificial Sequence
  Description of Artificial Sequence: Synthetic oligonucleotide
aggcactgactctctctgcctattggtctattttc

SEQ ID NO: 192042 - DNA, 34 bp, Artificial Sequence
  Description of Artificial Sequence: Synthetic oligonucleotide
ggcactgactctctctgcctattggtctattttc

SEQ ID NO: 192043 - DNA, 34 bp, Artificial Sequence
  Description of Artificial Sequence: Synthetic oligonucleotide
gcactgactctctctgcctattggtctattttcc

SEQ ID NO: 192044 - DNA, 34 bp, Artificial Sequence
  Description of Artificial Sequence: Synthetic oligonucleotide
cactgactctctctgcctattggtctattttccc

SEQ ID NO: 192045 - DNA, 35 bp, Artificial Sequence
  Description of Artificial Sequence: Synthetic oligonucleotide
actgactctctctgcctattggtctattttcccac

SEQ ID NO: 192046 - DNA, 34 bp, Artificial Sequence
  Description of Artificial Sequence: Synthetic oligonucleotide
ctgactctctctgcctattggtctattttcccac

SEQ ID NO: 192047 - DNA, 34 bp, Artificial Sequence
  Description of Artificial Sequence: Synthetic oligonucleotide
tgactctctctgcctattggtctattttcccacc

SEQ ID NO: 192048 - DNA, 33 bp, Artificial Sequence
  Description of Artificial Sequence: Synthetic oligonucleotide
gactctctctgcctattggtctattttcccacc

SEQ ID NO: 192049 - DNA, 33 bp, Artificial Sequence
  Description of Artificial Sequence: Synthetic oligonucleotide
actctctctgcctattggtctattttcccaccc

SEQ ID NO: 192050 - DNA, 32 bp, Artificial Sequence
  Description of Artificial Sequence: Synthetic oligonucleotide
ctctctctgcctattggtctattttcccaccc

SEQ ID NO: 192051 - DNA, 35 bp, Artificial Sequence
  Description of Artificial Sequence: Synthetic oligonucleotide
tctctctgcctattggtctattttcccacccttag

SEQ ID NO: 192052 - DNA, 34 bp, Artificial Sequence
  Description of Artificial Sequence: Synthetic oligonucleotide
ctctctgcctattggtctattttcccacccttag

SEQ ID NO: 192053 - DNA, 34 bp, Artificial Sequence
  Description of Artificial Sequence: Synthetic oligonucleotide
tctctgcctattggtctattttcccacccttagg

SEQ ID NO: 192054 - DNA, 33 bp, Artificial Sequence
  Description of Artificial Sequence: Synthetic oligonucleotide
ctctgcctattggtctattttcccacccttagg

SEQ ID NO: 192055 - DNA, 33 bp, Artificial Sequence
  Description of Artificial Sequence: Synthetic oligonucleotide
tctgcctattggtctattttcccacccttaggc

SEQ ID NO: 192056 - DNA, 32 bp, Artificial Sequence
  Description of Artificial Sequence: Synthetic oligonucleotide
ctgcctattggtctattttcccacccttaggc

SEQ ID NO: 192057 - DNA, 33 bp, Artificial Sequence
  Description of Artificial Sequence: Synthetic oligonucleotide
tgcctattggtctattttcccacccttaggctg

SEQ ID NO: 192058 - DNA, 32 bp, Artificial Sequence
  Description of Artificial Sequence: Synthetic oligonucleotide
gcctattggtctattttcccacccttaggctg

SEQ ID NO: 192059 - DNA, 32 bp, Artificial Sequence
  Description of Artificial Sequence: Synthetic oligonucleotide
cctattggtctattttcccacccttaggctgc

SEQ ID NO: 192060 - DNA, 33 bp, Artificial Sequence
  Description of Artificial Sequence: Synthetic oligonucleotide
ctattggtctattttcccacccttaggctgctg

SEQ ID NO: 192061 - DNA, 33 bp, Artificial Sequence
  Description of Artificial Sequence: Synthetic oligonucleotide
tattggtctattttcccacccttaggctgctgg

SEQ ID NO: 192062 - DNA, 32 bp, Artificial Sequence
  Description of Artificial Sequence: Synthetic oligonucleotide
attggtctattttcccacccttaggctgctgg

SEQ ID NO: 192063 - DNA, 31 bp, Artificial Sequence
  Description of Artificial Sequence: Synthetic oligonucleotide
ttggtctattttcccacccttaggctgctgg

SEQ ID NO: 192064 - DNA, 30 bp, Artificial Sequence
  Description of Artificial Sequence: Synthetic oligonucleotide
tggtctattttcccacccttaggctgctgg

SEQ ID NO: 192065 - DNA, 29 bp, Artificial Sequence
  Description of Artificial Sequence: Synthetic oligonucleotide
ggtctattttcccacccttaggctgctgg

SEQ ID NO: 192066 - DNA, 30 bp, Artificial Sequence
  Description of Artificial Sequence: Synthetic oligonucleotide
gtctattttcccacccttaggctgctggtg

SEQ ID NO: 192067 - DNA, 30 bp, Artificial Sequence
  Description of Artificial Sequence: Synthetic oligonucleotide
tctattttcccacccttaggctgctggtgg

SEQ ID NO: 192068 - DNA, 29 bp, Artificial Sequence
  Description of Artificial Sequence: Synthetic oligonucleotide
ctattttcccacccttaggctgctggtgg

SEQ ID NO: 192069 - DNA, 30 bp, Artificial Sequence
  Description of Artificial Sequence: Synthetic oligonucleotide
tattttcccacccttaggctgctggtggtc

SEQ ID NO: 192070 - DNA, 29 bp, Artificial Sequence
  Description of Artificial Sequence: Synthetic oligonucleotide
attttcccacccttaggctgctggtggtc

SEQ ID NO: 192071 - DNA, 28 bp, Artificial Sequence
  Description of Artificial Sequence: Synthetic oligonucleotide
ttttcccacccttaggctgctggtggtc

SEQ ID NO: 192072 - DNA, 27 bp, Artificial Sequence
  Description of Artificial Sequence: Synthetic oligonucleotide
tttcccacccttaggctgctggtggtc

SEQ ID NO: 192073 - DNA, 27 bp, Artificial Sequence
  Description of Artificial Sequence: Synthetic oligonucleotide
ttcccacccttaggctgctggtggtct

SEQ ID NO: 192074 - DNA, 27 bp, Artificial Sequence
  Description of Artificial Sequence: Synthetic oligonucleotide
tcccacccttaggctgctggtggtcta

SEQ ID NO: 192075 - DNA, 26 bp, Artificial Sequence
  Description of Artificial Sequence: Synthetic oligonucleotide
cccacccttaggctgctggtggtcta

SEQ ID NO: 192076 - DNA, 26 bp, Artificial Sequence
  Description of Artificial Sequence: Synthetic oligonucleotide
ccacccttaggctgctggtggtctac

SEQ ID NO: 192077 - DNA, 26 bp, Artificial Sequence
  Description of Artificial Sequence: Synthetic oligonucleotide
cacccttaggctgctggtggtctacc

SEQ ID NO: 192078 - DNA, 27 bp, Artificial Sequence
  Description of Artificial Sequence: Synthetic oligonucleotide
acccttaggctgctggtggtctaccct

SEQ ID NO: 192079 - DNA, 27 bp, Artificial Sequence
  Description of Artificial Sequence: Synthetic oligonucleotide
cccttaggctgctggtggtctaccctt

SEQ ID NO: 192080 - DNA, 27 bp, Artificial Sequence
  Description of Artificial Sequence: Synthetic oligonucleotide
ccttaggctgctggtggtctacccttg

SEQ ID NO: 192081 - DNA, 27 bp, Artificial Sequence
  Description of Artificial Sequence: Synthetic oligonucleotide
cttaggctgctggtggtctacccttgg

SEQ ID NO: 192082 - DNA, 28 bp, Artificial Sequence
  Description of Artificial Sequence: Synthetic oligonucleotide
ttaggctgctggtggtctacccttggac

SEQ ID NO: 192083 - DNA, 27 bp, Artificial Sequence
  Description of Artificial Sequence: Synthetic oligonucleotide
taggctgctggtggtctacccttggac

SEQ ID NO: 192084 - DNA, 28 bp, Artificial Sequence
  Description of Artificial Sequence: Synthetic oligonucleotide
ataggcactgactctctgtcccttgggc

SEQ ID NO: 192085 - DNA, 27 bp, Artificial Sequence
  Description of Artificial Sequence: Synthetic oligonucleotide
taggcactgactctctgtcccttgggc

SEQ ID NO: 192086 - DNA, 27 bp, Artificial Sequence
  Description of Artificial Sequence: Synthetic oligonucleotide
aggcactgactctctgtcccttgggct

SEQ ID NO: 192087 - DNA, 26 bp, Artificial Sequence
  Description of Artificial Sequence: Synthetic oligonucleotide
ggcactgactctctgtcccttgggct

SEQ ID NO: 192088 - DNA, 27 bp, Artificial Sequence
  Description of Artificial Sequence: Synthetic oligonucleotide
gcactgactctctgtcccttgggctgt

SEQ ID NO: 192089 - DNA, 30 bp, Artificial Sequence
  Description of Artificial Sequence: Synthetic oligonucleotide
cactgactctctgtcccttgggctgttttc

SEQ ID NO: 192090 - DNA, 30 bp, Artificial Sequence
  Description of Artificial Sequence: Synthetic oligonucleotide
actgactctctgtcccttgggctgttttcc

SEQ ID NO: 192091 - DNA, 29 bp, Artificial Sequence
  Description of Artificial Sequence: Synthetic oligonucleotide
ctgactctctgtcccttgggctgttttcc

SEQ ID NO: 192092 - DNA, 31 bp, Artificial Sequence
  Description of Artificial Sequence: Synthetic oligonucleotide
tgactctctgtcccttgggctgttttcctac

SEQ ID NO: 192093 - DNA, 30 bp, Artificial Sequence
  Description of Artificial Sequence: Synthetic oligonucleotide
gactctctgtcccttgggctgttttcctac

SEQ ID NO: 192094 - DNA, 30 bp, Artificial Sequence
  Description of Artificial Sequence: Synthetic oligonucleotide
actctctgtcccttgggctgttttcctacc

SEQ ID NO: 192095 - DNA, 29 bp, Artificial Sequence
  Description of Artificial Sequence: Synthetic oligonucleotide
ctctctgtcccttgggctgttttcctacc

SEQ ID NO: 192096 - DNA, 29 bp, Artificial Sequence
  Description of Artificial Sequence: Synthetic oligonucleotide
tctctgtcccttgggctgttttcctaccc

SEQ ID NO: 192097 - DNA, 28 bp, Artificial Sequence
  Description of Artificial Sequence: Synthetic oligonucleotide
ctctgtcccttgggctgttttcctaccc

SEQ ID NO: 192098 - DNA, 29 bp, Artificial Sequence
  Description of Artificial Sequence: Synthetic oligonucleotide
tctgtcccttgggctgttttcctaccctc

SEQ ID NO: 192099 - DNA, 28 bp, Artificial Sequence
  Description of Artificial Sequence: Synthetic oligonucleotide
ctgtcccttgggctgttttcctaccctc

SEQ ID NO: 192100 - DNA, 29 bp, Artificial Sequence
  Description of Artificial Sequence: Synthetic oligonucleotide
tgtcccttgggctgttttcctaccctcag

SEQ ID NO: 192101 - DNA, 28 bp, Artificial Sequence
  Description of Artificial Sequence: Synthetic oligonucleotide
gtcccttgggctgttttcctaccctcag

SEQ ID NO: 192102 - DNA, 32 bp, Artificial Sequence
  Description of Artificial Sequence: Synthetic oligonucleotide
tcccttgggctgttttcctaccctcagattac

SEQ ID NO: 192103 - DNA, 31 bp, Artificial Sequence
  Description of Artificial Sequence: Synthetic oligonucleotide
cccttgggctgttttcctaccctcagattac

SEQ ID NO: 192104 - DNA, 32 bp, Artificial Sequence
  Description of Artificial Sequence: Synthetic oligonucleotide
ccttgggctgttttcctaccctcagattactg

SEQ ID NO: 192105 - DNA, 32 bp, Artificial Sequence
  Description of Artificial Sequence: Synthetic oligonucleotide
cttgggctgttttcctaccctcagattactgg

SEQ ID NO: 192106 - DNA, 33 bp, Artificial Sequence
  Description of Artificial Sequence: Synthetic oligonucleotide
ttgggctgttttcctaccctcagattactggtg

SEQ ID NO: 192107 - DNA, 32 bp, Artificial Sequence
  Description of Artificial Sequence: Synthetic oligonucleotide
tgggctgttttcctaccctcagattactggtg

SEQ ID NO: 192108 - DNA, 31 bp, Artificial Sequence
  Description of Artificial Sequence: Synthetic oligonucleotide
gggctgttttcctaccctcagattactggtg

SEQ ID NO: 192109 - DNA, 31 bp, Artificial Sequence
  Description of Artificial Sequence: Synthetic oligonucleotide
ggctgttttcctaccctcagattactggtgg

SEQ ID NO: 192110 - DNA, 32 bp, Artificial Sequence
  Description of Artificial Sequence: Synthetic oligonucleotide
gctgttttcctaccctcagattactggtggtc

SEQ ID NO: 192111 - DNA, 34 bp, Artificial Sequence
  Description of Artificial Sequence: Synthetic oligonucleotide
ctgttttcctaccctcagattactggtggtctac

SEQ ID NO: 192112 - DNA, 34 bp, Artificial Sequence
  Description of Artificial Sequence: Synthetic oligonucleotide
tgttttcctaccctcagattactggtggtctacc

SEQ ID NO: 192113 - DNA, 33 bp, Artificial Sequence
  Description of Artificial Sequence: Synthetic oligonucleotide
gttttcctaccctcagattactggtggtctacc

SEQ ID NO: 192114 - DNA, 33 bp, Artificial Sequence
  Description of Artificial Sequence: Synthetic oligonucleotide
ttttcctaccctcagattactggtggtctaccc

SEQ ID NO: 192115 - DNA, 32 bp, Artificial Sequence
  Description of Artificial Sequence: Synthetic oligonucleotide
tttcctaccctcagattactggtggtctaccc

SEQ ID NO: 192116 - DNA, 31 bp, Artificial Sequence
  Description of Artificial Sequence: Synthetic oligonucleotide
ttcctaccctcagattactggtggtctaccc

SEQ ID NO: 192117 - DNA, 30 bp, Artificial Sequence
  Description of Artificial Sequence: Synthetic oligonucleotide
tcctaccctcagattactggtggtctaccc

SEQ ID NO: 192118 - DNA, 29 bp, Artificial Sequence
  Description of Artificial Sequence: Synthetic oligonucleotide
cctaccctcagattactggtggtctaccc

SEQ ID NO: 192119 - DNA, 31 bp, Artificial Sequence
  Description of Artificial Sequence: Synthetic oligonucleotide
ctaccctcagattactggtggtctacccttg

SEQ ID NO: 192120 - DNA, 31 bp, Artificial Sequence
  Description of Artificial Sequence: Synthetic oligonucleotide
taccctcagattactggtggtctacccttgg

SEQ ID NO: 192121 - DNA, 30 bp, Artificial Sequence
  Description of Artificial Sequence: Synthetic oligonucleotide
accctcagattactggtggtctacccttgg

SEQ ID NO: 192122 - DNA, 29 bp, Artificial Sequence
  Description of Artificial Sequence: Synthetic oligonucleotide
ccctcagattactggtggtctacccttgg

SEQ ID NO: 192123 - DNA, 30 bp, Artificial Sequence
  Description of Artificial Sequence: Synthetic oligonucleotide
cctcagattactggtggtctacccttggac

SEQ ID NO: 192124 - DNA, 30 bp, Artificial Sequence
  Description of Artificial Sequence: Synthetic oligonucleotide
ctcagattactggtggtctacccttggacc

SEQ ID NO: 192125 - DNA, 30 bp, Artificial Sequence
  Description of Artificial Sequence: Synthetic oligonucleotide
tcagattactggtggtctacccttggaccc

SEQ ID NO: 192126 - DNA, 29 bp, Artificial Sequence
  Description of Artificial Sequence: Synthetic oligonucleotide
cagattactggtggtctacccttggaccc

SEQ ID NO: 192127 - DNA, 30 bp, Artificial Sequence
  Description of Artificial Sequence: Synthetic oligonucleotide
agattactggtggtctacccttggacccag

SEQ ID NO: 192128 - DNA, 29 bp, Artificial Sequence
  Description of Artificial Sequence: Synthetic oligonucleotide
gattactggtggtctacccttggacccag

SEQ ID NO: 192129 - DNA, 30 bp, Artificial Sequence
  Description of Artificial Sequence: Synthetic oligonucleotide
attactggtggtctacccttggacccagag

SEQ ID NO: 192130 - DNA, 29 bp, Artificial Sequence
  Description of Artificial Sequence: Synthetic oligonucleotide
ttactggtggtctacccttggacccagag

SEQ ID NO: 192131 - DNA, 28 bp, Artificial Sequence
  Description of Artificial Sequence: Synthetic oligonucleotide
tactggtggtctacccttggacccagag

SEQ ID NO: 192132 - DNA, 27 bp, Artificial Sequence
  Description of Artificial Sequence: Synthetic oligonucleotide
actggtggtctacccttggacccagag

SEQ ID NO: 192133 - DNA, 32 bp, Artificial Sequence
  Description of Artificial Sequence: Synthetic oligonucleotide
aggttctttgagtcctttggggatctgtcctc

SEQ ID NO: 192134 - DNA, 31 bp, Artificial Sequence
  Description of Artificial Sequence: Synthetic oligonucleotide
ggttctttgagtcctttggggatctgtcctc

SEQ ID NO: 192135 - DNA, 32 bp, Artificial Sequence
  Description of Artificial Sequence: Synthetic oligonucleotide
gttctttgagtcctttggggatctgtcctctc

SEQ ID NO: 192136 - DNA, 32 bp, Artificial Sequence
  Description of Artificial Sequence: Synthetic oligonucleotide
ttctttgagtcctttggggatctgtcctctcc

SEQ ID NO: 192137 - DNA, 31 bp, Artificial Sequence
  Description of Artificial Sequence: Synthetic oligonucleotide
tctttgagtcctttggggatctgtcctctcc

SEQ ID NO: 192138 - DNA, 30 bp, Artificial Sequence
  Description of Artificial Sequence: Synthetic oligonucleotide
ctttgagtcctttggggatctgtcctctcc

SEQ ID NO: 192139 - DNA, 31 bp, Artificial Sequence
  Description of Artificial Sequence: Synthetic oligonucleotide
tttgagtcctttggggatctgtcctctcctg

SEQ ID NO: 192140 - DNA, 30 bp, Artificial Sequence
  Description of Artificial Sequence: Synthetic oligonucleotide
ttgagtcctttggggatctgtcctctcctg

SEQ ID NO: 192141 - DNA, 29 bp, Artificial Sequence
  Description of Artificial Sequence: Synthetic oligonucleotide
tgagtcctttggggatctgtcctctcctg

SEQ ID NO: 192142 - DNA, 28 bp, Artificial Sequence
  Description of Artificial Sequence: Synthetic oligonucleotide
gagtcctttggggatctgtcctctcctg

SEQ ID NO: 192143 - DNA, 30 bp, Artificial Sequence
  Description of Artificial Sequence: Synthetic oligonucleotide
agtcctttggggatctgtcctctcctgatg

SEQ ID NO: 192144 - DNA, 29 bp, Artificial Sequence
  Description of Artificial Sequence: Synthetic oligonucleotide
gtcctttggggatctgtcctctcctgatg

SEQ ID NO: 192145 - DNA, 29 bp, Artificial Sequence
  Description of Artificial Sequence: Synthetic oligonucleotide
tcctttggggatctgtcctctcctgatgc

SEQ ID NO: 192146 - DNA, 28 bp, Artificial Sequence
  Description of Artificial Sequence: Synthetic oligonucleotide
cctttggggatctgtcctctcctgatgc

SEQ ID NO: 192147 - DNA, 29 bp, Artificial Sequence
  Description of Artificial Sequence: Synthetic oligonucleotide
ctttggggatctgtcctctcctgatgctg

SEQ ID NO: 192148 - DNA, 33 bp, Artificial Sequence
  Description of Artificial Sequence: Synthetic oligonucleotide
tttggggatctgtcctctcctgatgctgttatg

SEQ ID NO: 192149 - DNA, 32 bp, Artificial Sequence
  Description of Artificial Sequence: Synthetic oligonucleotide
ttggggatctgtcctctcctgatgctgttatg

SEQ ID NO: 192150 - DNA, 31 bp, Artificial Sequence
  Description of Artificial Sequence: Synthetic oligonucleotide
tggggatctgtcctctcctgatgctgttatg

SEQ ID NO: 192151 - DNA, 30 bp, Artificial Sequence
  Description of Artificial Sequence: Synthetic oligonucleotide
ggggatctgtcctctcctgatgctgttatg

SEQ ID NO: 192152 - DNA, 30 bp, Artificial Sequence
  Description of Artificial Sequence: Synthetic oligonucleotide
gggatctgtcctctcctgatgctgttatgg

SEQ ID NO: 192153 - DNA, 30 bp, Artificial Sequence
  Description of Artificial Sequence: Synthetic oligonucleotide
ggatctgtcctctcctgatgctgttatggg

SEQ ID NO: 192154 - DNA, 30 bp, Artificial Sequence
  Description of Artificial Sequence: Synthetic oligonucleotide
gatctgtcctctcctgatgctgttatgggc

SEQ ID NO: 192155 - DNA, 32 bp, Artificial Sequence
  Description of Artificial Sequence: Synthetic oligonucleotide
atctgtcctctcctgatgctgttatgggcaac

SEQ ID NO: 192156 - DNA, 31 bp, Artificial Sequence
  Description of Artificial Sequence: Synthetic oligonucleotide
tctgtcctctcctgatgctgttatgggcaac

SEQ ID NO: 192157 - DNA, 30 bp, Artificial Sequence
  Description of Artificial Sequence: Synthetic oligonucleotide
ctgtcctctcctgatgctgttatgggcaac

SEQ ID NO: 192158 - DNA, 30 bp, Artificial Sequence
  Description of Artificial Sequence: Synthetic oligonucleotide
tgtcctctcctgatgctgttatgggcaacc

SEQ ID NO: 192159 - DNA, 29 bp, Artificial Sequence
  Description of Artificial Sequence: Synthetic oligonucleotide
gtcctctcctgatgctgttatgggcaacc

SEQ ID NO: 192160 - DNA, 29 bp, Artificial Sequence
  Description of Artificial Sequence: Synthetic oligonucleotide
tcctctcctgatgctgttatgggcaaccc

SEQ ID NO: 192161 - DNA, 28 bp, Artificial Sequence
  Description of Artificial Sequence: Synthetic oligonucleotide
cctctcctgatgctgttatgggcaaccc

SEQ ID NO: 192162 - DNA, 31 bp, Artificial Sequence
  Description of Artificial Sequence: Synthetic oligonucleotide
ctctcctgatgctgttatgggcaaccctaag

SEQ ID NO: 192163 - DNA, 31 bp, Artificial Sequence
  Description of Artificial Sequence: Synthetic oligonucleotide
tctcctgatgctgttatgggcaaccctaagg

SEQ ID NO: 192164 - DNA, 45 bp, Artificial Sequence
  Description of Artificial Sequence: Synthetic oligonucleotide
gcatctctaattttgtatctgatatggtgtcatttcatagactcc

SEQ ID NO: 192165 - DNA, 46 bp, Artificial Sequence
  Description of Artificial Sequence: Synthetic oligonucleotide
catctctaattttgtatctgatatggtgtcatttcatagactcctc

SEQ ID NO: 192166 - DNA, 46 bp, Artificial Sequence
  Description of Artificial Sequence: Synthetic oligonucleotide
atctctaattttgtatctgatatggtgtcatttcatagactcctcg

SEQ ID NO: 192167 - DNA, 45 bp, Artificial Sequence
  Description of Artificial Sequence: Synthetic oligonucleotide
tctctaattttgtatctgatatggtgtcatttcatagactcctcg

SEQ ID NO: 192168 - DNA, 44 bp, Artificial Sequence
  Description of Artificial Sequence: Synthetic oligonucleotide
ctctaattttgtatctgatatggtgtcatttcatagactcctcg

SEQ ID NO: 192169 - DNA, 46 bp, Artificial Sequence
  Description of Artificial Sequence: Synthetic oligonucleotide
tctaattttgtatctgatatggtgtcatttcatagactcctcgttg

SEQ ID NO: 192170 - DNA, 45 bp, Artificial Sequence
  Description of Artificial Sequence: Synthetic oligonucleotide
ctaattttgtatctgatatggtgtcatttcatagactcctcgttg

SEQ ID NO: 192171 - DNA, 49 bp, Artificial Sequence
  Description of Artificial Sequence: Synthetic oligonucleotide
taattttgtatctgatatggtgtcatttcatagactcctcgttgtttac

SEQ ID NO: 192172 - DNA, 48 bp, Artificial Sequence
  Description of Artificial Sequence: Synthetic oligonucleotide
aattttgtatctgatatggtgtcatttcatagactcctcgttgtttac

SEQ ID NO: 192173 - DNA, 47 bp, Artificial Sequence
  Description of Artificial Sequence: Synthetic oligonucleotide
attttgtatctgatatggtgtcatttcatagactcctcgttgtttac

SEQ ID NO: 192174 - DNA, 46 bp, Artificial Sequence
  Description of Artificial Sequence: Synthetic oligonucleotide
ttttgtatctgatatggtgtcatttcatagactcctcgttgtttac

SEQ ID NO: 192175 - DNA, 45 bp, Artificial Sequence
  Description of Artificial Sequence: Synthetic oligonucleotide
tttgtatctgatatggtgtcatttcatagactcctcgttgtttac

SEQ ID NO: 192176 - DNA, 44 bp, Artificial Sequence
  Description of Artificial Sequence: Synthetic oligonucleotide
ttgtatctgatatggtgtcatttcatagactcctcgttgtttac

SEQ ID NO: 192177 - DNA, 43 bp, Artificial Sequence
  Description of Artificial Sequence: Synthetic oligonucleotide
tgtatctgatatggtgtcatttcatagactcctcgttgtttac

SEQ ID NO: 192178 - DNA, 42 bp, Artificial Sequence
  Description of Artificial Sequence: Synthetic oligonucleotide
gtatctgatatggtgtcatttcatagactcctcgttgtttac

SEQ ID NO: 192179 - DNA, 42 bp, Artificial Sequence
  Description of Artificial Sequence: Synthetic oligonucleotide
tatctgatatggtgtcatttcatagactcctcgttgtttacc

SEQ ID NO: 192180 - DNA, 41 bp, Artificial Sequence
  Description of Artificial Sequence: Synthetic oligonucleotide
atctgatatggtgtcatttcatagactcctcgttgtttacc

SEQ ID NO: 192181 - DNA, 40 bp, Artificial Sequence
  Description of Artificial Sequence: Synthetic oligonucleotide
tctgatatggtgtcatttcatagactcctcgttgtttacc

SEQ ID NO: 192182 - DNA, 39 bp, Artificial Sequence
  Description of Artificial Sequence: Synthetic oligonucleotide
ctgatatggtgtcatttcatagactcctcgttgtttacc

SEQ ID NO: 192183 - DNA, 39 bp, Artificial Sequence
  Description of Artificial Sequence: Synthetic oligonucleotide
tgatatggtgtcatttcatagactcctcgttgtttaccc

SEQ ID NO: 192184 - DNA, 38 bp, Artificial Sequence
  Description of Artificial Sequence: Synthetic oligonucleotide
gatatggtgtcatttcatagactcctcgttgtttaccc

SEQ ID NO: 192185 - DNA, 38 bp, Artificial Sequence
  Description of Artificial Sequence: Synthetic oligonucleotide
atatggtgtcatttcatagactcctcgttgtttacccc

SEQ ID NO: 192186 - DNA, 37 bp, Artificial Sequence
  Description of Artificial Sequence: Synthetic oligonucleotide
tatggtgtcatttcatagactcctcgttgtttacccc

SEQ ID NO: 192187 - DNA, 36 bp, Artificial Sequence
  Description of Artificial Sequence: Synthetic oligonucleotide
atggtgtcatttcatagactcctcgttgtttacccc

SEQ ID NO: 192188 - DNA, 35 bp, Artificial Sequence
  Description of Artificial Sequence: Synthetic oligonucleotide
tggtgtcatttcatagactcctcgttgtttacccc

SEQ ID NO: 192189 - DNA, 34 bp, Artificial Sequence
  Description of Artificial Sequence: Synthetic oligonucleotide
ggtgtcatttcatagactcctcgttgtttacccc

SEQ ID NO: 192190 - DNA, 35 bp, Artificial Sequence
  Description of Artificial Sequence: Synthetic oligonucleotide
gtgtcatttcatagactcctcgttgtttacccctg

SEQ ID NO: 192191 - DNA, 35 bp, Artificial Sequence
  Description of Artificial Sequence: Synthetic oligonucleotide
tgtcatttcatagactcctcgttgtttacccctgg

SEQ ID NO: 192192 - DNA, 34 bp, Artificial Sequence
  Description of Artificial Sequence: Synthetic oligonucleotide
gtcatttcatagactcctcgttgtttacccctgg

SEQ ID NO: 192193 - DNA, 35 bp, Artificial Sequence
  Description of Artificial Sequence: Synthetic oligonucleotide
tcatttcatagactcctcgttgtttacccctggac

SEQ ID NO: 192194 - DNA, 34 bp, Artificial Sequence
  Description of Artificial Sequence: Synthetic oligonucleotide
catttcatagactcctcgttgtttacccctggac

SEQ ID NO: 192195 - DNA, 34 bp, Artificial Sequence
  Description of Artificial Sequence: Synthetic oligonucleotide
atttcatagactcctcgttgtttacccctggacc

SEQ ID NO: 192196 - DNA, 33 bp, Artificial Sequence
  Description of Artificial Sequence: Synthetic oligonucleotide
tttcatagactcctcgttgtttacccctggacc

SEQ ID NO: 192197 - DNA, 32 bp, Artificial Sequence
  Description of Artificial Sequence: Synthetic oligonucleotide
ttcatagactcctcgttgtttacccctggacc

SEQ ID NO: 192198 - DNA, 31 bp, Artificial Sequence
  Description of Artificial Sequence: Synthetic oligonucleotide
tcatagactcctcgttgtttacccctggacc

SEQ ID NO: 192199 - DNA, 30 bp, Artificial Sequence
  Description of Artificial Sequence: Synthetic oligonucleotide
catagactcctcgttgtttacccctggacc

SEQ ID NO: 192200 - DNA, 30 bp, Artificial Sequence
  Description of Artificial Sequence: Synthetic oligonucleotide
atagactcctcgttgtttacccctggaccc

SEQ ID NO: 192201 - DNA, 29 bp, Artificial Sequence
  Description of Artificial Sequence: Synthetic oligonucleotide
tagactcctcgttgtttacccctggaccc

SEQ ID NO: 192202 - DNA, 28 bp, Artificial Sequence
  Description of Artificial Sequence: Synthetic oligonucleotide
agactcctcgttgtttacccctggaccc

SEQ ID NO: 192203 - DNA, 27 bp, Artificial Sequence
  Description of Artificial Sequence: Synthetic oligonucleotide
gactcctcgttgtttacccctggaccc

SEQ ID NO: 192204 - DNA, 28 bp, Artificial Sequence
  Description of Artificial Sequence: Synthetic oligonucleotide
actcctcgttgtttacccctggacccag

SEQ ID NO: 192205 - DNA, 27 bp, Artificial Sequence
  Description of Artificial Sequence: Synthetic oligonucleotide
ctcctcgttgtttacccctggacccag

SEQ ID NO: 192206 - DNA, 28 bp, Artificial Sequence
  Description of Artificial Sequence: Synthetic oligonucleotide
tcctcgttgtttacccctggacccagag

SEQ ID NO: 192207 - DNA, 27 bp, Artificial Sequence
  Description of Artificial Sequence: Synthetic oligonucleotide
cctcgttgtttacccctggacccagag

SEQ ID NO: 192208 - DNA, 34 bp, Artificial Sequence
  Description of Artificial Sequence: Synthetic oligonucleotide
ctcgttgtttacccctggacccagagattttttg

SEQ ID NO: 192209 - DNA, 35 bp, Artificial Sequence
  Description of Artificial Sequence: Synthetic oligonucleotide
tcgttgtttacccctggacccagagattttttgac

SEQ ID NO: 192210 - DNA, 34 bp, Artificial Sequence
  Description of Artificial Sequence: Synthetic oligonucleotide
cgttgtttacccctggacccagagattttttgac

SEQ ID NO: 192211 - DNA, 35 bp, Artificial Sequence
  Description of Artificial Sequence: Synthetic oligonucleotide
gttgtttacccctggacccagagattttttgacag

SEQ ID NO: 192212 - DNA, 35 bp, Artificial Sequence
  Description of Artificial Sequence: Synthetic oligonucleotide
ttgtttacccctggacccagagattttttgacagc

SEQ ID NO: 192213 - DNA, 34 bp, Artificial Sequence
  Description of Artificial Sequence: Synthetic oligonucleotide
tgtttacccctggacccagagattttttgacagc

SEQ ID NO: 192214 - DNA, 33 bp, Artificial Sequence
  Description of Artificial Sequence: Synthetic oligonucleotide
gtttacccctggacccagagattttttgacagc

SEQ ID NO: 192215 - DNA, 36 bp, Artificial Sequence
  Description of Artificial Sequence: Synthetic oligonucleotide
tttacccctggacccagagattttttgacagctttg

SEQ ID NO: 192216 - DNA, 35 bp, Artificial Sequence
  Description of Artificial Sequence: Synthetic oligonucleotide
ttacccctggacccagagattttttgacagctttg

SEQ ID NO: 192217 - DNA, 34 bp, Artificial Sequence
  Description of Artificial Sequence: Synthetic oligonucleotide
tacccctggacccagagattttttgacagctttg

SEQ ID NO: 192218 - DNA, 33 bp, Artificial Sequence
  Description of Artificial Sequence: Synthetic oligonucleotide
acccctggacccagagattttttgacagctttg

SEQ ID NO: 192219 - DNA, 32 bp, Artificial Sequence
  Description of Artificial Sequence: Synthetic oligonucleotide
cccctggacccagagattttttgacagctttg

SEQ ID NO: 192220 - DNA, 32 bp, Artificial Sequence
  Description of Artificial Sequence: Synthetic oligonucleotide
ccctggacccagagattttttgacagctttgg

SEQ ID NO: 192221 - DNA, 35 bp, Artificial Sequence
  Description of Artificial Sequence: Synthetic oligonucleotide
cctggacccagagattttttgacagctttggaaac

SEQ ID NO: 192222 - DNA, 35 bp, Artificial Sequence
  Description of Artificial Sequence: Synthetic oligonucleotide
ctggacccagagattttttgacagctttggaaacc

SEQ ID NO: 192223 - DNA, 36 bp, Artificial Sequence
  Description of Artificial Sequence: Synthetic oligonucleotide
tggacccagagattttttgacagctttggaaacctg

SEQ ID NO: 192224 - DNA, 35 bp, Artificial Sequence
  Description of Artificial Sequence: Synthetic oligonucleotide
ggacccagagattttttgacagctttggaaacctg

SEQ ID NO: 192225 - DNA, 36 bp, Artificial Sequence
  Description of Artificial Sequence: Synthetic oligonucleotide
gacccagagattttttgacagctttggaaacctgtc

SEQ ID NO: 192226 - DNA, 36 bp, Artificial Sequence
  Description of Artificial Sequence: Synthetic oligonucleotide
acccagagattttttgacagctttggaaacctgtcg

SEQ ID NO: 192227 - DNA, 35 bp, Artificial Sequence
  Description of Artificial Sequence: Synthetic oligonucleotide
cccagagattttttgacagctttggaaacctgtcg

SEQ ID NO: 192228 - DNA, 36 bp, Artificial Sequence
  Description of Artificial Sequence: Synthetic oligonucleotide
ccagagattttttgacagctttggaaacctgtcgtc

SEQ ID NO: 192229 - DNA, 37 bp, Artificial Sequence
  Description of Artificial Sequence: Synthetic oligonucleotide
cagagattttttgacagctttggaaacctgtcgtctc

SEQ ID NO: 192230 - DNA, 37 bp, Artificial Sequence
  Description of Artificial Sequence: Synthetic oligonucleotide
agagattttttgacagctttggaaacctgtcgtctcc

SEQ ID NO: 192231 - DNA, 36 bp, Artificial Sequence
  Description of Artificial Sequence: Synthetic oligonucleotide
gagattttttgacagctttggaaacctgtcgtctcc

SEQ ID NO: 192232 - DNA, 36 bp, Artificial Sequence
  Description of Artificial Sequence: Synthetic oligonucleotide
agattttttgacagctttggaaacctgtcgtctccc

SEQ ID NO: 192233 - DNA, 35 bp, Artificial Sequence
  Description of Artificial Sequence: Synthetic oligonucleotide
gattttttgacagctttggaaacctgtcgtctccc

SEQ ID NO: 192234 - DNA, 36 bp, Artificial Sequence
  Description of Artificial Sequence: Synthetic oligonucleotide
attttttgacagctttggaaacctgtcgtctccctc

SEQ ID NO: 192235 - DNA, 35 bp, Artificial Sequence
  Description of Artificial Sequence: Synthetic oligonucleotide
ttttttgacagctttggaaacctgtcgtctccctc

SEQ ID NO: 192236 - DNA, 34 bp, Artificial Sequence
  Description of Artificial Sequence: Synthetic oligonucleotide
tttttgacagctttggaaacctgtcgtctccctc

SEQ ID NO: 192237 - DNA, 33 bp, Artificial Sequence
  Description of Artificial Sequence: Synthetic oligonucleotide
ttttgacagctttggaaacctgtcgtctccctc

SEQ ID NO: 192238 - DNA, 32 bp, Artificial Sequence
  Description of Artificial Sequence: Synthetic oligonucleotide
tttgacagctttggaaacctgtcgtctccctc

SEQ ID NO: 192239 - DNA, 31 bp, Artificial Sequence
  Description of Artificial Sequence: Synthetic oligonucleotide
ttgacagctttggaaacctgtcgtctccctc

SEQ ID NO: 192240 - DNA, 30 bp, Artificial Sequence
  Description of Artificial Sequence: Synthetic oligonucleotide
tgacagctttggaaacctgtcgtctccctc

SEQ ID NO: 192241 - DNA, 29 bp, Artificial Sequence
  Description of Artificial Sequence: Synthetic oligonucleotide
gacagctttggaaacctgtcgtctccctc

SEQ ID NO: 192242 - DNA, 30 bp, Artificial Sequence
  Description of Artificial Sequence: Synthetic oligonucleotide
acagctttggaaacctgtcgtctccctctg

SEQ ID NO: 192243 - DNA, 29 bp, Artificial Sequence
  Description of Artificial Sequence: Synthetic oligonucleotide
cagctttggaaacctgtcgtctccctctg

SEQ ID NO: 192244 - DNA, 29 bp, Artificial Sequence
  Description of Artificial Sequence: Synthetic oligonucleotide
agctttggaaacctgtcgtctccctctgc

SEQ ID NO: 192245 - DNA, 28 bp, Artificial Sequence
  Description of Artificial Sequence: Synthetic oligonucleotide
gctttggaaacctgtcgtctccctctgc

SEQ ID NO: 192246 - DNA, 28 bp, Artificial Sequence
  Description of Artificial Sequence: Synthetic oligonucleotide
ctttggaaacctgtcgtctccctctgcc

SEQ ID NO: 192247 - DNA, 30 bp, Artificial Sequence
  Description of Artificial Sequence: Synthetic oligonucleotide
tttggaaacctgtcgtctccctctgccatc

SEQ ID NO: 192248 - DNA, 29 bp, Artificial Sequence
  Description of Artificial Sequence: Synthetic oligonucleotide
ttggaaacctgtcgtctccctctgccatc

SEQ ID NO: 192249 - DNA, 28 bp, Artificial Sequence
  Description of Artificial Sequence: Synthetic oligonucleotide
tggaaacctgtcgtctccctctgccatc

SEQ ID NO: 192250 - DNA, 27 bp, Artificial Sequence
  Description of Artificial Sequence: Synthetic oligonucleotide
ggaaacctgtcgtctccctctgccatc

SEQ ID NO: 192251 - DNA, 27 bp, Artificial Sequence
  Description of Artificial Sequence: Synthetic oligonucleotide
gaaacctgtcgtctccctctgccatcc

SEQ ID NO: 192252 - DNA, 28 bp, Artificial Sequence
  Description of Artificial Sequence: Synthetic oligonucleotide
aaacctgtcgtctccctctgccatcctg

SEQ ID NO: 192253 - DNA, 27 bp, Artificial Sequence
  Description of Artificial Sequence: Synthetic oligonucleotide
aacctgtcgtctccctctgccatcctg

SEQ ID NO: 192254 - DNA, 26 bp, Artificial Sequence
  Description of Artificial Sequence: Synthetic oligonucleotide
acctgtcgtctccctctgccatcctg

SEQ ID NO: 192255 - DNA, 25 bp, Artificial Sequence
  Description of Artificial Sequence: Synthetic oligonucleotide
cctgtcgtctccctctgccatcctg

SEQ ID NO: 192256 - DNA, 25 bp, Artificial Sequence
  Description of Artificial Sequence: Synthetic oligonucleotide
ctgtcgtctccctctgccatcctgg

SEQ ID NO: 192257 - DNA, 25 bp, Artificial Sequence
  Description of Artificial Sequence: Synthetic oligonucleotide
tgtcgtctccctctgccatcctggg

SEQ ID NO: 192258 - DNA, 24 bp, Artificial Sequence
  Description of Artificial Sequence: Synthetic oligonucleotide
gtcgtctccctctgccatcctggg

SEQ ID NO: 192259 - DNA, 26 bp, Artificial Sequence
  Description of Artificial Sequence: Synthetic oligonucleotide
tcgtctccctctgccatcctgggcaa

SEQ ID NO: 192260 - DNA, 25 bp, Artificial Sequence
  Description of Artificial Sequence: Synthetic oligonucleotide
cgtctccctctgccatcctgggcaa

SEQ ID NO: 192261 - DNA, 25 bp, Artificial Sequence
  Description of Artificial Sequence: Synthetic oligonucleotide
gtctccctctgccatcctgggcaac

SEQ ID NO: 192262 - DNA, 25 bp, Artificial Sequence
  Description of Artificial Sequence: Synthetic oligonucleotide
tctccctctgccatcctgggcaacc

SEQ ID NO: 192263 - DNA, 24 bp, Artificial Sequence
  Description of Artificial Sequence: Synthetic oligonucleotide
ctccctctgccatcctgggcaacc

SEQ ID NO: 192264 - DNA, 24 bp, Artificial Sequence
  Description of Artificial Sequence: Synthetic oligonucleotide
tccctctgccatcctgggcaaccc

SEQ ID NO: 192265 - DNA, 23 bp, Artificial Sequence
  Description of Artificial Sequence: Synthetic oligonucleotide
ccctctgccatcctgggcaaccc

SEQ ID NO: 192266 - DNA, 25 bp, Artificial Sequence
  Description of Artificial Sequence: Synthetic oligonucleotide
cctctgccatcctgggcaaccccaa

SEQ ID NO: 192267 - DNA, 25 bp, Artificial Sequence
  Description of Artificial Sequence: Synthetic oligonucleotide
ctctgccatcctgggcaaccccaag

SEQ ID NO: 192268 - DNA, 26 bp, Artificial Sequence
  Description of Artificial Sequence: Synthetic oligonucleotide
tctgccatcctgggcaaccccaaggt

SEQ ID NO: 192269 - DNA, 25 bp, Artificial Sequence
  Description of Artificial Sequence: Synthetic oligonucleotide
ctgccatcctgggcaaccccaaggt

SEQ ID NO: 192270 - DNA, 27 bp, Artificial Sequence
  Description of Artificial Sequence: Synthetic oligonucleotide
tgccatcctgggcaaccccaaggtcaa

SEQ ID NO: 192271 - DNA, 26 bp, Artificial Sequence
  Description of Artificial Sequence: Synthetic oligonucleotide
gccatcctgggcaaccccaaggtcaa

SEQ ID NO: 192272 - DNA, 26 bp, Artificial Sequence
  Description of Artificial Sequence: Synthetic oligonucleotide
ccatcctgggcaaccccaaggtcaag

SEQ ID NO: 192273 - DNA, 26 bp, Artificial Sequence
  Description of Artificial Sequence: Synthetic oligonucleotide
catcctgggcaaccccaaggtcaagg

SEQ ID NO: 192274 - DNA, 26 bp, Artificial Sequence
  Description of Artificial Sequence: Synthetic oligonucleotide
atcctgggcaaccccaaggtcaaggc

SEQ ID NO: 192275 - DNA, 25 bp, Artificial Sequence
  Description of Artificial Sequence: Synthetic oligonucleotide
tcctgggcaaccccaaggtcaaggc

SEQ ID NO: 192276 - DNA, 24 bp, Artificial Sequence
  Description of Artificial Sequence: Synthetic oligonucleotide
cctgggcaaccccaaggtcaaggc

SEQ ID NO: 192277 - DNA, 24 bp, Artificial Sequence
  Description of Artificial Sequence: Synthetic oligonucleotide
ctgggcaaccccaaggtcaaggcc

SEQ ID NO: 192278 - DNA, 26 bp, Artificial Sequence
  Description of Artificial Sequence: Synthetic oligonucleotide
tgggcaaccccaaggtcaaggcccat

SEQ ID NO: 192279 - DNA, 25 bp, Artificial Sequence
  Description of Artificial Sequence: Synthetic oligonucleotide
gggcaaccccaaggtcaaggcccat

SEQ ID NO: 192280 - DNA, 25 bp, Artificial Sequence
  Description of Artificial Sequence: Synthetic oligonucleotide
ggcaaccccaaggtcaaggcccatg

SEQ ID NO: 192281 - DNA, 36 bp, Artificial Sequence
  Description of Artificial Sequence: Synthetic oligonucleotide
gcaccttctgactgtcaaactgttcttgtcaatctc

SEQ ID NO: 192282 - DNA, 37 bp, Artificial Sequence
  Description of Artificial Sequence: Synthetic oligonucleotide
caccttctgactgtcaaactgttcttgtcaatctcac

SEQ ID NO: 192283 - DNA, 38 bp, Artificial Sequence
  Description of Artificial Sequence: Synthetic oligonucleotide
accttctgactgtcaaactgttcttgtcaatctcacag

SEQ ID NO: 192284 - DNA, 37 bp, Artificial Sequence
  Description of Artificial Sequence: Synthetic oligonucleotide
ccttctgactgtcaaactgttcttgtcaatctcacag

SEQ ID NO: 192285 - DNA, 37 bp, Artificial Sequence
  Description of Artificial Sequence: Synthetic oligonucleotide
cttctgactgtcaaactgttcttgtcaatctcacagg

SEQ ID NO: 192286 - DNA, 37 bp, Artificial Sequence
  Description of Artificial Sequence: Synthetic oligonucleotide
ttctgactgtcaaactgttcttgtcaatctcacaggc

SEQ ID NO: 192287 - DNA, 36 bp, Artificial Sequence
  Description of Artificial Sequence: Synthetic oligonucleotide
tctgactgtcaaactgttcttgtcaatctcacaggc

SEQ ID NO: 192288 - DNA, 35 bp, Artificial Sequence
  Description of Artificial Sequence: Synthetic oligonucleotide
ctgactgtcaaactgttcttgtcaatctcacaggc

SEQ ID NO: 192289 - DNA, 36 bp, Artificial Sequence
  Description of Artificial Sequence: Synthetic oligonucleotide
tgactgtcaaactgttcttgtcaatctcacaggctc

SEQ ID NO: 192290 - DNA, 35 bp, Artificial Sequence
  Description of Artificial Sequence: Synthetic oligonucleotide
gactgtcaaactgttcttgtcaatctcacaggctc

SEQ ID NO: 192291 - DNA, 35 bp, Artificial Sequence
  Description of Artificial Sequence: Synthetic oligonucleotide
actgtcaaactgttcttgtcaatctcacaggctcc

SEQ ID NO: 192292 - DNA, 34 bp, Artificial Sequence
  Description of Artificial Sequence: Synthetic oligonucleotide
ctgtcaaactgttcttgtcaatctcacaggctcc

SEQ ID NO: 192293 - DNA, 35 bp, Artificial Sequence
  Description of Artificial Sequence: Synthetic oligonucleotide
tgtcaaactgttcttgtcaatctcacaggctcctg

SEQ ID NO: 192294 - DNA, 34 bp, Artificial Sequence
  Description of Artificial Sequence: Synthetic oligonucleotide
gtcaaactgttcttgtcaatctcacaggctcctg

SEQ ID NO: 192295 - DNA, 34 bp, Artificial Sequence
  Description of Artificial Sequence: Synthetic oligonucleotide
tcaaactgttcttgtcaatctcacaggctcctgg

SEQ ID NO: 192296 - DNA, 33 bp, Artificial Sequence
  Description of Artificial Sequence: Synthetic oligonucleotide
caaactgttcttgtcaatctcacaggctcctgg

SEQ ID NO: 192297 - DNA, 35 bp, Artificial Sequence
  Description of Artificial Sequence: Synthetic oligonucleotide
aaactgttcttgtcaatctcacaggctcctggttg

SEQ ID NO: 192298 - DNA, 34 bp, Artificial Sequence
  Description of Artificial Sequence: Synthetic oligonucleotide
aactgttcttgtcaatctcacaggctcctggttg

SEQ ID NO: 192299 - DNA, 33 bp, Artificial Sequence
  Description of Artificial Sequence: Synthetic oligonucleotide
actgttcttgtcaatctcacaggctcctggttg

SEQ ID NO: 192300 - DNA, 32 bp, Artificial Sequence
  Description of Artificial Sequence: Synthetic oligonucleotide
ctgttcttgtcaatctcacaggctcctggttg

SEQ ID NO: 192301 - DNA, 33 bp, Artificial Sequence
  Description of Artificial Sequence: Synthetic oligonucleotide
tgttcttgtcaatctcacaggctcctggttgtc

SEQ ID NO: 192302 - DNA, 32 bp, Artificial Sequence
  Description of Artificial Sequence: Synthetic oligonucleotide
gttcttgtcaatctcacaggctcctggttgtc

SEQ ID NO: 192303 - DNA, 34 bp, Artificial Sequence
  Description of Artificial Sequence: Synthetic oligonucleotide
ttcttgtcaatctcacaggctcctggttgtctac

SEQ ID NO: 192304 - DNA, 33 bp, Artificial Sequence
  Description of Artificial Sequence: Synthetic oligonucleotide
tcttgtcaatctcacaggctcctggttgtctac

SEQ ID NO: 192305 - DNA, 32 bp, Artificial Sequence
  Description of Artificial Sequence: Synthetic oligonucleotide
cttgtcaatctcacaggctcctggttgtctac

SEQ ID NO: 192306 - DNA, 32 bp, Artificial Sequence
  Description of Artificial Sequence: Synthetic oligonucleotide
ttgtcaatctcacaggctcctggttgtctacc

SEQ ID NO: 192307 - DNA, 31 bp, Artificial Sequence
  Description of Artificial Sequence: Synthetic oligonucleotide
tgtcaatctcacaggctcctggttgtctacc

SEQ ID NO: 192308 - DNA, 30 bp, Artificial Sequence
  Description of Artificial Sequence: Synthetic oligonucleotide
gtcaatctcacaggctcctggttgtctacc

SEQ ID NO: 192309 - DNA, 30 bp, Artificial Sequence
  Description of Artificial Sequence: Synthetic oligonucleotide
tcaatctcacaggctcctggttgtctaccc

SEQ ID NO: 192310 - DNA, 29 bp, Artificial Sequence
  Description of Artificial Sequence: Synthetic oligonucleotide
caatctcacaggctcctggttgtctaccc

SEQ ID NO: 192311 - DNA, 31 bp, Artificial Sequence
  Description of Artificial Sequence: Synthetic oligonucleotide
aatctcacaggctcctggttgtctacccatg

SEQ ID NO: 192312 - DNA, 30 bp, Artificial Sequence
  Description of Artificial Sequence: Synthetic oligonucleotide
atctcacaggctcctggttgtctacccatg

SEQ ID NO: 192313 - DNA, 29 bp, Artificial Sequence
  Description of Artificial Sequence: Synthetic oligonucleotide
tctcacaggctcctggttgtctacccatg

SEQ ID NO: 192314 - DNA, 28 bp, Artificial Sequence
  Description of Artificial Sequence: Synthetic oligonucleotide
ctcacaggctcctggttgtctacccatg

SEQ ID NO: 192315 - DNA, 28 bp, Artificial Sequence
  Description of Artificial Sequence: Synthetic oligonucleotide
tcacaggctcctggttgtctacccatgg

SEQ ID NO: 192316 - DNA, 27 bp, Artificial Sequence
  Description of Artificial Sequence: Synthetic oligonucleotide
cacaggctcctggttgtctacccatgg

SEQ ID NO: 192317 - DNA, 28 bp, Artificial Sequence
  Description of Artificial Sequence: Synthetic oligonucleotide
acaggctcctggttgtctacccatggac

SEQ ID NO: 192318 - DNA, 27 bp, Artificial Sequence
  Description of Artificial Sequence: Synthetic oligonucleotide
caggctcctggttgtctacccatggac

SEQ ID NO: 192319 - DNA, 27 bp, Artificial Sequence
  Description of Artificial Sequence: Synthetic oligonucleotide
aggctcctggttgtctacccatggacc

SEQ ID NO: 192320 - DNA, 26 bp, Artificial Sequence
  Description of Artificial Sequence: Synthetic oligonucleotide
ggctcctggttgtctacccatggacc

SEQ ID NO: 192321 - DNA, 27 bp, Artificial Sequence
  Description of Artificial Sequence: Synthetic oligonucleotide
gctcctggttgtctacccatggaccca

SEQ ID NO: 192322 - DNA, 27 bp, Artificial Sequence
  Description of Artificial Sequence: Synthetic oligonucleotide
ctcctggttgtctacccatggacccag

SEQ ID NO: 192323 - DNA, 28 bp, Artificial Sequence
  Description of Artificial Sequence: Synthetic oligonucleotide
tcctggttgtctacccatggacccagag

SEQ ID NO: 192324 - DNA, 27 bp, Artificial Sequence
  Description of Artificial Sequence: Synthetic oligonucleotide
cctggttgtctacccatggacccagag

SEQ ID NO: 192325 - DNA, 27 bp, Artificial Sequence
  Description of Artificial Sequence: Synthetic oligonucleotide
ctggttgtctacccatggacccagagg

SEQ ID NO: 192326 - DNA, 29 bp, Artificial Sequence
  Description of Artificial Sequence: Synthetic oligonucleotide
tggttgtctacccatggacccagaggttc

SEQ ID NO: 192327 - DNA, 28 bp, Artificial Sequence
  Description of Artificial Sequence: Synthetic oligonucleotide
ggttgtctacccatggacccagaggttc

SEQ ID NO: 192328 - DNA, 31 bp, Artificial Sequence
  Description of Artificial Sequence: Synthetic oligonucleotide
gttgtctacccatggacccagaggttctttg

SEQ ID NO: 192329 - DNA, 32 bp, Artificial Sequence
  Description of Artificial Sequence: Synthetic oligonucleotide
ttgtctacccatggacccagaggttctttgac

SEQ ID NO: 192330 - DNA, 31 bp, Artificial Sequence
  Description of Artificial Sequence: Synthetic oligonucleotide
tgtctacccatggacccagaggttctttgac

SEQ ID NO: 192331 - DNA, 30 bp, Artificial Sequence
  Description of Artificial Sequence: Synthetic oligonucleotide
gtctacccatggacccagaggttctttgac

SEQ ID NO: 192332 - DNA, 31 bp, Artificial Sequence
  Description of Artificial Sequence: Synthetic oligonucleotide
tctacccatggacccagaggttctttgacag

SEQ ID NO: 192333 - DNA, 30 bp, Artificial Sequence
  Description of Artificial Sequence: Synthetic oligonucleotide
ctacccatggacccagaggttctttgacag

SEQ ID NO: 192334 - DNA, 30 bp, Artificial Sequence
  Description of Artificial Sequence: Synthetic oligonucleotide
tacccatggacccagaggttctttgacagc

SEQ ID NO: 192335 - DNA, 29 bp, Artificial Sequence
  Description of Artificial Sequence: Synthetic oligonucleotide
acccatggacccagaggttctttgacagc

SEQ ID NO: 192336 - DNA, 28 bp, Artificial Sequence
  Description of Artificial Sequence: Synthetic oligonucleotide
cccatggacccagaggttctttgacagc

SEQ ID NO: 192337 - DNA, 31 bp, Artificial Sequence
  Description of Artificial Sequence: Synthetic oligonucleotide
ccatggacccagaggttctttgacagctttg

SEQ ID NO: 192338 - DNA, 31 bp, Artificial Sequence
  Description of Artificial Sequence: Synthetic oligonucleotide
catggacccagaggttctttgacagctttgg

SEQ ID NO: 192339 - DNA, 31 bp, Artificial Sequence
  Description of Artificial Sequence: Synthetic oligonucleotide
atggacccagaggttctttgacagctttggc

SEQ ID NO: 192340 - DNA, 30 bp, Artificial Sequence
  Description of Artificial Sequence: Synthetic oligonucleotide
tggacccagaggttctttgacagctttggc

SEQ ID NO: 192341 - DNA, 29 bp, Artificial Sequence
  Description of Artificial Sequence: Synthetic oligonucleotide
ggacccagaggttctttgacagctttggc

SEQ ID NO: 192342 - DNA, 31 bp, Artificial Sequence
  Description of Artificial Sequence: Synthetic oligonucleotide
gacccagaggttctttgacagctttggcaac

SEQ ID NO: 192343 - DNA, 31 bp, Artificial Sequence
  Description of Artificial Sequence: Synthetic oligonucleotide
acccagaggttctttgacagctttggcaacc

SEQ ID NO: 192344 - DNA, 30 bp, Artificial Sequence
  Description of Artificial Sequence: Synthetic oligonucleotide
cccagaggttctttgacagctttggcaacc

SEQ ID NO: 192345 - DNA, 31 bp, Artificial Sequence
  Description of Artificial Sequence: Synthetic oligonucleotide
ccagaggttctttgacagctttggcaacctg

SEQ ID NO: 192346 - DNA, 32 bp, Artificial Sequence
  Description of Artificial Sequence: Synthetic oligonucleotide
cagaggttctttgacagctttggcaacctgtc

SEQ ID NO: 192347 - DNA, 32 bp, Artificial Sequence
  Description of Artificial Sequence: Synthetic oligonucleotide
agaggttctttgacagctttggcaacctgtcc

SEQ ID NO: 192348 - DNA, 31 bp, Artificial Sequence
  Description of Artificial Sequence: Synthetic oligonucleotide
gaggttctttgacagctttggcaacctgtcc

SEQ ID NO: 192349 - DNA, 32 bp, Artificial Sequence
  Description of Artificial Sequence: Synthetic oligonucleotide
aggttctttgacagctttggcaacctgtcctc

SEQ ID NO: 192350 - DNA, 31 bp, Artificial Sequence
  Description of Artificial Sequence: Synthetic oligonucleotide
ggttctttgacagctttggcaacctgtcctc

SEQ ID NO: 192351 - DNA, 32 bp, Artificial Sequence
  Description of Artificial Sequence: Synthetic oligonucleotide
gttctttgacagctttggcaacctgtcctctg

SEQ ID NO: 192352 - DNA, 32 bp, Artificial Sequence
  Description of Artificial Sequence: Synthetic oligonucleotide
ttctttgacagctttggcaacctgtcctctgc

SEQ ID NO: 192353 - DNA, 31 bp, Artificial Sequence
  Description of Artificial Sequence: Synthetic oligonucleotide
tctttgacagctttggcaacctgtcctctgc

SEQ ID NO: 192354 - DNA, 30 bp, Artificial Sequence
  Description of Artificial Sequence: Synthetic oligonucleotide
ctttgacagctttggcaacctgtcctctgc

SEQ ID NO: 192355 - DNA, 30 bp, Artificial Sequence
  Description of Artificial Sequence: Synthetic oligonucleotide
tttgacagctttggcaacctgtcctctgcc

SEQ ID NO: 192356 - DNA, 29 bp, Artificial Sequence
  Description of Artificial Sequence: Synthetic oligonucleotide
ttgacagctttggcaacctgtcctctgcc

SEQ ID NO: 192357 - DNA, 28 bp, Artificial Sequence
  Description of Artificial Sequence: Synthetic oligonucleotide
tgacagctttggcaacctgtcctctgcc

SEQ ID NO: 192358 - DNA, 27 bp, Artificial Sequence
  Description of Artificial Sequence: Synthetic oligonucleotide
gacagctttggcaacctgtcctctgcc

SEQ ID NO: 192359 - DNA, 28 bp, Artificial Sequence
  Description of Artificial Sequence: Synthetic oligonucleotide
acagctttggcaacctgtcctctgcctc

SEQ ID NO: 192360 - DNA, 27 bp, Artificial Sequence
  Description of Artificial Sequence: Synthetic oligonucleotide
cagctttggcaacctgtcctctgcctc

SEQ ID NO: 192361 - DNA, 28 bp, Artificial Sequence
  Description of Artificial Sequence: Synthetic oligonucleotide
agctttggcaacctgtcctctgcctctg

SEQ ID NO: 192362 - DNA, 27 bp, Artificial Sequence
  Description of Artificial Sequence: Synthetic oligonucleotide
gctttggcaacctgtcctctgcctctg

SEQ ID NO: 192363 - DNA, 27 bp, Artificial Sequence
  Description of Artificial Sequence: Synthetic oligonucleotide
ctttggcaacctgtcctctgcctctgc

SEQ ID NO: 192364 - DNA, 27 bp, Artificial Sequence
  Description of Artificial Sequence: Synthetic oligonucleotide
tttggcaacctgtcctctgcctctgcc

SEQ ID NO: 192365 - DNA, 27 bp, Artificial Sequence
  Description of Artificial Sequence: Synthetic oligonucleotide
ttggcaacctgtcctctgcctctgcca

SEQ ID NO: 192366 - DNA, 27 bp, Artificial Sequence
  Description of Artificial Sequence: Synthetic oligonucleotide
tggcaacctgtcctctgcctctgccat

SEQ ID NO: 192367 - DNA, 26 bp, Artificial Sequence
  Description of Artificial Sequence: Synthetic oligonucleotide
ggcaacctgtcctctgcctctgccat

SEQ ID NO: 192368 - DNA, 27 bp, Artificial Sequence
  Description of Artificial Sequence: Synthetic oligonucleotide
gcaacctgtcctctgcctctgccatca

SEQ ID NO: 192369 - DNA, 28 bp, Artificial Sequence
  Description of Artificial Sequence: Synthetic oligonucleotide
caacctgtcctctgcctctgccatcatg

SEQ ID NO: 192370 - DNA, 28 bp, Artificial Sequence
  Description of Artificial Sequence: Synthetic oligonucleotide
aacctgtcctctgcctctgccatcatgg

SEQ ID NO: 192371 - DNA, 27 bp, Artificial Sequence
  Description of Artificial Sequence: Synthetic oligonucleotide
acctgtcctctgcctctgccatcatgg

SEQ ID NO: 192372 - DNA, 26 bp, Artificial Sequence
  Description of Artificial Sequence: Synthetic oligonucleotide
cctgtcctctgcctctgccatcatgg

SEQ ID NO: 192373 - DNA, 26 bp, Artificial Sequence
  Description of Artificial Sequence: Synthetic oligonucleotide
ctgtcctctgcctctgccatcatggg

SEQ ID NO: 192374 - DNA, 27 bp, Artificial Sequence
  Description of Artificial Sequence: Synthetic oligonucleotide
tgtcctctgcctctgccatcatgggca

SEQ ID NO: 192375 - DNA, 27 bp, Artificial Sequence
  Description of Artificial Sequence: Synthetic oligonucleotide
gtcctctgcctctgccatcatgggcaa

SEQ ID NO: 192376 - DNA, 27 bp, Artificial Sequence
  Description of Artificial Sequence: Synthetic oligonucleotide
tcctctgcctctgccatcatgggcaac

SEQ ID NO: 192377 - DNA, 26 bp, Artificial Sequence
  Description of Artificial Sequence: Synthetic oligonucleotide
cctctgcctctgccatcatgggcaac

SEQ ID NO: 192378 - DNA, 26 bp, Artificial Sequence
  Description of Artificial Sequence: Synthetic oligonucleotide
ctctgcctctgccatcatgggcaacc

SEQ ID NO: 192379 - DNA, 26 bp, Artificial Sequence
  Description of Artificial Sequence: Synthetic oligonucleotide
tctgcctctgccatcatgggcaaccc

SEQ ID NO: 192380 - DNA, 25 bp, Artificial Sequence
  Description of Artificial Sequence: Synthetic oligonucleotide
ctgcctctgccatcatgggcaaccc

SEQ ID NO: 192381 - DNA, 27 bp, Artificial Sequence
  Description of Artificial Sequence: Synthetic oligonucleotide
tgcctctgccatcatgggcaaccccaa

SEQ ID NO: 192382 - DNA, 27 bp, Artificial Sequence
  Description of Artificial Sequence: Synthetic oligonucleotide
gcctctgccatcatgggcaaccccaaa

SEQ ID NO: 192383 - DNA, 27 bp, Artificial Sequence
  Description of Artificial Sequence: Synthetic oligonucleotide
cctctgccatcatgggcaaccccaaag

SEQ ID NO: 192384 - DNA, 28 bp, Artificial Sequence
  Description of Artificial Sequence: Synthetic oligonucleotide
ctctgccatcatgggcaaccccaaagtc

SEQ ID NO: 192385 - DNA, 30 bp, Artificial Sequence
  Description of Artificial Sequence: Synthetic oligonucleotide
tctgccatcatgggcaaccccaaagtcaag

SEQ ID NO: 192386 - DNA, 29 bp, Artificial Sequence
  Description of Artificial Sequence: Synthetic oligonucleotide
ctgccatcatgggcaaccccaaagtcaag

SEQ ID NO: 192387 - DNA, 29 bp, Artificial Sequence
  Description of Artificial Sequence: Synthetic oligonucleotide
tgccatcatgggcaaccccaaagtcaagg

SEQ ID NO: 192388 - DNA, 28 bp, Artificial Sequence
  Description of Artificial Sequence: Synthetic oligonucleotide
gccatcatgggcaaccccaaagtcaagg

SEQ ID NO: 192389 - DNA, 28 bp, Artificial Sequence
  Description of Artificial Sequence: Synthetic oligonucleotide
ccatcatgggcaaccccaaagtcaaggc

SEQ ID NO: 192390 - DNA, 29 bp, Artificial Sequence
  Description of Artificial Sequence: Synthetic oligonucleotide
catcatgggcaaccccaaagtcaaggcac

SEQ ID NO: 192391 - DNA, 31 bp, Artificial Sequence
  Description of Artificial Sequence: Synthetic oligonucleotide
atcatgggcaaccccaaagtcaaggcacatg

SEQ ID NO: 192392 - DNA, 26 bp, Artificial Sequence
  Description of Artificial Sequence: Synthetic oligonucleotide
atgtggctccggagccatcgtcagct

SEQ ID NO: 192393 - DNA, 25 bp, Artificial Sequence
  Description of Artificial Sequence: Synthetic oligonucleotide
tgtggctccggagccatcgtcagct

SEQ ID NO: 192394 - DNA, 24 bp, Artificial Sequence
  Description of Artificial Sequence: Synthetic oligonucleotide
gtggctccggagccatcgtcagct

SEQ ID NO: 192395 - DNA, 25 bp, Artificial Sequence
  Description of Artificial Sequence: Synthetic oligonucleotide
tggctccggagccatcgtcagctct

SEQ ID NO: 192396 - DNA, 24 bp, Artificial Sequence
  Description of Artificial Sequence: Synthetic oligonucleotide
ggctccggagccatcgtcagctct

SEQ ID NO: 192397 - DNA, 24 bp, Artificial Sequence
  Description of Artificial Sequence: Synthetic oligonucleotide
gctccggagccatcgtcagctctg

SEQ ID NO: 192398 - DNA, 24 bp, Artificial Sequence
  Description of Artificial Sequence: Synthetic oligonucleotide
ctccggagccatcgtcagctctgc

SEQ ID NO: 192399 - DNA, 25 bp, Artificial Sequence
  Description of Artificial Sequence: Synthetic oligonucleotide
tccggagccatcgtcagctctgcct

SEQ ID NO: 192400 - DNA, 24 bp, Artificial Sequence
  Description of Artificial Sequence: Synthetic oligonucleotide
ccggagccatcgtcagctctgcct

SEQ ID NO: 192401 - DNA, 24 bp, Artificial Sequence
  Description of Artificial Sequence: Synthetic oligonucleotide
cggagccatcgtcagctctgcctg

SEQ ID NO: 192402 - DNA, 24 bp, Artificial Sequence
  Description of Artificial Sequence: Synthetic oligonucleotide
ggagccatcgtcagctctgcctgg

SEQ ID NO: 192403 - DNA, 24 bp, Artificial Sequence
  Description of Artificial Sequence: Synthetic oligonucleotide
gagccatcgtcagctctgcctggc

SEQ ID NO: 192404 - DNA, 26 bp, Artificial Sequence
  Description of Artificial Sequence: Synthetic oligonucleotide
agccatcgtcagctctgcctggcctt

SEQ ID NO: 192405 - DNA, 25 bp, Artificial Sequence
  Description of Artificial Sequence: Synthetic oligonucleotide
gccatcgtcagctctgcctggcctt

SEQ ID NO: 192406 - DNA, 25 bp, Artificial Sequence
  Description of Artificial Sequence: Synthetic oligonucleotide
ccatcgtcagctctgcctggccttc

SEQ ID NO: 192407 - DNA, 26 bp, Artificial Sequence
  Description of Artificial Sequence: Synthetic oligonucleotide
catcgtcagctctgcctggccttcct

SEQ ID NO: 192408 - DNA, 26 bp, Artificial Sequence
  Description of Artificial Sequence: Synthetic oligonucleotide
atcgtcagctctgcctggccttcctg

SEQ ID NO: 192409 - DNA, 25 bp, Artificial Sequence
  Description of Artificial Sequence: Synthetic oligonucleotide
tcgtcagctctgcctggccttcctg

SEQ ID NO: 192410 - DNA, 24 bp, Artificial Sequence
  Description of Artificial Sequence: Synthetic oligonucleotide
cgtcagctctgcctggccttcctg

SEQ ID NO: 192411 - DNA, 26 bp, Artificial Sequence
  Description of Artificial Sequence: Synthetic oligonucleotide
gtcagctctgcctggccttcctgcta

SEQ ID NO: 192412 - DNA, 27 bp, Artificial Sequence
  Description of Artificial Sequence: Synthetic oligonucleotide
tcagctctgcctggccttcctgctagt

SEQ ID NO: 192413 - DNA, 26 bp, Artificial Sequence
  Description of Artificial Sequence: Synthetic oligonucleotide
cagctctgcctggccttcctgctagt

SEQ ID NO: 192414 - DNA, 27 bp, Artificial Sequence
  Description of Artificial Sequence: Synthetic oligonucleotide
agctctgcctggccttcctgctagtct

SEQ ID NO: 192415 - DNA, 26 bp, Artificial Sequence
  Description of Artificial Sequence: Synthetic oligonucleotide
gctctgcctggccttcctgctagtct

SEQ ID NO: 192416 - DNA, 27 bp, Artificial Sequence
  Description of Artificial Sequence: Synthetic oligonucleotide
ctctgcctggccttcctgctagtctgt

SEQ ID NO: 192417 - DNA, 27 bp, Artificial Sequence
  Description of Artificial Sequence: Synthetic oligonucleotide
tctgcctggccttcctgctagtctgtg

SEQ ID NO: 192418 - DNA, 27 bp, Artificial Sequence
  Description of Artificial Sequence: Synthetic oligonucleotide
ctgcctggccttcctgctagtctgtgt

SEQ ID NO: 192419 - DNA, 27 bp, Artificial Sequence
  Description of Artificial Sequence: Synthetic oligonucleotide
tgcctggccttcctgctagtctgtgtc

SEQ ID NO: 192420 - DNA, 26 bp, Artificial Sequence
  Description of Artificial Sequence: Synthetic oligonucleotide
gcctggccttcctgctagtctgtgtc

SEQ ID NO: 192421 - DNA, 27 bp, Artificial Sequence
  Description of Artificial Sequence: Synthetic oligonucleotide
cctggccttcctgctagtctgtgtcct

SEQ ID NO: 192422 - DNA, 27 bp, Artificial Sequence
  Description of Artificial Sequence: Synthetic oligonucleotide
ctggccttcctgctagtctgtgtcctc

SEQ ID NO: 192423 - DNA, 28 bp, Artificial Sequence
  Description of Artificial Sequence: Synthetic oligonucleotide
tggccttcctgctagtctgtgtcctctc

SEQ ID NO: 192424 - DNA, 27 bp, Artificial Sequence
  Description of Artificial Sequence: Synthetic oligonucleotide
ggccttcctgctagtctgtgtcctctc

SEQ ID NO: 192425 - DNA, 28 bp, Artificial Sequence
  Description of Artificial Sequence: Synthetic oligonucleotide
gccttcctgctagtctgtgtcctctctg

SEQ ID NO: 192426 - DNA, 32 bp, Artificial Sequence
  Description of Artificial Sequence: Synthetic oligonucleotide
ccttcctgctagtctgtgtcctctctgtaatc

SEQ ID NO: 192427 - DNA, 34 bp, Artificial Sequence
  Description of Artificial Sequence: Synthetic oligonucleotide
cttcctgctagtctgtgtcctctctgtaatcttc

SEQ ID NO: 192428 - DNA, 36 bp, Artificial Sequence
  Description of Artificial Sequence: Synthetic oligonucleotide
ttcctgctagtctgtgtcctctctgtaatcttcttc

SEQ ID NO: 192429 - DNA, 35 bp, Artificial Sequence
  Description of Artificial Sequence: Synthetic oligonucleotide
tcctgctagtctgtgtcctctctgtaatcttcttc

SEQ ID NO: 192430 - DNA, 34 bp, Artificial Sequence
  Description of Artificial Sequence: Synthetic oligonucleotide
cctgctagtctgtgtcctctctgtaatcttcttc

SEQ ID NO: 192431 - DNA, 34 bp, Artificial Sequence
  Description of Artificial Sequence: Synthetic oligonucleotide
ctgctagtctgtgtcctctctgtaatcttcttcc

SEQ ID NO: 192432 - DNA, 35 bp, Artificial Sequence
  Description of Artificial Sequence: Synthetic oligonucleotide
tgctagtctgtgtcctctctgtaatcttcttcctc

SEQ ID NO: 192433 - DNA, 34 bp, Artificial Sequence
  Description of Artificial Sequence: Synthetic oligonucleotide
gctagtctgtgtcctctctgtaatcttcttcctc

SEQ ID NO: 192434 - DNA, 34 bp, Artificial Sequence
  Description of Artificial Sequence: Synthetic oligonucleotide
ctagtctgtgtcctctctgtaatcttcttcctcc

SEQ ID NO: 192435 - DNA, 38 bp, Artificial Sequence
  Description of Artificial Sequence: Synthetic oligonucleotide
tagtctgtgtcctctctgtaatcttcttcctccatatc

SEQ ID NO: 192436 - DNA, 37 bp, Artificial Sequence
  Description of Artificial Sequence: Synthetic oligonucleotide
agtctgtgtcctctctgtaatcttcttcctccatatc

SEQ ID NO: 192437 - DNA, 36 bp, Artificial Sequence
  Description of Artificial Sequence: Synthetic oligonucleotide
gtctgtgtcctctctgtaatcttcttcctccatatc

SEQ ID NO: 192438 - DNA, 36 bp, Artificial Sequence
  Description of Artificial Sequence: Synthetic oligonucleotide
tctgtgtcctctctgtaatcttcttcctccatatcc

SEQ ID NO: 192439 - DNA, 35 bp, Artificial Sequence
  Description of Artificial Sequence: Synthetic oligonucleotide
ctgtgtcctctctgtaatcttcttcctccatatcc

SEQ ID NO: 192440 - DNA, 37 bp, Artificial Sequence
  Description of Artificial Sequence: Synthetic oligonucleotide
tgtgtcctctctgtaatcttcttcctccatatccatc

SEQ ID NO: 192441 - DNA, 36 bp, Artificial Sequence
  Description of Artificial Sequence: Synthetic oligonucleotide
gtgtcctctctgtaatcttcttcctccatatccatc

SEQ ID NO: 192442 - DNA, 38 bp, Artificial Sequence
  Description of Artificial Sequence: Synthetic oligonucleotide
tgtcctctctgtaatcttcttcctccatatccatcaag

SEQ ID NO: 192443 - DNA, 37 bp, Artificial Sequence
  Description of Artificial Sequence: Synthetic oligonucleotide
gtcctctctgtaatcttcttcctccatatccatcaag

SEQ ID NO: 192444 - DNA, 38 bp, Artificial Sequence
  Description of Artificial Sequence: Synthetic oligonucleotide
tcctctctgtaatcttcttcctccatatccatcaagac

SEQ ID NO: 192445 - DNA, 37 bp, Artificial Sequence
  Description of Artificial Sequence: Synthetic oligonucleotide
cctctctgtaatcttcttcctccatatccatcaagac

SEQ ID NO: 192446 - DNA, 38 bp, Artificial Sequence
  Description of Artificial Sequence: Synthetic oligonucleotide
ctctctgtaatcttcttcctccatatccatcaagacag

SEQ ID NO: 192447 - DNA, 38 bp, Artificial Sequence
  Description of Artificial Sequence: Synthetic oligonucleotide
tctctgtaatcttcttcctccatatccatcaagacagc

SEQ ID NO: 192448 - DNA, 37 bp, Artificial Sequence
  Description of Artificial Sequence: Synthetic oligonucleotide
ctctgtaatcttcttcctccatatccatcaagacagc

SEQ ID NO: 192449 - DNA, 40 bp, Artificial Sequence
  Description of Artificial Sequence: Synthetic oligonucleotide
tctgtaatcttcttcctccatatccatcaagacagctttc

SEQ ID NO: 192450 - DNA, 39 bp, Artificial Sequence
  Description of Artificial Sequence: Synthetic oligonucleotide
ctgtaatcttcttcctccatatccatcaagacagctttc

SEQ ID NO: 192451 - DNA, 39 bp, Artificial Sequence
  Description of Artificial Sequence: Synthetic oligonucleotide
tgtaatcttcttcctccatatccatcaagacagctttcc

SEQ ID NO: 192452 - DNA, 38 bp, Artificial Sequence
  Description of Artificial Sequence: Synthetic oligonucleotide
gtaatcttcttcctccatatccatcaagacagctttcc

SEQ ID NO: 192453 - DNA, 39 bp, Artificial Sequence
  Description of Artificial Sequence: Synthetic oligonucleotide
taatcttcttcctccatatccatcaagacagctttccac

SEQ ID NO: 192454 - DNA, 38 bp, Artificial Sequence
  Description of Artificial Sequence: Synthetic oligonucleotide
aatcttcttcctccatatccatcaagacagctttccac

SEQ ID NO: 192455 - DNA, 37 bp, Artificial Sequence
  Description of Artificial Sequence: Synthetic oligonucleotide
atcttcttcctccatatccatcaagacagctttccac

SEQ ID NO: 192456 - DNA, 36 bp, Artificial Sequence
  Description of Artificial Sequence: Synthetic oligonucleotide
tcttcttcctccatatccatcaagacagctttccac

SEQ ID NO: 192457 - DNA, 35 bp, Artificial Sequence
  Description of Artificial Sequence: Synthetic oligonucleotide
cttcttcctccatatccatcaagacagctttccac

SEQ ID NO: 192458 - DNA, 37 bp, Artificial Sequence
  Description of Artificial Sequence: Synthetic oligonucleotide
ttcttcctccatatccatcaagacagctttccacatg

SEQ ID NO: 192459 - DNA, 36 bp, Artificial Sequence
  Description of Artificial Sequence: Synthetic oligonucleotide
tcttcctccatatccatcaagacagctttccacatg

SEQ ID NO: 192460 - DNA, 35 bp, Artificial Sequence
  Description of Artificial Sequence: Synthetic oligonucleotide
cttcctccatatccatcaagacagctttccacatg

SEQ ID NO: 192461 - DNA, 35 bp, Artificial Sequence
  Description of Artificial Sequence: Synthetic oligonucleotide
ttcctccatatccatcaagacagctttccacatgg

SEQ ID NO: 192462 - DNA, 34 bp, Artificial Sequence
  Description of Artificial Sequence: Synthetic oligonucleotide
tcctccatatccatcaagacagctttccacatgg

SEQ ID NO: 192463 - DNA, 33 bp, Artificial Sequence
  Description of Artificial Sequence: Synthetic oligonucleotide
cctccatatccatcaagacagctttccacatgg

SEQ ID NO: 192464 - DNA, 33 bp, Artificial Sequence
  Description of Artificial Sequence: Synthetic oligonucleotide
ctccatatccatcaagacagctttccacatggc

SEQ ID NO: 192465 - DNA, 33 bp, Artificial Sequence
  Description of Artificial Sequence: Synthetic oligonucleotide
tccatatccatcaagacagctttccacatggcc

SEQ ID NO: 192466 - DNA, 32 bp, Artificial Sequence
  Description of Artificial Sequence: Synthetic oligonucleotide
ccatatccatcaagacagctttccacatggcc

SEQ ID NO: 192467 - DNA, 34 bp, Artificial Sequence
  Description of Artificial Sequence: Synthetic oligonucleotide
catatccatcaagacagctttccacatggcctag

SEQ ID NO: 192468 - DNA, 34 bp, Artificial Sequence
  Description of Artificial Sequence: Synthetic oligonucleotide
atatccatcaagacagctttccacatggcctagg

SEQ ID NO: 192469 - DNA, 33 bp, Artificial Sequence
  Description of Artificial Sequence: Synthetic oligonucleotide
tatccatcaagacagctttccacatggcctagg

SEQ ID NO: 192470 - DNA, 32 bp, Artificial Sequence
  Description of Artificial Sequence: Synthetic oligonucleotide
atccatcaagacagctttccacatggcctagg

SEQ ID NO: 192471 - DNA, 31 bp, Artificial Sequence
  Description of Artificial Sequence: Synthetic oligonucleotide
tccatcaagacagctttccacatggcctagg

SEQ ID NO: 192472 - DNA, 30 bp, Artificial Sequence
  Description of Artificial Sequence: Synthetic oligonucleotide
ccatcaagacagctttccacatggcctagg

SEQ ID NO: 192473 - DNA, 30 bp, Artificial Sequence
  Description of Artificial Sequence: Synthetic oligonucleotide
catcaagacagctttccacatggcctaggc

SEQ ID NO: 192474 - DNA, 30 bp, Artificial Sequence
  Description of Artificial Sequence: Synthetic oligonucleotide
atcaagacagctttccacatggcctaggcc

SEQ ID NO: 192475 - DNA, 29 bp, Artificial Sequence
  Description of Artificial Sequence: Synthetic oligonucleotide
tcaagacagctttccacatggcctaggcc

SEQ ID NO: 192476 - DNA, 28 bp, Artificial Sequence
  Description of Artificial Sequence: Synthetic oligonucleotide
caagacagctttccacatggcctaggcc

SEQ ID NO: 192477 - DNA, 29 bp, Artificial Sequence
  Description of Artificial Sequence: Synthetic oligonucleotide
aagacagctttccacatggcctaggcctg

SEQ ID NO: 192478 - DNA, 28 bp, Artificial Sequence
  Description of Artificial Sequence: Synthetic oligonucleotide
agacagctttccacatggcctaggcctg

SEQ ID NO: 192479 - DNA, 27 bp, Artificial Sequence
  Description of Artificial Sequence: Synthetic oligonucleotide
gacagctttccacatggcctaggcctg

SEQ ID NO: 192480 - DNA, 28 bp, Artificial Sequence
  Description of Artificial Sequence: Synthetic oligonucleotide
acagctttccacatggcctaggcctgtc

SEQ ID NO: 192481 - DNA, 27 bp, Artificial Sequence
  Description of Artificial Sequence: Synthetic oligonucleotide
cagctttccacatggcctaggcctgtc

SEQ ID NO: 192482 - DNA, 27 bp, Artificial Sequence
  Description of Artificial Sequence: Synthetic oligonucleotide
agctttccacatggcctaggcctgtcg

SEQ ID NO: 192483 - DNA, 27 bp, Artificial Sequence
  Description of Artificial Sequence: Synthetic oligonucleotide
gctttccacatggcctaggcctgtcga

SEQ ID NO: 192484 - DNA, 28 bp, Artificial Sequence
  Description of Artificial Sequence: Synthetic oligonucleotide
ctttccacatggcctaggcctgtcgatc

SEQ ID NO: 192485 - DNA, 28 bp, Artificial Sequence
  Description of Artificial Sequence: Synthetic oligonucleotide
tttccacatggcctaggcctgtcgatcc

SEQ ID NO: 192486 - DNA, 27 bp, Artificial Sequence
  Description of Artificial Sequence: Synthetic oligonucleotide
ttccacatggcctaggcctgtcgatcc

SEQ ID NO: 192487 - DNA, 27 bp, Artificial Sequence
  Description of Artificial Sequence: Synthetic oligonucleotide
tccacatggcctaggcctgtcgatcct

SEQ ID NO: 192488 - DNA, 26 bp, Artificial Sequence
  Description of Artificial Sequence: Synthetic oligonucleotide
ccacatggcctaggcctgtcgatcct

SEQ ID NO: 192489 - DNA, 27 bp, Artificial Sequence
  Description of Artificial Sequence: Synthetic oligonucleotide
cacatggcctaggcctgtcgatcctgt

SEQ ID NO: 192490 - DNA, 27 bp, Artificial Sequence
  Description of Artificial Sequence: Synthetic oligonucleotide
acatggcctaggcctgtcgatcctgtg

SEQ ID NO: 192491 - DNA, 27 bp, Artificial Sequence
  Description of Artificial Sequence: Synthetic oligonucleotide
catggcctaggcctgtcgatcctgtgt

SEQ ID NO: 192492 - DNA, 27 bp, Artificial Sequence
  Description of Artificial Sequence: Synthetic oligonucleotide
atggcctaggcctgtcgatcctgtgtc

SEQ ID NO: 192493 - DNA, 26 bp, Artificial Sequence
  Description of Artificial Sequence: Synthetic oligonucleotide
tggcctaggcctgtcgatcctgtgtc

SEQ ID NO: 192494 - DNA, 25 bp, Artificial Sequence
  Description of Artificial Sequence: Synthetic oligonucleotide
ggcctaggcctgtcgatcctgtgtc

SEQ ID NO: 192495 - DNA, 26 bp, Artificial Sequence
  Description of Artificial Sequence: Synthetic oligonucleotide
gcctaggcctgtcgatcctgtgtcca

SEQ ID NO: 192496 - DNA, 27 bp, Artificial Sequence
  Description of Artificial Sequence: Synthetic oligonucleotide
cctaggcctgtcgatcctgtgtccaga

SEQ ID NO: 192497 - DNA, 27 bp, Artificial Sequence
  Description of Artificial Sequence: Synthetic oligonucleotide
ctaggcctgtcgatcctgtgtccagac

SEQ ID NO: 192498 - DNA, 27 bp, Artificial Sequence
  Description of Artificial Sequence: Synthetic oligonucleotide
taggcctgtcgatcctgtgtccagacc

SEQ ID NO: 192499 - DNA, 26 bp, Artificial Sequence
  Description of Artificial Sequence: Synthetic oligonucleotide
aggcctgtcgatcctgtgtccagacc

SEQ ID NO: 192500 - DNA, 25 bp, Artificial Sequence
  Description of Artificial Sequence: Synthetic oligonucleotide
ggcctgtcgatcctgtgtccagacc

SEQ ID NO: 192501 - DNA, 25 bp, Artificial Sequence
  Description of Artificial Sequence: Synthetic oligonucleotide
gcctgtcgatcctgtgtccagaccg

SEQ ID NO: 192502 - DNA, 25 bp, Artificial Sequence
  Description of Artificial Sequence: Synthetic oligonucleotide
cctgtcgatcctgtgtccagaccgc

SEQ ID NO: 192503 - DNA, 25 bp, Artificial Sequence
  Description of Artificial Sequence: Synthetic oligonucleotide
ctgtcgatcctgtgtccagaccgcc

SEQ ID NO: 192504 - DNA, 25 bp, Artificial Sequence
  Description of Artificial Sequence: Synthetic oligonucleotide
tgtcgatcctgtgtccagaccgccg

SEQ ID NO: 192505 - DNA, 24 bp, Artificial Sequence
  Description of Artificial Sequence: Synthetic oligonucleotide
gtcgatcctgtgtccagaccgccg

SEQ ID NO: 192506 - DNA, 24 bp, Artificial Sequence
  Description of Artificial Sequence: Synthetic oligonucleotide
tcgatcctgtgtccagaccgccgc

SEQ ID NO: 192507 - DNA, 23 bp, Artificial Sequence
  Description of Artificial Sequence: Synthetic oligonucleotide
cgatcctgtgtccagaccgccgc

SEQ ID NO: 192508 - DNA, 24 bp, Artificial Sequence
  Description of Artificial Sequence: Synthetic oligonucleotide
gatcctgtgtccagaccgccgcct

SEQ ID NO: 192509 - DNA, 24 bp, Artificial Sequence
  Description of Artificial Sequence: Synthetic oligonucleotide
atcctgtgtccagaccgccgcctg

SEQ ID NO: 192510 - DNA, 23 bp, Artificial Sequence
  Description of Artificial Sequence: Synthetic oligonucleotide
tcctgtgtccagaccgccgcctg

SEQ ID NO: 192511 - DNA, 22 bp, Artificial Sequence
  Description of Artificial Sequence: Synthetic oligonucleotide
cctgtgtccagaccgccgcctg

SEQ ID NO: 192512 - DNA, 23 bp, Artificial Sequence
  Description of Artificial Sequence: Synthetic oligonucleotide
ctgtgtccagaccgccgcctggt

SEQ ID NO: 192513 - DNA, 24 bp, Artificial Sequence
  Description of Artificial Sequence: Synthetic oligonucleotide
tgtgtccagaccgccgcctggtga

SEQ ID NO: 192514 - DNA, 23 bp, Artificial Sequence
  Description of Artificial Sequence: Synthetic oligonucleotide
gtgtccagaccgccgcctggtga

SEQ ID NO: 192515 - DNA, 24 bp, Artificial Sequence
  Description of Artificial Sequence: Synthetic oligonucleotide
tgtccagaccgccgcctggtgaca

SEQ ID NO: 192516 - DNA, 23 bp, Artificial Sequence
  Description of Artificial Sequence: Synthetic oligonucleotide
gtccagaccgccgcctggtgaca

SEQ ID NO: 192517 - DNA, 23 bp, Artificial Sequence
  Description of Artificial Sequence: Synthetic oligonucleotide
tccagaccgccgcctggtgacac

SEQ ID NO: 192518 - DNA, 22 bp, Artificial Sequence
  Description of Artificial Sequence: Synthetic oligonucleotide
ccagaccgccgcctggtgacac

SEQ ID NO: 192519 - DNA, 22 bp, Artificial Sequence
  Description of Artificial Sequence: Synthetic oligonucleotide
cagaccgccgcctggtgacacc

SEQ ID NO: 192520 - DNA, 22 bp, Artificial Sequence
  Description of Artificial Sequence: Synthetic oligonucleotide
agaccgccgcctggtgacaccc

SEQ ID NO: 192521 - DNA, 21 bp, Artificial Sequence
  Description of Artificial Sequence: Synthetic oligonucleotide
gaccgccgcctggtgacaccc

SEQ ID NO: 192522 - DNA, 21 bp, Artificial Sequence
  Description of Artificial Sequence: Synthetic oligonucleotide
accgccgcctggtgacacccc

SEQ ID NO: 192523 - DNA, 20 bp, Artificial Sequence
  Description of Artificial Sequence: Synthetic oligonucleotide
ccgccgcctggtgacacccc

SEQ ID NO: 192524 - DNA, 21 bp, Artificial Sequence
  Description of Artificial Sequence: Synthetic oligonucleotide
cgccgcctggtgacaccccca

SEQ ID NO: 192525 - DNA, 22 bp, Artificial Sequence
  Description of Artificial Sequence: Synthetic oligonucleotide
gccgcctggtgacacccccagt

SEQ ID NO: 192526 - DNA, 22 bp, Artificial Sequence
  Description of Artificial Sequence: Synthetic oligonucleotide
ccgcctggtgacacccccagtg

SEQ ID NO: 192527 - DNA, 22 bp, Artificial Sequence
  Description of Artificial Sequence: Synthetic oligonucleotide
cgcctggtgacacccccagtgg

SEQ ID NO: 192528 - DNA, 22 bp, Artificial Sequence
  Description of Artificial Sequence: Synthetic oligonucleotide
gcctggtgacacccccagtggc

SEQ ID NO: 192529 - DNA, 24 bp, Artificial Sequence
  Description of Artificial Sequence: Synthetic oligonucleotide
cctggtgacacccccagtggccat

SEQ ID NO: 192530 - DNA, 26 bp, Artificial Sequence
  Description of Artificial Sequence: Synthetic oligonucleotide
ctggtgacacccccagtggccatctt

SEQ ID NO: 192531 - DNA, 27 bp, Artificial Sequence
  Description of Artificial Sequence: Synthetic oligonucleotide
tggtgacacccccagtggccatcttct

SEQ ID NO: 192532 - DNA, 26 bp, Artificial Sequence
  Description of Artificial Sequence: Synthetic oligonucleotide
ggtgacacccccagtggccatcttct

SEQ ID NO: 192533 - DNA, 26 bp, Artificial Sequence
  Description of Artificial Sequence: Synthetic oligonucleotide
gtgacacccccagtggccatcttctg

SEQ ID NO: 192534 - DNA, 26 bp, Artificial Sequence
  Description of Artificial Sequence: Synthetic oligonucleotide
tgacacccccagtggccatcttctgc

SEQ ID NO: 192535 - DNA, 25 bp, Artificial Sequence
  Description of Artificial Sequence: Synthetic oligonucleotide
gacacccccagtggccatcttctgc

SEQ ID NO: 192536 - DNA, 26 bp, Artificial Sequence
  Description of Artificial Sequence: Synthetic oligonucleotide
acacccccagtggccatcttctgcct

SEQ ID NO: 192537 - DNA, 25 bp, Artificial Sequence
  Description of Artificial Sequence: Synthetic oligonucleotide
cacccccagtggccatcttctgcct

SEQ ID NO: 192538 - DNA, 25 bp, Artificial Sequence
  Description of Artificial Sequence: Synthetic oligonucleotide
acccccagtggccatcttctgcctg

SEQ ID NO: 192539 - DNA, 24 bp, Artificial Sequence
  Description of Artificial Sequence: Synthetic oligonucleotide
cccccagtggccatcttctgcctg

SEQ ID NO: 192540 - DNA, 24 bp, Artificial Sequence
  Description of Artificial Sequence: Synthetic oligonucleotide
ccccagtggccatcttctgcctgc

SEQ ID NO: 192541 - DNA, 24 bp, Artificial Sequence
  Description of Artificial Sequence: Synthetic oligonucleotide
cccagtggccatcttctgcctgcc

SEQ ID NO: 192542 - DNA, 24 bp, Artificial Sequence
  Description of Artificial Sequence: Synthetic oligonucleotide
ccagtggccatcttctgcctgccg

SEQ ID NO: 192543 - DNA, 24 bp, Artificial Sequence
  Description of Artificial Sequence: Synthetic oligonucleotide
cagtggccatcttctgcctgccgg

SEQ ID NO: 192544 - DNA, 26 bp, Artificial Sequence
  Description of Artificial Sequence: Synthetic oligonucleotide
agtggccatcttctgcctgccgggta

SEQ ID NO: 192545 - DNA, 25 bp, Artificial Sequence
  Description of Artificial Sequence: Synthetic oligonucleotide
gtggccatcttctgcctgccgggta

SEQ ID NO: 192546 - DNA, 26 bp, Artificial Sequence
  Description of Artificial Sequence: Synthetic oligonucleotide
tggccatcttctgcctgccgggtact

SEQ ID NO: 192547 - DNA, 25 bp, Artificial Sequence
  Description of Artificial Sequence: Synthetic oligonucleotide
ggccatcttctgcctgccgggtact

SEQ ID NO: 192548 - DNA, 25 bp, Artificial Sequence
  Description of Artificial Sequence: Synthetic oligonucleotide
gccatcttctgcctgccgggtactg

SEQ ID NO: 192549 - DNA, 25 bp, Artificial Sequence
  Description of Artificial Sequence: Synthetic oligonucleotide
ccatcttctgcctgccgggtactgc

SEQ ID NO: 192550 - DNA, 27 bp, Artificial Sequence
  Description of Artificial Sequence: Synthetic oligonucleotide
catcttctgcctgccgggtactgcgat

SEQ ID NO: 192551 - DNA, 27 bp, Artificial Sequence
  Description of Artificial Sequence: Synthetic oligonucleotide
atcttctgcctgccgggtactgcgatg

SEQ ID NO: 192552 - DNA, 26 bp, Artificial Sequence
  Description of Artificial Sequence: Synthetic oligonucleotide
tcttctgcctgccgggtactgcgatg

SEQ ID NO: 192553 - DNA, 25 bp, Artificial Sequence
  Description of Artificial Sequence: Synthetic oligonucleotide
cttctgcctgccgggtactgcgatg

SEQ ID NO: 192554 - DNA, 25 bp, Artificial Sequence
  Description of Artificial Sequence: Synthetic oligonucleotide
ttctgcctgccgggtactgcgatgg

SEQ ID NO: 192555 - DNA, 24 bp, Artificial Sequence
  Description of Artificial Sequence: Synthetic oligonucleotide
tctgcctgccgggtactgcgatgg

SEQ ID NO: 192556 - DNA, 23 bp, Artificial Sequence
  Description of Artificial Sequence: Synthetic oligonucleotide
ctgcctgccgggtactgcgatgg

SEQ ID NO: 192557 - DNA, 23 bp, Artificial Sequence
  Description of Artificial Sequence: Synthetic oligonucleotide
tgcctgccgggtactgcgatggg

SEQ ID NO: 192558 - DNA, 22 bp, Artificial Sequence
  Description of Artificial Sequence: Synthetic oligonucleotide
gcctgccgggtactgcgatggg

SEQ ID NO: 192559 - DNA, 22 bp, Artificial Sequence
  Description of Artificial Sequence: Synthetic oligonucleotide
cctgccgggtactgcgatgggc

SEQ ID NO: 192560 - DNA, 22 bp, Artificial Sequence
  Description of Artificial Sequence: Synthetic oligonucleotide
ctgccgggtactgcgatgggcc

SEQ ID NO: 192561 - DNA, 22 bp, Artificial Sequence
  Description of Artificial Sequence: Synthetic oligonucleotide
tgccgggtactgcgatgggccc

SEQ ID NO: 192562 - DNA, 21 bp, Artificial Sequence
  Description of Artificial Sequence: Synthetic oligonucleotide
gccgggtactgcgatgggccc

SEQ ID NO: 192563 - DNA, 23 bp, Artificial Sequence
  Description of Artificial Sequence: Synthetic oligonucleotide
ccgggtactgcgatgggccccaa

SEQ ID NO: 192564 - DNA, 23 bp, Artificial Sequence
  Description of Artificial Sequence: Synthetic oligonucleotide
cgggtactgcgatgggccccaac

SEQ ID NO: 192565 - DNA, 23 bp, Artificial Sequence
  Description of Artificial Sequence: Synthetic oligonucleotide
gggtactgcgatgggccccaacg

SEQ ID NO: 192566 - DNA, 23 bp, Artificial Sequence
  Description of Artificial Sequence: Synthetic oligonucleotide
ggtactgcgatgggccccaacgc

SEQ ID NO: 192567 - DNA, 24 bp, Artificial Sequence
  Description of Artificial Sequence: Synthetic oligonucleotide
gtactgcgatgggccccaacgcct

SEQ ID NO: 192568 - DNA, 24 bp, Artificial Sequence
  Description of Artificial Sequence: Synthetic oligonucleotide
tactgcgatgggccccaacgcctc

SEQ ID NO: 192569 - DNA, 23 bp, Artificial Sequence
  Description of Artificial Sequence: Synthetic oligonucleotide
actgcgatgggccccaacgcctc

SEQ ID NO: 192570 - DNA, 22 bp, Artificial Sequence
  Description of Artificial Sequence: Synthetic oligonucleotide
ctgcgatgggccccaacgcctc

SEQ ID NO: 192571 - DNA, 23 bp, Artificial Sequence
  Description of Artificial Sequence: Synthetic oligonucleotide
tgcgatgggccccaacgcctcct

SEQ ID NO: 192572 - DNA, 22 bp, Artificial Sequence
  Description of Artificial Sequence: Synthetic oligonucleotide
gcgatgggccccaacgcctcct

SEQ ID NO: 192573 - DNA, 24 bp, Artificial Sequence
  Description of Artificial Sequence: Synthetic oligonucleotide
cgatgggccccaacgcctcctctt

SEQ ID NO: 192574 - DNA, 24 bp, Artificial Sequence
  Description of Artificial Sequence: Synthetic oligonucleotide
gatgggccccaacgcctcctcttc

SEQ ID NO: 192575 - DNA, 25 bp, Artificial Sequence
  Description of Artificial Sequence: Synthetic oligonucleotide
atgggccccaacgcctcctcttcct

SEQ ID NO: 192576 - DNA, 24 bp, Artificial Sequence
  Description of Artificial Sequence: Synthetic oligonucleotide
tgggccccaacgcctcctcttcct

SEQ ID NO: 192577 - DNA, 23 bp, Artificial Sequence
  Description of Artificial Sequence: Synthetic oligonucleotide
gggccccaacgcctcctcttcct

SEQ ID NO: 192578 - DNA, 24 bp, Artificial Sequence
  Description of Artificial Sequence: Synthetic oligonucleotide
ggccccaacgcctcctcttcctgt

SEQ ID NO: 192579 - DNA, 24 bp, Artificial Sequence
  Description of Artificial Sequence: Synthetic oligonucleotide
gccccaacgcctcctcttcctgtc

SEQ ID NO: 192580 - DNA, 24 bp, Artificial Sequence
  Description of Artificial Sequence: Synthetic oligonucleotide
ccccaacgcctcctcttcctgtcc

SEQ ID NO: 192581 - DNA, 24 bp, Artificial Sequence
  Description of Artificial Sequence: Synthetic oligonucleotide
cccaacgcctcctcttcctgtccc

SEQ ID NO: 192582 - DNA, 25 bp, Artificial Sequence
  Description of Artificial Sequence: Synthetic oligonucleotide
ccaacgcctcctcttcctgtcccca

SEQ ID NO: 192583 - DNA, 25 bp, Artificial Sequence
  Description of Artificial Sequence: Synthetic oligonucleotide
caacgcctcctcttcctgtccccag

SEQ ID NO: 192584 - DNA, 26 bp, Artificial Sequence
  Description of Artificial Sequence: Synthetic oligonucleotide
aacgcctcctcttcctgtccccagca

SEQ ID NO: 192585 - DNA, 25 bp, Artificial Sequence
  Description of Artificial Sequence: Synthetic oligonucleotide
acgcctcctcttcctgtccccagca

SEQ ID NO: 192586 - DNA, 24 bp, Artificial Sequence
  Description of Artificial Sequence: Synthetic oligonucleotide
cgcctcctcttcctgtccccagca

SEQ ID NO: 192587 - DNA, 24 bp, Artificial Sequence
  Description of Artificial Sequence: Synthetic oligonucleotide
gcctcctcttcctgtccccagcac

SEQ ID NO: 192588 - DNA, 24 bp, Artificial Sequence
  Description of Artificial Sequence: Synthetic oligonucleotide
cctcctcttcctgtccccagcacc

SEQ ID NO: 192589 - DNA, 25 bp, Artificial Sequence
  Description of Artificial Sequence: Synthetic oligonucleotide
ctcctcttcctgtccccagcaccct

SEQ ID NO: 192590 - DNA, 25 bp, Artificial Sequence
  Description of Artificial Sequence: Synthetic oligonucleotide
tcctcttcctgtccccagcaccctg

SEQ ID NO: 192591 - DNA, 24 bp, Artificial Sequence
  Description of Artificial Sequence: Synthetic oligonucleotide
cctcttcctgtccccagcaccctg

SEQ ID NO: 192592 - DNA, 26 bp, Artificial Sequence
  Description of Artificial Sequence: Synthetic oligonucleotide
ctcttcctgtccccagcaccctgctt

SEQ ID NO: 192593 - DNA, 26 bp, Artificial Sequence
  Description of Artificial Sequence: Synthetic oligonucleotide
tcttcctgtccccagcaccctgcttc

SEQ ID NO: 192594 - DNA, 25 bp, Artificial Sequence
  Description of Artificial Sequence: Synthetic oligonucleotide
cttcctgtccccagcaccctgcttc

SEQ ID NO: 192595 - DNA, 25 bp, Artificial Sequence
  Description of Artificial Sequence: Synthetic oligonucleotide
ttcctgtccccagcaccctgcttcc

SEQ ID NO: 192596 - DNA, 24 bp, Artificial Sequence
  Description of Artificial Sequence: Synthetic oligonucleotide
tcctgtccccagcaccctgcttcc

SEQ ID NO: 192597 - DNA, 23 bp, Artificial Sequence
  Description of Artificial Sequence: Synthetic oligonucleotide
cctgtccccagcaccctgcttcc

SEQ ID NO: 192598 - DNA, 24 bp, Artificial Sequence
  Description of Artificial Sequence: Synthetic oligonucleotide
ctgtccccagcaccctgcttccct

SEQ ID NO: 192599 - DNA, 25 bp, Artificial Sequence
  Description of Artificial Sequence: Synthetic oligonucleotide
tgtccccagcaccctgcttccctct

SEQ ID NO: 192600 - DNA, 24 bp, Artificial Sequence
  Description of Artificial Sequence: Synthetic oligonucleotide
gtccccagcaccctgcttccctct

SEQ ID NO: 192601 - DNA, 24 bp, Artificial Sequence
  Description of Artificial Sequence: Synthetic oligonucleotide
tccccagcaccctgcttccctctc

SEQ ID NO: 192602 - DNA, 23 bp, Artificial Sequence
  Description of Artificial Sequence: Synthetic oligonucleotide
ccccagcaccctgcttccctctc

SEQ ID NO: 192603 - DNA, 23 bp, Artificial Sequence
  Description of Artificial Sequence: Synthetic oligonucleotide
cccagcaccctgcttccctctcc

SEQ ID NO: 192604 - DNA, 23 bp, Artificial Sequence
  Description of Artificial Sequence: Synthetic oligonucleotide
ccagcaccctgcttccctctccg

SEQ ID NO: 192605 - DNA, 23 bp, Artificial Sequence
  Description of Artificial Sequence: Synthetic oligonucleotide
cagcaccctgcttccctctccgg

SEQ ID NO: 192606 - DNA, 24 bp, Artificial Sequence
  Description of Artificial Sequence: Synthetic oligonucleotide
agcaccctgcttccctctccggca

SEQ ID NO: 192607 - DNA, 23 bp, Artificial Sequence
  Description of Artificial Sequence: Synthetic oligonucleotide
gcaccctgcttccctctccggca

SEQ ID NO: 192608 - DNA, 23 bp, Artificial Sequence
  Description of Artificial Sequence: Synthetic oligonucleotide
caccctgcttccctctccggcac

SEQ ID NO: 192609 - DNA, 24 bp, Artificial Sequence
  Description of Artificial Sequence: Synthetic oligonucleotide
accctgcttccctctccggcacct

SEQ ID NO: 192610 - DNA, 23 bp, Artificial Sequence
  Description of Artificial Sequence: Synthetic oligonucleotide
ccctgcttccctctccggcacct

SEQ ID NO: 192611 - DNA, 23 bp, Artificial Sequence
  Description of Artificial Sequence: Synthetic oligonucleotide
cctgcttccctctccggcacctg

SEQ ID NO: 192612 - DNA, 24 bp, Artificial Sequence
  Description of Artificial Sequence: Synthetic oligonucleotide
ctgcttccctctccggcacctgga

SEQ ID NO: 192613 - DNA, 25 bp, Artificial Sequence
  Description of Artificial Sequence: Synthetic oligonucleotide
tgcttccctctccggcacctggact

SEQ ID NO: 192614 - DNA, 24 bp, Artificial Sequence
  Description of Artificial Sequence: Synthetic oligonucleotide
gcttccctctccggcacctggact

SEQ ID NO: 192615 - DNA, 25 bp, Artificial Sequence
  Description of Artificial Sequence: Synthetic oligonucleotide
cttccctctccggcacctggactgt

SEQ ID NO: 192616 - DNA, 27 bp, Artificial Sequence
  Description of Artificial Sequence: Synthetic oligonucleotide
ttccctctccggcacctggactgtcta

SEQ ID NO: 192617 - DNA, 26 bp, Artificial Sequence
  Description of Artificial Sequence: Synthetic oligonucleotide
tccctctccggcacctggactgtcta

SEQ ID NO: 192618 - DNA, 25 bp, Artificial Sequence
  Description of Artificial Sequence: Synthetic oligonucleotide
ccctctccggcacctggactgtcta

SEQ ID NO: 192619 - DNA, 25 bp, Artificial Sequence
  Description of Artificial Sequence: Synthetic oligonucleotide
cctctccggcacctggactgtctac

SEQ ID NO: 192620 - DNA, 25 bp, Artificial Sequence
  Description of Artificial Sequence: Synthetic oligonucleotide
ctctccggcacctggactgtctacc

SEQ ID NO: 192621 - DNA, 25 bp, Artificial Sequence
  Description of Artificial Sequence: Synthetic oligonucleotide
tctccggcacctggactgtctaccc

SEQ ID NO: 192622 - DNA, 24 bp, Artificial Sequence
  Description of Artificial Sequence: Synthetic oligonucleotide
ctccggcacctggactgtctaccc

SEQ ID NO: 192623 - DNA, 27 bp, Artificial Sequence
  Description of Artificial Sequence: Synthetic oligonucleotide
tccggcacctggactgtctaccccaat

SEQ ID NO: 192624 - DNA, 26 bp, Artificial Sequence
  Description of Artificial Sequence: Synthetic oligonucleotide
ccggcacctggactgtctaccccaat

SEQ ID NO: 192625 - DNA, 26 bp, Artificial Sequence
  Description of Artificial Sequence: Synthetic oligonucleotide
cggcacctggactgtctaccccaatg

SEQ ID NO: 192626 - DNA, 26 bp, Artificial Sequence
  Description of Artificial Sequence: Synthetic oligonucleotide
ggcacctggactgtctaccccaatgg

SEQ ID NO: 192627 - DNA, 26 bp, Artificial Sequence
  Description of Artificial Sequence: Synthetic oligonucleotide
gcacctggactgtctaccccaatggc

SEQ ID NO: 192628 - DNA, 26 bp, Artificial Sequence
  Description of Artificial Sequence: Synthetic oligonucleotide
cacctggactgtctaccccaatggcc

SEQ ID NO: 192629 - DNA, 26 bp, Artificial Sequence
  Description of Artificial Sequence: Synthetic oligonucleotide
acctggactgtctaccccaatggccg

SEQ ID NO: 192630 - DNA, 25 bp, Artificial Sequence
  Description of Artificial Sequence: Synthetic oligonucleotide
cctggactgtctaccccaatggccg

SEQ ID NO: 192631 - DNA, 27 bp, Artificial Sequence
  Description of Artificial Sequence: Synthetic oligonucleotide
ctggactgtctaccccaatggccggtt

SEQ ID NO: 192632 - DNA, 28 bp, Artificial Sequence
  Description of Artificial Sequence: Synthetic oligonucleotide
tggactgtctaccccaatggccggtttg

SEQ ID NO: 192633 - DNA, 27 bp, Artificial Sequence
  Description of Artificial Sequence: Synthetic oligonucleotide
ggactgtctaccccaatggccggtttg

SEQ ID NO: 192634 - DNA, 27 bp, Artificial Sequence
  Description of Artificial Sequence: Synthetic oligonucleotide
gactgtctaccccaatggccggtttgg

SEQ ID NO: 192635 - DNA, 31 bp, Artificial Sequence
  Description of Artificial Sequence: Synthetic oligonucleotide
actgtctaccccaatggccggtttggtaatc

SEQ ID NO: 192636 - DNA, 30 bp, Artificial Sequence
  Description of Artificial Sequence: Synthetic oligonucleotide
ctgtctaccccaatggccggtttggtaatc

SEQ ID NO: 192637 - DNA, 31 bp, Artificial Sequence
  Description of Artificial Sequence: Synthetic oligonucleotide
tgtctaccccaatggccggtttggtaatcag

SEQ ID NO: 192638 - DNA, 30 bp, Artificial Sequence
  Description of Artificial Sequence: Synthetic oligonucleotide
gtctaccccaatggccggtttggtaatcag

SEQ ID NO: 192639 - DNA, 32 bp, Artificial Sequence
  Description of Artificial Sequence: Synthetic oligonucleotide
tctaccccaatggccggtttggtaatcagatg

SEQ ID NO: 192640 - DNA, 31 bp, Artificial Sequence
  Description of Artificial Sequence: Synthetic oligonucleotide
ctaccccaatggccggtttggtaatcagatg

SEQ ID NO: 192641 - DNA, 31 bp, Artificial Sequence
  Description of Artificial Sequence: Synthetic oligonucleotide
taccccaatggccggtttggtaatcagatgg

SEQ ID NO: 192642 - DNA, 30 bp, Artificial Sequence
  Description of Artificial Sequence: Synthetic oligonucleotide
accccaatggccggtttggtaatcagatgg

SEQ ID NO: 192643 - DNA, 29 bp, Artificial Sequence
  Description of Artificial Sequence: Synthetic oligonucleotide
ccccaatggccggtttggtaatcagatgg

SEQ ID NO: 192644 - DNA, 29 bp, Artificial Sequence
  Description of Artificial Sequence: Synthetic oligonucleotide
cccaatggccggtttggtaatcagatggg

SEQ ID NO: 192645 - DNA, 30 bp, Artificial Sequence
  Description of Artificial Sequence: Synthetic oligonucleotide
ccaatggccggtttggtaatcagatgggac

SEQ ID NO: 192646 - DNA, 31 bp, Artificial Sequence
  Description of Artificial Sequence: Synthetic oligonucleotide
caatggccggtttggtaatcagatgggacag

SEQ ID NO: 192647 - DNA, 34 bp, Artificial Sequence
  Description of Artificial Sequence: Synthetic oligonucleotide
aatggccggtttggtaatcagatgggacagtatg

SEQ ID NO: 192648 - DNA, 33 bp, Artificial Sequence
  Description of Artificial Sequence: Synthetic oligonucleotide
atggccggtttggtaatcagatgggacagtatg

SEQ ID NO: 192649 - DNA, 32 bp, Artificial Sequence
  Description of Artificial Sequence: Synthetic oligonucleotide
tggccggtttggtaatcagatgggacagtatg

SEQ ID NO: 192650 - DNA, 31 bp, Artificial Sequence
  Description of Artificial Sequence: Synthetic oligonucleotide
ggccggtttggtaatcagatgggacagtatg

SEQ ID NO: 192651 - DNA, 31 bp, Artificial Sequence
  Description of Artificial Sequence: Synthetic oligonucleotide
gccggtttggtaatcagatgggacagtatgc

SEQ ID NO: 192652 - DNA, 31 bp, Artificial Sequence
  Description of Artificial Sequence: Synthetic oligonucleotide
ccggtttggtaatcagatgggacagtatgcc

SEQ ID NO: 192653 - DNA, 32 bp, Artificial Sequence
  Description of Artificial Sequence: Synthetic oligonucleotide
cggtttggtaatcagatgggacagtatgccac

SEQ ID NO: 192654 - DNA, 32 bp, Artificial Sequence
  Description of Artificial Sequence: Synthetic oligonucleotide
ggtttggtaatcagatgggacagtatgccacg

SEQ ID NO: 192655 - DNA, 32 bp, Artificial Sequence
  Description of Artificial Sequence: Synthetic oligonucleotide
gtttggtaatcagatgggacagtatgccacgc

SEQ ID NO: 192656 - DNA, 33 bp, Artificial Sequence
  Description of Artificial Sequence: Synthetic oligonucleotide
tttggtaatcagatgggacagtatgccacgctg

SEQ ID NO: 192657 - DNA, 32 bp, Artificial Sequence
  Description of Artificial Sequence: Synthetic oligonucleotide
ttggtaatcagatgggacagtatgccacgctg

SEQ ID NO: 192658 - DNA, 31 bp, Artificial Sequence
  Description of Artificial Sequence: Synthetic oligonucleotide
tggtaatcagatgggacagtatgccacgctg

SEQ ID NO: 192659 - DNA, 30 bp, Artificial Sequence
  Description of Artificial Sequence: Synthetic oligonucleotide
ggtaatcagatgggacagtatgccacgctg

SEQ ID NO: 192660 - DNA, 30 bp, Artificial Sequence
  Description of Artificial Sequence: Synthetic oligonucleotide
gtaatcagatgggacagtatgccacgctgc

SEQ ID NO: 192661 - DNA, 31 bp, Artificial Sequence
  Description of Artificial Sequence: Synthetic oligonucleotide
taatcagatgggacagtatgccacgctgctg

SEQ ID NO: 192662 - DNA, 30 bp, Artificial Sequence
  Description of Artificial Sequence: Synthetic oligonucleotide
aatcagatgggacagtatgccacgctgctg

SEQ ID NO: 192663 - DNA, 29 bp, Artificial Sequence
  Description of Artificial Sequence: Synthetic oligonucleotide
atcagatgggacagtatgccacgctgctg

SEQ ID NO: 192664 - DNA, 28 bp, Artificial Sequence
  Description of Artificial Sequence: Synthetic oligonucleotide
tcagatgggacagtatgccacgctgctg

SEQ ID NO: 192665 - DNA, 27 bp, Artificial Sequence
  Description of Artificial Sequence: Synthetic oligonucleotide
cagatgggacagtatgccacgctgctg

SEQ ID NO: 192666 - DNA, 27 bp, Artificial Sequence
  Description of Artificial Sequence: Synthetic oligonucleotide
agatgggacagtatgccacgctgctgg

SEQ ID NO: 192667 - DNA, 26 bp, Artificial Sequence
  Description of Artificial Sequence: Synthetic oligonucleotide
gatgggacagtatgccacgctgctgg

SEQ ID NO: 192668 - DNA, 27 bp, Artificial Sequence
  Description of Artificial Sequence: Synthetic oligonucleotide
atgggacagtatgccacgctgctggct

SEQ ID NO: 192669 - DNA, 26 bp, Artificial Sequence
  Description of Artificial Sequence: Synthetic oligonucleotide
tgggacagtatgccacgctgctggct

SEQ ID NO: 192670 - DNA, 25 bp, Artificial Sequence
  Description of Artificial Sequence: Synthetic oligonucleotide
gggacagtatgccacgctgctggct

SEQ ID NO: 192671 - DNA, 26 bp, Artificial Sequence
  Description of Artificial Sequence: Synthetic oligonucleotide
ggacagtatgccacgctgctggctct

SEQ ID NO: 192672 - DNA, 26 bp, Artificial Sequence
  Description of Artificial Sequence: Synthetic oligonucleotide
gacagtatgccacgctgctggctctg

SEQ ID NO: 192673 - DNA, 26 bp, Artificial Sequence
  Description of Artificial Sequence: Synthetic oligonucleotide
acagtatgccacgctgctggctctgg

SEQ ID NO: 192674 - DNA, 25 bp, Artificial Sequence
  Description of Artificial Sequence: Synthetic oligonucleotide
cagtatgccacgctgctggctctgg

SEQ ID NO: 192675 - DNA, 25 bp, Artificial Sequence
  Description of Artificial Sequence: Synthetic oligonucleotide
agtatgccacgctgctggctctggc

SEQ ID NO: 192676 - DNA, 24 bp, Artificial Sequence
  Description of Artificial Sequence: Synthetic oligonucleotide
gtatgccacgctgctggctctggc

SEQ ID NO: 192677 - DNA, 24 bp, Artificial Sequence
  Description of Artificial Sequence: Synthetic oligonucleotide
tatgccacgctgctggctctggcc

SEQ ID NO: 192678 - DNA, 23 bp, Artificial Sequence
  Description of Artificial Sequence: Synthetic oligonucleotide
atgccacgctgctggctctggcc

SEQ ID NO: 192679 - DNA, 22 bp, Artificial Sequence
  Description of Artificial Sequence: Synthetic oligonucleotide
tgccacgctgctggctctggcc

SEQ ID NO: 192680 - DNA, 21 bp, Artificial Sequence
  Description of Artificial Sequence: Synthetic oligonucleotide
gccacgctgctggctctggcc

SEQ ID NO: 192681 - DNA, 22 bp, Artificial Sequence
  Description of Artificial Sequence: Synthetic oligonucleotide
ccacgctgctggctctggccca

SEQ ID NO: 192682 - DNA, 22 bp, Artificial Sequence
  Description of Artificial Sequence: Synthetic oligonucleotide
cacgctgctggctctggcccag

SEQ ID NO: 192683 - DNA, 23 bp, Artificial Sequence
  Description of Artificial Sequence: Synthetic oligonucleotide
acgctgctggctctggcccagct

SEQ ID NO: 192684 - DNA, 22 bp, Artificial Sequence
  Description of Artificial Sequence: Synthetic oligonucleotide
cgctgctggctctggcccagct

SEQ ID NO: 192685 - DNA, 24 bp, Artificial Sequence
  Description of Artificial Sequence: Synthetic oligonucleotide
gctgctggctctggcccagctcaa

SEQ ID NO: 192686 - DNA, 24 bp, Artificial Sequence
  Description of Artificial Sequence: Synthetic oligonucleotide
ctgctggctctggcccagctcaac

SEQ ID NO: 192687 - DNA, 24 bp, Artificial Sequence
  Description of Artificial Sequence: Synthetic oligonucleotide
tgctggctctggcccagctcaacg

SEQ ID NO: 192688 - DNA, 23 bp, Artificial Sequence
  Description of Artificial Sequence: Synthetic oligonucleotide
gctggctctggcccagctcaacg

SEQ ID NO: 192689 - DNA, 23 bp, Artificial Sequence
  Description of Artificial Sequence: Synthetic oligonucleotide
ctggctctggcccagctcaacgg

SEQ ID NO: 192690 - DNA, 23 bp, Artificial Sequence
  Description of Artificial Sequence: Synthetic oligonucleotide
tggctctggcccagctcaacggc

SEQ ID NO: 192691 - DNA, 22 bp, Artificial Sequence
  Description of Artificial Sequence: Synthetic oligonucleotide
ggctctggcccagctcaacggc

SEQ ID NO: 192692 - DNA, 22 bp, Artificial Sequence
  Description of Artificial Sequence: Synthetic oligonucleotide
gctctggcccagctcaacggcc

SEQ ID NO: 192693 - DNA, 22 bp, Artificial Sequence
  Description of Artificial Sequence: Synthetic oligonucleotide
ctctggcccagctcaacggccg

SEQ ID NO: 192694 - DNA, 22 bp, Artificial Sequence
  Description of Artificial Sequence: Synthetic oligonucleotide
tctggcccagctcaacggccgc

SEQ ID NO: 192695 - DNA, 21 bp, Artificial Sequence
  Description of Artificial Sequence: Synthetic oligonucleotide
ctggcccagctcaacggccgc

SEQ ID NO: 192696 - DNA, 21 bp, Artificial Sequence
  Description of Artificial Sequence: Synthetic oligonucleotide
tggcccagctcaacggccgcc

SEQ ID NO: 192697 - DNA, 20 bp, Artificial Sequence
  Description of Artificial Sequence: Synthetic oligonucleotide
ggcccagctcaacggccgcc

SEQ ID NO: 192698 - DNA, 20 bp, Artificial Sequence
  Description of Artificial Sequence: Synthetic oligonucleotide
gcccagctcaacggccgccg

SEQ ID NO: 192699 - DNA, 20 bp, Artificial Sequence
  Description of Artificial Sequence: Synthetic oligonucleotide
cccagctcaacggccgccgg

SEQ ID NO: 192700 - DNA, 20 bp, Artificial Sequence
  Description of Artificial Sequence: Synthetic oligonucleotide
ccagctcaacggccgccggg

SEQ ID NO: 192701 - DNA, 20 bp, Artificial Sequence
  Description of Artificial Sequence: Synthetic oligonucleotide
cagctcaacggccgccgggc

SEQ ID NO: 192702 - DNA, 25 bp, Artificial Sequence
  Description of Artificial Sequence: Synthetic oligonucleotide
agctcaacggccgccgggcctttat

SEQ ID NO: 192703 - DNA, 24 bp, Artificial Sequence
  Description of Artificial Sequence: Synthetic oligonucleotide
gctcaacggccgccgggcctttat

SEQ ID NO: 192704 - DNA, 24 bp, Artificial Sequence
  Description of Artificial Sequence: Synthetic oligonucleotide
ctcaacggccgccgggcctttatc

SEQ ID NO: 192705 - DNA, 25 bp, Artificial Sequence
  Description of Artificial Sequence: Synthetic oligonucleotide
tcaacggccgccgggcctttatcct

SEQ ID NO: 192706 - DNA, 24 bp, Artificial Sequence
  Description of Artificial Sequence: Synthetic oligonucleotide
caacggccgccgggcctttatcct

SEQ ID NO: 192707 - DNA, 24 bp, Artificial Sequence
  Description of Artificial Sequence: Synthetic oligonucleotide
aacggccgccgggcctttatcctg

SEQ ID NO: 192708 - DNA, 23 bp, Artificial Sequence
  Description of Artificial Sequence: Synthetic oligonucleotide
acggccgccgggcctttatcctg

SEQ ID NO: 192709 - DNA, 22 bp, Artificial Sequence
  Description of Artificial Sequence: Synthetic oligonucleotide
cggccgccgggcctttatcctg

SEQ ID NO: 192710 - DNA, 22 bp, Artificial Sequence
  Description of Artificial Sequence: Synthetic oligonucleotide
ggccgccgggcctttatcctgc

SEQ ID NO: 192711 - DNA, 23 bp, Artificial Sequence
  Description of Artificial Sequence: Synthetic oligonucleotide
gccgccgggcctttatcctgcct

SEQ ID NO: 192712 - DNA, 23 bp, Artificial Sequence
  Description of Artificial Sequence: Synthetic oligonucleotide
ccgccgggcctttatcctgcctg

SEQ ID NO: 192713 - DNA, 23 bp, Artificial Sequence
  Description of Artificial Sequence: Synthetic oligonucleotide
cgccgggcctttatcctgcctgc

SEQ ID NO: 192714 - DNA, 25 bp, Artificial Sequence
  Description of Artificial Sequence: Synthetic oligonucleotide
gccgggcctttatcctgcctgccat

SEQ ID NO: 192715 - DNA, 25 bp, Artificial Sequence
  Description of Artificial Sequence: Synthetic oligonucleotide
ccgggcctttatcctgcctgccatg

SEQ ID NO: 192716 - DNA, 27 bp, Artificial Sequence
  Description of Artificial Sequence: Synthetic oligonucleotide
cgggcctttatcctgcctgccatgcat

SEQ ID NO: 192717 - DNA, 27 bp, Artificial Sequence
  Description of Artificial Sequence: Synthetic oligonucleotide
gggcctttatcctgcctgccatgcatg

SEQ ID NO: 192718 - DNA, 27 bp, Artificial Sequence
  Description of Artificial Sequence: Synthetic oligonucleotide
ggcctttatcctgcctgccatgcatgc

SEQ ID NO: 192719 - DNA, 27 bp, Artificial Sequence
  Description of Artificial Sequence: Synthetic oligonucleotide
gcctttatcctgcctgccatgcatgcc

SEQ ID NO: 192720 - DNA, 27 bp, Artificial Sequence
  Description of Artificial Sequence: Synthetic oligonucleotide
cctttatcctgcctgccatgcatgccg

SEQ ID NO: 192721 - DNA, 27 bp, Artificial Sequence
  Description of Artificial Sequence: Synthetic oligonucleotide
ctttatcctgcctgccatgcatgccgc

SEQ ID NO: 192722 - DNA, 27 bp, Artificial Sequence
  Description of Artificial Sequence: Synthetic oligonucleotide
tttatcctgcctgccatgcatgccgcc

SEQ ID NO: 192723 - DNA, 26 bp, Artificial Sequence
  Description of Artificial Sequence: Synthetic oligonucleotide
ttatcctgcctgccatgcatgccgcc

SEQ ID NO: 192724 - DNA, 25 bp, Artificial Sequence
  Description of Artificial Sequence: Synthetic oligonucleotide
tatcctgcctgccatgcatgccgcc

SEQ ID NO: 192725 - DNA, 24 bp, Artificial Sequence
  Description of Artificial Sequence: Synthetic oligonucleotide
atcctgcctgccatgcatgccgcc

SEQ ID NO: 192726 - DNA, 23 bp, Artificial Sequence
  Description of Artificial Sequence: Synthetic oligonucleotide
tcctgcctgccatgcatgccgcc

SEQ ID NO: 192727 - DNA, 22 bp, Artificial Sequence
  Description of Artificial Sequence: Synthetic oligonucleotide
cctgcctgccatgcatgccgcc

SEQ ID NO: 192728 - DNA, 23 bp, Artificial Sequence
  Description of Artificial Sequence: Synthetic oligonucleotide
ctgcctgccatgcatgccgccct

SEQ ID NO: 192729 - DNA, 23 bp, Artificial Sequence
  Description of Artificial Sequence: Synthetic oligonucleotide
tgcctgccatgcatgccgccctg

SEQ ID NO: 192730 - DNA, 22 bp, Artificial Sequence
  Description of Artificial Sequence: Synthetic oligonucleotide
gcctgccatgcatgccgccctg

SEQ ID NO: 192731 - DNA, 22 bp, Artificial Sequence
  Description of Artificial Sequence: Synthetic oligonucleotide
cctgccatgcatgccgccctgg

SEQ ID NO: 192732 - DNA, 22 bp, Artificial Sequence
  Description of Artificial Sequence: Synthetic oligonucleotide
ctgccatgcatgccgccctggc

SEQ ID NO: 192733 - DNA, 22 bp, Artificial Sequence
  Description of Artificial Sequence: Synthetic oligonucleotide
tgccatgcatgccgccctggcc

SEQ ID NO: 192734 - DNA, 21 bp, Artificial Sequence
  Description of Artificial Sequence: Synthetic oligonucleotide
gccatgcatgccgccctggcc

SEQ ID NO: 192735 - DNA, 21 bp, Artificial Sequence
  Description of Artificial Sequence: Synthetic oligonucleotide
ccatgcatgccgccctggccc

SEQ ID NO: 192736 - DNA, 21 bp, Artificial Sequence
  Description of Artificial Sequence: Synthetic oligonucleotide
catgcatgccgccctggcccc

SEQ ID NO: 192737 - DNA, 21 bp, Artificial Sequence
  Description of Artificial Sequence: Synthetic oligonucleotide
atgcatgccgccctggccccg

SEQ ID NO: 192738 - DNA, 20 bp, Artificial Sequence
  Description of Artificial Sequence: Synthetic oligonucleotide
tgcatgccgccctggccccg

SEQ ID NO: 192739 - DNA, 20 bp, Artificial Sequence
  Description of Artificial Sequence: Synthetic oligonucleotide
gcatgccgccctggccccgt

SEQ ID NO: 192740 - DNA, 23 bp, Artificial Sequence
  Description of Artificial Sequence: Synthetic oligonucleotide
catgccgccctggccccggtatt

SEQ ID NO: 192741 - DNA, 23 bp, Artificial Sequence
  Description of Artificial Sequence: Synthetic oligonucleotide
atgccgccctggccccggtattc

SEQ ID NO: 192742 - DNA, 22 bp, Artificial Sequence
  Description of Artificial Sequence: Synthetic oligonucleotide
tgccgccctggccccggtattc

SEQ ID NO: 192743 - DNA, 21 bp, Artificial Sequence
  Description of Artificial Sequence: Synthetic oligonucleotide
gccgccctggccccggtattc

SEQ ID NO: 192744 - DNA, 21 bp, Artificial Sequence
  Description of Artificial Sequence: Synthetic oligonucleotide
ccgccctggccccggtattcc

SEQ ID NO: 192745 - DNA, 21 bp, Artificial Sequence
  Description of Artificial Sequence: Synthetic oligonucleotide
cgccctggccccggtattccg

SEQ ID NO: 192746 - DNA, 23 bp, Artificial Sequence
  Description of Artificial Sequence: Synthetic oligonucleotide
gccctggccccggtattccgcat

SEQ ID NO: 192747 - DNA, 24 bp, Artificial Sequence
  Description of Artificial Sequence: Synthetic oligonucleotide
ccctggccccggtattccgcatca

SEQ ID NO: 192748 - DNA, 24 bp, Artificial Sequence
  Description of Artificial Sequence: Synthetic oligonucleotide
cctggccccggtattccgcatcac

SEQ ID NO: 192749 - DNA, 24 bp, Artificial Sequence
  Description of Artificial Sequence: Synthetic oligonucleotide
ctggccccggtattccgcatcacc

SEQ ID NO: 192750 - DNA, 25 bp, Artificial Sequence
  Description of Artificial Sequence: Synthetic oligonucleotide
tggccccggtattccgcatcaccct

SEQ ID NO: 192751 - DNA, 24 bp, Artificial Sequence
  Description of Artificial Sequence: Synthetic oligonucleotide
ggccccggtattccgcatcaccct

SEQ ID NO: 192752 - DNA, 24 bp, Artificial Sequence
  Description of Artificial Sequence: Synthetic oligonucleotide
gccccggtattccgcatcaccctg

SEQ ID NO: 192753 - DNA, 24 bp, Artificial Sequence
  Description of Artificial Sequence: Synthetic oligonucleotide
ccccggtattccgcatcaccctgc

SEQ ID NO: 192754 - DNA, 24 bp, Artificial Sequence
  Description of Artificial Sequence: Synthetic oligonucleotide
cccggtattccgcatcaccctgcc

SEQ ID NO: 192755 - DNA, 24 bp, Artificial Sequence
  Description of Artificial Sequence: Synthetic oligonucleotide
ccggtattccgcatcaccctgccc

SEQ ID NO: 192756 - DNA, 25 bp, Artificial Sequence
  Description of Artificial Sequence: Synthetic oligonucleotide
cggtattccgcatcaccctgcccgt

SEQ ID NO: 192757 - DNA, 25 bp, Artificial Sequence
  Description of Artificial Sequence: Synthetic oligonucleotide
ggtattccgcatcaccctgcccgtg

SEQ ID NO: 192758 - DNA, 26 bp, Artificial Sequence
  Description of Artificial Sequence: Synthetic oligonucleotide
gtattccgcatcaccctgcccgtgct

SEQ ID NO: 192759 - DNA, 26 bp, Artificial Sequence
  Description of Artificial Sequence: Synthetic oligonucleotide
tattccgcatcaccctgcccgtgctg

SEQ ID NO: 192760 - DNA, 25 bp, Artificial Sequence
  Description of Artificial Sequence: Synthetic oligonucleotide
attccgcatcaccctgcccgtgctg

SEQ ID NO: 192761 - DNA, 24 bp, Artificial Sequence
  Description of Artificial Sequence: Synthetic oligonucleotide
ttccgcatcaccctgcccgtgctg

SEQ ID NO: 192762 - DNA, 23 bp, Artificial Sequence
  Description of Artificial Sequence: Synthetic oligonucleotide
tccgcatcaccctgcccgtgctg

SEQ ID NO: 192763 - DNA, 22 bp, Artificial Sequence
  Description of Artificial Sequence: Synthetic oligonucleotide
ccgcatcaccctgcccgtgctg

SEQ ID NO: 192764 - DNA, 22 bp, Artificial Sequence
  Description of Artificial Sequence: Synthetic oligonucleotide
cgcatcaccctgcccgtgctgg

SEQ ID NO: 192765 - DNA, 22 bp, Artificial Sequence
  Description of Artificial Sequence: Synthetic oligonucleotide
gcatcaccctgcccgtgctggc

SEQ ID NO: 192766 - DNA, 22 bp, Artificial Sequence
  Description of Artificial Sequence: Synthetic oligonucleotide
catcaccctgcccgtgctggcc

SEQ ID NO: 192767 - DNA, 22 bp, Artificial Sequence
  Description of Artificial Sequence: Synthetic oligonucleotide
atcaccctgcccgtgctggccc

SEQ ID NO: 192768 - DNA, 21 bp, Artificial Sequence
  Description of Artificial Sequence: Synthetic oligonucleotide
tcaccctgcccgtgctggccc

SEQ ID NO: 192769 - DNA, 20 bp, Artificial Sequence
  Description of Artificial Sequence: Synthetic oligonucleotide
caccctgcccgtgctggccc

SEQ ID NO: 192770 - DNA, 21 bp, Artificial Sequence
  Description of Artificial Sequence: Synthetic oligonucleotide
accctgcccgtgctggcccca

SEQ ID NO: 192771 - DNA, 20 bp, Artificial Sequence
  Description of Artificial Sequence: Synthetic oligonucleotide
ccctgcccgtgctggcccca

SEQ ID NO: 192772 - DNA, 22 bp, Artificial Sequence
  Description of Artificial Sequence: Synthetic oligonucleotide
cctgcccgtgctggccccagaa

SEQ ID NO: 192773 - DNA, 23 bp, Artificial Sequence
  Description of Artificial Sequence: Synthetic oligonucleotide
ctgcccgtgctggccccagaagt

SEQ ID NO: 192774 - DNA, 23 bp, Artificial Sequence
  Description of Artificial Sequence: Synthetic oligonucleotide
tgcccgtgctggccccagaagtg

SEQ ID NO: 192775 - DNA, 22 bp, Artificial Sequence
  Description of Artificial Sequence: Synthetic oligonucleotide
gcccgtgctggccccagaagtg

SEQ ID NO: 192776 - DNA, 23 bp, Artificial Sequence
  Description of Artificial Sequence: Synthetic oligonucleotide
cccgtgctggccccagaagtgga

SEQ ID NO: 192777 - DNA, 24 bp, Artificial Sequence
  Description of Artificial Sequence: Synthetic oligonucleotide
ccgtgctggccccagaagtggaca

SEQ ID NO: 192778 - DNA, 24 bp, Artificial Sequence
  Description of Artificial Sequence: Synthetic oligonucleotide
cgtgctggccccagaagtggacag

SEQ ID NO: 192779 - DNA, 24 bp, Artificial Sequence
  Description of Artificial Sequence: Synthetic oligonucleotide
gtgctggccccagaagtggacagc

SEQ ID NO: 192780 - DNA, 24 bp, Artificial Sequence
  Description of Artificial Sequence: Synthetic oligonucleotide
tgctggccccagaagtggacagcc

SEQ ID NO: 192781 - DNA, 23 bp, Artificial Sequence
  Description of Artificial Sequence: Synthetic oligonucleotide
gctggccccagaagtggacagcc

SEQ ID NO: 192782 - DNA, 23 bp, Artificial Sequence
  Description of Artificial Sequence: Synthetic oligonucleotide
ctggccccagaagtggacagccg

SEQ ID NO: 192783 - DNA, 24 bp, Artificial Sequence
  Description of Artificial Sequence: Synthetic oligonucleotide
tggccccagaagtggacagccgca

SEQ ID NO: 192784 - DNA, 23 bp, Artificial Sequence
  Description of Artificial Sequence: Synthetic oligonucleotide
ggccccagaagtggacagccgca

SEQ ID NO: 192785 - DNA, 23 bp, Artificial Sequence
  Description of Artificial Sequence: Synthetic oligonucleotide
gccccagaagtggacagccgcac

SEQ ID NO: 192786 - DNA, 23 bp, Artificial Sequence
  Description of Artificial Sequence: Synthetic oligonucleotide
ccccagaagtggacagccgcacg

SEQ ID NO: 192787 - DNA, 23 bp, Artificial Sequence
  Description of Artificial Sequence: Synthetic oligonucleotide
cccagaagtggacagccgcacgc

SEQ ID NO: 192788 - DNA, 23 bp, Artificial Sequence
  Description of Artificial Sequence: Synthetic oligonucleotide
ccagaagtggacagccgcacgcc

SEQ ID NO: 192789 - DNA, 24 bp, Artificial Sequence
  Description of Artificial Sequence: Synthetic oligonucleotide
cagaagtggacagccgcacgccgt

SEQ ID NO: 192790 - DNA, 24 bp, Artificial Sequence
  Description of Artificial Sequence: Synthetic oligonucleotide
agaagtggacagccgcacgccgtg

SEQ ID NO: 192791 - DNA, 23 bp, Artificial Sequence
  Description of Artificial Sequence: Synthetic oligonucleotide
gaagtggacagccgcacgccgtg

SEQ ID NO: 192792 - DNA, 23 bp, Artificial Sequence
  Description of Artificial Sequence: Synthetic oligonucleotide
aagtggacagccgcacgccgtgg

SEQ ID NO: 192793 - DNA, 22 bp, Artificial Sequence
  Description of Artificial Sequence: Synthetic oligonucleotide
agtggacagccgcacgccgtgg

SEQ ID NO: 192794 - DNA, 21 bp, Artificial Sequence
  Description of Artificial Sequence: Synthetic oligonucleotide
gtggacagccgcacgccgtgg

SEQ ID NO: 192795 - DNA, 21 bp, Artificial Sequence
  Description of Artificial Sequence: Synthetic oligonucleotide
tggacagccgcacgccgtggc

SEQ ID NO: 192796 - DNA, 20 bp, Artificial Sequence
  Description of Artificial Sequence: Synthetic oligonucleotide
ggacagccgcacgccgtggc

SEQ ID NO: 192797 - DNA, 20 bp, Artificial Sequence
  Description of Artificial Sequence: Synthetic oligonucleotide
gacagccgcacgccgtggcg

SEQ ID NO: 192798 - DNA, 20 bp, Artificial Sequence
  Description of Artificial Sequence: Synthetic oligonucleotide
acagccgcacgccgtggcgg

SEQ ID NO: 192799 - DNA, 20 bp, Artificial Sequence
  Description of Artificial Sequence: Synthetic oligonucleotide
cagccgcacgccgtggcggt

SEQ ID NO: 192800 - DNA, 20 bp, Artificial Sequence
  Description of Artificial Sequence: Synthetic oligonucleotide
agccgcacgccgtggcggga

SEQ ID NO: 192801 - DNA, 20 bp, Artificial Sequence
  Description of Artificial Sequence: Synthetic oligonucleotide
gccgcacgccgtggcgggat

SEQ ID NO: 192802 - DNA, 20 bp, Artificial Sequence
  Description of Artificial Sequence: Synthetic oligonucleotide
ccgcacgccgtggcgggagt

SEQ ID NO: 192803 - DNA, 20 bp, Artificial Sequence
  Description of Artificial Sequence: Synthetic oligonucleotide
cgcacgccgtggcgggagct

SEQ ID NO: 192804 - DNA, 20 bp, Artificial Sequence
  Description of Artificial Sequence: Synthetic oligonucleotide
gcacgccgtggcgggagctg

SEQ ID NO: 192805 - DNA, 21 bp, Artificial Sequence
  Description of Artificial Sequence: Synthetic oligonucleotide
cacgccgtggcgggagctgca

SEQ ID NO: 192806 - DNA, 21 bp, Artificial Sequence
  Description of Artificial Sequence: Synthetic oligonucleotide
acgccgtggcgggagctgcag

SEQ ID NO: 192807 - DNA, 20 bp, Artificial Sequence
  Description of Artificial Sequence: Synthetic oligonucleotide
cgccgtggcgggagctgcag

SEQ ID NO: 192808 - DNA, 22 bp, Artificial Sequence
  Description of Artificial Sequence: Synthetic oligonucleotide
gccgtggcgggagctgcagctt

SEQ ID NO: 192809 - DNA, 23 bp, Artificial Sequence
  Description of Artificial Sequence: Synthetic oligonucleotide
ccgtggcgggagctgcagcttca

SEQ ID NO: 192810 - DNA, 23 bp, Artificial Sequence
  Description of Artificial Sequence: Synthetic oligonucleotide
cgtggcgggagctgcagcttcac

SEQ ID NO: 192811 - DNA, 24 bp, Artificial Sequence
  Description of Artificial Sequence: Synthetic oligonucleotide
gtggcgggagctgcagcttcacga

SEQ ID NO: 192812 - DNA, 25 bp, Artificial Sequence
  Description of Artificial Sequence: Synthetic oligonucleotide
tggcgggagctgcagcttcacgact

SEQ ID NO: 192813 - DNA, 24 bp, Artificial Sequence
  Description of Artificial Sequence: Synthetic oligonucleotide
ggcgggagctgcagcttcacgact

SEQ ID NO: 192814 - DNA, 24 bp, Artificial Sequence
  Description of Artificial Sequence: Synthetic oligonucleotide
gcgggagctgcagcttcacgactg

SEQ ID NO: 192815 - DNA, 26 bp, Artificial Sequence
  Description of Artificial Sequence: Synthetic oligonucleotide
cgggagctgcagcttcacgactggat

SEQ ID NO: 192816 - DNA, 27 bp, Artificial Sequence
  Description of Artificial Sequence: Synthetic oligonucleotide
gggagctgcagcttcacgactggatgt

SEQ ID NO: 192817 - DNA, 27 bp, Artificial Sequence
  Description of Artificial Sequence: Synthetic oligonucleotide
ggagctgcagcttcacgactggatgtc

SEQ ID NO: 192818 - DNA, 27 bp, Artificial Sequence
  Description of Artificial Sequence: Synthetic oligonucleotide
gagctgcagcttcacgactggatgtcg

SEQ ID NO: 192819 - DNA, 27 bp, Artificial Sequence
  Description of Artificial Sequence: Synthetic oligonucleotide
agctgcagcttcacgactggatgtcgg

SEQ ID NO: 192820 - DNA, 27 bp, Artificial Sequence
  Description of Artificial Sequence: Synthetic oligonucleotide
gctgcagcttcacgactggatgtcgga

SEQ ID NO: 192821 - DNA, 27 bp, Artificial Sequence
  Description of Artificial Sequence: Synthetic oligonucleotide
ctgcagcttcacgactggatgtcggag

SEQ ID NO: 192822 - DNA, 27 bp, Artificial Sequence
  Description of Artificial Sequence: Synthetic oligonucleotide
tgcagcttcacgactggatgtcggagg

SEQ ID NO: 192823 - DNA, 27 bp, Artificial Sequence
  Description of Artificial Sequence: Synthetic oligonucleotide
gcagcttcacgactggatgtcggagga

SEQ ID NO: 192824 - DNA, 27 bp, Artificial Sequence
  Description of Artificial Sequence: Synthetic oligonucleotide
cagcttcacgactggatgtcggaggag

SEQ ID NO: 192825 - DNA, 29 bp, Artificial Sequence
  Description of Artificial Sequence: Synthetic oligonucleotide
agcttcacgactggatgtcggaggagtac

SEQ ID NO: 192826 - DNA, 28 bp, Artificial Sequence
  Description of Artificial Sequence: Synthetic oligonucleotide
gcttcacgactggatgtcggaggagtac

SEQ ID NO: 192827 - DNA, 28 bp, Artificial Sequence
  Description of Artificial Sequence: Synthetic oligonucleotide
cttcacgactggatgtcggaggagtacg

SEQ ID NO: 192828 - DNA, 28 bp, Artificial Sequence
  Description of Artificial Sequence: Synthetic oligonucleotide
ttcacgactggatgtcggaggagtacgc

SEQ ID NO: 192829 - DNA, 27 bp, Artificial Sequence
  Description of Artificial Sequence: Synthetic oligonucleotide
tcacgactggatgtcggaggagtacgc

SEQ ID NO: 192830 - DNA, 26 bp, Artificial Sequence
  Description of Artificial Sequence: Synthetic oligonucleotide
cacgactggatgtcggaggagtacgc

SEQ ID NO: 192831 - DNA, 26 bp, Artificial Sequence
  Description of Artificial Sequence: Synthetic oligonucleotide
acgactggatgtcggaggagtacgcg

SEQ ID NO: 192832 - DNA, 25 bp, Artificial Sequence
  Description of Artificial Sequence: Synthetic oligonucleotide
cgactggatgtcggaggagtacgcg

SEQ ID NO: 192833 - DNA, 26 bp, Artificial Sequence
  Description of Artificial Sequence: Synthetic oligonucleotide
gactggatgtcggaggagtacgcgga

SEQ ID NO: 192834 - DNA, 27 bp, Artificial Sequence
  Description of Artificial Sequence: Synthetic oligonucleotide
actggatgtcggaggagtacgcggact

SEQ ID NO: 192835 - DNA, 27 bp, Artificial Sequence
  Description of Artificial Sequence: Synthetic oligonucleotide
ctggatgtcggaggagtacgcggactt

SEQ ID NO: 192836 - DNA, 27 bp, Artificial Sequence
  Description of Artificial Sequence: Synthetic oligonucleotide
tggatgtcggaggagtacgcggacttg

SEQ ID NO: 192837 - DNA, 27 bp, Artificial Sequence
  Description of Artificial Sequence: Synthetic oligonucleotide
ggatgtcggaggagtacgcggacttga

SEQ ID NO: 192838 - DNA, 27 bp, Artificial Sequence
  Description of Artificial Sequence: Synthetic oligonucleotide
gatgtcggaggagtacgcggacttgag

SEQ ID NO: 192839 - DNA, 28 bp, Artificial Sequence
  Description of Artificial Sequence: Synthetic oligonucleotide
atgtcggaggagtacgcggacttgagag

SEQ ID NO: 192840 - DNA, 27 bp, Artificial Sequence
  Description of Artificial Sequence: Synthetic oligonucleotide
tgtcggaggagtacgcggacttgagag

SEQ ID NO: 192841 - DNA, 27 bp, Artificial Sequence
  Description of Artificial Sequence: Synthetic oligonucleotide
gtcggaggagtacgcggacttgagaga

SEQ ID NO: 192842 - DNA, 28 bp, Artificial Sequence
  Description of Artificial Sequence: Synthetic oligonucleotide
tcggaggagtacgcggacttgagagatc

SEQ ID NO: 192843 - DNA, 27 bp, Artificial Sequence
  Description of Artificial Sequence: Synthetic oligonucleotide
cggaggagtacgcggacttgagagatc

SEQ ID NO: 192844 - DNA, 27 bp, Artificial Sequence
  Description of Artificial Sequence: Synthetic oligonucleotide
ggaggagtacgcggacttgagagatcc

SEQ ID NO: 192845 - DNA, 30 bp, Artificial Sequence
  Description of Artificial Sequence: Synthetic oligonucleotide
gaggagtacgcggacttgagagatcctttc

SEQ ID NO: 192846 - DNA, 30 bp, Artificial Sequence
  Description of Artificial Sequence: Synthetic oligonucleotide
aggagtacgcggacttgagagatcctttcc

SEQ ID NO: 192847 - DNA, 29 bp, Artificial Sequence
  Description of Artificial Sequence: Synthetic oligonucleotide
ggagtacgcggacttgagagatcctttcc

SEQ ID NO: 192848 - DNA, 30 bp, Artificial Sequence
  Description of Artificial Sequence: Synthetic oligonucleotide
gagtacgcggacttgagagatcctttcctg

SEQ ID NO: 192849 - DNA, 32 bp, Artificial Sequence
  Description of Artificial Sequence: Synthetic oligonucleotide
agtacgcggacttgagagatcctttcctgaag

SEQ ID NO: 192850 - DNA, 31 bp, Artificial Sequence
  Description of Artificial Sequence: Synthetic oligonucleotide
gtacgcggacttgagagatcctttcctgaag

SEQ ID NO: 192851 - DNA, 31 bp, Artificial Sequence
  Description of Artificial Sequence: Synthetic oligonucleotide
tacgcggacttgagagatcctttcctgaagc

SEQ ID NO: 192852 - DNA, 30 bp, Artificial Sequence
  Description of Artificial Sequence: Synthetic oligonucleotide
acgcggacttgagagatcctttcctgaagc

SEQ ID NO: 192853 - DNA, 29 bp, Artificial Sequence
  Description of Artificial Sequence: Synthetic oligonucleotide
cgcggacttgagagatcctttcctgaagc

SEQ ID NO: 192854 - DNA, 30 bp, Artificial Sequence
  Description of Artificial Sequence: Synthetic oligonucleotide
gcggacttgagagatcctttcctgaagctc

SEQ ID NO: 192855 - DNA, 31 bp, Artificial Sequence
  Description of Artificial Sequence: Synthetic oligonucleotide
cggacttgagagatcctttcctgaagctctc

SEQ ID NO: 192856 - DNA, 32 bp, Artificial Sequence
  Description of Artificial Sequence: Synthetic oligonucleotide
ggacttgagagatcctttcctgaagctctctg

SEQ ID NO: 192857 - DNA, 32 bp, Artificial Sequence
  Description of Artificial Sequence: Synthetic oligonucleotide
gacttgagagatcctttcctgaagctctctgg

SEQ ID NO: 192858 - DNA, 32 bp, Artificial Sequence
  Description of Artificial Sequence: Synthetic oligonucleotide
acttgagagatcctttcctgaagctctctggc

SEQ ID NO: 192859 - DNA, 31 bp, Artificial Sequence
  Description of Artificial Sequence: Synthetic oligonucleotide
cttgagagatcctttcctgaagctctctggc

SEQ ID NO: 192860 - DNA, 33 bp, Artificial Sequence
  Description of Artificial Sequence: Synthetic oligonucleotide
ttgagagatcctttcctgaagctctctggcttc

SEQ ID NO: 192861 - DNA, 32 bp, Artificial Sequence
  Description of Artificial Sequence: Synthetic oligonucleotide
tgagagatcctttcctgaagctctctggcttc

SEQ ID NO: 192862 - DNA, 31 bp, Artificial Sequence
  Description of Artificial Sequence: Synthetic oligonucleotide
gagagatcctttcctgaagctctctggcttc

SEQ ID NO: 192863 - DNA, 31 bp, Artificial Sequence
  Description of Artificial Sequence: Synthetic oligonucleotide
agagatcctttcctgaagctctctggcttcc

SEQ ID NO: 192864 - DNA, 30 bp, Artificial Sequence
  Description of Artificial Sequence: Synthetic oligonucleotide
gagatcctttcctgaagctctctggcttcc

SEQ ID NO: 192865 - DNA, 30 bp, Artificial Sequence
  Description of Artificial Sequence: Synthetic oligonucleotide
agatcctttcctgaagctctctggcttccc

SEQ ID NO: 192866 - DNA, 29 bp, Artificial Sequence
  Description of Artificial Sequence: Synthetic oligonucleotide
gatcctttcctgaagctctctggcttccc

SEQ ID NO: 192867 - DNA, 29 bp, Artificial Sequence
  Description of Artificial Sequence: Synthetic oligonucleotide
atcctttcctgaagctctctggcttcccc

SEQ ID NO: 192868 - DNA, 28 bp, Artificial Sequence
  Description of Artificial Sequence: Synthetic oligonucleotide
tcctttcctgaagctctctggcttcccc

SEQ ID NO: 192869 - DNA, 27 bp, Artificial Sequence
  Description of Artificial Sequence: Synthetic oligonucleotide
cctttcctgaagctctctggcttcccc

SEQ ID NO: 192870 - DNA, 28 bp, Artificial Sequence
  Description of Artificial Sequence: Synthetic oligonucleotide
ctttcctgaagctctctggcttcccctg

SEQ ID NO: 192871 - DNA, 28 bp, Artificial Sequence
  Description of Artificial Sequence: Synthetic oligonucleotide
tttcctgaagctctctggcttcccctgc

SEQ ID NO: 192872 - DNA, 27 bp, Artificial Sequence
  Description of Artificial Sequence: Synthetic oligonucleotide
ttcctgaagctctctggcttcccctgc

SEQ ID NO: 192873 - DNA, 27 bp, Artificial Sequence
  Description of Artificial Sequence: Synthetic oligonucleotide
tcctgaagctctctggcttcccctgct

SEQ ID NO: 192874 - DNA, 26 bp, Artificial Sequence
  Description of Artificial Sequence: Synthetic oligonucleotide
cctgaagctctctggcttcccctgct

SEQ ID NO: 192875 - DNA, 27 bp, Artificial Sequence
  Description of Artificial Sequence: Synthetic oligonucleotide
ctgaagctctctggcttcccctgctct

SEQ ID NO: 192876 - DNA, 28 bp, Artificial Sequence
  Description of Artificial Sequence: Synthetic oligonucleotide
tgaagctctctggcttcccctgctcttg

SEQ ID NO: 192877 - DNA, 27 bp, Artificial Sequence
  Description of Artificial Sequence: Synthetic oligonucleotide
gaagctctctggcttcccctgctcttg

SEQ ID NO: 192878 - DNA, 27 bp, Artificial Sequence
  Description of Artificial Sequence: Synthetic oligonucleotide
aagctctctggcttcccctgctcttgg

SEQ ID NO: 192879 - DNA, 27 bp, Artificial Sequence
  Description of Artificial Sequence: Synthetic oligonucleotide
agctctctggcttcccctgctcttgga

SEQ ID NO: 192880 - DNA, 26 bp, Artificial Sequence
  Description of Artificial Sequence: Synthetic oligonucleotide
gctctctggcttcccctgctcttgga

SEQ ID NO: 192881 - DNA, 27 bp, Artificial Sequence
  Description of Artificial Sequence: Synthetic oligonucleotide
ctctctggcttcccctgctcttggact

SEQ ID NO: 192882 - DNA, 29 bp, Artificial Sequence
  Description of Artificial Sequence: Synthetic oligonucleotide
tctctggcttcccctgctcttggactttc

SEQ ID NO: 192883 - DNA, 28 bp, Artificial Sequence
  Description of Artificial Sequence: Synthetic oligonucleotide
ctctggcttcccctgctcttggactttc

SEQ ID NO: 192884 - DNA, 30 bp, Artificial Sequence
  Description of Artificial Sequence: Synthetic oligonucleotide
tctggcttcccctgctcttggactttcttc

SEQ ID NO: 192885 - DNA, 29 bp, Artificial Sequence
  Description of Artificial Sequence: Synthetic oligonucleotide
ctggcttcccctgctcttggactttcttc

SEQ ID NO: 192886 - DNA, 29 bp, Artificial Sequence
  Description of Artificial Sequence: Synthetic oligonucleotide
tggcttcccctgctcttggactttcttcc

SEQ ID NO: 192887 - DNA, 28 bp, Artificial Sequence
  Description of Artificial Sequence: Synthetic oligonucleotide
ggcttcccctgctcttggactttcttcc

SEQ ID NO: 192888 - DNA, 29 bp, Artificial Sequence
  Description of Artificial Sequence: Synthetic oligonucleotide
gcttcccctgctcttggactttcttccac

SEQ ID NO: 192889 - DNA, 29 bp, Artificial Sequence
  Description of Artificial Sequence: Synthetic oligonucleotide
cttcccctgctcttggactttcttccacc

SEQ ID NO: 192890 - DNA, 31 bp, Artificial Sequence
  Description of Artificial Sequence: Synthetic oligonucleotide
ttcccctgctcttggactttcttccaccatc

SEQ ID NO: 192891 - DNA, 30 bp, Artificial Sequence
  Description of Artificial Sequence: Synthetic oligonucleotide
tcccctgctcttggactttcttccaccatc

SEQ ID NO: 192892 - DNA, 29 bp, Artificial Sequence
  Description of Artificial Sequence: Synthetic oligonucleotide
cccctgctcttggactttcttccaccatc

SEQ ID NO: 192893 - DNA, 30 bp, Artificial Sequence
  Description of Artificial Sequence: Synthetic oligonucleotide
ccctgctcttggactttcttccaccatctc

SEQ ID NO: 192894 - DNA, 30 bp, Artificial Sequence
  Description of Artificial Sequence: Synthetic oligonucleotide
cctgctcttggactttcttccaccatctcc

SEQ ID NO: 192895 - DNA, 30 bp, Artificial Sequence
  Description of Artificial Sequence: Synthetic oligonucleotide
ctgctcttggactttcttccaccatctccg

SEQ ID NO: 192896 - DNA, 30 bp, Artificial Sequence
  Description of Artificial Sequence: Synthetic oligonucleotide
tgctcttggactttcttccaccatctccgg

SEQ ID NO: 192897 - DNA, 29 bp, Artificial Sequence
  Description of Artificial Sequence: Synthetic oligonucleotide
gctcttggactttcttccaccatctccgg

SEQ ID NO: 192898 - DNA, 29 bp, Artificial Sequence
  Description of Artificial Sequence: Synthetic oligonucleotide
ctcttggactttcttccaccatctccggg

SEQ ID NO: 192899 - DNA, 31 bp, Artificial Sequence
  Description of Artificial Sequence: Synthetic oligonucleotide
tcttggactttcttccaccatctccgggaac

SEQ ID NO: 192900 - DNA, 30 bp, Artificial Sequence
  Description of Artificial Sequence: Synthetic oligonucleotide
cttggactttcttccaccatctccgggaac

SEQ ID NO: 192901 - DNA, 31 bp, Artificial Sequence
  Description of Artificial Sequence: Synthetic oligonucleotide
ttggactttcttccaccatctccgggaacag

SEQ ID NO: 192902 - DNA, 30 bp, Artificial Sequence
  Description of Artificial Sequence: Synthetic oligonucleotide
tggactttcttccaccatctccgggaacag

SEQ ID NO: 192903 - DNA, 29 bp, Artificial Sequence
  Description of Artificial Sequence: Synthetic oligonucleotide
ggactttcttccaccatctccgggaacag

SEQ ID NO: 192904 - DNA, 31 bp, Artificial Sequence
  Description of Artificial Sequence: Synthetic oligonucleotide
gactttcttccaccatctccgggaacagatc

SEQ ID NO: 192905 - DNA, 31 bp, Artificial Sequence
  Description of Artificial Sequence: Synthetic oligonucleotide
actttcttccaccatctccgggaacagatcc

SEQ ID NO: 192906 - DNA, 30 bp, Artificial Sequence
  Description of Artificial Sequence: Synthetic oligonucleotide
ctttcttccaccatctccgggaacagatcc

SEQ ID NO: 192907 - DNA, 30 bp, Artificial Sequence
  Description of Artificial Sequence: Synthetic oligonucleotide
tttcttccaccatctccgggaacagatccg

SEQ ID NO: 192908 - DNA, 29 bp, Artificial Sequence
  Description of Artificial Sequence: Synthetic oligonucleotide
ttcttccaccatctccgggaacagatccg

SEQ ID NO: 192909 - DNA, 28 bp, Artificial Sequence
  Description of Artificial Sequence: Synthetic oligonucleotide
tcttccaccatctccgggaacagatccg

SEQ ID NO: 192910 - DNA, 27 bp, Artificial Sequence
  Description of Artificial Sequence: Synthetic oligonucleotide
cttccaccatctccgggaacagatccg

SEQ ID NO: 192911 - DNA, 27 bp, Artificial Sequence
  Description of Artificial Sequence: Synthetic oligonucleotide
ttccaccatctccgggaacagatccgc

SEQ ID NO: 192912 - DNA, 27 bp, Artificial Sequence
  Description of Artificial Sequence: Synthetic oligonucleotide
tccaccatctccgggaacagatccgca

SEQ ID NO: 192913 - DNA, 26 bp, Artificial Sequence
  Description of Artificial Sequence: Synthetic oligonucleotide
ccaccatctccgggaacagatccgca

SEQ ID NO: 192914 - DNA, 27 bp, Artificial Sequence
  Description of Artificial Sequence: Synthetic oligonucleotide
caccatctccgggaacagatccgcaga

SEQ ID NO: 192915 - DNA, 27 bp, Artificial Sequence
  Description of Artificial Sequence: Synthetic oligonucleotide
accatctccgggaacagatccgcagag

SEQ ID NO: 192916 - DNA, 27 bp, Artificial Sequence
  Description of Artificial Sequence: Synthetic oligonucleotide
ccatctccgggaacagatccgcagaga

SEQ ID NO: 192917 - DNA, 27 bp, Artificial Sequence
  Description of Artificial Sequence: Synthetic oligonucleotide
catctccgggaacagatccgcagagag

SEQ ID NO: 192918 - DNA, 29 bp, Artificial Sequence
  Description of Artificial Sequence: Synthetic oligonucleotide
atctccgggaacagatccgcagagagttc

SEQ ID NO: 192919 - DNA, 28 bp, Artificial Sequence
  Description of Artificial Sequence: Synthetic oligonucleotide
tctccgggaacagatccgcagagagttc

SEQ ID NO: 192920 - DNA, 27 bp, Artificial Sequence
  Description of Artificial Sequence: Synthetic oligonucleotide
ctccgggaacagatccgcagagagttc

SEQ ID NO: 192921 - DNA, 28 bp, Artificial Sequence
  Description of Artificial Sequence: Synthetic oligonucleotide
tccgggaacagatccgcagagagttcac

SEQ ID NO: 192922 - DNA, 27 bp, Artificial Sequence
  Description of Artificial Sequence: Synthetic oligonucleotide
ccgggaacagatccgcagagagttcac

SEQ ID NO: 192923 - DNA, 27 bp, Artificial Sequence
  Description of Artificial Sequence: Synthetic oligonucleotide
cgggaacagatccgcagagagttcacc

SEQ ID NO: 192924 - DNA, 27 bp, Artificial Sequence
  Description of Artificial Sequence: Synthetic oligonucleotide
gggaacagatccgcagagagttcaccc

SEQ ID NO: 192925 - DNA, 28 bp, Artificial Sequence
  Description of Artificial Sequence: Synthetic oligonucleotide
ggaacagatccgcagagagttcaccctg

SEQ ID NO: 192926 - DNA, 28 bp, Artificial Sequence
  Description of Artificial Sequence: Synthetic oligonucleotide
gaacagatccgcagagagttcaccctgc

SEQ ID NO: 192927 - DNA, 29 bp, Artificial Sequence
  Description of Artificial Sequence: Synthetic oligonucleotide
aacagatccgcagagagttcaccctgcac

SEQ ID NO: 192928 - DNA, 28 bp, Artificial Sequence
  Description of Artificial Sequence: Synthetic oligonucleotide
acagatccgcagagagttcaccctgcac

SEQ ID NO: 192929 - DNA, 27 bp, Artificial Sequence
  Description of Artificial Sequence: Synthetic oligonucleotide
cagatccgcagagagttcaccctgcac

SEQ ID NO: 192930 - DNA, 27 bp, Artificial Sequence
  Description of Artificial Sequence: Synthetic oligonucleotide
agatccgcagagagttcaccctgcacg

SEQ ID NO: 192931 - DNA, 27 bp, Artificial Sequence
  Description of Artificial Sequence: Synthetic oligonucleotide
gatccgcagagagttcaccctgcacga

SEQ ID NO: 192932 - DNA, 27 bp, Artificial Sequence
  Description of Artificial Sequence: Synthetic oligonucleotide
atccgcagagagttcaccctgcacgac

SEQ ID NO: 192933 - DNA, 26 bp, Artificial Sequence
  Description of Artificial Sequence: Synthetic oligonucleotide
tccgcagagagttcaccctgcacgac

SEQ ID NO: 192934 - DNA, 25 bp, Artificial Sequence
  Description of Artificial Sequence: Synthetic oligonucleotide
ccgcagagagttcaccctgcacgac

SEQ ID NO: 192935 - DNA, 26 bp, Artificial Sequence
  Description of Artificial Sequence: Synthetic oligonucleotide
cgcagagagttcaccctgcacgacca

SEQ ID NO: 192936 - DNA, 26 bp, Artificial Sequence
  Description of Artificial Sequence: Synthetic oligonucleotide
gcagagagttcaccctgcacgaccac

SEQ ID NO: 192937 - DNA, 27 bp, Artificial Sequence
  Description of Artificial Sequence: Synthetic oligonucleotide
cagagagttcaccctgcacgaccacct

SEQ ID NO: 192938 - DNA, 28 bp, Artificial Sequence
  Description of Artificial Sequence: Synthetic oligonucleotide
agagagttcaccctgcacgaccaccttc

SEQ ID NO: 192939 - DNA, 27 bp, Artificial Sequence
  Description of Artificial Sequence: Synthetic oligonucleotide
gagagttcaccctgcacgaccaccttc

SEQ ID NO: 192940 - DNA, 27 bp, Artificial Sequence
  Description of Artificial Sequence: Synthetic oligonucleotide
agagttcaccctgcacgaccaccttcg

SEQ ID NO: 192941 - DNA, 26 bp, Artificial Sequence
  Description of Artificial Sequence: Synthetic oligonucleotide
gagttcaccctgcacgaccaccttcg

SEQ ID NO: 192942 - DNA, 26 bp, Artificial Sequence
  Description of Artificial Sequence: Synthetic oligonucleotide
agttcaccctgcacgaccaccttcgg

SEQ ID NO: 192943 - DNA, 25 bp, Artificial Sequence
  Description of Artificial Sequence: Synthetic oligonucleotide
gttcaccctgcacgaccaccttcgg

SEQ ID NO: 192944 - DNA, 27 bp, Artificial Sequence
  Description of Artificial Sequence: Synthetic oligonucleotide
ttcaccctgcacgaccaccttcgggaa

SEQ ID NO: 192945 - DNA, 26 bp, Artificial Sequence
  Description of Artificial Sequence: Synthetic oligonucleotide
tcaccctgcacgaccaccttcgggaa

SEQ ID NO: 192946 - DNA, 25 bp, Artificial Sequence
  Description of Artificial Sequence: Synthetic oligonucleotide
caccctgcacgaccaccttcgggaa

SEQ ID NO: 192947 - DNA, 26 bp, Artificial Sequence
  Description of Artificial Sequence: Synthetic oligonucleotide
accctgcacgaccaccttcgggaaga

SEQ ID NO: 192948 - DNA, 25 bp, Artificial Sequence
  Description of Artificial Sequence: Synthetic oligonucleotide
ccctgcacgaccaccttcgggaaga

SEQ ID NO: 192949 - DNA, 25 bp, Artificial Sequence
  Description of Artificial Sequence: Synthetic oligonucleotide
cctgcacgaccaccttcgggaagag

SEQ ID NO: 192950 - DNA, 25 bp, Artificial Sequence
  Description of Artificial Sequence: Synthetic oligonucleotide
ctgcacgaccaccttcgggaagagg

SEQ ID NO: 192951 - DNA, 25 bp, Artificial Sequence
  Description of Artificial Sequence: Synthetic oligonucleotide
tgcacgaccaccttcgggaagaggc

SEQ ID NO: 192952 - DNA, 24 bp, Artificial Sequence
  Description of Artificial Sequence: Synthetic oligonucleotide
gcacgaccaccttcgggaagaggc

SEQ ID NO: 192953 - DNA, 24 bp, Artificial Sequence
  Description of Artificial Sequence: Synthetic oligonucleotide
cacgaccaccttcgggaagaggcg

SEQ ID NO: 192954 - DNA, 25 bp, Artificial Sequence
  Description of Artificial Sequence: Synthetic oligonucleotide
acgaccaccttcgggaagaggcgca

SEQ ID NO: 192955 - DNA, 24 bp, Artificial Sequence
  Description of Artificial Sequence: Synthetic oligonucleotide
cgaccaccttcgggaagaggcgca

SEQ ID NO: 192956 - DNA, 25 bp, Artificial Sequence
  Description of Artificial Sequence: Synthetic oligonucleotide
gaccaccttcgggaagaggcgcaga

SEQ ID NO: 192957 - DNA, 26 bp, Artificial Sequence
  Description of Artificial Sequence: Synthetic oligonucleotide
accaccttcgggaagaggcgcagagt

SEQ ID NO: 192958 - DNA, 25 bp, Artificial Sequence
  Description of Artificial Sequence: Synthetic oligonucleotide
ccaccttcgggaagaggcgcagagt

SEQ ID NO: 192959 - DNA, 26 bp, Artificial Sequence
  Description of Artificial Sequence: Synthetic oligonucleotide
caccttcgggaagaggcgcagagtgt

SEQ ID NO: 192960 - DNA, 26 bp, Artificial Sequence
  Description of Artificial Sequence: Synthetic oligonucleotide
accttcgggaagaggcgcagagtgtg

SEQ ID NO: 192961 - DNA, 25 bp, Artificial Sequence
  Description of Artificial Sequence: Synthetic oligonucleotide
ccttcgggaagaggcgcagagtgtg

SEQ ID NO: 192962 - DNA, 26 bp, Artificial Sequence
  Description of Artificial Sequence: Synthetic oligonucleotide
cttcgggaagaggcgcagagtgtgct

SEQ ID NO: 192963 - DNA, 26 bp, Artificial Sequence
  Description of Artificial Sequence: Synthetic oligonucleotide
ttcgggaagaggcgcagagtgtgctg

SEQ ID NO: 192964 - DNA, 25 bp, Artificial Sequence
  Description of Artificial Sequence: Synthetic oligonucleotide
tcgggaagaggcgcagagtgtgctg

SEQ ID NO: 192965 - DNA, 24 bp, Artificial Sequence
  Description of Artificial Sequence: Synthetic oligonucleotide
cgggaagaggcgcagagtgtgctg

SEQ ID NO: 192966 - DNA, 24 bp, Artificial Sequence
  Description of Artificial Sequence: Synthetic oligonucleotide
gggaagaggcgcagagtgtgctgg

SEQ ID NO: 192967 - DNA, 25 bp, Artificial Sequence
  Description of Artificial Sequence: Synthetic oligonucleotide
ggaagaggcgcagagtgtgctgggt

SEQ ID NO: 192968 - DNA, 26 bp, Artificial Sequence
  Description of Artificial Sequence: Synthetic oligonucleotide
gaagaggcgcagagtgtgctgggtca

SEQ ID NO: 192969 - DNA, 26 bp, Artificial Sequence
  Description of Artificial Sequence: Synthetic oligonucleotide
aagaggcgcagagtgtgctgggtcag

SEQ ID NO: 192970 - DNA, 25 bp, Artificial Sequence
  Description of Artificial Sequence: Synthetic oligonucleotide
agaggcgcagagtgtgctgggtcag

SEQ ID NO: 192971 - DNA, 24 bp, Artificial Sequence
  Description of Artificial Sequence: Synthetic oligonucleotide
gaggcgcagagtgtgctgggtcag

SEQ ID NO: 192972 - DNA, 25 bp, Artificial Sequence
  Description of Artificial Sequence: Synthetic oligonucleotide
aggcgcagagtgtgctgggtcagct

SEQ ID NO: 192973 - DNA, 24 bp, Artificial Sequence
  Description of Artificial Sequence: Synthetic oligonucleotide
ggcgcagagtgtgctgggtcagct

SEQ ID NO: 192974 - DNA, 24 bp, Artificial Sequence
  Description of Artificial Sequence: Synthetic oligonucleotide
gcgcagagtgtgctgggtcagctc

SEQ ID NO: 192975 - DNA, 24 bp, Artificial Sequence
  Description of Artificial Sequence: Synthetic oligonucleotide
cgcagagtgtgctgggtcagctcc

SEQ ID NO: 192976 - DNA, 24 bp, Artificial Sequence
  Description of Artificial Sequence: Synthetic oligonucleotide
gcagagtgtgctgggtcagctccg

SEQ ID NO: 192977 - DNA, 24 bp, Artificial Sequence
  Description of Artificial Sequence: Synthetic oligonucleotide
cagagtgtgctgggtcagctccgc

SEQ ID NO: 192978 - DNA, 25 bp, Artificial Sequence
  Description of Artificial Sequence: Synthetic oligonucleotide
agagtgtgctgggtcagctccgcct

SEQ ID NO: 192979 - DNA, 24 bp, Artificial Sequence
  Description of Artificial Sequence: Synthetic oligonucleotide
gagtgtgctgggtcagctccgcct

SEQ ID NO: 192980 - DNA, 24 bp, Artificial Sequence
  Description of Artificial Sequence: Synthetic oligonucleotide
agtgtgctgggtcagctccgcctg

SEQ ID NO: 192981 - DNA, 23 bp, Artificial Sequence
  Description of Artificial Sequence: Synthetic oligonucleotide
gtgtgctgggtcagctccgcctg

SEQ ID NO: 192982 - DNA, 23 bp, Artificial Sequence
  Description of Artificial Sequence: Synthetic oligonucleotide
tgtgctgggtcagctccgcctgg

SEQ ID NO: 192983 - DNA, 22 bp, Artificial Sequence
  Description of Artificial Sequence: Synthetic oligonucleotide
gtgctgggtcagctccgcctgg

SEQ ID NO: 192984 - DNA, 22 bp, Artificial Sequence
  Description of Artificial Sequence: Synthetic oligonucleotide
tgctgggtcagctccgcctggg

SEQ ID NO: 192985 - DNA, 21 bp, Artificial Sequence
  Description of Artificial Sequence: Synthetic oligonucleotide
gctgggtcagctccgcctggg

SEQ ID NO: 192986 - DNA, 21 bp, Artificial Sequence
  Description of Artificial Sequence: Synthetic oligonucleotide
ctgggtcagctccgcctgggc

SEQ ID NO: 192987 - DNA, 21 bp, Artificial Sequence
  Description of Artificial Sequence: Synthetic oligonucleotide
tgggtcagctccgcctgggcc

SEQ ID NO: 192988 - DNA, 20 bp, Artificial Sequence
  Description of Artificial Sequence: Synthetic oligonucleotide
gggtcagctccgcctgggcc

SEQ ID NO: 192989 - DNA, 20 bp, Artificial Sequence
  Description of Artificial Sequence: Synthetic oligonucleotide
ggtcagctccgcctgggccg

SEQ ID NO: 192990 - DNA, 21 bp, Artificial Sequence
  Description of Artificial Sequence: Synthetic oligonucleotide
gtcagctccgcctgggccgca

SEQ ID NO: 192991 - DNA, 22 bp, Artificial Sequence
  Description of Artificial Sequence: Synthetic oligonucleotide
tcagctccgcctgggccgcaca

SEQ ID NO: 192992 - DNA, 21 bp, Artificial Sequence
  Description of Artificial Sequence: Synthetic oligonucleotide
cagctccgcctgggccgcaca

SEQ ID NO: 192993 - DNA, 21 bp, Artificial Sequence
  Description of Artificial Sequence: Synthetic oligonucleotide
agctccgcctgggccgcacag

SEQ ID NO: 192994 - DNA, 20 bp, Artificial Sequence
  Description of Artificial Sequence: Synthetic oligonucleotide
gctccgcctgggccgcacag

SEQ ID NO: 192995 - DNA, 20 bp, Artificial Sequence
  Description of Artificial Sequence: Synthetic oligonucleotide
ctccgcctgggccgcacagg

SEQ ID NO: 192996 - DNA, 20 bp, Artificial Sequence
  Description of Artificial Sequence: Synthetic oligonucleotide
tccgcctgggccgcacaggg

SEQ ID NO: 192997 - DNA, 20 bp, Artificial Sequence
  Description of Artificial Sequence: Synthetic oligonucleotide
ccgcctgggccgcacagggt

SEQ ID NO: 192998 - DNA, 20 bp, Artificial Sequence
  Description of Artificial Sequence: Synthetic oligonucleotide
cgcctgggccgcacagggga

SEQ ID NO: 192999 - DNA, 20 bp, Artificial Sequence
  Description of Artificial Sequence: Synthetic oligonucleotide
gcctgggccgcacaggggac

SEQ ID NO: 193000 - DNA, 20 bp, Artificial Sequence
  Description of Artificial Sequence: Synthetic oligonucleotide
cctgggccgcacaggggacc

SEQ ID NO: 193001 - DNA, 20 bp, Artificial Sequence
  Description of Artificial Sequence: Synthetic oligonucleotide
ctgggccgcacaggggaccg

SEQ ID NO: 193002 - DNA, 20 bp, Artificial Sequence
  Description of Artificial Sequence: Synthetic oligonucleotide
tgggccgcacaggggaccgc

SEQ ID NO: 193003 - DNA, 20 bp, Artificial Sequence
  Description of Artificial Sequence: Synthetic oligonucleotide
gggccgcacaggggaccgct

SEQ ID NO: 193004 - DNA, 20 bp, Artificial Sequence
  Description of Artificial Sequence: Synthetic oligonucleotide
ggccgcacaggggaccgcct

SEQ ID NO: 193005 - DNA, 20 bp, Artificial Sequence
  Description of Artificial Sequence: Synthetic oligonucleotide
gccgcacaggggaccgccct

SEQ ID NO: 193006 - DNA, 20 bp, Artificial Sequence
  Description of Artificial Sequence: Synthetic oligonucleotide
ccgcacaggggaccgcccgt

SEQ ID NO: 193007 - DNA, 20 bp, Artificial Sequence
  Description of Artificial Sequence: Synthetic oligonucleotide
cgcacaggggaccgcccgct

SEQ ID NO: 193008 - DNA, 20 bp, Artificial Sequence
  Description of Artificial Sequence: Synthetic oligonucleotide
gcacaggggaccgcccgcgt

SEQ ID NO: 193009 - DNA, 20 bp, Artificial Sequence
  Description of Artificial Sequence: Synthetic oligonucleotide
cacaggggaccgcccgcgca

SEQ ID NO: 193010 - DNA, 20 bp, Artificial Sequence
  Description of Artificial Sequence: Synthetic oligonucleotide
acaggggaccgcccgcgcac

SEQ ID NO: 193011 - DNA, 20 bp, Artificial Sequence
  Description of Artificial Sequence: Synthetic oligonucleotide
caggggaccgcccgcgcact

SEQ ID NO: 193012 - DNA, 22 bp, Artificial Sequence
  Description of Artificial Sequence: Synthetic oligonucleotide
aggggaccgcccgcgcaccttt

SEQ ID NO: 193013 - DNA, 21 bp, Artificial Sequence
  Description of Artificial Sequence: Synthetic oligonucleotide
ggggaccgcccgcgcaccttt

SEQ ID NO: 193014 - DNA, 22 bp, Artificial Sequence
  Description of Artificial Sequence: Synthetic oligonucleotide
gggaccgcccgcgcacctttgt

SEQ ID NO: 193015 - DNA, 22 bp, Artificial Sequence
  Description of Artificial Sequence: Synthetic oligonucleotide
ggaccgcccgcgcacctttgtc

SEQ ID NO: 193016 - DNA, 22 bp, Artificial Sequence
  Description of Artificial Sequence: Synthetic oligonucleotide
gaccgcccgcgcacctttgtcg

SEQ ID NO: 193017 - DNA, 22 bp, Artificial Sequence
  Description of Artificial Sequence: Synthetic oligonucleotide
accgcccgcgcacctttgtcgg

SEQ ID NO: 193018 - DNA, 21 bp, Artificial Sequence
  Description of Artificial Sequence: Synthetic oligonucleotide
ccgcccgcgcacctttgtcgg

SEQ ID NO: 193019 - DNA, 21 bp, Artificial Sequence
  Description of Artificial Sequence: Synthetic oligonucleotide
cgcccgcgcacctttgtcggc

SEQ ID NO: 193020 - DNA, 22 bp, Artificial Sequence
  Description of Artificial Sequence: Synthetic oligonucleotide
gcccgcgcacctttgtcggcgt

SEQ ID NO: 193021 - DNA, 22 bp, Artificial Sequence
  Description of Artificial Sequence: Synthetic oligonucleotide
cccgcgcacctttgtcggcgtc

SEQ ID NO: 193022 - DNA, 23 bp, Artificial Sequence
  Description of Artificial Sequence: Synthetic oligonucleotide
ccgcgcacctttgtcggcgtcca

SEQ ID NO: 193023 - DNA, 23 bp, Artificial Sequence
  Description of Artificial Sequence: Synthetic oligonucleotide
cgcgcacctttgtcggcgtccac

SEQ ID NO: 193024 - DNA, 24 bp, Artificial Sequence
  Description of Artificial Sequence: Synthetic oligonucleotide
gcgcacctttgtcggcgtccacgt

SEQ ID NO: 193025 - DNA, 24 bp, Artificial Sequence
  Description of Artificial Sequence: Synthetic oligonucleotide
cgcacctttgtcggcgtccacgtg

SEQ ID NO: 193026 - DNA, 24 bp, Artificial Sequence
  Description of Artificial Sequence: Synthetic oligonucleotide
gcacctttgtcggcgtccacgtgc

SEQ ID NO: 193027 - DNA, 24 bp, Artificial Sequence
  Description of Artificial Sequence: Synthetic oligonucleotide
cacctttgtcggcgtccacgtgcg

SEQ ID NO: 193028 - DNA, 24 bp, Artificial Sequence
  Description of Artificial Sequence: Synthetic oligonucleotide
acctttgtcggcgtccacgtgcgc

SEQ ID NO: 193029 - DNA, 23 bp, Artificial Sequence
  Description of Artificial Sequence: Synthetic oligonucleotide
cctttgtcggcgtccacgtgcgc

SEQ ID NO: 193030 - DNA, 23 bp, Artificial Sequence
  Description of Artificial Sequence: Synthetic oligonucleotide
ctttgtcggcgtccacgtgcgcc

SEQ ID NO: 193031 - DNA, 24 bp, Artificial Sequence
  Description of Artificial Sequence: Synthetic oligonucleotide
tttgtcggcgtccacgtgcgccgt

SEQ ID NO: 193032 - DNA, 23 bp, Artificial Sequence
  Description of Artificial Sequence: Synthetic oligonucleotide
ttgtcggcgtccacgtgcgccgt

SEQ ID NO: 193033 - DNA, 22 bp, Artificial Sequence
  Description of Artificial Sequence: Synthetic oligonucleotide
tgtcggcgtccacgtgcgccgt
